United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 74

SEQ ID NO: 3370120 - RNA, 22 nt, Human
agaaaguacuucuccacccugc

SEQ ID NO: 3370121 - RNA, 15 nt, Human
agaaagugaauaaaa

SEQ ID NO: 3370122 - RNA, 16 nt, Human
agaaagugaauaaaaa

SEQ ID NO: 3370123 - RNA, 20 nt, Human
agaaagugaauaaaaauuaa

SEQ ID NO: 3370124 - RNA, 21 nt, Human
agaagggauggauuccaaccc

SEQ ID NO: 3370125 - RNA, 19 nt, Human
agaagggcauaaaacagcu

SEQ ID NO: 3370126 - RNA, 14 nt, Human
agaagggcuagaac

SEQ ID NO: 3370127 - RNA, 24 nt, Human
agaaggggcgggaauauuguuucu

SEQ ID NO: 3370128 - RNA, 13 nt, Human
agaaggggguggu

SEQ ID NO: 3370129 - RNA, 23 nt, Human
agaaggguccuucccucucccca

SEQ ID NO: 3370130 - RNA, 21 nt, Human
agaaggguuuuccacccugga

SEQ ID NO: 3370131 - RNA, 14 nt, Human
agaagguccuuaau

SEQ ID NO: 3370132 - RNA, 15 nt, Human
agaaggugccacuuu

SEQ ID NO: 3370133 - RNA, 21 nt, Human
agaaggugccucaagaauuuc

SEQ ID NO: 3370134 - RNA, 15 nt, Human
agaagguggaccuuu

SEQ ID NO: 3370135 - RNA, 18 nt, Human
agaagguggaccuuuuaa

SEQ ID NO: 3370136 - RNA, 22 nt, Human
agaaggugggaggaugugaauu

SEQ ID NO: 3370137 - RNA, 22 nt, Human
agaagguggguuuucaucaaga

SEQ ID NO: 3370138 - RNA, 18 nt, Human
agaagguuucagaaagaa

SEQ ID NO: 3370139 - RNA, 22 nt, Human
agaaguaaaagcaaaaaagaaa

SEQ ID NO: 3370140 - RNA, 13 nt, Human
agaaguagauuaa

SEQ ID NO: 3370141 - RNA, 17 nt, Human
agaaguaggcaugaggg

SEQ ID NO: 3370142 - RNA, 19 nt, Human
agaaguagggguggcccga

SEQ ID NO: 3370143 - RNA, 15 nt, Human
agaaguauaaagaau

SEQ ID NO: 3370144 - RNA, 20 nt, Human
agaaguauacguuuuucagu

SEQ ID NO: 3370145 - RNA, 21 nt, Human
agaaguauuuuuagaauaaga

SEQ ID NO: 3370146 - RNA, 14 nt, Human
agaagucaaaguaa

SEQ ID NO: 3370147 - RNA, 16 nt, Human
agaagucacagggcag

SEQ ID NO: 3370148 - RNA, 18 nt, Human
agaagucacauuccugaa

SEQ ID NO: 3370149 - RNA, 16 nt, Human
agaagucaucuugcua

SEQ ID NO: 3370150 - RNA, 19 nt, Human
agaaguccuguaugucugu

SEQ ID NO: 3370151 - RNA, 13 nt, Human
agaagucucagcu

SEQ ID NO: 3370152 - RNA, 15 nt, Human
agaagucuuagacuu

SEQ ID NO: 3370153 - RNA, 17 nt, Human
agaagucuuagauguau

SEQ ID NO: 3370154 - RNA, 19 nt, Human
agaagucuucaugaaaugc

SEQ ID NO: 3370155 - RNA, 19 nt, Human
agaagucuuucaagaauga

SEQ ID NO: 3370156 - RNA, 12 nt, Human
agaagugacagg

SEQ ID NO: 3370157 - RNA, 21 nt, Human
agaagugagaauaggcagccc

SEQ ID NO: 3370158 - RNA, 24 nt, Human
agaagugcauuucugaauagaaau

SEQ ID NO: 3370159 - RNA, 14 nt, Human
agaagugccccugc

SEQ ID NO: 3370160 - RNA, 19 nt, Human
agaagugccccugcugccu

SEQ ID NO: 3370161 - RNA, 17 nt, Human
agaagugcccuuccugc

SEQ ID NO: 3370162 - RNA, 19 nt, Human
agaaguggaccaggacagg

SEQ ID NO: 3370163 - RNA, 17 nt, Human
agaagugggccaggaca

SEQ ID NO: 3370164 - RNA, 19 nt, Human
agaagugggccaggacagg

SEQ ID NO: 3370165 - RNA, 15 nt, Human
agaagugucauguuu

SEQ ID NO: 3370166 - RNA, 19 nt, Human
agaaguguccgagaacuaa

SEQ ID NO: 3370167 - RNA, 19 nt, Human
agaaguuaagcaacaucua

SEQ ID NO: 3370168 - RNA, 18 nt, Human
agaaguuaguuuguauau

SEQ ID NO: 3370169 - RNA, 19 nt, Human
agaaguuaguuuguauaua

SEQ ID NO: 3370170 - RNA, 23 nt, Human
agaaguuauuuucuacagugguu

SEQ ID NO: 3370171 - RNA, 17 nt, Human
agaaguucauguccaaa

SEQ ID NO: 3370172 - RNA, 16 nt, Human
agaaguucuaguguuu

SEQ ID NO: 3370173 - RNA, 19 nt, Human
agaaguugauauagaacag

SEQ ID NO: 3370174 - RNA, 22 nt, Human
agaaguuggggacacauguauu

SEQ ID NO: 3370175 - RNA, 20 nt, Human
agaaguuguggauuucaguu

SEQ ID NO: 3370176 - RNA, 21 nt, Human
agaaguuguggauuucaguuu

SEQ ID NO: 3370177 - RNA, 16 nt, Human
agaaguuuaaggaaua

SEQ ID NO: 3370178 - RNA, 23 nt, Human
agaaguuucaucauuuuuuacuu

SEQ ID NO: 3370179 - RNA, 22 nt, Human
agaaguuucugccgcagcccug

SEQ ID NO: 3370180 - RNA, 13 nt, Human
agaaguuugcacu

SEQ ID NO: 3370181 - RNA, 21 nt, Human
agaaguuuggcugcugucaua

SEQ ID NO: 3370182 - RNA, 15 nt, Human
agaaguuugucaagu

SEQ ID NO: 3370183 - RNA, 13 nt, Human
agaaguuugucca

SEQ ID NO: 3370184 - RNA, 17 nt, Human
agaaguuuuaaauuuug

SEQ ID NO: 3370185 - RNA, 15 nt, Human
agaaguuuuuguacu

SEQ ID NO: 3370186 - RNA, 21 nt, Human
agaaguuuuuguacuguaaag

SEQ ID NO: 3370187 - RNA, 15 nt, Human
agaauaaaagguagu

SEQ ID NO: 3370188 - RNA, 14 nt, Human
agaauaaaauguug

SEQ ID NO: 3370189 - RNA, 14 nt, Human
agaauaaaauugua

SEQ ID NO: 3370190 - RNA, 17 nt, Human
agaauaaaauuuuuaau

SEQ ID NO: 3370191 - RNA, 13 nt, Human
agaauaaacauuu

SEQ ID NO: 3370192 - RNA, 11 nt, Human
agaauaaagca

SEQ ID NO: 3370193 - RNA, 15 nt, Human
agaauaaaggcagcu

SEQ ID NO: 3370194 - RNA, 20 nt, Human
agaauaaaggcaguuuucua

SEQ ID NO: 3370195 - RNA, 21 nt, Human
agaauguguuuaaacuugguu

SEQ ID NO: 3370196 - RNA, 22 nt, Human
agaauguguuucaaacuguaaa

SEQ ID NO: 3370197 - RNA, 17 nt, Human
agaauguguuuucugaa

SEQ ID NO: 3370198 - RNA, 21 nt, Human
agaauguuaagacuugacagu

SEQ ID NO: 3370199 - RNA, 18 nt, Human
agaauguuagagcacagu

SEQ ID NO: 3370200 - RNA, 16 nt, Human
agaauguuagaguaau

SEQ ID NO: 3370201 - RNA, 19 nt, Human
agaauguuauagugaauua

SEQ ID NO: 3370202 - RNA, 22 nt, Human
agaauguuauagugaauuaucc

SEQ ID NO: 3370203 - RNA, 23 nt, Human
agaauguugaaacugacuugcug

SEQ ID NO: 3370204 - RNA, 17 nt, Human
agaauguugguuuacuu

SEQ ID NO: 3370205 - RNA, 19 nt, Human
agaauguugguuuacuuuc

SEQ ID NO: 3370206 - RNA, 23 nt, Human
agaauguugguuuacuuucaaau

SEQ ID NO: 3370207 - RNA, 19 nt, Human
agaauguuguauucaguga

SEQ ID NO: 3370208 - RNA, 18 nt, Human
agaauguuuuacugugaa

SEQ ID NO: 3370209 - RNA, 15 nt, Human
agaauguuuucaaau

SEQ ID NO: 3370210 - RNA, 16 nt, Human
agaauguuuuccuucu

SEQ ID NO: 3370211 - RNA, 17 nt, Human
agaauuaaaaaugaaau

SEQ ID NO: 3370212 - RNA, 14 nt, Human
agaauuaaacuuuu

SEQ ID NO: 3370213 - RNA, 15 nt, Human
agaauuaacacauga

SEQ ID NO: 3370214 - RNA, 18 nt, Human
agaauuaccauuuguuaa

SEQ ID NO: 3370215 - RNA, 22 nt, Human
agaauuaccauuuguuaauauc

SEQ ID NO: 3370216 - RNA, 13 nt, Human
agaauuacuguaa

SEQ ID NO: 3370217 - RNA, 11 nt, Human
agaauuagcuu

SEQ ID NO: 3370218 - RNA, 17 nt, Human
agaauuagugccagaau

SEQ ID NO: 3370219 - RNA, 20 nt, Human
agaauuauaauuaguuccuc

SEQ ID NO: 3370220 - RNA, 20 nt, Human
agaauuaucuaauuuauaaa

SEQ ID NO: 3370221 - RNA, 13 nt, Human
agaauuauuuugu

SEQ ID NO: 3370222 - RNA, 14 nt, Human
agaauuauuuuuca

SEQ ID NO: 3370223 - RNA, 12 nt, Human
agaauuccuuca

SEQ ID NO: 3370224 - RNA, 18 nt, Human
agaauuccuucaggguga

SEQ ID NO: 3370225 - RNA, 20 nt, Human
agaauuccuucagggugaug

SEQ ID NO: 3370226 - RNA, 14 nt, Human
agaauucuagugcu

SEQ ID NO: 3370227 - RNA, 19 nt, Human
agaauucuccaaaacaauu

SEQ ID NO: 3370228 - RNA, 17 nt, Human
agaauucucuuauccaa

SEQ ID NO: 3370229 - RNA, 12 nt, Human
agaauucuguau

SEQ ID NO: 3370230 - RNA, 14 nt, Human
agaauucuguauag

SEQ ID NO: 3370231 - RNA, 16 nt, Human
agaauucuuacauguu

SEQ ID NO: 3370232 - RNA, 16 nt, Human
agaauugaaaaguuuu

SEQ ID NO: 3370233 - RNA, 17 nt, Human
agaauugaaaaguuuuu

SEQ ID NO: 3370234 - RNA, 17 nt, Human
agaauugaacccaggag

SEQ ID NO: 3370235 - RNA, 19 nt, Human
agaauugaacccaggaggu

SEQ ID NO: 3370236 - RNA, 12 nt, Human
agaauugaaggu

SEQ ID NO: 3370237 - RNA, 18 nt, Human
agaauugacauugaaauc

SEQ ID NO: 3370238 - RNA, 19 nt, Human
agaauugacauugaaaucu

SEQ ID NO: 3370239 - RNA, 17 nt, Human
agaauugaguaauggug

SEQ ID NO: 3370240 - RNA, 14 nt, Human
agaauugaguguuu

SEQ ID NO: 3370241 - RNA, 24 nt, Human
agaauugauugggcacaucauuuc

SEQ ID NO: 3370242 - RNA, 21 nt, Human
agaauugauuucccuucuucu

SEQ ID NO: 3370243 - RNA, 17 nt, Human
agaauugcaaucuauaa

SEQ ID NO: 3370244 - RNA, 20 nt, Human
agaauugcaaucuauaauau

SEQ ID NO: 3370245 - RNA, 20 nt, Human
agaauugcaauuuuaacaca

SEQ ID NO: 3370246 - RNA, 23 nt, Human
agaauugcugaagggcauucuuu

SEQ ID NO: 3370247 - RNA, 16 nt, Human
agaauuggcucaauaa

SEQ ID NO: 3370248 - RNA, 18 nt, Human
agaauuggcugaacucau

SEQ ID NO: 3370249 - RNA, 13 nt, Human
agaauugggcggc

SEQ ID NO: 3370250 - RNA, 20 nt, Human
agaauugucuuucugucucu

SEQ ID NO: 3370251 - RNA, 12 nt, Human
agaauugugguu

SEQ ID NO: 3370252 - RNA, 23 nt, Human
agaauugugguuuauauauuuaa

SEQ ID NO: 3370253 - RNA, 19 nt, Human
agaauugugucagacuguu

SEQ ID NO: 3370254 - RNA, 20 nt, Human
agaauugugucagacuguuu

SEQ ID NO: 3370255 - RNA, 23 nt, Human
agaauugugucagacuguuuagu

SEQ ID NO: 3370256 - RNA, 16 nt, Human
agaauugugucugcag

SEQ ID NO: 3370257 - RNA, 17 nt, Human
agaauugugucugcagg

SEQ ID NO: 3370258 - RNA, 23 nt, Human
agaauuguuggggguuuuuuugg

SEQ ID NO: 3370259 - RNA, 14 nt, Human
agaauuguuuagau

SEQ ID NO: 3370260 - RNA, 21 nt, Human
agaauuuaaagaaaaaaaugu

SEQ ID NO: 3370261 - RNA, 22 nt, Human
agaauuuagggagaaauguugu

SEQ ID NO: 3370262 - RNA, 21 nt, Human
agaauuuauucaauuccucug

SEQ ID NO: 3370263 - RNA, 20 nt, Human
agaauuucaauuuguucagu

SEQ ID NO: 3370264 - RNA, 20 nt, Human
agaauuucuaccauuucaga

SEQ ID NO: 3370265 - RNA, 19 nt, Human
agaauuugaagacuucaaa

SEQ ID NO: 3370266 - RNA, 21 nt, Human
agaauuugaagacuucaaaau

SEQ ID NO: 3370267 - RNA, 14 nt, Human
agaauuugaauuau

SEQ ID NO: 3370268 - RNA, 17 nt, Human
agaauuugagugcucug

SEQ ID NO: 3370269 - RNA, 19 nt, Human
agaauuugauaugugaaca

SEQ ID NO: 3370270 - RNA, 12 nt, Human
agaauuugcaua

SEQ ID NO: 3370271 - RNA, 16 nt, Human
agaauuugucacagga

SEQ ID NO: 3370272 - RNA, 21 nt, Human
agaauuuguguugaaggaacu

SEQ ID NO: 3370273 - RNA, 19 nt, Human
agaauuuuaaaaaugaauc

SEQ ID NO: 3370274 - RNA, 21 nt, Human
agaauuuuaaaaaugaauccu

SEQ ID NO: 3370275 - RNA, 13 nt, Human
agaauuuuaaauu

SEQ ID NO: 3370276 - RNA, 14 nt, Human
agaauuuuaagccu

SEQ ID NO: 3370277 - RNA, 22 nt, Human
agaauuuuaagccuuuguugaa

SEQ ID NO: 3370278 - RNA, 21 nt, Human
agaauuuuaagugcuuuguaa

SEQ ID NO: 3370279 - RNA, 14 nt, Human
agaauuuuaggaac

SEQ ID NO: 3370280 - RNA, 20 nt, Human
agaauuuuaggaacuucaga

SEQ ID NO: 3370281 - RNA, 20 nt, Human
agaauuuuauacuuucccua

SEQ ID NO: 3370282 - RNA, 15 nt, Human
agaauuuugagcagg

SEQ ID NO: 3370283 - RNA, 21 nt, Human
agaacagggucauguuugcag

SEQ ID NO: 3370284 - RNA, 18 nt, Human
agaacagguuuuuuuguu

SEQ ID NO: 3370285 - RNA, 14 nt, Human
agaacagugauuuu

SEQ ID NO: 3370286 - RNA, 18 nt, Human
agaacaguggaaacuaug

SEQ ID NO: 3370287 - RNA, 21 nt, Human
agaacaguuaagcagccgcca

SEQ ID NO: 3370288 - RNA, 17 nt, Human
agaacaguuuguacaga

SEQ ID NO: 3370289 - RNA, 17 nt, Human
agaacauaaagcaaaua

SEQ ID NO: 3370290 - RNA, 16 nt, Human
agaacaucauuagaac

SEQ ID NO: 3370291 - RNA, 20 nt, Human
agaacaucuguauacccucu

SEQ ID NO: 3370292 - RNA, 14 nt, Human
agaacaugaaucaa

SEQ ID NO: 3370293 - RNA, 17 nt, Human
agaacaugaaucaaaag

SEQ ID NO: 3370294 - RNA, 13 nt, Human
agaacaugcaguu

SEQ ID NO: 3370295 - RNA, 16 nt, Human
agaacauggacuugua

SEQ ID NO: 3370296 - RNA, 19 nt, Human
agaacauguagaaaacaaa

SEQ ID NO: 3370297 - RNA, 18 nt, Human
agaacauugauugcugug

SEQ ID NO: 3370298 - RNA, 17 nt, Human
agaaccaaaaagaggcu

SEQ ID NO: 3370299 - RNA, 18 nt, Human
agaaccaaaaguuuuccu

SEQ ID NO: 3370300 - RNA, 22 nt, Human
agaaccacagggcuauuuuguu

SEQ ID NO: 3370301 - RNA, 17 nt, Human
agaaccaggcaacuugg

SEQ ID NO: 3370302 - RNA, 19 nt, Human
agaaccaguccccccaccc

SEQ ID NO: 3370303 - RNA, 17 nt, Human
agaacccagcccacccc

SEQ ID NO: 3370304 - RNA, 18 nt, Human
agaacccagcccaccccc

SEQ ID NO: 3370305 - RNA, 23 nt, Human
agaaccccaggguccuguagccc

SEQ ID NO: 3370306 - RNA, 17 nt, Human
agaaccccuacaugaaa

SEQ ID NO: 3370307 - RNA, 19 nt, Human
agaaccccuacaugaaaca

SEQ ID NO: 3370308 - RNA, 20 nt, Human
agaacccuggugaggaagcu

SEQ ID NO: 3370309 - RNA, 22 nt, Human
agaacccuggugaggaagcucc

SEQ ID NO: 3370310 - RNA, 15 nt, Human
agaaccgagcaaaga

SEQ ID NO: 3370311 - RNA, 18 nt, Human
agaaccggagagccagcu

SEQ ID NO: 3370312 - RNA, 15 nt, Human
agaaccuaauucaau

SEQ ID NO: 3370313 - RNA, 18 nt, Human
agaaccucacgcaccucc

SEQ ID NO: 3370314 - RNA, 21 nt, Human
agaaccucacgcaccucccau

SEQ ID NO: 3370315 - RNA, 22 nt, Human
agaaccucacgcaccucccauc

SEQ ID NO: 3370316 - RNA, 12 nt, Human
agaaccucaggc

SEQ ID NO: 3370317 - RNA, 21 nt, Human
agaaccucaggcuuccuuggc

SEQ ID NO: 3370318 - RNA, 15 nt, Human
agaaccucuucccca

SEQ ID NO: 3370319 - RNA, 21 nt, Human
agaaccuggaaaaauuccaga

SEQ ID NO: 3370320 - RNA, 20 nt, Human
agaaccuggaacuuggggag

SEQ ID NO: 3370321 - RNA, 17 nt, Human
agaaccuggagagcuag

SEQ ID NO: 3370322 - RNA, 23 nt, Human
agaaccuggagggcuagaacugg

SEQ ID NO: 3370323 - RNA, 18 nt, Human
agaaccuggaguuccuga

SEQ ID NO: 3370324 - RNA, 12 nt, Human
agaaccuguccu

SEQ ID NO: 3370325 - RNA, 18 nt, Human
agaaccuucucuaugggg

SEQ ID NO: 3370326 - RNA, 14 nt, Human
agaaccuugccuga

SEQ ID NO: 3370327 - RNA, 22 nt, Human
agaaccuugccugaacauccuu

SEQ ID NO: 3370328 - RNA, 22 nt, Human
agaaccuugugccuggcucaga

SEQ ID NO: 3370329 - RNA, 19 nt, Human
agaaccuuuugagugccuu

SEQ ID NO: 3370330 - RNA, 18 nt, Human
agaacgaggauuuuaauu

SEQ ID NO: 3370331 - RNA, 13 nt, Human
agaacgcagcccu

SEQ ID NO: 3370332 - RNA, 23 nt, Human
agaacgcagcccuagagccugcc

SEQ ID NO: 3370333 - RNA, 16 nt, Human
agaacgcugauuuaaa

SEQ ID NO: 3370334 - RNA, 21 nt, Human
agaacggggcucuucucauuu

SEQ ID NO: 3370335 - RNA, 23 nt, Human
agaacguauuuuaaaagccacau

SEQ ID NO: 3370336 - RNA, 16 nt, Human
agaacuaaacucauuu

SEQ ID NO: 3370337 - RNA, 22 nt, Human
agaacuaacacuauuuuaugca

SEQ ID NO: 3370338 - RNA, 16 nt, Human
agacuggauaguccgu

SEQ ID NO: 3370339 - RNA, 11 nt, Human
accuuuucagg

SEQ ID NO: 3370340 - RNA, 11 nt, Human
accuuuucucu

SEQ ID NO: 3370341 - RNA, 12 nt, Human
accuuuucuugc

SEQ ID NO: 3370342 - RNA, 14 nt, Human
accuuuucuugccu

SEQ ID NO: 3370343 - RNA, 17 nt, Human
accuuuucuuguaucug

SEQ ID NO: 3370344 - RNA, 19 nt, Human
accuuuugaaguaguuugu

SEQ ID NO: 3370345 - RNA, 14 nt, Human
accuuuugagugcc

SEQ ID NO: 3370346 - RNA, 20 nt, Human
accuuuugagugccuuacac

SEQ ID NO: 3370347 - RNA, 16 nt, Human
accuuuugggaauguu

SEQ ID NO: 3370348 - RNA, 20 nt, Human
accuuuuggucuggagggaa

SEQ ID NO: 3370349 - RNA, 14 nt, Human
accuuuuguuuucu

SEQ ID NO: 3370350 - RNA, 14 nt, Human
accuuuuuaucucc

SEQ ID NO: 3370351 - RNA, 19 nt, Human
accuuuuuauuugcaugug

SEQ ID NO: 3370352 - RNA, 18 nt, Human
accuuuuuucaacaguga

SEQ ID NO: 3370353 - RNA, 23 nt, Human
accuuuuuucaacagugaagaca

SEQ ID NO: 3370354 - RNA, 18 nt, Human
acgaaacuuguuauugug

SEQ ID NO: 3370355 - RNA, 19 nt, Human
acgaaacuuguuauuguga

SEQ ID NO: 3370356 - RNA, 14 nt, Human
acgaaagaaaugua

SEQ ID NO: 3370357 - RNA, 13 nt, Human
acgaaagaaggca

SEQ ID NO: 3370358 - RNA, 17 nt, Human
acgaaauaucaaaguca

SEQ ID NO: 3370359 - RNA, 12 nt, Human
acgaaauguuau

SEQ ID NO: 3370360 - RNA, 18 nt, Human
acgaaccuuggccugggc

SEQ ID NO: 3370361 - RNA, 14 nt, Human
acgaacuuccaugg

SEQ ID NO: 3370362 - RNA, 17 nt, Human
acgaagccaucuuucuu

SEQ ID NO: 3370363 - RNA, 17 nt, Human
acgaagggaaaugucuu

SEQ ID NO: 3370364 - RNA, 18 nt, Human
acgaauauggacauauca

SEQ ID NO: 3370365 - RNA, 18 nt, Human
acgaauauugcugauggu

SEQ ID NO: 3370366 - RNA, 22 nt, Human
acgaauuucugugcccuccuga

SEQ ID NO: 3370367 - RNA, 14 nt, Human
acgacacugcagcc

SEQ ID NO: 3370368 - RNA, 13 nt, Human
acgacgcccucuc

SEQ ID NO: 3370369 - RNA, 16 nt, Human
acgacgcccucucccc

SEQ ID NO: 3370370 - RNA, 23 nt, Human
acgacucuuuuccaaacacaggc

SEQ ID NO: 3370371 - RNA, 14 nt, Human
acgacuucagggca

SEQ ID NO: 3370372 - RNA, 15 nt, Human
acgagaaagaucauu

SEQ ID NO: 3370373 - RNA, 19 nt, Human
acgagacccuacaggagag

SEQ ID NO: 3370374 - RNA, 19 nt, Human
acgagcaccuccagccuga

SEQ ID NO: 3370375 - RNA, 20 nt, Human
acgaggaaucugugggucug

SEQ ID NO: 3370376 - RNA, 20 nt, Human
acgaggcccucgggcccagc

SEQ ID NO: 3370377 - RNA, 21 nt, Human
acgaggcccucgggcccagcc

SEQ ID NO: 3370378 - RNA, 23 nt, Human
acgaggcccucgggcccagcccc

SEQ ID NO: 3370379 - RNA, 11 nt, Human
acgagggcugg

SEQ ID NO: 3370380 - RNA, 20 nt, Human
acgaggggugucuugggcag

SEQ ID NO: 3370381 - RNA, 21 nt, Human
acgaggggugucuugggcaga

SEQ ID NO: 3370382 - RNA, 18 nt, Human
acgaucacaaaugacuuu

SEQ ID NO: 3370383 - RNA, 15 nt, Human
acgauccuucaaagu

SEQ ID NO: 3370384 - RNA, 16 nt, Human
acgauccuucaaaguc

SEQ ID NO: 3370385 - RNA, 14 nt, Human
acgaugacaguguu

SEQ ID NO: 3370386 - RNA, 13 nt, Human
acgaugucuucau

SEQ ID NO: 3370387 - RNA, 21 nt, Human
acgauguggaaaaaugagaga

SEQ ID NO: 3370388 - RNA, 14 nt, Human
acgauguggcccug

SEQ ID NO: 3370389 - RNA, 17 nt, Human
acgauguggcccuggcc

SEQ ID NO: 3370390 - RNA, 22 nt, Human
acgauguggcccuggccugcug

SEQ ID NO: 3370391 - RNA, 23 nt, Human
acgaugugucuguauuucaugug

SEQ ID NO: 3370392 - RNA, 12 nt, Human
acgauuuaaggu

SEQ ID NO: 3370393 - RNA, 17 nt, Human
acgauuuaauucucuug

SEQ ID NO: 3370394 - RNA, 13 nt, Human
acgauuuaauuua

SEQ ID NO: 3370395 - RNA, 12 nt, Human
acgauuucuguu

SEQ ID NO: 3370396 - RNA, 19 nt, Human
acgauuucuguuuagauaa

SEQ ID NO: 3370397 - RNA, 18 nt, Human
acgauuuucuccagcuca

SEQ ID NO: 3370398 - RNA, 18 nt, Human
acgcaaacuuugagccuu

SEQ ID NO: 3370399 - RNA, 15 nt, Human
acgcaaguucccagu

SEQ ID NO: 3370400 - RNA, 13 nt, Human
acgcacacacaca

SEQ ID NO: 3370401 - RNA, 18 nt, Human
acgcacacacacacacag

SEQ ID NO: 3370402 - RNA, 21 nt, Human
acgcacacacacacacaggag

SEQ ID NO: 3370403 - RNA, 22 nt, Human
acgcacacguacuuaaaugaaa

SEQ ID NO: 3370404 - RNA, 13 nt, Human
acgcacagacagg

SEQ ID NO: 3370405 - RNA, 21 nt, Human
acgcacagacagguuuucaca

SEQ ID NO: 3370406 - RNA, 15 nt, Human
acgcaccucccaucc

SEQ ID NO: 3370407 - RNA, 16 nt, Human
acgcaccugccucagg

SEQ ID NO: 3370408 - RNA, 17 nt, Human
acgcaccugccucagga

SEQ ID NO: 3370409 - RNA, 15 nt, Human
acgcacgcacacaca

SEQ ID NO: 3370410 - RNA, 17 nt, Human
acgcacggcagccacag

SEQ ID NO: 3370411 - RNA, 21 nt, Human
acgcacuccaugagcacccca

SEQ ID NO: 3370412 - RNA, 15 nt, Human
acgcagaugauccau

SEQ ID NO: 3370413 - RNA, 21 nt, Human
acgcagcaggaggccaggccg

SEQ ID NO: 3370414 - RNA, 14 nt, Human
acgcagccaggaca

SEQ ID NO: 3370415 - RNA, 18 nt, Human
acgcagcccuagagccug

SEQ ID NO: 3370416 - RNA, 22 nt, Human
acgcagcccugcuuugggcugc

SEQ ID NO: 3370417 - RNA, 17 nt, Human
acgcaggaacucccagc

SEQ ID NO: 3370418 - RNA, 14 nt, Human
acgcauccagcaag

SEQ ID NO: 3370419 - RNA, 21 nt, Human
acgcaugcaguguuggggaug

SEQ ID NO: 3370420 - RNA, 22 nt, Human
acgcauggaguguguauuguuc

SEQ ID NO: 3370421 - RNA, 15 nt, Human
acgccacauccccca

SEQ ID NO: 3370422 - RNA, 12 nt, Human
acgccacccagc

SEQ ID NO: 3370423 - RNA, 12 nt, Human
acgccacucauu

SEQ ID NO: 3370424 - RNA, 22 nt, Human
acgccacugcacuccagccugg

SEQ ID NO: 3370425 - RNA, 23 nt, Human
acgccacugcacuccagccuggg

SEQ ID NO: 3370426 - RNA, 22 nt, Human
acgccagacuucccacggcucc

SEQ ID NO: 3370427 - RNA, 17 nt, Human
acgccagauucuuuccu

SEQ ID NO: 3370428 - RNA, 19 nt, Human
acgccagauucuuuccuga

SEQ ID NO: 3370429 - RNA, 19 nt, Human
acgccaugugauggacacu

SEQ ID NO: 3370430 - RNA, 16 nt, Human
acgcccaacccuuccc

SEQ ID NO: 3370431 - RNA, 13 nt, Human
acgcccacuuccc

SEQ ID NO: 3370432 - RNA, 15 nt, Human
acgcccaggacccca

SEQ ID NO: 3370433 - RNA, 14 nt, Human
acgcccauguguga

SEQ ID NO: 3370434 - RNA, 16 nt, Human
acgcccccccccaccc

SEQ ID NO: 3370435 - RNA, 19 nt, Human
acgcccguccugccugugg

SEQ ID NO: 3370436 - RNA, 12 nt, Human
acgcccuccccu

SEQ ID NO: 3370437 - RNA, 15 nt, Human
acgcccuccccuccc

SEQ ID NO: 3370438 - RNA, 21 nt, Human
acgcccucuaucauggugaaa

SEQ ID NO: 3370439 - RNA, 21 nt, Human
acgcccucuccccaccccuac

SEQ ID NO: 3370440 - RNA, 21 nt, Human
acgccggggacagaggccugc

SEQ ID NO: 3370441 - RNA, 22 nt, Human
acgccucacugaaacauggcug

SEQ ID NO: 3370442 - RNA, 18 nt, Human
acgccucuucugucccug

SEQ ID NO: 3370443 - RNA, 23 nt, Human
acgccucuucugucccuguuaga

SEQ ID NO: 3370444 - RNA, 24 nt, Human
acgccucuugaccaggcugccucc

SEQ ID NO: 3370445 - RNA, 12 nt, Human
acgccugagccc

SEQ ID NO: 3370446 - RNA, 20 nt, Human
acgccugagcccagggaggc

SEQ ID NO: 3370447 - RNA, 20 nt, Human
acgccugcaaacgcugccug

SEQ ID NO: 3370448 - RNA, 21 nt, Human
acgccugcaaacgcugccugc

SEQ ID NO: 3370449 - RNA, 12 nt, Human
acgccugccucc

SEQ ID NO: 3370450 - RNA, 12 nt, Human
acgccugccuuu

SEQ ID NO: 3370451 - RNA, 17 nt, Human
acgccuggcugcugauc

SEQ ID NO: 3370452 - RNA, 18 nt, Human
acgccugggggugccagg

SEQ ID NO: 3370453 - RNA, 19 nt, Human
acgccuguaaucccagcac

SEQ ID NO: 3370454 - RNA, 21 nt, Human
acgccuguaaucccagcacuu

SEQ ID NO: 3370455 - RNA, 13 nt, Human
acgcgcagaugug

SEQ ID NO: 3370456 - RNA, 20 nt, Human
acgcgcagaugugcagcaga

SEQ ID NO: 3370457 - RNA, 15 nt, Human
acgcgccccccuccc

SEQ ID NO: 3370458 - RNA, 16 nt, Human
acgcgcgucgccgcca

SEQ ID NO: 3370459 - RNA, 12 nt, Human
acgcggccgaga

SEQ ID NO: 3370460 - RNA, 24 nt, Human
acgcggcucccggggcagggcagc

SEQ ID NO: 3370461 - RNA, 12 nt, Human
acgcgucuccug

SEQ ID NO: 3370462 - RNA, 18 nt, Human
acgcguugaaauuguaau

SEQ ID NO: 3370463 - RNA, 17 nt, Human
acgcuaaagagcccuug

SEQ ID NO: 3370464 - RNA, 20 nt, Human
acgcuaaagagcccuugccu

SEQ ID NO: 3370465 - RNA, 17 nt, Human
acgcuacccgggaaggg

SEQ ID NO: 3370466 - RNA, 15 nt, Human
acgcuaccucucugu

SEQ ID NO: 3370467 - RNA, 19 nt, Human
acgcuacuauaaagagaag

SEQ ID NO: 3370468 - RNA, 13 nt, Human
acgcucagugggg

SEQ ID NO: 3370469 - RNA, 22 nt, Human
acgcuccccgccuguucccccg

SEQ ID NO: 3370470 - RNA, 13 nt, Human
acgcuccgcugcc

SEQ ID NO: 3370471 - RNA, 23 nt, Human
acgcuccucccucugaggcugua

SEQ ID NO: 3370472 - RNA, 22 nt, Human
acgcucuaaggcaggauguggc

SEQ ID NO: 3370473 - RNA, 22 nt, Human
acgcucuccuuucuuucuaacu

SEQ ID NO: 3370474 - RNA, 15 nt, Human
acgcucucuacucug

SEQ ID NO: 3370475 - RNA, 15 nt, Human
acgcugaccguggag

SEQ ID NO: 3370476 - RNA, 16 nt, Human
acgcugacuacagggc

SEQ ID NO: 3370477 - RNA, 18 nt, Human
acgcugacuacagggccg

SEQ ID NO: 3370478 - RNA, 17 nt, Human
acgcugagccaccugcc

SEQ ID NO: 3370479 - RNA, 13 nt, Human
acgcugccugccc

SEQ ID NO: 3370480 - RNA, 13 nt, Human
acgcugcucugcc

SEQ ID NO: 3370481 - RNA, 20 nt, Human
acgcuggaccuugaacuggg

SEQ ID NO: 3370482 - RNA, 18 nt, Human
acgcuggcuccccaaagg

SEQ ID NO: 3370483 - RNA, 15 nt, Human
acgugggcggcagag

SEQ ID NO: 3370484 - RNA, 17 nt, Human
acgugggcuccccucuu

SEQ ID NO: 3370485 - RNA, 15 nt, Human
acguggggcagcaca

SEQ ID NO: 3370486 - RNA, 18 nt, Human
acgugguuggggcccugc

SEQ ID NO: 3370487 - RNA, 18 nt, Human
acguguacuacaauuuaa

SEQ ID NO: 3370488 - RNA, 13 nt, Human
acgugucuuccac

SEQ ID NO: 3370489 - RNA, 16 nt, Human
acgugugcaugugucu

SEQ ID NO: 3370490 - RNA, 16 nt, Human
acguguggaccccugc

SEQ ID NO: 3370491 - RNA, 11 nt, Human
acgugugugac

SEQ ID NO: 3370492 - RNA, 16 nt, Human
acgugugugacucaga

SEQ ID NO: 3370493 - RNA, 23 nt, Human
acgugugugacucagaugucucu

SEQ ID NO: 3370494 - RNA, 16 nt, Human
acguguguuuuucuau

SEQ ID NO: 3370495 - RNA, 18 nt, Human
acguguguuuuucuauua

SEQ ID NO: 3370496 - RNA, 22 nt, Human
acguguguuuuucuauuaaaag

SEQ ID NO: 3370497 - RNA, 16 nt, Human
acguguuugugcugug

SEQ ID NO: 3370498 - RNA, 15 nt, Human
acguuaccaggcagg

SEQ ID NO: 3370499 - RNA, 23 nt, Human
acguuacucagggcuccucccag

SEQ ID NO: 3370500 - RNA, 16 nt, Human
acguuagucgugagcu

SEQ ID NO: 3370501 - RNA, 22 nt, Human
acguuagucgugagcucuugug

SEQ ID NO: 3370502 - RNA, 13 nt, Human
acguucaccccuc

SEQ ID NO: 3370503 - RNA, 16 nt, Human
agagaauguuccagac

SEQ ID NO: 3370504 - RNA, 23 nt, Human
agagaauuucuaccauuucagag

SEQ ID NO: 3370505 - RNA, 12 nt, Human
agagacaaagcu

SEQ ID NO: 3370506 - RNA, 17 nt, Human
agagacacacugaagaa

SEQ ID NO: 3370507 - RNA, 16 nt, Human
agagacaccugcaccu

SEQ ID NO: 3370508 - RNA, 13 nt, Human
agagacagaagca

SEQ ID NO: 3370509 - RNA, 17 nt, Human
agagacagaagcaggcu

SEQ ID NO: 3370510 - RNA, 23 nt, Human
agagacagaagcaggcuggaggu

SEQ ID NO: 3370511 - RNA, 15 nt, Human
agagacagcccagga

SEQ ID NO: 3370512 - RNA, 18 nt, Human
agagacagcccaggauac

SEQ ID NO: 3370513 - RNA, 13 nt, Human
agagacaggaaaa

SEQ ID NO: 3370514 - RNA, 13 nt, Human
agagacaggcagg

SEQ ID NO: 3370515 - RNA, 15 nt, Human
agagacaggcccaag

SEQ ID NO: 3370516 - RNA, 18 nt, Human
agagacaggcccaagaga

SEQ ID NO: 3370517 - RNA, 20 nt, Human
agagacaggcccaagagaug

SEQ ID NO: 3370518 - RNA, 22 nt, Human
agagacaguugggugagaacaa

SEQ ID NO: 3370519 - RNA, 23 nt, Human
agagacaguugggugagaacaac

SEQ ID NO: 3370520 - RNA, 22 nt, Human
agagacauacuugaagggccag

SEQ ID NO: 3370521 - RNA, 15 nt, Human
agagacaucagcccu

SEQ ID NO: 3370522 - RNA, 18 nt, Human
agagacauuaacucauua

SEQ ID NO: 3370523 - RNA, 22 nt, Human
agagacauuaacucauuagacu

SEQ ID NO: 3370524 - RNA, 13 nt, Human
agagaccagggcu

SEQ ID NO: 3370525 - RNA, 14 nt, Human
agagaccaucccug

SEQ ID NO: 3370526 - RNA, 18 nt, Human
agagaccaucccugaagg

SEQ ID NO: 3370527 - RNA, 12 nt, Human
agagacccaagg

SEQ ID NO: 3370528 - RNA, 16 nt, Human
agagacccaaggagga

SEQ ID NO: 3370529 - RNA, 21 nt, Human
agagacccccggaacaagccu

SEQ ID NO: 3370530 - RNA, 19 nt, Human
agagacccuucaaacuugg

SEQ ID NO: 3370531 - RNA, 17 nt, Human
agagacccuuguuugau

SEQ ID NO: 3370532 - RNA, 16 nt, Human
agagaccuaccucagg

SEQ ID NO: 3370533 - RNA, 18 nt, Human
agagaccuaccucagguu

SEQ ID NO: 3370534 - RNA, 15 nt, Human
agagaccugaagugu

SEQ ID NO: 3370535 - RNA, 15 nt, Human
agagacgguguuuug

SEQ ID NO: 3370536 - RNA, 18 nt, Human
agagacuauggagccugg

SEQ ID NO: 3370537 - RNA, 20 nt, Human
agagacucagggccccagca

SEQ ID NO: 3370538 - RNA, 20 nt, Human
agagacucccaugaagccuu

SEQ ID NO: 3370539 - RNA, 22 nt, Human
agagacucccaugaagccuuuu

SEQ ID NO: 3370540 - RNA, 12 nt, Human
agagacuccugc

SEQ ID NO: 3370541 - RNA, 14 nt, Human
agagacuccugcag

SEQ ID NO: 3370542 - RNA, 18 nt, Human
agagacuccugcaggcag

SEQ ID NO: 3370543 - RNA, 20 nt, Human
agagacuccugcaggcagcc

SEQ ID NO: 3370544 - RNA, 21 nt, Human
agagacuccugcaggcagcca

SEQ ID NO: 3370545 - RNA, 22 nt, Human
agagacuccuugagagaccagg

SEQ ID NO: 3370546 - RNA, 14 nt, Human
agagacugaaauua

SEQ ID NO: 3370547 - RNA, 14 nt, Human
agagacuguagauu

SEQ ID NO: 3370548 - RNA, 12 nt, Human
agagacuuguuu

SEQ ID NO: 3370549 - RNA, 16 nt, Human
agagacuuguuuugga

SEQ ID NO: 3370550 - RNA, 16 nt, Human
agagacuuuuaaucag

SEQ ID NO: 3370551 - RNA, 13 nt, Human
agagagaaaaaaa

SEQ ID NO: 3370552 - RNA, 13 nt, Human
agagagaaaaaca

SEQ ID NO: 3370553 - RNA, 11 nt, Human
agagagaaaau

SEQ ID NO: 3370554 - RNA, 13 nt, Human
agagagaaaauaa

SEQ ID NO: 3370555 - RNA, 17 nt, Human
agagagaaaauaaaaag

SEQ ID NO: 3370556 - RNA, 18 nt, Human
agagagaaaauaaaaagu

SEQ ID NO: 3370557 - RNA, 15 nt, Human
agagagaaagcauau

SEQ ID NO: 3370558 - RNA, 22 nt, Human
agagagaaagccaggcagguag

SEQ ID NO: 3370559 - RNA, 15 nt, Human
agagagaaaggacuc

SEQ ID NO: 3370560 - RNA, 18 nt, Human
agagagaaccuaacugua

SEQ ID NO: 3370561 - RNA, 22 nt, Human
agagagaaccuaacuguaucuu

SEQ ID NO: 3370562 - RNA, 14 nt, Human
agagagaagagccc

SEQ ID NO: 3370563 - RNA, 11 nt, Human
agagagaagcc

SEQ ID NO: 3370564 - RNA, 16 nt, Human
agagagaccacuuuuc

SEQ ID NO: 3370565 - RNA, 13 nt, Human
agagagagaaaga

SEQ ID NO: 3370566 - RNA, 14 nt, Human
agagagagaaagag

SEQ ID NO: 3370567 - RNA, 12 nt, Human
agagagagagaa

SEQ ID NO: 3370568 - RNA, 14 nt, Human
agagagagagaaau

SEQ ID NO: 3370569 - RNA, 23 nt, Human
agagagagggccugcuggagagc

SEQ ID NO: 3370570 - RNA, 14 nt, Human
agagagaguguuug

SEQ ID NO: 3370571 - RNA, 22 nt, Human
agagagauauaucugaaaacug

SEQ ID NO: 3370572 - RNA, 17 nt, Human
agagagaugggagcucc

SEQ ID NO: 3370573 - RNA, 18 nt, Human
agagagaugggagcuccu

SEQ ID NO: 3370574 - RNA, 19 nt, Human
agagagaugggagcuccuc

SEQ ID NO: 3370575 - RNA, 18 nt, Human
agagagauguguaauuuu

SEQ ID NO: 3370576 - RNA, 19 nt, Human
agagagauguguaauuuuu

SEQ ID NO: 3370577 - RNA, 14 nt, Human
agagagauguuuug

SEQ ID NO: 3370578 - RNA, 23 nt, Human
agagagcaagacgcugugcugcc

SEQ ID NO: 3370579 - RNA, 19 nt, Human
agagagcagagaauauaac

SEQ ID NO: 3370580 - RNA, 17 nt, Human
agagagcagcuucugcc

SEQ ID NO: 3370581 - RNA, 16 nt, Human
agagagcagugcuuuu

SEQ ID NO: 3370582 - RNA, 17 nt, Human
agagagcagugcuuuug

SEQ ID NO: 3370583 - RNA, 18 nt, Human
agagagccauuuugugaa

SEQ ID NO: 3370584 - RNA, 13 nt, Human
agagagcccgagg

SEQ ID NO: 3370585 - RNA, 18 nt, Human
agagagcgagcgcuaccc

SEQ ID NO: 3370586 - RNA, 18 nt, Human
agagagcugccaucgcug

SEQ ID NO: 3370587 - RNA, 17 nt, Human
agagagcuuagccugga

SEQ ID NO: 3370588 - RNA, 23 nt, Human
agagaggaaagguuugagaagca

SEQ ID NO: 3370589 - RNA, 17 nt, Human
agagaggaaucagacuu

SEQ ID NO: 3370590 - RNA, 15 nt, Human
agagaggagaggaga

SEQ ID NO: 3370591 - RNA, 13 nt, Human
agagaggaguuca

SEQ ID NO: 3370592 - RNA, 19 nt, Human
agagaggaugugcaagcga

SEQ ID NO: 3370593 - RNA, 15 nt, Human
agagaggcaauggcu

SEQ ID NO: 3370594 - RNA, 16 nt, Human
agagaggcagagagcg

SEQ ID NO: 3370595 - RNA, 23 nt, Human
agagaggccauucuuucccaaca

SEQ ID NO: 3370596 - RNA, 14 nt, Human
agagaggccuuuug

SEQ ID NO: 3370597 - RNA, 17 nt, Human
agagaggcuaaaauguu

SEQ ID NO: 3370598 - RNA, 17 nt, Human
agagagggagguaugga

SEQ ID NO: 3370599 - RNA, 14 nt, Human
agagagggcaggca

SEQ ID NO: 3370600 - RNA, 20 nt, Human
agagagggccaugcaauuca

SEQ ID NO: 3370601 - RNA, 22 nt, Human
agagaggggaauaauagaagaa

SEQ ID NO: 3370602 - RNA, 16 nt, Human
agagagggggccaccu

SEQ ID NO: 3370603 - RNA, 21 nt, Human
agagaggguggugaccucugc

SEQ ID NO: 3370604 - RNA, 22 nt, Human
agagaggucaagcccaggagga

SEQ ID NO: 3370605 - RNA, 20 nt, Human
agagagguuauagaguagaa

SEQ ID NO: 3370606 - RNA, 23 nt, Human
agagagucccacugccucagguu

SEQ ID NO: 3370607 - RNA, 17 nt, Human
agagaguggcuccuccc

SEQ ID NO: 3370608 - RNA, 15 nt, Human
agagaguguugaaac

SEQ ID NO: 3370609 - RNA, 15 nt, Human
agagaguugaaccua

SEQ ID NO: 3370610 - RNA, 18 nt, Human
agagaguuguuguguaca

SEQ ID NO: 3370611 - RNA, 13 nt, Human
agagauacagagg

SEQ ID NO: 3370612 - RNA, 20 nt, Human
agagauaccaagaugccauc

SEQ ID NO: 3370613 - RNA, 20 nt, Human
agagauaggaaggucauuuc

SEQ ID NO: 3370614 - RNA, 22 nt, Human
agagauaggaaggucauuucca

SEQ ID NO: 3370615 - RNA, 19 nt, Human
agagauauaucugaaaacu

SEQ ID NO: 3370616 - RNA, 20 nt, Human
agagauaugcagaaggaagg

SEQ ID NO: 3370617 - RNA, 13 nt, Human
agagauauuuuaa

SEQ ID NO: 3370618 - RNA, 18 nt, Human
agagauauuuuaaaauga

SEQ ID NO: 3370619 - RNA, 15 nt, Human
agagauauuuuguaa

SEQ ID NO: 3370620 - RNA, 16 nt, Human
agagauauuuuguaaa

SEQ ID NO: 3370621 - RNA, 14 nt, Human
agagaucaaagaug

SEQ ID NO: 3370622 - RNA, 21 nt, Human
agagaucauccuuuccagcau

SEQ ID NO: 3370623 - RNA, 15 nt, Human
agagaucaugagaaa

SEQ ID NO: 3370624 - RNA, 16 nt, Human
agagaucaugagaaau

SEQ ID NO: 3370625 - RNA, 16 nt, Human
agagauccaggaagca

SEQ ID NO: 3370626 - RNA, 21 nt, Human
agagaucuauauauguauaaa

SEQ ID NO: 3370627 - RNA, 13 nt, Human
agagaucugcugu

SEQ ID NO: 3370628 - RNA, 18 nt, Human
aauggcugauaauuuuaa

SEQ ID NO: 3370629 - RNA, 22 nt, Human
aauggcuuauccagcuggugag

SEQ ID NO: 3370630 - RNA, 21 nt, Human
aauggcuuuggucucuugcuu

SEQ ID NO: 3370631 - RNA, 16 nt, Human
aauggcuuuguauaga

SEQ ID NO: 3370632 - RNA, 15 nt, Human
aaugggaacauuuau

SEQ ID NO: 3370633 - RNA, 23 nt, Human
aaugggaacauuuauuuuaugag

SEQ ID NO: 3370634 - RNA, 22 nt, Human
aaugggaacugccucuuuccug

SEQ ID NO: 3370635 - RNA, 21 nt, Human
aaugggagcugaggccacacu

SEQ ID NO: 3370636 - RNA, 18 nt, Human
aaugggcaaaacugaauu

SEQ ID NO: 3370637 - RNA, 23 nt, Human
aaugggcacugggaugagccgcu

SEQ ID NO: 3370638 - RNA, 19 nt, Human
aaugggcacuuaaagcuuu

SEQ ID NO: 3370639 - RNA, 15 nt, Human
aaugggcagagcaga

SEQ ID NO: 3370640 - RNA, 18 nt, Human
aaugggcaguuacaugca

SEQ ID NO: 3370641 - RNA, 22 nt, Human
aaguccuuggcuugccauuuuu

SEQ ID NO: 3370642 - RNA, 13 nt, Human
aaguccuuuaugu

SEQ ID NO: 3370643 - RNA, 16 nt, Human
aagucggaacagcaga

SEQ ID NO: 3370644 - RNA, 19 nt, Human
aagucguccuuacuccugu

SEQ ID NO: 3370645 - RNA, 20 nt, Human
aagucguccuuacuccugug

SEQ ID NO: 3370646 - RNA, 24 nt, Human
aagucguccuuacuccugugggag

SEQ ID NO: 3370647 - RNA, 17 nt, Human
aagucguuuuccaaacu

SEQ ID NO: 3370648 - RNA, 11 nt, Human
aagucuaaagu

SEQ ID NO: 3370649 - RNA, 21 nt, Human
aagucuaaaguuuacaguaaa

SEQ ID NO: 3370650 - RNA, 13 nt, Human
aagucuauaaaaa

SEQ ID NO: 3370651 - RNA, 21 nt, Human
aagucucacuggcugucagua

SEQ ID NO: 3370652 - RNA, 17 nt, Human
aagucucuagguucuga

SEQ ID NO: 3370653 - RNA, 13 nt, Human
aagucucuauuua

SEQ ID NO: 3370654 - RNA, 15 nt, Human
aagucucuauuuaaa

SEQ ID NO: 3370655 - RNA, 19 nt, Human
aagucucugaagugaaacu

SEQ ID NO: 3370656 - RNA, 15 nt, Human
aagucucugcuggcc

SEQ ID NO: 3370657 - RNA, 21 nt, Human
aagucucugcuggcccagcca

SEQ ID NO: 3370658 - RNA, 16 nt, Human
aagucugcauuacauu

SEQ ID NO: 3370659 - RNA, 18 nt, Human
aagucuggaucugggacc

SEQ ID NO: 3370660 - RNA, 18 nt, Human
aagucuguccuugaagga

SEQ ID NO: 3370661 - RNA, 21 nt, Human
aagucuguccuugaaggacua

SEQ ID NO: 3370662 - RNA, 16 nt, Human
aagucuguuuacugca

SEQ ID NO: 3370663 - RNA, 18 nt, Human
aagucuguuuuaugacuu

SEQ ID NO: 3370664 - RNA, 23 nt, Human
aagucuguuuuaugacuucauua

SEQ ID NO: 3370665 - RNA, 19 nt, Human
aagucuuaaggacaaagug

SEQ ID NO: 3370666 - RNA, 16 nt, Human
aagucuuacuacagaa

SEQ ID NO: 3370667 - RNA, 21 nt, Human
aagucuuagacuugaaauacu

SEQ ID NO: 3370668 - RNA, 16 nt, Human
aagucuuaucaagcag

SEQ ID NO: 3370669 - RNA, 17 nt, Human
aagucuuaucaagcagc

SEQ ID NO: 3370670 - RNA, 21 nt, Human
aagucuucaagggcugcuuca

SEQ ID NO: 3370671 - RNA, 20 nt, Human
aagucuucacucucugaaga

SEQ ID NO: 3370672 - RNA, 12 nt, Human
aagucuucaggg

SEQ ID NO: 3370673 - RNA, 14 nt, Human
aagucuucaugaaa

SEQ ID NO: 3370674 - RNA, 18 nt, Human
aagucuucaugaaaugcu

SEQ ID NO: 3370675 - RNA, 22 nt, Human
aagucuucaugaaaugcuaugu

SEQ ID NO: 3370676 - RNA, 10 nt, Human
aagucuugua

SEQ ID NO: 3370677 - RNA, 21 nt, Human
aagucuugugacuagugcuga

SEQ ID NO: 3370678 - RNA, 22 nt, Human
aagucuugugacuagugcugaa

SEQ ID NO: 3370679 - RNA, 11 nt, Human
aagucuuugcu

SEQ ID NO: 3370680 - RNA, 19 nt, Human
aagucuuuuaaaaaguauu

SEQ ID NO: 3370681 - RNA, 14 nt, Human
aagucuuuuguucg

SEQ ID NO: 3370682 - RNA, 19 nt, Human
aagugaaauaacaaaaugg

SEQ ID NO: 3370683 - RNA, 14 nt, Human
aagugaaauaaugu

SEQ ID NO: 3370684 - RNA, 16 nt, Human
aagugaaauaaugugu

SEQ ID NO: 3370685 - RNA, 16 nt, Human
aagugaaaucaaaggu

SEQ ID NO: 3370686 - RNA, 17 nt, Human
aagugaagguuuacaau

SEQ ID NO: 3370687 - RNA, 18 nt, Human
aagugaagguuuacaauu

SEQ ID NO: 3370688 - RNA, 22 nt, Human
aagugaagguuuacaauuuaca

SEQ ID NO: 3370689 - RNA, 16 nt, Human
aagugaauaaacuuca

SEQ ID NO: 3370690 - RNA, 17 nt, Human
aagugaauaaacuucag

SEQ ID NO: 3370691 - RNA, 19 nt, Human
aagugaaugaaagauuaaa

SEQ ID NO: 3370692 - RNA, 15 nt, Human
aagugaaugcuggga

SEQ ID NO: 3370693 - RNA, 23 nt, Human
aagugaauuugaaugaaaaauuu

SEQ ID NO: 3370694 - RNA, 17 nt, Human
aagugaauuuuucucua

SEQ ID NO: 3370695 - RNA, 16 nt, Human
aagugacaaggcccca

SEQ ID NO: 3370696 - RNA, 20 nt, Human
aagugacaaggccccagaga

SEQ ID NO: 3370697 - RNA, 12 nt, Human
aagugacaggga

SEQ ID NO: 3370698 - RNA, 23 nt, Human
aagugacagggaagcuacagguu

SEQ ID NO: 3370699 - RNA, 15 nt, Human
aagugaccaaggagg

SEQ ID NO: 3370700 - RNA, 20 nt, Human
aagugaccuauaccuguguu

SEQ ID NO: 3370701 - RNA, 14 nt, Human
aagugacgguuccu

SEQ ID NO: 3370702 - RNA, 17 nt, Human
aagugacuguaucugug

SEQ ID NO: 3370703 - RNA, 18 nt, Human
aagugacuguaucugugu

SEQ ID NO: 3370704 - RNA, 19 nt, Human
aagugacuuagcagaugcu

SEQ ID NO: 3370705 - RNA, 19 nt, Human
aagugacuuuggcugcaug

SEQ ID NO: 3370706 - RNA, 14 nt, Human
aagugagaaaacug

SEQ ID NO: 3370707 - RNA, 18 nt, Human
aagugagaauaggcagcc

SEQ ID NO: 3370708 - RNA, 18 nt, Human
aagugagcuuugcugcua

SEQ ID NO: 3370709 - RNA, 18 nt, Human
aagugaggaaaucaaagu

SEQ ID NO: 3370710 - RNA, 21 nt, Human
aagugaggaaaucaaagugcu

SEQ ID NO: 3370711 - RNA, 22 nt, Human
aagugagggccgagugagagcg

SEQ ID NO: 3370712 - RNA, 21 nt, Human
aagugagggcucacucagcca

SEQ ID NO: 3370713 - RNA, 21 nt, Human
aagugaucaaacuacauauug

SEQ ID NO: 3370714 - RNA, 13 nt, Human
aagugauccuccc

SEQ ID NO: 3370715 - RNA, 19 nt, Human
aagugauccucccaccuca

SEQ ID NO: 3370716 - RNA, 14 nt, Human
aagugaugacauau

SEQ ID NO: 3370717 - RNA, 18 nt, Human
aagugauggagcagagca

SEQ ID NO: 3370718 - RNA, 19 nt, Human
aagugauucucaugccuca

SEQ ID NO: 3370719 - RNA, 17 nt, Human
aagugauucuccugccu

SEQ ID NO: 3370720 - RNA, 18 nt, Human
aagugauucuccugccuc

SEQ ID NO: 3370721 - RNA, 19 nt, Human
aagugauucuccugccuca

SEQ ID NO: 3370722 - RNA, 20 nt, Human
aagugauucuccugccucag

SEQ ID NO: 3370723 - RNA, 14 nt, Human
aagugauugaaaau

SEQ ID NO: 3370724 - RNA, 17 nt, Human
aagugauuuuuuugucc

SEQ ID NO: 3370725 - RNA, 23 nt, Human
aagugcaauaaaucugacccagu

SEQ ID NO: 3370726 - RNA, 17 nt, Human
aagugcagaaugcuccu

SEQ ID NO: 3370727 - RNA, 12 nt, Human
aagugcaggcug

SEQ ID NO: 3370728 - RNA, 17 nt, Human
aagugcaggcuggcacc

SEQ ID NO: 3370729 - RNA, 21 nt, Human
aagugcaucuggagagaacag

SEQ ID NO: 3370730 - RNA, 13 nt, Human
aagugcauuucug

SEQ ID NO: 3370731 - RNA, 15 nt, Human
aagugccaaagaaag

SEQ ID NO: 3370732 - RNA, 16 nt, Human
aagugccaaagaaagu

SEQ ID NO: 3370733 - RNA, 19 nt, Human
aagugccaaagaaaguggu

SEQ ID NO: 3370734 - RNA, 15 nt, Human
aagugccaaaugcuc

SEQ ID NO: 3370735 - RNA, 21 nt, Human
aagugccacugcccgagcugg

SEQ ID NO: 3370736 - RNA, 14 nt, Human
aagugccaguauuu

SEQ ID NO: 3370737 - RNA, 23 nt, Human
aagugccccugcugccuccccaa

SEQ ID NO: 3370738 - RNA, 19 nt, Human
aagugcccucucccacccu

SEQ ID NO: 3370739 - RNA, 15 nt, Human
aagugccgcaaauug

SEQ ID NO: 3370740 - RNA, 19 nt, Human
aagugccucaagaggaaug

SEQ ID NO: 3370741 - RNA, 18 nt, Human
aagugccucacauuuuuu

SEQ ID NO: 3370742 - RNA, 12 nt, Human
aagugccuuaau

SEQ ID NO: 3370743 - RNA, 13 nt, Human
aagugccuuucag

SEQ ID NO: 3370744 - RNA, 14 nt, Human
aagugccuuucagg

SEQ ID NO: 3370745 - RNA, 19 nt, Human
aagugccuuucaggaucua

SEQ ID NO: 3370746 - RNA, 17 nt, Human
aagugccuuucugcagu

SEQ ID NO: 3370747 - RNA, 22 nt, Human
aagugcgggguaggggaagaag

SEQ ID NO: 3370748 - RNA, 20 nt, Human
aagugcgugccgugugagug

SEQ ID NO: 3370749 - RNA, 19 nt, Human
aagugcguguguagaguua

SEQ ID NO: 3370750 - RNA, 21 nt, Human
aagugcguguguagaguuaag

SEQ ID NO: 3370751 - RNA, 16 nt, Human
aagugcuaagguucua

SEQ ID NO: 3370752 - RNA, 18 nt, Human
aagugcuaagguucuaag

SEQ ID NO: 3370753 - RNA, 13 nt, Human
aagugcuauuacg

SEQ ID NO: 3370754 - RNA, 14 nt, Human
aagugcugcauuua

SEQ ID NO: 3370755 - RNA, 13 nt, Human
aagugcugcggag

SEQ ID NO: 3370756 - RNA, 21 nt, Human
aagugcugcggagcaagagga

SEQ ID NO: 3370757 - RNA, 12 nt, Human
aagugcugggau

SEQ ID NO: 3370758 - RNA, 22 nt, Human
aagugcugggauuacaggugug

SEQ ID NO: 3370759 - RNA, 13 nt, Human
aagugcuguauaa

SEQ ID NO: 3370760 - RNA, 16 nt, Human
aagugcuguauaaaau

SEQ ID NO: 3370761 - RNA, 17 nt, Human
aagugcuguauaaaauc

SEQ ID NO: 3370762 - RNA, 19 nt, Human
aagugcuuauuacauuuua

SEQ ID NO: 3370763 - RNA, 13 nt, Human
aagugcuuucuuc

SEQ ID NO: 3370764 - RNA, 14 nt, Human
aaguggaaggaaag

SEQ ID NO: 3370765 - RNA, 16 nt, Human
aaguggaaguauguau

SEQ ID NO: 3370766 - RNA, 19 nt, Human
aaguggaccaggacaggac

SEQ ID NO: 3370767 - RNA, 20 nt, Human
aaguggaccuugagaccaca

SEQ ID NO: 3370768 - RNA, 23 nt, Human
aaguggacucuuugguggcuuug

SEQ ID NO: 3370769 - RNA, 14 nt, Human
aaguggacuggagg

SEQ ID NO: 3370770 - RNA, 13 nt, Human
aaguggcaaagcu

SEQ ID NO: 3370771 - RNA, 19 nt, Human
aaguggcaaagcuguucuu

SEQ ID NO: 3370772 - RNA, 17 nt, Human
aaguugaagcuaagauu

SEQ ID NO: 3370773 - RNA, 18 nt, Human
aaguugaagcuaagauuu

SEQ ID NO: 3370774 - RNA, 23 nt, Human
aaguugaauuuauuggcuuuucu

SEQ ID NO: 3370775 - RNA, 19 nt, Human
aaguugacuuauaguacau

SEQ ID NO: 3370776 - RNA, 19 nt, Human
aaguugagauaguuuucau

SEQ ID NO: 3370777 - RNA, 20 nt, Human
aaguugagcuaugacuuaac

SEQ ID NO: 3370778 - RNA, 18 nt, Human
aaguugaggauuguugaa

SEQ ID NO: 3370779 - RNA, 18 nt, Human
aaguugaguauauuauaa

SEQ ID NO: 3370780 - RNA, 14 nt, Human
aaguugaugcaauc

SEQ ID NO: 3370781 - RNA, 15 nt, Human
aaguugcacggcugc

SEQ ID NO: 3370782 - RNA, 18 nt, Human
aaguugcacggcugcuga

SEQ ID NO: 3370783 - RNA, 15 nt, Human
aaguugcagcuguuu

SEQ ID NO: 3370784 - RNA, 22 nt, Human
aaguugcagugagcugauauca

SEQ ID NO: 3370785 - RNA, 12 nt, Human
aaguugccuaaa

SEQ ID NO: 3370786 - RNA, 15 nt, Human
aaguugccuaaaucc

SEQ ID NO: 3370787 - RNA, 19 nt, Human
aaguugccuaaauccauuu

SEQ ID NO: 3370788 - RNA, 14 nt, Human
aaguugcgacggag

SEQ ID NO: 3370789 - RNA, 23 nt, Human
aaguugcgacggagagaaaaaag

SEQ ID NO: 3370790 - RNA, 14 nt, Human
aaguugcugcuucu

SEQ ID NO: 3370791 - RNA, 21 nt, Human
aaguugcugcuucucccaggc

SEQ ID NO: 3370792 - RNA, 15 nt, Human
aaguuggaaacacua

SEQ ID NO: 3370793 - RNA, 23 nt, Human
aaguuggaaacacuaaauguuaa

SEQ ID NO: 3370794 - RNA, 21 nt, Human
aaguuggcuucuguuucuagu

SEQ ID NO: 3370795 - RNA, 16 nt, Human
aaguugggcaauauaa

SEQ ID NO: 3370796 - RNA, 17 nt, Human
aaguugggcaauauaac

SEQ ID NO: 3370797 - RNA, 20 nt, Human
aaguugggcuugcuauucug

SEQ ID NO: 3370798 - RNA, 21 nt, Human
aaguugggcuugcuauucugu

SEQ ID NO: 3370799 - RNA, 21 nt, Human
aaguugguauuaauaaaaaga

SEQ ID NO: 3370800 - RNA, 23 nt, Human
aaguugguccuuuacacucaggc

SEQ ID NO: 3370801 - RNA, 15 nt, Human
aaguuguacaugaaa

SEQ ID NO: 3370802 - RNA, 21 nt, Human
aaugggcaguuacaugcauac

SEQ ID NO: 3370803 - RNA, 15 nt, Human
aaugggcucuccggg

SEQ ID NO: 3370804 - RNA, 17 nt, Human
aaugggcuuagagcagu

SEQ ID NO: 3370805 - RNA, 22 nt, Human
aauggggccagauccagccugg

SEQ ID NO: 3370806 - RNA, 20 nt, Human
aaugggggccucuucaaauu

SEQ ID NO: 3370807 - RNA, 18 nt, Human
aauggggguagcagcugg

SEQ ID NO: 3370808 - RNA, 15 nt, Human
aaugggggugcauuu

SEQ ID NO: 3370809 - RNA, 16 nt, Human
aauggguuuuucccug

SEQ ID NO: 3370810 - RNA, 15 nt, Human
aaugguaaaauugca

SEQ ID NO: 3370811 - RNA, 15 nt, Human
aaugguaccagauaa

SEQ ID NO: 3370812 - RNA, 18 nt, Human
aaugguacugacuuugcu

SEQ ID NO: 3370813 - RNA, 21 nt, Human
aaugguagcauuuuaaacaaa

SEQ ID NO: 3370814 - RNA, 17 nt, Human
aaugguaggcauuuccu

SEQ ID NO: 3370815 - RNA, 22 nt, Human
aaugguagucuaaccaaaugca

SEQ ID NO: 3370816 - RNA, 12 nt, Human
aaugguaguuuc

SEQ ID NO: 3370817 - RNA, 17 nt, Human
aaugguaguuucugugg

SEQ ID NO: 3370818 - RNA, 18 nt, Human
aaugguaguuucuguggu

SEQ ID NO: 3370819 - RNA, 14 nt, Human
aaugguaguuuuac

SEQ ID NO: 3370820 - RNA, 15 nt, Human
aaugguaugagcuga

SEQ ID NO: 3370821 - RNA, 22 nt, Human
aauggucacguuuggugcuucu

SEQ ID NO: 3370822 - RNA, 14 nt, Human
aauggucagcguug

SEQ ID NO: 3370823 - RNA, 20 nt, Human
aauggucagcguugcauguc

SEQ ID NO: 3370824 - RNA, 20 nt, Human
aaugguccaauuaguuuccu

SEQ ID NO: 3370825 - RNA, 19 nt, Human
aaugguccaggagaaggcc

SEQ ID NO: 3370826 - RNA, 13 nt, Human
aaugguccagggu

SEQ ID NO: 3370827 - RNA, 14 nt, Human
aaugguccaggguu

SEQ ID NO: 3370828 - RNA, 20 nt, Human
aaugguccgugcuaaggacu

SEQ ID NO: 3370829 - RNA, 21 nt, Human
aaugguccgugcuaaggacuu

SEQ ID NO: 3370830 - RNA, 22 nt, Human
aaugguccgugcuaaggacuug

SEQ ID NO: 3370831 - RNA, 22 nt, Human
aauggucuuucuaaugugugaa

SEQ ID NO: 3370832 - RNA, 13 nt, Human
aauggugauuuua

SEQ ID NO: 3370833 - RNA, 15 nt, Human
aauggugauuuuaaa

SEQ ID NO: 3370834 - RNA, 19 nt, Human
aaugguggcuucagcucca

SEQ ID NO: 3370835 - RNA, 23 nt, Human
aaugguggcuucagcuccagccc

SEQ ID NO: 3370836 - RNA, 15 nt, Human
aaugguggcuucuuu

SEQ ID NO: 3370837 - RNA, 22 nt, Human
aaugguggggaacuauaaagaa

SEQ ID NO: 3370838 - RNA, 21 nt, Human
aauggugguuguuucuuccaa

SEQ ID NO: 3370839 - RNA, 13 nt, Human
aaugguguacaua

SEQ ID NO: 3370840 - RNA, 22 nt, Human
aauggugugaacccgggagcgg

SEQ ID NO: 3370841 - RNA, 19 nt, Human
aaugguguuguaugccuuu

SEQ ID NO: 3370842 - RNA, 13 nt, Human
aaugguuaaaaga

SEQ ID NO: 3370843 - RNA, 15 nt, Human
aaugguuauaaaagu

SEQ ID NO: 3370844 - RNA, 19 nt, Human
aaugguuauaaaagugauu

SEQ ID NO: 3370845 - RNA, 14 nt, Human
aaugguuccaugcc

SEQ ID NO: 3370846 - RNA, 22 nt, Human
aaugguuuaacuucugccugug

SEQ ID NO: 3370847 - RNA, 21 nt, Human
aaugguuuauuuuguauugug

SEQ ID NO: 3370848 - RNA, 17 nt, Human
aaugguuuggugcuuuu

SEQ ID NO: 3370849 - RNA, 16 nt, Human
aaugguuuguccugau

SEQ ID NO: 3370850 - RNA, 22 nt, Human
aaugguuuucuuguguguuuau

SEQ ID NO: 3370851 - RNA, 21 nt, Human
aaugguuuuuaaauuuuguaa

SEQ ID NO: 3370852 - RNA, 19 nt, Human
aauguaaaaaagaaaaaca

SEQ ID NO: 3370853 - RNA, 14 nt, Human
aauguaaaaugauu

SEQ ID NO: 3370854 - RNA, 17 nt, Human
aauguaaaauguugaau

SEQ ID NO: 3370855 - RNA, 16 nt, Human
aauguaaacugccaua

SEQ ID NO: 3370856 - RNA, 14 nt, Human
aauguaaacuguuu

SEQ ID NO: 3370857 - RNA, 16 nt, Human
aauguaaacuguuucu

SEQ ID NO: 3370858 - RNA, 17 nt, Human
aauguaaacuguuucuu

SEQ ID NO: 3370859 - RNA, 19 nt, Human
aauguaaagcuugucugau

SEQ ID NO: 3370860 - RNA, 21 nt, Human
aauguaaaggagucaaaacua

SEQ ID NO: 3370861 - RNA, 22 nt, Human
aauguaaauaaaggauuucuag

SEQ ID NO: 3370862 - RNA, 21 nt, Human
aauguaaauauuuuaaagaau

SEQ ID NO: 3370863 - RNA, 14 nt, Human
aauguaaaugucuc

SEQ ID NO: 3370864 - RNA, 16 nt, Human
aauguaaaugucucac

SEQ ID NO: 3370865 - RNA, 12 nt, Human
aauguaaauuug

SEQ ID NO: 3370866 - RNA, 15 nt, Human
aauguaacugcucuu

SEQ ID NO: 3370867 - RNA, 12 nt, Human
aauguaacuguu

SEQ ID NO: 3370868 - RNA, 15 nt, Human
aauguaacuuagaga

SEQ ID NO: 3370869 - RNA, 22 nt, Human
aauguaacuuuuguaagacaaa

SEQ ID NO: 3370870 - RNA, 16 nt, Human
aauguaagauuauaga

SEQ ID NO: 3370871 - RNA, 21 nt, Human
aauguaagauuauagauucua

SEQ ID NO: 3370872 - RNA, 23 nt, Human
aauguaagauuauagauucuaaa

SEQ ID NO: 3370873 - RNA, 13 nt, Human
aauguaagcucua

SEQ ID NO: 3370874 - RNA, 20 nt, Human
aauguaagggaaacugccag

SEQ ID NO: 3370875 - RNA, 17 nt, Human
aauguaagguauaucau

SEQ ID NO: 3370876 - RNA, 23 nt, Human
aauguaagguauaucauucuaaa

SEQ ID NO: 3370877 - RNA, 16 nt, Human
aauguaauagggaaaa

SEQ ID NO: 3370878 - RNA, 15 nt, Human
aauguaaugaucaua

SEQ ID NO: 3370879 - RNA, 22 nt, Human
aauguaauuauuuauguauggu

SEQ ID NO: 3370880 - RNA, 14 nt, Human
aauguaauugaaua

SEQ ID NO: 3370881 - RNA, 16 nt, Human
aauguaauugaauaaa

SEQ ID NO: 3370882 - RNA, 23 nt, Human
aauguaauuguaauuuugaaaug

SEQ ID NO: 3370883 - RNA, 16 nt, Human
aauguaauuuaaauga

SEQ ID NO: 3370884 - RNA, 15 nt, Human
aauguacaaaauaaa

SEQ ID NO: 3370885 - RNA, 21 nt, Human
aauguacagcaaggagauuua

SEQ ID NO: 3370886 - RNA, 17 nt, Human
aauguacaguugaaaua

SEQ ID NO: 3370887 - RNA, 22 nt, Human
aauguacccaccgggccacucc

SEQ ID NO: 3370888 - RNA, 15 nt, Human
aauguaccuucuuuc

SEQ ID NO: 3370889 - RNA, 15 nt, Human
aauguacuaauauuu

SEQ ID NO: 3370890 - RNA, 18 nt, Human
aauguacugcauaugaaa

SEQ ID NO: 3370891 - RNA, 19 nt, Human
aauguacuuguuucucugu

SEQ ID NO: 3370892 - RNA, 14 nt, Human
aauguagauaagug

SEQ ID NO: 3370893 - RNA, 17 nt, Human
aauguagcuucagucau

SEQ ID NO: 3370894 - RNA, 16 nt, Human
aauguagguccucaga

SEQ ID NO: 3370895 - RNA, 22 nt, Human
aauguagugaagggauguauca

SEQ ID NO: 3370896 - RNA, 16 nt, Human
aauguaguugauguau

SEQ ID NO: 3370897 - RNA, 19 nt, Human
aauguaguugauguaucca

SEQ ID NO: 3370898 - RNA, 23 nt, Human
aauguaguuugaggaaauuugca

SEQ ID NO: 3370899 - RNA, 14 nt, Human
aauguauaaauaua

SEQ ID NO: 3370900 - RNA, 16 nt, Human
aauguauaaauauaca

SEQ ID NO: 3370901 - RNA, 13 nt, Human
aauguauaccugu

SEQ ID NO: 3370902 - RNA, 14 nt, Human
aauguauaguauuu

SEQ ID NO: 3370903 - RNA, 15 nt, Human
aauguauaguauuug

SEQ ID NO: 3370904 - RNA, 17 nt, Human
aauguauaguauuugaa

SEQ ID NO: 3370905 - RNA, 18 nt, Human
aauguauauacacauaua

SEQ ID NO: 3370906 - RNA, 19 nt, Human
aauguauauacacauauac

SEQ ID NO: 3370907 - RNA, 20 nt, Human
aauguauaugaacuuaacau

SEQ ID NO: 3370908 - RNA, 14 nt, Human
aauguauaugcacu

SEQ ID NO: 3370909 - RNA, 21 nt, Human
aauguauauguuuugugggaa

SEQ ID NO: 3370910 - RNA, 18 nt, Human
aauguaucaggaaauaua

SEQ ID NO: 3370911 - RNA, 19 nt, Human
aauguaucauagaaaugua

SEQ ID NO: 3370912 - RNA, 22 nt, Human
aauguaucccuucucacagcac

SEQ ID NO: 3370913 - RNA, 14 nt, Human
aauguaucugugaa

SEQ ID NO: 3370914 - RNA, 17 nt, Human
aauguaucugugaagua

SEQ ID NO: 3370915 - RNA, 17 nt, Human
aauguaugcuucauaca

SEQ ID NO: 3370916 - RNA, 14 nt, Human
aauucuuucauuuu

SEQ ID NO: 3370917 - RNA, 13 nt, Human
aauucuuuugcca

SEQ ID NO: 3370918 - RNA, 13 nt, Human
aauucuuuuuuau

SEQ ID NO: 3370919 - RNA, 17 nt, Human
aauucuuuuuuauuaau

SEQ ID NO: 3370920 - RNA, 23 nt, Human
aauucuuuuuuauuaaucacugu

SEQ ID NO: 3370921 - RNA, 15 nt, Human
aauugaaaagaagua

SEQ ID NO: 3370922 - RNA, 14 nt, Human
aauugaaaaguuau

SEQ ID NO: 3370923 - RNA, 12 nt, Human
aauugaaacacu

SEQ ID NO: 3370924 - RNA, 22 nt, Human
aauugaaagugggcaaaagcuu

SEQ ID NO: 3370925 - RNA, 15 nt, Human
aauugaaauguaagg

SEQ ID NO: 3370926 - RNA, 21 nt, Human
aauugaaccuuugugcccuau

SEQ ID NO: 3370927 - RNA, 23 nt, Human
aauugaaccuuugugcccuauca

SEQ ID NO: 3370928 - RNA, 22 nt, Human
aauugaacuuaaauaaauguca

SEQ ID NO: 3370929 - RNA, 17 nt, Human
aauugaagagagauaua

SEQ ID NO: 3370930 - RNA, 12 nt, Human
aauugaaggaaa

SEQ ID NO: 3370931 - RNA, 16 nt, Human
aauugaaggaaagauu

SEQ ID NO: 3370932 - RNA, 16 nt, Human
aauugaagguuuuuga

SEQ ID NO: 3370933 - RNA, 17 nt, Human
aauugaaguaaacuuuu

SEQ ID NO: 3370934 - RNA, 17 nt, Human
aauugaaguguauaaua

SEQ ID NO: 3370935 - RNA, 16 nt, Human
aauugaaguuucaagu

SEQ ID NO: 3370936 - RNA, 21 nt, Human
aauugaauaaugguaccagau

SEQ ID NO: 3370937 - RNA, 19 nt, Human
aauugaauacuuugaaugu

SEQ ID NO: 3370938 - RNA, 21 nt, Human
aauugaauacuuugaaugugu

SEQ ID NO: 3370939 - RNA, 14 nt, Human
aauugaauauuauu

SEQ ID NO: 3370940 - RNA, 22 nt, Human
aauugaaucacugcucacacug

SEQ ID NO: 3370941 - RNA, 18 nt, Human
aauugaaugcaaaccaua

SEQ ID NO: 3370942 - RNA, 13 nt, Human
aauugaauuuaac

SEQ ID NO: 3370943 - RNA, 15 nt, Human
aauugaauuuaacaa

SEQ ID NO: 3370944 - RNA, 18 nt, Human
aauugacagaucaagcug

SEQ ID NO: 3370945 - RNA, 23 nt, Human
aauugacagaucaagcugugaga

SEQ ID NO: 3370946 - RNA, 14 nt, Human
aauugacauugcuu

SEQ ID NO: 3370947 - RNA, 17 nt, Human
aauugaccaucugcuuu

SEQ ID NO: 3370948 - RNA, 18 nt, Human
aauugaccaucugcuuuu

SEQ ID NO: 3370949 - RNA, 19 nt, Human
aauugagaaaaauauauac

SEQ ID NO: 3370950 - RNA, 21 nt, Human
aauugagaagcguauguuuuu

SEQ ID NO: 3370951 - RNA, 12 nt, Human
aauugagacagu

SEQ ID NO: 3370952 - RNA, 12 nt, Human
aauugagcacaa

SEQ ID NO: 3370953 - RNA, 18 nt, Human
aauugagcugcagaaacg

SEQ ID NO: 3370954 - RNA, 22 nt, Human
aauugagcugcuuuuuuugaaa

SEQ ID NO: 3370955 - RNA, 16 nt, Human
aauugaguaauggugu

SEQ ID NO: 3370956 - RNA, 13 nt, Human
aauugauguguuu

SEQ ID NO: 3370957 - RNA, 15 nt, Human
aauugauguugaugc

SEQ ID NO: 3370958 - RNA, 21 nt, Human
aauugauuucuuuucuuccug

SEQ ID NO: 3370959 - RNA, 14 nt, Human
aauugauuuugaac

SEQ ID NO: 3370960 - RNA, 18 nt, Human
aauugcaaaucuugaaau

SEQ ID NO: 3370961 - RNA, 21 nt, Human
aauugcaauuuuaacacacau

SEQ ID NO: 3370962 - RNA, 20 nt, Human
aauugcacagaaguccugua

SEQ ID NO: 3370963 - RNA, 20 nt, Human
aauugcagauaacuuugacu

SEQ ID NO: 3370964 - RNA, 16 nt, Human
aauugcauacuuugua

SEQ ID NO: 3370965 - RNA, 22 nt, Human
aauugcauacuuuguauuuuga

SEQ ID NO: 3370966 - RNA, 18 nt, Human
aauugcaugcugcuuuaa

SEQ ID NO: 3370967 - RNA, 20 nt, Human
aauugcauugacuuucccca

SEQ ID NO: 3370968 - RNA, 16 nt, Human
aauugcauuugcuuuu

SEQ ID NO: 3370969 - RNA, 12 nt, Human
aauugccauauu

SEQ ID NO: 3370970 - RNA, 19 nt, Human
aauugccauauugcacaug

SEQ ID NO: 3370971 - RNA, 23 nt, Human
aauugccauauugcacaugucuu

SEQ ID NO: 3370972 - RNA, 19 nt, Human
aauugccugcagagagaag

SEQ ID NO: 3370973 - RNA, 20 nt, Human
aauugccuuuuuucuguaua

SEQ ID NO: 3370974 - RNA, 23 nt, Human
aauugccuuuuuucuguauaaau

SEQ ID NO: 3370975 - RNA, 16 nt, Human
aauugcguuggucucu

SEQ ID NO: 3370976 - RNA, 14 nt, Human
aauugcuauugugu

SEQ ID NO: 3370977 - RNA, 21 nt, Human
aauugcucaugcauaguccca

SEQ ID NO: 3370978 - RNA, 23 nt, Human
aauugcugaagggcauucuuucc

SEQ ID NO: 3370979 - RNA, 13 nt, Human
aauugcugaggca

SEQ ID NO: 3370980 - RNA, 20 nt, Human
aauugcuguugaaagcaaaa

SEQ ID NO: 3370981 - RNA, 15 nt, Human
aauugcuuacauuuu

SEQ ID NO: 3370982 - RNA, 19 nt, Human
aauugcuuacucauuaaaa

SEQ ID NO: 3370983 - RNA, 22 nt, Human
aauugcuuauuuauuguauucu

SEQ ID NO: 3370984 - RNA, 15 nt, Human
aauugcuugaaagaa

SEQ ID NO: 3370985 - RNA, 23 nt, Human
aauugcuugguuguaauuaaauu

SEQ ID NO: 3370986 - RNA, 19 nt, Human
aauugcuuguuugcuucaa

SEQ ID NO: 3370987 - RNA, 15 nt, Human
aauuggaaaagacua

SEQ ID NO: 3370988 - RNA, 18 nt, Human
aauuggaagucuaagaac

SEQ ID NO: 3370989 - RNA, 22 nt, Human
aauuggaguuggaguagaaugu

SEQ ID NO: 3370990 - RNA, 11 nt, Human
aauuggauuuc

SEQ ID NO: 3370991 - RNA, 11 nt, Human
aauuggcagca

SEQ ID NO: 3370992 - RNA, 14 nt, Human
aauuggcagcagau

SEQ ID NO: 3370993 - RNA, 22 nt, Human
aauuggcagcagauuuuaggaa

SEQ ID NO: 3370994 - RNA, 18 nt, Human
aauuggcauguguauguu

SEQ ID NO: 3370995 - RNA, 21 nt, Human
aauugggagcuugggaaugga

SEQ ID NO: 3370996 - RNA, 21 nt, Human
aauugggaguccaggcacagg

SEQ ID NO: 3370997 - RNA, 15 nt, Human
aauugggcacuauuu

SEQ ID NO: 3370998 - RNA, 19 nt, Human
aauugggccagcuuuucaa

SEQ ID NO: 3370999 - RNA, 20 nt, Human
aauugggccagcuuuucaaa

SEQ ID NO: 3371000 - RNA, 23 nt, Human
aauugguacuuuuaaaaacauaa

SEQ ID NO: 3371001 - RNA, 20 nt, Human
aauugguuaucaugggaaag

SEQ ID NO: 3371002 - RNA, 15 nt, Human
aauugguucuuuauu

SEQ ID NO: 3371003 - RNA, 11 nt, Human
aauuguaaaag

SEQ ID NO: 3371004 - RNA, 14 nt, Human
aauaauguuucaaa

SEQ ID NO: 3371005 - RNA, 19 nt, Human
aauaauguuucaaacauau

SEQ ID NO: 3371006 - RNA, 14 nt, Human
aauaauuauaugcu

SEQ ID NO: 3371007 - RNA, 22 nt, Human
aauaauuauaugcuauuucuau

SEQ ID NO: 3371008 - RNA, 20 nt, Human
aauaauuaugaguuugcuua

SEQ ID NO: 3371009 - RNA, 15 nt, Human
aauaauucauauucu

SEQ ID NO: 3371010 - RNA, 21 nt, Human
aauaauucugaguuuuguguu

SEQ ID NO: 3371011 - RNA, 14 nt, Human
aauaauucuuuuuu

SEQ ID NO: 3371012 - RNA, 23 nt, Human
aauaauucuuuuuuauuaaucac

SEQ ID NO: 3371013 - RNA, 13 nt, Human
aauaauugacagg

SEQ ID NO: 3371014 - RNA, 16 nt, Human
aauaauugcagaacua

SEQ ID NO: 3371015 - RNA, 12 nt, Human
aauaauuguugu

SEQ ID NO: 3371016 - RNA, 18 nt, Human
aauaauuuaacuacccuu

SEQ ID NO: 3371017 - RNA, 21 nt, Human
aauaauuuagacuucaagcau

SEQ ID NO: 3371018 - RNA, 15 nt, Human
aauaauuuauaguaa

SEQ ID NO: 3371019 - RNA, 16 nt, Human
aauaauuuauaguaau

SEQ ID NO: 3371020 - RNA, 13 nt, Human
aauaauuucuaau

SEQ ID NO: 3371021 - RNA, 17 nt, Human
aauaauuuguggugauu

SEQ ID NO: 3371022 - RNA, 18 nt, Human
aauaauuuucauuuugca

SEQ ID NO: 3371023 - RNA, 14 nt, Human
aauaauuuuguaau

SEQ ID NO: 3371024 - RNA, 19 nt, Human
aauaauuuuuauauuuaau

SEQ ID NO: 3371025 - RNA, 19 nt, Human
aauaauuuuuauauuugaa

SEQ ID NO: 3371026 - RNA, 21 nt, Human
aauacaaaaaucagccagaca

SEQ ID NO: 3371027 - RNA, 23 nt, Human
aauacaaaaaucagccagacaug

SEQ ID NO: 3371028 - RNA, 12 nt, Human
aauacaaaacuu

SEQ ID NO: 3371029 - RNA, 17 nt, Human
aauacaaacaccuggac

SEQ ID NO: 3371030 - RNA, 14 nt, Human
aauacaacaaagga

SEQ ID NO: 3371031 - RNA, 13 nt, Human
aauacaagguaua

SEQ ID NO: 3371032 - RNA, 17 nt, Human
aauacaagguauaauaa

SEQ ID NO: 3371033 - RNA, 19 nt, Human
aauacaagguauaauaaaa

SEQ ID NO: 3371034 - RNA, 20 nt, Human
aauacaaguucuauuuaagu

SEQ ID NO: 3371035 - RNA, 23 nt, Human
aauacaaguucuauuuaagugua

SEQ ID NO: 3371036 - RNA, 14 nt, Human
aauacaauaaguua

SEQ ID NO: 3371037 - RNA, 23 nt, Human
aauacaauuuuguuucuguacuu

SEQ ID NO: 3371038 - RNA, 18 nt, Human
aauacaauuuuuauuucu

SEQ ID NO: 3371039 - RNA, 23 nt, Human
aauacacauagcauguaauggua

SEQ ID NO: 3371040 - RNA, 21 nt, Human
aauacaccaccucacuccugu

SEQ ID NO: 3371041 - RNA, 16 nt, Human
aauacacuugcccugc

SEQ ID NO: 3371042 - RNA, 13 nt, Human
aauacagacacua

SEQ ID NO: 3371043 - RNA, 15 nt, Human
aauacagacuggaug

SEQ ID NO: 3371044 - RNA, 13 nt, Human
aauacagauaaau

SEQ ID NO: 3371045 - RNA, 23 nt, Human
aauacagauuuugauagcaaagc

SEQ ID NO: 3371046 - RNA, 18 nt, Human
aauacagcaacaauuuau

SEQ ID NO: 3371047 - RNA, 14 nt, Human
aauacagcagcaag

SEQ ID NO: 3371048 - RNA, 21 nt, Human
aauacagcagcaagaaaaaaa

SEQ ID NO: 3371049 - RNA, 13 nt, Human
aauacagcuuucu

SEQ ID NO: 3371050 - RNA, 19 nt, Human
aauacaggauuauuuugau

SEQ ID NO: 3371051 - RNA, 15 nt, Human
aauacaguacaggca

SEQ ID NO: 3371052 - RNA, 16 nt, Human
aauacaguacaggcag

SEQ ID NO: 3371053 - RNA, 20 nt, Human
aauacaguaucucagggccu

SEQ ID NO: 3371054 - RNA, 19 nt, Human
aauacaguuugucacauga

SEQ ID NO: 3371055 - RNA, 14 nt, Human
aauacauacgguca

SEQ ID NO: 3371056 - RNA, 14 nt, Human
aauacauagugaaa

SEQ ID NO: 3371057 - RNA, 21 nt, Human
aauacauaugauaaauuugac

SEQ ID NO: 3371058 - RNA, 23 nt, Human
aauacaugcuaagagaaguagaa

SEQ ID NO: 3371059 - RNA, 17 nt, Human
aauacauuaaagcaguc

SEQ ID NO: 3371060 - RNA, 16 nt, Human
aauagcuuuaaugaua

SEQ ID NO: 3371061 - RNA, 19 nt, Human
aauaggaaaaacugauuuu

SEQ ID NO: 3371062 - RNA, 11 nt, Human
aauaggaauaa

SEQ ID NO: 3371063 - RNA, 16 nt, Human
aauaggaauugguuuc

SEQ ID NO: 3371064 - RNA, 15 nt, Human
aauaggacuuguuuu

SEQ ID NO: 3371065 - RNA, 23 nt, Human
aauaggagaggaugagagcccag

SEQ ID NO: 3371066 - RNA, 21 nt, Human
aauaggaguggugauuugaaa

SEQ ID NO: 3371067 - RNA, 15 nt, Human
aauaggauuuuuaga

SEQ ID NO: 3371068 - RNA, 15 nt, Human
aauaggcacuuuaaa

SEQ ID NO: 3371069 - RNA, 14 nt, Human
aauaggcaggaagc

SEQ ID NO: 3371070 - RNA, 16 nt, Human
aauaggcauuaacaca

SEQ ID NO: 3371071 - RNA, 18 nt, Human
aauaggcggggcuugccu

SEQ ID NO: 3371072 - RNA, 20 nt, Human
aauaggcuauuaaaaaaguc

SEQ ID NO: 3371073 - RNA, 21 nt, Human
aauaggcuauuaaaaaagucu

SEQ ID NO: 3371074 - RNA, 18 nt, Human
aauagggcuaggaauaua

SEQ ID NO: 3371075 - RNA, 16 nt, Human
aauaggggauauuuaa

SEQ ID NO: 3371076 - RNA, 19 nt, Human
aauaggguauauuuuccua

SEQ ID NO: 3371077 - RNA, 16 nt, Human
aauagguucuucuugu

SEQ ID NO: 3371078 - RNA, 12 nt, Human
aauaguaauaua

SEQ ID NO: 3371079 - RNA, 13 nt, Human
aauaguaauguuu

SEQ ID NO: 3371080 - RNA, 21 nt, Human
aauaguaauuuguaaaguugg

SEQ ID NO: 3371081 - RNA, 14 nt, Human
aauaguauccucca

SEQ ID NO: 3371082 - RNA, 15 nt, Human
aauaguauccuccag

SEQ ID NO: 3371083 - RNA, 17 nt, Human
aauaguauccuccaggu

SEQ ID NO: 3371084 - RNA, 17 nt, Human
aauaguaugaaaaugga

SEQ ID NO: 3371085 - RNA, 18 nt, Human
aauaguauuuaugaaaug

SEQ ID NO: 3371086 - RNA, 15 nt, Human
aauaguauuucccau

SEQ ID NO: 3371087 - RNA, 22 nt, Human
aauaguauuugagaguucuaaa

SEQ ID NO: 3371088 - RNA, 13 nt, Human
aauagucaagaaa

SEQ ID NO: 3371089 - RNA, 20 nt, Human
aauagucuagauggcuccuc

SEQ ID NO: 3371090 - RNA, 14 nt, Human
aauagucuguguga

SEQ ID NO: 3371091 - RNA, 16 nt, Human
aauagucuuugccagu

SEQ ID NO: 3371092 - RNA, 13 nt, Human
aauagugaaauga

SEQ ID NO: 3371093 - RNA, 15 nt, Human
aauagugaaaugaau

SEQ ID NO: 3371094 - RNA, 16 nt, Human
aauaguggugugauuu

SEQ ID NO: 3371095 - RNA, 22 nt, Human
aauaguggugugauuuggggau

SEQ ID NO: 3371096 - RNA, 23 nt, Human
aauagugucauccucacagugaa

SEQ ID NO: 3371097 - RNA, 20 nt, Human
aauaguguccuaugcaauaa

SEQ ID NO: 3371098 - RNA, 21 nt, Human
aauaguguccuaugcaauaaa

SEQ ID NO: 3371099 - RNA, 22 nt, Human
aauaguguccuaugcaauaaaa

SEQ ID NO: 3371100 - RNA, 23 nt, Human
aauaguguccuaugcaauaaaau

SEQ ID NO: 3371101 - RNA, 16 nt, Human
aauagugugaaauaua

SEQ ID NO: 3371102 - RNA, 15 nt, Human
aauaguguguucuga

SEQ ID NO: 3371103 - RNA, 19 nt, Human
aauaguguuaaucaauuua

SEQ ID NO: 3371104 - RNA, 23 nt, Human
aauaguuaagacaugauuuccuu

SEQ ID NO: 3371105 - RNA, 15 nt, Human
aauaguuacuccagu

SEQ ID NO: 3371106 - RNA, 12 nt, Human
aauaguucaagg

SEQ ID NO: 3371107 - RNA, 21 nt, Human
aauaguucagguaacaggcag

SEQ ID NO: 3371108 - RNA, 11 nt, Human
aauaguuccug

SEQ ID NO: 3371109 - RNA, 13 nt, Human
aauaguuccugcu

SEQ ID NO: 3371110 - RNA, 11 nt, Human
aauaguucugu

SEQ ID NO: 3371111 - RNA, 12 nt, Human
aauaguugaauu

SEQ ID NO: 3371112 - RNA, 16 nt, Human
aauaguugagccagca

SEQ ID NO: 3371113 - RNA, 14 nt, Human
aauaguugagcccc

SEQ ID NO: 3371114 - RNA, 19 nt, Human
aauaguuuacauguaguag

SEQ ID NO: 3371115 - RNA, 22 nt, Human
aauaguuuauuuuaaaacaaua

SEQ ID NO: 3371116 - RNA, 16 nt, Human
aauaguuugucuauuu

SEQ ID NO: 3371117 - RNA, 18 nt, Human
aauaguuugucuauuuua

SEQ ID NO: 3371118 - RNA, 19 nt, Human
aauaguuugucuauuuuaa

SEQ ID NO: 3371119 - RNA, 22 nt, Human
aauaguuuuauuaauaaacauu

SEQ ID NO: 3371120 - RNA, 14 nt, Human
aauaguuuuuucuu

SEQ ID NO: 3371121 - RNA, 12 nt, Human
aauauaaaaaau

SEQ ID NO: 3371122 - RNA, 16 nt, Human
aauauaaaaaaucaug

SEQ ID NO: 3371123 - RNA, 22 nt, Human
aauauaaaaggcaaauguguac

SEQ ID NO: 3371124 - RNA, 22 nt, Human
aauauaaaauaguuguccauau

SEQ ID NO: 3371125 - RNA, 23 nt, Human
aauauaaaauaugaagacauaaa

SEQ ID NO: 3371126 - RNA, 15 nt, Human
aauauaaaauuauga

SEQ ID NO: 3371127 - RNA, 12 nt, Human
aauauaaacauc

SEQ ID NO: 3371128 - RNA, 12 nt, Human
aauauaaagacg

SEQ ID NO: 3371129 - RNA, 23 nt, Human
aauauaaagacguuuuauaagca

SEQ ID NO: 3371130 - RNA, 20 nt, Human
aauauaaaugcaaauaacaa

SEQ ID NO: 3371131 - RNA, 12 nt, Human
aauauaaauguu

SEQ ID NO: 3371132 - RNA, 16 nt, Human
aauauaacaugaaaug

SEQ ID NO: 3371133 - RNA, 16 nt, Human
aauauaagaauaaaau

SEQ ID NO: 3371134 - RNA, 13 nt, Human
aauauaagauuuu

SEQ ID NO: 3371135 - RNA, 21 nt, Human
aauauaaggaaagcaauaaau

SEQ ID NO: 3371136 - RNA, 17 nt, Human
aauauaaguaaagugau

SEQ ID NO: 3371137 - RNA, 17 nt, Human
aauauaaguuucuuugc

SEQ ID NO: 3371138 - RNA, 14 nt, Human
aauauaauauuguc

SEQ ID NO: 3371139 - RNA, 11 nt, Human
aauauaauuau

SEQ ID NO: 3371140 - RNA, 14 nt, Human
aauauaauuaucgg

SEQ ID NO: 3371141 - RNA, 13 nt, Human
aauauaauucugu

SEQ ID NO: 3371142 - RNA, 18 nt, Human
aauauacauguuuaugua

SEQ ID NO: 3371143 - RNA, 18 nt, Human
aauauacauucaaacuua

SEQ ID NO: 3371144 - RNA, 15 nt, Human
aauauacuguaaaga

SEQ ID NO: 3371145 - RNA, 18 nt, Human
aauauacuguaaagaaag

SEQ ID NO: 3371146 - RNA, 21 nt, Human
aauauacuguaaagaaagaga

SEQ ID NO: 3371147 - RNA, 17 nt, Human
aauauacuuguggacua

SEQ ID NO: 3371148 - RNA, 22 nt, Human
aauauacuuguggacuaaaaga

SEQ ID NO: 3371149 - RNA, 20 nt, Human
aauauagaauuuuuaauguu

SEQ ID NO: 3371150 - RNA, 21 nt, Human
aauauagaucaguuauaagua

SEQ ID NO: 3371151 - RNA, 13 nt, Human
aauauagcuauuu

SEQ ID NO: 3371152 - RNA, 16 nt, Human
aauauagcuguacaaa

SEQ ID NO: 3371153 - RNA, 16 nt, Human
aauauaggaacuuaaa

SEQ ID NO: 3371154 - RNA, 18 nt, Human
aauauaggaacuuaaaua

SEQ ID NO: 3371155 - RNA, 18 nt, Human
aauauauaaaaagaaaag

SEQ ID NO: 3371156 - RNA, 17 nt, Human
aauauauaaaaauauau

SEQ ID NO: 3371157 - RNA, 19 nt, Human
aauauauaaaaauauauau

SEQ ID NO: 3371158 - RNA, 20 nt, Human
aauauauaaaaauauauaua

SEQ ID NO: 3371159 - RNA, 14 nt, Human
aauauauaaauaua

SEQ ID NO: 3371160 - RNA, 14 nt, Human
aauauauaauuuau

SEQ ID NO: 3371161 - RNA, 19 nt, Human
aauauauacgaacaaaaca

SEQ ID NO: 3371162 - RNA, 10 nt, Human
aauauauaua

SEQ ID NO: 3371163 - RNA, 14 nt, Human
aauauauauaaacc

SEQ ID NO: 3371164 - RNA, 15 nt, Human
aauauauauaaaccu

SEQ ID NO: 3371165 - RNA, 19 nt, Human
aauauauauaaauauauau

SEQ ID NO: 3371166 - RNA, 12 nt, Human
aauauauauaca

SEQ ID NO: 3371167 - RNA, 19 nt, Human
aauauauauauauauaaaa

SEQ ID NO: 3371168 - RNA, 16 nt, Human
aauauauaucaaauau

SEQ ID NO: 3371169 - RNA, 22 nt, Human
aauauauauguugauuucuugu

SEQ ID NO: 3371170 - RNA, 23 nt, Human
aauuucaacgccugccuuuggca

SEQ ID NO: 3371171 - RNA, 23 nt, Human
aauuucagacucccauuccugaa

SEQ ID NO: 3371172 - RNA, 21 nt, Human
aauuucagcuucuauauauug

SEQ ID NO: 3371173 - RNA, 12 nt, Human
aauuucagggug

SEQ ID NO: 3371174 - RNA, 16 nt, Human
aauuucagggugcagc

SEQ ID NO: 3371175 - RNA, 23 nt, Human
aauuucaguccuguaguuuuauu

SEQ ID NO: 3371176 - RNA, 18 nt, Human
aauuucauaugcuguaua

SEQ ID NO: 3371177 - RNA, 21 nt, Human
aauuuccacaaaaucugucca

SEQ ID NO: 3371178 - RNA, 22 nt, Human
aauuuccauuuacuuaagacuu

SEQ ID NO: 3371179 - RNA, 12 nt, Human
aauuucccagga

SEQ ID NO: 3371180 - RNA, 22 nt, Human
aauuucccaggacccugaaggg

SEQ ID NO: 3371181 - RNA, 15 nt, Human
aauuuccccaacagu

SEQ ID NO: 3371182 - RNA, 21 nt, Human
aauuuccccaacagugugaag

SEQ ID NO: 3371183 - RNA, 17 nt, Human
aauuucccuucuugcau

SEQ ID NO: 3371184 - RNA, 13 nt, Human
aauuuccucuauu

SEQ ID NO: 3371185 - RNA, 15 nt, Human
aauuuccugggagcu

SEQ ID NO: 3371186 - RNA, 21 nt, Human
aauuuccugggagcuuuugua

SEQ ID NO: 3371187 - RNA, 21 nt, Human
aauuuccuguuggauuuguuu

SEQ ID NO: 3371188 - RNA, 21 nt, Human
aauuuccuuuauauuuaguga

SEQ ID NO: 3371189 - RNA, 21 nt, Human
aauuucgccguugaagaggaa

SEQ ID NO: 3371190 - RNA, 15 nt, Human
aauuucuaaagauaa

SEQ ID NO: 3371191 - RNA, 16 nt, Human
aauuucuaaagauaau

SEQ ID NO: 3371192 - RNA, 21 nt, Human
aauuucuaaaucuccaaaaua

SEQ ID NO: 3371193 - RNA, 16 nt, Human
aauuucuaccauuuca

SEQ ID NO: 3371194 - RNA, 11 nt, Human
aauuucuacua

SEQ ID NO: 3371195 - RNA, 15 nt, Human
aauuucuacuuugaa

SEQ ID NO: 3371196 - RNA, 17 nt, Human
aauuucuacuuugaagu

SEQ ID NO: 3371197 - RNA, 17 nt, Human
aauuucuaggacugaau

SEQ ID NO: 3371198 - RNA, 20 nt, Human
aauuucucccagucauuuaa

SEQ ID NO: 3371199 - RNA, 14 nt, Human
aauuucuccucccu

SEQ ID NO: 3371200 - RNA, 16 nt, Human
aauuucucuacugucu

SEQ ID NO: 3371201 - RNA, 18 nt, Human
aauuucugucagaaugcu

SEQ ID NO: 3371202 - RNA, 13 nt, Human
aauuucuguccuu

SEQ ID NO: 3371203 - RNA, 21 nt, Human
aauuucuuacuaaacauuuug

SEQ ID NO: 3371204 - RNA, 15 nt, Human
aauuucuuaugugac

SEQ ID NO: 3371205 - RNA, 22 nt, Human
acagcagcaagaaaaaaaaaug

SEQ ID NO: 3371206 - RNA, 15 nt, Human
acagcagccuccaac

SEQ ID NO: 3371207 - RNA, 16 nt, Human
acagcagccucugaag

SEQ ID NO: 3371208 - RNA, 17 nt, Human
acagcagccucugaagu

SEQ ID NO: 3371209 - RNA, 11 nt, Human
acagcagccug

SEQ ID NO: 3371210 - RNA, 15 nt, Human
acagcagcucaggca

SEQ ID NO: 3371211 - RNA, 16 nt, Human
acagcagcucaggcac

SEQ ID NO: 3371212 - RNA, 14 nt, Human
acagcagcugaaca

SEQ ID NO: 3371213 - RNA, 12 nt, Human
acagcagcuuca

SEQ ID NO: 3371214 - RNA, 17 nt, Human
acagcagcuucaccaga

SEQ ID NO: 3371215 - RNA, 18 nt, Human
acagcagcuucaccagag

SEQ ID NO: 3371216 - RNA, 22 nt, Human
acagcaggccagguccagagag

SEQ ID NO: 3371217 - RNA, 15 nt, Human
acagcaggcccaccu

SEQ ID NO: 3371218 - RNA, 20 nt, Human
acagcaggcccaccuaccuu

SEQ ID NO: 3371219 - RNA, 16 nt, Human
acagcaggcugccagu

SEQ ID NO: 3371220 - RNA, 13 nt, Human
acagcaguagaca

SEQ ID NO: 3371221 - RNA, 22 nt, Human
acagcagucuuaugcuuccaga

SEQ ID NO: 3371222 - RNA, 17 nt, Human
acagcagugucaucaga

SEQ ID NO: 3371223 - RNA, 18 nt, Human
acagcaguugaaaagacu

SEQ ID NO: 3371224 - RNA, 23 nt, Human
acagcaguugaaaagacuccaaa

SEQ ID NO: 3371225 - RNA, 16 nt, Human
acagcaguuucaggua

SEQ ID NO: 3371226 - RNA, 17 nt, Human
acaaugaaguugaaaau

SEQ ID NO: 3371227 - RNA, 21 nt, Human
acaaugaaguugaaaaucaua

SEQ ID NO: 3371228 - RNA, 15 nt, Human
acaaugaaugucuuu

SEQ ID NO: 3371229 - RNA, 21 nt, Human
acaaugacauacgcuuuuaau

SEQ ID NO: 3371230 - RNA, 20 nt, Human
acaaugacuaauucuugcau

SEQ ID NO: 3371231 - RNA, 18 nt, Human
acaaugacuuacuguaca

SEQ ID NO: 3371232 - RNA, 13 nt, Human
acaaugacuuuau

SEQ ID NO: 3371233 - RNA, 19 nt, Human
acaaugaugaugauaauga

SEQ ID NO: 3371234 - RNA, 20 nt, Human
acaaugaugcccugcuccag

SEQ ID NO: 3371235 - RNA, 16 nt, Human
acaaugcaaaaccuuu

SEQ ID NO: 3371236 - RNA, 11 nt, Human
acaaugcaaac

SEQ ID NO: 3371237 - RNA, 21 nt, Human
acaaugcaaaccaucauugaa

SEQ ID NO: 3371238 - RNA, 20 nt, Human
acaaugcagaugccagagca

SEQ ID NO: 3371239 - RNA, 16 nt, Human
acaaugccuauuguaa

SEQ ID NO: 3371240 - RNA, 19 nt, Human
acaaugcgaaugguagucu

SEQ ID NO: 3371241 - RNA, 21 nt, Human
acaaugcgaaugguagucuaa

SEQ ID NO: 3371242 - RNA, 14 nt, Human
acaaugcuguauuu

SEQ ID NO: 3371243 - RNA, 22 nt, Human
acaaugcuguauuuuaaaagaa

SEQ ID NO: 3371244 - RNA, 16 nt, Human
acaauggaccggagag

SEQ ID NO: 3371245 - RNA, 23 nt, Human
acaauggaccggagagugggggu

SEQ ID NO: 3371246 - RNA, 15 nt, Human
acaauggaguauucu

SEQ ID NO: 3371247 - RNA, 13 nt, Human
acaauggcagaug

SEQ ID NO: 3371248 - RNA, 17 nt, Human
acaauggggauguugug

SEQ ID NO: 3371249 - RNA, 15 nt, Human
acaaugguuuucuug

SEQ ID NO: 3371250 - RNA, 18 nt, Human
acaaugguuuuuaaauuu

SEQ ID NO: 3371251 - RNA, 12 nt, Human
acaauguaauua

SEQ ID NO: 3371252 - RNA, 13 nt, Human
acaauguaauuau

SEQ ID NO: 3371253 - RNA, 21 nt, Human
acaauguagauaaguguucug

SEQ ID NO: 3371254 - RNA, 14 nt, Human
acaauguauuuauu

SEQ ID NO: 3371255 - RNA, 17 nt, Human
acaauguauuuauuuaa

SEQ ID NO: 3371256 - RNA, 20 nt, Human
acaauguauuuauuuaaaag

SEQ ID NO: 3371257 - RNA, 11 nt, Human
acaaugucuug

SEQ ID NO: 3371258 - RNA, 22 nt, Human
acaaugugaacuuuauuaaaua

SEQ ID NO: 3371259 - RNA, 14 nt, Human
acaauguuaaggaa

SEQ ID NO: 3371260 - RNA, 20 nt, Human
acaauguuaaggaaacucuu

SEQ ID NO: 3371261 - RNA, 22 nt, Human
acaauguuaaggaaacucuuau

SEQ ID NO: 3371262 - RNA, 14 nt, Human
acaauguucuuuau

SEQ ID NO: 3371263 - RNA, 16 nt, Human
acaauguucuuuauau

SEQ ID NO: 3371264 - RNA, 17 nt, Human
acaauguucuuuauaua

SEQ ID NO: 3371265 - RNA, 16 nt, Human
acaauguuuuaacaag

SEQ ID NO: 3371266 - RNA, 14 nt, Human
acaauuagauuucu

SEQ ID NO: 3371267 - RNA, 21 nt, Human
acaauuaggcagacucuuuau

SEQ ID NO: 3371268 - RNA, 23 nt, Human
acaauuauaaacucauuuugcuu

SEQ ID NO: 3371269 - RNA, 18 nt, Human
acaauuauaucaguccuc

SEQ ID NO: 3371270 - RNA, 17 nt, Human
acaauuauuuaaagcaa

SEQ ID NO: 3371271 - RNA, 14 nt, Human
acaauucagcauua

SEQ ID NO: 3371272 - RNA, 14 nt, Human
acaauucaugaacu

SEQ ID NO: 3371273 - RNA, 19 nt, Human
acaauuccuagauaaaaag

SEQ ID NO: 3371274 - RNA, 22 nt, Human
acaauuccuagauaaaaagaug

SEQ ID NO: 3371275 - RNA, 22 nt, Human
acaauuccucuacuaacaauca

SEQ ID NO: 3371276 - RNA, 14 nt, Human
acaauucuaaaaug

SEQ ID NO: 3371277 - RNA, 22 nt, Human
acaauucuguuuuagguuaaaa

SEQ ID NO: 3371278 - RNA, 15 nt, Human
acaauucuguuuuua

SEQ ID NO: 3371279 - RNA, 13 nt, Human
acaauucuuuaua

SEQ ID NO: 3371280 - RNA, 15 nt, Human
acaauucuuuauaca

SEQ ID NO: 3371281 - RNA, 17 nt, Human
acaauugaacuuaaaua

SEQ ID NO: 3371282 - RNA, 12 nt, Human
acaauuguaaua

SEQ ID NO: 3371283 - RNA, 19 nt, Human
acaauugugggcauaaacu

SEQ ID NO: 3371284 - RNA, 16 nt, Human
acaauuguguagccuu

SEQ ID NO: 3371285 - RNA, 18 nt, Human
acaauuguguagccuuuu

SEQ ID NO: 3371286 - RNA, 12 nt, Human
acaauuguuugu

SEQ ID NO: 3371287 - RNA, 16 nt, Human
acaauuguuuuaaucu

SEQ ID NO: 3371288 - RNA, 19 nt, Human
acaauuuacaaagugugua

SEQ ID NO: 3371289 - RNA, 19 nt, Human
acaauuucaaaaaaauaaa

SEQ ID NO: 3371290 - RNA, 23 nt, Human
acaauuuccuuuauauuuaguga

SEQ ID NO: 3371291 - RNA, 11 nt, Human
acaauuucugu

SEQ ID NO: 3371292 - RNA, 13 nt, Human
acaauuucuuuug

SEQ ID NO: 3371293 - RNA, 21 nt, Human
acaauuugagauguauuucaa

SEQ ID NO: 3371294 - RNA, 17 nt, Human
acaauuugauacauaau

SEQ ID NO: 3371295 - RNA, 18 nt, Human
acaauuugauacauaaua

SEQ ID NO: 3371296 - RNA, 20 nt, Human
acaauuugcacuaaaucaga

SEQ ID NO: 3371297 - RNA, 15 nt, Human
acaauuuucagauuu

SEQ ID NO: 3371298 - RNA, 17 nt, Human
acaauuuucagauuugc

SEQ ID NO: 3371299 - RNA, 18 nt, Human
acaauuuucagauuugca

SEQ ID NO: 3371300 - RNA, 20 nt, Human
acaauuuucagauuugcaca

SEQ ID NO: 3371301 - RNA, 15 nt, Human
acaauuuuguacaaa

SEQ ID NO: 3371302 - RNA, 13 nt, Human
acaauuuuuaaug

SEQ ID NO: 3371303 - RNA, 22 nt, Human
acaauuuuuuaucaugcauguc

SEQ ID NO: 3371304 - RNA, 24 nt, Human
acaauuuuuuuuauuaguauuguu

SEQ ID NO: 3371305 - RNA, 21 nt, Human
acacaaaacuccgcccccagc

SEQ ID NO: 3371306 - RNA, 14 nt, Human
acacaaacaaacaa

SEQ ID NO: 3371307 - RNA, 14 nt, Human
acacaaacacacac

SEQ ID NO: 3371308 - RNA, 20 nt, Human
acacaaaccacaacugacac

SEQ ID NO: 3371309 - RNA, 22 nt, Human
acacaaaccacaacugacacag

SEQ ID NO: 3371310 - RNA, 18 nt, Human
acacaaacgggcucagca

SEQ ID NO: 3371311 - RNA, 15 nt, Human
acacaaacguaugua

SEQ ID NO: 3371312 - RNA, 14 nt, Human
acacaaacuguaaa

SEQ ID NO: 3371313 - RNA, 13 nt, Human
acacaaagcuuuu

SEQ ID NO: 3371314 - RNA, 19 nt, Human
acacaaagcuuuugcauau

SEQ ID NO: 3371315 - RNA, 20 nt, Human
acacaaaggaagugcccccu

SEQ ID NO: 3371316 - RNA, 23 nt, Human
acacaaaggggaucauaaaguua

SEQ ID NO: 3371317 - RNA, 14 nt, Human
acacaaaugcaggg

SEQ ID NO: 3371318 - RNA, 13 nt, Human
acacaaaugcaug

SEQ ID NO: 3371319 - RNA, 20 nt, Human
acacaaaugcucaaagaaau

SEQ ID NO: 3371320 - RNA, 22 nt, Human
acacaaaugcucaaagaaaucu

SEQ ID NO: 3371321 - RNA, 12 nt, Human
acacaacaaaaa

SEQ ID NO: 3371322 - RNA, 17 nt, Human
acacaacaaaaauuuga

SEQ ID NO: 3371323 - RNA, 13 nt, Human
acacaacagccaa

SEQ ID NO: 3371324 - RNA, 13 nt, Human
acacaacuauauu

SEQ ID NO: 3371325 - RNA, 14 nt, Human
acacaacuauauug

SEQ ID NO: 3371326 - RNA, 17 nt, Human
acacaacuauauuguuu

SEQ ID NO: 3371327 - RNA, 22 nt, Human
acacaagaagaagggcacccua

SEQ ID NO: 3371328 - RNA, 19 nt, Human
acacaagaccagugcuuag

SEQ ID NO: 3371329 - RNA, 19 nt, Human
acacaagauugguguuuuu

SEQ ID NO: 3371330 - RNA, 21 nt, Human
acacaagauugguguuuuuuu

SEQ ID NO: 3371331 - RNA, 23 nt, Human
acacaagauugguguuuuuuucu

SEQ ID NO: 3371332 - RNA, 23 nt, Human
acacaaggauagaugcuggccca

SEQ ID NO: 3371333 - RNA, 20 nt, Human
acacaaggggcccuuggagc

SEQ ID NO: 3371334 - RNA, 21 nt, Human
acacaaggucauggccacacu

SEQ ID NO: 3371335 - RNA, 23 nt, Human
acacaaggucauggccacacugu

SEQ ID NO: 3371336 - RNA, 12 nt, Human
acacaauacaau

SEQ ID NO: 3371337 - RNA, 23 nt, Human
acacaaugguuuuuaaauuuugu

SEQ ID NO: 3371338 - RNA, 23 nt, Human
acacaaugugucuuucuuuuugg

SEQ ID NO: 3371339 - RNA, 12 nt, Human
acacaauguuau

SEQ ID NO: 3371340 - RNA, 21 nt, Human
acacaauuggaauugucuuua

SEQ ID NO: 3371341 - RNA, 13 nt, Human
acacacaacaaaa

SEQ ID NO: 3371342 - RNA, 14 nt, Human
acacacaacaaaaa

SEQ ID NO: 3371343 - RNA, 14 nt, Human
acacacaacagcca

SEQ ID NO: 3371344 - RNA, 17 nt, Human
acacacaacagccaaca

SEQ ID NO: 3371345 - RNA, 11 nt, Human
acacacacaca

SEQ ID NO: 3371346 - RNA, 15 nt, Human
acacacacacaaacc

SEQ ID NO: 3371347 - RNA, 14 nt, Human
acacacacacacaa

SEQ ID NO: 3371348 - RNA, 15 nt, Human
acacacacacacaag

SEQ ID NO: 3371349 - RNA, 16 nt, Human
acacacacacacagcc

SEQ ID NO: 3371350 - RNA, 14 nt, Human
acaccaaucuuacu

SEQ ID NO: 3371351 - RNA, 18 nt, Human
acaccaaucuuacuuugu

SEQ ID NO: 3371352 - RNA, 22 nt, Human
acaccaaucuuacuuuguaaau

SEQ ID NO: 3371353 - RNA, 11 nt, Human
acaccacacac

SEQ ID NO: 3371354 - RNA, 20 nt, Human
acaccacacacaacagccaa

SEQ ID NO: 3371355 - RNA, 14 nt, Human
acaccacacccagc

SEQ ID NO: 3371356 - RNA, 12 nt, Human
acaccacagaca

SEQ ID NO: 3371357 - RNA, 13 nt, Human
acaccacagacac

SEQ ID NO: 3371358 - RNA, 14 nt, Human
acaccacagacaca

SEQ ID NO: 3371359 - RNA, 17 nt, Human
acaccacagacacacac

SEQ ID NO: 3371360 - RNA, 22 nt, Human
acaccacagacacacacacgca

SEQ ID NO: 3371361 - RNA, 18 nt, Human
acaccaccucacuccugu

SEQ ID NO: 3371362 - RNA, 17 nt, Human
acaccacuacauucugu

SEQ ID NO: 3371363 - RNA, 22 nt, Human
acaccacucuggcagccacacu

SEQ ID NO: 3371364 - RNA, 16 nt, Human
acaccagccaggcucu

SEQ ID NO: 3371365 - RNA, 17 nt, Human
acaccagccaggcucug

SEQ ID NO: 3371366 - RNA, 17 nt, Human
acaccagccccugcccc

SEQ ID NO: 3371367 - RNA, 19 nt, Human
acaccagccucgucuucau

SEQ ID NO: 3371368 - RNA, 15 nt, Human
acaccagcuguucug

SEQ ID NO: 3371369 - RNA, 23 nt, Human
acaccagcuguucugucccuugg

SEQ ID NO: 3371370 - RNA, 21 nt, Human
acaccaggccguccucccggg

SEQ ID NO: 3371371 - RNA, 12 nt, Human
acaccaggcugu

SEQ ID NO: 3371372 - RNA, 18 nt, Human
acaccaggcugugggccu

SEQ ID NO: 3371373 - RNA, 21 nt, Human
acaccaggcuugccugcaggc

SEQ ID NO: 3371374 - RNA, 19 nt, Human
acaccauaagcuacugcca

SEQ ID NO: 3371375 - RNA, 21 nt, Human
acaccauagguagaauguaaa

SEQ ID NO: 3371376 - RNA, 21 nt, Human
acaccaucacagcuuguuuug

SEQ ID NO: 3371377 - RNA, 20 nt, Human
acaccaugauuccuuuaaca

SEQ ID NO: 3371378 - RNA, 20 nt, Human
acaccauuaccaaaauaaua

SEQ ID NO: 3371379 - RNA, 17 nt, Human
acaccauuaugugcgcu

SEQ ID NO: 3371380 - RNA, 17 nt, Human
acaccauugaaggcuua

SEQ ID NO: 3371381 - RNA, 13 nt, Human
aaucuugaaaaug

SEQ ID NO: 3371382 - RNA, 15 nt, Human
aaucuugcuuucuuu

SEQ ID NO: 3371383 - RNA, 18 nt, Human
aaucuugcuuucuuuguu

SEQ ID NO: 3371384 - RNA, 23 nt, Human
aaucuuggaaguacaugaauaca

SEQ ID NO: 3371385 - RNA, 19 nt, Human
aaucuugggggguuuuuac

SEQ ID NO: 3371386 - RNA, 19 nt, Human
aaucuugguugaugccaaa

SEQ ID NO: 3371387 - RNA, 16 nt, Human
aaucuugucaugugua

SEQ ID NO: 3371388 - RNA, 16 nt, Human
aaucuugugcuagaau

SEQ ID NO: 3371389 - RNA, 20 nt, Human
aaucuugugcuagaauacuu

SEQ ID NO: 3371390 - RNA, 19 nt, Human
aaucuuguugguucaccau

SEQ ID NO: 3371391 - RNA, 14 nt, Human
aaucuuguuuccaa

SEQ ID NO: 3371392 - RNA, 17 nt, Human
aaucuuguuucugaaaa

SEQ ID NO: 3371393 - RNA, 17 nt, Human
aaucuuguuuugaaaau

SEQ ID NO: 3371394 - RNA, 19 nt, Human
aaucuuuaaaaaaaaaauu

SEQ ID NO: 3371395 - RNA, 23 nt, Human
aaucuuuaccuguauacagugca

SEQ ID NO: 3371396 - RNA, 15 nt, Human
aaucuuuauugagaa

SEQ ID NO: 3371397 - RNA, 13 nt, Human
aaucuuuccaaau

SEQ ID NO: 3371398 - RNA, 13 nt, Human
aaucuuucugcag

SEQ ID NO: 3371399 - RNA, 19 nt, Human
aaucuuucuuuaccugaga

SEQ ID NO: 3371400 - RNA, 22 nt, Human
aaucuuucuuuaccugagacca

SEQ ID NO: 3371401 - RNA, 14 nt, Human
aaucuuucuuucuu

SEQ ID NO: 3371402 - RNA, 20 nt, Human
aaucuuucuuucuuagaaau

SEQ ID NO: 3371403 - RNA, 21 nt, Human
aaucuuucuuucuuagaaauu

SEQ ID NO: 3371404 - RNA, 22 nt, Human
aaucuuucuuucuuagaaauuu

SEQ ID NO: 3371405 - RNA, 23 nt, Human
aaucuuuguaccaaaauuuuaaa

SEQ ID NO: 3371406 - RNA, 16 nt, Human
aaucuuuuauaggauu

SEQ ID NO: 3371407 - RNA, 17 nt, Human
aaucuuuucacaaauaa

SEQ ID NO: 3371408 - RNA, 18 nt, Human
aaucuuuucacaaauaaa

SEQ ID NO: 3371409 - RNA, 14 nt, Human
aaucuuuucuuauu

SEQ ID NO: 3371410 - RNA, 18 nt, Human
aaucuuuugggggaaacu

SEQ ID NO: 3371411 - RNA, 14 nt, Human
aaugaaaaaaugua

SEQ ID NO: 3371412 - RNA, 12 nt, Human
aaugaaaaauga

SEQ ID NO: 3371413 - RNA, 16 nt, Human
aaugaaaaaugaaaga

SEQ ID NO: 3371414 - RNA, 19 nt, Human
aaugaaaaauuccacucaa

SEQ ID NO: 3371415 - RNA, 21 nt, Human
aaugaaaaauuuaagcauugu

SEQ ID NO: 3371416 - RNA, 22 nt, Human
aaugaaaaauuuaagcauuguu

SEQ ID NO: 3371417 - RNA, 17 nt, Human
aaugaaaacaaugcagu

SEQ ID NO: 3371418 - RNA, 18 nt, Human
aaugaaaacaguguguaa

SEQ ID NO: 3371419 - RNA, 15 nt, Human
aaugaaaaccacauu

SEQ ID NO: 3371420 - RNA, 18 nt, Human
aaugaaaacucuuugcug

SEQ ID NO: 3371421 - RNA, 17 nt, Human
aaugaaaagcugaaucc

SEQ ID NO: 3371422 - RNA, 19 nt, Human
aaugaaaagucguuuucca

SEQ ID NO: 3371423 - RNA, 21 nt, Human
aaugaaaagucguuuuccaaa

SEQ ID NO: 3371424 - RNA, 15 nt, Human
aaugaaaauaaguga

SEQ ID NO: 3371425 - RNA, 21 nt, Human
aaugaaaauaagugaauaaua

SEQ ID NO: 3371426 - RNA, 13 nt, Human
aaugaaaaugaau

SEQ ID NO: 3371427 - RNA, 12 nt, Human
aaugaaaauguc

SEQ ID NO: 3371428 - RNA, 20 nt, Human
aaugaaaaugucagaaacca

SEQ ID NO: 3371429 - RNA, 23 nt, Human
aaugaaaaugucagaaaccaguu

SEQ ID NO: 3371430 - RNA, 15 nt, Human
aaugaaaaugucuug

SEQ ID NO: 3371431 - RNA, 16 nt, Human
aaugaaaaugucuugu

SEQ ID NO: 3371432 - RNA, 14 nt, Human
aaugaaaauuguau

SEQ ID NO: 3371433 - RNA, 20 nt, Human
aaugaaacaaauaaucacau

SEQ ID NO: 3371434 - RNA, 14 nt, Human
aaugaaacccccac

SEQ ID NO: 3371435 - RNA, 19 nt, Human
aaugaaacccccacacaca

SEQ ID NO: 3371436 - RNA, 20 nt, Human
aaugaaacccccacacacac

SEQ ID NO: 3371437 - RNA, 17 nt, Human
aaugaaaccugugucuc

SEQ ID NO: 3371438 - RNA, 19 nt, Human
aaugaaagaaaauugaguu

SEQ ID NO: 3371439 - RNA, 17 nt, Human
aaugaaagacuguacaa

SEQ ID NO: 3371440 - RNA, 18 nt, Human
aaugaaagacuguacaaa

SEQ ID NO: 3371441 - RNA, 16 nt, Human
aaugaaagauuaaaca

SEQ ID NO: 3371442 - RNA, 20 nt, Human
aaugaaagauuaaacagaug

SEQ ID NO: 3371443 - RNA, 17 nt, Human
aaugaaagcaugucuca

SEQ ID NO: 3371444 - RNA, 15 nt, Human
aaugaaagcaugugg

SEQ ID NO: 3371445 - RNA, 22 nt, Human
aaugaaagcauguggcauguuc

SEQ ID NO: 3371446 - RNA, 18 nt, Human
aaugaaagcuacucauag

SEQ ID NO: 3371447 - RNA, 17 nt, Human
aaugaaaguauaacuga

SEQ ID NO: 3371448 - RNA, 23 nt, Human
aaugaaagucuugugacuagugc

SEQ ID NO: 3371449 - RNA, 17 nt, Human
aaugaaagugaugacau

SEQ ID NO: 3371450 - RNA, 14 nt, Human
aaugaaauacacaa

SEQ ID NO: 3371451 - RNA, 23 nt, Human
aaugaaauaggagggaaaccuuu

SEQ ID NO: 3371452 - RNA, 14 nt, Human
aaugaaauaucugu

SEQ ID NO: 3371453 - RNA, 22 nt, Human
aaugaaauaucuguauuuaauu

SEQ ID NO: 3371454 - RNA, 18 nt, Human
aaugaaauauugcuguau

SEQ ID NO: 3371455 - RNA, 21 nt, Human
aaugaaauccugcuucagugu

SEQ ID NO: 3371456 - RNA, 17 nt, Human
aaugaaauccuuuuccu

SEQ ID NO: 3371457 - RNA, 14 nt, Human
aaugaaaugcauau

SEQ ID NO: 3371458 - RNA, 14 nt, Human
aaugaaauguaugc

SEQ ID NO: 3371459 - RNA, 15 nt, Human
aaugaaauguaugug

SEQ ID NO: 3371460 - RNA, 12 nt, Human
aaugaaauguuu

SEQ ID NO: 3371461 - RNA, 12 nt, Human
aaugaaauuuua

SEQ ID NO: 3371462 - RNA, 13 nt, Human
aaugaaauuuuac

SEQ ID NO: 3371463 - RNA, 14 nt, Human
aaugaaauuuuacc

SEQ ID NO: 3371464 - RNA, 16 nt, Human
aaugaaauuuuaccaa

SEQ ID NO: 3371465 - RNA, 14 nt, Human
aaugaacaaaauua

SEQ ID NO: 3371466 - RNA, 12 nt, Human
aaugaacaaaug

SEQ ID NO: 3371467 - RNA, 14 nt, Human
aaugaacaaauuga

SEQ ID NO: 3371468 - RNA, 21 nt, Human
aaugaacaagcauucucucca

SEQ ID NO: 3371469 - RNA, 14 nt, Human
aaugaacacaaauu

SEQ ID NO: 3371470 - RNA, 20 nt, Human
aaugaacacaaauuaugcua

SEQ ID NO: 3371471 - RNA, 21 nt, Human
aaugaacaucccuuuuucaau

SEQ ID NO: 3371472 - RNA, 17 nt, Human
aaugaaccacaucuugc

SEQ ID NO: 3371473 - RNA, 18 nt, Human
aaugaaccgcugaauaug

SEQ ID NO: 3371474 - RNA, 11 nt, Human
aaugaagaaag

SEQ ID NO: 3371475 - RNA, 13 nt, Human
aaugaagaauuua

SEQ ID NO: 3371476 - RNA, 16 nt, Human
aaugaagaauuuaaag

SEQ ID NO: 3371477 - RNA, 17 nt, Human
aaugaagauacugaaau

SEQ ID NO: 3371478 - RNA, 24 nt, Human
aaugaagaucuaaauaaaaugcua

SEQ ID NO: 3371479 - RNA, 22 nt, Human
aaugaagcagcuuuaaacaaau

SEQ ID NO: 3371480 - RNA, 14 nt, Human
aaugaagcaguauu

SEQ ID NO: 3371481 - RNA, 14 nt, Human
aaugaagcuugugu

SEQ ID NO: 3371482 - RNA, 19 nt, Human
aaugaagcuuguguaucca

SEQ ID NO: 3371483 - RNA, 22 nt, Human
aaugaaggcgggccugcaagcc

SEQ ID NO: 3371484 - RNA, 15 nt, Human
aaugaagguuuuugu

SEQ ID NO: 3371485 - RNA, 19 nt, Human
aaugaagguuuuuguaaag

SEQ ID NO: 3371486 - RNA, 22 nt, Human
aaugaagguuuuuguaaagauu

SEQ ID NO: 3371487 - RNA, 19 nt, Human
aaugaaguugaaaaucaua

SEQ ID NO: 3371488 - RNA, 17 nt, Human
aaugaaguuuauacagu

SEQ ID NO: 3371489 - RNA, 12 nt, Human
aaugaaguuuga

SEQ ID NO: 3371490 - RNA, 16 nt, Human
aaugaaguuugaaugu

SEQ ID NO: 3371491 - RNA, 17 nt, Human
aaugaaguuugaauguu

SEQ ID NO: 3371492 - RNA, 19 nt, Human
aaugaaguuugaauguuaa

SEQ ID NO: 3371493 - RNA, 22 nt, Human
aaugaaguuugaauguuaaaua

SEQ ID NO: 3371494 - RNA, 10 nt, Human
aaugaauaau

SEQ ID NO: 3371495 - RNA, 19 nt, Human
acaggguuuugccauguug

SEQ ID NO: 3371496 - RNA, 16 nt, Human
acagguaaaacagggc

SEQ ID NO: 3371497 - RNA, 15 nt, Human
acagguaccaguucu

SEQ ID NO: 3371498 - RNA, 19 nt, Human
acaggucaggggugacaca

SEQ ID NO: 3371499 - RNA, 20 nt, Human
acaggucaggggugacacag

SEQ ID NO: 3371500 - RNA, 13 nt, Human
acaggucccaaau

SEQ ID NO: 3371501 - RNA, 19 nt, Human
acaggucccaccuccagcc

SEQ ID NO: 3371502 - RNA, 20 nt, Human
acaggucccaccuccagccc

SEQ ID NO: 3371503 - RNA, 13 nt, Human
acagguccugauu

SEQ ID NO: 3371504 - RNA, 13 nt, Human
acaggucuagacu

SEQ ID NO: 3371505 - RNA, 16 nt, Human
acaggucucagaaucu

SEQ ID NO: 3371506 - RNA, 16 nt, Human
acaggucugggagagg

SEQ ID NO: 3371507 - RNA, 18 nt, Human
acaggugauuaacuugga

SEQ ID NO: 3371508 - RNA, 13 nt, Human
acaggugcccgcc

SEQ ID NO: 3371509 - RNA, 16 nt, Human
acagguggacacacaa

SEQ ID NO: 3371510 - RNA, 16 nt, Human
acagguggcaggacca

SEQ ID NO: 3371511 - RNA, 20 nt, Human
acagguggcaggaccaggac

SEQ ID NO: 3371512 - RNA, 15 nt, Human
acagguggugucacu

SEQ ID NO: 3371513 - RNA, 23 nt, Human
acagguggugucacugucccucc

SEQ ID NO: 3371514 - RNA, 22 nt, Human
acagguguccccagcccacugg

SEQ ID NO: 3371515 - RNA, 21 nt, Human
acaggugugagccaccacgcc

SEQ ID NO: 3371516 - RNA, 23 nt, Human
acaggugugagucaccaagccca

SEQ ID NO: 3371517 - RNA, 17 nt, Human
acaggugugguguaauu

SEQ ID NO: 3371518 - RNA, 14 nt, Human
acagguguuuauac

SEQ ID NO: 3371519 - RNA, 18 nt, Human
acagguguuuauaucucc

SEQ ID NO: 3371520 - RNA, 21 nt, Human
acagguuacaacagauuugug

SEQ ID NO: 3371521 - RNA, 15 nt, Human
acagguuagcugcuc

SEQ ID NO: 3371522 - RNA, 15 nt, Human
acagguuauaacagu

SEQ ID NO: 3371523 - RNA, 18 nt, Human
acagguuauaacaguguu

SEQ ID NO: 3371524 - RNA, 14 nt, Human
acagguuauuuuag

SEQ ID NO: 3371525 - RNA, 22 nt, Human
acagguuauuuuaguuucuguu

SEQ ID NO: 3371526 - RNA, 11 nt, Human
acagguuggga

SEQ ID NO: 3371527 - RNA, 15 nt, Human
acagguugggauggg

SEQ ID NO: 3371528 - RNA, 18 nt, Human
acagguuugggaccccug

SEQ ID NO: 3371529 - RNA, 13 nt, Human
acaguaaaaauaa

SEQ ID NO: 3371530 - RNA, 16 nt, Human
acaguaaaccacugaa

SEQ ID NO: 3371531 - RNA, 18 nt, Human
acaguaaaccacugaaaa

SEQ ID NO: 3371532 - RNA, 19 nt, Human
acaguaaaccacugaaaaa

SEQ ID NO: 3371533 - RNA, 21 nt, Human
acaguaaaccacugaaaaaau

SEQ ID NO: 3371534 - RNA, 22 nt, Human
acaguaaaccacugaaaaaaua

SEQ ID NO: 3371535 - RNA, 15 nt, Human
acaguaaauaaauug

SEQ ID NO: 3371536 - RNA, 23 nt, Human
acaguaaauaucccaaacuguga

SEQ ID NO: 3371537 - RNA, 17 nt, Human
acaguaacgcaggggaa

SEQ ID NO: 3371538 - RNA, 20 nt, Human
acaguaacuugguuauacau

SEQ ID NO: 3371539 - RNA, 20 nt, Human
acaguaaguuccuacuaggc

SEQ ID NO: 3371540 - RNA, 15 nt, Human
acaguaauuguguuu

SEQ ID NO: 3371541 - RNA, 19 nt, Human
acaguacagcaugugccuu

SEQ ID NO: 3371542 - RNA, 20 nt, Human
acaguacaggcagcacagag

SEQ ID NO: 3371543 - RNA, 19 nt, Human
acaguagaacugucuguga

SEQ ID NO: 3371544 - RNA, 14 nt, Human
acaguagagccagc

SEQ ID NO: 3371545 - RNA, 23 nt, Human
acaguagucuugaugaccaaagu

SEQ ID NO: 3371546 - RNA, 18 nt, Human
acaguagugagaagaaua

SEQ ID NO: 3371547 - RNA, 17 nt, Human
aaugagaacauguuggu

SEQ ID NO: 3371548 - RNA, 14 nt, Human
aaugagaaccaaca

SEQ ID NO: 3371549 - RNA, 22 nt, Human
aaugagaagaaaauggaaccag

SEQ ID NO: 3371550 - RNA, 17 nt, Human
aaugagaaggcagccac

SEQ ID NO: 3371551 - RNA, 15 nt, Human
aaugagaauuuaagc

SEQ ID NO: 3371552 - RNA, 22 nt, Human
aaugagacagcagucuuaugcu

SEQ ID NO: 3371553 - RNA, 14 nt, Human
aaugagacauccag

SEQ ID NO: 3371554 - RNA, 19 nt, Human
aaugagacccucguggccu

SEQ ID NO: 3371555 - RNA, 15 nt, Human
aaugagacuugccuu

SEQ ID NO: 3371556 - RNA, 16 nt, Human
aaugagacuugcucuc

SEQ ID NO: 3371557 - RNA, 16 nt, Human
aaugagacuuuaaaag

SEQ ID NO: 3371558 - RNA, 17 nt, Human
aaugagacuuuaaaagc

SEQ ID NO: 3371559 - RNA, 21 nt, Human
aaugagagacacacugaagaa

SEQ ID NO: 3371560 - RNA, 17 nt, Human
aaugagaggcauuuccc

SEQ ID NO: 3371561 - RNA, 17 nt, Human
aaugagagguuccuaag

SEQ ID NO: 3371562 - RNA, 16 nt, Human
aaugagauaguagcau

SEQ ID NO: 3371563 - RNA, 16 nt, Human
aaugagaucaggcucu

SEQ ID NO: 3371564 - RNA, 17 nt, Human
aaugagauuaauuccuu

SEQ ID NO: 3371565 - RNA, 12 nt, Human
aaugagcauguu

SEQ ID NO: 3371566 - RNA, 19 nt, Human
aaugagcccagagaacagc

SEQ ID NO: 3371567 - RNA, 11 nt, Human
aaugagccugg

SEQ ID NO: 3371568 - RNA, 14 nt, Human
aaugagcucugaaa

SEQ ID NO: 3371569 - RNA, 14 nt, Human
aaugagcuuaagaa

SEQ ID NO: 3371570 - RNA, 19 nt, Human
aaugagcuugauuaaauca

SEQ ID NO: 3371571 - RNA, 23 nt, Human
aaugagcuuucugaacagcuggu

SEQ ID NO: 3371572 - RNA, 19 nt, Human
aaugaggaaaauucuuaaa

SEQ ID NO: 3371573 - RNA, 13 nt, Human
aaugaggaaugua

SEQ ID NO: 3371574 - RNA, 22 nt, Human
aaugaggagagaaaauauaugu

SEQ ID NO: 3371575 - RNA, 14 nt, Human
aaugagggacugga

SEQ ID NO: 3371576 - RNA, 16 nt, Human
aaugagggggcucagu

SEQ ID NO: 3371577 - RNA, 16 nt, Human
aaugaggucagagccu

SEQ ID NO: 3371578 - RNA, 18 nt, Human
aaugaggucagagccugc

SEQ ID NO: 3371579 - RNA, 15 nt, Human
aaugaggucuguuua

SEQ ID NO: 3371580 - RNA, 23 nt, Human
aaugaggugggagguggaagaag

SEQ ID NO: 3371581 - RNA, 17 nt, Human
aaugaguaacauuugcu

SEQ ID NO: 3371582 - RNA, 14 nt, Human
aaugaguuuaaaaa

SEQ ID NO: 3371583 - RNA, 21 nt, Human
aaugaguuuaaaaaucaacuu

SEQ ID NO: 3371584 - RNA, 22 nt, Human
aaugaguuucuuagacuuuucc

SEQ ID NO: 3371585 - RNA, 12 nt, Human
aaugauaaaaca

SEQ ID NO: 3371586 - RNA, 15 nt, Human
aaugauaacuggaaa

SEQ ID NO: 3371587 - RNA, 17 nt, Human
aaugauaacuggaaacu

SEQ ID NO: 3371588 - RNA, 20 nt, Human
aaugauaacuggaaacuuca

SEQ ID NO: 3371589 - RNA, 16 nt, Human
aaugauaguagaguga

SEQ ID NO: 3371590 - RNA, 19 nt, Human
aaugauaguugauuuucaa

SEQ ID NO: 3371591 - RNA, 23 nt, Human
aaugauauacugaucuucauuac

SEQ ID NO: 3371592 - RNA, 17 nt, Human
aaugauaugcuuguaac

SEQ ID NO: 3371593 - RNA, 19 nt, Human
aaugauaugcuuguaacua

SEQ ID NO: 3371594 - RNA, 19 nt, Human
aaugauauuguuauauaca

SEQ ID NO: 3371595 - RNA, 17 nt, Human
aaugaucagcaucugug

SEQ ID NO: 3371596 - RNA, 20 nt, Human
aaugauccccaagugugaac

SEQ ID NO: 3371597 - RNA, 19 nt, Human
aaugauccccagcuguuua

SEQ ID NO: 3371598 - RNA, 20 nt, Human
aaugauccccagcuguuuau

SEQ ID NO: 3371599 - RNA, 19 nt, Human
aaugauccuguauucagac

SEQ ID NO: 3371600 - RNA, 16 nt, Human
aaugaucuagguuuaa

SEQ ID NO: 3371601 - RNA, 17 nt, Human
aaugaucuagguuuaac

SEQ ID NO: 3371602 - RNA, 19 nt, Human
aaugaucuagguuuaacuc

SEQ ID NO: 3371603 - RNA, 16 nt, Human
aaugaucucuucuuuu

SEQ ID NO: 3371604 - RNA, 21 nt, Human
aaugaucugauugaccguguu

SEQ ID NO: 3371605 - RNA, 17 nt, Human
aaugaucuuuucaaguu

SEQ ID NO: 3371606 - RNA, 12 nt, Human
aaugaugauaac

SEQ ID NO: 3371607 - RNA, 23 nt, Human
aaugaugaucaauuauaguuucu

SEQ ID NO: 3371608 - RNA, 21 nt, Human
aaugaugauccuaggcauuug

SEQ ID NO: 3371609 - RNA, 23 nt, Human
aaugaugaugacgacgacaacga

SEQ ID NO: 3371610 - RNA, 13 nt, Human
aaugaugcacauu

SEQ ID NO: 3371611 - RNA, 18 nt, Human
aaugaugcacauuucaug

SEQ ID NO: 3371612 - RNA, 19 nt, Human
aaugaugcuauuugcaauu

SEQ ID NO: 3371613 - RNA, 14 nt, Human
aaugauggcaauuu

SEQ ID NO: 3371614 - RNA, 17 nt, Human
aaugauggcaauuuugu

SEQ ID NO: 3371615 - RNA, 15 nt, Human
aaugauguccagaag

SEQ ID NO: 3371616 - RNA, 18 nt, Human
aaugauuauuuucauuac

SEQ ID NO: 3371617 - RNA, 19 nt, Human
aaugauuauuuucauuaca

SEQ ID NO: 3371618 - RNA, 21 nt, Human
aaugauucaguguuaaaugug

SEQ ID NO: 3371619 - RNA, 22 nt, Human
aaugauucaguguuaaauguga

SEQ ID NO: 3371620 - RNA, 23 nt, Human
aaugauucaguguuaaaugugau

SEQ ID NO: 3371621 - RNA, 14 nt, Human
aaugauuguaaaau

SEQ ID NO: 3371622 - RNA, 20 nt, Human
aaugauuguaaaauagcuug

SEQ ID NO: 3371623 - RNA, 13 nt, Human
aaugauuguuuaa

SEQ ID NO: 3371624 - RNA, 14 nt, Human
aaugauuguuuaaa

SEQ ID NO: 3371625 - RNA, 24 nt, Human
aaugauuucagcucacugcaaccu

SEQ ID NO: 3371626 - RNA, 13 nt, Human
aaugauuucaugc

SEQ ID NO: 3371627 - RNA, 23 nt, Human
aaugauuuccucuguaaucuauu

SEQ ID NO: 3371628 - RNA, 20 nt, Human
aaugauuuuaucugugaauu

SEQ ID NO: 3371629 - RNA, 14 nt, Human
aaugauuuuuagau

SEQ ID NO: 3371630 - RNA, 15 nt, Human
aaugauuuuucuuua

SEQ ID NO: 3371631 - RNA, 12 nt, Human
aaugcaaaaaaa

SEQ ID NO: 3371632 - RNA, 16 nt, Human
aaugcaaaaaaaauua

SEQ ID NO: 3371633 - RNA, 17 nt, Human
aaugcaaaaacucuuug

SEQ ID NO: 3371634 - RNA, 21 nt, Human
aaugcaaaaauuagccgggcg

SEQ ID NO: 3371635 - RNA, 20 nt, Human
aaugcaaaacacaaaacaaa

SEQ ID NO: 3371636 - RNA, 16 nt, Human
aaugcaaaccaucauu

SEQ ID NO: 3371637 - RNA, 22 nt, Human
aaugcaaaccaucauugaaauc

SEQ ID NO: 3371638 - RNA, 17 nt, Human
aaugcaaagaaucccua

SEQ ID NO: 3371639 - RNA, 22 nt, Human
acaggcagcgauggucucagaa

SEQ ID NO: 3371640 - RNA, 21 nt, Human
acaggcagcuggaugagacuu

SEQ ID NO: 3371641 - RNA, 15 nt, Human
acaggcagcuuucua

SEQ ID NO: 3371642 - RNA, 17 nt, Human
acaggcagcuuucuaga

SEQ ID NO: 3371643 - RNA, 12 nt, Human
acaggcagggca

SEQ ID NO: 3371644 - RNA, 13 nt, Human
acaggcagggcag

SEQ ID NO: 3371645 - RNA, 22 nt, Human
acaggcagggcaggaccagccc

SEQ ID NO: 3371646 - RNA, 20 nt, Human
acaggcagucucucucuucc

SEQ ID NO: 3371647 - RNA, 22 nt, Human
acaggcaugaggaaucugggag

SEQ ID NO: 3371648 - RNA, 16 nt, Human
acaggcaugugucacc

SEQ ID NO: 3371649 - RNA, 15 nt, Human
acaggcauguucucu

SEQ ID NO: 3371650 - RNA, 18 nt, Human
acaggcauguucucugag

SEQ ID NO: 3371651 - RNA, 18 nt, Human
acaggcauuuccugggug

SEQ ID NO: 3371652 - RNA, 12 nt, Human
acaggcccagca

SEQ ID NO: 3371653 - RNA, 22 nt, Human
acaggcccagcauugcugguuc

SEQ ID NO: 3371654 - RNA, 22 nt, Human
acaggcccggcuccaggcuccu

SEQ ID NO: 3371655 - RNA, 22 nt, Human
acaggcccuccucccucccagc

SEQ ID NO: 3371656 - RNA, 14 nt, Human
acaggcccugcucc

SEQ ID NO: 3371657 - RNA, 15 nt, Human
acaggcccugcuccu

SEQ ID NO: 3371658 - RNA, 21 nt, Human
acaggcccugcuccugcagca

SEQ ID NO: 3371659 - RNA, 18 nt, Human
acaggcccuuuccucagg

SEQ ID NO: 3371660 - RNA, 20 nt, Human
acaggcccuuuccucaggca

SEQ ID NO: 3371661 - RNA, 21 nt, Human
acaggcccuuuccucaggcaa

SEQ ID NO: 3371662 - RNA, 19 nt, Human
acaggccucaccucuaccc

SEQ ID NO: 3371663 - RNA, 13 nt, Human
acaggccucaggg

SEQ ID NO: 3371664 - RNA, 21 nt, Human
acaggccugagauuucaucug

SEQ ID NO: 3371665 - RNA, 21 nt, Human
acaggcgagagaggagccaga

SEQ ID NO: 3371666 - RNA, 12 nt, Human
acaggcucaggc

SEQ ID NO: 3371667 - RNA, 14 nt, Human
acaggcucaggcag

SEQ ID NO: 3371668 - RNA, 13 nt, Human
acaggcuccugcc

SEQ ID NO: 3371669 - RNA, 15 nt, Human
acaggcugagugcag

SEQ ID NO: 3371670 - RNA, 20 nt, Human
acaggcugagugcaggccca

SEQ ID NO: 3371671 - RNA, 22 nt, Human
acaggcugagugcaggcccacc

SEQ ID NO: 3371672 - RNA, 23 nt, Human
acaggcugagugcaggcccaccc

SEQ ID NO: 3371673 - RNA, 16 nt, Human
acaggcugcggccccu

SEQ ID NO: 3371674 - RNA, 18 nt, Human
acaggcugcggccccucc

SEQ ID NO: 3371675 - RNA, 19 nt, Human
acaggcugcggccccuccc

SEQ ID NO: 3371676 - RNA, 21 nt, Human
acaggcuggaagauagcugug

SEQ ID NO: 3371677 - RNA, 12 nt, Human
acaggcugggcu

SEQ ID NO: 3371678 - RNA, 15 nt, Human
acaggcugggcuggg

SEQ ID NO: 3371679 - RNA, 19 nt, Human
acaggcuguucugcacuga

SEQ ID NO: 3371680 - RNA, 21 nt, Human
acaggcuguucugcacugaaa

SEQ ID NO: 3371681 - RNA, 19 nt, Human
acaggcuuagugauguaau

SEQ ID NO: 3371682 - RNA, 23 nt, Human
acagggaacccugcuugcacuuu

SEQ ID NO: 3371683 - RNA, 22 nt, Human
acagggaacgugauuagugaaa

SEQ ID NO: 3371684 - RNA, 15 nt, Human
acagggaagagcaga

SEQ ID NO: 3371685 - RNA, 16 nt, Human
acagggaagcuacagg

SEQ ID NO: 3371686 - RNA, 13 nt, Human
acagggaaggcag

SEQ ID NO: 3371687 - RNA, 13 nt, Human
acagggacuugaa

SEQ ID NO: 3371688 - RNA, 15 nt, Human
acagggagccuccug

SEQ ID NO: 3371689 - RNA, 16 nt, Human
acagggagccuccugc

SEQ ID NO: 3371690 - RNA, 17 nt, Human
acagggagccuccugcc

SEQ ID NO: 3371691 - RNA, 12 nt, Human
acagggagggga

SEQ ID NO: 3371692 - RNA, 21 nt, Human
acagggaugagcauggagcug

SEQ ID NO: 3371693 - RNA, 20 nt, Human
acagggauuuagacuuacua

SEQ ID NO: 3371694 - RNA, 22 nt, Human
acagggcacaccgggcacucag

SEQ ID NO: 3371695 - RNA, 16 nt, Human
acagggcaugaaauga

SEQ ID NO: 3371696 - RNA, 23 nt, Human
acagggcaugccccggccaccuc

SEQ ID NO: 3371697 - RNA, 24 nt, Human
acagggcaugccccggccaccucu

SEQ ID NO: 3371698 - RNA, 15 nt, Human
acagggccacauaga

SEQ ID NO: 3371699 - RNA, 17 nt, Human
acagggccagugcaguu

SEQ ID NO: 3371700 - RNA, 21 nt, Human
acagggccuuuggcaggugca

SEQ ID NO: 3371701 - RNA, 16 nt, Human
acagggcggggguggc

SEQ ID NO: 3371702 - RNA, 21 nt, Human
acagggcugauaagcuaacac

SEQ ID NO: 3371703 - RNA, 18 nt, Human
acagggcuggcccagccc

SEQ ID NO: 3371704 - RNA, 20 nt, Human
acagggcuggcccagcccug

SEQ ID NO: 3371705 - RNA, 17 nt, Human
acaggggaauauuuuau

SEQ ID NO: 3371706 - RNA, 20 nt, Human
acaggggaauauuuuauuca

SEQ ID NO: 3371707 - RNA, 22 nt, Human
acaggggaggugauagcauugc

SEQ ID NO: 3371708 - RNA, 15 nt, Human
acaggggcaggagga

SEQ ID NO: 3371709 - RNA, 17 nt, Human
acaggggccagaagaug

SEQ ID NO: 3371710 - RNA, 13 nt, Human
acagggggucugg

SEQ ID NO: 3371711 - RNA, 20 nt, Human
acagggggucuggcuggugu

SEQ ID NO: 3371712 - RNA, 23 nt, Human
acagggucugcucuuucucugcc

SEQ ID NO: 3371713 - RNA, 24 nt, Human
acagggucugcucuuucucugcca

SEQ ID NO: 3371714 - RNA, 18 nt, Human
acaggguuuuuaccuguc

SEQ ID NO: 3371715 - RNA, 14 nt, Human
acagguaaaacagg

SEQ ID NO: 3371716 - RNA, 14 nt, Human
acagguacuuuguc

SEQ ID NO: 3371717 - RNA, 22 nt, Human
acagguagaauuaucuaauuua

SEQ ID NO: 3371718 - RNA, 12 nt, Human
acagguauuuug

SEQ ID NO: 3371719 - RNA, 17 nt, Human
acagguauuuuguuucu

SEQ ID NO: 3371720 - RNA, 23 nt, Human
acaggucaauacaguacaggcag

SEQ ID NO: 3371721 - RNA, 21 nt, Human
acaggucaggggugacacaga

SEQ ID NO: 3371722 - RNA, 22 nt, Human
acaggucaggggugacacagac

SEQ ID NO: 3371723 - RNA, 19 nt, Human
acaggucauauuaauauau

SEQ ID NO: 3371724 - RNA, 19 nt, Human
acaggucuccucuuaaaaa

SEQ ID NO: 3371725 - RNA, 19 nt, Human
acaggucugggagaggcag

SEQ ID NO: 3371726 - RNA, 16 nt, Human
acaggucuucaucgaa

SEQ ID NO: 3371727 - RNA, 18 nt, Human
acaggugcuaauuuguuu

SEQ ID NO: 3371728 - RNA, 22 nt, Human
acaggugggcuucccaguggcu

SEQ ID NO: 3371729 - RNA, 18 nt, Human
acagguggugucacuguc

SEQ ID NO: 3371730 - RNA, 20 nt, Human
acagguggugucacuguccc

SEQ ID NO: 3371731 - RNA, 17 nt, Human
acagguguccccagccc

SEQ ID NO: 3371732 - RNA, 13 nt, Human
acaggugugcacc

SEQ ID NO: 3371733 - RNA, 16 nt, Human
acaggugugguguaau

SEQ ID NO: 3371734 - RNA, 18 nt, Human
acagguuacaacagauuu

SEQ ID NO: 3371735 - RNA, 19 nt, Human
acagguuacaacagauuug

SEQ ID NO: 3371736 - RNA, 22 nt, Human
acagguuacaacagauuuguga

SEQ ID NO: 3371737 - RNA, 21 nt, Human
acagguuauuuuaguuucugu

SEQ ID NO: 3371738 - RNA, 16 nt, Human
acagguuggaagagaa

SEQ ID NO: 3371739 - RNA, 20 nt, Human
acagguuggaagagaaucac

SEQ ID NO: 3371740 - RNA, 14 nt, Human
acagguuuuauaau

SEQ ID NO: 3371741 - RNA, 16 nt, Human
acagguuuucacauaa

SEQ ID NO: 3371742 - RNA, 14 nt, Human
acaguaaaaauaaa

SEQ ID NO: 3371743 - RNA, 16 nt, Human
acaguaaaaauaaaau

SEQ ID NO: 3371744 - RNA, 13 nt, Human
acaguaaauaaau

SEQ ID NO: 3371745 - RNA, 19 nt, Human
acaguaacgcaggggaaac

SEQ ID NO: 3371746 - RNA, 15 nt, Human
acaguaacuugguua

SEQ ID NO: 3371747 - RNA, 18 nt, Human
acaguaacuuuaugugua

SEQ ID NO: 3371748 - RNA, 16 nt, Human
acaguaaugucauaaa

SEQ ID NO: 3371749 - RNA, 15 nt, Human
acaguacagcaugug

SEQ ID NO: 3371750 - RNA, 17 nt, Human
acaguacagcaugugcc

SEQ ID NO: 3371751 - RNA, 15 nt, Human
acaguacccaaacug

SEQ ID NO: 3371752 - RNA, 22 nt, Human
acaguaccccucuagcuuuguu

SEQ ID NO: 3371753 - RNA, 19 nt, Human
acaguacccugguugugug

SEQ ID NO: 3371754 - RNA, 13 nt, Human
acaguagaacugu

SEQ ID NO: 3371755 - RNA, 15 nt, Human
acaguagagccagcu

SEQ ID NO: 3371756 - RNA, 13 nt, Human
acaguaggagccc

SEQ ID NO: 3371757 - RNA, 22 nt, Human
acaguaggagcccagcucugaa

SEQ ID NO: 3371758 - RNA, 21 nt, Human
acaguaguaccaaaugcuuua

SEQ ID NO: 3371759 - RNA, 23 nt, Human
acaguaguaccaaaugcuuuaaa

SEQ ID NO: 3371760 - RNA, 13 nt, Human
acaguauaauuaa

SEQ ID NO: 3371761 - RNA, 15 nt, Human
acaguauaauuaaca

SEQ ID NO: 3371762 - RNA, 21 nt, Human
acaguauaauuaacauguuaa

SEQ ID NO: 3371763 - RNA, 18 nt, Human
acauuuuaaaaacauaga

SEQ ID NO: 3371764 - RNA, 14 nt, Human
acauuuuaaauaaa

SEQ ID NO: 3371765 - RNA, 11 nt, Human
acauuuuaaca

SEQ ID NO: 3371766 - RNA, 14 nt, Human
acauuuuaacaaga

SEQ ID NO: 3371767 - RNA, 14 nt, Human
acauuuuacauuaa

SEQ ID NO: 3371768 - RNA, 20 nt, Human
acauuuuauuuuauuaugca

SEQ ID NO: 3371769 - RNA, 19 nt, Human
acauuuuccuuuucaaaua

SEQ ID NO: 3371770 - RNA, 18 nt, Human
acauuuucuaagaaacau

SEQ ID NO: 3371771 - RNA, 13 nt, Human
acauuuucucuua

SEQ ID NO: 3371772 - RNA, 17 nt, Human
acauuuucuuaauccag

SEQ ID NO: 3371773 - RNA, 15 nt, Human
acauuuugagaacaa

SEQ ID NO: 3371774 - RNA, 17 nt, Human
acauuuuggugagaaau

SEQ ID NO: 3371775 - RNA, 11 nt, Human
acauuuuguau

SEQ ID NO: 3371776 - RNA, 13 nt, Human
acauuuuguauaa

SEQ ID NO: 3371777 - RNA, 16 nt, Human
acauuuuguauaauug

SEQ ID NO: 3371778 - RNA, 14 nt, Human
acauuuuguucuua

SEQ ID NO: 3371779 - RNA, 20 nt, Human
acauuuuguucuuacacaua

SEQ ID NO: 3371780 - RNA, 15 nt, Human
acauuuuguuguaaa

SEQ ID NO: 3371781 - RNA, 20 nt, Human
acauuuuguuguaaaaagaa

SEQ ID NO: 3371782 - RNA, 23 nt, Human
acauuuuguuguaaaaagaaaaa

SEQ ID NO: 3371783 - RNA, 22 nt, Human
accauuuugcugucccuuuucc

SEQ ID NO: 3371784 - RNA, 23 nt, Human
accauuuuguuauugacuaacag

SEQ ID NO: 3371785 - RNA, 15 nt, Human
accauuuuuguuacu

SEQ ID NO: 3371786 - RNA, 22 nt, Human
accauuuuuuaaggaaacaaua

SEQ ID NO: 3371787 - RNA, 17 nt, Human
accauuuuuuaauuuac

SEQ ID NO: 3371788 - RNA, 18 nt, Human
acccaaaaacugucuuua

SEQ ID NO: 3371789 - RNA, 15 nt, Human
acccaaaacaagccu

SEQ ID NO: 3371790 - RNA, 14 nt, Human
acccaaaccuggag

SEQ ID NO: 3371791 - RNA, 18 nt, Human
acccaaagaccaauauuc

SEQ ID NO: 3371792 - RNA, 18 nt, Human
acccaaagagguauuuau

SEQ ID NO: 3371793 - RNA, 14 nt, Human
acccaaagcaugga

SEQ ID NO: 3371794 - RNA, 16 nt, Human
acccaaagcauggacu

SEQ ID NO: 3371795 - RNA, 11 nt, Human
acccaaagcug

SEQ ID NO: 3371796 - RNA, 18 nt, Human
acccaaagcugagccugc

SEQ ID NO: 3371797 - RNA, 23 nt, Human
acccaacggcccugcagccagcu

SEQ ID NO: 3371798 - RNA, 14 nt, Human
acccaagcuuggca

SEQ ID NO: 3371799 - RNA, 17 nt, Human
acccaaggacugaggga

SEQ ID NO: 3371800 - RNA, 15 nt, Human
acccaaggagcacag

SEQ ID NO: 3371801 - RNA, 21 nt, Human
acccaaggagcacagguccca

SEQ ID NO: 3371802 - RNA, 16 nt, Human
acccaagggccuggcc

SEQ ID NO: 3371803 - RNA, 23 nt, Human
acccaagggccuggccugagcug

SEQ ID NO: 3371804 - RNA, 16 nt, Human
acccaaguccaagcau

SEQ ID NO: 3371805 - RNA, 16 nt, Human
acccaagugggggcag

SEQ ID NO: 3371806 - RNA, 17 nt, Human
acccaauagcugcccau

SEQ ID NO: 3371807 - RNA, 13 nt, Human
acccaauccaaau

SEQ ID NO: 3371808 - RNA, 20 nt, Human
acccaaugcacacaaaacaa

SEQ ID NO: 3371809 - RNA, 22 nt, Human
acccaauuaaguccuacuuuac

SEQ ID NO: 3371810 - RNA, 20 nt, Human
acccacaaaaguacaauuua

SEQ ID NO: 3371811 - RNA, 17 nt, Human
acccacaagaaaugaaa

SEQ ID NO: 3371812 - RNA, 17 nt, Human
acccacaagugccacug

SEQ ID NO: 3371813 - RNA, 18 nt, Human
acccacacaaauaacaag

SEQ ID NO: 3371814 - RNA, 15 nt, Human
acccacaccucugcc

SEQ ID NO: 3371815 - RNA, 23 nt, Human
acccacacucagauccuccucau

SEQ ID NO: 3371816 - RNA, 14 nt, Human
acccacagaaagag

SEQ ID NO: 3371817 - RNA, 14 nt, Human
acccacaugcucca

SEQ ID NO: 3371818 - RNA, 17 nt, Human
acccaccaacccucagg

SEQ ID NO: 3371819 - RNA, 15 nt, Human
acccaccaccaugcc

SEQ ID NO: 3371820 - RNA, 16 nt, Human
acccacccagcaccca

SEQ ID NO: 3371821 - RNA, 23 nt, Human
acccaccccaccugcagggcugc

SEQ ID NO: 3371822 - RNA, 13 nt, Human
acccaccccugug

SEQ ID NO: 3371823 - RNA, 15 nt, Human
acccaccccugugcu

SEQ ID NO: 3371824 - RNA, 17 nt, Human
acccaccccugugcucc

SEQ ID NO: 3371825 - RNA, 16 nt, Human
acauuuuuauuuauga

SEQ ID NO: 3371826 - RNA, 17 nt, Human
acauuuuuauuuaugaa

SEQ ID NO: 3371827 - RNA, 18 nt, Human
acauuuuuauuuaugaag

SEQ ID NO: 3371828 - RNA, 23 nt, Human
acauuuuuauuuaugaaguuuaa

SEQ ID NO: 3371829 - RNA, 21 nt, Human
acauuuuucagauauaaaaga

SEQ ID NO: 3371830 - RNA, 23 nt, Human
acauuuuucuuagggaaggauac

SEQ ID NO: 3371831 - RNA, 14 nt, Human
acauuuuuuaaaug

SEQ ID NO: 3371832 - RNA, 16 nt, Human
acauuuuuuaaaugca

SEQ ID NO: 3371833 - RNA, 14 nt, Human
acauuuuuucauca

SEQ ID NO: 3371834 - RNA, 13 nt, Human
acauuuuuugaaa

SEQ ID NO: 3371835 - RNA, 13 nt, Human
acauuuuuuucua

SEQ ID NO: 3371836 - RNA, 14 nt, Human
accaaaaagaaaaa

SEQ ID NO: 3371837 - RNA, 13 nt, Human
accaaaagaagua

SEQ ID NO: 3371838 - RNA, 23 nt, Human
accaaaaguuacauguuugcacc

SEQ ID NO: 3371839 - RNA, 13 nt, Human
accaaaauaagaa

SEQ ID NO: 3371840 - RNA, 15 nt, Human
accaaaauaagaaaa

SEQ ID NO: 3371841 - RNA, 16 nt, Human
accaaaauccccuucu

SEQ ID NO: 3371842 - RNA, 17 nt, Human
accaaaauccccuucuc

SEQ ID NO: 3371843 - RNA, 16 nt, Human
accaaaauuauuucag

SEQ ID NO: 3371844 - RNA, 21 nt, Human
accaaaauuugggguauuuau

SEQ ID NO: 3371845 - RNA, 16 nt, Human
accaaacaauuauuua

SEQ ID NO: 3371846 - RNA, 20 nt, Human
accaaacccacccuuucuac

SEQ ID NO: 3371847 - RNA, 14 nt, Human
accaaaccuucuga

SEQ ID NO: 3371848 - RNA, 22 nt, Human
accaaagauauauacacaggau

SEQ ID NO: 3371849 - RNA, 23 nt, Human
accaaagauauauacacaggauc

SEQ ID NO: 3371850 - RNA, 23 nt, Human
accaaagaugaaugaagcaaaug

SEQ ID NO: 3371851 - RNA, 20 nt, Human
accaaagcaccuuagcuggc

SEQ ID NO: 3371852 - RNA, 12 nt, Human
accaaagccacc

SEQ ID NO: 3371853 - RNA, 13 nt, Human
accaaagcugccc

SEQ ID NO: 3371854 - RNA, 18 nt, Human
accaaagcugcccacugu

SEQ ID NO: 3371855 - RNA, 21 nt, Human
accaaaggacauuaugugugc

SEQ ID NO: 3371856 - RNA, 13 nt, Human
accaaaggccagg

SEQ ID NO: 3371857 - RNA, 18 nt, Human
accaaaggugaaggaaua

SEQ ID NO: 3371858 - RNA, 21 nt, Human
accaaaggugaaggaauauau

SEQ ID NO: 3371859 - RNA, 21 nt, Human
accaaaguccuuuuuuuccau

SEQ ID NO: 3371860 - RNA, 14 nt, Human
accaaaguucuaau

SEQ ID NO: 3371861 - RNA, 20 nt, Human
accaaaguucuaauaauuuc

SEQ ID NO: 3371862 - RNA, 21 nt, Human
accaaauaucaccaggacugu

SEQ ID NO: 3371863 - RNA, 20 nt, Human
accaaaucucucaaaucugu

SEQ ID NO: 3371864 - RNA, 15 nt, Human
accaaaucuggaagc

SEQ ID NO: 3371865 - RNA, 12 nt, Human
accaaaugcauc

SEQ ID NO: 3371866 - RNA, 11 nt, Human
accaaaugcuu

SEQ ID NO: 3371867 - RNA, 22 nt, Human
accaaaugcuuuaaaaacuauu

SEQ ID NO: 3371868 - RNA, 15 nt, Human
accaaaugguacaaa

SEQ ID NO: 3371869 - RNA, 18 nt, Human
accaaauguaacuauguu

SEQ ID NO: 3371870 - RNA, 14 nt, Human
accaaauuaucuug

SEQ ID NO: 3371871 - RNA, 17 nt, Human
accaaauuuuucuauca

SEQ ID NO: 3371872 - RNA, 13 nt, Human
accaacaagggca

SEQ ID NO: 3371873 - RNA, 16 nt, Human
accaacaagggcagug

SEQ ID NO: 3371874 - RNA, 21 nt, Human
accaacaccaucacagcuugu

SEQ ID NO: 3371875 - RNA, 14 nt, Human
accaacacgagcag

SEQ ID NO: 3371876 - RNA, 19 nt, Human
accaacacgagcaggcuac

SEQ ID NO: 3371877 - RNA, 22 nt, Human
accaacaggcuguucugcacug

SEQ ID NO: 3371878 - RNA, 16 nt, Human
accaacauacucccau

SEQ ID NO: 3371879 - RNA, 21 nt, Human
accaacaucuacaaaacauua

SEQ ID NO: 3371880 - RNA, 20 nt, Human
accaaccacugcgaccacaa

SEQ ID NO: 3371881 - RNA, 20 nt, Human
accaacccagccgcugcccg

SEQ ID NO: 3371882 - RNA, 22 nt, Human
accaacccaucagaaggagaag

SEQ ID NO: 3371883 - RNA, 14 nt, Human
accaacccucaggg

SEQ ID NO: 3371884 - RNA, 21 nt, Human
accaacccucagggcaaagcc

SEQ ID NO: 3371885 - RNA, 13 nt, Human
accaaccugacca

SEQ ID NO: 3371886 - RNA, 11 nt, Human
accaaccuggg

SEQ ID NO: 3371887 - RNA, 15 nt, Human
accaacuagacauuc

SEQ ID NO: 3371888 - RNA, 17 nt, Human
accaacuagacauucug

SEQ ID NO: 3371889 - RNA, 23 nt, Human
accaacuccuaguucuagaaaaa

SEQ ID NO: 3371890 - RNA, 11 nt, Human
accaacuggaa

SEQ ID NO: 3371891 - RNA, 23 nt, Human
accaacugucacucauugcugag

SEQ ID NO: 3371892 - RNA, 15 nt, Human
accaacugucacugu

SEQ ID NO: 3371893 - RNA, 20 nt, Human
accaacuuguauccaggccu

SEQ ID NO: 3371894 - RNA, 12 nt, Human
accaacuuucaa

SEQ ID NO: 3371895 - RNA, 14 nt, Human
accaacuuucaaga

SEQ ID NO: 3371896 - RNA, 20 nt, Human
accaacuuucaagaacuugu

SEQ ID NO: 3371897 - RNA, 19 nt, Human
accaacuuucuguaaacuc

SEQ ID NO: 3371898 - RNA, 21 nt, Human
accaacuuuucuauuaaaagu

SEQ ID NO: 3371899 - RNA, 22 nt, Human
accaacuuuucuauuaaaagug

SEQ ID NO: 3371900 - RNA, 19 nt, Human
accaagaagccuuuccugu

SEQ ID NO: 3371901 - RNA, 20 nt, Human
accaagaagccuuuccugua

SEQ ID NO: 3371902 - RNA, 13 nt, Human
accaagagagaaa

SEQ ID NO: 3371903 - RNA, 15 nt, Human
accaagagauugcua

SEQ ID NO: 3371904 - RNA, 18 nt, Human
accaagagauugcuaauu

SEQ ID NO: 3371905 - RNA, 12 nt, Human
accaagaggcug

SEQ ID NO: 3371906 - RNA, 14 nt, Human
accaagaucuauaa

SEQ ID NO: 3371907 - RNA, 17 nt, Human
accaagcacagcagccu

SEQ ID NO: 3371908 - RNA, 15 nt, Human
accaagcaggagacg

SEQ ID NO: 3371909 - RNA, 18 nt, Human
accaagcucacaguuccu

SEQ ID NO: 3371910 - RNA, 19 nt, Human
accaagcucacaguuccuc

SEQ ID NO: 3371911 - RNA, 17 nt, Human
accaagcugaguuuccu

SEQ ID NO: 3371912 - RNA, 20 nt, Human
accaagcugugccacccugg

SEQ ID NO: 3371913 - RNA, 20 nt, Human
accaaggaaacgcuaccucu

SEQ ID NO: 3371914 - RNA, 21 nt, Human
accaaggaaacgcuaccucuc

SEQ ID NO: 3371915 - RNA, 17 nt, Human
accaaggagaugaagca

SEQ ID NO: 3371916 - RNA, 16 nt, Human
accaaggcaaggcagg

SEQ ID NO: 3371917 - RNA, 19 nt, Human
accaaggcaaggcaggugc

SEQ ID NO: 3371918 - RNA, 17 nt, Human
accaaggcuuucucuac

SEQ ID NO: 3371919 - RNA, 20 nt, Human
accaagguagaaugaccuug

SEQ ID NO: 3371920 - RNA, 15 nt, Human
accaaguauuuauua

SEQ ID NO: 3371921 - RNA, 16 nt, Human
accaaguggaccuuga

SEQ ID NO: 3371922 - RNA, 15 nt, Human
accaauaaaauuucu

SEQ ID NO: 3371923 - RNA, 17 nt, Human
accaauaaagugacccu

SEQ ID NO: 3371924 - RNA, 13 nt, Human
accaauagauucc

SEQ ID NO: 3371925 - RNA, 23 nt, Human
accaauagggcugagcucucugu

SEQ ID NO: 3371926 - RNA, 14 nt, Human
accaauauuguaca

SEQ ID NO: 3371927 - RNA, 19 nt, Human
accaauauuguacaguuuu

SEQ ID NO: 3371928 - RNA, 20 nt, Human
aauuuagguuuuuauuagua

SEQ ID NO: 3371929 - RNA, 16 nt, Human
aauuuaguaaauguua

SEQ ID NO: 3371930 - RNA, 20 nt, Human
aauuuaguaaauguuaucuu

SEQ ID NO: 3371931 - RNA, 13 nt, Human
aauuuaguauuuu

SEQ ID NO: 3371932 - RNA, 21 nt, Human
aauuuagugaucuuagcauag

SEQ ID NO: 3371933 - RNA, 16 nt, Human
aauuuaguguauccau

SEQ ID NO: 3371934 - RNA, 15 nt, Human
aauuuaguuauugau

SEQ ID NO: 3371935 - RNA, 21 nt, Human
aauuuaguuucauauaaagua

SEQ ID NO: 3371936 - RNA, 18 nt, Human
aauuuaguuuuuguucuu

SEQ ID NO: 3371937 - RNA, 16 nt, Human
aauuuauaaaaaggug

SEQ ID NO: 3371938 - RNA, 16 nt, Human
aauuuauaauuuuaag

SEQ ID NO: 3371939 - RNA, 15 nt, Human
aauuuauacaauauc

SEQ ID NO: 3371940 - RNA, 21 nt, Human
aauuuauaccuaccugugugg

SEQ ID NO: 3371941 - RNA, 21 nt, Human
aauuuauaccucaauuuucac

SEQ ID NO: 3371942 - RNA, 15 nt, Human
aauuuauaguuuaua

SEQ ID NO: 3371943 - RNA, 20 nt, Human
aauuuauauacaaccugcuu

SEQ ID NO: 3371944 - RNA, 16 nt, Human
aauuuauauuguaaau

SEQ ID NO: 3371945 - RNA, 17 nt, Human
aauuuaucagauugcuu

SEQ ID NO: 3371946 - RNA, 20 nt, Human
aauuuaucagauugcuuuug

SEQ ID NO: 3371947 - RNA, 21 nt, Human
aauuuaucuaaauuaaagccu

SEQ ID NO: 3371948 - RNA, 23 nt, Human
aauuuaugaauugaauuaucuug

SEQ ID NO: 3371949 - RNA, 19 nt, Human
aauuuaugaguuuuugaua

SEQ ID NO: 3371950 - RNA, 22 nt, Human
aauuuaugcacuuauaaggugu

SEQ ID NO: 3371951 - RNA, 17 nt, Human
aauuuauuaauugcuuu

SEQ ID NO: 3371952 - RNA, 18 nt, Human
aauuuauuaauugcuuug

SEQ ID NO: 3371953 - RNA, 19 nt, Human
aauuuauuaguuaauauau

SEQ ID NO: 3371954 - RNA, 14 nt, Human
aauuuauuauggca

SEQ ID NO: 3371955 - RNA, 16 nt, Human
aauuuauuauuguucu

SEQ ID NO: 3371956 - RNA, 19 nt, Human
aauuuauugaggaaaaaua

SEQ ID NO: 3371957 - RNA, 21 nt, Human
aauuuauugaggaaaaauaug

SEQ ID NO: 3371958 - RNA, 14 nt, Human
aauuuauugcacaa

SEQ ID NO: 3371959 - RNA, 16 nt, Human
aauuuauugcacaaaa

SEQ ID NO: 3371960 - RNA, 20 nt, Human
aauuuauugcacauuguuca

SEQ ID NO: 3371961 - RNA, 16 nt, Human
aauuuauugcuugaua

SEQ ID NO: 3371962 - RNA, 17 nt, Human
aauuuauuggcuuuucu

SEQ ID NO: 3371963 - RNA, 20 nt, Human
aauuuauuggcuuuucugau

SEQ ID NO: 3371964 - RNA, 23 nt, Human
aauuuauuggcuuuucugaucca

SEQ ID NO: 3371965 - RNA, 22 nt, Human
aauuuauuuccuaguucuguag

SEQ ID NO: 3371966 - RNA, 23 nt, Human
aauuuauuugaaugauuuuucuu

SEQ ID NO: 3371967 - RNA, 22 nt, Human
aauuuauuuuauaagaaaaacu

SEQ ID NO: 3371968 - RNA, 20 nt, Human
aauuuauuuuugcauggcac

SEQ ID NO: 3371969 - RNA, 15 nt, Human
aauuucaaaaauaua

SEQ ID NO: 3371970 - RNA, 20 nt, Human
aauuucaaaagacauguugu

SEQ ID NO: 3371971 - RNA, 12 nt, Human
aauuucaaaaug

SEQ ID NO: 3371972 - RNA, 16 nt, Human
aauuucaaaaugcuuu

SEQ ID NO: 3371973 - RNA, 15 nt, Human
aauuucaagcuuauu

SEQ ID NO: 3371974 - RNA, 18 nt, Human
aauuucaagguucuaacc

SEQ ID NO: 3371975 - RNA, 14 nt, Human
aauuucaauuuguu

SEQ ID NO: 3371976 - RNA, 15 nt, Human
aauuucaauuuguuc

SEQ ID NO: 3371977 - RNA, 21 nt, Human
aauuucaccaccaaaugccaa

SEQ ID NO: 3371978 - RNA, 18 nt, Human
aauuucacgauucauuuu

SEQ ID NO: 3371979 - RNA, 22 nt, Human
aauuucacgucauaggaaguua

SEQ ID NO: 3371980 - RNA, 21 nt, Human
acccacccuuucuacuuccaa

SEQ ID NO: 3371981 - RNA, 19 nt, Human
acccaccgggccacuccuu

SEQ ID NO: 3371982 - RNA, 22 nt, Human
acccaccgggccacuccuuccu

SEQ ID NO: 3371983 - RNA, 20 nt, Human
acccaccguccgcccugcuc

SEQ ID NO: 3371984 - RNA, 22 nt, Human
acccaccguccgcccugcuccu

SEQ ID NO: 3371985 - RNA, 22 nt, Human
acccaccguggaggaggaaggc

SEQ ID NO: 3371986 - RNA, 13 nt, Human
acccaccucagcc

SEQ ID NO: 3371987 - RNA, 16 nt, Human
acccaccucagccucc

SEQ ID NO: 3371988 - RNA, 13 nt, Human
acccaccucccug

SEQ ID NO: 3371989 - RNA, 15 nt, Human
acccaccucccugcc

SEQ ID NO: 3371990 - RNA, 16 nt, Human
acccaccucccugccu

SEQ ID NO: 3371991 - RNA, 18 nt, Human
acccaccucccugccucc

SEQ ID NO: 3371992 - RNA, 12 nt, Human
acccaccugagc

SEQ ID NO: 3371993 - RNA, 19 nt, Human
acccaccugguggccucug

SEQ ID NO: 3371994 - RNA, 13 nt, Human
acccacucagcuc

SEQ ID NO: 3371995 - RNA, 15 nt, Human
acccacucgguccca

SEQ ID NO: 3371996 - RNA, 20 nt, Human
acccacucuccucugccuca

SEQ ID NO: 3371997 - RNA, 11 nt, Human
acccacugcuc

SEQ ID NO: 3371998 - RNA, 14 nt, Human
acccacuggacuca

SEQ ID NO: 3371999 - RNA, 21 nt, Human
acccacuggacucaccucccc

SEQ ID NO: 3372000 - RNA, 14 nt, Human
acccacuucugcac

SEQ ID NO: 3372001 - RNA, 15 nt, Human
acccacuugucacug

SEQ ID NO: 3372002 - RNA, 18 nt, Human
acccagaaugagacaucc

SEQ ID NO: 3372003 - RNA, 15 nt, Human
acccagacauaaagg

SEQ ID NO: 3372004 - RNA, 17 nt, Human
acccagacauaaaggaa

SEQ ID NO: 3372005 - RNA, 18 nt, Human
acccagacauaaaggaaa

SEQ ID NO: 3372006 - RNA, 10 nt, Human
acccagaccc

SEQ ID NO: 3372007 - RNA, 22 nt, Human
acccagaccuguuagcagacag

SEQ ID NO: 3372008 - RNA, 14 nt, Human
acccagagaauaua

SEQ ID NO: 3372009 - RNA, 16 nt, Human
acccagagaauauaua

SEQ ID NO: 3372010 - RNA, 17 nt, Human
acccagagaggaaucag

SEQ ID NO: 3372011 - RNA, 23 nt, Human
acccagagcauuacgugagccag

SEQ ID NO: 3372012 - RNA, 22 nt, Human
acccagaggaaggggccagagg

SEQ ID NO: 3372013 - RNA, 14 nt, Human
acccagaggaggca

SEQ ID NO: 3372014 - RNA, 23 nt, Human
acccagaggaggcagaauaagaa

SEQ ID NO: 3372015 - RNA, 14 nt, Human
acccagauccucac

SEQ ID NO: 3372016 - RNA, 17 nt, Human
acccagcaacuccaacu

SEQ ID NO: 3372017 - RNA, 15 nt, Human
acccagcaguucugu

SEQ ID NO: 3372018 - RNA, 13 nt, Human
acccagccaucug

SEQ ID NO: 3372019 - RNA, 20 nt, Human
acccagccaucugcccaggg

SEQ ID NO: 3372020 - RNA, 17 nt, Human
acccagcccacuucugc

SEQ ID NO: 3372021 - RNA, 23 nt, Human
acccagcccauucucucuccugu

SEQ ID NO: 3372022 - RNA, 13 nt, Human
acccagcccuggu

SEQ ID NO: 3372023 - RNA, 16 nt, Human
acccagcccuggucuc

SEQ ID NO: 3372024 - RNA, 13 nt, Human
acccagccgcugc

SEQ ID NO: 3372025 - RNA, 18 nt, Human
acccagccgcugcccggc

SEQ ID NO: 3372026 - RNA, 17 nt, Human
acccagccucaguccuc

SEQ ID NO: 3372027 - RNA, 11 nt, Human
acccagccugg

SEQ ID NO: 3372028 - RNA, 17 nt, Human
acccagcgagcccuggu

SEQ ID NO: 3372029 - RNA, 23 nt, Human
acccagcgggcagguucugccug

SEQ ID NO: 3372030 - RNA, 22 nt, Human
acccagcuaugguucucucgca

SEQ ID NO: 3372031 - RNA, 20 nt, Human
acccagcucccuucuucccu

SEQ ID NO: 3372032 - RNA, 15 nt, Human
acccagcucuggucc

SEQ ID NO: 3372033 - RNA, 10 nt, Human
acccaggaca

SEQ ID NO: 3372034 - RNA, 18 nt, Human
acccaggacgcuucugaa

SEQ ID NO: 3372035 - RNA, 14 nt, Human
acccaggaggcagg

SEQ ID NO: 3372036 - RNA, 12 nt, Human
acccaggaggcg

SEQ ID NO: 3372037 - RNA, 18 nt, Human
acccaggaggggaacacu

SEQ ID NO: 3372038 - RNA, 21 nt, Human
acccaggaggggaacacugcc

SEQ ID NO: 3372039 - RNA, 11 nt, Human
acccaggaggu

SEQ ID NO: 3372040 - RNA, 15 nt, Human
acccaggcuccgccc

SEQ ID NO: 3372041 - RNA, 19 nt, Human
acccaggcuccgcccuuag

SEQ ID NO: 3372042 - RNA, 21 nt, Human
acccaggcuccgcccuuaguc

SEQ ID NO: 3372043 - RNA, 20 nt, Human
acccaggcuggagugcaaug

SEQ ID NO: 3372044 - RNA, 20 nt, Human
acccaggcuggagugcagug

SEQ ID NO: 3372045 - RNA, 21 nt, Human
acccagggcccaggcaaauca

SEQ ID NO: 3372046 - RNA, 12 nt, Human
acccagggcucu

SEQ ID NO: 3372047 - RNA, 15 nt, Human
acccagggcucugcc

SEQ ID NO: 3372048 - RNA, 21 nt, Human
acccagggcucugccccaguc

SEQ ID NO: 3372049 - RNA, 15 nt, Human
acccagggcucugua

SEQ ID NO: 3372050 - RNA, 21 nt, Human
acccaggggcagccccaggcc

SEQ ID NO: 3372051 - RNA, 13 nt, Human
acccagggguggg

SEQ ID NO: 3372052 - RNA, 14 nt, Human
acccaggugggucc

SEQ ID NO: 3372053 - RNA, 17 nt, Human
acccaguccccgugccc

SEQ ID NO: 3372054 - RNA, 16 nt, Human
acccaguccugcccgc

SEQ ID NO: 3372055 - RNA, 9 nt, Human
acccagugc

SEQ ID NO: 3372056 - RNA, 22 nt, Human
acccagugcccucuccccucag

SEQ ID NO: 3372057 - RNA, 11 nt, Human
acccaguggca

SEQ ID NO: 3372058 - RNA, 13 nt, Human
acccaguggcagg

SEQ ID NO: 3372059 - RNA, 15 nt, Human
acccaguggcagggc

SEQ ID NO: 3372060 - RNA, 17 nt, Human
acccaguugccaucugc

SEQ ID NO: 3372061 - RNA, 18 nt, Human
acccauagaucuucugaa

SEQ ID NO: 3372062 - RNA, 20 nt, Human
acccauaggcccacacacag

SEQ ID NO: 3372063 - RNA, 21 nt, Human
acccauaggcccacacacagg

SEQ ID NO: 3372064 - RNA, 11 nt, Human
acccauauccc

SEQ ID NO: 3372065 - RNA, 14 nt, Human
acccauauguuaaa

SEQ ID NO: 3372066 - RNA, 20 nt, Human
acccauccuaccaaugcaug

SEQ ID NO: 3372067 - RNA, 21 nt, Human
acccaucgguguccauuuaua

SEQ ID NO: 3372068 - RNA, 19 nt, Human
acccaucuaguacuugaaa

SEQ ID NO: 3372069 - RNA, 13 nt, Human
acccaucugggcu

SEQ ID NO: 3372070 - RNA, 16 nt, Human
acccaugaaagaaaac

SEQ ID NO: 3372071 - RNA, 22 nt, Human
acccaugaaagaaaacuuuuau

SEQ ID NO: 3372072 - RNA, 20 nt, Human
acccaugaggcaaugucagg

SEQ ID NO: 3372073 - RNA, 21 nt, Human
accacugcccccugcugccau

SEQ ID NO: 3372074 - RNA, 20 nt, Human
accacuggccaccaggcugg

SEQ ID NO: 3372075 - RNA, 16 nt, Human
accacuggucuguagg

SEQ ID NO: 3372076 - RNA, 15 nt, Human
accacugucuucuuc

SEQ ID NO: 3372077 - RNA, 16 nt, Human
accacuguguauuuaa

SEQ ID NO: 3372078 - RNA, 16 nt, Human
accacuucacugaaag

SEQ ID NO: 3372079 - RNA, 18 nt, Human
accacuucacugaaagac

SEQ ID NO: 3372080 - RNA, 13 nt, Human
accacuucauucu

SEQ ID NO: 3372081 - RNA, 16 nt, Human
accacuugaggccuga

SEQ ID NO: 3372082 - RNA, 16 nt, Human
accacuuguagauuug

SEQ ID NO: 3372083 - RNA, 19 nt, Human
accacuuguagauuugauu

SEQ ID NO: 3372084 - RNA, 12 nt, Human
accacuuuuguu

SEQ ID NO: 3372085 - RNA, 15 nt, Human
accacuuuuugcagc

SEQ ID NO: 3372086 - RNA, 16 nt, Human
accacuuuuugcagcu

SEQ ID NO: 3372087 - RNA, 18 nt, Human
accagaacaguaugaauu

SEQ ID NO: 3372088 - RNA, 14 nt, Human
accagaaccaaacc

SEQ ID NO: 3372089 - RNA, 15 nt, Human
accagaagcaacaga

SEQ ID NO: 3372090 - RNA, 16 nt, Human
accagaagcccagaau

SEQ ID NO: 3372091 - RNA, 14 nt, Human
accagacaagcugu

SEQ ID NO: 3372092 - RNA, 14 nt, Human
accagacaccuuga

SEQ ID NO: 3372093 - RNA, 12 nt, Human
accagacagagg

SEQ ID NO: 3372094 - RNA, 13 nt, Human
accagacagaggg

SEQ ID NO: 3372095 - RNA, 21 nt, Human
accagacuacuugggagcacc

SEQ ID NO: 3372096 - RNA, 22 nt, Human
accagacuagauggaccugccu

SEQ ID NO: 3372097 - RNA, 15 nt, Human
accagacucuugccu

SEQ ID NO: 3372098 - RNA, 18 nt, Human
accagagaaaaagggagg

SEQ ID NO: 3372099 - RNA, 20 nt, Human
accagagaaaaagggagggg

SEQ ID NO: 3372100 - RNA, 18 nt, Human
accagagaccguccucac

SEQ ID NO: 3372101 - RNA, 20 nt, Human
accagagcacuguauacccc

SEQ ID NO: 3372102 - RNA, 16 nt, Human
accagagcagaugcag

SEQ ID NO: 3372103 - RNA, 17 nt, Human
accagagcagaugcaga

SEQ ID NO: 3372104 - RNA, 16 nt, Human
accagagcccaccuug

SEQ ID NO: 3372105 - RNA, 14 nt, Human
accagagccccaca

SEQ ID NO: 3372106 - RNA, 18 nt, Human
accagagcucuggagcca

SEQ ID NO: 3372107 - RNA, 13 nt, Human
accagagcugcca

SEQ ID NO: 3372108 - RNA, 14 nt, Human
accagagcugccac

SEQ ID NO: 3372109 - RNA, 14 nt, Human
accagaggcugcag

SEQ ID NO: 3372110 - RNA, 15 nt, Human
accagaggcugcaga

SEQ ID NO: 3372111 - RNA, 22 nt, Human
accagagugcugaaggaaugga

SEQ ID NO: 3372112 - RNA, 20 nt, Human
accagauaagaaugcugguu

SEQ ID NO: 3372113 - RNA, 18 nt, Human
accagaugagaauuaggc

SEQ ID NO: 3372114 - RNA, 10 nt, Human
accagaugcu

SEQ ID NO: 3372115 - RNA, 12 nt, Human
accagaugcuga

SEQ ID NO: 3372116 - RNA, 14 nt, Human
accagaugcugaaa

SEQ ID NO: 3372117 - RNA, 20 nt, Human
accagaugcugaaagagaaa

SEQ ID NO: 3372118 - RNA, 14 nt, Human
accagaugugacag

SEQ ID NO: 3372119 - RNA, 16 nt, Human
accagcacacucccga

SEQ ID NO: 3372120 - RNA, 14 nt, Human
accagcagaaaugc

SEQ ID NO: 3372121 - RNA, 22 nt, Human
accagcagacagagccaggaga

SEQ ID NO: 3372122 - RNA, 13 nt, Human
accagcagagcac

SEQ ID NO: 3372123 - RNA, 14 nt, Human
accagcagccugga

SEQ ID NO: 3372124 - RNA, 16 nt, Human
accagcaucaccugcc

SEQ ID NO: 3372125 - RNA, 17 nt, Human
accagcaucaccugccu

SEQ ID NO: 3372126 - RNA, 17 nt, Human
accagcauuccuuuuga

SEQ ID NO: 3372127 - RNA, 15 nt, Human
accagccagauccuc

SEQ ID NO: 3372128 - RNA, 22 nt, Human
accagccauacuuaucucucug

SEQ ID NO: 3372129 - RNA, 22 nt, Human
accagcccacgcugacuacagg

SEQ ID NO: 3372130 - RNA, 15 nt, Human
accagcccagauguu

SEQ ID NO: 3372131 - RNA, 18 nt, Human
accagcccauggcccugu

SEQ ID NO: 3372132 - RNA, 19 nt, Human
accagcccauggcccugug

SEQ ID NO: 3372133 - RNA, 20 nt, Human
accagcccauggcccugugc

SEQ ID NO: 3372134 - RNA, 19 nt, Human
accagccccaauccaaaac

SEQ ID NO: 3372135 - RNA, 17 nt, Human
accagccccacugccag

SEQ ID NO: 3372136 - RNA, 20 nt, Human
aauuucagagagaaucaaga

SEQ ID NO: 3372137 - RNA, 20 nt, Human
aauuucagguuuuguaaaga

SEQ ID NO: 3372138 - RNA, 22 nt, Human
aauuucauaccuaucaucuuaa

SEQ ID NO: 3372139 - RNA, 16 nt, Human
aauuucauaugcugua

SEQ ID NO: 3372140 - RNA, 18 nt, Human
aauuucauguaaaacaga

SEQ ID NO: 3372141 - RNA, 15 nt, Human
aauuucauuuauuuu

SEQ ID NO: 3372142 - RNA, 11 nt, Human
aauuuccagag

SEQ ID NO: 3372143 - RNA, 15 nt, Human
aauuuccagagaaga

SEQ ID NO: 3372144 - RNA, 15 nt, Human
aauuuccaguaccuu

SEQ ID NO: 3372145 - RNA, 24 nt, Human
aauuuccagugagcuuaucaugcu

SEQ ID NO: 3372146 - RNA, 14 nt, Human
aauuucccaggacc

SEQ ID NO: 3372147 - RNA, 15 nt, Human
aauuucccaggaccc

SEQ ID NO: 3372148 - RNA, 17 nt, Human
aauuucccaggacccug

SEQ ID NO: 3372149 - RNA, 20 nt, Human
aauuuccccaacagugugaa

SEQ ID NO: 3372150 - RNA, 19 nt, Human
aauuucccccuaaaccaac

SEQ ID NO: 3372151 - RNA, 22 nt, Human
aauuuccuggugugaagguccu

SEQ ID NO: 3372152 - RNA, 20 nt, Human
aauuuccuguuggauuuguu

SEQ ID NO: 3372153 - RNA, 16 nt, Human
aauuuccuuuauauuu

SEQ ID NO: 3372154 - RNA, 14 nt, Human
aauuucgagauuug

SEQ ID NO: 3372155 - RNA, 17 nt, Human
aauuucggauuuuuucc

SEQ ID NO: 3372156 - RNA, 18 nt, Human
aauuucuaccauuucaga

SEQ ID NO: 3372157 - RNA, 22 nt, Human
aauuucuagccugcacuuugau

SEQ ID NO: 3372158 - RNA, 13 nt, Human
aauuucuauuaaa

SEQ ID NO: 3372159 - RNA, 14 nt, Human
aauuucucaucaca

SEQ ID NO: 3372160 - RNA, 11 nt, Human
aauuucucccc

SEQ ID NO: 3372161 - RNA, 19 nt, Human
aauuucuccccagggugga

SEQ ID NO: 3372162 - RNA, 14 nt, Human
aauuucugugaaac

SEQ ID NO: 3372163 - RNA, 21 nt, Human
aauuucuguguugccaagcuc

SEQ ID NO: 3372164 - RNA, 15 nt, Human
aauuucuuaacuucu

SEQ ID NO: 3372165 - RNA, 16 nt, Human
aauuucuuaacuucuu

SEQ ID NO: 3372166 - RNA, 20 nt, Human
aauuucuuaugugacauuaa

SEQ ID NO: 3372167 - RNA, 21 nt, Human
aauuucuugcucuaucucuca

SEQ ID NO: 3372168 - RNA, 11 nt, Human
aauuucuuguu

SEQ ID NO: 3372169 - RNA, 18 nt, Human
aauuucuuugccuguuca

SEQ ID NO: 3372170 - RNA, 13 nt, Human
aauuugaaccaaa

SEQ ID NO: 3372171 - RNA, 23 nt, Human
aauuugaaccaaaacauuccguu

SEQ ID NO: 3372172 - RNA, 17 nt, Human
aauuugaagacuucaaa

SEQ ID NO: 3372173 - RNA, 13 nt, Human
aauuugaaugaaa

SEQ ID NO: 3372174 - RNA, 22 nt, Human
aauuugaauuaucagcaaagaa

SEQ ID NO: 3372175 - RNA, 17 nt, Human
aauuugacuaauuuuac

SEQ ID NO: 3372176 - RNA, 18 nt, Human
aauuugacuuuucuguaa

SEQ ID NO: 3372177 - RNA, 24 nt, Human
aauuugaguaaucugaucguucuu

SEQ ID NO: 3372178 - RNA, 20 nt, Human
aauuugaguuggaucaucua

SEQ ID NO: 3372179 - RNA, 18 nt, Human
aauuugauacauaauaaa

SEQ ID NO: 3372180 - RNA, 21 nt, Human
aauuugauacauaugugaaua

SEQ ID NO: 3372181 - RNA, 13 nt, Human
aauuugauacuua

SEQ ID NO: 3372182 - RNA, 16 nt, Human
aauuugauaugugaac

SEQ ID NO: 3372183 - RNA, 18 nt, Human
aauuugauaugugaacag

SEQ ID NO: 3372184 - RNA, 17 nt, Human
aauuugauuaacaaaua

SEQ ID NO: 3372185 - RNA, 18 nt, Human
aauuugauuaacaaauau

SEQ ID NO: 3372186 - RNA, 12 nt, Human
aauuugauugau

SEQ ID NO: 3372187 - RNA, 13 nt, Human
aauuugauugauu

SEQ ID NO: 3372188 - RNA, 14 nt, Human
aauuugauugauuu

SEQ ID NO: 3372189 - RNA, 17 nt, Human
aauuugauugauuugaa

SEQ ID NO: 3372190 - RNA, 10 nt, Human
aauuugcaaa

SEQ ID NO: 3372191 - RNA, 18 nt, Human
aauuugcaaaguacugua

SEQ ID NO: 3372192 - RNA, 18 nt, Human
aauuugcaagucauggcu

SEQ ID NO: 3372193 - RNA, 22 nt, Human
aauuugcacaucuuggcuaugu

SEQ ID NO: 3372194 - RNA, 20 nt, Human
aauuugcacuaaaucagaga

SEQ ID NO: 3372195 - RNA, 15 nt, Human
aauuugcauuaaauu

SEQ ID NO: 3372196 - RNA, 17 nt, Human
aauuugcauuaaauuac

SEQ ID NO: 3372197 - RNA, 22 nt, Human
aauuugccuguaacaagccaga

SEQ ID NO: 3372198 - RNA, 16 nt, Human
aauuugcuucacucaa

SEQ ID NO: 3372199 - RNA, 21 nt, Human
aauuuggaaacuaauaaaaua

SEQ ID NO: 3372200 - RNA, 23 nt, Human
aauuuggaaacuaauaaaauauu

SEQ ID NO: 3372201 - RNA, 15 nt, Human
aauuuggaauucugu

SEQ ID NO: 3372202 - RNA, 16 nt, Human
aauuuggauugcuaau

SEQ ID NO: 3372203 - RNA, 18 nt, Human
aauuugggacccugcuuu

SEQ ID NO: 3372204 - RNA, 16 nt, Human
aauuugggagauauau

SEQ ID NO: 3372205 - RNA, 24 nt, Human
aauuuggggacagauucagucuug

SEQ ID NO: 3372206 - RNA, 21 nt, Human
aauuugggggacuuacaugau

SEQ ID NO: 3372207 - RNA, 20 nt, Human
aauuuggguaugaacagauu

SEQ ID NO: 3372208 - RNA, 19 nt, Human
aauuugguuuaaaaauaca

SEQ ID NO: 3372209 - RNA, 22 nt, Human
aauuuguaaaaacagcauugcu

SEQ ID NO: 3372210 - RNA, 23 nt, Human
aauuuguaaaaacagcauugcuu

SEQ ID NO: 3372211 - RNA, 13 nt, Human
aauuuguaaguuu

SEQ ID NO: 3372212 - RNA, 23 nt, Human
aauuuguaaguuucaggugacau

SEQ ID NO: 3372213 - RNA, 17 nt, Human
aauuuguaaugucuuga

SEQ ID NO: 3372214 - RNA, 17 nt, Human
aauuuguaggguuucua

SEQ ID NO: 3372215 - RNA, 15 nt, Human
aauuuguaucugaag

SEQ ID NO: 3372216 - RNA, 17 nt, Human
aauuuguaucugaagga

SEQ ID NO: 3372217 - RNA, 22 nt, Human
aauuuguaucugaaggagauuu

SEQ ID NO: 3372218 - RNA, 22 nt, Human
acccaggaggcagggaggcagc

SEQ ID NO: 3372219 - RNA, 23 nt, Human
acccaggaggcagggaggcagcc

SEQ ID NO: 3372220 - RNA, 19 nt, Human
acccaggagggagggggcu

SEQ ID NO: 3372221 - RNA, 21 nt, Human
acccaggagguggagguugca

SEQ ID NO: 3372222 - RNA, 23 nt, Human
acccaggagguggagguugcagu

SEQ ID NO: 3372223 - RNA, 17 nt, Human
acccaggaguguggcca

SEQ ID NO: 3372224 - RNA, 20 nt, Human
acccaggauuugcugggaga

SEQ ID NO: 3372225 - RNA, 19 nt, Human
acccaggccaggcaugugg

SEQ ID NO: 3372226 - RNA, 15 nt, Human
acccaggccgcagcu

SEQ ID NO: 3372227 - RNA, 19 nt, Human
acccaggcuagagugcaau

SEQ ID NO: 3372228 - RNA, 20 nt, Human
acccaggcuggaguacagug

SEQ ID NO: 3372229 - RNA, 19 nt, Human
acccaggcuggagugcagu

SEQ ID NO: 3372230 - RNA, 12 nt, Human
acccaggcuggg

SEQ ID NO: 3372231 - RNA, 13 nt, Human
acccagggaacag

SEQ ID NO: 3372232 - RNA, 13 nt, Human
acccagggcucug

SEQ ID NO: 3372233 - RNA, 17 nt, Human
acccagggcucugcccc

SEQ ID NO: 3372234 - RNA, 18 nt, Human
acccaggguaaucuguac

SEQ ID NO: 3372235 - RNA, 13 nt, Human
acccagguggguc

SEQ ID NO: 3372236 - RNA, 18 nt, Human
acccaggugggucccggc

SEQ ID NO: 3372237 - RNA, 16 nt, Human
acccagguguggccua

SEQ ID NO: 3372238 - RNA, 19 nt, Human
acccagguuggagugcagu

SEQ ID NO: 3372239 - RNA, 20 nt, Human
acccagguuggagugcagug

SEQ ID NO: 3372240 - RNA, 13 nt, Human
acccagucccugg

SEQ ID NO: 3372241 - RNA, 16 nt, Human
acccagucuguucccc

SEQ ID NO: 3372242 - RNA, 12 nt, Human
acccagugcaga

SEQ ID NO: 3372243 - RNA, 18 nt, Human
acccagugcagaauguaa

SEQ ID NO: 3372244 - RNA, 16 nt, Human
acccaguggcagggca

SEQ ID NO: 3372245 - RNA, 24 nt, Human
acccaguggcagggcacagggccu

SEQ ID NO: 3372246 - RNA, 22 nt, Human
acccaguguuuuaggagcauga

SEQ ID NO: 3372247 - RNA, 18 nt, Human
acccaguugccaucugcg

SEQ ID NO: 3372248 - RNA, 16 nt, Human
acccauaauccuuucu

SEQ ID NO: 3372249 - RNA, 14 nt, Human
acccauacaccccc

SEQ ID NO: 3372250 - RNA, 22 nt, Human
acccauagaucuucugaaauga

SEQ ID NO: 3372251 - RNA, 15 nt, Human
acccauagcuuccau

SEQ ID NO: 3372252 - RNA, 16 nt, Human
acccauagcuuccaug

SEQ ID NO: 3372253 - RNA, 15 nt, Human
acccauaggcccaca

SEQ ID NO: 3372254 - RNA, 15 nt, Human
acccauauccccucu

SEQ ID NO: 3372255 - RNA, 19 nt, Human
acccauauccccucucccc

SEQ ID NO: 3372256 - RNA, 21 nt, Human
acccauauccccucucccccc

SEQ ID NO: 3372257 - RNA, 18 nt, Human
acccaucacgccugugca

SEQ ID NO: 3372258 - RNA, 18 nt, Human
acccaucagaaggagaag

SEQ ID NO: 3372259 - RNA, 17 nt, Human
acccauccccgcagugu

SEQ ID NO: 3372260 - RNA, 21 nt, Human
acccauccuaccaaugcaugc

SEQ ID NO: 3372261 - RNA, 14 nt, Human
acccauccuagaga

SEQ ID NO: 3372262 - RNA, 17 nt, Human
acccaucgcuguguguu

SEQ ID NO: 3372263 - RNA, 22 nt, Human
acccaucugcaccccccugggc

SEQ ID NO: 3372264 - RNA, 18 nt, Human
acccaucuguuuuuugua

SEQ ID NO: 3372265 - RNA, 14 nt, Human
acccaucuuaaaaa

SEQ ID NO: 3372266 - RNA, 19 nt, Human
acccaugaagacaggacag

SEQ ID NO: 3372267 - RNA, 20 nt, Human
acccaugaagacaggacagu

SEQ ID NO: 3372268 - RNA, 13 nt, Human
acccaugaggcaa

SEQ ID NO: 3372269 - RNA, 21 nt, Human
acccaugaguuggggucuggc

SEQ ID NO: 3372270 - RNA, 15 nt, Human
acccaugcugcccug

SEQ ID NO: 3372271 - RNA, 16 nt, Human
acccaugcugcccugu

SEQ ID NO: 3372272 - RNA, 17 nt, Human
acccaugggcaggagac

SEQ ID NO: 3372273 - RNA, 14 nt, Human
acccaugggcucug

SEQ ID NO: 3372274 - RNA, 17 nt, Human
acccaugggcucugaca

SEQ ID NO: 3372275 - RNA, 22 nt, Human
acccauucguggugaucaauua

SEQ ID NO: 3372276 - RNA, 19 nt, Human
acccauucuacacagagca

SEQ ID NO: 3372277 - RNA, 17 nt, Human
acccauugcuguugucc

SEQ ID NO: 3372278 - RNA, 20 nt, Human
acccauuuaaauuuuuuucc

SEQ ID NO: 3372279 - RNA, 14 nt, Human
acccauuuucacau

SEQ ID NO: 3372280 - RNA, 17 nt, Human
acccauuuuuccuuuug

SEQ ID NO: 3372281 - RNA, 15 nt, Human
accccaaagagccug

SEQ ID NO: 3372282 - RNA, 21 nt, Human
accccaaagagccuggagaag

SEQ ID NO: 3372283 - RNA, 22 nt, Human
accccaaagagccuggagaagc

SEQ ID NO: 3372284 - RNA, 15 nt, Human
accccaaagccccuu

SEQ ID NO: 3372285 - RNA, 16 nt, Human
accccaaagccccuug

SEQ ID NO: 3372286 - RNA, 18 nt, Human
accccaaagccccuugcu

SEQ ID NO: 3372287 - RNA, 18 nt, Human
accccaaagcuuuccugc

SEQ ID NO: 3372288 - RNA, 15 nt, Human
accccaacaaaccau

SEQ ID NO: 3372289 - RNA, 15 nt, Human
accccaaccugcucu

SEQ ID NO: 3372290 - RNA, 18 nt, Human
accccaaccugcucuccu

SEQ ID NO: 3372291 - RNA, 15 nt, Human
accccaacuccagua

SEQ ID NO: 3372292 - RNA, 16 nt, Human
accccaagacucccau

SEQ ID NO: 3372293 - RNA, 17 nt, Human
accccaagacucccaug

SEQ ID NO: 3372294 - RNA, 13 nt, Human
accccaagagaac

SEQ ID NO: 3372295 - RNA, 16 nt, Human
accccaagagaacucg

SEQ ID NO: 3372296 - RNA, 18 nt, Human
accccaagagaacucgcg

SEQ ID NO: 3372297 - RNA, 16 nt, Human
accccaagcgcccugg

SEQ ID NO: 3372298 - RNA, 19 nt, Human
accccaagcgcccuggccc

SEQ ID NO: 3372299 - RNA, 23 nt, Human
accccaagcgcccuggcccccac

SEQ ID NO: 3372300 - RNA, 20 nt, Human
accccaaguagucugcucac

SEQ ID NO: 3372301 - RNA, 17 nt, Human
accccaauuccuuguag

SEQ ID NO: 3372302 - RNA, 20 nt, Human
accccaauuucggauuuuuu

SEQ ID NO: 3372303 - RNA, 21 nt, Human
accccaauuucggauuuuuuc

SEQ ID NO: 3372304 - RNA, 17 nt, Human
accccacaccaggccgu

SEQ ID NO: 3372305 - RNA, 22 nt, Human
accccacaccaggccguccucc

SEQ ID NO: 3372306 - RNA, 18 nt, Human
accccacacgcuccuccc

SEQ ID NO: 3372307 - RNA, 21 nt, Human
accccacccccuucagugccc

SEQ ID NO: 3372308 - RNA, 13 nt, Human
accccacccuccc

SEQ ID NO: 3372309 - RNA, 19 nt, Human
accccacccucccuggagu

SEQ ID NO: 3372310 - RNA, 15 nt, Human
accccacccuguuug

SEQ ID NO: 3372311 - RNA, 16 nt, Human
accccacccuguuugg

SEQ ID NO: 3372312 - RNA, 12 nt, Human
accccaccugca

SEQ ID NO: 3372313 - RNA, 12 nt, Human
accccacuccca

SEQ ID NO: 3372314 - RNA, 14 nt, Human
accccacucccaca

SEQ ID NO: 3372315 - RNA, 17 nt, Human
accccagagauucccaa

SEQ ID NO: 3372316 - RNA, 13 nt, Human
accccagagccac

SEQ ID NO: 3372317 - RNA, 19 nt, Human
accccagagccacacaugg

SEQ ID NO: 3372318 - RNA, 20 nt, Human
accccagcaauuaugaaaau

SEQ ID NO: 3372319 - RNA, 23 nt, Human
accccagccgcucggaggcccca

SEQ ID NO: 3372320 - RNA, 18 nt, Human
accccagccuggccacgc

SEQ ID NO: 3372321 - RNA, 15 nt, Human
accccagcugggagg

SEQ ID NO: 3372322 - RNA, 20 nt, Human
accccagcugggaggcaaga

SEQ ID NO: 3372323 - RNA, 22 nt, Human
accccagcuggggccaggcugg

SEQ ID NO: 3372324 - RNA, 23 nt, Human
accccagcuggggccaggcuggg

SEQ ID NO: 3372325 - RNA, 20 nt, Human
accccagcugugagccuugg

SEQ ID NO: 3372326 - RNA, 22 nt, Human
accccagcugugagccuuggcu

SEQ ID NO: 3372327 - RNA, 21 nt, Human
accccaggacgccacucauuu

SEQ ID NO: 3372328 - RNA, 18 nt, Human
accccaggcccacucagg

SEQ ID NO: 3372329 - RNA, 14 nt, Human
accccaggccccga

SEQ ID NO: 3372330 - RNA, 20 nt, Human
accccaggcugaagcagguu

SEQ ID NO: 3372331 - RNA, 15 nt, Human
accccagggcacagg

SEQ ID NO: 3372332 - RNA, 19 nt, Human
accccagggcacaggagcu

SEQ ID NO: 3372333 - RNA, 13 nt, Human
accccagggccug

SEQ ID NO: 3372334 - RNA, 23 nt, Human
accccagggcuguaacugccagg

SEQ ID NO: 3372335 - RNA, 16 nt, Human
accccaguggccacuc

SEQ ID NO: 3372336 - RNA, 23 nt, Human
accccaguggccacucagcuucc

SEQ ID NO: 3372337 - RNA, 17 nt, Human
acaauacagauaacauu

SEQ ID NO: 3372338 - RNA, 23 nt, Human
acaauacaucccuuaccugggaa

SEQ ID NO: 3372339 - RNA, 18 nt, Human
acaauacucauaauguga

SEQ ID NO: 3372340 - RNA, 20 nt, Human
acaauacucauaaugugaag

SEQ ID NO: 3372341 - RNA, 20 nt, Human
acaauagcuuuacccucagg

SEQ ID NO: 3372342 - RNA, 22 nt, Human
acaauaggaugggcuucugugc

SEQ ID NO: 3372343 - RNA, 16 nt, Human
acaauauauaaaaaua

SEQ ID NO: 3372344 - RNA, 17 nt, Human
acaauauauaaaaauau

SEQ ID NO: 3372345 - RNA, 17 nt, Human
acaauaucauaucauca

SEQ ID NO: 3372346 - RNA, 19 nt, Human
acaauaugcaaugugaagc

SEQ ID NO: 3372347 - RNA, 10 nt, Human
acaauauuua

SEQ ID NO: 3372348 - RNA, 13 nt, Human
acaauauuuaaaa

SEQ ID NO: 3372349 - RNA, 14 nt, Human
acaauauuuuaagc

SEQ ID NO: 3372350 - RNA, 15 nt, Human
acaauauuuuaagca

SEQ ID NO: 3372351 - RNA, 17 nt, Human
acaauauuuuaagcauu

SEQ ID NO: 3372352 - RNA, 19 nt, Human
acaaucaaaggaaaauagu

SEQ ID NO: 3372353 - RNA, 16 nt, Human
acaaucagaaacucuu

SEQ ID NO: 3372354 - RNA, 18 nt, Human
acaaucagcugcuuuguu

SEQ ID NO: 3372355 - RNA, 18 nt, Human
acaaucaguccccuccca

SEQ ID NO: 3372356 - RNA, 19 nt, Human
acaaucaguccccucccau

SEQ ID NO: 3372357 - RNA, 18 nt, Human
acaaucauugcugaaaau

SEQ ID NO: 3372358 - RNA, 17 nt, Human
acaaucauuguuuugaa

SEQ ID NO: 3372359 - RNA, 21 nt, Human
acaaucauuguuuugaauauu

SEQ ID NO: 3372360 - RNA, 17 nt, Human
acaauccuagugcuuuc

SEQ ID NO: 3372361 - RNA, 23 nt, Human
acaauccuagugcuuuccuuuuu

SEQ ID NO: 3372362 - RNA, 22 nt, Human
accucagucaguauuguuuugg

SEQ ID NO: 3372363 - RNA, 23 nt, Human
accucagugccuuccuguuuuuc

SEQ ID NO: 3372364 - RNA, 19 nt, Human
accucagugucauuuauga

SEQ ID NO: 3372365 - RNA, 20 nt, Human
accucaguucccuuggccuc

SEQ ID NO: 3372366 - RNA, 13 nt, Human
accucauccaaac

SEQ ID NO: 3372367 - RNA, 19 nt, Human
accucaugcaucuccaccu

SEQ ID NO: 3372368 - RNA, 21 nt, Human
accucaugcaucuccaccugc

SEQ ID NO: 3372369 - RNA, 13 nt, Human
accucaugcccac

SEQ ID NO: 3372370 - RNA, 20 nt, Human
accucaugcccacccccugc

SEQ ID NO: 3372371 - RNA, 22 nt, Human
accucaugcccacccccugccc

SEQ ID NO: 3372372 - RNA, 19 nt, Human
accuccaaaacuccugccc

SEQ ID NO: 3372373 - RNA, 21 nt, Human
accuccaaaacuccugccccu

SEQ ID NO: 3372374 - RNA, 19 nt, Human
accuccaaaagcccugagu

SEQ ID NO: 3372375 - RNA, 22 nt, Human
accuccaacccugccgucacca

SEQ ID NO: 3372376 - RNA, 13 nt, Human
accuccacagcuu

SEQ ID NO: 3372377 - RNA, 14 nt, Human
accuccacagcuuc

SEQ ID NO: 3372378 - RNA, 18 nt, Human
accuccacaguucagugg

SEQ ID NO: 3372379 - RNA, 17 nt, Human
accuccaccuccugggu

SEQ ID NO: 3372380 - RNA, 17 nt, Human
accuccagcccgggagc

SEQ ID NO: 3372381 - RNA, 21 nt, Human
accuccagcccgggagccuag

SEQ ID NO: 3372382 - RNA, 22 nt, Human
accuccagcccgggagccuagg

SEQ ID NO: 3372383 - RNA, 21 nt, Human
accuccauucuauuuuagaau

SEQ ID NO: 3372384 - RNA, 19 nt, Human
accucccagagguccagcc

SEQ ID NO: 3372385 - RNA, 21 nt, Human
accucccagagguccagccca

SEQ ID NO: 3372386 - RNA, 22 nt, Human
accucccagagguccagcccau

SEQ ID NO: 3372387 - RNA, 13 nt, Human
accucccagcccc

SEQ ID NO: 3372388 - RNA, 19 nt, Human
accucccagcccuauggau

SEQ ID NO: 3372389 - RNA, 20 nt, Human
accucccagcccuauggaug

SEQ ID NO: 3372390 - RNA, 19 nt, Human
accuccccacgcccucccc

SEQ ID NO: 3372391 - RNA, 20 nt, Human
accuccccacgcccuccccu

SEQ ID NO: 3372392 - RNA, 15 nt, Human
accuccccagcauuc

SEQ ID NO: 3372393 - RNA, 21 nt, Human
accuccccagcauuccagccc

SEQ ID NO: 3372394 - RNA, 12 nt, Human
accuccccagcc

SEQ ID NO: 3372395 - RNA, 13 nt, Human
accuccccagccc

SEQ ID NO: 3372396 - RNA, 16 nt, Human
accuccccagccccua

SEQ ID NO: 3372397 - RNA, 14 nt, Human
accuccccagccug

SEQ ID NO: 3372398 - RNA, 14 nt, Human
accuccccccacug

SEQ ID NO: 3372399 - RNA, 22 nt, Human
accucccccuccuucccagcug

SEQ ID NO: 3372400 - RNA, 17 nt, Human
accuccccuauccaccc

SEQ ID NO: 3372401 - RNA, 19 nt, Human
accuccccuauccacccag

SEQ ID NO: 3372402 - RNA, 17 nt, Human
accuccccuccuugccu

SEQ ID NO: 3372403 - RNA, 20 nt, Human
accuccccuccuugccuccu

SEQ ID NO: 3372404 - RNA, 21 nt, Human
accuccccuccuugccuccug

SEQ ID NO: 3372405 - RNA, 15 nt, Human
accuccccugccuug

SEQ ID NO: 3372406 - RNA, 16 nt, Human
accuccccuugccagc

SEQ ID NO: 3372407 - RNA, 17 nt, Human
accuccccuugccagcu

SEQ ID NO: 3372408 - RNA, 13 nt, Human
accuccccuuggg

SEQ ID NO: 3372409 - RNA, 18 nt, Human
accucccucuuguuuugu

SEQ ID NO: 3372410 - RNA, 15 nt, Human
accucccugaaccau

SEQ ID NO: 3372411 - RNA, 20 nt, Human
accucccugaaccaucccug

SEQ ID NO: 3372412 - RNA, 12 nt, Human
accucccugcaa

SEQ ID NO: 3372413 - RNA, 14 nt, Human
accucccugcaacc

SEQ ID NO: 3372414 - RNA, 13 nt, Human
accucccugcaau

SEQ ID NO: 3372415 - RNA, 14 nt, Human
accucccugcccag

SEQ ID NO: 3372416 - RNA, 13 nt, Human
accucccuuccga

SEQ ID NO: 3372417 - RNA, 21 nt, Human
accuccggccaggugccuccu

SEQ ID NO: 3372418 - RNA, 23 nt, Human
accuccggccaggugccuccuga

SEQ ID NO: 3372419 - RNA, 17 nt, Human
accuccuaaaaggccca

SEQ ID NO: 3372420 - RNA, 19 nt, Human
accuccuauggguugucac

SEQ ID NO: 3372421 - RNA, 14 nt, Human
accuccucagggau

SEQ ID NO: 3372422 - RNA, 15 nt, Human
accuccucauggcag

SEQ ID NO: 3372423 - RNA, 18 nt, Human
accuccucccacugccca

SEQ ID NO: 3372424 - RNA, 23 nt, Human
accuccuccccccuccucugaaa

SEQ ID NO: 3372425 - RNA, 19 nt, Human
accuccucucacuccccag

SEQ ID NO: 3372426 - RNA, 16 nt, Human
accuccucucaguguu

SEQ ID NO: 3372427 - RNA, 12 nt, Human
accuccucugug

SEQ ID NO: 3372428 - RNA, 18 nt, Human
accuccucugugaagcau

SEQ ID NO: 3372429 - RNA, 14 nt, Human
accuccucuucccc

SEQ ID NO: 3372430 - RNA, 15 nt, Human
accuccucuuccccc

SEQ ID NO: 3372431 - RNA, 16 nt, Human
accuccucuucugacg

SEQ ID NO: 3372432 - RNA, 13 nt, Human
accuccugcccag

SEQ ID NO: 3372433 - RNA, 15 nt, Human
accuccugcccagga

SEQ ID NO: 3372434 - RNA, 13 nt, Human
accuccugccucg

SEQ ID NO: 3372435 - RNA, 13 nt, Human
accuccugggcua

SEQ ID NO: 3372436 - RNA, 12 nt, Human
accuccuggggc

SEQ ID NO: 3372437 - RNA, 13 nt, Human
accuccuguggaa

SEQ ID NO: 3372438 - RNA, 13 nt, Human
accuccuucccuc

SEQ ID NO: 3372439 - RNA, 15 nt, Human
accuccuucccucuc

SEQ ID NO: 3372440 - RNA, 19 nt, Human
accuccuucccucucugga

SEQ ID NO: 3372441 - RNA, 19 nt, Human
accuccuuucaucacacug

SEQ ID NO: 3372442 - RNA, 16 nt, Human
accuccuuucucuucu

SEQ ID NO: 3372443 - RNA, 16 nt, Human
accucgaguacugugg

SEQ ID NO: 3372444 - RNA, 18 nt, Human
accucgaguacugugggc

SEQ ID NO: 3372445 - RNA, 19 nt, Human
accucgaguacugugggca

SEQ ID NO: 3372446 - RNA, 13 nt, Human
accucgcccucuc

SEQ ID NO: 3372447 - RNA, 15 nt, Human
accucgcccucuccu

SEQ ID NO: 3372448 - RNA, 18 nt, Human
accucgcuggacucucag

SEQ ID NO: 3372449 - RNA, 17 nt, Human
accucggugccuuccuc

SEQ ID NO: 3372450 - RNA, 14 nt, Human
accucguccucccc

SEQ ID NO: 3372451 - RNA, 18 nt, Human
accucuaaaacaguccuu

SEQ ID NO: 3372452 - RNA, 16 nt, Human
accucuaacagcacca

SEQ ID NO: 3372453 - RNA, 19 nt, Human
accucuaacagcaccaaau

SEQ ID NO: 3372454 - RNA, 20 nt, Human
accucuaauaguauaaaccc

SEQ ID NO: 3372455 - RNA, 19 nt, Human
accucuacccaaacccuag

SEQ ID NO: 3372456 - RNA, 12 nt, Human
accucuagaauu

SEQ ID NO: 3372457 - RNA, 16 nt, Human
accucuagcccugccc

SEQ ID NO: 3372458 - RNA, 18 nt, Human
accucuagcccugcccgg

SEQ ID NO: 3372459 - RNA, 16 nt, Human
accucuaguagcugaa

SEQ ID NO: 3372460 - RNA, 18 nt, Human
accucuauaauugccacu

SEQ ID NO: 3372461 - RNA, 13 nt, Human
accucucacuccc

SEQ ID NO: 3372462 - RNA, 11 nt, Human
accucucccac

SEQ ID NO: 3372463 - RNA, 15 nt, Human
accucucccacggga

SEQ ID NO: 3372464 - RNA, 13 nt, Human
accucucccaggg

SEQ ID NO: 3372465 - RNA, 15 nt, Human
accucucccucaaca

SEQ ID NO: 3372466 - RNA, 15 nt, Human
accucucccuuggau

SEQ ID NO: 3372467 - RNA, 23 nt, Human
accucucccuuggauuguccccg

SEQ ID NO: 3372468 - RNA, 20 nt, Human
accucuccuuuggccauucc

SEQ ID NO: 3372469 - RNA, 22 nt, Human
accucucugucccuugcuguau

SEQ ID NO: 3372470 - RNA, 22 nt, Human
accucugaauuuacuuccuugc

SEQ ID NO: 3372471 - RNA, 13 nt, Human
accucugacagca

SEQ ID NO: 3372472 - RNA, 15 nt, Human
accucugauaccuca

SEQ ID NO: 3372473 - RNA, 21 nt, Human
accucugcacaagcugcaccc

SEQ ID NO: 3372474 - RNA, 15 nt, Human
accucugcagcaaua

SEQ ID NO: 3372475 - RNA, 12 nt, Human
accucugccuca

SEQ ID NO: 3372476 - RNA, 17 nt, Human
accucugccucagaaaa

SEQ ID NO: 3372477 - RNA, 18 nt, Human
accucugccucagaaaac

SEQ ID NO: 3372478 - RNA, 20 nt, Human
accucugccucagaaaacaa

SEQ ID NO: 3372479 - RNA, 23 nt, Human
accucugccugaagucacacagu

SEQ ID NO: 3372480 - RNA, 14 nt, Human
accucugcggaccc

SEQ ID NO: 3372481 - RNA, 19 nt, Human
accucugcggaccccagcu

SEQ ID NO: 3372482 - RNA, 22 nt, Human
accucugcucugaggcuuccag

SEQ ID NO: 3372483 - RNA, 15 nt, Human
accucugcugccucc

SEQ ID NO: 3372484 - RNA, 14 nt, Human
accucugcuuccca

SEQ ID NO: 3372485 - RNA, 16 nt, Human
accucuggacuggcua

SEQ ID NO: 3372486 - RNA, 21 nt, Human
accucuggauuaggucucugu

SEQ ID NO: 3372487 - RNA, 13 nt, Human
accucugggagcu

SEQ ID NO: 3372488 - RNA, 18 nt, Human
accucuggguugggauca

SEQ ID NO: 3372489 - RNA, 13 nt, Human
accucuguaauuu

SEQ ID NO: 3372490 - RNA, 15 nt, Human
accucugucauuugu

SEQ ID NO: 3372491 - RNA, 21 nt, Human
accucugucucauccuccugg

SEQ ID NO: 3372492 - RNA, 14 nt, Human
accucugugaccuc

SEQ ID NO: 3372493 - RNA, 19 nt, Human
accccaguucugcuccucu

SEQ ID NO: 3372494 - RNA, 21 nt, Human
accccauagugaccggcugcu

SEQ ID NO: 3372495 - RNA, 17 nt, Human
accccauccaguucaug

SEQ ID NO: 3372496 - RNA, 17 nt, Human
accccaucccuccccag

SEQ ID NO: 3372497 - RNA, 15 nt, Human
accccaucugcccag

SEQ ID NO: 3372498 - RNA, 19 nt, Human
accccaugcuggccuugcc

SEQ ID NO: 3372499 - RNA, 20 nt, Human
accccaugcuguugauugcu

SEQ ID NO: 3372500 - RNA, 23 nt, Human
accccaugcuguugauugcuaaa

SEQ ID NO: 3372501 - RNA, 19 nt, Human
accccauggagcugggcua

SEQ ID NO: 3372502 - RNA, 22 nt, Human
accccauggcagugggaaaaau

SEQ ID NO: 3372503 - RNA, 14 nt, Human
accccauggccggc

SEQ ID NO: 3372504 - RNA, 20 nt, Human
accccauggccggcuuucag

SEQ ID NO: 3372505 - RNA, 16 nt, Human
acccccaaauuuucuu

SEQ ID NO: 3372506 - RNA, 15 nt, Human
acccccacacacaca

SEQ ID NO: 3372507 - RNA, 18 nt, Human
acccgccucucccgucag

SEQ ID NO: 3372508 - RNA, 19 nt, Human
acccgccuuuuauaaaccu

SEQ ID NO: 3372509 - RNA, 15 nt, Human
acccgcucuggacca

SEQ ID NO: 3372510 - RNA, 18 nt, Human
acccggaggggccuggca

SEQ ID NO: 3372511 - RNA, 22 nt, Human
acccggcacccccugcagcuug

SEQ ID NO: 3372512 - RNA, 13 nt, Human
acccggcuaauuu

SEQ ID NO: 3372513 - RNA, 22 nt, Human
acccgggaaccuccccagccug

SEQ ID NO: 3372514 - RNA, 23 nt, Human
acccgggaaccuccccagccugc

SEQ ID NO: 3372515 - RNA, 22 nt, Human
acccgggaagggggcugggaca

SEQ ID NO: 3372516 - RNA, 12 nt, Human
acccgggcucag

SEQ ID NO: 3372517 - RNA, 14 nt, Human
acccggggcccagg

SEQ ID NO: 3372518 - RNA, 22 nt, Human
acccggggcccagggcaagcuc

SEQ ID NO: 3372519 - RNA, 14 nt, Human
acccgguucagugu

SEQ ID NO: 3372520 - RNA, 16 nt, Human
acccgugagcgccugu

SEQ ID NO: 3372521 - RNA, 19 nt, Human
acccgugagcgccugugca

SEQ ID NO: 3372522 - RNA, 18 nt, Human
acccgugccaaguccagg

SEQ ID NO: 3372523 - RNA, 13 nt, Human
acccguggaggcu

SEQ ID NO: 3372524 - RNA, 16 nt, Human
acccguucacauuuuu

SEQ ID NO: 3372525 - RNA, 17 nt, Human
acccguucaugggggag

SEQ ID NO: 3372526 - RNA, 23 nt, Human
acccguucugcuggccuggaucu

SEQ ID NO: 3372527 - RNA, 21 nt, Human
acccguuuuaugauuuacuca

SEQ ID NO: 3372528 - RNA, 22 nt, Human
acccguuuuaugauuuacucau

SEQ ID NO: 3372529 - RNA, 16 nt, Human
acccuaaaucugagga

SEQ ID NO: 3372530 - RNA, 15 nt, Human
acccuaaccaaguuc

SEQ ID NO: 3372531 - RNA, 16 nt, Human
acccuaagccuccuuu

SEQ ID NO: 3372532 - RNA, 21 nt, Human
acccuaauagacuaaaugaaa

SEQ ID NO: 3372533 - RNA, 13 nt, Human
acccuaaugucuu

SEQ ID NO: 3372534 - RNA, 19 nt, Human
acccuaccaacuuuacugu

SEQ ID NO: 3372535 - RNA, 16 nt, Human
acccuaccugugccug

SEQ ID NO: 3372536 - RNA, 14 nt, Human
acccuacuucuuuu

SEQ ID NO: 3372537 - RNA, 22 nt, Human
acccuagguucccggucccgag

SEQ ID NO: 3372538 - RNA, 16 nt, Human
acccuagguucccugu

SEQ ID NO: 3372539 - RNA, 22 nt, Human
acccuagguucccuguucuucc

SEQ ID NO: 3372540 - RNA, 15 nt, Human
acccuaguucuaccu

SEQ ID NO: 3372541 - RNA, 21 nt, Human
acccuaguucuaccucaggca

SEQ ID NO: 3372542 - RNA, 17 nt, Human
acccuauauguaguaua

SEQ ID NO: 3372543 - RNA, 18 nt, Human
acccuaucuccugacaga

SEQ ID NO: 3372544 - RNA, 14 nt, Human
acccuaugggucua

SEQ ID NO: 3372545 - RNA, 19 nt, Human
acccuaugggucuaggaca

SEQ ID NO: 3372546 - RNA, 23 nt, Human
acccuaugggucuaggacacagu

SEQ ID NO: 3372547 - RNA, 15 nt, Human
acccucacacuggga

SEQ ID NO: 3372548 - RNA, 21 nt, Human
acccucacuggcucuccuggc

SEQ ID NO: 3372549 - RNA, 14 nt, Human
acccucagcacccc

SEQ ID NO: 3372550 - RNA, 17 nt, Human
acccucagcaccccuuc

SEQ ID NO: 3372551 - RNA, 18 nt, Human
acccucagcaccccuucc

SEQ ID NO: 3372552 - RNA, 15 nt, Human
acccucaggcaggug

SEQ ID NO: 3372553 - RNA, 16 nt, Human
acccucaggcaggugg

SEQ ID NO: 3372554 - RNA, 22 nt, Human
acccucaggcauaggccugggu

SEQ ID NO: 3372555 - RNA, 23 nt, Human
acccucaggcauaggccugggug

SEQ ID NO: 3372556 - RNA, 13 nt, Human
acccucaucacca

SEQ ID NO: 3372557 - RNA, 14 nt, Human
acccucaugcugcc

SEQ ID NO: 3372558 - RNA, 16 nt, Human
acccucaugcugccaa

SEQ ID NO: 3372559 - RNA, 15 nt, Human
acccucauguucuua

SEQ ID NO: 3372560 - RNA, 17 nt, Human
acccucauguucuuaau

SEQ ID NO: 3372561 - RNA, 14 nt, Human
acccuccaaggcca

SEQ ID NO: 3372562 - RNA, 23 nt, Human
acccuccacccugucccccagcu

SEQ ID NO: 3372563 - RNA, 21 nt, Human
acccuccacucagcuguccug

SEQ ID NO: 3372564 - RNA, 15 nt, Human
acccuccagagacaa

SEQ ID NO: 3372565 - RNA, 13 nt, Human
acccucccacccc

SEQ ID NO: 3372566 - RNA, 13 nt, Human
acccucccagcuc

SEQ ID NO: 3372567 - RNA, 16 nt, Human
acccucccagcucuga

SEQ ID NO: 3372568 - RNA, 23 nt, Human
acccucccccaggaggucgaccc

SEQ ID NO: 3372569 - RNA, 12 nt, Human
acccuccccucc

SEQ ID NO: 3372570 - RNA, 18 nt, Human
acccuccccucucuugca

SEQ ID NO: 3372571 - RNA, 17 nt, Human
acccuccccuucccagg

SEQ ID NO: 3372572 - RNA, 20 nt, Human
acccuccccuucccagggca

SEQ ID NO: 3372573 - RNA, 17 nt, Human
acccucccucagccccu

SEQ ID NO: 3372574 - RNA, 16 nt, Human
acccucccuccgaucc

SEQ ID NO: 3372575 - RNA, 22 nt, Human
acccucccuccgauccuuccuc

SEQ ID NO: 3372576 - RNA, 23 nt, Human
acccucccuccgauccuuccucc

SEQ ID NO: 3372577 - RNA, 12 nt, Human
acccucccugcu

SEQ ID NO: 3372578 - RNA, 14 nt, Human
acccucccugcugu

SEQ ID NO: 3372579 - RNA, 17 nt, Human
acccuccuguaaauggu

SEQ ID NO: 3372580 - RNA, 18 nt, Human
acccuccugucuucccag

SEQ ID NO: 3372581 - RNA, 21 nt, Human
acccuccugucuucccagggu

SEQ ID NO: 3372582 - RNA, 23 nt, Human
acccuccugucuucccaggguag

SEQ ID NO: 3372583 - RNA, 11 nt, Human
acccuccuguu

SEQ ID NO: 3372584 - RNA, 19 nt, Human
acccuccuguugcacccag

SEQ ID NO: 3372585 - RNA, 23 nt, Human
acccuccuguugcacccagcccu

SEQ ID NO: 3372586 - RNA, 16 nt, Human
acccucgaagcgcgcc

SEQ ID NO: 3372587 - RNA, 20 nt, Human
acccucgaagcgcgccacuc

SEQ ID NO: 3372588 - RNA, 18 nt, Human
acccucgccggacccucu

SEQ ID NO: 3372589 - RNA, 16 nt, Human
acccucgcuggccccc

SEQ ID NO: 3372590 - RNA, 17 nt, Human
acccucgcuggccccca

SEQ ID NO: 3372591 - RNA, 15 nt, Human
acccucgggcccacc

SEQ ID NO: 3372592 - RNA, 17 nt, Human
acccucggggauguguc

SEQ ID NO: 3372593 - RNA, 23 nt, Human
acccucggggauguguccugaca

SEQ ID NO: 3372594 - RNA, 20 nt, Human
acccucguggacaccugccc

SEQ ID NO: 3372595 - RNA, 23 nt, Human
acccucguggacaccugcccugc

SEQ ID NO: 3372596 - RNA, 22 nt, Human
acccucuaaccucgcccucucc

SEQ ID NO: 3372597 - RNA, 19 nt, Human
acccucucaggugaccaaa

SEQ ID NO: 3372598 - RNA, 16 nt, Human
acccucugaaauacau

SEQ ID NO: 3372599 - RNA, 14 nt, Human
acccucugccacca

SEQ ID NO: 3372600 - RNA, 20 nt, Human
acccucuggauucugaaucu

SEQ ID NO: 3372601 - RNA, 11 nt, Human
acccucuggcc

SEQ ID NO: 3372602 - RNA, 15 nt, Human
acccucugggaaccu

SEQ ID NO: 3372603 - RNA, 20 nt, Human
acccucugggaaccucccag

SEQ ID NO: 3372604 - RNA, 21 nt, Human
acccucugggaaccucccaga

SEQ ID NO: 3372605 - RNA, 22 nt, Human
acccucuguaccccaugaccuu

SEQ ID NO: 3372606 - RNA, 14 nt, Human
acccucuuagaaaa

SEQ ID NO: 3372607 - RNA, 23 nt, Human
acccucuugcccauccugacuga

SEQ ID NO: 3372608 - RNA, 16 nt, Human
acccucuuugcugcag

SEQ ID NO: 3372609 - RNA, 12 nt, Human
acccugaaaugu

SEQ ID NO: 3372610 - RNA, 13 nt, Human
acccugaaaugug

SEQ ID NO: 3372611 - RNA, 14 nt, Human
acccugaaaugugu

SEQ ID NO: 3372612 - RNA, 15 nt, Human
acccugaaaugugug

SEQ ID NO: 3372613 - RNA, 22 nt, Human
acccugaaugguuccaugccug

SEQ ID NO: 3372614 - RNA, 21 nt, Human
acccugaauuuggccugcacu

SEQ ID NO: 3372615 - RNA, 17 nt, Human
acccugaccagcucccc

SEQ ID NO: 3372616 - RNA, 13 nt, Human
acccugaccuggc

SEQ ID NO: 3372617 - RNA, 20 nt, Human
acccugaccuggcccccuca

SEQ ID NO: 3372618 - RNA, 11 nt, Human
acccugagccc

SEQ ID NO: 3372619 - RNA, 17 nt, Human
acccugaggagucugag

SEQ ID NO: 3372620 - RNA, 16 nt, Human
acccugaguugcuuuu

SEQ ID NO: 3372621 - RNA, 22 nt, Human
acccugauuuaggagaagccag

SEQ ID NO: 3372622 - RNA, 17 nt, Human
acccugauuucuugcuu

SEQ ID NO: 3372623 - RNA, 18 nt, Human
acccugcaaaggacuguu

SEQ ID NO: 3372624 - RNA, 15 nt, Human
acccugcaaggccca

SEQ ID NO: 3372625 - RNA, 16 nt, Human
acccugcaaggcccac

SEQ ID NO: 3372626 - RNA, 14 nt, Human
acccugccaggcac

SEQ ID NO: 3372627 - RNA, 21 nt, Human
acccugccaggcacaggcagg

SEQ ID NO: 3372628 - RNA, 23 nt, Human
acccugccaggcacaggcagggc

SEQ ID NO: 3372629 - RNA, 22 nt, Human
acccugccauggaacuguuucc

SEQ ID NO: 3372630 - RNA, 17 nt, Human
acccugccccagcuggg

SEQ ID NO: 3372631 - RNA, 18 nt, Human
acccugccccugccccgu

SEQ ID NO: 3372632 - RNA, 12 nt, Human
acccugcccugu

SEQ ID NO: 3372633 - RNA, 13 nt, Human
acccugcccugug

SEQ ID NO: 3372634 - RNA, 21 nt, Human
acccugcccuuguuuggggca

SEQ ID NO: 3372635 - RNA, 23 nt, Human
acccugccucucccaggcagggg

SEQ ID NO: 3372636 - RNA, 18 nt, Human
acccugcgaaggggcccu

SEQ ID NO: 3372637 - RNA, 20 nt, Human
acccugcgaaggggcccugg

SEQ ID NO: 3372638 - RNA, 22 nt, Human
acccugcgaaggggcccugguc

SEQ ID NO: 3372639 - RNA, 16 nt, Human
acccugcuuggcccag

SEQ ID NO: 3372640 - RNA, 12 nt, Human
acccuggaggca

SEQ ID NO: 3372641 - RNA, 20 nt, Human
acccuggaggcaccuggugg

SEQ ID NO: 3372642 - RNA, 21 nt, Human
acccuggaggccccaacccug

SEQ ID NO: 3372643 - RNA, 15 nt, Human
acccuggcauuaugu

SEQ ID NO: 3372644 - RNA, 16 nt, Human
acccuggccccucucc

SEQ ID NO: 3372645 - RNA, 21 nt, Human
acccuggccgaguccaagcug

SEQ ID NO: 3372646 - RNA, 16 nt, Human
acccuggccgcccccu

SEQ ID NO: 3372647 - RNA, 23 nt, Human
acccuggccuagaccagcagaca

SEQ ID NO: 3372648 - RNA, 15 nt, Human
acccuggcuccuugu

SEQ ID NO: 3372649 - RNA, 22 nt, Human
acccugggcccugggcuggaau

SEQ ID NO: 3372650 - RNA, 21 nt, Human
acccugggcucugggagcagc

SEQ ID NO: 3372651 - RNA, 16 nt, Human
acagagaaaccagcuu

SEQ ID NO: 3372652 - RNA, 18 nt, Human
acagagaaaccagcuucc

SEQ ID NO: 3372653 - RNA, 20 nt, Human
acagagaaaccagcuuccuu

SEQ ID NO: 3372654 - RNA, 16 nt, Human
acagagaagccagcuu

SEQ ID NO: 3372655 - RNA, 18 nt, Human
acagagaagccagcuugu

SEQ ID NO: 3372656 - RNA, 20 nt, Human
acagagaagccaucaccuca

SEQ ID NO: 3372657 - RNA, 21 nt, Human
acagagaagccaucaccucag

SEQ ID NO: 3372658 - RNA, 20 nt, Human
acagagaagcggauuuccag

SEQ ID NO: 3372659 - RNA, 16 nt, Human
acagagaaggcaggaa

SEQ ID NO: 3372660 - RNA, 13 nt, Human
acagagaagucac

SEQ ID NO: 3372661 - RNA, 17 nt, Human
acagagaagucacaggg

SEQ ID NO: 3372662 - RNA, 15 nt, Human
acagagacaccugca

SEQ ID NO: 3372663 - RNA, 21 nt, Human
acagagacaccugcaccuccc

SEQ ID NO: 3372664 - RNA, 23 nt, Human
acagagacaggcccaagagauga

SEQ ID NO: 3372665 - RNA, 14 nt, Human
acagagaccaagau

SEQ ID NO: 3372666 - RNA, 11 nt, Human
acagagaccua

SEQ ID NO: 3372667 - RNA, 14 nt, Human
acagagaccuccug

SEQ ID NO: 3372668 - RNA, 20 nt, Human
acagagacugaauagauaug

SEQ ID NO: 3372669 - RNA, 23 nt, Human
acagagagacagacuugagaacu

SEQ ID NO: 3372670 - RNA, 19 nt, Human
acagagagagauacucugg

SEQ ID NO: 3372671 - RNA, 16 nt, Human
acagagaggacuguag

SEQ ID NO: 3372672 - RNA, 16 nt, Human
acagagaggagaaaca

SEQ ID NO: 3372673 - RNA, 16 nt, Human
acagagcaaccccugg

SEQ ID NO: 3372674 - RNA, 12 nt, Human
acagagcaagac

SEQ ID NO: 3372675 - RNA, 11 nt, Human
acagagccagu

SEQ ID NO: 3372676 - RNA, 18 nt, Human
acagagccgagcaauauu

SEQ ID NO: 3372677 - RNA, 17 nt, Human
acagagccucgcucugu

SEQ ID NO: 3372678 - RNA, 21 nt, Human
acagagccucgggacaucaaa

SEQ ID NO: 3372679 - RNA, 15 nt, Human
acagagccugcccca

SEQ ID NO: 3372680 - RNA, 23 nt, Human
acagagcgugagcugagcaggcc

SEQ ID NO: 3372681 - RNA, 16 nt, Human
acagagcuacacaggg

SEQ ID NO: 3372682 - RNA, 16 nt, Human
acagagcugacaaaau

SEQ ID NO: 3372683 - RNA, 18 nt, Human
acagagcugacaaaauuu

SEQ ID NO: 3372684 - RNA, 20 nt, Human
acagagcugacaaaauuuug

SEQ ID NO: 3372685 - RNA, 18 nt, Human
acagagcugggauguuuc

SEQ ID NO: 3372686 - RNA, 21 nt, Human
acagagcugggauguuucugu

SEQ ID NO: 3372687 - RNA, 19 nt, Human
acagaggaagaauuuguua

SEQ ID NO: 3372688 - RNA, 20 nt, Human
acagaggaagaauuuguuau

SEQ ID NO: 3372689 - RNA, 17 nt, Human
acagaggaagagcaggc

SEQ ID NO: 3372690 - RNA, 21 nt, Human
acagaggaauuuauaccucaa

SEQ ID NO: 3372691 - RNA, 23 nt, Human
acagaggacaguauuugugggga

SEQ ID NO: 3372692 - RNA, 14 nt, Human
acagaggaccagca

SEQ ID NO: 3372693 - RNA, 20 nt, Human
acagaggaccagcacacucc

SEQ ID NO: 3372694 - RNA, 21 nt, Human
acagaggaccagcacacuccc

SEQ ID NO: 3372695 - RNA, 16 nt, Human
acagaggaugagcucu

SEQ ID NO: 3372696 - RNA, 20 nt, Human
acagaggaugagcucuaccc

SEQ ID NO: 3372697 - RNA, 13 nt, Human
acagaggcagccc

SEQ ID NO: 3372698 - RNA, 17 nt, Human
acagaggccaugggccu

SEQ ID NO: 3372699 - RNA, 15 nt, Human
acagaggccccagcc

SEQ ID NO: 3372700 - RNA, 15 nt, Human
acagagggaagaaaa

SEQ ID NO: 3372701 - RNA, 14 nt, Human
acagaggggguggc

SEQ ID NO: 3372702 - RNA, 17 nt, Human
acagaggggguggccuc

SEQ ID NO: 3372703 - RNA, 20 nt, Human
accuggaagaacaggccucu

SEQ ID NO: 3372704 - RNA, 18 nt, Human
accuggaagcccucucug

SEQ ID NO: 3372705 - RNA, 14 nt, Human
accuggaauauaua

SEQ ID NO: 3372706 - RNA, 19 nt, Human
accuggaauuguggggcaa

SEQ ID NO: 3372707 - RNA, 16 nt, Human
accuggaccccugcau

SEQ ID NO: 3372708 - RNA, 23 nt, Human
accuggagaacuagaaccuggag

SEQ ID NO: 3372709 - RNA, 13 nt, Human
accuggagaccag

SEQ ID NO: 3372710 - RNA, 14 nt, Human
accuggagccccug

SEQ ID NO: 3372711 - RNA, 21 nt, Human
accuggagggcuagaaccuag

SEQ ID NO: 3372712 - RNA, 22 nt, Human
accuggagggcuagaaccuggc

SEQ ID NO: 3372713 - RNA, 15 nt, Human
accuggagggcugga

SEQ ID NO: 3372714 - RNA, 14 nt, Human
accuggauggggca

SEQ ID NO: 3372715 - RNA, 22 nt, Human
accuggcaagcuagaaccugga

SEQ ID NO: 3372716 - RNA, 15 nt, Human
accuggcacugcugu

SEQ ID NO: 3372717 - RNA, 17 nt, Human
accuggcagcucuggac

SEQ ID NO: 3372718 - RNA, 20 nt, Human
accuggccaccugagguggg

SEQ ID NO: 3372719 - RNA, 23 nt, Human
accuggccccaugucucucagaa

SEQ ID NO: 3372720 - RNA, 19 nt, Human
accuggcccucucugaagg

SEQ ID NO: 3372721 - RNA, 23 nt, Human
accuggcccucucugaaggaggc

SEQ ID NO: 3372722 - RNA, 15 nt, Human
accuggcccugcuuc

SEQ ID NO: 3372723 - RNA, 17 nt, Human
accuggcccugcuuccu

SEQ ID NO: 3372724 - RNA, 12 nt, Human
accuggcccugg

SEQ ID NO: 3372725 - RNA, 19 nt, Human
accuggcccuggggccugu

SEQ ID NO: 3372726 - RNA, 21 nt, Human
accuggcccuggggccuguac

SEQ ID NO: 3372727 - RNA, 16 nt, Human
accuggcucucaccuc

SEQ ID NO: 3372728 - RNA, 20 nt, Human
accuggcucucaccucuagg

SEQ ID NO: 3372729 - RNA, 13 nt, Human
accuggcugaggu

SEQ ID NO: 3372730 - RNA, 21 nt, Human
accuggcugagguuccucugc

SEQ ID NO: 3372731 - RNA, 14 nt, Human
accuggcuuauuua

SEQ ID NO: 3372732 - RNA, 22 nt, Human
accuggcuuguuuauuuugugg

SEQ ID NO: 3372733 - RNA, 22 nt, Human
accugggaaagagauuuaaacu

SEQ ID NO: 3372734 - RNA, 14 nt, Human
accugggcccuggg

SEQ ID NO: 3372735 - RNA, 15 nt, Human
accugggcccugggg

SEQ ID NO: 3372736 - RNA, 18 nt, Human
accugggcccuggggccu

SEQ ID NO: 3372737 - RNA, 20 nt, Human
accugggcccuggggccugu

SEQ ID NO: 3372738 - RNA, 21 nt, Human
accugggcccuggggccugua

SEQ ID NO: 3372739 - RNA, 18 nt, Human
accuggggcugcuggccu

SEQ ID NO: 3372740 - RNA, 18 nt, Human
accuggggugugggaggc

SEQ ID NO: 3372741 - RNA, 16 nt, Human
accugggguugucagc

SEQ ID NO: 3372742 - RNA, 21 nt, Human
accuggguaacuagggaagau

SEQ ID NO: 3372743 - RNA, 18 nt, Human
accuggguccaaauaaaa

SEQ ID NO: 3372744 - RNA, 20 nt, Human
accuggguccaaauaaaaac

SEQ ID NO: 3372745 - RNA, 23 nt, Human
accuggguccccagcccuuccuc

SEQ ID NO: 3372746 - RNA, 17 nt, Human
accuggguucccuuucc

SEQ ID NO: 3372747 - RNA, 22 nt, Human
accuggguucccuuuccuucca

SEQ ID NO: 3372748 - RNA, 18 nt, Human
accuggguugcagacagg

SEQ ID NO: 3372749 - RNA, 16 nt, Human
accugguacccuccug

SEQ ID NO: 3372750 - RNA, 21 nt, Human
accugguacucccucucagga

SEQ ID NO: 3372751 - RNA, 15 nt, Human
accugguccacaggg

SEQ ID NO: 3372752 - RNA, 10 nt, Human
accuggugcu

SEQ ID NO: 3372753 - RNA, 12 nt, Human
accuguaaauua

SEQ ID NO: 3372754 - RNA, 20 nt, Human
accuguaacuuuuguaaaua

SEQ ID NO: 3372755 - RNA, 14 nt, Human
accuguaaucccag

SEQ ID NO: 3372756 - RNA, 11 nt, Human
accuguacagu

SEQ ID NO: 3372757 - RNA, 14 nt, Human
accuguacuggaga

SEQ ID NO: 3372758 - RNA, 14 nt, Human
accuguagucccag

SEQ ID NO: 3372759 - RNA, 16 nt, Human
accuguauacagugca

SEQ ID NO: 3372760 - RNA, 20 nt, Human
accuguauauuuguaaagcu

SEQ ID NO: 3372761 - RNA, 21 nt, Human
accuguauauuuguaaagcua

SEQ ID NO: 3372762 - RNA, 23 nt, Human
accuguaucuuucuaugcugcuu

SEQ ID NO: 3372763 - RNA, 20 nt, Human
accuguauuuaaaaauagaa

SEQ ID NO: 3372764 - RNA, 23 nt, Human
accuguauuuaaaaauagaaaca

SEQ ID NO: 3372765 - RNA, 20 nt, Human
accugucaaacaaagccaga

SEQ ID NO: 3372766 - RNA, 20 nt, Human
accugucacauugcauucua

SEQ ID NO: 3372767 - RNA, 23 nt, Human
accugucacgauugucaucagga

SEQ ID NO: 3372768 - RNA, 19 nt, Human
accugucaugccccccuca

SEQ ID NO: 3372769 - RNA, 20 nt, Human
accugucaugccccccucaa

SEQ ID NO: 3372770 - RNA, 14 nt, Human
accugucccaccuc

SEQ ID NO: 3372771 - RNA, 14 nt, Human
accuguccccaccc

SEQ ID NO: 3372772 - RNA, 16 nt, Human
accugucccccugaca

SEQ ID NO: 3372773 - RNA, 15 nt, Human
accuguccuccuggu

SEQ ID NO: 3372774 - RNA, 18 nt, Human
accuguccuccugguggg

SEQ ID NO: 3372775 - RNA, 14 nt, Human
accugucgcccagu

SEQ ID NO: 3372776 - RNA, 16 nt, Human
accugucgcccagugc

SEQ ID NO: 3372777 - RNA, 14 nt, Human
accugucucagccu

SEQ ID NO: 3372778 - RNA, 17 nt, Human
accugucuccacugugc

SEQ ID NO: 3372779 - RNA, 18 nt, Human
accugucugaacuguuaa

SEQ ID NO: 3372780 - RNA, 20 nt, Human
accugucugucugucugucc

SEQ ID NO: 3372781 - RNA, 15 nt, Human
accugugagcccagc

SEQ ID NO: 3372782 - RNA, 23 nt, Human
accugugagcugcaccagguaga

SEQ ID NO: 3372783 - RNA, 17 nt, Human
accugugaguaaauauu

SEQ ID NO: 3372784 - RNA, 19 nt, Human
accugugcacaccccacuc

SEQ ID NO: 3372785 - RNA, 14 nt, Human
accugugccucggc

SEQ ID NO: 3372786 - RNA, 23 nt, Human
accuguggaacauaaaaaggaca

SEQ ID NO: 3372787 - RNA, 19 nt, Human
accuguggccaaguucuua

SEQ ID NO: 3372788 - RNA, 20 nt, Human
accuguggggauuucuccca

SEQ ID NO: 3372789 - RNA, 12 nt, Human
accugugggugu

SEQ ID NO: 3372790 - RNA, 13 nt, Human
accuguguacaua

SEQ ID NO: 3372791 - RNA, 16 nt, Human
accuguguacauaacu

SEQ ID NO: 3372792 - RNA, 11 nt, Human
accugugucuc

SEQ ID NO: 3372793 - RNA, 14 nt, Human
accugugucugcga

SEQ ID NO: 3372794 - RNA, 19 nt, Human
accuguguggacaggacua

SEQ ID NO: 3372795 - RNA, 19 nt, Human
acagcacuggcucucucca

SEQ ID NO: 3372796 - RNA, 13 nt, Human
acagcagacucag

SEQ ID NO: 3372797 - RNA, 18 nt, Human
acagcagacucagcucug

SEQ ID NO: 3372798 - RNA, 19 nt, Human
acagcagacucagcucuga

SEQ ID NO: 3372799 - RNA, 17 nt, Human
acagcagcaagaaaaaa

SEQ ID NO: 3372800 - RNA, 23 nt, Human
acagcagcaagaaaaaaaaaugc

SEQ ID NO: 3372801 - RNA, 14 nt, Human
acagcagcaucucu

SEQ ID NO: 3372802 - RNA, 12 nt, Human
acagcagcauuu

SEQ ID NO: 3372803 - RNA, 14 nt, Human
acagcagcauuuuu

SEQ ID NO: 3372804 - RNA, 18 nt, Human
acagcagccccugcacaa

SEQ ID NO: 3372805 - RNA, 18 nt, Human
acagcagccucugaaguu

SEQ ID NO: 3372806 - RNA, 14 nt, Human
acagcagcucaggc

SEQ ID NO: 3372807 - RNA, 22 nt, Human
acagcagcuuauaaugggcucu

SEQ ID NO: 3372808 - RNA, 13 nt, Human
acagcagcuucac

SEQ ID NO: 3372809 - RNA, 22 nt, Human
acagcagcuucaccagagcauu

SEQ ID NO: 3372810 - RNA, 15 nt, Human
acagcaggcugccag

SEQ ID NO: 3372811 - RNA, 15 nt, Human
acagcaguagacauu

SEQ ID NO: 3372812 - RNA, 16 nt, Human
acagcaguagacauuu

SEQ ID NO: 3372813 - RNA, 20 nt, Human
acagcaguagacauuuuaac

SEQ ID NO: 3372814 - RNA, 24 nt, Human
acagcaguagacauuuuaacaaga

SEQ ID NO: 3372815 - RNA, 20 nt, Human
acagcagucuuaugcuucca

SEQ ID NO: 3372816 - RNA, 21 nt, Human
acagcagugagacuggggcca

SEQ ID NO: 3372817 - RNA, 19 nt, Human
acagcaguguuccccaucu

SEQ ID NO: 3372818 - RNA, 22 nt, Human
acagcaguugaaaagacuccaa

SEQ ID NO: 3372819 - RNA, 15 nt, Human
acagcauaacaaggu

SEQ ID NO: 3372820 - RNA, 16 nt, Human
acagcaucauuuugca

SEQ ID NO: 3372821 - RNA, 22 nt, Human
acagcauccccaaaacaaaguc

SEQ ID NO: 3372822 - RNA, 14 nt, Human
acagcaucucagcu

SEQ ID NO: 3372823 - RNA, 15 nt, Human
acagcaucucagcuc

SEQ ID NO: 3372824 - RNA, 15 nt, Human
acagcaucuccaagc

SEQ ID NO: 3372825 - RNA, 20 nt, Human
acagcaugagaggcucugug

SEQ ID NO: 3372826 - RNA, 17 nt, Human
acagcauggcacucccu

SEQ ID NO: 3372827 - RNA, 22 nt, Human
acagcauguacggauuuucagu

SEQ ID NO: 3372828 - RNA, 21 nt, Human
acagcauguguuaaucuuaau

SEQ ID NO: 3372829 - RNA, 14 nt, Human
acagcauuuuccuc

SEQ ID NO: 3372830 - RNA, 18 nt, Human
acagcauuuuccucugcu

SEQ ID NO: 3372831 - RNA, 16 nt, Human
acagccaaaggcuggc

SEQ ID NO: 3372832 - RNA, 14 nt, Human
acagccaaauuuaa

SEQ ID NO: 3372833 - RNA, 15 nt, Human
acagccaaauuuaaa

SEQ ID NO: 3372834 - RNA, 24 nt, Human
acagccaacacgcaccugccucag

SEQ ID NO: 3372835 - RNA, 13 nt, Human
acagccaacaggu

SEQ ID NO: 3372836 - RNA, 23 nt, Human
acagccaacagguggcaggacca

SEQ ID NO: 3372837 - RNA, 18 nt, Human
acagccaacuagccccug

SEQ ID NO: 3372838 - RNA, 20 nt, Human
acagccaagauuuuccucuu

SEQ ID NO: 3372839 - RNA, 13 nt, Human
acagccaagugcc

SEQ ID NO: 3372840 - RNA, 15 nt, Human
acagccaagugccaa

SEQ ID NO: 3372841 - RNA, 12 nt, Human
acagccacacac

SEQ ID NO: 3372842 - RNA, 15 nt, Human
acagccacacacaca

SEQ ID NO: 3372843 - RNA, 16 nt, Human
acagccacacacacag

SEQ ID NO: 3372844 - RNA, 18 nt, Human
acagccacacacacagaa

SEQ ID NO: 3372845 - RNA, 20 nt, Human
acagccacacacacagaaaa

SEQ ID NO: 3372846 - RNA, 23 nt, Human
acagccacacacacagaaaauau

SEQ ID NO: 3372847 - RNA, 19 nt, Human
acagccacggccaggccag

SEQ ID NO: 3372848 - RNA, 16 nt, Human
acagccagacuggcac

SEQ ID NO: 3372849 - RNA, 16 nt, Human
acagccagcaccuggc

SEQ ID NO: 3372850 - RNA, 15 nt, Human
acagccaucccagcc

SEQ ID NO: 3372851 - RNA, 16 nt, Human
acagcccaaagaagga

SEQ ID NO: 3372852 - RNA, 13 nt, Human
acagcccaccugg

SEQ ID NO: 3372853 - RNA, 16 nt, Human
acagcccacguccugu

SEQ ID NO: 3372854 - RNA, 13 nt, Human
acagcccagagcc

SEQ ID NO: 3372855 - RNA, 15 nt, Human
acagcccagagccug

SEQ ID NO: 3372856 - RNA, 15 nt, Human
acagcccaggccucc

SEQ ID NO: 3372857 - RNA, 13 nt, Human
acagccccacccu

SEQ ID NO: 3372858 - RNA, 14 nt, Human
acagccccacccug

SEQ ID NO: 3372859 - RNA, 15 nt, Human
acagccccacccugg

SEQ ID NO: 3372860 - RNA, 18 nt, Human
acagccccucccuccucu

SEQ ID NO: 3372861 - RNA, 21 nt, Human
acagcccgggcucugccuccc

SEQ ID NO: 3372862 - RNA, 20 nt, Human
acgcuuguagaacucacucu

SEQ ID NO: 3372863 - RNA, 22 nt, Human
acgcuuguagaacucacucugg

SEQ ID NO: 3372864 - RNA, 12 nt, Human
acgcuugugaau

SEQ ID NO: 3372865 - RNA, 13 nt, Human
acgcuuugauuca

SEQ ID NO: 3372866 - RNA, 16 nt, Human
acgcuuugauucauag

SEQ ID NO: 3372867 - RNA, 17 nt, Human
acgcuuugggagaaugu

SEQ ID NO: 3372868 - RNA, 14 nt, Human
acgcuuuucuuugu

SEQ ID NO: 3372869 - RNA, 18 nt, Human
acggaaaaugccaaucuc

SEQ ID NO: 3372870 - RNA, 19 nt, Human
acggaaaaugccaaucucu

SEQ ID NO: 3372871 - RNA, 13 nt, Human
acggaaguuuuca

SEQ ID NO: 3372872 - RNA, 15 nt, Human
acggacaauaaaccu

SEQ ID NO: 3372873 - RNA, 17 nt, Human
acggacacucaaaagcu

SEQ ID NO: 3372874 - RNA, 17 nt, Human
acggacagagaccaaga

SEQ ID NO: 3372875 - RNA, 12 nt, Human
acggagagaaaa

SEQ ID NO: 3372876 - RNA, 19 nt, Human
acggagagcgccugccccu

SEQ ID NO: 3372877 - RNA, 14 nt, Human
acggagauguuuca

SEQ ID NO: 3372878 - RNA, 15 nt, Human
acggagcccagcccu

SEQ ID NO: 3372879 - RNA, 18 nt, Human
acggaggggaguagagaa

SEQ ID NO: 3372880 - RNA, 13 nt, Human
acggagucucgcu

SEQ ID NO: 3372881 - RNA, 21 nt, Human
acggauccauguagcaggacu

SEQ ID NO: 3372882 - RNA, 15 nt, Human
acggaugauuucuau

SEQ ID NO: 3372883 - RNA, 22 nt, Human
acggauuagggcauuugagaaa

SEQ ID NO: 3372884 - RNA, 23 nt, Human
acggauuagggcauuugagaaau

SEQ ID NO: 3372885 - RNA, 16 nt, Human
acggauuauuuuuuca

SEQ ID NO: 3372886 - RNA, 15 nt, Human
acggauuuucaguua

SEQ ID NO: 3372887 - RNA, 19 nt, Human
acggcaccugggcccuggg

SEQ ID NO: 3372888 - RNA, 23 nt, Human
acggcaccugggcccuggggccu

SEQ ID NO: 3372889 - RNA, 18 nt, Human
acggcacggucuucccuc

SEQ ID NO: 3372890 - RNA, 22 nt, Human
acggcacggucuucccucuucc

SEQ ID NO: 3372891 - RNA, 14 nt, Human
acggcacuguggcc

SEQ ID NO: 3372892 - RNA, 15 nt, Human
acggcagccacagcu

SEQ ID NO: 3372893 - RNA, 22 nt, Human
acggcaggcucacugccaggcc

SEQ ID NO: 3372894 - RNA, 23 nt, Human
acggccaagaauguacguccagc

SEQ ID NO: 3372895 - RNA, 17 nt, Human
acggccacacagcugcc

SEQ ID NO: 3372896 - RNA, 15 nt, Human
acggccacuggccau

SEQ ID NO: 3372897 - RNA, 23 nt, Human
acggccagggagaagcuccucuc

SEQ ID NO: 3372898 - RNA, 20 nt, Human
acggccccagcuucucagcu

SEQ ID NO: 3372899 - RNA, 21 nt, Human
acggccccgaagggcccccac

SEQ ID NO: 3372900 - RNA, 22 nt, Human
acggccccgaagggcccccaca

SEQ ID NO: 3372901 - RNA, 18 nt, Human
acggcccugcagccagcu

SEQ ID NO: 3372902 - RNA, 12 nt, Human
acggcccuggcc

SEQ ID NO: 3372903 - RNA, 14 nt, Human
acggcccuggccuu

SEQ ID NO: 3372904 - RNA, 18 nt, Human
acggccgcuccaggggug

SEQ ID NO: 3372905 - RNA, 13 nt, Human
acggccuccuuuc

SEQ ID NO: 3372906 - RNA, 17 nt, Human
acggcgcccccagugug

SEQ ID NO: 3372907 - RNA, 18 nt, Human
acggcucgauuucuccag

SEQ ID NO: 3372908 - RNA, 18 nt, Human
acggcucuagguggggcg

SEQ ID NO: 3372909 - RNA, 22 nt, Human
acggcugggcacacgccuccca

SEQ ID NO: 3372910 - RNA, 23 nt, Human
acggcuuagacuucgacucagga

SEQ ID NO: 3372911 - RNA, 18 nt, Human
acggcuuuuacuuaaacc

SEQ ID NO: 3372912 - RNA, 21 nt, Human
acgggaagcgcucagaacagu

SEQ ID NO: 3372913 - RNA, 23 nt, Human
acgggacaucacagggugggccu

SEQ ID NO: 3372914 - RNA, 21 nt, Human
acgggacccacaugcuccaga

SEQ ID NO: 3372915 - RNA, 18 nt, Human
acgggacugcggaggaag

SEQ ID NO: 3372916 - RNA, 16 nt, Human
acgggcaguagcugug

SEQ ID NO: 3372917 - RNA, 21 nt, Human
acgggcccggguugggucacc

SEQ ID NO: 3372918 - RNA, 18 nt, Human
acggggagcggcggaaag

SEQ ID NO: 3372919 - RNA, 20 nt, Human
acggggccgacauugucucc

SEQ ID NO: 3372920 - RNA, 15 nt, Human
acggggcucuucuca

SEQ ID NO: 3372921 - RNA, 18 nt, Human
acggggcucuucucauuu

SEQ ID NO: 3372922 - RNA, 15 nt, Human
acgggugccagaagc

SEQ ID NO: 3372923 - RNA, 13 nt, Human
acggguggucccc

SEQ ID NO: 3372924 - RNA, 14 nt, Human
acgggugguccccg

SEQ ID NO: 3372925 - RNA, 14 nt, Human
acgguauuaugcuu

SEQ ID NO: 3372926 - RNA, 20 nt, Human
acgguauuaugcuucuugga

SEQ ID NO: 3372927 - RNA, 20 nt, Human
acggucagguuuaacauuug

SEQ ID NO: 3372928 - RNA, 16 nt, Human
acggucgccaccuggc

SEQ ID NO: 3372929 - RNA, 21 nt, Human
acggucggggcaucuggccug

SEQ ID NO: 3372930 - RNA, 19 nt, Human
acggugaaggugacagcag

SEQ ID NO: 3372931 - RNA, 17 nt, Human
acggugcagucugggug

SEQ ID NO: 3372932 - RNA, 15 nt, Human
acggugcccaagcca

SEQ ID NO: 3372933 - RNA, 18 nt, Human
acggugcugugagggagg

SEQ ID NO: 3372934 - RNA, 18 nt, Human
acggugggcauuugugag

SEQ ID NO: 3372935 - RNA, 21 nt, Human
acggugggccuugcuggggac

SEQ ID NO: 3372936 - RNA, 22 nt, Human
acggugucuuguucugucacuc

SEQ ID NO: 3372937 - RNA, 19 nt, Human
acgguucaaaccugugaag

SEQ ID NO: 3372938 - RNA, 19 nt, Human
acgguucaccagccucucu

SEQ ID NO: 3372939 - RNA, 23 nt, Human
acagcugccugggaucccucauc

SEQ ID NO: 3372940 - RNA, 14 nt, Human
acagcugccuuagc

SEQ ID NO: 3372941 - RNA, 16 nt, Human
acagcugccuuagcuu

SEQ ID NO: 3372942 - RNA, 17 nt, Human
acagcugccuuagcuuc

SEQ ID NO: 3372943 - RNA, 20 nt, Human
acagcugccuuagcuucagg

SEQ ID NO: 3372944 - RNA, 21 nt, Human
acagcugccuuagcuucagga

SEQ ID NO: 3372945 - RNA, 10 nt, Human
acagcugcuc

SEQ ID NO: 3372946 - RNA, 22 nt, Human
acagcugcuccuagagggaggg

SEQ ID NO: 3372947 - RNA, 13 nt, Human
acagcugcuuucu

SEQ ID NO: 3372948 - RNA, 21 nt, Human
acagcugcuuucuguugucau

SEQ ID NO: 3372949 - RNA, 18 nt, Human
acagcuggguggcacugc

SEQ ID NO: 3372950 - RNA, 20 nt, Human
acagcuggguggcacugcca

SEQ ID NO: 3372951 - RNA, 23 nt, Human
acagcuggguggcacugccaugc

SEQ ID NO: 3372952 - RNA, 16 nt, Human
acagcugguguagcua

SEQ ID NO: 3372953 - RNA, 21 nt, Human
acagcugguguagcuacagag

SEQ ID NO: 3372954 - RNA, 19 nt, Human
acagcuguauugucugaac

SEQ ID NO: 3372955 - RNA, 18 nt, Human
acagcugucccugucacc

SEQ ID NO: 3372956 - RNA, 21 nt, Human
acagcugugcuguaacacaag

SEQ ID NO: 3372957 - RNA, 23 nt, Human
acagcuguucaguugcacuucua

SEQ ID NO: 3372958 - RNA, 16 nt, Human
acagcuguucuucugu

SEQ ID NO: 3372959 - RNA, 13 nt, Human
acagcuguugacu

SEQ ID NO: 3372960 - RNA, 14 nt, Human
acagcuuagauuuc

SEQ ID NO: 3372961 - RNA, 18 nt, Human
acagcuucagccaggagc

SEQ ID NO: 3372962 - RNA, 21 nt, Human
acagcuucagccaggagcugg

SEQ ID NO: 3372963 - RNA, 13 nt, Human
acagcuucagguu

SEQ ID NO: 3372964 - RNA, 17 nt, Human
acagcuucaugccuuug

SEQ ID NO: 3372965 - RNA, 17 nt, Human
acagcuucauuuccugu

SEQ ID NO: 3372966 - RNA, 21 nt, Human
acagcuucauuuccugugucu

SEQ ID NO: 3372967 - RNA, 15 nt, Human
acagcuuccuguccc

SEQ ID NO: 3372968 - RNA, 20 nt, Human
acagcuucucauccugcagg

SEQ ID NO: 3372969 - RNA, 17 nt, Human
acagcuugaccgugagg

SEQ ID NO: 3372970 - RNA, 20 nt, Human
acagcuugaccgugaggcca

SEQ ID NO: 3372971 - RNA, 17 nt, Human
acagcuugaccugaggc

SEQ ID NO: 3372972 - RNA, 23 nt, Human
acagcuugaccugaggcuguggu

SEQ ID NO: 3372973 - RNA, 16 nt, Human
acagcuugagccgggc

SEQ ID NO: 3372974 - RNA, 22 nt, Human
acagcuugagccgggccccugg

SEQ ID NO: 3372975 - RNA, 15 nt, Human
acagcuuucaagugc

SEQ ID NO: 3372976 - RNA, 15 nt, Human
acagcuuucugaccu

SEQ ID NO: 3372977 - RNA, 18 nt, Human
acagcuuucugaccuuca

SEQ ID NO: 3372978 - RNA, 22 nt, Human
acagcuuucuugcucccuucag

SEQ ID NO: 3372979 - RNA, 21 nt, Human
acagcuuugcugcugaaggcu

SEQ ID NO: 3372980 - RNA, 21 nt, Human
acagcuuuggggugucuuuuu

SEQ ID NO: 3372981 - RNA, 23 nt, Human
acagcuuugugacuguauauaaa

SEQ ID NO: 3372982 - RNA, 21 nt, Human
acagcuuuuaguacccaccug

SEQ ID NO: 3372983 - RNA, 12 nt, Human
acagcuuuugca

SEQ ID NO: 3372984 - RNA, 16 nt, Human
acaggaaaaaaacuuu

SEQ ID NO: 3372985 - RNA, 22 nt, Human
acaggaaaaaaacuuuuauaaa

SEQ ID NO: 3372986 - RNA, 16 nt, Human
acaggaaaagcugcug

SEQ ID NO: 3372987 - RNA, 19 nt, Human
acaggaaaagcugcugaca

SEQ ID NO: 3372988 - RNA, 16 nt, Human
acaggaaaauccucug

SEQ ID NO: 3372989 - RNA, 20 nt, Human
acaggaaaauuuuaaaaaua

SEQ ID NO: 3372990 - RNA, 20 nt, Human
acaggaaacuccugugacca

SEQ ID NO: 3372991 - RNA, 22 nt, Human
acaggaaacuccugugaccaca

SEQ ID NO: 3372992 - RNA, 16 nt, Human
acaggaaagggaaggc

SEQ ID NO: 3372993 - RNA, 19 nt, Human
acaggaaagggaaggcccc

SEQ ID NO: 3372994 - RNA, 22 nt, Human
acaggaaagggaaggccccaca

SEQ ID NO: 3372995 - RNA, 18 nt, Human
acaggaaaguucagaguu

SEQ ID NO: 3372996 - RNA, 15 nt, Human
acaggaagcacccca

SEQ ID NO: 3372997 - RNA, 15 nt, Human
acaggacacagucag

SEQ ID NO: 3372998 - RNA, 17 nt, Human
acaggacagugcuucag

SEQ ID NO: 3372999 - RNA, 14 nt, Human
acaggacauauauu

SEQ ID NO: 3373000 - RNA, 17 nt, Human
acaggacauauauuuuu

SEQ ID NO: 3373001 - RNA, 23 nt, Human
acaggaccagggauuuccaugau

SEQ ID NO: 3373002 - RNA, 12 nt, Human
acaggaccccag

SEQ ID NO: 3373003 - RNA, 16 nt, Human
acaggaccccagcucu

SEQ ID NO: 3373004 - RNA, 17 nt, Human
acaggaccccagcucug

SEQ ID NO: 3373005 - RNA, 18 nt, Human
acaggaccccagcucugc

SEQ ID NO: 3373006 - RNA, 17 nt, Human
acaggacccccuucccc

SEQ ID NO: 3373007 - RNA, 16 nt, Human
acaggaccccugcagu

SEQ ID NO: 3373008 - RNA, 20 nt, Human
acaggacuaacacucagaag

SEQ ID NO: 3373009 - RNA, 23 nt, Human
acaggacuaacacucagaagccu

SEQ ID NO: 3373010 - RNA, 24 nt, Human
acaggacuaacacucagaagccug

SEQ ID NO: 3373011 - RNA, 16 nt, Human
acaggacucugccucc

SEQ ID NO: 3373012 - RNA, 18 nt, Human
acaggacuuaaaaugaca

SEQ ID NO: 3373013 - RNA, 11 nt, Human
acaggagaaau

SEQ ID NO: 3373014 - RNA, 17 nt, Human
acaggagaagaaagaac

SEQ ID NO: 3373015 - RNA, 18 nt, Human
acaggagagaaaggggau

SEQ ID NO: 3373016 - RNA, 13 nt, Human
acaggagcuaccu

SEQ ID NO: 3373017 - RNA, 14 nt, Human
acaggagcugggau

SEQ ID NO: 3373018 - RNA, 20 nt, Human
acaggaggacaauucaugaa

SEQ ID NO: 3373019 - RNA, 21 nt, Human
acaggaggcaggcauggcccu

SEQ ID NO: 3373020 - RNA, 19 nt, Human
acguuccucuccaccugca

SEQ ID NO: 3373021 - RNA, 16 nt, Human
acguuccuuacugcag

SEQ ID NO: 3373022 - RNA, 17 nt, Human
acguucucacacccacc

SEQ ID NO: 3373023 - RNA, 12 nt, Human
acguuggacuuu

SEQ ID NO: 3373024 - RNA, 18 nt, Human
acguuggagaagcccgug

SEQ ID NO: 3373025 - RNA, 18 nt, Human
acguuuaaaguucugugu

SEQ ID NO: 3373026 - RNA, 17 nt, Human
acguuuaagccaaaaca

SEQ ID NO: 3373027 - RNA, 17 nt, Human
acguuuagcugacaaaa

SEQ ID NO: 3373028 - RNA, 11 nt, Human
acguuuauaaa

SEQ ID NO: 3373029 - RNA, 19 nt, Human
acguuuauaaacagaaaug

SEQ ID NO: 3373030 - RNA, 12 nt, Human
acguuuccauca

SEQ ID NO: 3373031 - RNA, 15 nt, Human
acguuucuaaaggcu

SEQ ID NO: 3373032 - RNA, 12 nt, Human
acguuucucauu

SEQ ID NO: 3373033 - RNA, 23 nt, Human
acguuuggaagauccugugagga

SEQ ID NO: 3373034 - RNA, 19 nt, Human
acguuugguucaaaugugu

SEQ ID NO: 3373035 - RNA, 21 nt, Human
acguuuuauaagcaucauuau

SEQ ID NO: 3373036 - RNA, 18 nt, Human
acguuuuauuguguuuuu

SEQ ID NO: 3373037 - RNA, 12 nt, Human
acguuuucuaau

SEQ ID NO: 3373038 - RNA, 19 nt, Human
acguuuucuaauugcuuau

SEQ ID NO: 3373039 - RNA, 13 nt, Human
acguuuuuccuuu

SEQ ID NO: 3373040 - RNA, 17 nt, Human
acuaaaaauacaaacaa

SEQ ID NO: 3373041 - RNA, 13 nt, Human
acuaaaaauauug

SEQ ID NO: 3373042 - RNA, 21 nt, Human
acuaaaaauauuguuucugca

SEQ ID NO: 3373043 - RNA, 16 nt, Human
acuaaaacaaagccac

SEQ ID NO: 3373044 - RNA, 13 nt, Human
acuaaaagacauu

SEQ ID NO: 3373045 - RNA, 20 nt, Human
acuaaaagauauaagugcug

SEQ ID NO: 3373046 - RNA, 21 nt, Human
acuaaaagauauaagugcugu

SEQ ID NO: 3373047 - RNA, 22 nt, Human
acuaaaauuuuaggcacucuua

SEQ ID NO: 3373048 - RNA, 18 nt, Human
acuaaacacgugacacaa

SEQ ID NO: 3373049 - RNA, 19 nt, Human
acuaaacauaugauuucac

SEQ ID NO: 3373050 - RNA, 16 nt, Human
acuaaacucauuuaua

SEQ ID NO: 3373051 - RNA, 15 nt, Human
acuaaacucucuuug

SEQ ID NO: 3373052 - RNA, 15 nt, Human
acuaaacuuucacac

SEQ ID NO: 3373053 - RNA, 17 nt, Human
acuaaacuuuuuuucug

SEQ ID NO: 3373054 - RNA, 18 nt, Human
acuaaacuuuuuuucugu

SEQ ID NO: 3373055 - RNA, 12 nt, Human
acuaaagagaga

SEQ ID NO: 3373056 - RNA, 16 nt, Human
acuaaagauccaagaa

SEQ ID NO: 3373057 - RNA, 13 nt, Human
acuaaagcaauag

SEQ ID NO: 3373058 - RNA, 14 nt, Human
acuaaagcaauaga

SEQ ID NO: 3373059 - RNA, 16 nt, Human
acuaaagcaauagaaa

SEQ ID NO: 3373060 - RNA, 17 nt, Human
acuaaagcaguagaaau

SEQ ID NO: 3373061 - RNA, 22 nt, Human
acuaaagcaugaaaugugaauu

SEQ ID NO: 3373062 - RNA, 17 nt, Human
acuaaagccaaacauau

SEQ ID NO: 3373063 - RNA, 16 nt, Human
acuaaagccagccuga

SEQ ID NO: 3373064 - RNA, 22 nt, Human
acuaaaguauguaaaguaugua

SEQ ID NO: 3373065 - RNA, 22 nt, Human
acuaaaguuguacuuuaaaaau

SEQ ID NO: 3373066 - RNA, 16 nt, Human
acuaaauagcauguau

SEQ ID NO: 3373067 - RNA, 18 nt, Human
acuaaauagcauguauug

SEQ ID NO: 3373068 - RNA, 20 nt, Human
acuaaauagcauguauugug

SEQ ID NO: 3373069 - RNA, 23 nt, Human
acuaaauagcauguauugugucu

SEQ ID NO: 3373070 - RNA, 22 nt, Human
acuaaauaugaacccuuuguuu

SEQ ID NO: 3373071 - RNA, 18 nt, Human
acuaaaucagagacaaaa

SEQ ID NO: 3373072 - RNA, 20 nt, Human
acuaaaucuguaagcucuuu

SEQ ID NO: 3373073 - RNA, 15 nt, Human
acuaaaugcccugcu

SEQ ID NO: 3373074 - RNA, 17 nt, Human
acuaaaugccuaguuuu

SEQ ID NO: 3373075 - RNA, 11 nt, Human
acuaaauguua

SEQ ID NO: 3373076 - RNA, 12 nt, Human
acuaaauguuaa

SEQ ID NO: 3373077 - RNA, 14 nt, Human
acuaaauguucuau

SEQ ID NO: 3373078 - RNA, 20 nt, Human
acuaaauucgugauuuucaa

SEQ ID NO: 3373079 - RNA, 21 nt, Human
acuaaauuugauacuuauauu

SEQ ID NO: 3373080 - RNA, 14 nt, Human
acuaaauuugggga

SEQ ID NO: 3373081 - RNA, 20 nt, Human
acuaaauuuggggacagauu

SEQ ID NO: 3373082 - RNA, 21 nt, Human
acuaaauuuggggacagauuc

SEQ ID NO: 3373083 - RNA, 17 nt, Human
acaguucuuugggccag

SEQ ID NO: 3373084 - RNA, 21 nt, Human
acaguucuuugggccagacau

SEQ ID NO: 3373085 - RNA, 22 nt, Human
acaguucuuugggccagacaug

SEQ ID NO: 3373086 - RNA, 20 nt, Human
acaguugaaaaacagcugag

SEQ ID NO: 3373087 - RNA, 22 nt, Human
acaguugaagggaggggcugug

SEQ ID NO: 3373088 - RNA, 19 nt, Human
acaguugcacagcaucuca

SEQ ID NO: 3373089 - RNA, 20 nt, Human
acaguugcacagcaucucag

SEQ ID NO: 3373090 - RNA, 18 nt, Human
acaguugcagcccuugug

SEQ ID NO: 3373091 - RNA, 16 nt, Human
acaguugcucuaugcu

SEQ ID NO: 3373092 - RNA, 21 nt, Human
acaguugcugucauaagaaug

SEQ ID NO: 3373093 - RNA, 18 nt, Human
acaguuggaaauccaucc

SEQ ID NO: 3373094 - RNA, 17 nt, Human
acaguugggaaaauaug

SEQ ID NO: 3373095 - RNA, 14 nt, Human
acaguugggugaga

SEQ ID NO: 3373096 - RNA, 16 nt, Human
acaguuggguuuuuua

SEQ ID NO: 3373097 - RNA, 18 nt, Human
acaguuggguuuuuuaag

SEQ ID NO: 3373098 - RNA, 15 nt, Human
acaguugguaacuuu

SEQ ID NO: 3373099 - RNA, 16 nt, Human
acaguugguaacuuuu

SEQ ID NO: 3373100 - RNA, 22 nt, Human
acaguuguauuuaacagaaauu

SEQ ID NO: 3373101 - RNA, 17 nt, Human
acaguugugcaggaggu

SEQ ID NO: 3373102 - RNA, 19 nt, Human
acaguuuaccaguugccuu

SEQ ID NO: 3373103 - RNA, 15 nt, Human
acaguuuaucaugaa

SEQ ID NO: 3373104 - RNA, 18 nt, Human
acaguuuaucaugaagcc

SEQ ID NO: 3373105 - RNA, 19 nt, Human
acaguuuaucaugaagccu

SEQ ID NO: 3373106 - RNA, 21 nt, Human
acaguuuaugcagugcugcuu

SEQ ID NO: 3373107 - RNA, 13 nt, Human
acaguuugaaaua

SEQ ID NO: 3373108 - RNA, 14 nt, Human
acaguuugaaauaa

SEQ ID NO: 3373109 - RNA, 15 nt, Human
acaguuugaaauaag

SEQ ID NO: 3373110 - RNA, 12 nt, Human
acaguuugcugu

SEQ ID NO: 3373111 - RNA, 13 nt, Human
acaguuugcugua

SEQ ID NO: 3373112 - RNA, 16 nt, Human
acaguuuguaaauguu

SEQ ID NO: 3373113 - RNA, 20 nt, Human
acaguuuguuaguaugaggc

SEQ ID NO: 3373114 - RNA, 16 nt, Human
acaguuuguuuacaca

SEQ ID NO: 3373115 - RNA, 22 nt, Human
acaguuuguuuacacacgugca

SEQ ID NO: 3373116 - RNA, 14 nt, Human
acaguuuuaaagaa

SEQ ID NO: 3373117 - RNA, 19 nt, Human
acaguuuuaaagaaucauu

SEQ ID NO: 3373118 - RNA, 21 nt, Human
acaguuuuaaagaaucauuau

SEQ ID NO: 3373119 - RNA, 13 nt, Human
acaguuuuaacug

SEQ ID NO: 3373120 - RNA, 12 nt, Human
acaguuuuaugc

SEQ ID NO: 3373121 - RNA, 19 nt, Human
acaguuuuaugcucuuuuu

SEQ ID NO: 3373122 - RNA, 21 nt, Human
acaguuuucagaaaaagaaau

SEQ ID NO: 3373123 - RNA, 18 nt, Human
acaguuuuccaugaaaac

SEQ ID NO: 3373124 - RNA, 19 nt, Human
acaguuuuccaugaaaacg

SEQ ID NO: 3373125 - RNA, 19 nt, Human
acaguuuuccuaaauguau

SEQ ID NO: 3373126 - RNA, 20 nt, Human
acaguuuuccuaaauguaua

SEQ ID NO: 3373127 - RNA, 15 nt, Human
acaguuuucugagaa

SEQ ID NO: 3373128 - RNA, 17 nt, Human
acaguuuucugagaaag

SEQ ID NO: 3373129 - RNA, 14 nt, Human
acaguuuuuccugg

SEQ ID NO: 3373130 - RNA, 19 nt, Human
acauaaaaacaacuuuaua

SEQ ID NO: 3373131 - RNA, 14 nt, Human
acauaaaaaggaca

SEQ ID NO: 3373132 - RNA, 20 nt, Human
acauaaaaaggacaucagca

SEQ ID NO: 3373133 - RNA, 21 nt, Human
acauaaaaaggacaucagcaa

SEQ ID NO: 3373134 - RNA, 19 nt, Human
acauaaaaaugaucuaaac

SEQ ID NO: 3373135 - RNA, 15 nt, Human
acauaaaagaaauaa

SEQ ID NO: 3373136 - RNA, 23 nt, Human
acauaaacaagaccacguuucua

SEQ ID NO: 3373137 - RNA, 12 nt, Human
acauaaacauca

SEQ ID NO: 3373138 - RNA, 22 nt, Human
acauaaaccauuuuuguuacuc

SEQ ID NO: 3373139 - RNA, 21 nt, Human
acauaaagcaaauagacacag

SEQ ID NO: 3373140 - RNA, 12 nt, Human
acauaaaggaaa

SEQ ID NO: 3373141 - RNA, 14 nt, Human
acauaaaggaaaag

SEQ ID NO: 3373142 - RNA, 20 nt, Human
acauaaaggaaaagacacau

SEQ ID NO: 3373143 - RNA, 21 nt, Human
acauaaaggugguaugugugu

SEQ ID NO: 3373144 - RNA, 15 nt, Human
acauaaaguugauaa

SEQ ID NO: 3373145 - RNA, 15 nt, Human
acauaaauaaaauga

SEQ ID NO: 3373146 - RNA, 23 nt, Human
acauaaauaaauuaaauaaaaua

SEQ ID NO: 3373147 - RNA, 16 nt, Human
acauaaaugcagccca

SEQ ID NO: 3373148 - RNA, 20 nt, Human
acauaaauuuaguauuuugu

SEQ ID NO: 3373149 - RNA, 22 nt, Human
acauaacaaaaucacuuccaua

SEQ ID NO: 3373150 - RNA, 14 nt, Human
acauaacaaauaac

SEQ ID NO: 3373151 - RNA, 12 nt, Human
acauaacaagaa

SEQ ID NO: 3373152 - RNA, 13 nt, Human
acauaacaagaaa

SEQ ID NO: 3373153 - RNA, 14 nt, Human
acauaacaagaaaa

SEQ ID NO: 3373154 - RNA, 15 nt, Human
acauaacaagaaaau

SEQ ID NO: 3373155 - RNA, 16 nt, Human
acauaacauaaauuuu

SEQ ID NO: 3373156 - RNA, 14 nt, Human
acauaacguuuuuc

SEQ ID NO: 3373157 - RNA, 18 nt, Human
acauaacguuuuuccuuu

SEQ ID NO: 3373158 - RNA, 20 nt, Human
acauaacguuuuuccuuuaa

SEQ ID NO: 3373159 - RNA, 21 nt, Human
acauaacguuuuuccuuuaaa

SEQ ID NO: 3373160 - RNA, 22 nt, Human
acauaacuaaauuugauacuua

SEQ ID NO: 3373161 - RNA, 20 nt, Human
acauaacugaaaaugugcua

SEQ ID NO: 3373162 - RNA, 15 nt, Human
acauaagauaaaugu

SEQ ID NO: 3373163 - RNA, 14 nt, Human
acauaagaucacug

SEQ ID NO: 3373164 - RNA, 15 nt, Human
acauaagccauuauu

SEQ ID NO: 3373165 - RNA, 22 nt, Human
acauaagcggcguaaguuuaaa

SEQ ID NO: 3373166 - RNA, 17 nt, Human
acauaagcuauuuuucu

SEQ ID NO: 3373167 - RNA, 19 nt, Human
acauaagcuauuuuucuaa

SEQ ID NO: 3373168 - RNA, 20 nt, Human
acauaagcuauuuuucuaac

SEQ ID NO: 3373169 - RNA, 15 nt, Human
acauaaguaauucaa

SEQ ID NO: 3373170 - RNA, 21 nt, Human
acauaaguaauucaagaaaac

SEQ ID NO: 3373171 - RNA, 19 nt, Human
acauaaguuuaggauaaaa

SEQ ID NO: 3373172 - RNA, 17 nt, Human
acauaauacugaaccac

SEQ ID NO: 3373173 - RNA, 20 nt, Human
acauaaugcuuaauuucuaa

SEQ ID NO: 3373174 - RNA, 19 nt, Human
acauaaugggccacugaaa

SEQ ID NO: 3373175 - RNA, 17 nt, Human
acauaaugggguccugg

SEQ ID NO: 3373176 - RNA, 16 nt, Human
acauaauuaaaguguc

SEQ ID NO: 3373177 - RNA, 18 nt, Human
acauaauucacucugagu

SEQ ID NO: 3373178 - RNA, 18 nt, Human
acauaauuuaguuguuuc

SEQ ID NO: 3373179 - RNA, 18 nt, Human
acauaauuuuuuauucaa

SEQ ID NO: 3373180 - RNA, 11 nt, Human
acauacaaaug

SEQ ID NO: 3373181 - RNA, 21 nt, Human
acauacaaaugcaucuuugau

SEQ ID NO: 3373182 - RNA, 18 nt, Human
acauacaacacaaagaga

SEQ ID NO: 3373183 - RNA, 14 nt, Human
acauacaccagcau

SEQ ID NO: 3373184 - RNA, 22 nt, Human
acauacacccaaacacuuacac

SEQ ID NO: 3373185 - RNA, 22 nt, Human
acauacacuguauguuauagaa

SEQ ID NO: 3373186 - RNA, 20 nt, Human
acauacacuuguauaaaugu

SEQ ID NO: 3373187 - RNA, 19 nt, Human
acauacagaauuacuguaa

SEQ ID NO: 3373188 - RNA, 15 nt, Human
acauaccagcuuaga

SEQ ID NO: 3373189 - RNA, 22 nt, Human
acauacccgccuagcugcuguc

SEQ ID NO: 3373190 - RNA, 14 nt, Human
acauacccuccccc

SEQ ID NO: 3373191 - RNA, 22 nt, Human
acauacccugaccuggcccccu

SEQ ID NO: 3373192 - RNA, 14 nt, Human
acauaccuaagaag

SEQ ID NO: 3373193 - RNA, 16 nt, Human
acauaccuaagcaaac

SEQ ID NO: 3373194 - RNA, 19 nt, Human
acauacgauuuaagguauu

SEQ ID NO: 3373195 - RNA, 14 nt, Human
acauacggucaggu

SEQ ID NO: 3373196 - RNA, 15 nt, Human
acauacguaaaaauc

SEQ ID NO: 3373197 - RNA, 13 nt, Human
acauacuaaccag

SEQ ID NO: 3373198 - RNA, 16 nt, Human
acauacucauuuuuca

SEQ ID NO: 3373199 - RNA, 13 nt, Human
acauacucccauc

SEQ ID NO: 3373200 - RNA, 15 nt, Human
acauacuugaagggc

SEQ ID NO: 3373201 - RNA, 15 nt, Human
acauacuuuaucaau

SEQ ID NO: 3373202 - RNA, 22 nt, Human
acauacuuucauccugacucug

SEQ ID NO: 3373203 - RNA, 23 nt, Human
acauacuuucauccugacucugc

SEQ ID NO: 3373204 - RNA, 20 nt, Human
acauacuuuuuggguuuauu

SEQ ID NO: 3373205 - RNA, 12 nt, Human
acauagaaaguu

SEQ ID NO: 3373206 - RNA, 12 nt, Human
acauagaaaugg

SEQ ID NO: 3373207 - RNA, 21 nt, Human
acauagaaauugccugacgaa

SEQ ID NO: 3373208 - RNA, 16 nt, Human
acauagacagaagaaa

SEQ ID NO: 3373209 - RNA, 18 nt, Human
acauagacagaagaaaca

SEQ ID NO: 3373210 - RNA, 16 nt, Human
acauagacuagagaaa

SEQ ID NO: 3373211 - RNA, 20 nt, Human
acauagagagggagaagaag

SEQ ID NO: 3373212 - RNA, 22 nt, Human
acauagagccggguguccccaa

SEQ ID NO: 3373213 - RNA, 22 nt, Human
acauagagugacuccaagaaca

SEQ ID NO: 3373214 - RNA, 15 nt, Human
acauagauauuuuca

SEQ ID NO: 3373215 - RNA, 16 nt, Human
acauagauauuuucac

SEQ ID NO: 3373216 - RNA, 17 nt, Human
acauagauucaccugua

SEQ ID NO: 3373217 - RNA, 18 nt, Human
acauagcaugacauuucu

SEQ ID NO: 3373218 - RNA, 19 nt, Human
acauagcccacuuacauuu

SEQ ID NO: 3373219 - RNA, 19 nt, Human
acauagcccaucccugccu

SEQ ID NO: 3373220 - RNA, 16 nt, Human
acucccaucaccucua

SEQ ID NO: 3373221 - RNA, 15 nt, Human
acucccaucagccca

SEQ ID NO: 3373222 - RNA, 16 nt, Human
acucccauuccugaag

SEQ ID NO: 3373223 - RNA, 22 nt, Human
acucccauuccugaagaaccag

SEQ ID NO: 3373224 - RNA, 14 nt, Human
acuccccaaggaag

SEQ ID NO: 3373225 - RNA, 21 nt, Human
acuccccagccagccuggcug

SEQ ID NO: 3373226 - RNA, 15 nt, Human
acuccccaggccagg

SEQ ID NO: 3373227 - RNA, 19 nt, Human
acucaggugggcccucuga

SEQ ID NO: 3373228 - RNA, 14 nt, Human
acucaguaauuugu

SEQ ID NO: 3373229 - RNA, 19 nt, Human
acucagucucucuucucuc

SEQ ID NO: 3373230 - RNA, 11 nt, Human
acucagugcag

SEQ ID NO: 3373231 - RNA, 12 nt, Human
acucagugcaga

SEQ ID NO: 3373232 - RNA, 20 nt, Human
acucaguggguuaacaucag

SEQ ID NO: 3373233 - RNA, 16 nt, Human
acucaguuuaugcugu

SEQ ID NO: 3373234 - RNA, 20 nt, Human
acucaguuuauguuguacaa

SEQ ID NO: 3373235 - RNA, 19 nt, Human
acucaguuugucagacuuu

SEQ ID NO: 3373236 - RNA, 18 nt, Human
acucuauagacucuagga

SEQ ID NO: 3373237 - RNA, 23 nt, Human
acucuaucggagaacaugaauca

SEQ ID NO: 3373238 - RNA, 15 nt, Human
acucuaucugggccu

SEQ ID NO: 3373239 - RNA, 13 nt, Human
acucuauggucuu

SEQ ID NO: 3373240 - RNA, 17 nt, Human
acucuauguucuaagaa

SEQ ID NO: 3373241 - RNA, 14 nt, Human
acucuauucucaaa

SEQ ID NO: 3373242 - RNA, 13 nt, Human
acucuauucuuua

SEQ ID NO: 3373243 - RNA, 14 nt, Human
acucuauucuuuaa

SEQ ID NO: 3373244 - RNA, 15 nt, Human
acucuauucuuuaac

SEQ ID NO: 3373245 - RNA, 15 nt, Human
acucucagugcuucu

SEQ ID NO: 3373246 - RNA, 15 nt, Human
acucucauuccccag

SEQ ID NO: 3373247 - RNA, 14 nt, Human
acucucccauggcu

SEQ ID NO: 3373248 - RNA, 15 nt, Human
acucucccauggcuu

SEQ ID NO: 3373249 - RNA, 11 nt, Human
acucuccccac

SEQ ID NO: 3373250 - RNA, 21 nt, Human
acucuccccacgagggcuggc

SEQ ID NO: 3373251 - RNA, 22 nt, Human
acucuccgcggugguuguuggg

SEQ ID NO: 3373252 - RNA, 17 nt, Human
acucuccuccagaguca

SEQ ID NO: 3373253 - RNA, 19 nt, Human
acucuccucggcccccucc

SEQ ID NO: 3373254 - RNA, 14 nt, Human
acucuccucugcug

SEQ ID NO: 3373255 - RNA, 12 nt, Human
acucuccugccu

SEQ ID NO: 3373256 - RNA, 15 nt, Human
acucuccugggcccc

SEQ ID NO: 3373257 - RNA, 18 nt, Human
acucuccugggccccucc

SEQ ID NO: 3373258 - RNA, 13 nt, Human
acucuccuugcag

SEQ ID NO: 3373259 - RNA, 23 nt, Human
acucuccuuggugucgggcauga

SEQ ID NO: 3373260 - RNA, 20 nt, Human
acucucuccacccuauaugu

SEQ ID NO: 3373261 - RNA, 22 nt, Human
acucucuggaagccccugggcc

SEQ ID NO: 3373262 - RNA, 23 nt, Human
acucucuuggcugucacccgauc

SEQ ID NO: 3373263 - RNA, 13 nt, Human
acucugaacuuug

SEQ ID NO: 3373264 - RNA, 17 nt, Human
acucugaacuuuggaga

SEQ ID NO: 3373265 - RNA, 18 nt, Human
acucugaagccucuggga

SEQ ID NO: 3373266 - RNA, 22 nt, Human
acucugaauaagcacuuuuuaa

SEQ ID NO: 3373267 - RNA, 15 nt, Human
acucugaauuuaucu

SEQ ID NO: 3373268 - RNA, 13 nt, Human
acucugacaacag

SEQ ID NO: 3373269 - RNA, 18 nt, Human
acucugacaacagacuuc

SEQ ID NO: 3373270 - RNA, 18 nt, Human
acucugacaagggcugac

SEQ ID NO: 3373271 - RNA, 20 nt, Human
acucugacaagggcugaccu

SEQ ID NO: 3373272 - RNA, 14 nt, Human
acucugagcccaug

SEQ ID NO: 3373273 - RNA, 21 nt, Human
acucugagcgggaggcagagu

SEQ ID NO: 3373274 - RNA, 21 nt, Human
acucugaggcucuuucugggc

SEQ ID NO: 3373275 - RNA, 14 nt, Human
acucugaguguuuu

SEQ ID NO: 3373276 - RNA, 19 nt, Human
acucugauguaaaugaagu

SEQ ID NO: 3373277 - RNA, 21 nt, Human
acucugcacaugucuuguaca

SEQ ID NO: 3373278 - RNA, 16 nt, Human
acucugcagccucaga

SEQ ID NO: 3373279 - RNA, 18 nt, Human
acucugcaucccagcacc

SEQ ID NO: 3373280 - RNA, 21 nt, Human
acucugcaucccagcaccugc

SEQ ID NO: 3373281 - RNA, 16 nt, Human
acucugcauucuagua

SEQ ID NO: 3373282 - RNA, 11 nt, Human
acucugccagg

SEQ ID NO: 3373283 - RNA, 20 nt, Human
acucugccccccccccccau

SEQ ID NO: 3373284 - RNA, 13 nt, Human
acucugcccccug

SEQ ID NO: 3373285 - RNA, 19 nt, Human
acucugcccccugcuggcu

SEQ ID NO: 3373286 - RNA, 13 nt, Human
acucugcccucua

SEQ ID NO: 3373287 - RNA, 19 nt, Human
acucugccuacagaacuuc

SEQ ID NO: 3373288 - RNA, 15 nt, Human
acucugccuccucuu

SEQ ID NO: 3373289 - RNA, 23 nt, Human
acucugccuccucuucaacugac

SEQ ID NO: 3373290 - RNA, 16 nt, Human
acucugccucugccug

SEQ ID NO: 3373291 - RNA, 19 nt, Human
acucugcuaccuugcccca

SEQ ID NO: 3373292 - RNA, 14 nt, Human
acucugcucugaug

SEQ ID NO: 3373293 - RNA, 13 nt, Human
acucugcugaggg

SEQ ID NO: 3373294 - RNA, 15 nt, Human
acucugcugcuuaga

SEQ ID NO: 3373295 - RNA, 22 nt, Human
acucugcugucuaaccugugac

SEQ ID NO: 3373296 - RNA, 14 nt, Human
acucugcuguuuga

SEQ ID NO: 3373297 - RNA, 17 nt, Human
acucugcuucucugacu

SEQ ID NO: 3373298 - RNA, 15 nt, Human
acucugcuugauuuu

SEQ ID NO: 3373299 - RNA, 22 nt, Human
acucugcuuugacugagcagac

SEQ ID NO: 3373300 - RNA, 16 nt, Human
acucuggacuuucucu

SEQ ID NO: 3373301 - RNA, 15 nt, Human
acucuggcaaagcuu

SEQ ID NO: 3373302 - RNA, 23 nt, Human
acucuggcaaagcuuuuagaaau

SEQ ID NO: 3373303 - RNA, 17 nt, Human
acucuggcagccacacu

SEQ ID NO: 3373304 - RNA, 13 nt, Human
acucuggcagcuc

SEQ ID NO: 3373305 - RNA, 17 nt, Human
acucuggcagcucagag

SEQ ID NO: 3373306 - RNA, 19 nt, Human
acucuggcagcucagagag

SEQ ID NO: 3373307 - RNA, 12 nt, Human
acucuggcccug

SEQ ID NO: 3373308 - RNA, 11 nt, Human
acucuggccuc

SEQ ID NO: 3373309 - RNA, 14 nt, Human
acucuggccucugu

SEQ ID NO: 3373310 - RNA, 14 nt, Human
acucuggcuuccag

SEQ ID NO: 3373311 - RNA, 20 nt, Human
acucugggcacacucugcca

SEQ ID NO: 3373312 - RNA, 19 nt, Human
acucugggcuauggacaca

SEQ ID NO: 3373313 - RNA, 16 nt, Human
acucugggcuccagag

SEQ ID NO: 3373314 - RNA, 15 nt, Human
acucuggguccuucc

SEQ ID NO: 3373315 - RNA, 16 nt, Human
acucuggguccuuccu

SEQ ID NO: 3373316 - RNA, 18 nt, Human
acucuggguccuuccuga

SEQ ID NO: 3373317 - RNA, 18 nt, Human
acucuggucuucuuuggg

SEQ ID NO: 3373318 - RNA, 17 nt, Human
acucuggucuuggaauu

SEQ ID NO: 3373319 - RNA, 15 nt, Human
acucugguucuuugu

SEQ ID NO: 3373320 - RNA, 12 nt, Human
acucuguccuga

SEQ ID NO: 3373321 - RNA, 13 nt, Human
acucuguccugaa

SEQ ID NO: 3373322 - RNA, 19 nt, Human
acucuguccugaaggccug

SEQ ID NO: 3373323 - RNA, 21 nt, Human
acucugucgagccugggggcu

SEQ ID NO: 3373324 - RNA, 15 nt, Human
acucugucuaaaaaa

SEQ ID NO: 3373325 - RNA, 16 nt, Human
acucugucuucaccug

SEQ ID NO: 3373326 - RNA, 15 nt, Human
acucugucuuguguu

SEQ ID NO: 3373327 - RNA, 16 nt, Human
acucugugccagagcc

SEQ ID NO: 3373328 - RNA, 19 nt, Human
acucugugccagagccugg

SEQ ID NO: 3373329 - RNA, 22 nt, Human
acucugugccagagccuggggc

SEQ ID NO: 3373330 - RNA, 17 nt, Human
acucugugcuggccagc

SEQ ID NO: 3373331 - RNA, 15 nt, Human
acucuguggccaaag

SEQ ID NO: 3373332 - RNA, 16 nt, Human
acucugugucaggugg

SEQ ID NO: 3373333 - RNA, 19 nt, Human
acucugugucagguggggc

SEQ ID NO: 3373334 - RNA, 15 nt, Human
acucugugucugagu

SEQ ID NO: 3373335 - RNA, 19 nt, Human
acucuguucauuccuccag

SEQ ID NO: 3373336 - RNA, 21 nt, Human
acucuguucauuccuccaggu

SEQ ID NO: 3373337 - RNA, 15 nt, Human
acucuguuccuggcu

SEQ ID NO: 3373338 - RNA, 20 nt, Human
acucuuaaagcaaaaaauga

SEQ ID NO: 3373339 - RNA, 14 nt, Human
acucuuaaguuucu

SEQ ID NO: 3373340 - RNA, 21 nt, Human
acucuuaaguuucucagcucc

SEQ ID NO: 3373341 - RNA, 22 nt, Human
acucuuacgaauauuuucagua

SEQ ID NO: 3373342 - RNA, 14 nt, Human
acucuuagaaauga

SEQ ID NO: 3373343 - RNA, 19 nt, Human
acucuuagauggauucucc

SEQ ID NO: 3373344 - RNA, 18 nt, Human
acucuuauaucuauauuu

SEQ ID NO: 3373345 - RNA, 23 nt, Human
acucuuauaucuauauuuuacau

SEQ ID NO: 3373346 - RNA, 23 nt, Human
acucuuaucucagucaugcauaa

SEQ ID NO: 3373347 - RNA, 19 nt, Human
acucuucaaggucugcuuu

SEQ ID NO: 3373348 - RNA, 17 nt, Human
acucuucacaaaaucug

SEQ ID NO: 3373349 - RNA, 16 nt, Human
acucuucacucuucaa

SEQ ID NO: 3373350 - RNA, 13 nt, Human
acucuucacuguu

SEQ ID NO: 3373351 - RNA, 16 nt, Human
acucuucuaugaccca

SEQ ID NO: 3373352 - RNA, 12 nt, Human
acucuucucagc

SEQ ID NO: 3373353 - RNA, 12 nt, Human
acucuucucauu

SEQ ID NO: 3373354 - RNA, 24 nt, Human
acucuucucauuacuuguugccua

SEQ ID NO: 3373355 - RNA, 14 nt, Human
acucuucucucugc

SEQ ID NO: 3373356 - RNA, 15 nt, Human
acucuucucucugcu

SEQ ID NO: 3373357 - RNA, 18 nt, Human
acucuucucucugcucug

SEQ ID NO: 3373358 - RNA, 19 nt, Human
acucuucucucugcucuga

SEQ ID NO: 3373359 - RNA, 17 nt, Human
acucuucugaauugacu

SEQ ID NO: 3373360 - RNA, 19 nt, Human
acucuucuuaacuuaaauu

SEQ ID NO: 3373361 - RNA, 20 nt, Human
acucuucuugauuaaaaguu

SEQ ID NO: 3373362 - RNA, 13 nt, Human
acucuugaaaaau

SEQ ID NO: 3373363 - RNA, 16 nt, Human
acucuugaccucaggu

SEQ ID NO: 3373364 - RNA, 22 nt, Human
acucuugaguuguuuuuguaua

SEQ ID NO: 3373365 - RNA, 16 nt, Human
acucuugauuauccau

SEQ ID NO: 3373366 - RNA, 14 nt, Human
acucuuguaagauu

SEQ ID NO: 3373367 - RNA, 21 nt, Human
acucuuguaagauuuugaaaa

SEQ ID NO: 3373368 - RNA, 23 nt, Human
acucuuguaagauuuugaaaacu

SEQ ID NO: 3373369 - RNA, 19 nt, Human
acucuuuacccuugagccc

SEQ ID NO: 3373370 - RNA, 18 nt, Human
acucuuuauagugcacaa

SEQ ID NO: 3373371 - RNA, 15 nt, Human
acucuuuaugcuugc

SEQ ID NO: 3373372 - RNA, 11 nt, Human
acucuuucaaa

SEQ ID NO: 3373373 - RNA, 17 nt, Human
aaaaguuuacaacauaa

SEQ ID NO: 3373374 - RNA, 22 nt, Human
aaaaguuuacaaguguauauca

SEQ ID NO: 3373375 - RNA, 13 nt, Human
aaaaguuucaaug

SEQ ID NO: 3373376 - RNA, 18 nt, Human
aaaaguuucaaugugauu

SEQ ID NO: 3373377 - RNA, 15 nt, Human
aaaauaaaaaaaaga

SEQ ID NO: 3373378 - RNA, 17 nt, Human
aaaauaaaaaaaagaaa

SEQ ID NO: 3373379 - RNA, 15 nt, Human
aaaauaaaaaacacu

SEQ ID NO: 3373380 - RNA, 17 nt, Human
aaaauaaaaaacauaua

SEQ ID NO: 3373381 - RNA, 20 nt, Human
aaaauaaaaagaucacuuuc

SEQ ID NO: 3373382 - RNA, 17 nt, Human
aaaauaaaaagugacac

SEQ ID NO: 3373383 - RNA, 16 nt, Human
aaaauaaaaaguuaaa

SEQ ID NO: 3373384 - RNA, 18 nt, Human
aaaauaaaacauagcaaa

SEQ ID NO: 3373385 - RNA, 16 nt, Human
aaaauaaaacauuuua

SEQ ID NO: 3373386 - RNA, 22 nt, Human
aaaauaaaacauuuuaaaugga

SEQ ID NO: 3373387 - RNA, 22 nt, Human
aaaauaaaacccguugauuacu

SEQ ID NO: 3373388 - RNA, 14 nt, Human
aaaauaaaacuuuu

SEQ ID NO: 3373389 - RNA, 14 nt, Human
aaaauaaacuauaa

SEQ ID NO: 3373390 - RNA, 14 nt, Human
aaaauaaacuuucu

SEQ ID NO: 3373391 - RNA, 16 nt, Human
aaaauaaagaaaagau

SEQ ID NO: 3373392 - RNA, 12 nt, Human
aaaauaaagaau

SEQ ID NO: 3373393 - RNA, 15 nt, Human
aaaauaaagaaugga

SEQ ID NO: 3373394 - RNA, 16 nt, Human
aaaauaaaguuacauu

SEQ ID NO: 3373395 - RNA, 17 nt, Human
aaaauaaauaaaagccu

SEQ ID NO: 3373396 - RNA, 14 nt, Human
aaaauaaauaaaua

SEQ ID NO: 3373397 - RNA, 12 nt, Human
aaaauaaauaua

SEQ ID NO: 3373398 - RNA, 15 nt, Human
aaaauaaauggaaau

SEQ ID NO: 3373399 - RNA, 13 nt, Human
aaaauaaauugga

SEQ ID NO: 3373400 - RNA, 12 nt, Human
aaaauaaauuua

SEQ ID NO: 3373401 - RNA, 17 nt, Human
aaaauaacuaaaaugua

SEQ ID NO: 3373402 - RNA, 15 nt, Human
aaaauaacugaauuu

SEQ ID NO: 3373403 - RNA, 12 nt, Human
aaaauaacugua

SEQ ID NO: 3373404 - RNA, 18 nt, Human
aaaauaacuuagacucua

SEQ ID NO: 3373405 - RNA, 22 nt, Human
aaaauaagaaaagauguagauu

SEQ ID NO: 3373406 - RNA, 13 nt, Human
aaaauaagcaggu

SEQ ID NO: 3373407 - RNA, 14 nt, Human
aaaauaagcaggug

SEQ ID NO: 3373408 - RNA, 21 nt, Human
aaaauaagugaauaauaauua

SEQ ID NO: 3373409 - RNA, 12 nt, Human
aaaauaauaaau

SEQ ID NO: 3373410 - RNA, 13 nt, Human
aaaauaauaauaa

SEQ ID NO: 3373411 - RNA, 22 nt, Human
aaaauaauaauuuuuauauuua

SEQ ID NO: 3373412 - RNA, 23 nt, Human
aaaauaaucaaaagcuauuuaaa

SEQ ID NO: 3373413 - RNA, 14 nt, Human
aaaauaaucucuga

SEQ ID NO: 3373414 - RNA, 14 nt, Human
aaaauaaugcugca

SEQ ID NO: 3373415 - RNA, 20 nt, Human
aaaauaauuauauaacugua

SEQ ID NO: 3373416 - RNA, 14 nt, Human
aaaauaauuauuua

SEQ ID NO: 3373417 - RNA, 14 nt, Human
aaaauaauucuaaa

SEQ ID NO: 3373418 - RNA, 12 nt, Human
aaaauaauuuua

SEQ ID NO: 3373419 - RNA, 19 nt, Human
aaaauaauuuuaaaaaugg

SEQ ID NO: 3373420 - RNA, 15 nt, Human
aaaauaauuuuauga

SEQ ID NO: 3373421 - RNA, 14 nt, Human
aaaauaauuuugua

SEQ ID NO: 3373422 - RNA, 16 nt, Human
aaaauaauuuuuauau

SEQ ID NO: 3373423 - RNA, 17 nt, Human
aaaauaauuuuuauauu

SEQ ID NO: 3373424 - RNA, 20 nt, Human
aaaauaauuuuuauauuuga

SEQ ID NO: 3373425 - RNA, 14 nt, Human
aaaauacaaaauua

SEQ ID NO: 3373426 - RNA, 15 nt, Human
aaaauacaagacugc

SEQ ID NO: 3373427 - RNA, 14 nt, Human
aaaauacaauaaac

SEQ ID NO: 3373428 - RNA, 16 nt, Human
aaaauacaauuuuuau

SEQ ID NO: 3373429 - RNA, 12 nt, Human
aaaauacaugaa

SEQ ID NO: 3373430 - RNA, 12 nt, Human
aaaauacauucu

SEQ ID NO: 3373431 - RNA, 12 nt, Human
aaaauacauuuu

SEQ ID NO: 3373432 - RNA, 24 nt, Human
aaaauaccucaggaaagaauagaa

SEQ ID NO: 3373433 - RNA, 17 nt, Human
aaaauacuauuuaagau

SEQ ID NO: 3373434 - RNA, 16 nt, Human
aaaauacucuaauucu

SEQ ID NO: 3373435 - RNA, 15 nt, Human
aaaauacugccagau

SEQ ID NO: 3373436 - RNA, 14 nt, Human
aaaauacuuaaaug

SEQ ID NO: 3373437 - RNA, 21 nt, Human
aaaauacuugucaauauuuaa

SEQ ID NO: 3373438 - RNA, 21 nt, Human
aaaauacuuuuacucugccua

SEQ ID NO: 3373439 - RNA, 16 nt, Human
aaaauacuuuuccuua

SEQ ID NO: 3373440 - RNA, 12 nt, Human
aaaauagaaaag

SEQ ID NO: 3373441 - RNA, 16 nt, Human
aaaauagaaaaguuau

SEQ ID NO: 3373442 - RNA, 15 nt, Human
aaaauagaaacauau

SEQ ID NO: 3373443 - RNA, 20 nt, Human
aaaauagaaauuuuguaaga

SEQ ID NO: 3373444 - RNA, 13 nt, Human
aaaauagacacuc

SEQ ID NO: 3373445 - RNA, 21 nt, Human
aaaauagagcuuuuaaaaaug

SEQ ID NO: 3373446 - RNA, 22 nt, Human
aaaauagauaagaguagaaacu

SEQ ID NO: 3373447 - RNA, 23 nt, Human
aaaauagauauaaauuuuuaaga

SEQ ID NO: 3373448 - RNA, 17 nt, Human
aaaauagaugucuuuua

SEQ ID NO: 3373449 - RNA, 18 nt, Human
aaaauagauuuuauaaga

SEQ ID NO: 3373450 - RNA, 21 nt, Human
aaaauagauuuuauaagauga

SEQ ID NO: 3373451 - RNA, 10 nt, Human
aaaauagcca

SEQ ID NO: 3373452 - RNA, 15 nt, Human
aaaauagcguucuug

SEQ ID NO: 3373453 - RNA, 17 nt, Human
aaaauagcguucuugua

SEQ ID NO: 3373454 - RNA, 20 nt, Human
aaaauagcguucuuguaauu

SEQ ID NO: 3373455 - RNA, 12 nt, Human
aaaauagcuugu

SEQ ID NO: 3373456 - RNA, 15 nt, Human
aaaauaggagagaga

SEQ ID NO: 3373457 - RNA, 13 nt, Human
aaaauaggcagga

SEQ ID NO: 3373458 - RNA, 15 nt, Human
aaaauaggcuuuuua

SEQ ID NO: 3373459 - RNA, 21 nt, Human
aaaauaggcuuuuuaaucaug

SEQ ID NO: 3373460 - RNA, 22 nt, Human
aaaauagggacuaucuaucuua

SEQ ID NO: 3373461 - RNA, 18 nt, Human
aaaauaggggauauuuaa

SEQ ID NO: 3373462 - RNA, 20 nt, Human
aaaauaggguauauuuuccu

SEQ ID NO: 3373463 - RNA, 23 nt, Human
aaaauaguuaagacaugauuucc

SEQ ID NO: 3373464 - RNA, 13 nt, Human
aaaauaguuugga

SEQ ID NO: 3373465 - RNA, 19 nt, Human
aaaauaguuuggauaugua

SEQ ID NO: 3373466 - RNA, 22 nt, Human
aaaauaguuuggauauguaaaa

SEQ ID NO: 3373467 - RNA, 12 nt, Human
aaaauaguuugu

SEQ ID NO: 3373468 - RNA, 13 nt, Human
aaaauaguuuguu

SEQ ID NO: 3373469 - RNA, 19 nt, Human
aaaacacuguucucugccc

SEQ ID NO: 3373470 - RNA, 19 nt, Human
aaaacacuucuguccugug

SEQ ID NO: 3373471 - RNA, 13 nt, Human
aaaacagaaauug

SEQ ID NO: 3373472 - RNA, 14 nt, Human
aaaacagaacacuu

SEQ ID NO: 3373473 - RNA, 18 nt, Human
aaaacagaacaucauuag

SEQ ID NO: 3373474 - RNA, 21 nt, Human
aaaacagaacaucauuagaac

SEQ ID NO: 3373475 - RNA, 22 nt, Human
aaaacagaacaucauuagaaca

SEQ ID NO: 3373476 - RNA, 16 nt, Human
aaaacagcauugcuuu

SEQ ID NO: 3373477 - RNA, 22 nt, Human
aaaacagccauaggcccuuuca

SEQ ID NO: 3373478 - RNA, 13 nt, Human
aaaacaggcagcu

SEQ ID NO: 3373479 - RNA, 23 nt, Human
aaaacagggccacauagaugcug

SEQ ID NO: 3373480 - RNA, 17 nt, Human
aaaacagguagaauuau

SEQ ID NO: 3373481 - RNA, 13 nt, Human
aaaacaguauuua

SEQ ID NO: 3373482 - RNA, 17 nt, Human
aaaacaguauuuauuuu

SEQ ID NO: 3373483 - RNA, 20 nt, Human
aaaacaguauuuauuuugua

SEQ ID NO: 3373484 - RNA, 15 nt, Human
aaaacauaacauaaa

SEQ ID NO: 3373485 - RNA, 20 nt, Human
aaaacauaaucuucugccuu

SEQ ID NO: 3373486 - RNA, 16 nt, Human
aaaacauagcaucuca

SEQ ID NO: 3373487 - RNA, 19 nt, Human
aaaacauauucuugugcuu

SEQ ID NO: 3373488 - RNA, 21 nt, Human
aaaacauccagauacacccaa

SEQ ID NO: 3373489 - RNA, 13 nt, Human
aaaacaucuauuc

SEQ ID NO: 3373490 - RNA, 16 nt, Human
aaaacaucuuugaaau

SEQ ID NO: 3373491 - RNA, 21 nt, Human
aaaacaugcagaacaaaugaa

SEQ ID NO: 3373492 - RNA, 15 nt, Human
aaaacaugcuacaca

SEQ ID NO: 3373493 - RNA, 15 nt, Human
aaaacauguuuauuu

SEQ ID NO: 3373494 - RNA, 15 nt, Human
aaaacauuaagaaaa

SEQ ID NO: 3373495 - RNA, 19 nt, Human
aaaacauucuaucuacuga

SEQ ID NO: 3373496 - RNA, 22 nt, Human
aaaacauugccuuugaauguua

SEQ ID NO: 3373497 - RNA, 21 nt, Human
aaaacauuggauuauccugag

SEQ ID NO: 3373498 - RNA, 13 nt, Human
aaaacauuguucc

SEQ ID NO: 3373499 - RNA, 13 nt, Human
aaaacauuuauuu

SEQ ID NO: 3373500 - RNA, 22 nt, Human
aaaacauuuauuuugacauaaa

SEQ ID NO: 3373501 - RNA, 13 nt, Human
aaaaccacagcag

SEQ ID NO: 3373502 - RNA, 12 nt, Human
aaaaccaccccu

SEQ ID NO: 3373503 - RNA, 16 nt, Human
aaaaccacuagaacuc

SEQ ID NO: 3373504 - RNA, 17 nt, Human
aaaaccaguauuguaca

SEQ ID NO: 3373505 - RNA, 13 nt, Human
aaaaccauugcuu

SEQ ID NO: 3373506 - RNA, 14 nt, Human
aaaaccauugcuuc

SEQ ID NO: 3373507 - RNA, 16 nt, Human
aaaaccauugcuucac

SEQ ID NO: 3373508 - RNA, 13 nt, Human
aaaaccauuugaa

SEQ ID NO: 3373509 - RNA, 15 nt, Human
aaaacccagagagga

SEQ ID NO: 3373510 - RNA, 15 nt, Human
aaaacccagauaaag

SEQ ID NO: 3373511 - RNA, 22 nt, Human
aaaacccagcugcaccccuucc

SEQ ID NO: 3373512 - RNA, 20 nt, Human
aaaaccccccagauaucauc

SEQ ID NO: 3373513 - RNA, 19 nt, Human
aaaacccuugggccagaag

SEQ ID NO: 3373514 - RNA, 23 nt, Human
aaaaccguguuugucucuucugg

SEQ ID NO: 3373515 - RNA, 20 nt, Human
aaaaccuaaguccuuuaugu

SEQ ID NO: 3373516 - RNA, 13 nt, Human
aaaaccugacaaa

SEQ ID NO: 3373517 - RNA, 11 nt, Human
aaaaccuguuc

SEQ ID NO: 3373518 - RNA, 23 nt, Human
aaaaccuguucaagucuaccaac

SEQ ID NO: 3373519 - RNA, 22 nt, Human
aaaaccuuccaugucaagauuc

SEQ ID NO: 3373520 - RNA, 11 nt, Human
aaacagcugcc

SEQ ID NO: 3373521 - RNA, 14 nt, Human
aaacagcugccuua

SEQ ID NO: 3373522 - RNA, 19 nt, Human
aaacagcugccuuagcuuc

SEQ ID NO: 3373523 - RNA, 16 nt, Human
aaacaggaaaaaaacu

SEQ ID NO: 3373524 - RNA, 20 nt, Human
aaacaggaaaaaaacuuuua

SEQ ID NO: 3373525 - RNA, 16 nt, Human
aaacaggagacaggaa

SEQ ID NO: 3373526 - RNA, 12 nt, Human
aaacaggagaga

SEQ ID NO: 3373527 - RNA, 12 nt, Human
aaacaggaucag

SEQ ID NO: 3373528 - RNA, 18 nt, Human
aaaauauacuguaaagaa

SEQ ID NO: 3373529 - RNA, 23 nt, Human
aaaauauacuguaaagaaagaga

SEQ ID NO: 3373530 - RNA, 16 nt, Human
aaaauauagcuguaca

SEQ ID NO: 3373531 - RNA, 20 nt, Human
aaaauauagcuguacaaaua

SEQ ID NO: 3373532 - RNA, 13 nt, Human
aaaauauauaucu

SEQ ID NO: 3373533 - RNA, 12 nt, Human
aaaauauaucuu

SEQ ID NO: 3373534 - RNA, 12 nt, Human
aaaauauaugua

SEQ ID NO: 3373535 - RNA, 14 nt, Human
aaaauauauuuaau

SEQ ID NO: 3373536 - RNA, 18 nt, Human
aaaauauauuuauaagga

SEQ ID NO: 3373537 - RNA, 14 nt, Human
aaaauaucauucag

SEQ ID NO: 3373538 - RNA, 19 nt, Human
aaaauaucuaguaauauau

SEQ ID NO: 3373539 - RNA, 12 nt, Human
aaaauaucuugg

SEQ ID NO: 3373540 - RNA, 11 nt, Human
aaaauaugcau

SEQ ID NO: 3373541 - RNA, 14 nt, Human
aaaauauguaccaa

SEQ ID NO: 3373542 - RNA, 18 nt, Human
aaaauaugugaaggaccu

SEQ ID NO: 3373543 - RNA, 22 nt, Human
aaaauauuacucaguuuauguu

SEQ ID NO: 3373544 - RNA, 16 nt, Human
aaaauauuauaacuua

SEQ ID NO: 3373545 - RNA, 19 nt, Human
aaaauauuauaacuuaaaa

SEQ ID NO: 3373546 - RNA, 19 nt, Human
aaaauauuauuuuauuaua

SEQ ID NO: 3373547 - RNA, 14 nt, Human
aaaauauucaauaa

SEQ ID NO: 3373548 - RNA, 16 nt, Human
aaaauauuguuucugc

SEQ ID NO: 3373549 - RNA, 22 nt, Human
aaaauauuguuucugcauucau

SEQ ID NO: 3373550 - RNA, 19 nt, Human
aaaauauuguuuuacaaua

SEQ ID NO: 3373551 - RNA, 20 nt, Human
aaaauauuguuuuacaauag

SEQ ID NO: 3373552 - RNA, 16 nt, Human
aaaauauuuaaaaaug

SEQ ID NO: 3373553 - RNA, 14 nt, Human
aaaauauuuaugaa

SEQ ID NO: 3373554 - RNA, 23 nt, Human
aaaauauuuauuaaauaaaauca

SEQ ID NO: 3373555 - RNA, 13 nt, Human
aaaauauuuucau

SEQ ID NO: 3373556 - RNA, 20 nt, Human
aaaauauuuucauacagcau

SEQ ID NO: 3373557 - RNA, 12 nt, Human
aaaauauuuucu

SEQ ID NO: 3373558 - RNA, 23 nt, Human
aaaauauuuucucuguacuuuuc

SEQ ID NO: 3373559 - RNA, 17 nt, Human
aaaauauuuucugugug

SEQ ID NO: 3373560 - RNA, 19 nt, Human
aaaauauuuucuguguguu

SEQ ID NO: 3373561 - RNA, 15 nt, Human
aaaauauuuugaucu

SEQ ID NO: 3373562 - RNA, 21 nt, Human
aaaauauuuugaucuucaaca

SEQ ID NO: 3373563 - RNA, 12 nt, Human
aaaauauuuugu

SEQ ID NO: 3373564 - RNA, 20 nt, Human
aaaauauuuuuuauauauac

SEQ ID NO: 3373565 - RNA, 16 nt, Human
aaaaucaaagcugagg

SEQ ID NO: 3373566 - RNA, 21 nt, Human
aaaaucaacuuuuuauugccu

SEQ ID NO: 3373567 - RNA, 22 nt, Human
aaaaucaacuuuuuauugccuu

SEQ ID NO: 3373568 - RNA, 15 nt, Human
aaaaucaaguauuau

SEQ ID NO: 3373569 - RNA, 14 nt, Human
aaaaucacuugauu

SEQ ID NO: 3373570 - RNA, 21 nt, Human
aaaaucacuuugucuaacuca

SEQ ID NO: 3373571 - RNA, 14 nt, Human
aaaaucagccaauu

SEQ ID NO: 3373572 - RNA, 17 nt, Human
aaaaucagccaauuaug

SEQ ID NO: 3373573 - RNA, 22 nt, Human
aaaaucagccaauuauguuaaa

SEQ ID NO: 3373574 - RNA, 21 nt, Human
aaaaucagccugcuccagcug

SEQ ID NO: 3373575 - RNA, 12 nt, Human
aaaaucaucaag

SEQ ID NO: 3373576 - RNA, 14 nt, Human
aaaaucaucuauuu

SEQ ID NO: 3373577 - RNA, 15 nt, Human
aaaaucaucuauuuu

SEQ ID NO: 3373578 - RNA, 18 nt, Human
aaaaucaucuauuuugau

SEQ ID NO: 3373579 - RNA, 12 nt, Human
aaaaucaugaga

SEQ ID NO: 3373580 - RNA, 19 nt, Human
aaaaucaugccaguauuuu

SEQ ID NO: 3373581 - RNA, 13 nt, Human
aaaaucauggaau

SEQ ID NO: 3373582 - RNA, 19 nt, Human
aaaaucauggaaugguuau

SEQ ID NO: 3373583 - RNA, 12 nt, Human
aaaaucauugau

SEQ ID NO: 3373584 - RNA, 11 nt, Human
aaaaucauuuc

SEQ ID NO: 3373585 - RNA, 12 nt, Human
aaaaucauuucu

SEQ ID NO: 3373586 - RNA, 14 nt, Human
aaaauccaaauauu

SEQ ID NO: 3373587 - RNA, 22 nt, Human
aaaauccaaauauuguuaaggg

SEQ ID NO: 3373588 - RNA, 21 nt, Human
aaaauccacuuuaucuugaau

SEQ ID NO: 3373589 - RNA, 21 nt, Human
aaaauccagaaacuuguucuu

SEQ ID NO: 3373590 - RNA, 15 nt, Human
aaaauccugugcaau

SEQ ID NO: 3373591 - RNA, 21 nt, Human
aaaauccuuccaaagaauucu

SEQ ID NO: 3373592 - RNA, 13 nt, Human
aaaaucuauucug

SEQ ID NO: 3373593 - RNA, 15 nt, Human
aaaaucucaaauuuc

SEQ ID NO: 3373594 - RNA, 11 nt, Human
aaaaucuccua

SEQ ID NO: 3373595 - RNA, 14 nt, Human
aaaaucuccuaaau

SEQ ID NO: 3373596 - RNA, 18 nt, Human
aaaaucucuccacuuuca

SEQ ID NO: 3373597 - RNA, 20 nt, Human
aaaaucucuccacuuucagc

SEQ ID NO: 3373598 - RNA, 23 nt, Human
aaaaucugaaaaugugaauaaaa

SEQ ID NO: 3373599 - RNA, 14 nt, Human
aaaaucugaagauu

SEQ ID NO: 3373600 - RNA, 16 nt, Human
aaaaucugaagauugu

SEQ ID NO: 3373601 - RNA, 18 nt, Human
aaaaucugaagauuguuu

SEQ ID NO: 3373602 - RNA, 15 nt, Human
aaaaucugcuaggga

SEQ ID NO: 3373603 - RNA, 15 nt, Human
aaaaucugcuguuaa

SEQ ID NO: 3373604 - RNA, 19 nt, Human
aaaaucuguuugaucccug

SEQ ID NO: 3373605 - RNA, 14 nt, Human
aaaaucuuaaugua

SEQ ID NO: 3373606 - RNA, 19 nt, Human
aaaaucuuauaguucuagg

SEQ ID NO: 3373607 - RNA, 18 nt, Human
aaaaucuuauuaaaguuu

SEQ ID NO: 3373608 - RNA, 21 nt, Human
aaaaucuuauuaaaguuucaa

SEQ ID NO: 3373609 - RNA, 20 nt, Human
aaaaucuuggagacccugca

SEQ ID NO: 3373610 - RNA, 18 nt, Human
aaaaucuuggcacagaaa

SEQ ID NO: 3373611 - RNA, 18 nt, Human
aaaaucuugugcuagaau

SEQ ID NO: 3373612 - RNA, 17 nt, Human
aaaaucuuucuuucuua

SEQ ID NO: 3373613 - RNA, 19 nt, Human
aaaaucuuucuuucuuaga

SEQ ID NO: 3373614 - RNA, 9 nt, Human
aaaaugaaa

SEQ ID NO: 3373615 - RNA, 13 nt, Human
aaaaugaaagaug

SEQ ID NO: 3373616 - RNA, 22 nt, Human
aaaaugaaagcaugucucaaua

SEQ ID NO: 3373617 - RNA, 15 nt, Human
aaaaugaaauauuuu

SEQ ID NO: 3373618 - RNA, 15 nt, Human
aaaaugaaauguuuu

SEQ ID NO: 3373619 - RNA, 15 nt, Human
aaaaugaagaauuua

SEQ ID NO: 3373620 - RNA, 16 nt, Human
aaaaugaagaauuuaa

SEQ ID NO: 3373621 - RNA, 15 nt, Human
aaaaugaagauuauu

SEQ ID NO: 3373622 - RNA, 23 nt, Human
aaaaugaagauuauuuuuuauga

SEQ ID NO: 3373623 - RNA, 20 nt, Human
aaaaugaagguuaggauuua

SEQ ID NO: 3373624 - RNA, 14 nt, Human
aaaaugaauaucua

SEQ ID NO: 3373625 - RNA, 18 nt, Human
aaaaugaauaucuauuaa

SEQ ID NO: 3373626 - RNA, 14 nt, Human
aaaaugacauccca

SEQ ID NO: 3373627 - RNA, 16 nt, Human
aaaaugacaucuuuuu

SEQ ID NO: 3373628 - RNA, 15 nt, Human
aaaaugagaacaugu

SEQ ID NO: 3373629 - RNA, 18 nt, Human
aaaaugagaacauguugg

SEQ ID NO: 3373630 - RNA, 16 nt, Human
aaaaugagcuugauua

SEQ ID NO: 3373631 - RNA, 16 nt, Human
aaaaugaggaauguau

SEQ ID NO: 3373632 - RNA, 18 nt, Human
aaaaugagguucaacugu

SEQ ID NO: 3373633 - RNA, 20 nt, Human
aaaaugaguugugaaaguuu

SEQ ID NO: 3373634 - RNA, 23 nt, Human
aaaaugaguuuuuauggggcuga

SEQ ID NO: 3373635 - RNA, 16 nt, Human
aaaaugauguucauuu

SEQ ID NO: 3373636 - RNA, 22 nt, Human
aaaaugauuuguaguggaaaca

SEQ ID NO: 3373637 - RNA, 18 nt, Human
aaaaugcaaauccuaugu

SEQ ID NO: 3373638 - RNA, 22 nt, Human
aaaaugcaaauccuaugugauu

SEQ ID NO: 3373639 - RNA, 17 nt, Human
aaaaugcaauauuugua

SEQ ID NO: 3373640 - RNA, 14 nt, Human
aaaaugcacauagc

SEQ ID NO: 3373641 - RNA, 14 nt, Human
aaaaugcauuguau

SEQ ID NO: 3373642 - RNA, 17 nt, Human
aaaaugccaagacauga

SEQ ID NO: 3373643 - RNA, 21 nt, Human
aaaaugccauaauacaaaagg

SEQ ID NO: 3373644 - RNA, 17 nt, Human
aaaaugcccuuaaauca

SEQ ID NO: 3373645 - RNA, 16 nt, Human
aaaaugccucagugua

SEQ ID NO: 3373646 - RNA, 20 nt, Human
aaaaugccucaguguauuug

SEQ ID NO: 3373647 - RNA, 12 nt, Human
aaaaugccuuug

SEQ ID NO: 3373648 - RNA, 13 nt, Human
aaaaugcuagguu

SEQ ID NO: 3373649 - RNA, 16 nt, Human
aaaaugcuagguucua

SEQ ID NO: 3373650 - RNA, 17 nt, Human
aaaaugcucuuauuuca

SEQ ID NO: 3373651 - RNA, 16 nt, Human
aaaaugcugaacauug

SEQ ID NO: 3373652 - RNA, 14 nt, Human
aaaaugcuucaaag

SEQ ID NO: 3373653 - RNA, 12 nt, Human
aaaauggaaaga

SEQ ID NO: 3373654 - RNA, 16 nt, Human
aaaauggaaccaggcu

SEQ ID NO: 3373655 - RNA, 14 nt, Human
aaaauggaacugug

SEQ ID NO: 3373656 - RNA, 12 nt, Human
aaaauggaauac

SEQ ID NO: 3373657 - RNA, 23 nt, Human
aaaauggacaugguggcuuuguu

SEQ ID NO: 3373658 - RNA, 14 nt, Human
aaaauggcagugau

SEQ ID NO: 3373659 - RNA, 23 nt, Human
aaaauggccauuugcuuuuucac

SEQ ID NO: 3373660 - RNA, 15 nt, Human
aaaaugggacuucuu

SEQ ID NO: 3373661 - RNA, 19 nt, Human
aaaaugggacuucuuuuca

SEQ ID NO: 3373662 - RNA, 21 nt, Human
aaaaugggacuucuuuucaca

SEQ ID NO: 3373663 - RNA, 16 nt, Human
aaaauggguuuuacug

SEQ ID NO: 3373664 - RNA, 24 nt, Human
aaaaugguaucaaaauuacauaua

SEQ ID NO: 3373665 - RNA, 15 nt, Human
aaaauggucucuaac

SEQ ID NO: 3373666 - RNA, 22 nt, Human
aaacuagaaagcagagauuuuc

SEQ ID NO: 3373667 - RNA, 15 nt, Human
aaacuagaauuucau

SEQ ID NO: 3373668 - RNA, 16 nt, Human
aaacuagaugaccuca

SEQ ID NO: 3373669 - RNA, 20 nt, Human
aaacuagaugaccucauuaa

SEQ ID NO: 3373670 - RNA, 20 nt, Human
aaacuagcauaucugccuuu

SEQ ID NO: 3373671 - RNA, 22 nt, Human
aaacuagcauaucugccuuuau

SEQ ID NO: 3373672 - RNA, 17 nt, Human
aaacuaggcauuuguaa

SEQ ID NO: 3373673 - RNA, 22 nt, Human
aaacuaggugcauauuuauaaa

SEQ ID NO: 3373674 - RNA, 15 nt, Human
aaacuaguaguucuc

SEQ ID NO: 3373675 - RNA, 18 nt, Human
aaacuaguaguucucuug

SEQ ID NO: 3373676 - RNA, 14 nt, Human
aaacuaguuuuucc

SEQ ID NO: 3373677 - RNA, 11 nt, Human
aaacuaucagu

SEQ ID NO: 3373678 - RNA, 15 nt, Human
aaacuaucuggccau

SEQ ID NO: 3373679 - RNA, 16 nt, Human
aaacuaucuuggugaa

SEQ ID NO: 3373680 - RNA, 20 nt, Human
aaacuauguguuuuucucau

SEQ ID NO: 3373681 - RNA, 20 nt, Human
aaacuauuggaaaguacucc

SEQ ID NO: 3373682 - RNA, 13 nt, Human
aaacuauuuaacu

SEQ ID NO: 3373683 - RNA, 17 nt, Human
aaacuauuuaacuugag

SEQ ID NO: 3373684 - RNA, 16 nt, Human
aaacaggcacugcccu

SEQ ID NO: 3373685 - RNA, 12 nt, Human
aaacaggcagcu

SEQ ID NO: 3373686 - RNA, 13 nt, Human
aaacaggcccagc

SEQ ID NO: 3373687 - RNA, 14 nt, Human
aaacaggcccagca

SEQ ID NO: 3373688 - RNA, 19 nt, Human
aaacagggcaucuccagga

SEQ ID NO: 3373689 - RNA, 15 nt, Human
aaacagggcugccuu

SEQ ID NO: 3373690 - RNA, 21 nt, Human
aaacagguauauacuuugaaa

SEQ ID NO: 3373691 - RNA, 18 nt, Human
aaacagguggugagaaau

SEQ ID NO: 3373692 - RNA, 12 nt, Human
aaacaguauuua

SEQ ID NO: 3373693 - RNA, 15 nt, Human
aaacaguauuuauuu

SEQ ID NO: 3373694 - RNA, 17 nt, Human
aaacaguauuucauugc

SEQ ID NO: 3373695 - RNA, 12 nt, Human
aaacagugccug

SEQ ID NO: 3373696 - RNA, 14 nt, Human
aaacagugcuguuu

SEQ ID NO: 3373697 - RNA, 18 nt, Human
aaacaguuaacuuucaga

SEQ ID NO: 3373698 - RNA, 18 nt, Human
aaacaguugcacagcauc

SEQ ID NO: 3373699 - RNA, 19 nt, Human
aaacaguugcacagcaucu

SEQ ID NO: 3373700 - RNA, 19 nt, Human
aaacaguugcauguaguaa

SEQ ID NO: 3373701 - RNA, 13 nt, Human
aaacauaaaaagu

SEQ ID NO: 3373702 - RNA, 17 nt, Human
aaacauaacauaaauuu

SEQ ID NO: 3373703 - RNA, 14 nt, Human
aaacauaagugcaa

SEQ ID NO: 3373704 - RNA, 17 nt, Human
aaacauaccaacauguu

SEQ ID NO: 3373705 - RNA, 15 nt, Human
aaacauaugauuuca

SEQ ID NO: 3373706 - RNA, 19 nt, Human
aaacaucaguuacucugaa

SEQ ID NO: 3373707 - RNA, 23 nt, Human
aaacaucaguuacucugaagggc

SEQ ID NO: 3373708 - RNA, 21 nt, Human
aaacaucauuccuuuuuauuu

SEQ ID NO: 3373709 - RNA, 22 nt, Human
aaacauccuacaagacacagug

SEQ ID NO: 3373710 - RNA, 13 nt, Human
aaacaucuagaaa

SEQ ID NO: 3373711 - RNA, 23 nt, Human
aaacaucucaucaugucuauugu

SEQ ID NO: 3373712 - RNA, 13 nt, Human
aaacaucuccuua

SEQ ID NO: 3373713 - RNA, 11 nt, Human
aaacaucugga

SEQ ID NO: 3373714 - RNA, 16 nt, Human
aaacaucuuugaaauu

SEQ ID NO: 3373715 - RNA, 19 nt, Human
aaacaugacccuaaaucuu

SEQ ID NO: 3373716 - RNA, 18 nt, Human
aaacaugcuguacauacu

SEQ ID NO: 3373717 - RNA, 20 nt, Human
aaacaugcuguacauacuuu

SEQ ID NO: 3373718 - RNA, 16 nt, Human
aaacauggccuuugcu

SEQ ID NO: 3373719 - RNA, 17 nt, Human
aaacaugguuacaauca

SEQ ID NO: 3373720 - RNA, 12 nt, Human
aaacauguaugu

SEQ ID NO: 3373721 - RNA, 16 nt, Human
aaacauguuagaagca

SEQ ID NO: 3373722 - RNA, 23 nt, Human
aaacauguuucuuuguaaugaaa

SEQ ID NO: 3373723 - RNA, 13 nt, Human
aaacauuaagaaa

SEQ ID NO: 3373724 - RNA, 15 nt, Human
aaacauuaagaaaau

SEQ ID NO: 3373725 - RNA, 20 nt, Human
aaacauuaauagcagccuuu

SEQ ID NO: 3373726 - RNA, 21 nt, Human
aaacauuaauagcagccuuuc

SEQ ID NO: 3373727 - RNA, 24 nt, Human
aaacauuaauguugauuucuaguu

SEQ ID NO: 3373728 - RNA, 23 nt, Human
aaacauucugauuuggaaaaaga

SEQ ID NO: 3373729 - RNA, 24 nt, Human
aaacauugacgauuccuucucuga

SEQ ID NO: 3373730 - RNA, 17 nt, Human
aaacauugccuuugaau

SEQ ID NO: 3373731 - RNA, 17 nt, Human
aaacauuggaagcaggu

SEQ ID NO: 3373732 - RNA, 17 nt, Human
aaacauugguucuugua

SEQ ID NO: 3373733 - RNA, 18 nt, Human
aaacauugguucuuguau

SEQ ID NO: 3373734 - RNA, 17 nt, Human
aaacauuguguugacau

SEQ ID NO: 3373735 - RNA, 11 nt, Human
aaacauuuaua

SEQ ID NO: 3373736 - RNA, 14 nt, Human
aaacauuuauuuug

SEQ ID NO: 3373737 - RNA, 18 nt, Human
aaacauuuauuuugacau

SEQ ID NO: 3373738 - RNA, 16 nt, Human
aaacauuucauaauuu

SEQ ID NO: 3373739 - RNA, 22 nt, Human
aaacauuucauaauuuguuucc

SEQ ID NO: 3373740 - RNA, 14 nt, Human
aaacauuugcugaa

SEQ ID NO: 3373741 - RNA, 13 nt, Human
aaacauuuucaca

SEQ ID NO: 3373742 - RNA, 21 nt, Human
aaacauuuuguggucauuaag

SEQ ID NO: 3373743 - RNA, 15 nt, Human
aaaccaaaaacugaa

SEQ ID NO: 3373744 - RNA, 13 nt, Human
aaaccaaaaugac

SEQ ID NO: 3373745 - RNA, 17 nt, Human
aaaccaaaaugacaucu

SEQ ID NO: 3373746 - RNA, 18 nt, Human
aaaccaaaaugacaucuu

SEQ ID NO: 3373747 - RNA, 20 nt, Human
aaaccaaaaugacaucuuuu

SEQ ID NO: 3373748 - RNA, 23 nt, Human
aaaccaaaaugacaucuuuuuaa

SEQ ID NO: 3373749 - RNA, 14 nt, Human
aaaccaaaaugaua

SEQ ID NO: 3373750 - RNA, 19 nt, Human
aaaccaaagagggcuuccu

SEQ ID NO: 3373751 - RNA, 21 nt, Human
aaaccaaagagggcuuccucu

SEQ ID NO: 3373752 - RNA, 18 nt, Human
aaaccaaaucacugaacu

SEQ ID NO: 3373753 - RNA, 15 nt, Human
aaaccaagcaaagga

SEQ ID NO: 3373754 - RNA, 16 nt, Human
aaaccaagcaucaggg

SEQ ID NO: 3373755 - RNA, 14 nt, Human
aaaccaagccgugg

SEQ ID NO: 3373756 - RNA, 20 nt, Human
aaaccaagucggaacagcag

SEQ ID NO: 3373757 - RNA, 17 nt, Human
aaaccaauccuaugcau

SEQ ID NO: 3373758 - RNA, 19 nt, Human
aaaccacaaaggccaaacu

SEQ ID NO: 3373759 - RNA, 20 nt, Human
aaaccacaaggcuguugcau

SEQ ID NO: 3373760 - RNA, 12 nt, Human
aaaccacacaaa

SEQ ID NO: 3373761 - RNA, 21 nt, Human
aaaccacauuggagauguuua

SEQ ID NO: 3373762 - RNA, 19 nt, Human
aaaccaccagaagcccaga

SEQ ID NO: 3373763 - RNA, 16 nt, Human
aaaccacuagaacucu

SEQ ID NO: 3373764 - RNA, 17 nt, Human
aaaccacugaaaaaaua

SEQ ID NO: 3373765 - RNA, 22 nt, Human
aaaccacuuaaacgaagaguuc

SEQ ID NO: 3373766 - RNA, 10 nt, Human
aaaccacuuu

SEQ ID NO: 3373767 - RNA, 15 nt, Human
aaaccagaggcagcu

SEQ ID NO: 3373768 - RNA, 13 nt, Human
aaaccagcucagc

SEQ ID NO: 3373769 - RNA, 12 nt, Human
aaaccagcuucc

SEQ ID NO: 3373770 - RNA, 13 nt, Human
aaaccagcuuccu

SEQ ID NO: 3373771 - RNA, 17 nt, Human
aaaccagcuuccuucag

SEQ ID NO: 3373772 - RNA, 19 nt, Human
aaaccagcuuccuucagag

SEQ ID NO: 3373773 - RNA, 17 nt, Human
aaaccagggagccccuu

SEQ ID NO: 3373774 - RNA, 20 nt, Human
aaaccagguccaaugagcuu

SEQ ID NO: 3373775 - RNA, 16 nt, Human
aaaccaguauuguaca

SEQ ID NO: 3373776 - RNA, 18 nt, Human
aaaccaguauuguacaaa

SEQ ID NO: 3373777 - RNA, 13 nt, Human
aaaccauaaacuu

SEQ ID NO: 3373778 - RNA, 23 nt, Human
aaaccaucucccuggugcuuaug

SEQ ID NO: 3373779 - RNA, 18 nt, Human
aaaccaucuggccuggcc

SEQ ID NO: 3373780 - RNA, 23 nt, Human
aaaccaugaagagauuuuucaug

SEQ ID NO: 3373781 - RNA, 15 nt, Human
aaaccaugcaaaugc

SEQ ID NO: 3373782 - RNA, 15 nt, Human
aaaccaugggauaaa

SEQ ID NO: 3373783 - RNA, 14 nt, Human
aaaccauugcuuca

SEQ ID NO: 3373784 - RNA, 16 nt, Human
aaaccauugcuucacu

SEQ ID NO: 3373785 - RNA, 12 nt, Human
aaacccagcucu

SEQ ID NO: 3373786 - RNA, 23 nt, Human
aaacccagcugcaccccuuccug

SEQ ID NO: 3373787 - RNA, 17 nt, Human
aaacccaguugccaucu

SEQ ID NO: 3373788 - RNA, 15 nt, Human
aaacccccacacaca

SEQ ID NO: 3373789 - RNA, 15 nt, Human
aaaccccccagauau

SEQ ID NO: 3373790 - RNA, 19 nt, Human
aaaccccuacccucacaau

SEQ ID NO: 3373791 - RNA, 13 nt, Human
aaaccccuguccc

SEQ ID NO: 3373792 - RNA, 19 nt, Human
aaacccgacagagggaaga

SEQ ID NO: 3373793 - RNA, 21 nt, Human
aaacccgggaaccuccccagc

SEQ ID NO: 3373794 - RNA, 20 nt, Human
aaacccgucucuacuaaaaa

SEQ ID NO: 3373795 - RNA, 14 nt, Human
aaacccuagccuug

SEQ ID NO: 3373796 - RNA, 16 nt, Human
aaacccuauugguaaa

SEQ ID NO: 3373797 - RNA, 15 nt, Human
aaacccucagagccu

SEQ ID NO: 3373798 - RNA, 24 nt, Human
aaacccucgaggcggaucuuugga

SEQ ID NO: 3373799 - RNA, 16 nt, Human
aaacccugucaaacau

SEQ ID NO: 3373800 - RNA, 19 nt, Human
aaacccuugccaugugcua

SEQ ID NO: 3373801 - RNA, 13 nt, Human
aaaccgaauaaau

SEQ ID NO: 3373802 - RNA, 14 nt, Human
aaaccgaauaaaug

SEQ ID NO: 3373803 - RNA, 16 nt, Human
aaaccgccaaggcugg

SEQ ID NO: 3373804 - RNA, 14 nt, Human
aaaccgccagcucu

SEQ ID NO: 3373805 - RNA, 18 nt, Human
aaaccgccagcucuguuc

SEQ ID NO: 3373806 - RNA, 15 nt, Human
aaaccgcuaaaagaa

SEQ ID NO: 3373807 - RNA, 18 nt, Human
aaaccgcuaaaagaaacu

SEQ ID NO: 3373808 - RNA, 19 nt, Human
aaaccuaaaaaagauauau

SEQ ID NO: 3373809 - RNA, 20 nt, Human
aaaccuaaguccuuuaugug

SEQ ID NO: 3373810 - RNA, 18 nt, Human
aaaccuacacacugucau

SEQ ID NO: 3373811 - RNA, 20 nt, Human
aaacuuugagaucuaaaaau

SEQ ID NO: 3373812 - RNA, 21 nt, Human
aaacuuugagaucuaaaaaua

SEQ ID NO: 3373813 - RNA, 12 nt, Human
aaacuuuguagu

SEQ ID NO: 3373814 - RNA, 14 nt, Human
aaacuuuuaaacua

SEQ ID NO: 3373815 - RNA, 16 nt, Human
aaacuuuuaauucauu

SEQ ID NO: 3373816 - RNA, 16 nt, Human
aaacuuuuauaaauua

SEQ ID NO: 3373817 - RNA, 17 nt, Human
aaacuuuuauaaauuaa

SEQ ID NO: 3373818 - RNA, 19 nt, Human
aaacuuuuauaaauuaaau

SEQ ID NO: 3373819 - RNA, 22 nt, Human
aaacuuuucaaggcuuauauuc

SEQ ID NO: 3373820 - RNA, 13 nt, Human
aaacuuuucuaga

SEQ ID NO: 3373821 - RNA, 13 nt, Human
aaacuuuucugau

SEQ ID NO: 3373822 - RNA, 14 nt, Human
aaacuuuucugaua

SEQ ID NO: 3373823 - RNA, 16 nt, Human
aaacuuuucugcugau

SEQ ID NO: 3373824 - RNA, 20 nt, Human
aaacuuuucuuaaaaaguua

SEQ ID NO: 3373825 - RNA, 12 nt, Human
aaacuuuuuuau

SEQ ID NO: 3373826 - RNA, 16 nt, Human
aaacuuuuuuucaaug

SEQ ID NO: 3373827 - RNA, 19 nt, Human
aaacuuuuuuucuguacca

SEQ ID NO: 3373828 - RNA, 23 nt, Human
aaacuuuuuuucuguaccaguua

SEQ ID NO: 3373829 - RNA, 13 nt, Human
aaagaaaaaaaau

SEQ ID NO: 3373830 - RNA, 17 nt, Human
aaagaaaaaaauguauu

SEQ ID NO: 3373831 - RNA, 22 nt, Human
aaagaaaaaaauguauuuuaug

SEQ ID NO: 3373832 - RNA, 13 nt, Human
aaagaaaaaaauu

SEQ ID NO: 3373833 - RNA, 18 nt, Human
aaagaaaaaauaauugau

SEQ ID NO: 3373834 - RNA, 14 nt, Human
aaagaaaacaaaaa

SEQ ID NO: 3373835 - RNA, 20 nt, Human
aaagaaaacuuguauuaugu

SEQ ID NO: 3373836 - RNA, 16 nt, Human
aaagaaaagaaaauuu

SEQ ID NO: 3373837 - RNA, 23 nt, Human
aaagaaaauaaagacaaccauau

SEQ ID NO: 3373838 - RNA, 14 nt, Human
aaagaaaauaugca

SEQ ID NO: 3373839 - RNA, 17 nt, Human
aaagaaaauaugcaucu

SEQ ID NO: 3373840 - RNA, 13 nt, Human
aaagaaaaugaaa

SEQ ID NO: 3373841 - RNA, 22 nt, Human
aaagaaaaugaaaaacaaccaa

SEQ ID NO: 3373842 - RNA, 18 nt, Human
aaagaaaauucuuggaau

SEQ ID NO: 3373843 - RNA, 13 nt, Human
aaagaaaauugag

SEQ ID NO: 3373844 - RNA, 15 nt, Human
aaagaaacagcuuuc

SEQ ID NO: 3373845 - RNA, 15 nt, Human
aaaauguaugcaugu

SEQ ID NO: 3373846 - RNA, 16 nt, Human
aaaauguaugcauguu

SEQ ID NO: 3373847 - RNA, 13 nt, Human
aaaauguauuuua

SEQ ID NO: 3373848 - RNA, 16 nt, Human
aaaauguauuuuaugu

SEQ ID NO: 3373849 - RNA, 16 nt, Human
aaaauguauuuuucua

SEQ ID NO: 3373850 - RNA, 14 nt, Human
aaaaugucaaaagu

SEQ ID NO: 3373851 - RNA, 15 nt, Human
aaaaugucaaaagua

SEQ ID NO: 3373852 - RNA, 21 nt, Human
aaaaugucaaaaguagaacuu

SEQ ID NO: 3373853 - RNA, 23 nt, Human
aaaaugucaaaaguagaacuuug

SEQ ID NO: 3373854 - RNA, 22 nt, Human
aaaaugucaaagagaaaacuua

SEQ ID NO: 3373855 - RNA, 23 nt, Human
aaaauguccaguaagaucacugu

SEQ ID NO: 3373856 - RNA, 18 nt, Human
aaaauguccugccuuuua

SEQ ID NO: 3373857 - RNA, 14 nt, Human
aaaauguccuugug

SEQ ID NO: 3373858 - RNA, 11 nt, Human
aaaaugucugu

SEQ ID NO: 3373859 - RNA, 18 nt, Human
aaaaugucuguaauaaua

SEQ ID NO: 3373860 - RNA, 18 nt, Human
aaaaugugaauaaaauua

SEQ ID NO: 3373861 - RNA, 19 nt, Human
aaaaugugacccagauccu

SEQ ID NO: 3373862 - RNA, 18 nt, Human
aaaaugugagugguugaa

SEQ ID NO: 3373863 - RNA, 12 nt, Human
aaaaugugauuu

SEQ ID NO: 3373864 - RNA, 23 nt, Human
aaaauguguguauucuuaaaaug

SEQ ID NO: 3373865 - RNA, 15 nt, Human
aaaauguguugaaac

SEQ ID NO: 3373866 - RNA, 14 nt, Human
aaaauguuaagcau

SEQ ID NO: 3373867 - RNA, 16 nt, Human
aaaauguuauuuaaca

SEQ ID NO: 3373868 - RNA, 13 nt, Human
aaaauguugaaaa

SEQ ID NO: 3373869 - RNA, 19 nt, Human
aaaauguugaaaagucaaa

SEQ ID NO: 3373870 - RNA, 19 nt, Human
aaaauguuggauuuauaaa

SEQ ID NO: 3373871 - RNA, 20 nt, Human
aaaauguuggauuuauaaau

SEQ ID NO: 3373872 - RNA, 12 nt, Human
aaaauguuuuaa

SEQ ID NO: 3373873 - RNA, 21 nt, Human
aaaauguuuuuucauguguuu

SEQ ID NO: 3373874 - RNA, 18 nt, Human
aaaauuaaacacaaagug

SEQ ID NO: 3373875 - RNA, 20 nt, Human
aaaauuaaaccggaccaucu

SEQ ID NO: 3373876 - RNA, 17 nt, Human
aaaauuaaaucaaccuu

SEQ ID NO: 3373877 - RNA, 14 nt, Human
aaaauuaacacugc

SEQ ID NO: 3373878 - RNA, 20 nt, Human
aaaauuaagaaaggauaaag

SEQ ID NO: 3373879 - RNA, 14 nt, Human
aaaauuaagaaugu

SEQ ID NO: 3373880 - RNA, 20 nt, Human
aaaauuaagcaaauguuaaa

SEQ ID NO: 3373881 - RNA, 17 nt, Human
aaaauuaaggcaacuga

SEQ ID NO: 3373882 - RNA, 20 nt, Human
aaaauuaagguguuugaaaa

SEQ ID NO: 3373883 - RNA, 14 nt, Human
aaaauuacaacuaa

SEQ ID NO: 3373884 - RNA, 15 nt, Human
aaaauuacuaauuuu

SEQ ID NO: 3373885 - RNA, 17 nt, Human
aaaauuacuaauuuuac

SEQ ID NO: 3373886 - RNA, 14 nt, Human
aaaauuagaaauug

SEQ ID NO: 3373887 - RNA, 19 nt, Human
aaaauuaggauuucaugau

SEQ ID NO: 3373888 - RNA, 21 nt, Human
aaaauuauacuaacuuauuua

SEQ ID NO: 3373889 - RNA, 13 nt, Human
aaaauuauacugu

SEQ ID NO: 3373890 - RNA, 18 nt, Human
aaaauuauacugugugug

SEQ ID NO: 3373891 - RNA, 15 nt, Human
aaaauuauagcucua

SEQ ID NO: 3373892 - RNA, 22 nt, Human
aaaauuauaucucaguaaacuu

SEQ ID NO: 3373893 - RNA, 15 nt, Human
aaaauuaucuauuug

SEQ ID NO: 3373894 - RNA, 19 nt, Human
aaaauuaugaaucugauuu

SEQ ID NO: 3373895 - RNA, 14 nt, Human
aaaauuauggaaac

SEQ ID NO: 3373896 - RNA, 23 nt, Human
aaaauuauguuugccacuuugca

SEQ ID NO: 3373897 - RNA, 19 nt, Human
aaaauuauugauugcuuuu

SEQ ID NO: 3373898 - RNA, 19 nt, Human
aaaauuauuuuaaacaaaa

SEQ ID NO: 3373899 - RNA, 16 nt, Human
aaaauuauuuuguuca

SEQ ID NO: 3373900 - RNA, 20 nt, Human
aaaauuauuuuguucauaca

SEQ ID NO: 3373901 - RNA, 14 nt, Human
aaaauucaaaaagu

SEQ ID NO: 3373902 - RNA, 16 nt, Human
aaaauucaaaaagugu

SEQ ID NO: 3373903 - RNA, 18 nt, Human
aaaauucaaaaaguguuu

SEQ ID NO: 3373904 - RNA, 21 nt, Human
aaaauucaaagcauggacauu

SEQ ID NO: 3373905 - RNA, 12 nt, Human
aaaauucagaga

SEQ ID NO: 3373906 - RNA, 13 nt, Human
aaaauucagcaaa

SEQ ID NO: 3373907 - RNA, 13 nt, Human
aaaauucagugga

SEQ ID NO: 3373908 - RNA, 18 nt, Human
aaaauucauaguaagauu

SEQ ID NO: 3373909 - RNA, 22 nt, Human
aaaauucaugauacucauuucu

SEQ ID NO: 3373910 - RNA, 13 nt, Human
aaaauucauuuca

SEQ ID NO: 3373911 - RNA, 14 nt, Human
aaaauucauuucac

SEQ ID NO: 3373912 - RNA, 21 nt, Human
aaaauucgaccugauuuacag

SEQ ID NO: 3373913 - RNA, 15 nt, Human
aaaauucugaaugua

SEQ ID NO: 3373914 - RNA, 19 nt, Human
aaaauugaauuuaacaaug

SEQ ID NO: 3373915 - RNA, 20 nt, Human
aaaauugaauuuaacaaugc

SEQ ID NO: 3373916 - RNA, 23 nt, Human
aaaauugaguucuuccuguaauc

SEQ ID NO: 3373917 - RNA, 21 nt, Human
aaaauugaugggauuugguca

SEQ ID NO: 3373918 - RNA, 12 nt, Human
aaaauugaugug

SEQ ID NO: 3373919 - RNA, 17 nt, Human
aaaauugccauauugca

SEQ ID NO: 3373920 - RNA, 19 nt, Human
aaaauugccauauugcaca

SEQ ID NO: 3373921 - RNA, 12 nt, Human
aaaauugccuuu

SEQ ID NO: 3373922 - RNA, 22 nt, Human
aaaauugccuuucuguguuuau

SEQ ID NO: 3373923 - RNA, 13 nt, Human
aaaauugcuaugu

SEQ ID NO: 3373924 - RNA, 20 nt, Human
aaaauugcugacuguagcuu

SEQ ID NO: 3373925 - RNA, 16 nt, Human
aaaauuggcaaaacua

SEQ ID NO: 3373926 - RNA, 21 nt, Human
aaaauuggggauucuuaaagu

SEQ ID NO: 3373927 - RNA, 15 nt, Human
aaaauuguauagaga

SEQ ID NO: 3373928 - RNA, 16 nt, Human
aaaauugucuucaugu

SEQ ID NO: 3373929 - RNA, 20 nt, Human
aaaauuguuaauuuuuccua

SEQ ID NO: 3373930 - RNA, 21 nt, Human
aaaauuguuuugagcuuucca

SEQ ID NO: 3373931 - RNA, 14 nt, Human
aaaauuuaagcauu

SEQ ID NO: 3373932 - RNA, 15 nt, Human
aaaauuuaagcauug

SEQ ID NO: 3373933 - RNA, 19 nt, Human
aaaauuuaagcugcaaaaa

SEQ ID NO: 3373934 - RNA, 19 nt, Human
aaaauuuaaguaucuuuuu

SEQ ID NO: 3373935 - RNA, 23 nt, Human
aaaauuuaagugcguguguagag

SEQ ID NO: 3373936 - RNA, 15 nt, Human
aaaauuuaguuuuug

SEQ ID NO: 3373937 - RNA, 19 nt, Human
aaaauuuaguuuuuguucu

SEQ ID NO: 3373938 - RNA, 23 nt, Human
aaaauuuaguuuuuguucuuaau

SEQ ID NO: 3373939 - RNA, 12 nt, Human
aaaauuuauaac

SEQ ID NO: 3373940 - RNA, 20 nt, Human
aaaauuuauauuguaaauau

SEQ ID NO: 3373941 - RNA, 22 nt, Human
aaaauuuaugguuuugguauuu

SEQ ID NO: 3373942 - RNA, 13 nt, Human
aaaauuucacauu

SEQ ID NO: 3373943 - RNA, 13 nt, Human
aaaauuucuaaga

SEQ ID NO: 3373944 - RNA, 20 nt, Human
aaaauuucuuagaaaacaau

SEQ ID NO: 3373945 - RNA, 19 nt, Human
aaaauuugaaacauugcuu

SEQ ID NO: 3373946 - RNA, 21 nt, Human
aaaauuugaaacauugcuuuu

SEQ ID NO: 3373947 - RNA, 23 nt, Human
aaaauuugaaccaaaacauuccg

SEQ ID NO: 3373948 - RNA, 16 nt, Human
aaaauuugcccuccca

SEQ ID NO: 3373949 - RNA, 14 nt, Human
aaaauuuggaauuc

SEQ ID NO: 3373950 - RNA, 22 nt, Human
aaaauuugucugaaacauuuca

SEQ ID NO: 3373951 - RNA, 20 nt, Human
aaaauuuguucuuguauuua

SEQ ID NO: 3373952 - RNA, 13 nt, Human
aaaauuuguugca

SEQ ID NO: 3373953 - RNA, 16 nt, Human
aaaauuuguuuugacg

SEQ ID NO: 3373954 - RNA, 17 nt, Human
aaaauuuuaaaaaucua

SEQ ID NO: 3373955 - RNA, 23 nt, Human
aaaauuuuauaagcaaauuucaa

SEQ ID NO: 3373956 - RNA, 14 nt, Human
aaaagauauaagug

SEQ ID NO: 3373957 - RNA, 15 nt, Human
aaaagauauaagugc

SEQ ID NO: 3373958 - RNA, 23 nt, Human
aaaagauauaagugcuguauaaa

SEQ ID NO: 3373959 - RNA, 21 nt, Human
aaaagauauauuaaaaauaua

SEQ ID NO: 3373960 - RNA, 22 nt, Human
aaaagauauauuaaaaauauaa

SEQ ID NO: 3373961 - RNA, 10 nt, Human
aaaagauccc

SEQ ID NO: 3373962 - RNA, 13 nt, Human
aaaagaucgcagu

SEQ ID NO: 3373963 - RNA, 21 nt, Human
aaaagauggggucuguaaaau

SEQ ID NO: 3373964 - RNA, 13 nt, Human
aaaagauguagau

SEQ ID NO: 3373965 - RNA, 15 nt, Human
aaaagauuaaacugc

SEQ ID NO: 3373966 - RNA, 18 nt, Human
aaaagauucuuuuucuga

SEQ ID NO: 3373967 - RNA, 21 nt, Human
aaaagauugcugaaauuuuau

SEQ ID NO: 3373968 - RNA, 17 nt, Human
aaaagauuguauugcug

SEQ ID NO: 3373969 - RNA, 14 nt, Human
aaaagauuuuaauc

SEQ ID NO: 3373970 - RNA, 21 nt, Human
aaaagcaaaauaaaaacuauu

SEQ ID NO: 3373971 - RNA, 14 nt, Human
aaaagcaaaaucau

SEQ ID NO: 3373972 - RNA, 17 nt, Human
aaaagcaacaucagcuu

SEQ ID NO: 3373973 - RNA, 12 nt, Human
aaaagcaagacu

SEQ ID NO: 3373974 - RNA, 11 nt, Human
aaaagcaccuc

SEQ ID NO: 3373975 - RNA, 15 nt, Human
aaaagcacuccugcu

SEQ ID NO: 3373976 - RNA, 19 nt, Human
aaaagcagcccuuggccag

SEQ ID NO: 3373977 - RNA, 18 nt, Human
aaaagcaucuaugugaga

SEQ ID NO: 3373978 - RNA, 15 nt, Human
aaaagcauguacagu

SEQ ID NO: 3373979 - RNA, 22 nt, Human
aaaagcauguacaguguucugu

SEQ ID NO: 3373980 - RNA, 21 nt, Human
aaaagcauuuuucaauauauu

SEQ ID NO: 3373981 - RNA, 18 nt, Human
aaaagccaagaggcugca

SEQ ID NO: 3373982 - RNA, 22 nt, Human
aaaagccagcaggcuucaaacu

SEQ ID NO: 3373983 - RNA, 12 nt, Human
aaaagccagggc

SEQ ID NO: 3373984 - RNA, 14 nt, Human
aaaagccaucaugu

SEQ ID NO: 3373985 - RNA, 14 nt, Human
aaaagcccaggagc

SEQ ID NO: 3373986 - RNA, 14 nt, Human
aaaagccucugugu

SEQ ID NO: 3373987 - RNA, 19 nt, Human
aaaagccugcaauuucaua

SEQ ID NO: 3373988 - RNA, 11 nt, Human
aaaagccugcu

SEQ ID NO: 3373989 - RNA, 16 nt, Human
aaaagccuguuuaaga

SEQ ID NO: 3373990 - RNA, 18 nt, Human
aaaagccuguuuaagaga

SEQ ID NO: 3373991 - RNA, 14 nt, Human
aaaagccuuggccu

SEQ ID NO: 3373992 - RNA, 20 nt, Human
aaaagccuuguguauauuug

SEQ ID NO: 3373993 - RNA, 22 nt, Human
aaaagcggaaaguuagugcuug

SEQ ID NO: 3373994 - RNA, 14 nt, Human
aaaagcuagaauug

SEQ ID NO: 3373995 - RNA, 21 nt, Human
aaaagcuaguguaccuccucu

SEQ ID NO: 3373996 - RNA, 16 nt, Human
aaaagcuaucuucaug

SEQ ID NO: 3373997 - RNA, 17 nt, Human
aaaagcuauuagccagg

SEQ ID NO: 3373998 - RNA, 20 nt, Human
aaaagcuauuagccaggauc

SEQ ID NO: 3373999 - RNA, 12 nt, Human
aaaagcuccugu

SEQ ID NO: 3374000 - RNA, 13 nt, Human
aaaagcuccuguc

SEQ ID NO: 3374001 - RNA, 19 nt, Human
aaaagcugaacacauuucu

SEQ ID NO: 3374002 - RNA, 20 nt, Human
aaaagcugaacacauuucuu

SEQ ID NO: 3374003 - RNA, 13 nt, Human
aaaagcugcucag

SEQ ID NO: 3374004 - RNA, 15 nt, Human
aaaagcuucuuaauu

SEQ ID NO: 3374005 - RNA, 18 nt, Human
aaaagcuuuaugauuuuc

SEQ ID NO: 3374006 - RNA, 22 nt, Human
aaaagcuuuaugauuuucauaa

SEQ ID NO: 3374007 - RNA, 13 nt, Human
aaaagcuuucaug

SEQ ID NO: 3374008 - RNA, 15 nt, Human
aaaagcuuuuaugag

SEQ ID NO: 3374009 - RNA, 10 nt, Human
aaaaggaaaa

SEQ ID NO: 3374010 - RNA, 15 nt, Human
aaaaggaaaaaaaga

SEQ ID NO: 3374011 - RNA, 11 nt, Human
aaaaggaaagc

SEQ ID NO: 3374012 - RNA, 16 nt, Human
aaaaggaacugcagca

SEQ ID NO: 3374013 - RNA, 20 nt, Human
aaaaggaagcuuacaugccu

SEQ ID NO: 3374014 - RNA, 16 nt, Human
aaaaggacaauuucaa

SEQ ID NO: 3374015 - RNA, 23 nt, Human
aaaaggaucuuuguggccaagga

SEQ ID NO: 3374016 - RNA, 14 nt, Human
aaaaggaugcacag

SEQ ID NO: 3374017 - RNA, 15 nt, Human
aaaaggaugcacaga

SEQ ID NO: 3374018 - RNA, 17 nt, Human
aaaaggcauuguuugag

SEQ ID NO: 3374019 - RNA, 14 nt, Human
aaaaggccaaaccu

SEQ ID NO: 3374020 - RNA, 11 nt, Human
aaaaggcccag

SEQ ID NO: 3374021 - RNA, 22 nt, Human
aaaaggccucuuguaaagacug

SEQ ID NO: 3374022 - RNA, 13 nt, Human
aaaaggccugggg

SEQ ID NO: 3374023 - RNA, 20 nt, Human
aaaaggcgcaucuaacgcgu

SEQ ID NO: 3374024 - RNA, 20 nt, Human
aaaaggcugugcugcccuga

SEQ ID NO: 3374025 - RNA, 20 nt, Human
aaaaggcuuauaaaacagag

SEQ ID NO: 3374026 - RNA, 14 nt, Human
aaaaggcuugaagc

SEQ ID NO: 3374027 - RNA, 18 nt, Human
aaaagggaacugaacauu

SEQ ID NO: 3374028 - RNA, 15 nt, Human
aaaagggaagaaacu

SEQ ID NO: 3374029 - RNA, 14 nt, Human
aaaagggacaugaa

SEQ ID NO: 3374030 - RNA, 19 nt, Human
aaaagggaguuuaaaaaug

SEQ ID NO: 3374031 - RNA, 23 nt, Human
aaagaaaagauaaagaugaucua

SEQ ID NO: 3374032 - RNA, 13 nt, Human
aaagaaaagaugc

SEQ ID NO: 3374033 - RNA, 14 nt, Human
aaagaaaagaugca

SEQ ID NO: 3374034 - RNA, 17 nt, Human
aaagaaaagaugcacuu

SEQ ID NO: 3374035 - RNA, 14 nt, Human
aaagaaaauaaaau

SEQ ID NO: 3374036 - RNA, 16 nt, Human
aaagaaaauaaagaca

SEQ ID NO: 3374037 - RNA, 15 nt, Human
aaagaaaauaugcau

SEQ ID NO: 3374038 - RNA, 13 nt, Human
aaagaaaauuccu

SEQ ID NO: 3374039 - RNA, 20 nt, Human
aaagaaacccgacagaggga

SEQ ID NO: 3374040 - RNA, 22 nt, Human
aaagaaacugacaugcccuccc

SEQ ID NO: 3374041 - RNA, 12 nt, Human
aaagaaacuuuc

SEQ ID NO: 3374042 - RNA, 18 nt, Human
aaagaaagagagaaaaua

SEQ ID NO: 3374043 - RNA, 15 nt, Human
aaagaaagaggaaaa

SEQ ID NO: 3374044 - RNA, 12 nt, Human
aaagaaagugua

SEQ ID NO: 3374045 - RNA, 16 nt, Human
aaagaaauaauaauau

SEQ ID NO: 3374046 - RNA, 13 nt, Human
aaagaaauaauuu

SEQ ID NO: 3374047 - RNA, 14 nt, Human
aaagaaauaccuug

SEQ ID NO: 3374048 - RNA, 11 nt, Human
aaagaaauauu

SEQ ID NO: 3374049 - RNA, 14 nt, Human
aaagaaaucauguu

SEQ ID NO: 3374050 - RNA, 13 nt, Human
aaagaaaugaaca

SEQ ID NO: 3374051 - RNA, 15 nt, Human
aaagaaaugaacauu

SEQ ID NO: 3374052 - RNA, 16 nt, Human
aaagaaaugacuaauu

SEQ ID NO: 3374053 - RNA, 13 nt, Human
aaagaaaugcaaa

SEQ ID NO: 3374054 - RNA, 13 nt, Human
aaagaaauuaugu

SEQ ID NO: 3374055 - RNA, 11 nt, Human
aaagaacaucc

SEQ ID NO: 3374056 - RNA, 19 nt, Human
aaagaacaugcaguuugaa

SEQ ID NO: 3374057 - RNA, 22 nt, Human
aaagaacauggacuuguauauu

SEQ ID NO: 3374058 - RNA, 15 nt, Human
aaagaacgcugauuu

SEQ ID NO: 3374059 - RNA, 18 nt, Human
aaagaacuaucuucaucu

SEQ ID NO: 3374060 - RNA, 17 nt, Human
aaagaagaacuugcaug

SEQ ID NO: 3374061 - RNA, 21 nt, Human
aaagaagaagaagaagaaaag

SEQ ID NO: 3374062 - RNA, 20 nt, Human
aaagaagaaggugggaggau

SEQ ID NO: 3374063 - RNA, 19 nt, Human
aaagaagacaacauuaaaa

SEQ ID NO: 3374064 - RNA, 12 nt, Human
aaagaagacaug

SEQ ID NO: 3374065 - RNA, 14 nt, Human
aaagaagacauguu

SEQ ID NO: 3374066 - RNA, 18 nt, Human
aaagaagacauguuuuag

SEQ ID NO: 3374067 - RNA, 18 nt, Human
aaagaagaccugagaaug

SEQ ID NO: 3374068 - RNA, 12 nt, Human
aaagaagagaca

SEQ ID NO: 3374069 - RNA, 21 nt, Human
aaagaagagccggagccucca

SEQ ID NO: 3374070 - RNA, 22 nt, Human
aaagaagguuuguguuuuucug

SEQ ID NO: 3374071 - RNA, 21 nt, Human
aaagaaguaacaagagugauu

SEQ ID NO: 3374072 - RNA, 23 nt, Human
aaagaaguaggggaagacaugca

SEQ ID NO: 3374073 - RNA, 16 nt, Human
aaagaaguauuuuuag

SEQ ID NO: 3374074 - RNA, 17 nt, Human
aaagaaguuugaacauu

SEQ ID NO: 3374075 - RNA, 17 nt, Human
aaagaauacagaaagau

SEQ ID NO: 3374076 - RNA, 18 nt, Human
aaagaauacuauuuccaa

SEQ ID NO: 3374077 - RNA, 14 nt, Human
aaagaauacuugaa

SEQ ID NO: 3374078 - RNA, 12 nt, Human
aaagaauagaaa

SEQ ID NO: 3374079 - RNA, 20 nt, Human
aaagaauaugacuuuuuaua

SEQ ID NO: 3374080 - RNA, 13 nt, Human
aaagaauauucag

SEQ ID NO: 3374081 - RNA, 19 nt, Human
aaagaaucauuauuuauua

SEQ ID NO: 3374082 - RNA, 23 nt, Human
aaagaaucauuauuuauuaaauu

SEQ ID NO: 3374083 - RNA, 17 nt, Human
aaagaauggaaggugga

SEQ ID NO: 3374084 - RNA, 17 nt, Human
aaagaauggcagaaaag

SEQ ID NO: 3374085 - RNA, 18 nt, Human
aaagaaugggcaguuaca

SEQ ID NO: 3374086 - RNA, 16 nt, Human
aaagaauucaaauuuu

SEQ ID NO: 3374087 - RNA, 14 nt, Human
aaagaauuuaguau

SEQ ID NO: 3374088 - RNA, 13 nt, Human
aaagaauuuguca

SEQ ID NO: 3374089 - RNA, 14 nt, Human
aaagacaaauagua

SEQ ID NO: 3374090 - RNA, 18 nt, Human
aaagacaaauaguaggca

SEQ ID NO: 3374091 - RNA, 14 nt, Human
aaagacaagaaaau

SEQ ID NO: 3374092 - RNA, 11 nt, Human
aaagacaauuc

SEQ ID NO: 3374093 - RNA, 16 nt, Human
aaagacaauucuuuau

SEQ ID NO: 3374094 - RNA, 19 nt, Human
aaagacaccuacugagugg

SEQ ID NO: 3374095 - RNA, 13 nt, Human
aaagacacugccu

SEQ ID NO: 3374096 - RNA, 17 nt, Human
aaagacacugccugggc

SEQ ID NO: 3374097 - RNA, 14 nt, Human
aaagacagagcugg

SEQ ID NO: 3374098 - RNA, 15 nt, Human
aaagacaggcucugu

SEQ ID NO: 3374099 - RNA, 22 nt, Human
aaagacaguguauguagaagca

SEQ ID NO: 3374100 - RNA, 15 nt, Human
aaagacaugaauaug

SEQ ID NO: 3374101 - RNA, 14 nt, Human
aaagacauguugua

SEQ ID NO: 3374102 - RNA, 11 nt, Human
aaagaccaaac

SEQ ID NO: 3374103 - RNA, 14 nt, Human
aaagaccagaaauu

SEQ ID NO: 3374104 - RNA, 20 nt, Human
aaagacccuaaaucugagga

SEQ ID NO: 3374105 - RNA, 18 nt, Human
aaagacguuuuauaagca

SEQ ID NO: 3374106 - RNA, 20 nt, Human
aaagacguuuuauaagcauc

SEQ ID NO: 3374107 - RNA, 17 nt, Human
aaagacuaucuaaaugu

SEQ ID NO: 3374108 - RNA, 13 nt, Human
aaagacuccaaag

SEQ ID NO: 3374109 - RNA, 15 nt, Human
aaagacuccaaagaa

SEQ ID NO: 3374110 - RNA, 21 nt, Human
aaagacuccaaagaaauguaa

SEQ ID NO: 3374111 - RNA, 12 nt, Human
aaagacuggcuu

SEQ ID NO: 3374112 - RNA, 14 nt, Human
aaagacuguacaaa

SEQ ID NO: 3374113 - RNA, 13 nt, Human
aaagacuuaaagg

SEQ ID NO: 3374114 - RNA, 20 nt, Human
aaagacuugguugguagggu

SEQ ID NO: 3374115 - RNA, 19 nt, Human
aaagacuuuuccaacccuc

SEQ ID NO: 3374116 - RNA, 18 nt, Human
aaagagaaaacaucucau

SEQ ID NO: 3374117 - RNA, 12 nt, Human
aaagagaaacuu

SEQ ID NO: 3374118 - RNA, 12 nt, Human
aaagagaagaag

SEQ ID NO: 3374119 - RNA, 15 nt, Human
aaagagaaguauuau

SEQ ID NO: 3374120 - RNA, 20 nt, Human
aaagagaaugaguccuugau

SEQ ID NO: 3374121 - RNA, 20 nt, Human
aaagagaaugccauucucuu

SEQ ID NO: 3374122 - RNA, 18 nt, Human
aaagagagaaaacuuauu

SEQ ID NO: 3374123 - RNA, 17 nt, Human
aaagagagaaaauaaaa

SEQ ID NO: 3374124 - RNA, 18 nt, Human
aaagagagaacaggacua

SEQ ID NO: 3374125 - RNA, 13 nt, Human
aaagagagaaugu

SEQ ID NO: 3374126 - RNA, 20 nt, Human
aaagagagagagagaaaaaa

SEQ ID NO: 3374127 - RNA, 15 nt, Human
aaagagagauuuuuu

SEQ ID NO: 3374128 - RNA, 13 nt, Human
aaagagagcacug

SEQ ID NO: 3374129 - RNA, 12 nt, Human
aaagagauauuu

SEQ ID NO: 3374130 - RNA, 20 nt, Human
aaagagauauuuuaaaauga

SEQ ID NO: 3374131 - RNA, 14 nt, Human
aaagagauuucaag

SEQ ID NO: 3374132 - RNA, 15 nt, Human
aaagagcaagucugg

SEQ ID NO: 3374133 - RNA, 23 nt, Human
aaagagcaagucuggaucuggga

SEQ ID NO: 3374134 - RNA, 12 nt, Human
aaagagcacaaa

SEQ ID NO: 3374135 - RNA, 15 nt, Human
aaagagcccuugccu

SEQ ID NO: 3374136 - RNA, 22 nt, Human
aaagagcuuucuucccgaaccc

SEQ ID NO: 3374137 - RNA, 14 nt, Human
aaagaggagugcuu

SEQ ID NO: 3374138 - RNA, 11 nt, Human
aaauaaacuuu

SEQ ID NO: 3374139 - RNA, 12 nt, Human
aaauaaacuuuu

SEQ ID NO: 3374140 - RNA, 19 nt, Human
aaauaaacuuuuuuucaau

SEQ ID NO: 3374141 - RNA, 21 nt, Human
aaauaaacuuuuuuucaaugu

SEQ ID NO: 3374142 - RNA, 22 nt, Human
aaauaaacuuuuuuucaaugug

SEQ ID NO: 3374143 - RNA, 11 nt, Human
aaauaaagaag

SEQ ID NO: 3374144 - RNA, 14 nt, Human
aaauaaagagagaa

SEQ ID NO: 3374145 - RNA, 22 nt, Human
aaauaaagagagaacaggacua

SEQ ID NO: 3374146 - RNA, 15 nt, Human
aaauaaagagccaua

SEQ ID NO: 3374147 - RNA, 15 nt, Human
aaauaaagcaucuca

SEQ ID NO: 3374148 - RNA, 12 nt, Human
aaauaaagcccu

SEQ ID NO: 3374149 - RNA, 20 nt, Human
aaauaaagcuugcaacaaaa

SEQ ID NO: 3374150 - RNA, 18 nt, Human
aaauaaaggauuucuaga

SEQ ID NO: 3374151 - RNA, 10 nt, Human
aaauaaauaa

SEQ ID NO: 3374152 - RNA, 12 nt, Human
aaauaaauauau

SEQ ID NO: 3374153 - RNA, 14 nt, Human
aaauaaauauauau

SEQ ID NO: 3374154 - RNA, 15 nt, Human
aaauaaauauauaua

SEQ ID NO: 3374155 - RNA, 17 nt, Human
aaauaaauuaguuguua

SEQ ID NO: 3374156 - RNA, 13 nt, Human
aaauaaauuguau

SEQ ID NO: 3374157 - RNA, 20 nt, Human
aaauaaauuguauauucacu

SEQ ID NO: 3374158 - RNA, 22 nt, Human
aaauaaauuguauauucacuuu

SEQ ID NO: 3374159 - RNA, 12 nt, Human
aaauaaauuguu

SEQ ID NO: 3374160 - RNA, 16 nt, Human
aaauaaauuuauauga

SEQ ID NO: 3374161 - RNA, 17 nt, Human
aaauaaauuuauaugaa

SEQ ID NO: 3374162 - RNA, 22 nt, Human
aaauaacaaguaccaaaguuuu

SEQ ID NO: 3374163 - RNA, 12 nt, Human
aaauaacaauga

SEQ ID NO: 3374164 - RNA, 18 nt, Human
aaauaacaauguuaagga

SEQ ID NO: 3374165 - RNA, 20 nt, Human
aaauaacaggcauuuguuca

SEQ ID NO: 3374166 - RNA, 20 nt, Human
aaauaaccuaauuaauauau

SEQ ID NO: 3374167 - RNA, 15 nt, Human
aaauaacugaauuug

SEQ ID NO: 3374168 - RNA, 13 nt, Human
aaauaacuguaau

SEQ ID NO: 3374169 - RNA, 21 nt, Human
aaauaacuguaauuauuugaa

SEQ ID NO: 3374170 - RNA, 18 nt, Human
aaauaacuucaagcaaac

SEQ ID NO: 3374171 - RNA, 15 nt, Human
aaauaacuucagucc

SEQ ID NO: 3374172 - RNA, 14 nt, Human
aaauaagaaaccua

SEQ ID NO: 3374173 - RNA, 12 nt, Human
aaauaagaaacu

SEQ ID NO: 3374174 - RNA, 15 nt, Human
aaauaagaaacuuuu

SEQ ID NO: 3374175 - RNA, 14 nt, Human
aaauaagaauagaa

SEQ ID NO: 3374176 - RNA, 12 nt, Human
aaauaagagauu

SEQ ID NO: 3374177 - RNA, 14 nt, Human
aaauaagauucuaa

SEQ ID NO: 3374178 - RNA, 15 nt, Human
aaauaagauucuaac

SEQ ID NO: 3374179 - RNA, 17 nt, Human
aaauaccauuauuauca

SEQ ID NO: 3374180 - RNA, 16 nt, Human
aaauaccauugacaca

SEQ ID NO: 3374181 - RNA, 15 nt, Human
aaauaccucaggaaa

SEQ ID NO: 3374182 - RNA, 18 nt, Human
aaauaccucaggaaagaa

SEQ ID NO: 3374183 - RNA, 16 nt, Human
aaauaccucauguuua

SEQ ID NO: 3374184 - RNA, 18 nt, Human
aaauaccucuuagcugag

SEQ ID NO: 3374185 - RNA, 21 nt, Human
aaauacgccagaacugcuuua

SEQ ID NO: 3374186 - RNA, 20 nt, Human
aaauacgugggcauucaaau

SEQ ID NO: 3374187 - RNA, 15 nt, Human
aaauacuauuuaaga

SEQ ID NO: 3374188 - RNA, 18 nt, Human
aaauacuauuuaagaugu

SEQ ID NO: 3374189 - RNA, 22 nt, Human
aaauacuauuuaagaugugaaa

SEQ ID NO: 3374190 - RNA, 15 nt, Human
aaauacucaugugua

SEQ ID NO: 3374191 - RNA, 14 nt, Human
aaauacucuaauuc

SEQ ID NO: 3374192 - RNA, 16 nt, Human
aaauacucuaauucua

SEQ ID NO: 3374193 - RNA, 19 nt, Human
aaauacucuaauucuaacc

SEQ ID NO: 3374194 - RNA, 17 nt, Human
aaauacugcaagaaaau

SEQ ID NO: 3374195 - RNA, 17 nt, Human
aaauacugccagaugcu

SEQ ID NO: 3374196 - RNA, 23 nt, Human
aaauacugccagaugcugauguu

SEQ ID NO: 3374197 - RNA, 15 nt, Human
aaauacuguacaaug

SEQ ID NO: 3374198 - RNA, 16 nt, Human
aaauacuguagauaau

SEQ ID NO: 3374199 - RNA, 14 nt, Human
aaauacuguuugag

SEQ ID NO: 3374200 - RNA, 16 nt, Human
aaauacuugucuguuu

SEQ ID NO: 3374201 - RNA, 19 nt, Human
aaauacuugucuguuuuaa

SEQ ID NO: 3374202 - RNA, 18 nt, Human
aaauagaaaacaggaaaa

SEQ ID NO: 3374203 - RNA, 18 nt, Human
aaauagaaaaguagacaa

SEQ ID NO: 3374204 - RNA, 15 nt, Human
aaauagaaaaugguc

SEQ ID NO: 3374205 - RNA, 12 nt, Human
aaauagaaacau

SEQ ID NO: 3374206 - RNA, 22 nt, Human
aaauagaaaguugcaaggcaaa

SEQ ID NO: 3374207 - RNA, 19 nt, Human
aaauagaaauuuuguaaga

SEQ ID NO: 3374208 - RNA, 16 nt, Human
aaauagaaccacuaug

SEQ ID NO: 3374209 - RNA, 22 nt, Human
aaauagaagaauacaaacauau

SEQ ID NO: 3374210 - RNA, 20 nt, Human
aaauagaauugacauugaaa

SEQ ID NO: 3374211 - RNA, 14 nt, Human
aaauagacaaaaag

SEQ ID NO: 3374212 - RNA, 18 nt, Human
aaauagacaaaaaguaua

SEQ ID NO: 3374213 - RNA, 15 nt, Human
aaauagacaaauaga

SEQ ID NO: 3374214 - RNA, 17 nt, Human
aaauagacagcaugaga

SEQ ID NO: 3374215 - RNA, 16 nt, Human
aaauagacaguauauu

SEQ ID NO: 3374216 - RNA, 19 nt, Human
aaauagacauauuaacaug

SEQ ID NO: 3374217 - RNA, 19 nt, Human
aaauagagaugagcuuucu

SEQ ID NO: 3374218 - RNA, 15 nt, Human
aaauagagcuuuuaa

SEQ ID NO: 3374219 - RNA, 20 nt, Human
aaauagagcuuuuaaaaaug

SEQ ID NO: 3374220 - RNA, 19 nt, Human
aaauagaguuugcuauuag

SEQ ID NO: 3374221 - RNA, 14 nt, Human
aaauagaugacauu

SEQ ID NO: 3374222 - RNA, 18 nt, Human
aaauagaugucuuuuaua

SEQ ID NO: 3374223 - RNA, 13 nt, Human
aaauagcaaaacu

SEQ ID NO: 3374224 - RNA, 21 nt, Human
aaauagcauguauugugucuu

SEQ ID NO: 3374225 - RNA, 18 nt, Human
aaauagcgcuguuuuugu

SEQ ID NO: 3374226 - RNA, 17 nt, Human
aaauagcguucuuguaa

SEQ ID NO: 3374227 - RNA, 18 nt, Human
aaauagcguucuuguaau

SEQ ID NO: 3374228 - RNA, 24 nt, Human
aaauagcucaggugucccugcacu

SEQ ID NO: 3374229 - RNA, 19 nt, Human
aaauagcuccguggagcag

SEQ ID NO: 3374230 - RNA, 16 nt, Human
aaauagcuuguauagu

SEQ ID NO: 3374231 - RNA, 17 nt, Human
aaauagcuuuuuucucu

SEQ ID NO: 3374232 - RNA, 16 nt, Human
aaauaggagaggauga

SEQ ID NO: 3374233 - RNA, 16 nt, Human
aaauaggauuuuuaga

SEQ ID NO: 3374234 - RNA, 14 nt, Human
aaauaggcaggaag

SEQ ID NO: 3374235 - RNA, 16 nt, Human
aaauaguaaaaauaaa

SEQ ID NO: 3374236 - RNA, 13 nt, Human
aaauaguaggcaa

SEQ ID NO: 3374237 - RNA, 22 nt, Human
aaauaguaggcaagauggcaca

SEQ ID NO: 3374238 - RNA, 16 nt, Human
aaauagucuaguguag

SEQ ID NO: 3374239 - RNA, 19 nt, Human
aaauagugacauaauauau

SEQ ID NO: 3374240 - RNA, 19 nt, Human
aaauaguggugugauuugg

SEQ ID NO: 3374241 - RNA, 15 nt, Human
aaauagugucuuugu

SEQ ID NO: 3374242 - RNA, 20 nt, Human
aaauaguguggaaauuaaga

SEQ ID NO: 3374243 - RNA, 19 nt, Human
aaauaguguuauugagaga

SEQ ID NO: 3374244 - RNA, 17 nt, Human
aaauaguuaagacauga

SEQ ID NO: 3374245 - RNA, 16 nt, Human
aaauaguucugugacu

SEQ ID NO: 3374246 - RNA, 22 nt, Human
aaauaguucugugacuaggaaa

SEQ ID NO: 3374247 - RNA, 13 nt, Human
aaauaguucuucu

SEQ ID NO: 3374248 - RNA, 19 nt, Human
aaauaguugagccagcaga

SEQ ID NO: 3374249 - RNA, 22 nt, Human
aaauaguugcauagcaguauau

SEQ ID NO: 3374250 - RNA, 20 nt, Human
aaauaguuuggauauguaaa

SEQ ID NO: 3374251 - RNA, 13 nt, Human
aaauauaaaauua

SEQ ID NO: 3374252 - RNA, 10 nt, Human
aaauauaaag

SEQ ID NO: 3374253 - RNA, 12 nt, Human
aaauauaauucu

SEQ ID NO: 3374254 - RNA, 19 nt, Human
aaauauaauucuguaaaug

SEQ ID NO: 3374255 - RNA, 21 nt, Human
aaauauaauuguuuuuuaucu

SEQ ID NO: 3374256 - RNA, 14 nt, Human
aaauauacauguuu

SEQ ID NO: 3374257 - RNA, 15 nt, Human
aaauauacauguuua

SEQ ID NO: 3374258 - RNA, 23 nt, Human
aaauauacauguuuauguaaaca

SEQ ID NO: 3374259 - RNA, 16 nt, Human
aaauauaccacucuuu

SEQ ID NO: 3374260 - RNA, 19 nt, Human
aaauauacuguaaagaaag

SEQ ID NO: 3374261 - RNA, 21 nt, Human
aaauauacuguaaagaaagag

SEQ ID NO: 3374262 - RNA, 22 nt, Human
aaauauacuuuuacaaguaaca

SEQ ID NO: 3374263 - RNA, 13 nt, Human
aaauauagaauuu

SEQ ID NO: 3374264 - RNA, 16 nt, Human
aaauauagaauuuuua

SEQ ID NO: 3374265 - RNA, 18 nt, Human
aaauauagaucaguuaua

SEQ ID NO: 3374266 - RNA, 17 nt, Human
aaauauagauuagaaaa

SEQ ID NO: 3374267 - RNA, 19 nt, Human
aaauauagauuagaaaaau

SEQ ID NO: 3374268 - RNA, 16 nt, Human
aaauauagcuguacaa

SEQ ID NO: 3374269 - RNA, 14 nt, Human
aaauauaguuccua

SEQ ID NO: 3374270 - RNA, 18 nt, Human
aaauauaguuccuaagaa

SEQ ID NO: 3374271 - RNA, 17 nt, Human
aaauauauaaauauaua

SEQ ID NO: 3374272 - RNA, 23 nt, Human
aaauauauacccccccaugcagu

SEQ ID NO: 3374273 - RNA, 16 nt, Human
aaauauauacuaaaca

SEQ ID NO: 3374274 - RNA, 16 nt, Human
aaauauauauaaaccu

SEQ ID NO: 3374275 - RNA, 21 nt, Human
aaauauauauaaauauauaua

SEQ ID NO: 3374276 - RNA, 14 nt, Human
aaauauauauagaa

SEQ ID NO: 3374277 - RNA, 15 nt, Human
aaauauauauauccu

SEQ ID NO: 3374278 - RNA, 14 nt, Human
aaauauauauuaua

SEQ ID NO: 3374279 - RNA, 23 nt, Human
aaauauaugauuaacuaauuuua

SEQ ID NO: 3374280 - RNA, 22 nt, Human
aaauauauggucuaauguuuaa

SEQ ID NO: 3374281 - RNA, 11 nt, Human
aaauauaugua

SEQ ID NO: 3374282 - RNA, 16 nt, Human
aaauauauguauguaa

SEQ ID NO: 3374283 - RNA, 20 nt, Human
aaauauauguauguaaaaau

SEQ ID NO: 3374284 - RNA, 18 nt, Human
aaauauauuacuuaacug

SEQ ID NO: 3374285 - RNA, 13 nt, Human
aaauauauuauua

SEQ ID NO: 3374286 - RNA, 16 nt, Human
aaauauauuauuacuu

SEQ ID NO: 3374287 - RNA, 19 nt, Human
aaauauauuauuacuugua

SEQ ID NO: 3374288 - RNA, 21 nt, Human
aaauauauuauuacuuguaaa

SEQ ID NO: 3374289 - RNA, 23 nt, Human
aaauauauuauuacuuguaaaua

SEQ ID NO: 3374290 - RNA, 20 nt, Human
aaauaucaaauuaauugugu

SEQ ID NO: 3374291 - RNA, 22 nt, Human
aaauaucaaucauuuuccuuuu

SEQ ID NO: 3374292 - RNA, 20 nt, Human
aaauaucaguuacucagccc

SEQ ID NO: 3374293 - RNA, 21 nt, Human
aaauaucauauaaauauugag

SEQ ID NO: 3374294 - RNA, 13 nt, Human
aaauaucauucag

SEQ ID NO: 3374295 - RNA, 18 nt, Human
aaauaucauuuauuuuuu

SEQ ID NO: 3374296 - RNA, 19 nt, Human
aaauaucccgggggugggg

SEQ ID NO: 3374297 - RNA, 22 nt, Human
aaauaucccuuggacauuuuau

SEQ ID NO: 3374298 - RNA, 16 nt, Human
aaauaucucuauuuaa

SEQ ID NO: 3374299 - RNA, 17 nt, Human
aaauaucugaaaaugua

SEQ ID NO: 3374300 - RNA, 20 nt, Human
aaauagcuuuuuucucugau

SEQ ID NO: 3374301 - RNA, 14 nt, Human
aaauaggagaggau

SEQ ID NO: 3374302 - RNA, 23 nt, Human
aaauaggagaggaugagagccca

SEQ ID NO: 3374303 - RNA, 19 nt, Human
aaauaggagggaaaccuuu

SEQ ID NO: 3374304 - RNA, 16 nt, Human
aaauagggucuaacuc

SEQ ID NO: 3374305 - RNA, 23 nt, Human
aaauaguaggcaagauggcacag

SEQ ID NO: 3374306 - RNA, 14 nt, Human
aaauaguauuugag

SEQ ID NO: 3374307 - RNA, 20 nt, Human
aaauagucuagacuaaaaga

SEQ ID NO: 3374308 - RNA, 21 nt, Human
aaauagugacauaauauauuc

SEQ ID NO: 3374309 - RNA, 20 nt, Human
aaauagugcagaaucucaua

SEQ ID NO: 3374310 - RNA, 21 nt, Human
aaauagugguucuuggaaaaa

SEQ ID NO: 3374311 - RNA, 23 nt, Human
aaauaguucugugacuaggaaaa

SEQ ID NO: 3374312 - RNA, 16 nt, Human
aaauaguuguccauau

SEQ ID NO: 3374313 - RNA, 17 nt, Human
aaauaguuuauuuuaaa

SEQ ID NO: 3374314 - RNA, 21 nt, Human
aaauaguuuauuuuaaaacaa

SEQ ID NO: 3374315 - RNA, 14 nt, Human
aaauaguuuggaua

SEQ ID NO: 3374316 - RNA, 11 nt, Human
aaauauaaaac

SEQ ID NO: 3374317 - RNA, 13 nt, Human
aaauauaaacaaa

SEQ ID NO: 3374318 - RNA, 24 nt, Human
aaauauaaagacguuuuauaagca

SEQ ID NO: 3374319 - RNA, 18 nt, Human
aaauauaaagcaucuaaa

SEQ ID NO: 3374320 - RNA, 22 nt, Human
aaauauaagccuuuuauacuga

SEQ ID NO: 3374321 - RNA, 11 nt, Human
aaauauaauuc

SEQ ID NO: 3374322 - RNA, 13 nt, Human
aaauauacauguu

SEQ ID NO: 3374323 - RNA, 20 nt, Human
aaauucuuucccagucuguc

SEQ ID NO: 3374324 - RNA, 21 nt, Human
aaauugaaaaguuauuucccu

SEQ ID NO: 3374325 - RNA, 20 nt, Human
aaauugaaaggcauucucug

SEQ ID NO: 3374326 - RNA, 22 nt, Human
aaauugaaaggcauucucugaa

SEQ ID NO: 3374327 - RNA, 13 nt, Human
aaauugaaauugu

SEQ ID NO: 3374328 - RNA, 15 nt, Human
aaauugaaccuuugu

SEQ ID NO: 3374329 - RNA, 12 nt, Human
aaauugaagaga

SEQ ID NO: 3374330 - RNA, 21 nt, Human
aaauugaagagagauauaucu

SEQ ID NO: 3374331 - RNA, 13 nt, Human
aaauugaaugcaa

SEQ ID NO: 3374332 - RNA, 14 nt, Human
aaauugaaugcaaa

SEQ ID NO: 3374333 - RNA, 13 nt, Human
aaauugaauuuaa

SEQ ID NO: 3374334 - RNA, 13 nt, Human
aaauugacuguac

SEQ ID NO: 3374335 - RNA, 18 nt, Human
aaauugagacagugcaca

SEQ ID NO: 3374336 - RNA, 23 nt, Human
aaauugagcugcuuuuuuugaaa

SEQ ID NO: 3374337 - RNA, 20 nt, Human
aaauugauaaugcuuucaca

SEQ ID NO: 3374338 - RNA, 21 nt, Human
aaauugauguguuuauuuaua

SEQ ID NO: 3374339 - RNA, 12 nt, Human
aaauugauguug

SEQ ID NO: 3374340 - RNA, 13 nt, Human
aaauugauguuga

SEQ ID NO: 3374341 - RNA, 15 nt, Human
aaauugauuuugaac

SEQ ID NO: 3374342 - RNA, 19 nt, Human
aaauugcaaaucuugaaau

SEQ ID NO: 3374343 - RNA, 17 nt, Human
aaauugcauaaagcaua

SEQ ID NO: 3374344 - RNA, 19 nt, Human
aaauugcaugcugcuuuaa

SEQ ID NO: 3374345 - RNA, 19 nt, Human
aaauugccauauugcacau

SEQ ID NO: 3374346 - RNA, 23 nt, Human
aaauugccauauugcacaugucu

SEQ ID NO: 3374347 - RNA, 14 nt, Human
aaauugccuuucug

SEQ ID NO: 3374348 - RNA, 17 nt, Human
aaauugcuaauguugcu

SEQ ID NO: 3374349 - RNA, 21 nt, Human
aaauggugguuguuucuucca

SEQ ID NO: 3374350 - RNA, 18 nt, Human
aaaugguguuuucaugua

SEQ ID NO: 3374351 - RNA, 13 nt, Human
aaaugguuaaaag

SEQ ID NO: 3374352 - RNA, 13 nt, Human
aaaugguuguauu

SEQ ID NO: 3374353 - RNA, 14 nt, Human
aaaugguuguauua

SEQ ID NO: 3374354 - RNA, 19 nt, Human
aaauguaaaaauaauaauu

SEQ ID NO: 3374355 - RNA, 13 nt, Human
aaauguaaacugc

SEQ ID NO: 3374356 - RNA, 14 nt, Human
aaauguaaacugcc

SEQ ID NO: 3374357 - RNA, 20 nt, Human
aaauguaaacuguuucuuua

SEQ ID NO: 3374358 - RNA, 13 nt, Human
aaauguaacaguc

SEQ ID NO: 3374359 - RNA, 18 nt, Human
aaauguaacuauguuuua

SEQ ID NO: 3374360 - RNA, 22 nt, Human
aaauguaagaucguucucugcc

SEQ ID NO: 3374361 - RNA, 12 nt, Human
aaauguaauuga

SEQ ID NO: 3374362 - RNA, 14 nt, Human
aaauguaauuuaaa

SEQ ID NO: 3374363 - RNA, 16 nt, Human
aaauguacagacauau

SEQ ID NO: 3374364 - RNA, 20 nt, Human
aaauguacagacauauuuaa

SEQ ID NO: 3374365 - RNA, 16 nt, Human
aaauguacauguauua

SEQ ID NO: 3374366 - RNA, 18 nt, Human
aaauguagaauauucaga

SEQ ID NO: 3374367 - RNA, 19 nt, Human
aaauguagaguuuuuaaac

SEQ ID NO: 3374368 - RNA, 21 nt, Human
aaauguaggcaucaugcaugu

SEQ ID NO: 3374369 - RNA, 16 nt, Human
aaauguagguaugaau

SEQ ID NO: 3374370 - RNA, 15 nt, Human
aaauguauaccugua

SEQ ID NO: 3374371 - RNA, 13 nt, Human
aaauguauauaca

SEQ ID NO: 3374372 - RNA, 17 nt, Human
aaauguauauacacaua

SEQ ID NO: 3374373 - RNA, 23 nt, Human
aaauguauauacacauauaccua

SEQ ID NO: 3374374 - RNA, 21 nt, Human
aaauguauauauuuagugcug

SEQ ID NO: 3374375 - RNA, 15 nt, Human
aaauguaucuaagaa

SEQ ID NO: 3374376 - RNA, 14 nt, Human
aaauguaucuuauu

SEQ ID NO: 3374377 - RNA, 17 nt, Human
aaauguaucuuauucac

SEQ ID NO: 3374378 - RNA, 13 nt, Human
aaauguaugugag

SEQ ID NO: 3374379 - RNA, 15 nt, Human
aaauguauuacagug

SEQ ID NO: 3374380 - RNA, 11 nt, Human
aaauguauuau

SEQ ID NO: 3374381 - RNA, 13 nt, Human
aaauguauuaugu

SEQ ID NO: 3374382 - RNA, 14 nt, Human
aaauguauucaaau

SEQ ID NO: 3374383 - RNA, 21 nt, Human
aaauguauuuuauguuauaua

SEQ ID NO: 3374384 - RNA, 21 nt, Human
aaaugucacguuuuguuuugu

SEQ ID NO: 3374385 - RNA, 14 nt, Human
aaaugucacuuuuu

SEQ ID NO: 3374386 - RNA, 16 nt, Human
aaaugucacuuuuuga

SEQ ID NO: 3374387 - RNA, 20 nt, Human
aaaugucagauacaauguau

SEQ ID NO: 3374388 - RNA, 22 nt, Human
aaaugucaguggaagaagcaga

SEQ ID NO: 3374389 - RNA, 20 nt, Human
aaaugucaugagauugcugu

SEQ ID NO: 3374390 - RNA, 15 nt, Human
aaaugucaugcugcc

SEQ ID NO: 3374391 - RNA, 16 nt, Human
aaaugucaugcugccu

SEQ ID NO: 3374392 - RNA, 18 nt, Human
aaaugucaugcugccuua

SEQ ID NO: 3374393 - RNA, 22 nt, Human
aaauguccuccagaagccucug

SEQ ID NO: 3374394 - RNA, 16 nt, Human
aaaugucuaauguauu

SEQ ID NO: 3374395 - RNA, 20 nt, Human
aaaugucuaauguauuuuau

SEQ ID NO: 3374396 - RNA, 18 nt, Human
aaaugucuguaauaauag

SEQ ID NO: 3374397 - RNA, 16 nt, Human
aaaugucuucuguauu

SEQ ID NO: 3374398 - RNA, 18 nt, Human
aaaugucuucuguauuca

SEQ ID NO: 3374399 - RNA, 22 nt, Human
aaaugucuugcuguugacauau

SEQ ID NO: 3374400 - RNA, 13 nt, Human
aaaugucuugugu

SEQ ID NO: 3374401 - RNA, 17 nt, Human
aaaugucuuuguaaguc

SEQ ID NO: 3374402 - RNA, 17 nt, Human
aaaugugaagaugcauu

SEQ ID NO: 3374403 - RNA, 22 nt, Human
aaaugugaagaugcauuguagu

SEQ ID NO: 3374404 - RNA, 15 nt, Human
aaaugugaauuacua

SEQ ID NO: 3374405 - RNA, 18 nt, Human
aaaugugaauuuuuauug

SEQ ID NO: 3374406 - RNA, 14 nt, Human
aaaugugaggaaga

SEQ ID NO: 3374407 - RNA, 20 nt, Human
aaaugugagugguugaauau

SEQ ID NO: 3374408 - RNA, 13 nt, Human
aaaugugauuuuu

SEQ ID NO: 3374409 - RNA, 15 nt, Human
aaaugugauuuuucu

SEQ ID NO: 3374410 - RNA, 18 nt, Human
aaaugugccuucauuuuu

SEQ ID NO: 3374411 - RNA, 15 nt, Human
aaaugugcuuuuaaa

SEQ ID NO: 3374412 - RNA, 18 nt, Human
aaauguggcauuugugau

SEQ ID NO: 3374413 - RNA, 20 nt, Human
aaaugugggauuauggguca

SEQ ID NO: 3374414 - RNA, 22 nt, Human
aaaugugggauuaugggucaca

SEQ ID NO: 3374415 - RNA, 10 nt, Human
aaauguguaa

SEQ ID NO: 3374416 - RNA, 13 nt, Human
aaauguguacaua

SEQ ID NO: 3374417 - RNA, 15 nt, Human
aaauguguauuuuaa

SEQ ID NO: 3374418 - RNA, 20 nt, Human
aaauguguccuaucuaucuu

SEQ ID NO: 3374419 - RNA, 21 nt, Human
aaauguguccuaucuaucuuc

SEQ ID NO: 3374420 - RNA, 19 nt, Human
aaaugugugagugcaugua

SEQ ID NO: 3374421 - RNA, 15 nt, Human
aaaugugugugaugu

SEQ ID NO: 3374422 - RNA, 22 nt, Human
aaaugugugugaugugacauuu

SEQ ID NO: 3374423 - RNA, 23 nt, Human
aaauguguguuuuuuuaggguuu

SEQ ID NO: 3374424 - RNA, 20 nt, Human
aaauguguuggacaaaugug

SEQ ID NO: 3374425 - RNA, 13 nt, Human
aaauguuaaaaug

SEQ ID NO: 3374426 - RNA, 13 nt, Human
aaauguuaacaau

SEQ ID NO: 3374427 - RNA, 15 nt, Human
aaauguuaccucuga

SEQ ID NO: 3374428 - RNA, 15 nt, Human
aaauguuaguuucuu

SEQ ID NO: 3374429 - RNA, 23 nt, Human
aaauguuaucuucucaaguucua

SEQ ID NO: 3374430 - RNA, 12 nt, Human
aaauguuaugua

SEQ ID NO: 3374431 - RNA, 23 nt, Human
aaauguuauguauauggugguaa

SEQ ID NO: 3374432 - RNA, 16 nt, Human
aaauguuauuaucugg

SEQ ID NO: 3374433 - RNA, 12 nt, Human
aaauguuauuuc

SEQ ID NO: 3374434 - RNA, 16 nt, Human
aaauguucacuuuuga

SEQ ID NO: 3374435 - RNA, 13 nt, Human
aaauguucaucaa

SEQ ID NO: 3374436 - RNA, 17 nt, Human
aaauguucaucaaugaa

SEQ ID NO: 3374437 - RNA, 13 nt, Human
aaauguucuaagu

SEQ ID NO: 3374438 - RNA, 14 nt, Human
aaauguucuaaguu

SEQ ID NO: 3374439 - RNA, 19 nt, Human
aaauguucuaaguuucuaa

SEQ ID NO: 3374440 - RNA, 21 nt, Human
aaauguucuaaguuucuaaga

SEQ ID NO: 3374441 - RNA, 21 nt, Human
aaauguugaaaagucaaacug

SEQ ID NO: 3374442 - RNA, 23 nt, Human
aaauguugaaauaugauguuaaa

SEQ ID NO: 3374443 - RNA, 22 nt, Human
aaauguugaaccaaaccucccu

SEQ ID NO: 3374444 - RNA, 22 nt, Human
aaauguugacauaccuuuuauu

SEQ ID NO: 3374445 - RNA, 19 nt, Human
aaauguugcugaaaaaugg

SEQ ID NO: 3374446 - RNA, 22 nt, Human
aaauguuggauuuauaaaugcu

SEQ ID NO: 3374447 - RNA, 13 nt, Human
aaauguuuaauca

SEQ ID NO: 3374448 - RNA, 19 nt, Human
aaauguuuaaucauauaaa

SEQ ID NO: 3374449 - RNA, 17 nt, Human
aaauguuuauuuaaaag

SEQ ID NO: 3374450 - RNA, 18 nt, Human
aaauguuuauuuaaaaga

SEQ ID NO: 3374451 - RNA, 22 nt, Human
aaauguuuauuuaaaagagcag

SEQ ID NO: 3374452 - RNA, 10 nt, Human
aaauguuucu

SEQ ID NO: 3374453 - RNA, 11 nt, Human
aaauguuucuu

SEQ ID NO: 3374454 - RNA, 14 nt, Human
aaauguuucuuuug

SEQ ID NO: 3374455 - RNA, 14 nt, Human
aaauguuugacaca

SEQ ID NO: 3374456 - RNA, 22 nt, Human
aaauguuuuauaaguucacaaa

SEQ ID NO: 3374457 - RNA, 11 nt, Human
aaauguuuuca

SEQ ID NO: 3374458 - RNA, 18 nt, Human
aaauguuuucagcuagga

SEQ ID NO: 3374459 - RNA, 17 nt, Human
aaauguuuuguaaacau

SEQ ID NO: 3374460 - RNA, 18 nt, Human
aaauguuuuguaaacauu

SEQ ID NO: 3374461 - RNA, 20 nt, Human
aaauguuuuguaaacauuua

SEQ ID NO: 3374462 - RNA, 16 nt, Human
aaauguuuuguaaacu

SEQ ID NO: 3374463 - RNA, 23 nt, Human
aaauguuuuguaaacuuugaaau

SEQ ID NO: 3374464 - RNA, 20 nt, Human
aaauguuuuuaauaaaagaa

SEQ ID NO: 3374465 - RNA, 21 nt, Human
aaauguuuuuaauaaaagaaa

SEQ ID NO: 3374466 - RNA, 16 nt, Human
aaauguuuuucugcca

SEQ ID NO: 3374467 - RNA, 12 nt, Human
aaauguuuuugg

SEQ ID NO: 3374468 - RNA, 21 nt, Human
aaauugagacagugcacauga

SEQ ID NO: 3374469 - RNA, 23 nt, Human
aaauugagcuggaccucaccaag

SEQ ID NO: 3374470 - RNA, 18 nt, Human
aaauugaugggauuuggu

SEQ ID NO: 3374471 - RNA, 14 nt, Human
aaauugauguugau

SEQ ID NO: 3374472 - RNA, 18 nt, Human
aaauugauguugaugcaa

SEQ ID NO: 3374473 - RNA, 14 nt, Human
aaauugcaaaucuu

SEQ ID NO: 3374474 - RNA, 20 nt, Human
aaauugcacacacucagugc

SEQ ID NO: 3374475 - RNA, 16 nt, Human
aaauugcauaaagcau

SEQ ID NO: 3374476 - RNA, 12 nt, Human
aaauugcauacu

SEQ ID NO: 3374477 - RNA, 14 nt, Human
aaauugcauacuuu

SEQ ID NO: 3374478 - RNA, 16 nt, Human
aaauugcaugcugcuu

SEQ ID NO: 3374479 - RNA, 23 nt, Human
aaauugcauggguuuuguaggua

SEQ ID NO: 3374480 - RNA, 18 nt, Human
aaauugcauuuccugaca

SEQ ID NO: 3374481 - RNA, 14 nt, Human
aaauugccauauug

SEQ ID NO: 3374482 - RNA, 22 nt, Human
aaauugcuauguuacuauuuuc

SEQ ID NO: 3374483 - RNA, 13 nt, Human
aaauugcuccuug

SEQ ID NO: 3374484 - RNA, 14 nt, Human
aaauugcuguguau

SEQ ID NO: 3374485 - RNA, 18 nt, Human
aaauugcuuacuuuggaa

SEQ ID NO: 3374486 - RNA, 13 nt, Human
aaauugcuugaaa

SEQ ID NO: 3374487 - RNA, 18 nt, Human
aaauuggauuagccugga

SEQ ID NO: 3374488 - RNA, 23 nt, Human
aaauuggauucccuuaaacaaaa

SEQ ID NO: 3374489 - RNA, 16 nt, Human
aaauuggcauggaaau

SEQ ID NO: 3374490 - RNA, 21 nt, Human
aaauuggcauggaaauuuaaa

SEQ ID NO: 3374491 - RNA, 14 nt, Human
aaauuggcauuaaa

SEQ ID NO: 3374492 - RNA, 22 nt, Human
aaauuggccugguauggcugca

SEQ ID NO: 3374493 - RNA, 22 nt, Human
aaauuggggauucuuaaaguug

SEQ ID NO: 3374494 - RNA, 15 nt, Human
aaauugggguuuauu

SEQ ID NO: 3374495 - RNA, 15 nt, Human
aaauuggguucauga

SEQ ID NO: 3374496 - RNA, 19 nt, Human
aaauuguaagcaugcacaa

SEQ ID NO: 3374497 - RNA, 22 nt, Human
aaauuguacauauuuguggaau

SEQ ID NO: 3374498 - RNA, 15 nt, Human
aaauuguaccuuuuu

SEQ ID NO: 3374499 - RNA, 14 nt, Human
aaauuguauauuca

SEQ ID NO: 3374500 - RNA, 13 nt, Human
aaauuguauauug

SEQ ID NO: 3374501 - RNA, 18 nt, Human
aaauuguaucucauuacu

SEQ ID NO: 3374502 - RNA, 23 nt, Human
aaauuguccguguucauacauuu

SEQ ID NO: 3374503 - RNA, 19 nt, Human
aaauugugggucuauuucu

SEQ ID NO: 3374504 - RNA, 21 nt, Human
aaauugugugugcucugcuuc

SEQ ID NO: 3374505 - RNA, 22 nt, Human
aaauugugugugcucugcuuca

SEQ ID NO: 3374506 - RNA, 19 nt, Human
aaauuguuacuccauauau

SEQ ID NO: 3374507 - RNA, 19 nt, Human
aaauuguuaucaaaauagu

SEQ ID NO: 3374508 - RNA, 13 nt, Human
aaauuguuuagug

SEQ ID NO: 3374509 - RNA, 22 nt, Human
aaauuguuuccaagauagagag

SEQ ID NO: 3374510 - RNA, 19 nt, Human
aaauuguuuggcuuccucc

SEQ ID NO: 3374511 - RNA, 21 nt, Human
aaauuguuuggcuuccuccug

SEQ ID NO: 3374512 - RNA, 12 nt, Human
aaauuuaaaaaa

SEQ ID NO: 3374513 - RNA, 23 nt, Human
aaauuuaaaagacacuguuuaca

SEQ ID NO: 3374514 - RNA, 19 nt, Human
aacaaagcuuagcaggaga

SEQ ID NO: 3374515 - RNA, 15 nt, Human
aacaaaggauacuua

SEQ ID NO: 3374516 - RNA, 17 nt, Human
aacaaaggcaaguuaag

SEQ ID NO: 3374517 - RNA, 20 nt, Human
aacaaaggcaaguuaagaga

SEQ ID NO: 3374518 - RNA, 19 nt, Human
aacaaaguggaaggaaaga

SEQ ID NO: 3374519 - RNA, 19 nt, Human
aacaaauaaaaaagcucuu

SEQ ID NO: 3374520 - RNA, 16 nt, Human
aacaaauaugcuaauu

SEQ ID NO: 3374521 - RNA, 13 nt, Human
aacaaaucuuccu

SEQ ID NO: 3374522 - RNA, 19 nt, Human
aacaaaugaacgauaugua

SEQ ID NO: 3374523 - RNA, 20 nt, Human
aacaaauuagguuuuguaca

SEQ ID NO: 3374524 - RNA, 18 nt, Human
aacaaauucauauucugu

SEQ ID NO: 3374525 - RNA, 22 nt, Human
aacaaauucaucaaauggaaga

SEQ ID NO: 3374526 - RNA, 13 nt, Human
aacaacaauuggu

SEQ ID NO: 3374527 - RNA, 14 nt, Human
aacaacauuuugag

SEQ ID NO: 3374528 - RNA, 21 nt, Human
aacaacauuuugagaacaaag

SEQ ID NO: 3374529 - RNA, 22 nt, Human
aacaaccccccaucacaaacuu

SEQ ID NO: 3374530 - RNA, 18 nt, Human
aacaaccucggcuccugg

SEQ ID NO: 3374531 - RNA, 15 nt, Human
aacaacucuuugaga

SEQ ID NO: 3374532 - RNA, 16 nt, Human
aacaacuucuuuguaa

SEQ ID NO: 3374533 - RNA, 17 nt, Human
aacaacuucuuuguaau

SEQ ID NO: 3374534 - RNA, 15 nt, Human
aacaacuuuuuuuuc

SEQ ID NO: 3374535 - RNA, 13 nt, Human
aacaagaaaacau

SEQ ID NO: 3374536 - RNA, 15 nt, Human
aacaagaaaguuucc

SEQ ID NO: 3374537 - RNA, 14 nt, Human
aacaagaagaauuu

SEQ ID NO: 3374538 - RNA, 17 nt, Human
aacaagaagaauuugaa

SEQ ID NO: 3374539 - RNA, 12 nt, Human
aacaagaaugca

SEQ ID NO: 3374540 - RNA, 22 nt, Human
aacaagaccaccacuucgaaac

SEQ ID NO: 3374541 - RNA, 16 nt, Human
aacaagaccacguuuc

SEQ ID NO: 3374542 - RNA, 17 nt, Human
aacaagaccacguuucu

SEQ ID NO: 3374543 - RNA, 19 nt, Human
aacaagaccccgucucaaa

SEQ ID NO: 3374544 - RNA, 17 nt, Human
aacaagagaagcauucu

SEQ ID NO: 3374545 - RNA, 21 nt, Human
aacaagagaagcauucucauu

SEQ ID NO: 3374546 - RNA, 19 nt, Human
aacaagaugguucuagcau

SEQ ID NO: 3374547 - RNA, 19 nt, Human
aacaagcaagcucccaagg

SEQ ID NO: 3374548 - RNA, 16 nt, Human
aacaagcauauaaaau

SEQ ID NO: 3374549 - RNA, 21 nt, Human
aacaagccuccuuuuaaagua

SEQ ID NO: 3374550 - RNA, 12 nt, Human
aacaagcuucag

SEQ ID NO: 3374551 - RNA, 14 nt, Human
aacaagcuucagua

SEQ ID NO: 3374552 - RNA, 16 nt, Human
aacaaggcaaggcugu

SEQ ID NO: 3374553 - RNA, 23 nt, Human
aacaaggcaaggcugucaauuac

SEQ ID NO: 3374554 - RNA, 23 nt, Human
aacaaggccugucagcuaaagaa

SEQ ID NO: 3374555 - RNA, 21 nt, Human
aacaagggagagaccucauca

SEQ ID NO: 3374556 - RNA, 18 nt, Human
aacaagggcaguggaggu

SEQ ID NO: 3374557 - RNA, 19 nt, Human
aacaagucgaugaacuauu

SEQ ID NO: 3374558 - RNA, 21 nt, Human
aacaagugaaauaacaaaaug

SEQ ID NO: 3374559 - RNA, 20 nt, Human
aacaagugaacacauugugu

SEQ ID NO: 3374560 - RNA, 17 nt, Human
aacaaguugagcuauga

SEQ ID NO: 3374561 - RNA, 22 nt, Human
aacaaguugagcuaugacuuaa

SEQ ID NO: 3374562 - RNA, 17 nt, Human
aacaaguuuuaauguau

SEQ ID NO: 3374563 - RNA, 16 nt, Human
aacaauaaaacauuau

SEQ ID NO: 3374564 - RNA, 17 nt, Human
aacaauaaaacauuaug

SEQ ID NO: 3374565 - RNA, 16 nt, Human
aacaauaaaauuuuuu

SEQ ID NO: 3374566 - RNA, 14 nt, Human
aacaauaaagagau

SEQ ID NO: 3374567 - RNA, 15 nt, Human
aacaauaacuacugu

SEQ ID NO: 3374568 - RNA, 17 nt, Human
aacaauaacuacugugu

SEQ ID NO: 3374569 - RNA, 14 nt, Human
aacaauacaaaugg

SEQ ID NO: 3374570 - RNA, 15 nt, Human
aacaauacaaaugga

SEQ ID NO: 3374571 - RNA, 17 nt, Human
aacaauacaaauggauu

SEQ ID NO: 3374572 - RNA, 19 nt, Human
aacaauacucauaauguga

SEQ ID NO: 3374573 - RNA, 21 nt, Human
aacaauacucauaaugugaag

SEQ ID NO: 3374574 - RNA, 23 nt, Human
aacaauaggaugggcuucugugc

SEQ ID NO: 3374575 - RNA, 13 nt, Human
aacaauaucauau

SEQ ID NO: 3374576 - RNA, 16 nt, Human
aacaauauugucugaa

SEQ ID NO: 3374577 - RNA, 15 nt, Human
aacaauauuuauugu

SEQ ID NO: 3374578 - RNA, 22 nt, Human
aacaauauuuuaugguuauguu

SEQ ID NO: 3374579 - RNA, 23 nt, Human
aacaaucaaagcacuuggacucu

SEQ ID NO: 3374580 - RNA, 13 nt, Human
aacaaucacacuc

SEQ ID NO: 3374581 - RNA, 17 nt, Human
aacaaucuggaagaaaa

SEQ ID NO: 3374582 - RNA, 14 nt, Human
aacaaucuuccugu

SEQ ID NO: 3374583 - RNA, 17 nt, Human
aacaaucuuccuguuua

SEQ ID NO: 3374584 - RNA, 18 nt, Human
aacaaugaagauaaaaag

SEQ ID NO: 3374585 - RNA, 16 nt, Human
aacaaugaaguugaaa

SEQ ID NO: 3374586 - RNA, 18 nt, Human
aacaaugaaguugaaaau

SEQ ID NO: 3374587 - RNA, 22 nt, Human
aacaaugaauaaaaacucaagg

SEQ ID NO: 3374588 - RNA, 15 nt, Human
aacaaugacauuuau

SEQ ID NO: 3374589 - RNA, 20 nt, Human
aacaaugacuaauucuugca

SEQ ID NO: 3374590 - RNA, 14 nt, Human
aacaaugauauaug

SEQ ID NO: 3374591 - RNA, 23 nt, Human
aacaaugccuauuguaauauaga

SEQ ID NO: 3374592 - RNA, 15 nt, Human
aacaaugcuguauuu

SEQ ID NO: 3374593 - RNA, 16 nt, Human
aacaauggaaacugaa

SEQ ID NO: 3374594 - RNA, 18 nt, Human
aacaauggaaacugaaug

SEQ ID NO: 3374595 - RNA, 16 nt, Human
aacaauggaguauucu

SEQ ID NO: 3374596 - RNA, 20 nt, Human
aacaaugguaacauuuuuca

SEQ ID NO: 3374597 - RNA, 21 nt, Human
aacaauguuaaggaaacucuu

SEQ ID NO: 3374598 - RNA, 22 nt, Human
aacaauucuaaaaugauuguag

SEQ ID NO: 3374599 - RNA, 22 nt, Human
aacaauucucccgggacucugc

SEQ ID NO: 3374600 - RNA, 23 nt, Human
aacaauucucccgggacucugca

SEQ ID NO: 3374601 - RNA, 16 nt, Human
aacaauugaaguaaac

SEQ ID NO: 3374602 - RNA, 23 nt, Human
aacaauugaaguaaacuuuuugu

SEQ ID NO: 3374603 - RNA, 16 nt, Human
aacaauugguaaaacu

SEQ ID NO: 3374604 - RNA, 20 nt, Human
aacaauuguguagccuuuuu

SEQ ID NO: 3374605 - RNA, 22 nt, Human
aacaauuguguagccuuuuugu

SEQ ID NO: 3374606 - RNA, 13 nt, Human
aacaauuuaaaaa

SEQ ID NO: 3374607 - RNA, 22 nt, Human
aacaauuuauuuuauuuuagca

SEQ ID NO: 3374608 - RNA, 14 nt, Human
aacaauuuggcaau

SEQ ID NO: 3374609 - RNA, 23 nt, Human
aacaauuuuaggaggaccagagc

SEQ ID NO: 3374610 - RNA, 14 nt, Human
aacaauuuucagau

SEQ ID NO: 3374611 - RNA, 17 nt, Human
aaccauucaaaaauuuc

SEQ ID NO: 3374612 - RNA, 12 nt, Human
aaccauugcuuc

SEQ ID NO: 3374613 - RNA, 13 nt, Human
aaccauugcuuca

SEQ ID NO: 3374614 - RNA, 16 nt, Human
aaccauugcuucacua

SEQ ID NO: 3374615 - RNA, 23 nt, Human
aaccauugcuucacuacccaucg

SEQ ID NO: 3374616 - RNA, 18 nt, Human
aaccauugucuuguucug

SEQ ID NO: 3374617 - RNA, 19 nt, Human
aaccauuugaaaccccugu

SEQ ID NO: 3374618 - RNA, 23 nt, Human
aaccauuugaaguguaccugugu

SEQ ID NO: 3374619 - RNA, 20 nt, Human
aaccauuuuauaaagugcuu

SEQ ID NO: 3374620 - RNA, 22 nt, Human
aaccauuuuauaaagugcuugu

SEQ ID NO: 3374621 - RNA, 22 nt, Human
aacccaaauuacguguacuaca

SEQ ID NO: 3374622 - RNA, 21 nt, Human
aacccaagaugcaagaaggag

SEQ ID NO: 3374623 - RNA, 16 nt, Human
aacccaagcuuagaac

SEQ ID NO: 3374624 - RNA, 18 nt, Human
aacccaaggacugaggga

SEQ ID NO: 3374625 - RNA, 22 nt, Human
aacccaaggagcacagguccca

SEQ ID NO: 3374626 - RNA, 15 nt, Human
aacccacccuuucua

SEQ ID NO: 3374627 - RNA, 14 nt, Human
aacccaccugcuga

SEQ ID NO: 3374628 - RNA, 21 nt, Human
aacccacuugucacugacaca

SEQ ID NO: 3374629 - RNA, 23 nt, Human
aacccacuuuaaaauaucuacau

SEQ ID NO: 3374630 - RNA, 23 nt, Human
aacccagaccuguuagcagacag

SEQ ID NO: 3374631 - RNA, 12 nt, Human
aacccagacuca

SEQ ID NO: 3374632 - RNA, 14 nt, Human
aacccagacucaga

SEQ ID NO: 3374633 - RNA, 13 nt, Human
aacccagauuuug

SEQ ID NO: 3374634 - RNA, 21 nt, Human
aacccagauuuugcuguauau

SEQ ID NO: 3374635 - RNA, 16 nt, Human
aacccagcccaccccc

SEQ ID NO: 3374636 - RNA, 16 nt, Human
aacccagccgcugccc

SEQ ID NO: 3374637 - RNA, 17 nt, Human
aacccagcucuggucca

SEQ ID NO: 3374638 - RNA, 23 nt, Human
aacccagcugcaccccuuccugg

SEQ ID NO: 3374639 - RNA, 13 nt, Human
aacccaggagcau

SEQ ID NO: 3374640 - RNA, 11 nt, Human
aacccaggagg

SEQ ID NO: 3374641 - RNA, 17 nt, Human
aacccagggcucugccc

SEQ ID NO: 3374642 - RNA, 20 nt, Human
aacccagguuggcgacugca

SEQ ID NO: 3374643 - RNA, 15 nt, Human
aacccagucgcccuu

SEQ ID NO: 3374644 - RNA, 17 nt, Human
aacccauauuguaaaac

SEQ ID NO: 3374645 - RNA, 15 nt, Human
aacccaucagaagga

SEQ ID NO: 3374646 - RNA, 17 nt, Human
aacccaucagaaggaga

SEQ ID NO: 3374647 - RNA, 17 nt, Human
aacccaucuaccccugg

SEQ ID NO: 3374648 - RNA, 15 nt, Human
aacccaugagauuca

SEQ ID NO: 3374649 - RNA, 23 nt, Human
aacccauuaaggggaagaaugaa

SEQ ID NO: 3374650 - RNA, 20 nt, Human
aacccauuugucucuacuuu

SEQ ID NO: 3374651 - RNA, 22 nt, Human
aaccccaaaaugaagauuauuu

SEQ ID NO: 3374652 - RNA, 14 nt, Human
aaccccaaacagug

SEQ ID NO: 3374653 - RNA, 17 nt, Human
aaccccaacgcacagga

SEQ ID NO: 3374654 - RNA, 19 nt, Human
aaccccaacuacuguguua

SEQ ID NO: 3374655 - RNA, 11 nt, Human
aaccccagccg

SEQ ID NO: 3374656 - RNA, 14 nt, Human
aaccccaggccccg

SEQ ID NO: 3374657 - RNA, 16 nt, Human
aaccccaguucugcuc

SEQ ID NO: 3374658 - RNA, 18 nt, Human
aaccccaguucugcuccu

SEQ ID NO: 3374659 - RNA, 22 nt, Human
aaccccaguucugcuccucucc

SEQ ID NO: 3374660 - RNA, 23 nt, Human
aaccccaguucugcuccucucca

SEQ ID NO: 3374661 - RNA, 17 nt, Human
aaccccauaccuacauu

SEQ ID NO: 3374662 - RNA, 13 nt, Human
aacccccacacac

SEQ ID NO: 3374663 - RNA, 15 nt, Human
aacccccaccccaca

SEQ ID NO: 3374664 - RNA, 18 nt, Human
aacccccaccccacacuu

SEQ ID NO: 3374665 - RNA, 19 nt, Human
aacccccagcacccgggcu

SEQ ID NO: 3374666 - RNA, 16 nt, Human
aacccccauucucauc

SEQ ID NO: 3374667 - RNA, 18 nt, Human
aaccccccagcacugagg

SEQ ID NO: 3374668 - RNA, 16 nt, Human
aacccccuuugugcug

SEQ ID NO: 3374669 - RNA, 19 nt, Human
aacccccuuugugcugugg

SEQ ID NO: 3374670 - RNA, 20 nt, Human
aaccccggggugcccacagg

SEQ ID NO: 3374671 - RNA, 14 nt, Human
aaccccgucaacaa

SEQ ID NO: 3374672 - RNA, 16 nt, Human
aaccccgucaacaaau

SEQ ID NO: 3374673 - RNA, 21 nt, Human
aaccccuacaugaaacagaaa

SEQ ID NO: 3374674 - RNA, 20 nt, Human
aaccccuccccuccaucccu

SEQ ID NO: 3374675 - RNA, 21 nt, Human
aaccccuccccuccaucccug

SEQ ID NO: 3374676 - RNA, 23 nt, Human
aaccccuccccuccaucccuggc

SEQ ID NO: 3374677 - RNA, 12 nt, Human
aaccccucgccc

SEQ ID NO: 3374678 - RNA, 16 nt, Human
aaccccucgcccaguc

SEQ ID NO: 3374679 - RNA, 20 nt, Human
aaccccuggaccccagccuc

SEQ ID NO: 3374680 - RNA, 23 nt, Human
aaccccugucccaugcaggcccu

SEQ ID NO: 3374681 - RNA, 18 nt, Human
aaccccuucucugugacc

SEQ ID NO: 3374682 - RNA, 20 nt, Human
aaccccuucucugugaccca

SEQ ID NO: 3374683 - RNA, 16 nt, Human
aacccgacagagggaa

SEQ ID NO: 3374684 - RNA, 23 nt, Human
aacccgggagcggagguugcagu

SEQ ID NO: 3374685 - RNA, 14 nt, Human
aacccguggaggcu

SEQ ID NO: 3374686 - RNA, 15 nt, Human
aacccguggaggcug

SEQ ID NO: 3374687 - RNA, 21 nt, Human
aacccuaaaaagcagagcuuu

SEQ ID NO: 3374688 - RNA, 19 nt, Human
aacccuagccuugcuuguu

SEQ ID NO: 3374689 - RNA, 16 nt, Human
aacccuaucuccugac

SEQ ID NO: 3374690 - RNA, 10 nt, Human
aacccucagg

SEQ ID NO: 3374691 - RNA, 19 nt, Human
aacccucccucagccccuc

SEQ ID NO: 3374692 - RNA, 20 nt, Human
aacccucccucagccccucu

SEQ ID NO: 3374693 - RNA, 23 nt, Human
aacccucccucagccccucuugc

SEQ ID NO: 3374694 - RNA, 21 nt, Human
aacccugccauggaacuguuu

SEQ ID NO: 3374695 - RNA, 17 nt, Human
aacccugcccccaaaua

SEQ ID NO: 3374696 - RNA, 12 nt, Human
aacccugccccu

SEQ ID NO: 3374697 - RNA, 15 nt, Human
aacccugccgucacc

SEQ ID NO: 3374698 - RNA, 20 nt, Human
aacccugccgucaccaccac

SEQ ID NO: 3374699 - RNA, 16 nt, Human
aacccuggggaaggag

SEQ ID NO: 3374700 - RNA, 20 nt, Human
aacccuggggaaggagccag

SEQ ID NO: 3374701 - RNA, 20 nt, Human
aacccuggggccugacugcu

SEQ ID NO: 3374702 - RNA, 14 nt, Human
aacccuggugacca

SEQ ID NO: 3374703 - RNA, 23 nt, Human
aacccugucaaacauuaguacuu

SEQ ID NO: 3374704 - RNA, 22 nt, Human
aacccugucuggauccuauccu

SEQ ID NO: 3374705 - RNA, 19 nt, Human
aacccugugcugguguccu

SEQ ID NO: 3374706 - RNA, 16 nt, Human
aacccuguuuuauacu

SEQ ID NO: 3374707 - RNA, 18 nt, Human
aacccuuaaacaguugca

SEQ ID NO: 3374708 - RNA, 23 nt, Human
aacccuuaaacaguugcacagca

SEQ ID NO: 3374709 - RNA, 21 nt, Human
aacccuuaccccuuagccucc

SEQ ID NO: 3374710 - RNA, 11 nt, Human
aacccuucucc

SEQ ID NO: 3374711 - RNA, 14 nt, Human
aacccuucuuuuaa

SEQ ID NO: 3374712 - RNA, 15 nt, Human
aacccuugcuugcaa

SEQ ID NO: 3374713 - RNA, 21 nt, Human
aacccuuggagccaauggaga

SEQ ID NO: 3374714 - RNA, 18 nt, Human
aacccuugggccagaagu

SEQ ID NO: 3374715 - RNA, 18 nt, Human
aacccuuuauuugaacaa

SEQ ID NO: 3374716 - RNA, 20 nt, Human
aacccuuugugugcucucca

SEQ ID NO: 3374717 - RNA, 13 nt, Human
aaccgaauaaaug

SEQ ID NO: 3374718 - RNA, 19 nt, Human
aaccgagggggcugcuccc

SEQ ID NO: 3374719 - RNA, 16 nt, Human
aaaugagguacucucc

SEQ ID NO: 3374720 - RNA, 21 nt, Human
aaaugaggucuguuuaaagug

SEQ ID NO: 3374721 - RNA, 13 nt, Human
aaaugaguaacau

SEQ ID NO: 3374722 - RNA, 14 nt, Human
aaaugaguaacauu

SEQ ID NO: 3374723 - RNA, 15 nt, Human
aaaugagugugaagg

SEQ ID NO: 3374724 - RNA, 21 nt, Human
aaaugaguuaccuacauuuua

SEQ ID NO: 3374725 - RNA, 14 nt, Human
aaaugaguugugaa

SEQ ID NO: 3374726 - RNA, 22 nt, Human
aaaugaguuuuuauggggcuga

SEQ ID NO: 3374727 - RNA, 13 nt, Human
aaaugauagauuu

SEQ ID NO: 3374728 - RNA, 20 nt, Human
aaaugauagauuugaccucc

SEQ ID NO: 3374729 - RNA, 23 nt, Human
aaaugauccccagcuguuuaugc

SEQ ID NO: 3374730 - RNA, 20 nt, Human
aaaugaucugagucccagga

SEQ ID NO: 3374731 - RNA, 19 nt, Human
aaaugaugugccugcuuca

SEQ ID NO: 3374732 - RNA, 22 nt, Human
aaaugauugcuuuuaaaauuuu

SEQ ID NO: 3374733 - RNA, 15 nt, Human
aaaugauuguaaaau

SEQ ID NO: 3374734 - RNA, 14 nt, Human
aaaugauuguagua

SEQ ID NO: 3374735 - RNA, 21 nt, Human
aaaugauuuaaauuuaaguaa

SEQ ID NO: 3374736 - RNA, 15 nt, Human
aaaugcaaaaaaaau

SEQ ID NO: 3374737 - RNA, 17 nt, Human
aaaugcaaaaaaaauua

SEQ ID NO: 3374738 - RNA, 22 nt, Human
aaaugcaaaaaaucuuaauacu

SEQ ID NO: 3374739 - RNA, 16 nt, Human
aaaugcaacaacaugu

SEQ ID NO: 3374740 - RNA, 14 nt, Human
aaaugcaauauuaa

SEQ ID NO: 3374741 - RNA, 14 nt, Human
aaaugcaaugugaa

SEQ ID NO: 3374742 - RNA, 13 nt, Human
aaaugcagcccau

SEQ ID NO: 3374743 - RNA, 21 nt, Human
aaaugcagcccauuucuccag

SEQ ID NO: 3374744 - RNA, 22 nt, Human
aaaugcagcccauuucuccaga

SEQ ID NO: 3374745 - RNA, 23 nt, Human
aaaugcagcgaaccaauauuugu

SEQ ID NO: 3374746 - RNA, 18 nt, Human
aaaugcaguauauuucuu

SEQ ID NO: 3374747 - RNA, 12 nt, Human
aaaugcagugaa

SEQ ID NO: 3374748 - RNA, 20 nt, Human
aaaugcauauccugagccau

SEQ ID NO: 3374749 - RNA, 11 nt, Human
aaaugcauauu

SEQ ID NO: 3374750 - RNA, 20 nt, Human
aaaugcauccauuccucagg

SEQ ID NO: 3374751 - RNA, 22 nt, Human
aaaugcauccauuccucaggga

SEQ ID NO: 3374752 - RNA, 16 nt, Human
aaaugcaucuuugaug

SEQ ID NO: 3374753 - RNA, 14 nt, Human
aaaugcaugaacaa

SEQ ID NO: 3374754 - RNA, 20 nt, Human
aaaugcaugauuuuguaacc

SEQ ID NO: 3374755 - RNA, 20 nt, Human
aaccacauuggagauguuua

SEQ ID NO: 3374756 - RNA, 19 nt, Human
aaccaccacacccagccca

SEQ ID NO: 3374757 - RNA, 21 nt, Human
aaccaccacacccagcccacu

SEQ ID NO: 3374758 - RNA, 14 nt, Human
aaccaccagaagcc

SEQ ID NO: 3374759 - RNA, 19 nt, Human
aaccaccgcuccccagccc

SEQ ID NO: 3374760 - RNA, 20 nt, Human
aaccaccgcuccccagccca

SEQ ID NO: 3374761 - RNA, 19 nt, Human
aaccaccuaaucaggcuga

SEQ ID NO: 3374762 - RNA, 15 nt, Human
aaccaccuaccccug

SEQ ID NO: 3374763 - RNA, 16 nt, Human
aaccaccuauuuuuga

SEQ ID NO: 3374764 - RNA, 15 nt, Human
aaccacgccucuuga

SEQ ID NO: 3374765 - RNA, 18 nt, Human
aaccacgucugucuucac

SEQ ID NO: 3374766 - RNA, 18 nt, Human
aaccacucccagucccca

SEQ ID NO: 3374767 - RNA, 22 nt, Human
aaccacucuaucaaguauuaua

SEQ ID NO: 3374768 - RNA, 19 nt, Human
aaccacugaaaaaauauau

SEQ ID NO: 3374769 - RNA, 11 nt, Human
aaccacugaau

SEQ ID NO: 3374770 - RNA, 17 nt, Human
aaccacugaaucuggac

SEQ ID NO: 3374771 - RNA, 12 nt, Human
aaccacugcuuc

SEQ ID NO: 3374772 - RNA, 20 nt, Human
aaccacuguaaaaugaaauu

SEQ ID NO: 3374773 - RNA, 21 nt, Human
aaccacugugcgucuuggugu

SEQ ID NO: 3374774 - RNA, 19 nt, Human
aaccacuuaaaaaaugucc

SEQ ID NO: 3374775 - RNA, 13 nt, Human
aaccacuucauuc

SEQ ID NO: 3374776 - RNA, 16 nt, Human
aaccacuucauucugc

SEQ ID NO: 3374777 - RNA, 12 nt, Human
aaccacuuguag

SEQ ID NO: 3374778 - RNA, 21 nt, Human
aaccacuuguagauuugauuu

SEQ ID NO: 3374779 - RNA, 22 nt, Human
aaccacuuguagauuugauuuu

SEQ ID NO: 3374780 - RNA, 16 nt, Human
aaccagaacaguauga

SEQ ID NO: 3374781 - RNA, 17 nt, Human
aaccagaagcaacagaa

SEQ ID NO: 3374782 - RNA, 21 nt, Human
aaccagaagcaacagaaaaaa

SEQ ID NO: 3374783 - RNA, 18 nt, Human
aaccagaauaaaguucug

SEQ ID NO: 3374784 - RNA, 12 nt, Human
aaccagaccugg

SEQ ID NO: 3374785 - RNA, 13 nt, Human
aaccagagcacug

SEQ ID NO: 3374786 - RNA, 16 nt, Human
aaccagauauauauuc

SEQ ID NO: 3374787 - RNA, 23 nt, Human
aaccagcacagcuuagauuucau

SEQ ID NO: 3374788 - RNA, 14 nt, Human
aaccagccggggcc

SEQ ID NO: 3374789 - RNA, 16 nt, Human
aaccagcuaagaaaag

SEQ ID NO: 3374790 - RNA, 22 nt, Human
aaccagcuguaacacagcugag

SEQ ID NO: 3374791 - RNA, 13 nt, Human
aaccagcuuccuu

SEQ ID NO: 3374792 - RNA, 23 nt, Human
aaccagcuugcgaauaacagucc

SEQ ID NO: 3374793 - RNA, 15 nt, Human
aaccaggagcugcuc

SEQ ID NO: 3374794 - RNA, 16 nt, Human
aaccaggcaccucuuc

SEQ ID NO: 3374795 - RNA, 17 nt, Human
aaccaggcuuucuagaa

SEQ ID NO: 3374796 - RNA, 21 nt, Human
aaccagguccaaugagcuuuc

SEQ ID NO: 3374797 - RNA, 17 nt, Human
aaccaguauacaagaua

SEQ ID NO: 3374798 - RNA, 18 nt, Human
aaccaguauacaagauaa

SEQ ID NO: 3374799 - RNA, 19 nt, Human
aaccaguauacaagauaag

SEQ ID NO: 3374800 - RNA, 11 nt, Human
aaccaguauug

SEQ ID NO: 3374801 - RNA, 13 nt, Human
aaccaguauugua

SEQ ID NO: 3374802 - RNA, 23 nt, Human
aaccaguauuuuugcugcuucug

SEQ ID NO: 3374803 - RNA, 21 nt, Human
aaccagucuuucaacucauug

SEQ ID NO: 3374804 - RNA, 14 nt, Human
aaccagugccaagg

SEQ ID NO: 3374805 - RNA, 12 nt, Human
aaccaguugugg

SEQ ID NO: 3374806 - RNA, 20 nt, Human
aaccaguuguggugugagua

SEQ ID NO: 3374807 - RNA, 18 nt, Human
aaccaguuucagguguuu

SEQ ID NO: 3374808 - RNA, 16 nt, Human
aaccauaguuacugua

SEQ ID NO: 3374809 - RNA, 17 nt, Human
aaccauaguuacuguaa

SEQ ID NO: 3374810 - RNA, 23 nt, Human
aaccauaguuacuguaaaaugca

SEQ ID NO: 3374811 - RNA, 22 nt, Human
aaccauccagugacaaaccauc

SEQ ID NO: 3374812 - RNA, 22 nt, Human
aaccaucccugaugucugucug

SEQ ID NO: 3374813 - RNA, 16 nt, Human
aaccaucuggccuggc

SEQ ID NO: 3374814 - RNA, 15 nt, Human
aaccaugacgcaaag

SEQ ID NO: 3374815 - RNA, 19 nt, Human
aaccaugcaaaugcuauga

SEQ ID NO: 3374816 - RNA, 22 nt, Human
aaccauggcugaaggaaaccag

SEQ ID NO: 3374817 - RNA, 15 nt, Human
aaccaugggauaaau

SEQ ID NO: 3374818 - RNA, 17 nt, Human
aaccaugggauaaaugc

SEQ ID NO: 3374819 - RNA, 17 nt, Human
aaccaugucagcaaaaa

SEQ ID NO: 3374820 - RNA, 17 nt, Human
aaccauuccauuuccaa

SEQ ID NO: 3374821 - RNA, 14 nt, Human
aaccauugcuucac

SEQ ID NO: 3374822 - RNA, 19 nt, Human
aaccauugucuuguucugu

SEQ ID NO: 3374823 - RNA, 13 nt, Human
aaccauugugcau

SEQ ID NO: 3374824 - RNA, 23 nt, Human
aaccauuguucugacacgacuuc

SEQ ID NO: 3374825 - RNA, 12 nt, Human
aaccauuuaucu

SEQ ID NO: 3374826 - RNA, 19 nt, Human
aaccauuuaucuugaagga

SEQ ID NO: 3374827 - RNA, 12 nt, Human
aaccauuuccuc

SEQ ID NO: 3374828 - RNA, 15 nt, Human
aaccauuuucauuug

SEQ ID NO: 3374829 - RNA, 14 nt, Human
aaccauuuuuguua

SEQ ID NO: 3374830 - RNA, 14 nt, Human
aacccaaaccugga

SEQ ID NO: 3374831 - RNA, 23 nt, Human
aacccaaauguucaucaaugaau

SEQ ID NO: 3374832 - RNA, 14 nt, Human
aacccaagcuccuc

SEQ ID NO: 3374833 - RNA, 16 nt, Human
aacccaagcuccuccu

SEQ ID NO: 3374834 - RNA, 15 nt, Human
aacccaagcuuagaa

SEQ ID NO: 3374835 - RNA, 21 nt, Human
aacccaaggagcacagguccc

SEQ ID NO: 3374836 - RNA, 22 nt, Human
aacccaagguggguagaucacg

SEQ ID NO: 3374837 - RNA, 18 nt, Human
aacccaaguccaagcaua

SEQ ID NO: 3374838 - RNA, 11 nt, Human
aacccacacug

SEQ ID NO: 3374839 - RNA, 19 nt, Human
aacccacaggcccacagua

SEQ ID NO: 3374840 - RNA, 20 nt, Human
aacccacuugucacugacac

SEQ ID NO: 3374841 - RNA, 19 nt, Human
aacccacuuuaaaauaucu

SEQ ID NO: 3374842 - RNA, 13 nt, Human
aacccagaaacac

SEQ ID NO: 3374843 - RNA, 22 nt, Human
aacccagaccuguuagcagaca

SEQ ID NO: 3374844 - RNA, 12 nt, Human
aacccagagagg

SEQ ID NO: 3374845 - RNA, 16 nt, Human
aacccagcaacagaaa

SEQ ID NO: 3374846 - RNA, 17 nt, Human
aacccagcaacagaaaa

SEQ ID NO: 3374847 - RNA, 17 nt, Human
aacccagcaguucuguu

SEQ ID NO: 3374848 - RNA, 11 nt, Human
aacccagcucu

SEQ ID NO: 3374849 - RNA, 16 nt, Human
aacccaggacgcuucu

SEQ ID NO: 3374850 - RNA, 20 nt, Human
aacccaggagcauccaccuc

SEQ ID NO: 3374851 - RNA, 22 nt, Human
aacccagggcucugccccaguc

SEQ ID NO: 3374852 - RNA, 18 nt, Human
aacccauaggcccacaca

SEQ ID NO: 3374853 - RNA, 19 nt, Human
aacccauaggcccacacac

SEQ ID NO: 3374854 - RNA, 23 nt, Human
aacccauaggcccacacacaggu

SEQ ID NO: 3374855 - RNA, 13 nt, Human
aacccauuuuagu

SEQ ID NO: 3374856 - RNA, 20 nt, Human
aaccccacccuugcccaccc

SEQ ID NO: 3374857 - RNA, 14 nt, Human
aaccccagcauccu

SEQ ID NO: 3374858 - RNA, 12 nt, Human
aaccccaguucu

SEQ ID NO: 3374859 - RNA, 13 nt, Human
aaccccaguucug

SEQ ID NO: 3374860 - RNA, 16 nt, Human
aacccccacuggacug

SEQ ID NO: 3374861 - RNA, 20 nt, Human
aacccccacuggacugaccu

SEQ ID NO: 3374862 - RNA, 14 nt, Human
aacccccagccugc

SEQ ID NO: 3374863 - RNA, 17 nt, Human
aaccccccauuucuucc

SEQ ID NO: 3374864 - RNA, 17 nt, Human
aaccccgucaacaaauc

SEQ ID NO: 3374865 - RNA, 20 nt, Human
aaccccucgcccagucccag

SEQ ID NO: 3374866 - RNA, 16 nt, Human
aaccccuggaccccag

SEQ ID NO: 3374867 - RNA, 13 nt, Human
aaccccuguggag

SEQ ID NO: 3374868 - RNA, 11 nt, Human
aaccccuuucc

SEQ ID NO: 3374869 - RNA, 16 nt, Human
aacccgggaggcagag

SEQ ID NO: 3374870 - RNA, 14 nt, Human
aacccgugccaagu

SEQ ID NO: 3374871 - RNA, 13 nt, Human
aacccguggaggc

SEQ ID NO: 3374872 - RNA, 12 nt, Human
aacccguggcgc

SEQ ID NO: 3374873 - RNA, 23 nt, Human
aacccuaaauaauaaaaauaaac

SEQ ID NO: 3374874 - RNA, 13 nt, Human
aacccuagccuug

SEQ ID NO: 3374875 - RNA, 17 nt, Human
aaccgaguagaaaaugu

SEQ ID NO: 3374876 - RNA, 19 nt, Human
aaccgaguagaaaauguga

SEQ ID NO: 3374877 - RNA, 14 nt, Human
aaccgcaggaagcu

SEQ ID NO: 3374878 - RNA, 14 nt, Human
aaccgccagcucug

SEQ ID NO: 3374879 - RNA, 17 nt, Human
aaccgccagcucuguuc

SEQ ID NO: 3374880 - RNA, 14 nt, Human
aaccgcugaauaug

SEQ ID NO: 3374881 - RNA, 13 nt, Human
aaccgggauggga

SEQ ID NO: 3374882 - RNA, 23 nt, Human
aaccggggagcccccgccccgcc

SEQ ID NO: 3374883 - RNA, 22 nt, Human
aaccguaaagguuuauuuuucu

SEQ ID NO: 3374884 - RNA, 15 nt, Human
aaccguccucuuuuu

SEQ ID NO: 3374885 - RNA, 18 nt, Human
aaccgucuguuaugcugu

SEQ ID NO: 3374886 - RNA, 11 nt, Human
aaccguggccc

SEQ ID NO: 3374887 - RNA, 19 nt, Human
aaccguggcccuuccugga

SEQ ID NO: 3374888 - RNA, 15 nt, Human
aaccuaaaaaagaua

SEQ ID NO: 3374889 - RNA, 16 nt, Human
aaccuaaaaaagauau

SEQ ID NO: 3374890 - RNA, 20 nt, Human
aaccuaaaauaauugguucu

SEQ ID NO: 3374891 - RNA, 22 nt, Human
aaccuaaauaaacacauagauu

SEQ ID NO: 3374892 - RNA, 22 nt, Human
aaccuaaauuugguucuaggcc

SEQ ID NO: 3374893 - RNA, 14 nt, Human
aaccuaaccugugu

SEQ ID NO: 3374894 - RNA, 13 nt, Human
aaccuaacuguau

SEQ ID NO: 3374895 - RNA, 20 nt, Human
aaccuaaucaccauguaagc

SEQ ID NO: 3374896 - RNA, 14 nt, Human
aaccuaauuaauau

SEQ ID NO: 3374897 - RNA, 15 nt, Human
aaccuacauauucca

SEQ ID NO: 3374898 - RNA, 19 nt, Human
aaccuaccaccccuuccug

SEQ ID NO: 3374899 - RNA, 18 nt, Human
aaccuaccucccacacuc

SEQ ID NO: 3374900 - RNA, 22 nt, Human
aaccuaccucccacacucccaa

SEQ ID NO: 3374901 - RNA, 19 nt, Human
aacgccugagcccagggag

SEQ ID NO: 3374902 - RNA, 21 nt, Human
aacgcgcagaugugcagcaga

SEQ ID NO: 3374903 - RNA, 14 nt, Human
aacgcguugaaauu

SEQ ID NO: 3374904 - RNA, 21 nt, Human
aacgcuaaagagcccuugccu

SEQ ID NO: 3374905 - RNA, 20 nt, Human
aacgcuccaaagucauaauu

SEQ ID NO: 3374906 - RNA, 16 nt, Human
aacgcuccuuugugug

SEQ ID NO: 3374907 - RNA, 12 nt, Human
aacgcugccugc

SEQ ID NO: 3374908 - RNA, 15 nt, Human
aacgcugccugccca

SEQ ID NO: 3374909 - RNA, 17 nt, Human
aacgcuuaaaggaaguc

SEQ ID NO: 3374910 - RNA, 22 nt, Human
aacgcuuguagaacucacucug

SEQ ID NO: 3374911 - RNA, 23 nt, Human
aacgcuuguagaacucacucugg

SEQ ID NO: 3374912 - RNA, 14 nt, Human
aacggaagaagaga

SEQ ID NO: 3374913 - RNA, 22 nt, Human
aacggaggccugcgacccuggg

SEQ ID NO: 3374914 - RNA, 13 nt, Human
aacggaucagaaa

SEQ ID NO: 3374915 - RNA, 17 nt, Human
aacggaucagaaauaca

SEQ ID NO: 3374916 - RNA, 15 nt, Human
aacggaugauuucua

SEQ ID NO: 3374917 - RNA, 20 nt, Human
aacggauuauuuuuucagac

SEQ ID NO: 3374918 - RNA, 15 nt, Human
aacggauuccaaaga

SEQ ID NO: 3374919 - RNA, 14 nt, Human
aacggccccagcuu

SEQ ID NO: 3374920 - RNA, 16 nt, Human
aacgggaacaugcccc

SEQ ID NO: 3374921 - RNA, 19 nt, Human
aacgggaacaugcccccug

SEQ ID NO: 3374922 - RNA, 17 nt, Human
aacgggcugcccugcca

SEQ ID NO: 3374923 - RNA, 14 nt, Human
aacgguuaaaacug

SEQ ID NO: 3374924 - RNA, 13 nt, Human
aacguauuuuaaa

SEQ ID NO: 3374925 - RNA, 13 nt, Human
aacgucugugcca

SEQ ID NO: 3374926 - RNA, 14 nt, Human
aacgucuuaaauau

SEQ ID NO: 3374927 - RNA, 17 nt, Human
aacgugcagacuaugca

SEQ ID NO: 3374928 - RNA, 16 nt, Human
aacgugcauugugcuu

SEQ ID NO: 3374929 - RNA, 13 nt, Human
aacgugcccucug

SEQ ID NO: 3374930 - RNA, 19 nt, Human
aacgugcucuuuguuuugu

SEQ ID NO: 3374931 - RNA, 15 nt, Human
aacguggcucugcug

SEQ ID NO: 3374932 - RNA, 16 nt, Human
aacguggcucugcugg

SEQ ID NO: 3374933 - RNA, 23 nt, Human
aacgugggaguucagcugcuucu

SEQ ID NO: 3374934 - RNA, 20 nt, Human
aacguguauguuuuucaguu

SEQ ID NO: 3374935 - RNA, 22 nt, Human
aacguguauguuuuucaguuca

SEQ ID NO: 3374936 - RNA, 17 nt, Human
aacguguucaauauuuu

SEQ ID NO: 3374937 - RNA, 14 nt, Human
aacguugcucccca

SEQ ID NO: 3374938 - RNA, 13 nt, Human
aacguugcugugg

SEQ ID NO: 3374939 - RNA, 21 nt, Human
aacguuucaguaauaaaacau

SEQ ID NO: 3374940 - RNA, 15 nt, Human
aacguuuucuaauug

SEQ ID NO: 3374941 - RNA, 20 nt, Human
aacguuuugaacuaauaaaa

SEQ ID NO: 3374942 - RNA, 13 nt, Human
aacuaaaacaaag

SEQ ID NO: 3374943 - RNA, 14 nt, Human
aacuaaaagacauu

SEQ ID NO: 3374944 - RNA, 15 nt, Human
aacuaaaauaauuuu

SEQ ID NO: 3374945 - RNA, 12 nt, Human
aacuaaaaugua

SEQ ID NO: 3374946 - RNA, 13 nt, Human
aacuaaaauguau

SEQ ID NO: 3374947 - RNA, 15 nt, Human
aacuaaaauguucua

SEQ ID NO: 3374948 - RNA, 15 nt, Human
aacuaaaauuugaag

SEQ ID NO: 3374949 - RNA, 15 nt, Human
aacuaaacucauuua

SEQ ID NO: 3374950 - RNA, 17 nt, Human
aacuaaacucauuuaua

SEQ ID NO: 3374951 - RNA, 23 nt, Human
aacuaaacucuuaccauauguuu

SEQ ID NO: 3374952 - RNA, 16 nt, Human
aacuaaagcaauagaa

SEQ ID NO: 3374953 - RNA, 19 nt, Human
aacuaaagcaauagaaaca

SEQ ID NO: 3374954 - RNA, 14 nt, Human
aacuaaauguucua

SEQ ID NO: 3374955 - RNA, 16 nt, Human
aacuaaauuguaaacu

SEQ ID NO: 3374956 - RNA, 14 nt, Human
aacuaaauuugaua

SEQ ID NO: 3374957 - RNA, 19 nt, Human
aacuaacacgugaugugau

SEQ ID NO: 3374958 - RNA, 20 nt, Human
aacuaacacgugaugugaua

SEQ ID NO: 3374959 - RNA, 11 nt, Human
aacuaacaugu

SEQ ID NO: 3374960 - RNA, 15 nt, Human
aacuaagaaacuuaa

SEQ ID NO: 3374961 - RNA, 22 nt, Human
aacuaagauucuuuuaaauuag

SEQ ID NO: 3374962 - RNA, 20 nt, Human
aacuaauaaaauauuuucug

SEQ ID NO: 3374963 - RNA, 21 nt, Human
aacuaauaaaauauuuucugu

SEQ ID NO: 3374964 - RNA, 23 nt, Human
aacuaauaaaauauuuucugugu

SEQ ID NO: 3374965 - RNA, 14 nt, Human
aacuaauaauugca

SEQ ID NO: 3374966 - RNA, 23 nt, Human
aacuaauccuucuggcagauuca

SEQ ID NO: 3374967 - RNA, 20 nt, Human
aacuaaucuauuggguucau

SEQ ID NO: 3374968 - RNA, 22 nt, Human
aacuaaucuauuggguucauua

SEQ ID NO: 3374969 - RNA, 13 nt, Human
aacuaaugaguuu

SEQ ID NO: 3374970 - RNA, 13 nt, Human
aacuacaaaucaa

SEQ ID NO: 3374971 - RNA, 22 nt, Human
aacuacaaccaagcucucugca

SEQ ID NO: 3374972 - RNA, 19 nt, Human
aacuacagaaaaaccagag

SEQ ID NO: 3374973 - RNA, 22 nt, Human
aacuacagaccugcuuuuugaa

SEQ ID NO: 3374974 - RNA, 14 nt, Human
aacuacagucuaaa

SEQ ID NO: 3374975 - RNA, 13 nt, Human
aacuacaguggcu

SEQ ID NO: 3374976 - RNA, 22 nt, Human
aacuacaugagaacaaacagau

SEQ ID NO: 3374977 - RNA, 13 nt, Human
aacuacauuuuaa

SEQ ID NO: 3374978 - RNA, 15 nt, Human
aacuacauuuuaaca

SEQ ID NO: 3374979 - RNA, 16 nt, Human
aacuacccaaaacaag

SEQ ID NO: 3374980 - RNA, 21 nt, Human
aacuacccuuaauuacuuaaa

SEQ ID NO: 3374981 - RNA, 20 nt, Human
aacuaccucgcaucauugca

SEQ ID NO: 3374982 - RNA, 23 nt, Human
aacuaccucgcaucauugcagau

SEQ ID NO: 3374983 - RNA, 15 nt, Human
aacuaccugagcuaa

SEQ ID NO: 3374984 - RNA, 19 nt, Human
aacuacgcuugcucauuuu

SEQ ID NO: 3374985 - RNA, 19 nt, Human
aacuacuccggagacaggg

SEQ ID NO: 3374986 - RNA, 13 nt, Human
aacuacucuuuga

SEQ ID NO: 3374987 - RNA, 16 nt, Human
aacuacucuuugauuu

SEQ ID NO: 3374988 - RNA, 21 nt, Human
aacuacugaaugaagcaguau

SEQ ID NO: 3374989 - RNA, 16 nt, Human
aacuacugcaccauuu

SEQ ID NO: 3374990 - RNA, 17 nt, Human
aacuacugccuuuagaa

SEQ ID NO: 3374991 - RNA, 13 nt, Human
aacuacuguguuc

SEQ ID NO: 3374992 - RNA, 13 nt, Human
aacuacuuuauaa

SEQ ID NO: 3374993 - RNA, 17 nt, Human
aacuacuuuauaacuaa

SEQ ID NO: 3374994 - RNA, 16 nt, Human
aacuagaaaucugcca

SEQ ID NO: 3374995 - RNA, 13 nt, Human
aacuagaacaaau

SEQ ID NO: 3374996 - RNA, 17 nt, Human
aacuagaacugaauuuu

SEQ ID NO: 3374997 - RNA, 19 nt, Human
aacuagaauuuauucaauu

SEQ ID NO: 3374998 - RNA, 15 nt, Human
aacuagaauuugauu

SEQ ID NO: 3374999 - RNA, 18 nt, Human
aacuagacauucugucgc

SEQ ID NO: 3375000 - RNA, 23 nt, Human
aacuagacucccaagcuggacua

SEQ ID NO: 3375001 - RNA, 22 nt, Human
aacuagagcagcccuggaguca

SEQ ID NO: 3375002 - RNA, 14 nt, Human
aacuagaugaccuc

SEQ ID NO: 3375003 - RNA, 18 nt, Human
aacuagaugaccucauua

SEQ ID NO: 3375004 - RNA, 14 nt, Human
aacuagauggugcu

SEQ ID NO: 3375005 - RNA, 14 nt, Human
aacuagcauaucug

SEQ ID NO: 3375006 - RNA, 19 nt, Human
aacuagcauaucugccuuu

SEQ ID NO: 3375007 - RNA, 18 nt, Human
aacuagccaaaccaggac

SEQ ID NO: 3375008 - RNA, 15 nt, Human
aacuagccaccaacu

SEQ ID NO: 3375009 - RNA, 20 nt, Human
aacuagcucuauguuuacaa

SEQ ID NO: 3375010 - RNA, 23 nt, Human
aacuagcuggaauuuuuuauucu

SEQ ID NO: 3375011 - RNA, 18 nt, Human
aacuagcuuggaaacugg

SEQ ID NO: 3375012 - RNA, 12 nt, Human
aacuaggaaaau

SEQ ID NO: 3375013 - RNA, 15 nt, Human
aacuaggaaaauugg

SEQ ID NO: 3375014 - RNA, 15 nt, Human
aacuaggcauuugua

SEQ ID NO: 3375015 - RNA, 23 nt, Human
aacuaggcauuuguaaauauuaa

SEQ ID NO: 3375016 - RNA, 22 nt, Human
aacuaggucugauauucaaaug

SEQ ID NO: 3375017 - RNA, 17 nt, Human
aacuaguaguucucuug

SEQ ID NO: 3375018 - RNA, 23 nt, Human
aacuagugggguuuccuggcacu

SEQ ID NO: 3375019 - RNA, 14 nt, Human
aacuaguuuuguuu

SEQ ID NO: 3375020 - RNA, 15 nt, Human
aacuaguuuuguuua

SEQ ID NO: 3375021 - RNA, 17 nt, Human
aacuauacuugaacaaa

SEQ ID NO: 3375022 - RNA, 14 nt, Human
aacuauaugugaau

SEQ ID NO: 3375023 - RNA, 20 nt, Human
aacuauauucauuuccacuc

SEQ ID NO: 3375024 - RNA, 16 nt, Human
aacuauauuuucuuua

SEQ ID NO: 3375025 - RNA, 16 nt, Human
aacuauauuuugucau

SEQ ID NO: 3375026 - RNA, 17 nt, Human
aacuaugcauggugccc

SEQ ID NO: 3375027 - RNA, 22 nt, Human
aacuaugcauggugccccagga

SEQ ID NO: 3375028 - RNA, 12 nt, Human
aacuauggccug

SEQ ID NO: 3375029 - RNA, 13 nt, Human
aacuauguacaau

SEQ ID NO: 3375030 - RNA, 16 nt, Human
aacuauguacaauauu

SEQ ID NO: 3375031 - RNA, 20 nt, Human
aacuauguguuuuucucaua

SEQ ID NO: 3375032 - RNA, 15 nt, Human
aacuauguugauaaa

SEQ ID NO: 3375033 - RNA, 17 nt, Human
aacuauguuuaaaguaa

SEQ ID NO: 3375034 - RNA, 22 nt, Human
aacuauuaagaggcagaaaauu

SEQ ID NO: 3375035 - RNA, 24 nt, Human
aacuauuaaggauguagcuuuuca

SEQ ID NO: 3375036 - RNA, 22 nt, Human
aacuauuacaccaaauaaauau

SEQ ID NO: 3375037 - RNA, 13 nt, Human
aacuauucacaaa

SEQ ID NO: 3375038 - RNA, 15 nt, Human
aacuauugcauuuau

SEQ ID NO: 3375039 - RNA, 14 nt, Human
aacuauugcccagg

SEQ ID NO: 3375040 - RNA, 15 nt, Human
aacuauuuaaagaaa

SEQ ID NO: 3375041 - RNA, 19 nt, Human
aaccuugccugguacagua

SEQ ID NO: 3375042 - RNA, 23 nt, Human
aaccuugccuuucucgauuuuau

SEQ ID NO: 3375043 - RNA, 13 nt, Human
aaccuugcugucc

SEQ ID NO: 3375044 - RNA, 18 nt, Human
aaccuugguguaguugaa

SEQ ID NO: 3375045 - RNA, 21 nt, Human
aaccuugugccuggcucagag

SEQ ID NO: 3375046 - RNA, 19 nt, Human
aagaacauggacuuguaua

SEQ ID NO: 3375047 - RNA, 21 nt, Human
aagaacauggacuuguauauu

SEQ ID NO: 3375048 - RNA, 17 nt, Human
aagaaccagucccccca

SEQ ID NO: 3375049 - RNA, 13 nt, Human
aagaaccuggaaa

SEQ ID NO: 3375050 - RNA, 14 nt, Human
aagaacggaagaag

SEQ ID NO: 3375051 - RNA, 17 nt, Human
aagaacggggcucuucu

SEQ ID NO: 3375052 - RNA, 22 nt, Human
aagaacggggcucuucucauuu

SEQ ID NO: 3375053 - RNA, 23 nt, Human
aagaacuauaugugaauccucuu

SEQ ID NO: 3375054 - RNA, 16 nt, Human
aagaacucaucacugu

SEQ ID NO: 3375055 - RNA, 20 nt, Human
aagaacucaucacuguggcu

SEQ ID NO: 3375056 - RNA, 14 nt, Human
aagaacucucugga

SEQ ID NO: 3375057 - RNA, 13 nt, Human
aagaacugaaauc

SEQ ID NO: 3375058 - RNA, 15 nt, Human
aagaacugaaaucau

SEQ ID NO: 3375059 - RNA, 19 nt, Human
aagaacugcacaugaagaa

SEQ ID NO: 3375060 - RNA, 22 nt, Human
aagaacugcaggcccuggccuc

SEQ ID NO: 3375061 - RNA, 12 nt, Human
aagaacugcuuu

SEQ ID NO: 3375062 - RNA, 20 nt, Human
aagaacugucauguaaacau

SEQ ID NO: 3375063 - RNA, 21 nt, Human
aagaacuguuuacugcuugau

SEQ ID NO: 3375064 - RNA, 17 nt, Human
aagaacuucuauaauug

SEQ ID NO: 3375065 - RNA, 20 nt, Human
aagaacuuugagcuacugcc

SEQ ID NO: 3375066 - RNA, 13 nt, Human
aagaagaaaaaaa

SEQ ID NO: 3375067 - RNA, 14 nt, Human
aagaagaaaaaaac

SEQ ID NO: 3375068 - RNA, 14 nt, Human
aagaagaaaaaggu

SEQ ID NO: 3375069 - RNA, 13 nt, Human
aagaagaaaacac

SEQ ID NO: 3375070 - RNA, 9 nt, Human
aagaagaag

SEQ ID NO: 3375071 - RNA, 15 nt, Human
aagaagaagaaaaga

SEQ ID NO: 3375072 - RNA, 16 nt, Human
aagaagacaaacuuug

SEQ ID NO: 3375073 - RNA, 16 nt, Human
aagaagacaugaacca

SEQ ID NO: 3375074 - RNA, 21 nt, Human
aagaagaccugagaauguauc

SEQ ID NO: 3375075 - RNA, 14 nt, Human
aagaagagaaagaa

SEQ ID NO: 3375076 - RNA, 18 nt, Human
aagaagagaagcugcuga

SEQ ID NO: 3375077 - RNA, 19 nt, Human
aagaagagcgagagaucaa

SEQ ID NO: 3375078 - RNA, 20 nt, Human
aagaagagcuaucaggagaa

SEQ ID NO: 3375079 - RNA, 13 nt, Human
aagaagagggaga

SEQ ID NO: 3375080 - RNA, 17 nt, Human
aagaagaucacgcuccc

SEQ ID NO: 3375081 - RNA, 22 nt, Human
aagaagaucacgcuccccgccu

SEQ ID NO: 3375082 - RNA, 15 nt, Human
aagaagaugaauggc

SEQ ID NO: 3375083 - RNA, 17 nt, Human
aagaagauguugaagaa

SEQ ID NO: 3375084 - RNA, 22 nt, Human
aagaagcaccaaucaugaauua

SEQ ID NO: 3375085 - RNA, 13 nt, Human
aagaagcagagag

SEQ ID NO: 3375086 - RNA, 14 nt, Human
aagaagcaggcuac

SEQ ID NO: 3375087 - RNA, 19 nt, Human
aagaagcaggcuacacuga

SEQ ID NO: 3375088 - RNA, 12 nt, Human
aagaagcauuuc

SEQ ID NO: 3375089 - RNA, 16 nt, Human
aagaagcccaggaaag

SEQ ID NO: 3375090 - RNA, 17 nt, Human
aagaagccgggaacaga

SEQ ID NO: 3375091 - RNA, 22 nt, Human
aagaagccuguaacacuccucu

SEQ ID NO: 3375092 - RNA, 17 nt, Human
aagaagcuguuguacau

SEQ ID NO: 3375093 - RNA, 18 nt, Human
aagaagcuguuguacauu

SEQ ID NO: 3375094 - RNA, 19 nt, Human
aagaagcuguuguacauuu

SEQ ID NO: 3375095 - RNA, 18 nt, Human
aagaagcuucuaauaaau

SEQ ID NO: 3375096 - RNA, 21 nt, Human
aagaagcuucuaauaaauuau

SEQ ID NO: 3375097 - RNA, 16 nt, Human
aagaaggaaaaugauc

SEQ ID NO: 3375098 - RNA, 13 nt, Human
aagaaaaagaaaa

SEQ ID NO: 3375099 - RNA, 13 nt, Human
aagaaaaagcaaa

SEQ ID NO: 3375100 - RNA, 11 nt, Human
aagaaaaauau

SEQ ID NO: 3375101 - RNA, 17 nt, Human
aagaaaaaugagccugg

SEQ ID NO: 3375102 - RNA, 22 nt, Human
aagaaaacaaaaccaaaaguua

SEQ ID NO: 3375103 - RNA, 13 nt, Human
aagaaaacacugu

SEQ ID NO: 3375104 - RNA, 13 nt, Human
aagaaaacaucua

SEQ ID NO: 3375105 - RNA, 18 nt, Human
aagaaaacaucuauucuc

SEQ ID NO: 3375106 - RNA, 13 nt, Human
aagaaaacaucuu

SEQ ID NO: 3375107 - RNA, 20 nt, Human
aagaaaaccaccccuuagau

SEQ ID NO: 3375108 - RNA, 12 nt, Human
aagaaaagaauc

SEQ ID NO: 3375109 - RNA, 13 nt, Human
aagaaaagaccuu

SEQ ID NO: 3375110 - RNA, 15 nt, Human
aagaaaagauaaaga

SEQ ID NO: 3375111 - RNA, 13 nt, Human
aagaaaagaugaa

SEQ ID NO: 3375112 - RNA, 22 nt, Human
aagaaaagauuuuaaucaaguu

SEQ ID NO: 3375113 - RNA, 19 nt, Human
aagaaaagggucaaacauc

SEQ ID NO: 3375114 - RNA, 22 nt, Human
aagaaaagguucuuacugcuug

SEQ ID NO: 3375115 - RNA, 15 nt, Human
aagaaaaguauuuug

SEQ ID NO: 3375116 - RNA, 16 nt, Human
aagaaaaguauuuuga

SEQ ID NO: 3375117 - RNA, 22 nt, Human
aagaaaagugcauauuuaucca

SEQ ID NO: 3375118 - RNA, 16 nt, Human
aagaaaaguuuuguaa

SEQ ID NO: 3375119 - RNA, 21 nt, Human
aagaaaauaaaaaaaagaaaa

SEQ ID NO: 3375120 - RNA, 17 nt, Human
aagaaaauacaauaaac

SEQ ID NO: 3375121 - RNA, 16 nt, Human
aagaaaauacuuaaau

SEQ ID NO: 3375122 - RNA, 13 nt, Human
aagaaaaucacuu

SEQ ID NO: 3375123 - RNA, 14 nt, Human
aagaaaauugaguu

SEQ ID NO: 3375124 - RNA, 22 nt, Human
aagaaaauuuuuguaguagcgu

SEQ ID NO: 3375125 - RNA, 14 nt, Human
aagaaacaacagaa

SEQ ID NO: 3375126 - RNA, 12 nt, Human
aagaaacacuga

SEQ ID NO: 3375127 - RNA, 14 nt, Human
aagaaacagccagc

SEQ ID NO: 3375128 - RNA, 16 nt, Human
aagaaacccgacagag

SEQ ID NO: 3375129 - RNA, 16 nt, Human
aagaaaccuacugccc

SEQ ID NO: 3375130 - RNA, 21 nt, Human
aagaaacgucuauguguacag

SEQ ID NO: 3375131 - RNA, 17 nt, Human
aagaaacuauacaucau

SEQ ID NO: 3375132 - RNA, 20 nt, Human
aagaaacugaggaauuuucu

SEQ ID NO: 3375133 - RNA, 17 nt, Human
aagaaacuuguccuucc

SEQ ID NO: 3375134 - RNA, 17 nt, Human
aagaaacuuuuguaaag

SEQ ID NO: 3375135 - RNA, 18 nt, Human
aagaaacuuuuguaaaga

SEQ ID NO: 3375136 - RNA, 14 nt, Human
aagaaacuuuuuua

SEQ ID NO: 3375137 - RNA, 14 nt, Human
aagaaagaaaauca

SEQ ID NO: 3375138 - RNA, 16 nt, Human
aagaaagaaaaucagg

SEQ ID NO: 3375139 - RNA, 22 nt, Human
aagaaagaauguuacugccuua

SEQ ID NO: 3375140 - RNA, 16 nt, Human
aagaaagacgcacuuu

SEQ ID NO: 3375141 - RNA, 20 nt, Human
aagaaagacuaucuaaaugu

SEQ ID NO: 3375142 - RNA, 22 nt, Human
aagaaagacuaucuaaauguug

SEQ ID NO: 3375143 - RNA, 13 nt, Human
aagaaagacucua

SEQ ID NO: 3375144 - RNA, 16 nt, Human
aagaaagagagaaaau

SEQ ID NO: 3375145 - RNA, 17 nt, Human
aagaaagauguauauag

SEQ ID NO: 3375146 - RNA, 14 nt, Human
aagaaagcaacuuu

SEQ ID NO: 3375147 - RNA, 19 nt, Human
aagaaagcccuuaggaaga

SEQ ID NO: 3375148 - RNA, 17 nt, Human
aagaaagcugguaaacu

SEQ ID NO: 3375149 - RNA, 16 nt, Human
aagaaaggaaaagaaa

SEQ ID NO: 3375150 - RNA, 20 nt, Human
aagaaaggcugcuguacuga

SEQ ID NO: 3375151 - RNA, 20 nt, Human
aagaaaggcuguuaaauaca

SEQ ID NO: 3375152 - RNA, 17 nt, Human
aagaaaggguucuguaa

SEQ ID NO: 3375153 - RNA, 13 nt, Human
aagaaaguccacc

SEQ ID NO: 3375154 - RNA, 23 nt, Human
aagaaagucuaucuaaugacaug

SEQ ID NO: 3375155 - RNA, 22 nt, Human
aagaaagugagcaguguuagcu

SEQ ID NO: 3375156 - RNA, 20 nt, Human
aagaaaguugcacggcugcu

SEQ ID NO: 3375157 - RNA, 17 nt, Human
aagaaauaaaccaaagg

SEQ ID NO: 3375158 - RNA, 15 nt, Human
aagaaauaaguuuuu

SEQ ID NO: 3375159 - RNA, 12 nt, Human
aagaaauaauaa

SEQ ID NO: 3375160 - RNA, 18 nt, Human
aagaaauaauaauaucca

SEQ ID NO: 3375161 - RNA, 14 nt, Human
aagaaauaauagaa

SEQ ID NO: 3375162 - RNA, 12 nt, Human
aagaaauagaau

SEQ ID NO: 3375163 - RNA, 13 nt, Human
aagaaauauaccu

SEQ ID NO: 3375164 - RNA, 12 nt, Human
aagaaauaucug

SEQ ID NO: 3375165 - RNA, 17 nt, Human
aagaaauaucugugaaa

SEQ ID NO: 3375166 - RNA, 13 nt, Human
aagaaauauguga

SEQ ID NO: 3375167 - RNA, 15 nt, Human
aagaaauaugugaga

SEQ ID NO: 3375168 - RNA, 19 nt, Human
aagaaauaugugagauuuu

SEQ ID NO: 3375169 - RNA, 23 nt, Human
aagaaaucauguccauacacuuu

SEQ ID NO: 3375170 - RNA, 13 nt, Human
aagaaaucccugu

SEQ ID NO: 3375171 - RNA, 14 nt, Human
aagaaaucccuguu

SEQ ID NO: 3375172 - RNA, 16 nt, Human
aagaaaugaaauuuua

SEQ ID NO: 3375173 - RNA, 18 nt, Human
aagaaaugaaauuuuacc

SEQ ID NO: 3375174 - RNA, 13 nt, Human
aagaaaugauguu

SEQ ID NO: 3375175 - RNA, 23 nt, Human
aagaaaugauguuggagaaggga

SEQ ID NO: 3375176 - RNA, 14 nt, Human
aagaaaugcacaau

SEQ ID NO: 3375177 - RNA, 16 nt, Human
aagaaauguaguugau

SEQ ID NO: 3375178 - RNA, 21 nt, Human
aagaaauuagggcucuaauuu

SEQ ID NO: 3375179 - RNA, 14 nt, Human
aagaaauuccugua

SEQ ID NO: 3375180 - RNA, 18 nt, Human
aagaaauuuauuacuugu

SEQ ID NO: 3375181 - RNA, 21 nt, Human
aagaaauuuccacucaggucu

SEQ ID NO: 3375182 - RNA, 16 nt, Human
aagaaauuugauuucu

SEQ ID NO: 3375183 - RNA, 21 nt, Human
aagaacaauauugacuuuguc

SEQ ID NO: 3375184 - RNA, 19 nt, Human
aagaacacacacauauaca

SEQ ID NO: 3375185 - RNA, 19 nt, Human
aagaacacccuauauuuug

SEQ ID NO: 3375186 - RNA, 16 nt, Human
aagaacacccucuaaa

SEQ ID NO: 3375187 - RNA, 12 nt, Human
aagaacauagaa

SEQ ID NO: 3375188 - RNA, 18 nt, Human
aagaacauccaaggagaa

SEQ ID NO: 3375189 - RNA, 16 nt, Human
aagaacaugcaguuug

SEQ ID NO: 3375190 - RNA, 19 nt, Human
aagaacaugcaguuugaaa

SEQ ID NO: 3375191 - RNA, 20 nt, Human
aagaacaugcaguuugaaau

SEQ ID NO: 3375192 - RNA, 17 nt, Human
aagaauugccagucuuu

SEQ ID NO: 3375193 - RNA, 15 nt, Human
aagaauuuagggaga

SEQ ID NO: 3375194 - RNA, 20 nt, Human
aagaauuugaagacuucaaa

SEQ ID NO: 3375195 - RNA, 13 nt, Human
aagaauuuuaaaa

SEQ ID NO: 3375196 - RNA, 15 nt, Human
aagaauuuuaaaaau

SEQ ID NO: 3375197 - RNA, 17 nt, Human
aagaauuuuaaaaauga

SEQ ID NO: 3375198 - RNA, 18 nt, Human
aagaauuuuaaaaaugaa

SEQ ID NO: 3375199 - RNA, 13 nt, Human
aagaauuuuuuug

SEQ ID NO: 3375200 - RNA, 20 nt, Human
aagacaaaaagcuacuuauu

SEQ ID NO: 3375201 - RNA, 23 nt, Human
aagacaaaaagcuacuuauugua

SEQ ID NO: 3375202 - RNA, 14 nt, Human
aagacaaaaauacu

SEQ ID NO: 3375203 - RNA, 22 nt, Human
aagacaaaaauacucuaauucu

SEQ ID NO: 3375204 - RNA, 14 nt, Human
aagacaaaagucug

SEQ ID NO: 3375205 - RNA, 14 nt, Human
aagacaaacugcau

SEQ ID NO: 3375206 - RNA, 15 nt, Human
aagacaaacuuugca

SEQ ID NO: 3375207 - RNA, 13 nt, Human
aagacaaauagua

SEQ ID NO: 3375208 - RNA, 20 nt, Human
aagacaaauauuccuuugca

SEQ ID NO: 3375209 - RNA, 12 nt, Human
aagacaacauua

SEQ ID NO: 3375210 - RNA, 21 nt, Human
aagacaacauuaaaacaauau

SEQ ID NO: 3375211 - RNA, 17 nt, Human
aagacaacauuguaaga

SEQ ID NO: 3375212 - RNA, 21 nt, Human
aagacaaggaaaaaauaacaa

SEQ ID NO: 3375213 - RNA, 22 nt, Human
aagacaauagcacuuaaauucc

SEQ ID NO: 3375214 - RNA, 13 nt, Human
aagacaauauaau

SEQ ID NO: 3375215 - RNA, 23 nt, Human
aagacaauggcuuacuccaggag

SEQ ID NO: 3375216 - RNA, 22 nt, Human
aagacaaugugaaaagaaaaau

SEQ ID NO: 3375217 - RNA, 12 nt, Human
aagacaauucuu

SEQ ID NO: 3375218 - RNA, 17 nt, Human
aagacaauuugauacau

SEQ ID NO: 3375219 - RNA, 19 nt, Human
aagacaauuugauacauaa

SEQ ID NO: 3375220 - RNA, 14 nt, Human
aagacaccagagca

SEQ ID NO: 3375221 - RNA, 21 nt, Human
aagacaccagagcagaugcag

SEQ ID NO: 3375222 - RNA, 23 nt, Human
aagacaccagagcagaugcagag

SEQ ID NO: 3375223 - RNA, 14 nt, Human
aagacaccugguug

SEQ ID NO: 3375224 - RNA, 14 nt, Human
aagacacugaaaua

SEQ ID NO: 3375225 - RNA, 16 nt, Human
aagacacugccugggc

SEQ ID NO: 3375226 - RNA, 16 nt, Human
aagacagaaguuugca

SEQ ID NO: 3375227 - RNA, 20 nt, Human
aagacagaugccccagagcu

SEQ ID NO: 3375228 - RNA, 15 nt, Human
aagacagcagaacug

SEQ ID NO: 3375229 - RNA, 21 nt, Human
aagacagcccgauccuccccu

SEQ ID NO: 3375230 - RNA, 18 nt, Human
aagacaggaaaguucaga

SEQ ID NO: 3375231 - RNA, 21 nt, Human
aagacaggaaaguucagaguu

SEQ ID NO: 3375232 - RNA, 14 nt, Human
aagacaggagacaa

SEQ ID NO: 3375233 - RNA, 19 nt, Human
aagacaggagagauuauuu

SEQ ID NO: 3375234 - RNA, 22 nt, Human
aagacaggaugggggcuggccu

SEQ ID NO: 3375235 - RNA, 23 nt, Human
aagacagugaaagaaaauaacaa

SEQ ID NO: 3375236 - RNA, 20 nt, Human
aagacaguguauguagaagc

SEQ ID NO: 3375237 - RNA, 21 nt, Human
aagacaguguauguagaagca

SEQ ID NO: 3375238 - RNA, 21 nt, Human
aagacauaacguuuuuccuuu

SEQ ID NO: 3375239 - RNA, 17 nt, Human
aagacauccauaaagaa

SEQ ID NO: 3375240 - RNA, 20 nt, Human
aagacaugauuuccuugaau

SEQ ID NO: 3375241 - RNA, 19 nt, Human
aagacaugcacuaugagga

SEQ ID NO: 3375242 - RNA, 13 nt, Human
aagacaugucugu

SEQ ID NO: 3375243 - RNA, 19 nt, Human
aagacaugucuguucuaca

SEQ ID NO: 3375244 - RNA, 19 nt, Human
aagacauguuguaaauuag

SEQ ID NO: 3375245 - RNA, 17 nt, Human
aagacauguuuuagaca

SEQ ID NO: 3375246 - RNA, 16 nt, Human
aagacauucaggacug

SEQ ID NO: 3375247 - RNA, 18 nt, Human
aagacauugggucuauuc

SEQ ID NO: 3375248 - RNA, 23 nt, Human
aagacauugggucuauuccagcu

SEQ ID NO: 3375249 - RNA, 17 nt, Human
aagaccaccucaaauuu

SEQ ID NO: 3375250 - RNA, 17 nt, Human
aagaccacguuucuaaa

SEQ ID NO: 3375251 - RNA, 14 nt, Human
aagaccagccuggc

SEQ ID NO: 3375252 - RNA, 16 nt, Human
aagaccccaagaggaa

SEQ ID NO: 3375253 - RNA, 13 nt, Human
aagacccuccccg

SEQ ID NO: 3375254 - RNA, 16 nt, Human
aagacccucuugccca

SEQ ID NO: 3375255 - RNA, 14 nt, Human
aagacccuggcuuu

SEQ ID NO: 3375256 - RNA, 18 nt, Human
aagaccggaagcuccugg

SEQ ID NO: 3375257 - RNA, 19 nt, Human
aagaccggaagcuccuggu

SEQ ID NO: 3375258 - RNA, 20 nt, Human
aagaccuacuguucuaaagc

SEQ ID NO: 3375259 - RNA, 17 nt, Human
aagaccuguugguucca

SEQ ID NO: 3375260 - RNA, 19 nt, Human
aagaccuguugguuccaag

SEQ ID NO: 3375261 - RNA, 21 nt, Human
aagaccuucuccaaaugagau

SEQ ID NO: 3375262 - RNA, 23 nt, Human
aagaccuugcuuaugauugcaga

SEQ ID NO: 3375263 - RNA, 23 nt, Human
aagacguguuuguguuugugugu

SEQ ID NO: 3375264 - RNA, 18 nt, Human
aagacguuuuauaagcau

SEQ ID NO: 3375265 - RNA, 12 nt, Human
aagacuaaaagu

SEQ ID NO: 3375266 - RNA, 21 nt, Human
aagacuagaaaauuagacugu

SEQ ID NO: 3375267 - RNA, 14 nt, Human
aagacuauauauau

SEQ ID NO: 3375268 - RNA, 20 nt, Human
aagacuauauauauaaaugu

SEQ ID NO: 3375269 - RNA, 22 nt, Human
aagacuaucuuacuauuucaca

SEQ ID NO: 3375270 - RNA, 18 nt, Human
aagacucaaauguucuaa

SEQ ID NO: 3375271 - RNA, 23 nt, Human
aagacucaagugggaacgacugg

SEQ ID NO: 3375272 - RNA, 12 nt, Human
aagacucauccg

SEQ ID NO: 3375273 - RNA, 17 nt, Human
aagacucauucccuaga

SEQ ID NO: 3375274 - RNA, 12 nt, Human
aagacuccagaa

SEQ ID NO: 3375275 - RNA, 19 nt, Human
aagacucuagaguccaagg

SEQ ID NO: 3375276 - RNA, 21 nt, Human
aagacucuagaguccaagguu

SEQ ID NO: 3375277 - RNA, 23 nt, Human
aagacugaguacguugugcauuu

SEQ ID NO: 3375278 - RNA, 20 nt, Human
aagacugcuguggccaggag

SEQ ID NO: 3375279 - RNA, 23 nt, Human
aagacuggaagcuaauuugcauu

SEQ ID NO: 3375280 - RNA, 15 nt, Human
aagacugguuuucug

SEQ ID NO: 3375281 - RNA, 13 nt, Human
aagacuguaauga

SEQ ID NO: 3375282 - RNA, 17 nt, Human
aagacuguacaaaguag

SEQ ID NO: 3375283 - RNA, 19 nt, Human
aagacugucuuaauuugca

SEQ ID NO: 3375284 - RNA, 12 nt, Human
aagacuguggcu

SEQ ID NO: 3375285 - RNA, 17 nt, Human
aagacuguugcucaaau

SEQ ID NO: 3375286 - RNA, 24 nt, Human
aagacuguugcucaaaucuauuca

SEQ ID NO: 3375287 - RNA, 20 nt, Human
aagacuucaguauguuguca

SEQ ID NO: 3375288 - RNA, 18 nt, Human
aagacuuccaaagaaugu

SEQ ID NO: 3375289 - RNA, 19 nt, Human
aagacuucucuuugccuca

SEQ ID NO: 3375290 - RNA, 20 nt, Human
aagacuugcauuuaaaugug

SEQ ID NO: 3375291 - RNA, 17 nt, Human
aagacuuggcaacagaa

SEQ ID NO: 3375292 - RNA, 20 nt, Human
aagacuuggcaacagaagca

SEQ ID NO: 3375293 - RNA, 23 nt, Human
aagacuugguugguaggguggga

SEQ ID NO: 3375294 - RNA, 16 nt, Human
aagacuuuggaaagag

SEQ ID NO: 3375295 - RNA, 15 nt, Human
aagacuuugguuauu

SEQ ID NO: 3375296 - RNA, 14 nt, Human
aagagaaaagaaaa

SEQ ID NO: 3375297 - RNA, 12 nt, Human
aagagaaacuuu

SEQ ID NO: 3375298 - RNA, 22 nt, Human
aagagaaacuuuauacauuagu

SEQ ID NO: 3375299 - RNA, 17 nt, Human
aagagaaaggccugcac

SEQ ID NO: 3375300 - RNA, 16 nt, Human
aagagaaccgagcaaa

SEQ ID NO: 3375301 - RNA, 13 nt, Human
aagagaagaagaa

SEQ ID NO: 3375302 - RNA, 14 nt, Human
aagagaagaagaaa

SEQ ID NO: 3375303 - RNA, 16 nt, Human
aagagaagacgaaaua

SEQ ID NO: 3375304 - RNA, 16 nt, Human
aagagaagcugcugac

SEQ ID NO: 3375305 - RNA, 18 nt, Human
aagagaagcugcugacca

SEQ ID NO: 3375306 - RNA, 20 nt, Human
aagagaauauuagcuuuacu

SEQ ID NO: 3375307 - RNA, 20 nt, Human
aagagaauauuuuaaguauu

SEQ ID NO: 3375308 - RNA, 22 nt, Human
aagagaauauuuuaaguauugc

SEQ ID NO: 3375309 - RNA, 16 nt, Human
aagagaaugaguccuu

SEQ ID NO: 3375310 - RNA, 13 nt, Human
aagagaauguaga

SEQ ID NO: 3375311 - RNA, 21 nt, Human
aagagacaaacaccucccagg

SEQ ID NO: 3375312 - RNA, 19 nt, Human
aagagacacucagaccaga

SEQ ID NO: 3375313 - RNA, 18 nt, Human
aagagacagaauguaucu

SEQ ID NO: 3375314 - RNA, 20 nt, Human
aagagacagucaccccagga

SEQ ID NO: 3375315 - RNA, 21 nt, Human
aagagacagucaccccaggac

SEQ ID NO: 3375316 - RNA, 22 nt, Human
aagagacagucaccccaggacu

SEQ ID NO: 3375317 - RNA, 14 nt, Human
aagagacagugaua

SEQ ID NO: 3375318 - RNA, 15 nt, Human
aagagacauccaaau

SEQ ID NO: 3375319 - RNA, 16 nt, Human
aagagaccuaccucag

SEQ ID NO: 3375320 - RNA, 12 nt, Human
aagagacucagc

SEQ ID NO: 3375321 - RNA, 14 nt, Human
aagagacuggagca

SEQ ID NO: 3375322 - RNA, 15 nt, Human
aagagagaaaauaaa

SEQ ID NO: 3375323 - RNA, 18 nt, Human
aagagagaaaauaaaaag

SEQ ID NO: 3375324 - RNA, 22 nt, Human
aagagagaaaauaaaaaguuaa

SEQ ID NO: 3375325 - RNA, 23 nt, Human
aagagagaaaauaaaaaguuaaa

SEQ ID NO: 3375326 - RNA, 20 nt, Human
aagagagaaagcauauugac

SEQ ID NO: 3375327 - RNA, 13 nt, Human
aagagagaaaucu

SEQ ID NO: 3375328 - RNA, 18 nt, Human
aagagagaaccuaacugu

SEQ ID NO: 3375329 - RNA, 20 nt, Human
aagagagagaaacaaacuuu

SEQ ID NO: 3375330 - RNA, 16 nt, Human
aagagagauauaucug

SEQ ID NO: 3375331 - RNA, 17 nt, Human
aagagagauauaucuga

SEQ ID NO: 3375332 - RNA, 20 nt, Human
aagagagauauaucugaaaa

SEQ ID NO: 3375333 - RNA, 22 nt, Human
aagagagccuugguucaucagu

SEQ ID NO: 3375334 - RNA, 18 nt, Human
aagagaggagaggagaga

SEQ ID NO: 3375335 - RNA, 16 nt, Human
aaaaugaaaauuguau

SEQ ID NO: 3375336 - RNA, 19 nt, Human
aaaaugaaagcaugucuca

SEQ ID NO: 3375337 - RNA, 14 nt, Human
aaaaugaaagcuac

SEQ ID NO: 3375338 - RNA, 19 nt, Human
aaaaugaaagcuacucaua

SEQ ID NO: 3375339 - RNA, 18 nt, Human
aaaaugaaaugcauauuu

SEQ ID NO: 3375340 - RNA, 14 nt, Human
aaaaugaagaauuu

SEQ ID NO: 3375341 - RNA, 12 nt, Human
aaaaugaagauu

SEQ ID NO: 3375342 - RNA, 22 nt, Human
aaaaugaauaucuauuaauaua

SEQ ID NO: 3375343 - RNA, 23 nt, Human
aaaaugaaugaggucugggcuag

SEQ ID NO: 3375344 - RNA, 14 nt, Human
aaaaugacaaucau

SEQ ID NO: 3375345 - RNA, 17 nt, Human
aaaaugacagauguuga

SEQ ID NO: 3375346 - RNA, 18 nt, Human
aaaaugacagauguugaa

SEQ ID NO: 3375347 - RNA, 15 nt, Human
aaaaugacaucuuuu

SEQ ID NO: 3375348 - RNA, 21 nt, Human
aaaaugacuaaaaauauuaua

SEQ ID NO: 3375349 - RNA, 19 nt, Human
aaaaugacuacuuagcauc

SEQ ID NO: 3375350 - RNA, 11 nt, Human
aaaaugagaaa

SEQ ID NO: 3375351 - RNA, 18 nt, Human
aaaaugagcauacaucuu

SEQ ID NO: 3375352 - RNA, 22 nt, Human
aaaaugagccgugccaaagucu

SEQ ID NO: 3375353 - RNA, 21 nt, Human
aaaaugagccuggcaagaaug

SEQ ID NO: 3375354 - RNA, 23 nt, Human
aaaaugagcucgcauuugucaau

SEQ ID NO: 3375355 - RNA, 18 nt, Human
aaaaugaggaauguauau

SEQ ID NO: 3375356 - RNA, 21 nt, Human
aaaaugaguuaccuacauuuu

SEQ ID NO: 3375357 - RNA, 23 nt, Human
aaaaugauguguacccaaacgug

SEQ ID NO: 3375358 - RNA, 19 nt, Human
aaaaugauuguaaaauagc

SEQ ID NO: 3375359 - RNA, 18 nt, Human
aaaaugcaacaacaugua

SEQ ID NO: 3375360 - RNA, 11 nt, Human
aaaaugcaaua

SEQ ID NO: 3375361 - RNA, 18 nt, Human
aaaaugcagcagggaugc

SEQ ID NO: 3375362 - RNA, 15 nt, Human
aaaaugccaaucucu

SEQ ID NO: 3375363 - RNA, 15 nt, Human
aaaaugccauaauac

SEQ ID NO: 3375364 - RNA, 17 nt, Human
aaaaugccauaauacaa

SEQ ID NO: 3375365 - RNA, 18 nt, Human
aaaaugccauaauacaaa

SEQ ID NO: 3375366 - RNA, 16 nt, Human
aaaaugccaugaauua

SEQ ID NO: 3375367 - RNA, 19 nt, Human
aaaaugccucaguguauuu

SEQ ID NO: 3375368 - RNA, 14 nt, Human
aaaaugccuuugag

SEQ ID NO: 3375369 - RNA, 16 nt, Human
aaaaugcuaauauuaa

SEQ ID NO: 3375370 - RNA, 20 nt, Human
aaaaugcucuuauuucauca

SEQ ID NO: 3375371 - RNA, 15 nt, Human
aaaaugcugaacauu

SEQ ID NO: 3375372 - RNA, 18 nt, Human
aaaaugcugaacauugca

SEQ ID NO: 3375373 - RNA, 13 nt, Human
aaaaugcuuuuua

SEQ ID NO: 3375374 - RNA, 20 nt, Human
aaaauggaagccaacacauc

SEQ ID NO: 3375375 - RNA, 21 nt, Human
aaaauggacguguuaugacuc

SEQ ID NO: 3375376 - RNA, 16 nt, Human
aaaauggagguggaaa

SEQ ID NO: 3375377 - RNA, 14 nt, Human
aaaauggauacaua

SEQ ID NO: 3375378 - RNA, 14 nt, Human
aaaaugggagaucu

SEQ ID NO: 3375379 - RNA, 17 nt, Human
aaaaugguaaaauugca

SEQ ID NO: 3375380 - RNA, 18 nt, Human
aaaaugguaucaaaauua

SEQ ID NO: 3375381 - RNA, 20 nt, Human
aaaaugguguuuucauguaa

SEQ ID NO: 3375382 - RNA, 23 nt, Human
aaaaugguguuuucauguaaaua

SEQ ID NO: 3375383 - RNA, 16 nt, Human
aaaaugguuuaaaugg

SEQ ID NO: 3375384 - RNA, 14 nt, Human
aaaauguaaagcca

SEQ ID NO: 3375385 - RNA, 15 nt, Human
aaaauguaacuguua

SEQ ID NO: 3375386 - RNA, 21 nt, Human
aaaauguaagcuguuuauuuu

SEQ ID NO: 3375387 - RNA, 14 nt, Human
aaaauguacaugua

SEQ ID NO: 3375388 - RNA, 16 nt, Human
aaaauguacauguauu

SEQ ID NO: 3375389 - RNA, 18 nt, Human
aaaauguacauguauuaa

SEQ ID NO: 3375390 - RNA, 22 nt, Human
aaaauguacauguauuaaauua

SEQ ID NO: 3375391 - RNA, 18 nt, Human
aaaauguacugagauuuu

SEQ ID NO: 3375392 - RNA, 14 nt, Human
aaaauguauauauu

SEQ ID NO: 3375393 - RNA, 20 nt, Human
aaaauguaugcauguugucu

SEQ ID NO: 3375394 - RNA, 15 nt, Human
aaaauguaugucugg

SEQ ID NO: 3375395 - RNA, 18 nt, Human
aaaauguauguguaagua

SEQ ID NO: 3375396 - RNA, 11 nt, Human
aaaauguauuu

SEQ ID NO: 3375397 - RNA, 17 nt, Human
aaaauguauuuuauguu

SEQ ID NO: 3375398 - RNA, 12 nt, Human
aaaaugucugua

SEQ ID NO: 3375399 - RNA, 17 nt, Human
aaaaugucuguaauaau

SEQ ID NO: 3375400 - RNA, 15 nt, Human
aaaaugucuucaagg

SEQ ID NO: 3375401 - RNA, 18 nt, Human
aaaaugucuuguguuacc

SEQ ID NO: 3375402 - RNA, 21 nt, Human
aaaaugucuuuccaaauuauu

SEQ ID NO: 3375403 - RNA, 15 nt, Human
aaaaugugaggaaga

SEQ ID NO: 3375404 - RNA, 18 nt, Human
aaaaugugccauuuugca

SEQ ID NO: 3375405 - RNA, 19 nt, Human
aaaaugugcuauacugcau

SEQ ID NO: 3375406 - RNA, 21 nt, Human
aaaaugugggauuauggguca

SEQ ID NO: 3375407 - RNA, 20 nt, Human
aaaauguguaauuuuguucu

SEQ ID NO: 3375408 - RNA, 16 nt, Human
aaaauguguguauucu

SEQ ID NO: 3375409 - RNA, 12 nt, Human
aaaaugugugug

SEQ ID NO: 3375410 - RNA, 14 nt, Human
aaaauguguguuuu

SEQ ID NO: 3375411 - RNA, 13 nt, Human
aaaauguguugaa

SEQ ID NO: 3375412 - RNA, 22 nt, Human
aaaauguuaucuucucaaguuc

SEQ ID NO: 3375413 - RNA, 16 nt, Human
aaaauguuauuucccu

SEQ ID NO: 3375414 - RNA, 17 nt, Human
aaaauguugaaaaguca

SEQ ID NO: 3375415 - RNA, 15 nt, Human
aaaauguuuuagcaa

SEQ ID NO: 3375416 - RNA, 17 nt, Human
aaaauguuuuguaagaa

SEQ ID NO: 3375417 - RNA, 21 nt, Human
aaaauguuuuguaagaaacca

SEQ ID NO: 3375418 - RNA, 12 nt, Human
aaaauuaaaaug

SEQ ID NO: 3375419 - RNA, 12 nt, Human
aaaauuaagaaa

SEQ ID NO: 3375420 - RNA, 20 nt, Human
aaaauuaagacaagccuggc

SEQ ID NO: 3375421 - RNA, 21 nt, Human
aaaauuaaggcaacugaacaa

SEQ ID NO: 3375422 - RNA, 12 nt, Human
cacuuuguucuu

SEQ ID NO: 3375423 - RNA, 18 nt, Human
cacuuuguucuuuaggag

SEQ ID NO: 3375424 - RNA, 15 nt, Human
cacuuuguugcaaga

SEQ ID NO: 3375425 - RNA, 21 nt, Human
cacuuuguugcaagaugugaa

SEQ ID NO: 3375426 - RNA, 20 nt, Human
cacuuuguuucguggggagg

SEQ ID NO: 3375427 - RNA, 12 nt, Human
cacuuuucaccu

SEQ ID NO: 3375428 - RNA, 18 nt, Human
cacuuuucaccuccuuca

SEQ ID NO: 3375429 - RNA, 11 nt, Human
cacuuuuccag

SEQ ID NO: 3375430 - RNA, 15 nt, Human
cacuuuuccaguauu

SEQ ID NO: 3375431 - RNA, 17 nt, Human
cacuuuuccaguauuuu

SEQ ID NO: 3375432 - RNA, 16 nt, Human
cacuuuuccucccuca

SEQ ID NO: 3375433 - RNA, 12 nt, Human
cacuuuucucca

SEQ ID NO: 3375434 - RNA, 12 nt, Human
cacuuuugcaag

SEQ ID NO: 3375435 - RNA, 12 nt, Human
cacuuuugccag

SEQ ID NO: 3375436 - RNA, 22 nt, Human
cacuuuugguuaagucuguuuu

SEQ ID NO: 3375437 - RNA, 22 nt, Human
cacuuuuguucuugguuuguaa

SEQ ID NO: 3375438 - RNA, 17 nt, Human
cacuuuuuaaaaaacuu

SEQ ID NO: 3375439 - RNA, 20 nt, Human
cacuuuuuaaaaaacuuucu

SEQ ID NO: 3375440 - RNA, 14 nt, Human
cacuuuuuaugcua

SEQ ID NO: 3375441 - RNA, 19 nt, Human
cacuuuuuauuagauaacg

SEQ ID NO: 3375442 - RNA, 20 nt, Human
cacuuuuucauuugccuauu

SEQ ID NO: 3375443 - RNA, 17 nt, Human
cacuuuuucucuuucca

SEQ ID NO: 3375444 - RNA, 20 nt, Human
cacuuuuucuuuacaaacaa

SEQ ID NO: 3375445 - RNA, 19 nt, Human
cacuuuuugaacuaagaaa

SEQ ID NO: 3375446 - RNA, 21 nt, Human
cacuuuuuuggggauaugcuu

SEQ ID NO: 3375447 - RNA, 20 nt, Human
cagaaaaaaagagugaaaaa

SEQ ID NO: 3375448 - RNA, 21 nt, Human
cagaaaaaaagagugaaaaag

SEQ ID NO: 3375449 - RNA, 12 nt, Human
cagaaaaaaggu

SEQ ID NO: 3375450 - RNA, 22 nt, Human
cagaaaaaagguucuuugugua

SEQ ID NO: 3375451 - RNA, 20 nt, Human
cagaaaaaaugucuguaaau

SEQ ID NO: 3375452 - RNA, 16 nt, Human
cagaaaaacucuggga

SEQ ID NO: 3375453 - RNA, 19 nt, Human
cagaaaaacucugggaaau

SEQ ID NO: 3375454 - RNA, 17 nt, Human
cagaaaaaggcugugcu

SEQ ID NO: 3375455 - RNA, 11 nt, Human
cagaaaacaac

SEQ ID NO: 3375456 - RNA, 19 nt, Human
cagaaaacaacaaaaaaua

SEQ ID NO: 3375457 - RNA, 10 nt, Human
cagaaaacag

SEQ ID NO: 3375458 - RNA, 16 nt, Human
cagaaaacagaaaaaa

SEQ ID NO: 3375459 - RNA, 11 nt, Human
cagaaaacauu

SEQ ID NO: 3375460 - RNA, 14 nt, Human
cagaaaaccccagc

SEQ ID NO: 3375461 - RNA, 20 nt, Human
cagaaaacccuugggccaga

SEQ ID NO: 3375462 - RNA, 19 nt, Human
cagaaaacgguuaaaacug

SEQ ID NO: 3375463 - RNA, 18 nt, Human
cagaaaacuagaauuuca

SEQ ID NO: 3375464 - RNA, 14 nt, Human
cagaaaagcaccug

SEQ ID NO: 3375465 - RNA, 16 nt, Human
cagaaaagcaccugcc

SEQ ID NO: 3375466 - RNA, 19 nt, Human
cagaaaagcaccugccgac

SEQ ID NO: 3375467 - RNA, 17 nt, Human
cagaaaagggaaguugu

SEQ ID NO: 3375468 - RNA, 22 nt, Human
cagaaaaguugaauuuuacaug

SEQ ID NO: 3375469 - RNA, 12 nt, Human
cagaaaauaagg

SEQ ID NO: 3375470 - RNA, 11 nt, Human
cagaaaauaua

SEQ ID NO: 3375471 - RNA, 16 nt, Human
cagaaaauauacugua

SEQ ID NO: 3375472 - RNA, 20 nt, Human
cagaaaauauacuguaaaga

SEQ ID NO: 3375473 - RNA, 15 nt, Human
cagaaaauauguauu

SEQ ID NO: 3375474 - RNA, 11 nt, Human
cagaaaaugag

SEQ ID NO: 3375475 - RNA, 20 nt, Human
cagaaaauggaagacagcuc

SEQ ID NO: 3375476 - RNA, 20 nt, Human
cagaaacacccucacacugg

SEQ ID NO: 3375477 - RNA, 23 nt, Human
cagaaacacccucacacugggac

SEQ ID NO: 3375478 - RNA, 13 nt, Human
cagaaacacugcc

SEQ ID NO: 3375479 - RNA, 21 nt, Human
cagaaacacugccuuuuuauu

SEQ ID NO: 3375480 - RNA, 21 nt, Human
cagaggccgcgcguccagcug

SEQ ID NO: 3375481 - RNA, 16 nt, Human
cagaggccuauaauga

SEQ ID NO: 3375482 - RNA, 20 nt, Human
cagaggccuauaaugaagcu

SEQ ID NO: 3375483 - RNA, 12 nt, Human
cagaggccuccu

SEQ ID NO: 3375484 - RNA, 14 nt, Human
cagaggccugcccg

SEQ ID NO: 3375485 - RNA, 23 nt, Human
cagaggcgcaugaauuugugaag

SEQ ID NO: 3375486 - RNA, 21 nt, Human
cagaggcucagauuguaauau

SEQ ID NO: 3375487 - RNA, 13 nt, Human
cagaggcugaggu

SEQ ID NO: 3375488 - RNA, 22 nt, Human
cagaggcugaguuuucucuuug

SEQ ID NO: 3375489 - RNA, 17 nt, Human
cagaggcuggaggcagg

SEQ ID NO: 3375490 - RNA, 18 nt, Human
cagaggcuggaggcaggg

SEQ ID NO: 3375491 - RNA, 16 nt, Human
cagaggcuggccucag

SEQ ID NO: 3375492 - RNA, 17 nt, Human
cagaggcuggccucaga

SEQ ID NO: 3375493 - RNA, 12 nt, Human
cagaggcugggu

SEQ ID NO: 3375494 - RNA, 13 nt, Human
cagaggcuggguu

SEQ ID NO: 3375495 - RNA, 14 nt, Human
cagaggcuggguuc

SEQ ID NO: 3375496 - RNA, 14 nt, Human
cagaggcuguggcu

SEQ ID NO: 3375497 - RNA, 19 nt, Human
cagagggaagaaaagagcu

SEQ ID NO: 3375498 - RNA, 19 nt, Human
cagagggacuuuguauaga

SEQ ID NO: 3375499 - RNA, 23 nt, Human
cagagggaggaaucgaggaacca

SEQ ID NO: 3375500 - RNA, 16 nt, Human
cagagggagugacaga

SEQ ID NO: 3375501 - RNA, 23 nt, Human
cagagggagugacagaggcagcc

SEQ ID NO: 3375502 - RNA, 14 nt, Human
cagagggcacucug

SEQ ID NO: 3375503 - RNA, 18 nt, Human
cagagggcagaggcugga

SEQ ID NO: 3375504 - RNA, 22 nt, Human
cagagggccugcaagggaguga

SEQ ID NO: 3375505 - RNA, 19 nt, Human
cagagggcuggaggcccag

SEQ ID NO: 3375506 - RNA, 20 nt, Human
cagagggcuggaggcccagg

SEQ ID NO: 3375507 - RNA, 16 nt, Human
cagaggggcagaggcc

SEQ ID NO: 3375508 - RNA, 17 nt, Human
cagaggggcagauggaa

SEQ ID NO: 3375509 - RNA, 20 nt, Human
cagaggggcaggcccugcac

SEQ ID NO: 3375510 - RNA, 22 nt, Human
cagaggggcaggcccugcacug

SEQ ID NO: 3375511 - RNA, 14 nt, Human
cagaggggguggcc

SEQ ID NO: 3375512 - RNA, 15 nt, Human
cagagggguaggcag

SEQ ID NO: 3375513 - RNA, 20 nt, Human
cagagggguaggcagagccu

SEQ ID NO: 3375514 - RNA, 21 nt, Human
cagagggguaggcagagccuu

SEQ ID NO: 3375515 - RNA, 20 nt, Human
cagagggguggguuccucuu

SEQ ID NO: 3375516 - RNA, 23 nt, Human
cagagggguggguuccucuuccc

SEQ ID NO: 3375517 - RNA, 17 nt, Human
cagaggguugugauuuu

SEQ ID NO: 3375518 - RNA, 18 nt, Human
cagagguaaaagugugag

SEQ ID NO: 3375519 - RNA, 22 nt, Human
cagagguaacagaacagcuuca

SEQ ID NO: 3375520 - RNA, 18 nt, Human
cagagguacccugggugu

SEQ ID NO: 3375521 - RNA, 13 nt, Human
cagagguccagcc

SEQ ID NO: 3375522 - RNA, 14 nt, Human
cagagguccagccc

SEQ ID NO: 3375523 - RNA, 17 nt, Human
cagaggucuagauuaau

SEQ ID NO: 3375524 - RNA, 20 nt, Human
cagaggucucugccggcucu

SEQ ID NO: 3375525 - RNA, 14 nt, Human
cagaggugcuucac

SEQ ID NO: 3375526 - RNA, 21 nt, Human
cagagguggccagagcuggga

SEQ ID NO: 3375527 - RNA, 17 nt, Human
cagagguugcagugugg

SEQ ID NO: 3375528 - RNA, 14 nt, Human
cagaguaagacauu

SEQ ID NO: 3375529 - RNA, 21 nt, Human
cagaguaggcuauuccugaga

SEQ ID NO: 3375530 - RNA, 23 nt, Human
cagaguaggggucugucuuuuaa

SEQ ID NO: 3375531 - RNA, 21 nt, Human
cagaguaugaacaccugggcu

SEQ ID NO: 3375532 - RNA, 14 nt, Human
cagaguauggagcu

SEQ ID NO: 3375533 - RNA, 18 nt, Human
cagaguauuuuuguauuc

SEQ ID NO: 3375534 - RNA, 20 nt, Human
cagagucagaaguuucugcc

SEQ ID NO: 3375535 - RNA, 14 nt, Human
cagagucagcagaa

SEQ ID NO: 3375536 - RNA, 16 nt, Human
cagagucagccaggac

SEQ ID NO: 3375537 - RNA, 20 nt, Human
cagaguccacggagcucgcg

SEQ ID NO: 3375538 - RNA, 16 nt, Human
cagaguccaggcccca

SEQ ID NO: 3375539 - RNA, 16 nt, Human
cagaguccccccacuc

SEQ ID NO: 3375540 - RNA, 14 nt, Human
cagagucccugccu

SEQ ID NO: 3375541 - RNA, 15 nt, Human
cagaguccuuuccaa

SEQ ID NO: 3375542 - RNA, 15 nt, Human
cagagucggaacgga

SEQ ID NO: 3375543 - RNA, 18 nt, Human
cagagucggaacggagaa

SEQ ID NO: 3375544 - RNA, 17 nt, Human
cagagucucacuguugc

SEQ ID NO: 3375545 - RNA, 21 nt, Human
cagagucucacuguugcccag

SEQ ID NO: 3375546 - RNA, 22 nt, Human
cagagucucacuguugcccagg

SEQ ID NO: 3375547 - RNA, 20 nt, Human
cagagugacauccaggagga

SEQ ID NO: 3375548 - RNA, 20 nt, Human
cagagugagacccagcccuc

SEQ ID NO: 3375549 - RNA, 16 nt, Human
cagagugagacucugu

SEQ ID NO: 3375550 - RNA, 18 nt, Human
cagagugcaagccccugc

SEQ ID NO: 3375551 - RNA, 23 nt, Human
cagagugcaagccccugcuccag

SEQ ID NO: 3375552 - RNA, 13 nt, Human
cagagugcccaga

SEQ ID NO: 3375553 - RNA, 15 nt, Human
cagagugccccaccu

SEQ ID NO: 3375554 - RNA, 16 nt, Human
cagagugccccaccug

SEQ ID NO: 3375555 - RNA, 17 nt, Human
cagaguggaauaagaca

SEQ ID NO: 3375556 - RNA, 18 nt, Human
cagaguggaauaagacag

SEQ ID NO: 3375557 - RNA, 14 nt, Human
cagaguggaaugcu

SEQ ID NO: 3375558 - RNA, 12 nt, Human
cagaguggccug

SEQ ID NO: 3375559 - RNA, 13 nt, Human
cagaguggccugg

SEQ ID NO: 3375560 - RNA, 17 nt, Human
cagaguggccuggccag

SEQ ID NO: 3375561 - RNA, 22 nt, Human
cagaguggccuggccaggagcu

SEQ ID NO: 3375562 - RNA, 15 nt, Human
cagaguggucuuucu

SEQ ID NO: 3375563 - RNA, 19 nt, Human
cagaguguagccagguccc

SEQ ID NO: 3375564 - RNA, 12 nt, Human
cagagugugcug

SEQ ID NO: 3375565 - RNA, 18 nt, Human
cagagugugcuggaggac

SEQ ID NO: 3375566 - RNA, 18 nt, Human
cagaguuacaguucugug

SEQ ID NO: 3375567 - RNA, 19 nt, Human
cagaguuacaguucugugg

SEQ ID NO: 3375568 - RNA, 12 nt, Human
cagaguuacuug

SEQ ID NO: 3375569 - RNA, 18 nt, Human
cagaguuccccaugcaga

SEQ ID NO: 3375570 - RNA, 24 nt, Human
cagaguuccccaugcagacaugag

SEQ ID NO: 3375571 - RNA, 21 nt, Human
cagaguucuauacuguaaagc

SEQ ID NO: 3375572 - RNA, 23 nt, Human
cagaguucuuuuugaaguauuua

SEQ ID NO: 3375573 - RNA, 15 nt, Human
cagaguugaagacag

SEQ ID NO: 3375574 - RNA, 19 nt, Human
cagaguuguaaauauauaa

SEQ ID NO: 3375575 - RNA, 19 nt, Human
cagaguuguuacauuuuua

SEQ ID NO: 3375576 - RNA, 19 nt, Human
cagaguuuguguguugucu

SEQ ID NO: 3375577 - RNA, 22 nt, Human
cagaguuuguguguugucuuga

SEQ ID NO: 3375578 - RNA, 21 nt, Human
cagauaaaccuagauaaagag

SEQ ID NO: 3375579 - RNA, 22 nt, Human
cagauaaagguucaugcaaacu

SEQ ID NO: 3375580 - RNA, 23 nt, Human
cagauaaauaguuuaugauucca

SEQ ID NO: 3375581 - RNA, 17 nt, Human
cagauaacaaugcagca

SEQ ID NO: 3375582 - RNA, 16 nt, Human
cagauaacauaccuuu

SEQ ID NO: 3375583 - RNA, 13 nt, Human
cagaacguggcuc

SEQ ID NO: 3375584 - RNA, 19 nt, Human
cagaacuaaacucauuuau

SEQ ID NO: 3375585 - RNA, 12 nt, Human
cagaacuaaaug

SEQ ID NO: 3375586 - RNA, 17 nt, Human
cagaacuaaauguucua

SEQ ID NO: 3375587 - RNA, 19 nt, Human
cagaacuagaauuugauua

SEQ ID NO: 3375588 - RNA, 17 nt, Human
cagaacuauguuuuugu

SEQ ID NO: 3375589 - RNA, 22 nt, Human
cagaacucaaauggggccagau

SEQ ID NO: 3375590 - RNA, 18 nt, Human
cagaacucacuggggccu

SEQ ID NO: 3375591 - RNA, 22 nt, Human
cagaacucgguguccccaccau

SEQ ID NO: 3375592 - RNA, 15 nt, Human
cagaacucugccugc

SEQ ID NO: 3375593 - RNA, 16 nt, Human
cagaacucugccugcc

SEQ ID NO: 3375594 - RNA, 17 nt, Human
cagaacucuuaaaaaug

SEQ ID NO: 3375595 - RNA, 15 nt, Human
cagaacucuuccucc

SEQ ID NO: 3375596 - RNA, 14 nt, Human
cagaacucuuucaa

SEQ ID NO: 3375597 - RNA, 16 nt, Human
cagaacugagcuccuc

SEQ ID NO: 3375598 - RNA, 17 nt, Human
cagaacugagcuccucu

SEQ ID NO: 3375599 - RNA, 20 nt, Human
cagaacugagcuccucuggg

SEQ ID NO: 3375600 - RNA, 12 nt, Human
cagaacugccau

SEQ ID NO: 3375601 - RNA, 20 nt, Human
cagaacugccauuauuuucu

SEQ ID NO: 3375602 - RNA, 13 nt, Human
cagaacugcuuua

SEQ ID NO: 3375603 - RNA, 13 nt, Human
cagaacuggacuc

SEQ ID NO: 3375604 - RNA, 15 nt, Human
cagaacuucccugau

SEQ ID NO: 3375605 - RNA, 21 nt, Human
cagaacuugaagccugcuccu

SEQ ID NO: 3375606 - RNA, 11 nt, Human
cagaagaaaga

SEQ ID NO: 3375607 - RNA, 18 nt, Human
cagaagaagagaagcugc

SEQ ID NO: 3375608 - RNA, 23 nt, Human
cagaagaagagaagcugcugacc

SEQ ID NO: 3375609 - RNA, 14 nt, Human
cagaagaaggcagc

SEQ ID NO: 3375610 - RNA, 12 nt, Human
cagaagaauauu

SEQ ID NO: 3375611 - RNA, 19 nt, Human
cagaagaauugaacccagg

SEQ ID NO: 3375612 - RNA, 21 nt, Human
cagaagaauugaacccaggag

SEQ ID NO: 3375613 - RNA, 18 nt, Human
cagaagacaaaaagacaa

SEQ ID NO: 3375614 - RNA, 15 nt, Human
cagaagacaccagag

SEQ ID NO: 3375615 - RNA, 19 nt, Human
cagaagacaccagagcaga

SEQ ID NO: 3375616 - RNA, 21 nt, Human
cagaagacacugaugggcaac

SEQ ID NO: 3375617 - RNA, 23 nt, Human
cagaagaggguguguuugaaauc

SEQ ID NO: 3375618 - RNA, 22 nt, Human
cagaagauaacuugagcaccgu

SEQ ID NO: 3375619 - RNA, 15 nt, Human
cagaagauccccuca

SEQ ID NO: 3375620 - RNA, 19 nt, Human
cagaagauccccucaggac

SEQ ID NO: 3375621 - RNA, 15 nt, Human
cagaagaugaacaga

SEQ ID NO: 3375622 - RNA, 19 nt, Human
cagaagcaacccaaauguu

SEQ ID NO: 3375623 - RNA, 20 nt, Human
cagaagcacagaauauuuuu

SEQ ID NO: 3375624 - RNA, 17 nt, Human
aaaauugaaauguaagg

SEQ ID NO: 3375625 - RNA, 21 nt, Human
aaaauugaaauguaaggcugu

SEQ ID NO: 3375626 - RNA, 19 nt, Human
aaaauugaacaaagacuac

SEQ ID NO: 3375627 - RNA, 12 nt, Human
aaaauugaaugc

SEQ ID NO: 3375628 - RNA, 13 nt, Human
aaaauugaauuua

SEQ ID NO: 3375629 - RNA, 16 nt, Human
aaaauugaauuuaaca

SEQ ID NO: 3375630 - RNA, 21 nt, Human
aaaauugaauuuaacaaugcg

SEQ ID NO: 3375631 - RNA, 14 nt, Human
aaaauugauguguu

SEQ ID NO: 3375632 - RNA, 15 nt, Human
aaaauugcaaaucuu

SEQ ID NO: 3375633 - RNA, 20 nt, Human
aaaauugcuauguuacuauu

SEQ ID NO: 3375634 - RNA, 22 nt, Human
aaaauugcuuuugagagaacau

SEQ ID NO: 3375635 - RNA, 19 nt, Human
aaaauuggggauucuuaaa

SEQ ID NO: 3375636 - RNA, 23 nt, Human
aaaauuggggauucuuaaaguug

SEQ ID NO: 3375637 - RNA, 17 nt, Human
aaaauugguuggagaau

SEQ ID NO: 3375638 - RNA, 15 nt, Human
aaaauuguaaaauug

SEQ ID NO: 3375639 - RNA, 21 nt, Human
aaaauuguauguuaaguuacu

SEQ ID NO: 3375640 - RNA, 13 nt, Human
aaaauugugauca

SEQ ID NO: 3375641 - RNA, 16 nt, Human
aaaauugugauguguc

SEQ ID NO: 3375642 - RNA, 17 nt, Human
aaaauuuaaaaguaaaa

SEQ ID NO: 3375643 - RNA, 19 nt, Human
aaaauuuaaaaguaaaaug

SEQ ID NO: 3375644 - RNA, 22 nt, Human
aaaauuuaaaggguguacuuau

SEQ ID NO: 3375645 - RNA, 23 nt, Human
aaaauuuaagcauuguuugcuua

SEQ ID NO: 3375646 - RNA, 13 nt, Human
aaaauuuagaaca

SEQ ID NO: 3375647 - RNA, 13 nt, Human
aaaauuuauuuca

SEQ ID NO: 3375648 - RNA, 18 nt, Human
aaaauuuauuuuauaaga

SEQ ID NO: 3375649 - RNA, 20 nt, Human
aaaauuuauuuuauaagaaa

SEQ ID NO: 3375650 - RNA, 20 nt, Human
aaaauuucaacaaguagcua

SEQ ID NO: 3375651 - RNA, 15 nt, Human
aaaauuucuauuaaa

SEQ ID NO: 3375652 - RNA, 15 nt, Human
aaaauuugaaccaaa

SEQ ID NO: 3375653 - RNA, 20 nt, Human
aaaauuugaaccaaaacauu

SEQ ID NO: 3375654 - RNA, 12 nt, Human
aaaauuugaagu

SEQ ID NO: 3375655 - RNA, 13 nt, Human
aaaauuugagacu

SEQ ID NO: 3375656 - RNA, 19 nt, Human
aaaauuugagacuauuuaa

SEQ ID NO: 3375657 - RNA, 16 nt, Human
aaaauuuguucuugua

SEQ ID NO: 3375658 - RNA, 22 nt, Human
aaaauuuguuuugacggaugau

SEQ ID NO: 3375659 - RNA, 12 nt, Human
aaaauuuuaagc

SEQ ID NO: 3375660 - RNA, 15 nt, Human
aaaauuuuauaagca

SEQ ID NO: 3375661 - RNA, 19 nt, Human
aaaauuuucucauuuucuu

SEQ ID NO: 3375662 - RNA, 23 nt, Human
aaaauuuugcuccccagugaagg

SEQ ID NO: 3375663 - RNA, 17 nt, Human
aaaauuuuguaauuuuc

SEQ ID NO: 3375664 - RNA, 22 nt, Human
aaaauuuuguauguuaaagaga

SEQ ID NO: 3375665 - RNA, 16 nt, Human
aaaauuuugugacauu

SEQ ID NO: 3375666 - RNA, 21 nt, Human
aaaauuuugugacauuccuuc

SEQ ID NO: 3375667 - RNA, 17 nt, Human
aaaauuuuuguuuauaa

SEQ ID NO: 3375668 - RNA, 14 nt, Human
aaaauuuuuuuaga

SEQ ID NO: 3375669 - RNA, 17 nt, Human
aaaauuuuuuuucaugu

SEQ ID NO: 3375670 - RNA, 18 nt, Human
aaaauuuuuuuucauguu

SEQ ID NO: 3375671 - RNA, 19 nt, Human
aaaauuuuuuuucauguuu

SEQ ID NO: 3375672 - RNA, 13 nt, Human
aaacaaaaaacaa

SEQ ID NO: 3375673 - RNA, 13 nt, Human
aaacaaaaacacu

SEQ ID NO: 3375674 - RNA, 12 nt, Human
aaacaaaaacau

SEQ ID NO: 3375675 - RNA, 11 nt, Human
aaacaaaaaga

SEQ ID NO: 3375676 - RNA, 12 nt, Human
aaacaaaaagaa

SEQ ID NO: 3375677 - RNA, 17 nt, Human
aaacaaaaagaacaaaa

SEQ ID NO: 3375678 - RNA, 19 nt, Human
aaacaaaaauuaaaauccu

SEQ ID NO: 3375679 - RNA, 14 nt, Human
aaacaaaacaaaac

SEQ ID NO: 3375680 - RNA, 16 nt, Human
aaacaaaacaaaacaa

SEQ ID NO: 3375681 - RNA, 12 nt, Human
aaacaaaaggca

SEQ ID NO: 3375682 - RNA, 16 nt, Human
aaacaaaauagaaagu

SEQ ID NO: 3375683 - RNA, 15 nt, Human
aaacaaaauuugacu

SEQ ID NO: 3375684 - RNA, 20 nt, Human
aaacaaacucguuuuuuaca

SEQ ID NO: 3375685 - RNA, 11 nt, Human
aaacaaagaag

SEQ ID NO: 3375686 - RNA, 18 nt, Human
aaacaaagaguucaagaa

SEQ ID NO: 3375687 - RNA, 15 nt, Human
aaacaaaguuucaga

SEQ ID NO: 3375688 - RNA, 12 nt, Human
aaacaaauaugc

SEQ ID NO: 3375689 - RNA, 14 nt, Human
aaacaaauaugcaa

SEQ ID NO: 3375690 - RNA, 15 nt, Human
aaacaacagcugaag

SEQ ID NO: 3375691 - RNA, 18 nt, Human
aaacaacauuuauaugua

SEQ ID NO: 3375692 - RNA, 21 nt, Human
aaacaacauuuugagaacaaa

SEQ ID NO: 3375693 - RNA, 17 nt, Human
aaacaacuuucucuugu

SEQ ID NO: 3375694 - RNA, 18 nt, Human
aaacaagaaaaauaaaga

SEQ ID NO: 3375695 - RNA, 15 nt, Human
aaacaagaaaguuuc

SEQ ID NO: 3375696 - RNA, 22 nt, Human
aaacaagauuuuaaagacaugu

SEQ ID NO: 3375697 - RNA, 18 nt, Human
aaacaagcauauaaaaug

SEQ ID NO: 3375698 - RNA, 17 nt, Human
aaacaaggaugaauuaa

SEQ ID NO: 3375699 - RNA, 13 nt, Human
aaacaaguauuug

SEQ ID NO: 3375700 - RNA, 23 nt, Human
aaacaaguauuuguuaauuuaga

SEQ ID NO: 3375701 - RNA, 16 nt, Human
aaacaauaaaugugca

SEQ ID NO: 3375702 - RNA, 14 nt, Human
aaacaauauuguuu

SEQ ID NO: 3375703 - RNA, 16 nt, Human
aaacaauauuuauugu

SEQ ID NO: 3375704 - RNA, 17 nt, Human
aaacaauauuuauugua

SEQ ID NO: 3375705 - RNA, 12 nt, Human
aaacaaucucuu

SEQ ID NO: 3375706 - RNA, 18 nt, Human
aaacaauggaguauucuc

SEQ ID NO: 3375707 - RNA, 13 nt, Human
aaacaauuuauuu

SEQ ID NO: 3375708 - RNA, 20 nt, Human
aaacacaaaaguuagcugag

SEQ ID NO: 3375709 - RNA, 22 nt, Human
aaacacaaaccacaacugacac

SEQ ID NO: 3375710 - RNA, 19 nt, Human
aaacacaaacgggcucagc

SEQ ID NO: 3375711 - RNA, 14 nt, Human
aaacacaacuauau

SEQ ID NO: 3375712 - RNA, 17 nt, Human
aaacacaccaggcugug

SEQ ID NO: 3375713 - RNA, 23 nt, Human
aaacacaccaggcugugggccuc

SEQ ID NO: 3375714 - RNA, 15 nt, Human
aaacacacugaggca

SEQ ID NO: 3375715 - RNA, 11 nt, Human
aaacacagcaa

SEQ ID NO: 3375716 - RNA, 12 nt, Human
aaacacagcaag

SEQ ID NO: 3375717 - RNA, 20 nt, Human
aaacacagucaaaauaauuc

SEQ ID NO: 3375718 - RNA, 16 nt, Human
aaacacaguguuuuug

SEQ ID NO: 3375719 - RNA, 20 nt, Human
aaacacaguguuuuuguaaa

SEQ ID NO: 3375720 - RNA, 19 nt, Human
aaacacauaauuaacacuu

SEQ ID NO: 3375721 - RNA, 18 nt, Human
aaacacaucuaguaguug

SEQ ID NO: 3375722 - RNA, 16 nt, Human
aaacacaucuucccua

SEQ ID NO: 3375723 - RNA, 21 nt, Human
aaacacauuaaagguacuuug

SEQ ID NO: 3375724 - RNA, 15 nt, Human
aaacacauuguuauu

SEQ ID NO: 3375725 - RNA, 16 nt, Human
aaacacauuuuucuua

SEQ ID NO: 3375726 - RNA, 19 nt, Human
aaacaccaacauaaaaaug

SEQ ID NO: 3375727 - RNA, 15 nt, Human
aaacacccucacacu

SEQ ID NO: 3375728 - RNA, 17 nt, Human
aaacaccggguuccagc

SEQ ID NO: 3375729 - RNA, 15 nt, Human
aaacaccucugcuuu

SEQ ID NO: 3375730 - RNA, 18 nt, Human
aaacaccugacagccccu

SEQ ID NO: 3375731 - RNA, 22 nt, Human
aaacaccuuccagcuccuguaa

SEQ ID NO: 3375732 - RNA, 16 nt, Human
aaacacgaaacuuguu

SEQ ID NO: 3375733 - RNA, 17 nt, Human
aaacacgaaacuuguua

SEQ ID NO: 3375734 - RNA, 13 nt, Human
aaacacuaaaugu

SEQ ID NO: 3375735 - RNA, 16 nt, Human
aaacacuaaauguuaa

SEQ ID NO: 3375736 - RNA, 21 nt, Human
aaacacuaaauguuaaagaug

SEQ ID NO: 3375737 - RNA, 23 nt, Human
aaacacuauuuuuuuuucuuuug

SEQ ID NO: 3375738 - RNA, 14 nt, Human
aaacacucagcugu

SEQ ID NO: 3375739 - RNA, 15 nt, Human
aaacacucagcuguu

SEQ ID NO: 3375740 - RNA, 16 nt, Human
aaacacuccuugcauc

SEQ ID NO: 3375741 - RNA, 20 nt, Human
aaacacucggcauuucaaau

SEQ ID NO: 3375742 - RNA, 13 nt, Human
aaacacucuugaa

SEQ ID NO: 3375743 - RNA, 13 nt, Human
aaacacugaaaaa

SEQ ID NO: 3375744 - RNA, 14 nt, Human
aaacacugcaggca

SEQ ID NO: 3375745 - RNA, 15 nt, Human
cagauaacauuugug

SEQ ID NO: 3375746 - RNA, 21 nt, Human
cagauaacuguuauuuauaau

SEQ ID NO: 3375747 - RNA, 19 nt, Human
cagauaagaaugcugguuu

SEQ ID NO: 3375748 - RNA, 20 nt, Human
cagauaagacauaucucuaa

SEQ ID NO: 3375749 - RNA, 20 nt, Human
cagauaagguaaaaugccau

SEQ ID NO: 3375750 - RNA, 19 nt, Human
cagauaaucagccucuuaa

SEQ ID NO: 3375751 - RNA, 14 nt, Human
cagauaaucagugu

SEQ ID NO: 3375752 - RNA, 15 nt, Human
cagauaaucccugua

SEQ ID NO: 3375753 - RNA, 14 nt, Human
cagauaaugugaaa

SEQ ID NO: 3375754 - RNA, 14 nt, Human
cagauacaauguau

SEQ ID NO: 3375755 - RNA, 17 nt, Human
cagauacaauguauuua

SEQ ID NO: 3375756 - RNA, 21 nt, Human
cagauacaggaaaagcugcug

SEQ ID NO: 3375757 - RNA, 17 nt, Human
cagauacauaugagugu

SEQ ID NO: 3375758 - RNA, 13 nt, Human
cagauacaucacu

SEQ ID NO: 3375759 - RNA, 22 nt, Human
cagauaccuuaucuuacaauau

SEQ ID NO: 3375760 - RNA, 21 nt, Human
cagauacggacagagaccaag

SEQ ID NO: 3375761 - RNA, 18 nt, Human
cagauacuggaaguuuug

SEQ ID NO: 3375762 - RNA, 14 nt, Human
cagauagaaagcau

SEQ ID NO: 3375763 - RNA, 21 nt, Human
cagauagagaguuguugugua

SEQ ID NO: 3375764 - RNA, 19 nt, Human
cagauagauauaugcucug

SEQ ID NO: 3375765 - RNA, 19 nt, Human
cagauaggccuucuuguga

SEQ ID NO: 3375766 - RNA, 18 nt, Human
cagauaguguagcugagg

SEQ ID NO: 3375767 - RNA, 20 nt, Human
cagauauaaauggcugguuu

SEQ ID NO: 3375768 - RNA, 18 nt, Human
cagauauauuuucuuucu

SEQ ID NO: 3375769 - RNA, 14 nt, Human
cagauauauuuuuc

SEQ ID NO: 3375770 - RNA, 22 nt, Human
auugaagccgacucuggcccug

SEQ ID NO: 3375771 - RNA, 13 nt, Human
auugaaggaaaga

SEQ ID NO: 3375772 - RNA, 20 nt, Human
auugaaggaagccaaauuua

SEQ ID NO: 3375773 - RNA, 18 nt, Human
auugaaggaucaucugaa

SEQ ID NO: 3375774 - RNA, 13 nt, Human
auugaaggccugg

SEQ ID NO: 3375775 - RNA, 19 nt, Human
auugaaggcuuaaacccau

SEQ ID NO: 3375776 - RNA, 19 nt, Human
auugaagguuuuugauagc

SEQ ID NO: 3375777 - RNA, 16 nt, Human
auugaaguaaugaauu

SEQ ID NO: 3375778 - RNA, 18 nt, Human
auugaagucagauguggu

SEQ ID NO: 3375779 - RNA, 15 nt, Human
auugaaguuucaagu

SEQ ID NO: 3375780 - RNA, 16 nt, Human
auugaaguuucaaguu

SEQ ID NO: 3375781 - RNA, 19 nt, Human
auugaauaaaguugaagcu

SEQ ID NO: 3375782 - RNA, 16 nt, Human
auugaauacuuacauu

SEQ ID NO: 3375783 - RNA, 13 nt, Human
auugaauacuuug

SEQ ID NO: 3375784 - RNA, 16 nt, Human
auugaauacuuugaau

SEQ ID NO: 3375785 - RNA, 20 nt, Human
auugaauacuuugaaugugu

SEQ ID NO: 3375786 - RNA, 13 nt, Human
auugaauauugug

SEQ ID NO: 3375787 - RNA, 20 nt, Human
auugaaucauguaguaucaa

SEQ ID NO: 3375788 - RNA, 20 nt, Human
auugaauggugcauuguaua

SEQ ID NO: 3375789 - RNA, 16 nt, Human
auugaauguuuccaac

SEQ ID NO: 3375790 - RNA, 13 nt, Human
auugaauuaucuu

SEQ ID NO: 3375791 - RNA, 13 nt, Human
auugaauuuucaa

SEQ ID NO: 3375792 - RNA, 20 nt, Human
auugaauuuucaagcaucuc

SEQ ID NO: 3375793 - RNA, 14 nt, Human
auugaauuuuuccu

SEQ ID NO: 3375794 - RNA, 13 nt, Human
cagccccacugcc

SEQ ID NO: 3375795 - RNA, 15 nt, Human
cagccccacugccag

SEQ ID NO: 3375796 - RNA, 21 nt, Human
cagccccacugccagcagcag

SEQ ID NO: 3375797 - RNA, 15 nt, Human
cagccccagagcagg

SEQ ID NO: 3375798 - RNA, 14 nt, Human
cagccccagcacca

SEQ ID NO: 3375799 - RNA, 12 nt, Human
cagccccagccc

SEQ ID NO: 3375800 - RNA, 15 nt, Human
cagccccagccugcu

SEQ ID NO: 3375801 - RNA, 17 nt, Human
cagccccagccugcuag

SEQ ID NO: 3375802 - RNA, 18 nt, Human
cagccccagccugcuagc

SEQ ID NO: 3375803 - RNA, 20 nt, Human
cagccccaucugugcauucu

SEQ ID NO: 3375804 - RNA, 16 nt, Human
cagccccauucugccu

SEQ ID NO: 3375805 - RNA, 18 nt, Human
cagccccauucugccugc

SEQ ID NO: 3375806 - RNA, 17 nt, Human
cagcccccacagugcug

SEQ ID NO: 3375807 - RNA, 18 nt, Human
cagcccccacccccaagg

SEQ ID NO: 3375808 - RNA, 17 nt, Human
cagcccccagccccucc

SEQ ID NO: 3375809 - RNA, 19 nt, Human
cagcccccagcucccaccu

SEQ ID NO: 3375810 - RNA, 14 nt, Human
cagcccccucacag

SEQ ID NO: 3375811 - RNA, 13 nt, Human
cagcccccugacc

SEQ ID NO: 3375812 - RNA, 18 nt, Human
cagcccccugaccacuca

SEQ ID NO: 3375813 - RNA, 13 nt, Human
cagcccccugguc

SEQ ID NO: 3375814 - RNA, 20 nt, Human
cagcccccuuugggcccagg

SEQ ID NO: 3375815 - RNA, 21 nt, Human
cagcccccuuugggcccaggg

SEQ ID NO: 3375816 - RNA, 16 nt, Human
cagccccgcgccuccu

SEQ ID NO: 3375817 - RNA, 18 nt, Human
cagccccgcgccuccuuc

SEQ ID NO: 3375818 - RNA, 24 nt, Human
cagccccgcguggaacucgugucu

SEQ ID NO: 3375819 - RNA, 17 nt, Human
cagccccuacugcugug

SEQ ID NO: 3375820 - RNA, 20 nt, Human
cagccccuacugcugugaac

SEQ ID NO: 3375821 - RNA, 12 nt, Human
cagccccuagaa

SEQ ID NO: 3375822 - RNA, 21 nt, Human
cagccccuagaaacccaagcu

SEQ ID NO: 3375823 - RNA, 13 nt, Human
cagccccuagccc

SEQ ID NO: 3375824 - RNA, 12 nt, Human
cagccccuagga

SEQ ID NO: 3375825 - RNA, 13 nt, Human
cagccccuaggag

SEQ ID NO: 3375826 - RNA, 15 nt, Human
cagccccuccaucug

SEQ ID NO: 3375827 - RNA, 12 nt, Human
cagccccuccuc

SEQ ID NO: 3375828 - RNA, 13 nt, Human
cagccccuccucu

SEQ ID NO: 3375829 - RNA, 19 nt, Human
cagccccuccucugccacc

SEQ ID NO: 3375830 - RNA, 13 nt, Human
cagccccucuggu

SEQ ID NO: 3375831 - RNA, 14 nt, Human
cagccccucugguc

SEQ ID NO: 3375832 - RNA, 21 nt, Human
cagccccucuggucgcuccug

SEQ ID NO: 3375833 - RNA, 23 nt, Human
cagccccucuugccccccacccc

SEQ ID NO: 3375834 - RNA, 15 nt, Human
cagccccugccccag

SEQ ID NO: 3375835 - RNA, 22 nt, Human
cagccccugccccagcccaagu

SEQ ID NO: 3375836 - RNA, 12 nt, Human
cagccccuggau

SEQ ID NO: 3375837 - RNA, 20 nt, Human
cagccccuguucuggcagag

SEQ ID NO: 3375838 - RNA, 18 nt, Human
cagccccuuagacagagg

SEQ ID NO: 3375839 - RNA, 20 nt, Human
cagccccuucucagaaucua

SEQ ID NO: 3375840 - RNA, 22 nt, Human
cagccccuucucagaaucuacc

SEQ ID NO: 3375841 - RNA, 22 nt, Human
cagccccuucugacccaugcug

SEQ ID NO: 3375842 - RNA, 23 nt, Human
cagccccuucugacccaugcugc

SEQ ID NO: 3375843 - RNA, 23 nt, Human
cagccccuuuccaaaauuuuuca

SEQ ID NO: 3375844 - RNA, 13 nt, Human
cagccccuuuccc

SEQ ID NO: 3375845 - RNA, 19 nt, Human
cagcccgauccuccccugg

SEQ ID NO: 3375846 - RNA, 14 nt, Human
cagcccgcacaccu

SEQ ID NO: 3375847 - RNA, 14 nt, Human
cagcccgcaucagc

SEQ ID NO: 3375848 - RNA, 19 nt, Human
cagcccgcaugcagcagcu

SEQ ID NO: 3375849 - RNA, 23 nt, Human
cagcccgcaugcagcagcuugcu

SEQ ID NO: 3375850 - RNA, 17 nt, Human
cagcccgcuaggcucgc

SEQ ID NO: 3375851 - RNA, 15 nt, Human
cagcccggaccuugg

SEQ ID NO: 3375852 - RNA, 20 nt, Human
cagcccggccugcucccagc

SEQ ID NO: 3375853 - RNA, 22 nt, Human
cagcccggcugguuuuguaaga

SEQ ID NO: 3375854 - RNA, 17 nt, Human
cagcccgggcucugccu

SEQ ID NO: 3375855 - RNA, 18 nt, Human
cagcccgggcucugccuc

SEQ ID NO: 3375856 - RNA, 22 nt, Human
cagcccgggcucugccucccau

SEQ ID NO: 3375857 - RNA, 17 nt, Human
cagcccguguggccccu

SEQ ID NO: 3375858 - RNA, 16 nt, Human
cagcccuaaacaucau

SEQ ID NO: 3375859 - RNA, 17 nt, Human
cagcccuaaggaucucu

SEQ ID NO: 3375860 - RNA, 12 nt, Human
cagcccuagagc

SEQ ID NO: 3375861 - RNA, 16 nt, Human
cagcccucacacaccc

SEQ ID NO: 3375862 - RNA, 14 nt, Human
cagcccucaucccg

SEQ ID NO: 3375863 - RNA, 17 nt, Human
cagcccucaucccgagc

SEQ ID NO: 3375864 - RNA, 23 nt, Human
cagcccuccaucuaaacugcccc

SEQ ID NO: 3375865 - RNA, 16 nt, Human
cagcccucccugcccc

SEQ ID NO: 3375866 - RNA, 18 nt, Human
cagcccucccugccccuc

SEQ ID NO: 3375867 - RNA, 22 nt, Human
cagcccucccugccccucccuu

SEQ ID NO: 3375868 - RNA, 17 nt, Human
cagcccuccucugcacu

SEQ ID NO: 3375869 - RNA, 18 nt, Human
cagcccuccucugcacuc

SEQ ID NO: 3375870 - RNA, 13 nt, Human
cagcccugacccu

SEQ ID NO: 3375871 - RNA, 19 nt, Human
cagcccugagaaagcccug

SEQ ID NO: 3375872 - RNA, 21 nt, Human
cagcccugaguuccuagccac

SEQ ID NO: 3375873 - RNA, 13 nt, Human
cagcccugcacca

SEQ ID NO: 3375874 - RNA, 17 nt, Human
cagcccugcaccaugcu

SEQ ID NO: 3375875 - RNA, 14 nt, Human
cagcccugcagagg

SEQ ID NO: 3375876 - RNA, 18 nt, Human
cagcccugcagagggcac

SEQ ID NO: 3375877 - RNA, 20 nt, Human
cagcccugcagagggcacag

SEQ ID NO: 3375878 - RNA, 14 nt, Human
cagcccugccugga

SEQ ID NO: 3375879 - RNA, 15 nt, Human
cagcccugccuggag

SEQ ID NO: 3375880 - RNA, 19 nt, Human
cagcccugccuggaggacc

SEQ ID NO: 3375881 - RNA, 20 nt, Human
cagcccugcugcugccugcc

SEQ ID NO: 3375882 - RNA, 13 nt, Human
cagcccugcuggg

SEQ ID NO: 3375883 - RNA, 15 nt, Human
cagcccugcugggga

SEQ ID NO: 3375884 - RNA, 20 nt, Human
cagcccugcuggggaucccc

SEQ ID NO: 3375885 - RNA, 19 nt, Human
cagcccugcuuugggcugc

SEQ ID NO: 3375886 - RNA, 21 nt, Human
cagcccugcuuugggcugccc

SEQ ID NO: 3375887 - RNA, 18 nt, Human
cagcccuggaggugccag

SEQ ID NO: 3375888 - RNA, 19 nt, Human
cagcccuggaggugccagc

SEQ ID NO: 3375889 - RNA, 14 nt, Human
cagcccuggaguca

SEQ ID NO: 3375890 - RNA, 20 nt, Human
cagcccuggagucaugccaa

SEQ ID NO: 3375891 - RNA, 18 nt, Human
cagcccuggcccaucaug

SEQ ID NO: 3375892 - RNA, 16 nt, Human
cagcccuggcucugca

SEQ ID NO: 3375893 - RNA, 13 nt, Human
cagcccuggcuga

SEQ ID NO: 3375894 - RNA, 15 nt, Human
cagcccuggcugaag

SEQ ID NO: 3375895 - RNA, 11 nt, Human
cagcccugggc

SEQ ID NO: 3375896 - RNA, 12 nt, Human
cagcccugggcc

SEQ ID NO: 3375897 - RNA, 19 nt, Human
cagcccugggccccaccac

SEQ ID NO: 3375898 - RNA, 18 nt, Human
cagcccuggggcugggcc

SEQ ID NO: 3375899 - RNA, 13 nt, Human
cagcccuggucuc

SEQ ID NO: 3375900 - RNA, 12 nt, Human
cagcccugucag

SEQ ID NO: 3375901 - RNA, 16 nt, Human
cagcccugucagugca

SEQ ID NO: 3375902 - RNA, 20 nt, Human
cagcccugucagugcagccc

SEQ ID NO: 3375903 - RNA, 21 nt, Human
cagcccugucugaaggacacu

SEQ ID NO: 3375904 - RNA, 15 nt, Human
cagcccuuagcaggg

SEQ ID NO: 3375905 - RNA, 21 nt, Human
cagcccuuagcagggaaacag

SEQ ID NO: 3375906 - RNA, 20 nt, Human
cagcccuucuuuccacagaa

SEQ ID NO: 3375907 - RNA, 20 nt, Human
cagcccuuggggguccuccu

SEQ ID NO: 3375908 - RNA, 23 nt, Human
cagcccuuggggguccuccucca

SEQ ID NO: 3375909 - RNA, 19 nt, Human
cagcccuuugggaggcuga

SEQ ID NO: 3375910 - RNA, 14 nt, Human
cagcccuuuugucu

SEQ ID NO: 3375911 - RNA, 20 nt, Human
cagccgagauagccaaggcc

SEQ ID NO: 3375912 - RNA, 21 nt, Human
cagccgagauagccaaggcca

SEQ ID NO: 3375913 - RNA, 21 nt, Human
cagccgagcaggaggccuagg

SEQ ID NO: 3375914 - RNA, 14 nt, Human
cagccgagccgggc

SEQ ID NO: 3375915 - RNA, 15 nt, Human
cagauaccucacccu

SEQ ID NO: 3375916 - RNA, 19 nt, Human
cagauaccuccaacccugc

SEQ ID NO: 3375917 - RNA, 20 nt, Human
cagauaccuccaacccugcc

SEQ ID NO: 3375918 - RNA, 18 nt, Human
cagauaccuuaucuuaca

SEQ ID NO: 3375919 - RNA, 23 nt, Human
cagauaccuuaucuuacaauauu

SEQ ID NO: 3375920 - RNA, 22 nt, Human
cagauacggacagagaccaaga

SEQ ID NO: 3375921 - RNA, 22 nt, Human
cagauacuggaaguuuugcauu

SEQ ID NO: 3375922 - RNA, 13 nt, Human
cagauacuggauu

SEQ ID NO: 3375923 - RNA, 14 nt, Human
cagauacuggauug

SEQ ID NO: 3375924 - RNA, 15 nt, Human
cagauagaaagcauu

SEQ ID NO: 3375925 - RNA, 16 nt, Human
cagauagaaucaauca

SEQ ID NO: 3375926 - RNA, 17 nt, Human
cagauaggccuucuugu

SEQ ID NO: 3375927 - RNA, 18 nt, Human
cagauaggccuucuugug

SEQ ID NO: 3375928 - RNA, 20 nt, Human
cagauauauaucauauuggu

SEQ ID NO: 3375929 - RNA, 15 nt, Human
cagauauauauucau

SEQ ID NO: 3375930 - RNA, 11 nt, Human
cagauauuuau

SEQ ID NO: 3375931 - RNA, 22 nt, Human
cagaucaccagcccggccugcu

SEQ ID NO: 3375932 - RNA, 19 nt, Human
cagaucacugaauuuauaa

SEQ ID NO: 3375933 - RNA, 15 nt, Human
cagaucacugccaca

SEQ ID NO: 3375934 - RNA, 16 nt, Human
cagaucacugccacac

SEQ ID NO: 3375935 - RNA, 15 nt, Human
cagaucagccagaag

SEQ ID NO: 3375936 - RNA, 20 nt, Human
cagaucagcuccuaacccuu

SEQ ID NO: 3375937 - RNA, 17 nt, Human
cagaucagucagagccc

SEQ ID NO: 3375938 - RNA, 19 nt, Human
cagaucauuucaaaacuca

SEQ ID NO: 3375939 - RNA, 17 nt, Human
cagauccagccuggggu

SEQ ID NO: 3375940 - RNA, 13 nt, Human
cagauccaggacu

SEQ ID NO: 3375941 - RNA, 15 nt, Human
cagauccagggacug

SEQ ID NO: 3375942 - RNA, 22 nt, Human
cagaucccagaaggaccuccug

SEQ ID NO: 3375943 - RNA, 12 nt, Human
cagaucccagcu

SEQ ID NO: 3375944 - RNA, 14 nt, Human
cagaucccagcuca

SEQ ID NO: 3375945 - RNA, 15 nt, Human
cagaucccagcucac

SEQ ID NO: 3375946 - RNA, 14 nt, Human
cagauccccaagcc

SEQ ID NO: 3375947 - RNA, 11 nt, Human
cagauccuacc

SEQ ID NO: 3375948 - RNA, 14 nt, Human
cagauccuccucau

SEQ ID NO: 3375949 - RNA, 13 nt, Human
cagauccucuugg

SEQ ID NO: 3375950 - RNA, 22 nt, Human
cagauccugaucuuaagaggcu

SEQ ID NO: 3375951 - RNA, 13 nt, Human
cagauccuuguuu

SEQ ID NO: 3375952 - RNA, 14 nt, Human
cagauccuuguuuc

SEQ ID NO: 3375953 - RNA, 16 nt, Human
cagauccuuguuucaa

SEQ ID NO: 3375954 - RNA, 19 nt, Human
cagccggccucucuggccu

SEQ ID NO: 3375955 - RNA, 20 nt, Human
cagccggccucucuggccuc

SEQ ID NO: 3375956 - RNA, 20 nt, Human
cagccggcguggcaaauaua

SEQ ID NO: 3375957 - RNA, 21 nt, Human
cagccggcguggcaaauauaa

SEQ ID NO: 3375958 - RNA, 17 nt, Human
cagccggggaagacuug

SEQ ID NO: 3375959 - RNA, 14 nt, Human
cagccgugagcaug

SEQ ID NO: 3375960 - RNA, 16 nt, Human
cagccgugaugcucag

SEQ ID NO: 3375961 - RNA, 9 nt, Human
cagccgugc

SEQ ID NO: 3375962 - RNA, 16 nt, Human
cagccgugccuucagc

SEQ ID NO: 3375963 - RNA, 18 nt, Human
cagccgugccuucagcuc

SEQ ID NO: 3375964 - RNA, 20 nt, Human
cagccgugccuucagcucua

SEQ ID NO: 3375965 - RNA, 15 nt, Human
cagccuaccaugaga

SEQ ID NO: 3375966 - RNA, 20 nt, Human
cagccuacuagggaccuggg

SEQ ID NO: 3375967 - RNA, 19 nt, Human
cagccuagcacagcagcuu

SEQ ID NO: 3375968 - RNA, 20 nt, Human
cagccuagccgaccucagcc

SEQ ID NO: 3375969 - RNA, 21 nt, Human
cagccuagccgaccucagccu

SEQ ID NO: 3375970 - RNA, 22 nt, Human
cagccuagccgaccucagccuu

SEQ ID NO: 3375971 - RNA, 20 nt, Human
cagccucaaauccaggaccc

SEQ ID NO: 3375972 - RNA, 19 nt, Human
cagccucaaccuccugggc

SEQ ID NO: 3375973 - RNA, 21 nt, Human
cagccucaaccuccugggcua

SEQ ID NO: 3375974 - RNA, 21 nt, Human
cagccucaagucacucccaag

SEQ ID NO: 3375975 - RNA, 19 nt, Human
cagccucaauaagccuugu

SEQ ID NO: 3375976 - RNA, 14 nt, Human
cagccucacagucc

SEQ ID NO: 3375977 - RNA, 15 nt, Human
cagccucacccuugc

SEQ ID NO: 3375978 - RNA, 12 nt, Human
cagccucagaga

SEQ ID NO: 3375979 - RNA, 14 nt, Human
cagccucaggacug

SEQ ID NO: 3375980 - RNA, 16 nt, Human
cagccucaggacuggg

SEQ ID NO: 3375981 - RNA, 17 nt, Human
cagccucaggacuggga

SEQ ID NO: 3375982 - RNA, 19 nt, Human
cagccucaggacugggagc

SEQ ID NO: 3375983 - RNA, 21 nt, Human
cagccucaggacugggagccc

SEQ ID NO: 3375984 - RNA, 23 nt, Human
cagccucaggacugggagccccc

SEQ ID NO: 3375985 - RNA, 22 nt, Human
cagccucagggacgacucugac

SEQ ID NO: 3375986 - RNA, 22 nt, Human
cagccuccaacacaaggcucca

SEQ ID NO: 3375987 - RNA, 14 nt, Human
cagccuccaagcuc

SEQ ID NO: 3375988 - RNA, 20 nt, Human
cagccuccaagcuccaucuc

SEQ ID NO: 3375989 - RNA, 17 nt, Human
cagccuccagccucugu

SEQ ID NO: 3375990 - RNA, 23 nt, Human
cagccucccaaagugcugggauu

SEQ ID NO: 3375991 - RNA, 16 nt, Human
cagccucccaccccca

SEQ ID NO: 3375992 - RNA, 14 nt, Human
cagccucccaucca

SEQ ID NO: 3375993 - RNA, 19 nt, Human
cagccucccauccagggcc

SEQ ID NO: 3375994 - RNA, 16 nt, Human
cagccuccccugccag

SEQ ID NO: 3375995 - RNA, 19 nt, Human
cagccuccccugccagggc

SEQ ID NO: 3375996 - RNA, 21 nt, Human
cagccucccgaauagcuggga

SEQ ID NO: 3375997 - RNA, 19 nt, Human
cagccucccgaguagcugg

SEQ ID NO: 3375998 - RNA, 21 nt, Human
cagccucccgaguagcuggga

SEQ ID NO: 3375999 - RNA, 13 nt, Human
cagccucccucug

SEQ ID NO: 3376000 - RNA, 14 nt, Human
cagccucccucuga

SEQ ID NO: 3376001 - RNA, 15 nt, Human
cagccucccucugac

SEQ ID NO: 3376002 - RNA, 16 nt, Human
cagccucccugaagcc

SEQ ID NO: 3376003 - RNA, 17 nt, Human
cagccuccgagagggag

SEQ ID NO: 3376004 - RNA, 16 nt, Human
cagccuccgcuucccu

SEQ ID NO: 3376005 - RNA, 23 nt, Human
cagccuccucaucugggggagug

SEQ ID NO: 3376006 - RNA, 13 nt, Human
cagccuccuccug

SEQ ID NO: 3376007 - RNA, 15 nt, Human
cagccuccuccugac

SEQ ID NO: 3376008 - RNA, 23 nt, Human
cagccuccucuggacggcaggcu

SEQ ID NO: 3376009 - RNA, 22 nt, Human
cagccucgaacuccugggcuca

SEQ ID NO: 3376010 - RNA, 22 nt, Human
cagccucgcaggccucccugcc

SEQ ID NO: 3376011 - RNA, 15 nt, Human
cagccucuagggacc

SEQ ID NO: 3376012 - RNA, 19 nt, Human
cagccucuagggaccccuc

SEQ ID NO: 3376013 - RNA, 22 nt, Human
cagccucucagugcccuccagc

SEQ ID NO: 3376014 - RNA, 23 nt, Human
cagccucuccacucaugugacuc

SEQ ID NO: 3376015 - RNA, 15 nt, Human
cagccucucucccag

SEQ ID NO: 3376016 - RNA, 22 nt, Human
cagccucucucccagucuaccc

SEQ ID NO: 3376017 - RNA, 23 nt, Human
cagccucucucccagucuaccca

SEQ ID NO: 3376018 - RNA, 22 nt, Human
cagccucucuuccuaucccauc

SEQ ID NO: 3376019 - RNA, 23 nt, Human
cagccucucuugguuuccuuccu

SEQ ID NO: 3376020 - RNA, 21 nt, Human
cagccucugaaguuggacagc

SEQ ID NO: 3376021 - RNA, 13 nt, Human
cagccucugaccc

SEQ ID NO: 3376022 - RNA, 13 nt, Human
cagccucuggggg

SEQ ID NO: 3376023 - RNA, 23 nt, Human
cagccucugggggguggccaggc

SEQ ID NO: 3376024 - RNA, 17 nt, Human
cagccucugucaggccu

SEQ ID NO: 3376025 - RNA, 18 nt, Human
cagccucugucaggccuu

SEQ ID NO: 3376026 - RNA, 20 nt, Human
cagccucugucaggccuuca

SEQ ID NO: 3376027 - RNA, 14 nt, Human
cagccucuguuccc

SEQ ID NO: 3376028 - RNA, 15 nt, Human
cagccucuuaaagcu

SEQ ID NO: 3376029 - RNA, 19 nt, Human
cagccucuuucccuuccag

SEQ ID NO: 3376030 - RNA, 17 nt, Human
cagccugaacagaagcu

SEQ ID NO: 3376031 - RNA, 20 nt, Human
cagccugaaccccagggcug

SEQ ID NO: 3376032 - RNA, 13 nt, Human
cagccugagaguc

SEQ ID NO: 3376033 - RNA, 19 nt, Human
cagccugagcgacagugag

SEQ ID NO: 3376034 - RNA, 22 nt, Human
cagccugagcgacagugagacu

SEQ ID NO: 3376035 - RNA, 12 nt, Human
cagccugaggcu

SEQ ID NO: 3376036 - RNA, 10 nt, Human
cagccugagu

SEQ ID NO: 3376037 - RNA, 16 nt, Human
cagccugagucuccug

SEQ ID NO: 3376038 - RNA, 20 nt, Human
cagccugagucuccugugcc

SEQ ID NO: 3376039 - RNA, 14 nt, Human
cagccugcacagug

SEQ ID NO: 3376040 - RNA, 22 nt, Human
cagccugcacagugucccccag

SEQ ID NO: 3376041 - RNA, 23 nt, Human
cagccugcacuugggggcucagc

SEQ ID NO: 3376042 - RNA, 18 nt, Human
cagccugcagacucacug

SEQ ID NO: 3376043 - RNA, 21 nt, Human
cagccugcaggaccucgugcc

SEQ ID NO: 3376044 - RNA, 12 nt, Human
cagccugccacu

SEQ ID NO: 3376045 - RNA, 17 nt, Human
cagccugccacucaggc

SEQ ID NO: 3376046 - RNA, 21 nt, Human
cagccugcccaagcccaggcc

SEQ ID NO: 3376047 - RNA, 17 nt, Human
cagccugcccucuucau

SEQ ID NO: 3376048 - RNA, 15 nt, Human
cagccugccuggcag

SEQ ID NO: 3376049 - RNA, 13 nt, Human
cagccugcgccug

SEQ ID NO: 3376050 - RNA, 16 nt, Human
cagccugcgccugcug

SEQ ID NO: 3376051 - RNA, 22 nt, Human
cagccugcgccugcugcaugcc

SEQ ID NO: 3376052 - RNA, 23 nt, Human
cagccugcgccugcugcaugccc

SEQ ID NO: 3376053 - RNA, 16 nt, Human
cagccugcguggcuga

SEQ ID NO: 3376054 - RNA, 17 nt, Human
cagccugcguggcugac

SEQ ID NO: 3376055 - RNA, 19 nt, Human
cagccugcuaauuccccag

SEQ ID NO: 3376056 - RNA, 15 nt, Human
cagccugcuccagcu

SEQ ID NO: 3376057 - RNA, 20 nt, Human
cagccuggaaaccugucuga

SEQ ID NO: 3376058 - RNA, 17 nt, Human
cagccuggacccccagc

SEQ ID NO: 3376059 - RNA, 20 nt, Human
auuguuuccucuuccaaagu

SEQ ID NO: 3376060 - RNA, 16 nt, Human
auuguuucuauacaaa

SEQ ID NO: 3376061 - RNA, 16 nt, Human
auuguuucucugaaag

SEQ ID NO: 3376062 - RNA, 15 nt, Human
auuguuucugugggc

SEQ ID NO: 3376063 - RNA, 18 nt, Human
auuguuugaaacaaagaa

SEQ ID NO: 3376064 - RNA, 19 nt, Human
auuguuugaaacaaagaag

SEQ ID NO: 3376065 - RNA, 20 nt, Human
auuguuugaaacaaagaagg

SEQ ID NO: 3376066 - RNA, 14 nt, Human
auuguuugcuuauu

SEQ ID NO: 3376067 - RNA, 15 nt, Human
auuguuugcuuauug

SEQ ID NO: 3376068 - RNA, 22 nt, Human
auuguuugcuuauuguuccaag

SEQ ID NO: 3376069 - RNA, 19 nt, Human
auuguuugguaaauguuuc

SEQ ID NO: 3376070 - RNA, 21 nt, Human
auuguuugucuuuaacuguca

SEQ ID NO: 3376071 - RNA, 14 nt, Human
auuguuuuaaaaag

SEQ ID NO: 3376072 - RNA, 13 nt, Human
auuguuuuacaau

SEQ ID NO: 3376073 - RNA, 17 nt, Human
auuguuuuacaauaguu

SEQ ID NO: 3376074 - RNA, 19 nt, Human
auuguuuuagagacuaugg

SEQ ID NO: 3376075 - RNA, 13 nt, Human
auuguuuuaucau

SEQ ID NO: 3376076 - RNA, 18 nt, Human
auuguuuucaguguacau

SEQ ID NO: 3376077 - RNA, 19 nt, Human
auuguuuucaguguacaug

SEQ ID NO: 3376078 - RNA, 15 nt, Human
auuguuuugcacuuu

SEQ ID NO: 3376079 - RNA, 13 nt, Human
auuuaaaaaauaa

SEQ ID NO: 3376080 - RNA, 17 nt, Human
auuuaaaaaauaaauaa

SEQ ID NO: 3376081 - RNA, 22 nt, Human
auuuaaaaaauaaauaaaaacu

SEQ ID NO: 3376082 - RNA, 15 nt, Human
auuuaaaaagcccaa

SEQ ID NO: 3376083 - RNA, 18 nt, Human
auuuaaaaagcccaaccu

SEQ ID NO: 3376084 - RNA, 21 nt, Human
auuuaaaaagguuuaaaacua

SEQ ID NO: 3376085 - RNA, 14 nt, Human
auuuaaaaauagaa

SEQ ID NO: 3376086 - RNA, 16 nt, Human
auuuaaaaauagaaac

SEQ ID NO: 3376087 - RNA, 17 nt, Human
auuuaaaaauagaaaca

SEQ ID NO: 3376088 - RNA, 15 nt, Human
auuuaaaaauauauu

SEQ ID NO: 3376089 - RNA, 14 nt, Human
auuuaaaaauauuu

SEQ ID NO: 3376090 - RNA, 19 nt, Human
auuuaaaaaugagugugaa

SEQ ID NO: 3376091 - RNA, 21 nt, Human
auuuaaaaaugagugugaagg

SEQ ID NO: 3376092 - RNA, 13 nt, Human
auuuaaaaauguc

SEQ ID NO: 3376093 - RNA, 11 nt, Human
auuuaaaacaa

SEQ ID NO: 3376094 - RNA, 14 nt, Human
auuuaaaacaaaca

SEQ ID NO: 3376095 - RNA, 14 nt, Human
auuuaaaacagaca

SEQ ID NO: 3376096 - RNA, 16 nt, Human
auuuaaaacagacacu

SEQ ID NO: 3376097 - RNA, 13 nt, Human
auuuaaaacaugu

SEQ ID NO: 3376098 - RNA, 21 nt, Human
auuuaaaacauuaaaauauaa

SEQ ID NO: 3376099 - RNA, 14 nt, Human
auuuaaaagagcag

SEQ ID NO: 3376100 - RNA, 17 nt, Human
auuuaaaagagcaggcc

SEQ ID NO: 3376101 - RNA, 13 nt, Human
auuuaaaagauac

SEQ ID NO: 3376102 - RNA, 14 nt, Human
auuuaaaagauaca

SEQ ID NO: 3376103 - RNA, 16 nt, Human
auuuaaaagauacagu

SEQ ID NO: 3376104 - RNA, 17 nt, Human
auuuaaaagauacaguu

SEQ ID NO: 3376105 - RNA, 16 nt, Human
auuuaaaagauucauu

SEQ ID NO: 3376106 - RNA, 18 nt, Human
auuuaaaagauucauuuu

SEQ ID NO: 3376107 - RNA, 19 nt, Human
auuuaaaagggaagucuag

SEQ ID NO: 3376108 - RNA, 21 nt, Human
auuuaaaagggaagucuagag

SEQ ID NO: 3376109 - RNA, 21 nt, Human
auuuaaaaguaaaaugucuuu

SEQ ID NO: 3376110 - RNA, 15 nt, Human
auuuaaaagugucaa

SEQ ID NO: 3376111 - RNA, 13 nt, Human
auuuaaaauagca

SEQ ID NO: 3376112 - RNA, 20 nt, Human
auuuaaaauagcaaaagaag

SEQ ID NO: 3376113 - RNA, 16 nt, Human
auuuaaaaugauuaga

SEQ ID NO: 3376114 - RNA, 19 nt, Human
auuuaaacaauaaaugugc

SEQ ID NO: 3376115 - RNA, 13 nt, Human
auuuaaacacaca

SEQ ID NO: 3376116 - RNA, 15 nt, Human
auuuaaacacacaga

SEQ ID NO: 3376117 - RNA, 18 nt, Human
auuuaaacacauuaaagg

SEQ ID NO: 3376118 - RNA, 20 nt, Human
auuuaaacagcaguguuccc

SEQ ID NO: 3376119 - RNA, 17 nt, Human
auuuaaacaggcccagc

SEQ ID NO: 3376120 - RNA, 18 nt, Human
auuuaaacccauuuuagu

SEQ ID NO: 3376121 - RNA, 18 nt, Human
auuuaaaccgcuaaaaga

SEQ ID NO: 3376122 - RNA, 24 nt, Human
auuuaaaccgcuaaaagaaacuuu

SEQ ID NO: 3376123 - RNA, 20 nt, Human
auuuaaaccuuuuauuauaa

SEQ ID NO: 3376124 - RNA, 23 nt, Human
auuuaaacucugaauuuaucuuu

SEQ ID NO: 3376125 - RNA, 23 nt, Human
auuuaaagaaauauguauucugu

SEQ ID NO: 3376126 - RNA, 16 nt, Human
auuuaaagacaaagac

SEQ ID NO: 3376127 - RNA, 13 nt, Human
auuuaaagauauu

SEQ ID NO: 3376128 - RNA, 12 nt, Human
auuuaaagcagg

SEQ ID NO: 3376129 - RNA, 15 nt, Human
auuuaaagcagguuc

SEQ ID NO: 3376130 - RNA, 19 nt, Human
auuuaaagcuuauuaaaac

SEQ ID NO: 3376131 - RNA, 19 nt, Human
auuuaaaggcuaccuuauu

SEQ ID NO: 3376132 - RNA, 22 nt, Human
auuuaaaggcuaccuuauugua

SEQ ID NO: 3376133 - RNA, 22 nt, Human
auuuaaaguuguuugugccuuu

SEQ ID NO: 3376134 - RNA, 21 nt, Human
auuuaaauacagucuuccauu

SEQ ID NO: 3376135 - RNA, 14 nt, Human
auuuaaauagauga

SEQ ID NO: 3376136 - RNA, 15 nt, Human
auuuaaauagaugac

SEQ ID NO: 3376137 - RNA, 16 nt, Human
auuuaaauagcuuuuu

SEQ ID NO: 3376138 - RNA, 15 nt, Human
auuuaaauauaauuc

SEQ ID NO: 3376139 - RNA, 22 nt, Human
auuuaaauauaauucuguaaau

SEQ ID NO: 3376140 - RNA, 20 nt, Human
auuuaaauccugaagagcau

SEQ ID NO: 3376141 - RNA, 17 nt, Human
auuuaaaugaaagaaaa

SEQ ID NO: 3376142 - RNA, 13 nt, Human
auuuaaaugccau

SEQ ID NO: 3376143 - RNA, 15 nt, Human
auuuaaauguguaca

SEQ ID NO: 3376144 - RNA, 23 nt, Human
auuuaaauguuaugacuauguaa

SEQ ID NO: 3376145 - RNA, 19 nt, Human
auuuaaauucuuuuuuaaa

SEQ ID NO: 3376146 - RNA, 16 nt, Human
auuuaaauuuaaagau

SEQ ID NO: 3376147 - RNA, 19 nt, Human
auuuaaauuuuacccuuua

SEQ ID NO: 3376148 - RNA, 20 nt, Human
auuuaacaaaaagugcuuca

SEQ ID NO: 3376149 - RNA, 16 nt, Human
auuuaacagaaaugua

SEQ ID NO: 3376150 - RNA, 17 nt, Human
auuuaacagaaauguac

SEQ ID NO: 3376151 - RNA, 17 nt, Human
auuuaacagaaauugua

SEQ ID NO: 3376152 - RNA, 20 nt, Human
auuuaacagaaauuguauau

SEQ ID NO: 3376153 - RNA, 22 nt, Human
auuuaacagaaauuguauauug

SEQ ID NO: 3376154 - RNA, 15 nt, Human
auuuaacagucauuu

SEQ ID NO: 3376155 - RNA, 17 nt, Human
auuuaacauuauuuaua

SEQ ID NO: 3376156 - RNA, 20 nt, Human
auuuaaccccccuguacaca

SEQ ID NO: 3376157 - RNA, 16 nt, Human
auuuaaccucuaaauu

SEQ ID NO: 3376158 - RNA, 18 nt, Human
auuuaaccucuaaauucu

SEQ ID NO: 3376159 - RNA, 13 nt, Human
auuuaacugacua

SEQ ID NO: 3376160 - RNA, 13 nt, Human
auuuaacuggcuu

SEQ ID NO: 3376161 - RNA, 21 nt, Human
cagccacuccccuccacucuc

SEQ ID NO: 3376162 - RNA, 18 nt, Human
cagccagaacucuguguc

SEQ ID NO: 3376163 - RNA, 14 nt, Human
cagccagacuggca

SEQ ID NO: 3376164 - RNA, 20 nt, Human
cagccagacuggcacaguuu

SEQ ID NO: 3376165 - RNA, 20 nt, Human
cagccagaguuccugcggag

SEQ ID NO: 3376166 - RNA, 17 nt, Human
cagccagauccucuugg

SEQ ID NO: 3376167 - RNA, 22 nt, Human
cagccagauggacuccagccug

SEQ ID NO: 3376168 - RNA, 13 nt, Human
cagccagcaauga

SEQ ID NO: 3376169 - RNA, 20 nt, Human
cagccagcaaugauguccag

SEQ ID NO: 3376170 - RNA, 11 nt, Human
cagccagcagc

SEQ ID NO: 3376171 - RNA, 21 nt, Human
cagccagcagccagcucucag

SEQ ID NO: 3376172 - RNA, 15 nt, Human
cagccagcaguucag

SEQ ID NO: 3376173 - RNA, 22 nt, Human
cagccagcaguucagagcugcc

SEQ ID NO: 3376174 - RNA, 17 nt, Human
cagccagcaucugggcc

SEQ ID NO: 3376175 - RNA, 12 nt, Human
cagccagccacu

SEQ ID NO: 3376176 - RNA, 18 nt, Human
cagccagcccugccugga

SEQ ID NO: 3376177 - RNA, 19 nt, Human
cagccagcccugccuggag

SEQ ID NO: 3376178 - RNA, 21 nt, Human
cagccagcccugccuggagga

SEQ ID NO: 3376179 - RNA, 22 nt, Human
cagccagcccugccuggaggac

SEQ ID NO: 3376180 - RNA, 17 nt, Human
cagccagcgccucccuc

SEQ ID NO: 3376181 - RNA, 23 nt, Human
cagccagcgccucccuccacccc

SEQ ID NO: 3376182 - RNA, 22 nt, Human
cagccagcgucggucugugccc

SEQ ID NO: 3376183 - RNA, 16 nt, Human
cagccagcucucagcc

SEQ ID NO: 3376184 - RNA, 12 nt, Human
cagccagcugcc

SEQ ID NO: 3376185 - RNA, 15 nt, Human
cagccagcugcccua

SEQ ID NO: 3376186 - RNA, 18 nt, Human
cagccaggagagcuuagg

SEQ ID NO: 3376187 - RNA, 14 nt, Human
cagccaggagcugg

SEQ ID NO: 3376188 - RNA, 22 nt, Human
cagccaggccacaagacccuug

SEQ ID NO: 3376189 - RNA, 18 nt, Human
cagccaggcucugugcug

SEQ ID NO: 3376190 - RNA, 12 nt, Human
cagccaggcugc

SEQ ID NO: 3376191 - RNA, 16 nt, Human
cagccagggagagccc

SEQ ID NO: 3376192 - RNA, 18 nt, Human
cagccagggagagcccag

SEQ ID NO: 3376193 - RNA, 19 nt, Human
cagccagggagagcccagg

SEQ ID NO: 3376194 - RNA, 22 nt, Human
cagccagggagagcccaggagc

SEQ ID NO: 3376195 - RNA, 21 nt, Human
cagccagggccugcgagggca

SEQ ID NO: 3376196 - RNA, 16 nt, Human
cagccagggcucaauc

SEQ ID NO: 3376197 - RNA, 16 nt, Human
cagccagggcugcuag

SEQ ID NO: 3376198 - RNA, 23 nt, Human
cagccaggggagcagaggggcag

SEQ ID NO: 3376199 - RNA, 13 nt, Human
cagccaggugccu

SEQ ID NO: 3376200 - RNA, 15 nt, Human
cagccaggugccuug

SEQ ID NO: 3376201 - RNA, 21 nt, Human
cagccagugaccugaggaagc

SEQ ID NO: 3376202 - RNA, 15 nt, Human
cagccaguucaaaaa

SEQ ID NO: 3376203 - RNA, 21 nt, Human
cagccauacuuaucucucugu

SEQ ID NO: 3376204 - RNA, 17 nt, Human
caggagaggagagccag

SEQ ID NO: 3376205 - RNA, 12 nt, Human
caggagaggagc

SEQ ID NO: 3376206 - RNA, 22 nt, Human
caggagaucgagaccauccugg

SEQ ID NO: 3376207 - RNA, 17 nt, Human
caggagaugcugugccc

SEQ ID NO: 3376208 - RNA, 16 nt, Human
caggagauugagaagg

SEQ ID NO: 3376209 - RNA, 22 nt, Human
caggagauugagaaggagagaa

SEQ ID NO: 3376210 - RNA, 22 nt, Human
caggagcaaauguuucugcagu

SEQ ID NO: 3376211 - RNA, 18 nt, Human
caggagcacaggcagcug

SEQ ID NO: 3376212 - RNA, 12 nt, Human
caggagcagcca

SEQ ID NO: 3376213 - RNA, 13 nt, Human
caggagcagccac

SEQ ID NO: 3376214 - RNA, 20 nt, Human
caggagcagccucagaacaa

SEQ ID NO: 3376215 - RNA, 11 nt, Human
caggagcccau

SEQ ID NO: 3376216 - RNA, 18 nt, Human
caggagccccgaggccuu

SEQ ID NO: 3376217 - RNA, 11 nt, Human
caggagcccug

SEQ ID NO: 3376218 - RNA, 14 nt, Human
caggagccuccugc

SEQ ID NO: 3376219 - RNA, 11 nt, Human
caggagccugg

SEQ ID NO: 3376220 - RNA, 16 nt, Human
caggagcgcaagauag

SEQ ID NO: 3376221 - RNA, 14 nt, Human
caggagcuccccuc

SEQ ID NO: 3376222 - RNA, 22 nt, Human
caggagcuccccuccccaacug

SEQ ID NO: 3376223 - RNA, 20 nt, Human
caggagcucuucaggccucc

SEQ ID NO: 3376224 - RNA, 23 nt, Human
caggagcuuccuguccucccagc

SEQ ID NO: 3376225 - RNA, 23 nt, Human
caggaggaaucaugucaggccug

SEQ ID NO: 3376226 - RNA, 17 nt, Human
caggaggacccagggcu

SEQ ID NO: 3376227 - RNA, 14 nt, Human
caggaggcagaagg

SEQ ID NO: 3376228 - RNA, 15 nt, Human
caggaggcaggaccu

SEQ ID NO: 3376229 - RNA, 12 nt, Human
caggaggcaggc

SEQ ID NO: 3376230 - RNA, 23 nt, Human
caggaggcaggcauggcccuggg

SEQ ID NO: 3376231 - RNA, 14 nt, Human
caggaggcaggguu

SEQ ID NO: 3376232 - RNA, 15 nt, Human
caggaggccagccuu

SEQ ID NO: 3376233 - RNA, 14 nt, Human
caggaggccccugg

SEQ ID NO: 3376234 - RNA, 16 nt, Human
caggaggccccuggcc

SEQ ID NO: 3376235 - RNA, 19 nt, Human
caggaggccccuggcccag

SEQ ID NO: 3376236 - RNA, 19 nt, Human
caggaggccggggccgggu

SEQ ID NO: 3376237 - RNA, 14 nt, Human
caggaggccuagga

SEQ ID NO: 3376238 - RNA, 13 nt, Human
caggaggcgcccu

SEQ ID NO: 3376239 - RNA, 15 nt, Human
caggaggcugaggca

SEQ ID NO: 3376240 - RNA, 13 nt, Human
caggaggcuggag

SEQ ID NO: 3376241 - RNA, 19 nt, Human
caggagggacaaaggagcc

SEQ ID NO: 3376242 - RNA, 20 nt, Human
caggagggacagucucacca

SEQ ID NO: 3376243 - RNA, 15 nt, Human
caggagggaggcagg

SEQ ID NO: 3376244 - RNA, 21 nt, Human
caggagggaggcaggggaggg

SEQ ID NO: 3376245 - RNA, 15 nt, Human
caggagggaggggga

SEQ ID NO: 3376246 - RNA, 23 nt, Human
caggagggagggggaaggcaggg

SEQ ID NO: 3376247 - RNA, 12 nt, Human
caggagggcccu

SEQ ID NO: 3376248 - RNA, 22 nt, Human
caggagggcggccuccuucuga

SEQ ID NO: 3376249 - RNA, 19 nt, Human
caggaggggaacacugccc

SEQ ID NO: 3376250 - RNA, 23 nt, Human
caggaggggggagggaagggagc

SEQ ID NO: 3376251 - RNA, 19 nt, Human
caggagggggucguggaga

SEQ ID NO: 3376252 - RNA, 20 nt, Human
caggagggucuauggggaga

SEQ ID NO: 3376253 - RNA, 20 nt, Human
caggaggugccacuggagug

SEQ ID NO: 3376254 - RNA, 19 nt, Human
caggagguggagguugcag

SEQ ID NO: 3376255 - RNA, 22 nt, Human
caggagguggcuauggccaccc

SEQ ID NO: 3376256 - RNA, 13 nt, Human
caggaguagcuga

SEQ ID NO: 3376257 - RNA, 14 nt, Human
caggaguagcugag

SEQ ID NO: 3376258 - RNA, 15 nt, Human
caggaguagugaaga

SEQ ID NO: 3376259 - RNA, 23 nt, Human
caggaguagugaagacuccagaa

SEQ ID NO: 3376260 - RNA, 19 nt, Human
caggaguccaagaccagac

SEQ ID NO: 3376261 - RNA, 14 nt, Human
caggagucccugcc

SEQ ID NO: 3376262 - RNA, 14 nt, Human
caggaguggguggg

SEQ ID NO: 3376263 - RNA, 17 nt, Human
caggaguggguugauuu

SEQ ID NO: 3376264 - RNA, 13 nt, Human
caggagugugugu

SEQ ID NO: 3376265 - RNA, 19 nt, Human
caggaguuagaggccagcc

SEQ ID NO: 3376266 - RNA, 21 nt, Human
caggaguucgagaccagccug

SEQ ID NO: 3376267 - RNA, 18 nt, Human
caggaguucgaggcugca

SEQ ID NO: 3376268 - RNA, 20 nt, Human
caggaguucugcucauucua

SEQ ID NO: 3376269 - RNA, 22 nt, Human
caggaguuuaagaccagccugg

SEQ ID NO: 3376270 - RNA, 21 nt, Human
caggaguuugaggcugcagcg

SEQ ID NO: 3376271 - RNA, 22 nt, Human
caggaguuugaggcugcagcga

SEQ ID NO: 3376272 - RNA, 16 nt, Human
caggaguuuggccaga

SEQ ID NO: 3376273 - RNA, 18 nt, Human
caggauacuggcacagag

SEQ ID NO: 3376274 - RNA, 19 nt, Human
caggauagagacuggaaca

SEQ ID NO: 3376275 - RNA, 19 nt, Human
caggaucaugguguaauaa

SEQ ID NO: 3376276 - RNA, 16 nt, Human
caggaucccaggggcc

SEQ ID NO: 3376277 - RNA, 21 nt, Human
caggaucccaggggcccaagg

SEQ ID NO: 3376278 - RNA, 22 nt, Human
caggaucccaggggcccaaggc

SEQ ID NO: 3376279 - RNA, 21 nt, Human
caggauccuauucucaccagg

SEQ ID NO: 3376280 - RNA, 20 nt, Human
caggauccucuccuuugaaa

SEQ ID NO: 3376281 - RNA, 19 nt, Human
caggaucucagaucacugc

SEQ ID NO: 3376282 - RNA, 23 nt, Human
caggaucucuuagcauuuuaauu

SEQ ID NO: 3376283 - RNA, 15 nt, Human
caggaugaacccagg

SEQ ID NO: 3376284 - RNA, 16 nt, Human
caggaugaacccagga

SEQ ID NO: 3376285 - RNA, 17 nt, Human
caggaugaacccaggac

SEQ ID NO: 3376286 - RNA, 15 nt, Human
caggaugaagcauuu

SEQ ID NO: 3376287 - RNA, 15 nt, Human
caggaugacccugcg

SEQ ID NO: 3376288 - RNA, 21 nt, Human
caggaugacgguauuaugcuu

SEQ ID NO: 3376289 - RNA, 18 nt, Human
caggaugagggaaaagaa

SEQ ID NO: 3376290 - RNA, 22 nt, Human
caggaugagggaaaagaaaaag

SEQ ID NO: 3376291 - RNA, 14 nt, Human
caggaugcccaggg

SEQ ID NO: 3376292 - RNA, 23 nt, Human
caggaugcuaacaucuaaaaaua

SEQ ID NO: 3376293 - RNA, 16 nt, Human
caggaugcuggguggc

SEQ ID NO: 3376294 - RNA, 21 nt, Human
caggauggaggggugguccug

SEQ ID NO: 3376295 - RNA, 23 nt, Human
caggauggaggggugguccugac

SEQ ID NO: 3376296 - RNA, 15 nt, Human
caggauggccuggcc

SEQ ID NO: 3376297 - RNA, 14 nt, Human
caggaugguaauuc

SEQ ID NO: 3376298 - RNA, 23 nt, Human
caggaugguucccuugaugaaga

SEQ ID NO: 3376299 - RNA, 21 nt, Human
caggauguggcuuaugagaua

SEQ ID NO: 3376300 - RNA, 20 nt, Human
caggauguguuugcuuucug

SEQ ID NO: 3376301 - RNA, 15 nt, Human
caggauucagccgga

SEQ ID NO: 3376302 - RNA, 14 nt, Human
caggauucuccuuu

SEQ ID NO: 3376303 - RNA, 13 nt, Human
caggauugaagag

SEQ ID NO: 3376304 - RNA, 18 nt, Human
caggauugcgagagaugu

SEQ ID NO: 3376305 - RNA, 20 nt, Human
caggauugcgagagaugugu

SEQ ID NO: 3376306 - RNA, 22 nt, Human
caggauugcgagagaugugugu

SEQ ID NO: 3376307 - RNA, 17 nt, Human
caggauuugcugggaga

SEQ ID NO: 3376308 - RNA, 14 nt, Human
caggcaaaauccuu

SEQ ID NO: 3376309 - RNA, 16 nt, Human
caggcaaauaaaauuc

SEQ ID NO: 3376310 - RNA, 22 nt, Human
caggcaacgcacaaaacagaaa

SEQ ID NO: 3376311 - RNA, 20 nt, Human
caggcaacugaggcagacag

SEQ ID NO: 3376312 - RNA, 22 nt, Human
caggcaacuucaguccugggag

SEQ ID NO: 3376313 - RNA, 16 nt, Human
caggcaagcaccuccu

SEQ ID NO: 3376314 - RNA, 13 nt, Human
caggcaaggcugu

SEQ ID NO: 3376315 - RNA, 18 nt, Human
caggcaagugaagaaaag

SEQ ID NO: 3376316 - RNA, 15 nt, Human
caggcaaugcuggcu

SEQ ID NO: 3376317 - RNA, 16 nt, Human
caggcaaugcuggcug

SEQ ID NO: 3376318 - RNA, 23 nt, Human
caggcacacaaggggcccuugga

SEQ ID NO: 3376319 - RNA, 13 nt, Human
caggcacacagcu

SEQ ID NO: 3376320 - RNA, 13 nt, Human
auuuauauguaug

SEQ ID NO: 3376321 - RNA, 16 nt, Human
auuuauauguaugugu

SEQ ID NO: 3376322 - RNA, 13 nt, Human
auuuauauugaua

SEQ ID NO: 3376323 - RNA, 22 nt, Human
auuuauauugauaagaucuuuu

SEQ ID NO: 3376324 - RNA, 20 nt, Human
auuuauauuguaaauauugu

SEQ ID NO: 3376325 - RNA, 13 nt, Human
auuuauauuuuug

SEQ ID NO: 3376326 - RNA, 22 nt, Human
auuuaucaaagcauagauguuu

SEQ ID NO: 3376327 - RNA, 12 nt, Human
auuuaucaaauc

SEQ ID NO: 3376328 - RNA, 17 nt, Human
auuuaucaaucaguaua

SEQ ID NO: 3376329 - RNA, 18 nt, Human
auuuaucaaucaguauaa

SEQ ID NO: 3376330 - RNA, 13 nt, Human
auuuaucauucuu

SEQ ID NO: 3376331 - RNA, 22 nt, Human
auuuauccagaaaacugugauu

SEQ ID NO: 3376332 - RNA, 15 nt, Human
auuuauccauuugua

SEQ ID NO: 3376333 - RNA, 13 nt, Human
auuuaucuaaauu

SEQ ID NO: 3376334 - RNA, 10 nt, Human
auuuaucuau

SEQ ID NO: 3376335 - RNA, 17 nt, Human
auuuaucuauuguaaga

SEQ ID NO: 3376336 - RNA, 23 nt, Human
auuuaucuauuguaagauaaaaa

SEQ ID NO: 3376337 - RNA, 19 nt, Human
auuuaucuugaaggaaaaa

SEQ ID NO: 3376338 - RNA, 19 nt, Human
auuuaucuugucucugggc

SEQ ID NO: 3376339 - RNA, 22 nt, Human
auuuaucuuuacuuuuaaacag

SEQ ID NO: 3376340 - RNA, 13 nt, Human
auuuaugaaaaga

SEQ ID NO: 3376341 - RNA, 16 nt, Human
auuuaugaagaaaaua

SEQ ID NO: 3376342 - RNA, 20 nt, Human
auuuaugaguaacuauuauu

SEQ ID NO: 3376343 - RNA, 15 nt, Human
auuuaugaguuuuug

SEQ ID NO: 3376344 - RNA, 19 nt, Human
auuuaugauuuaauaaaau

SEQ ID NO: 3376345 - RNA, 19 nt, Human
auuuaugcacuuauaaggu

SEQ ID NO: 3376346 - RNA, 16 nt, Human
auuuaugcauauuauu

SEQ ID NO: 3376347 - RNA, 15 nt, Human
auuuaugggccccug

SEQ ID NO: 3376348 - RNA, 21 nt, Human
cagccucucagugcccuccag

SEQ ID NO: 3376349 - RNA, 16 nt, Human
cagccucuccccaggu

SEQ ID NO: 3376350 - RNA, 20 nt, Human
cagccucuccccagguccag

SEQ ID NO: 3376351 - RNA, 18 nt, Human
cagccucuccccugccug

SEQ ID NO: 3376352 - RNA, 12 nt, Human
cagccucucucc

SEQ ID NO: 3376353 - RNA, 17 nt, Human
cagccucucuuccuauc

SEQ ID NO: 3376354 - RNA, 20 nt, Human
cagccucucuuccuauccca

SEQ ID NO: 3376355 - RNA, 22 nt, Human
cagccucucuugguuuccuucc

SEQ ID NO: 3376356 - RNA, 17 nt, Human
cagccucugaaaaccaa

SEQ ID NO: 3376357 - RNA, 12 nt, Human
cagccucugaag

SEQ ID NO: 3376358 - RNA, 20 nt, Human
cagccucugaccccuccuca

SEQ ID NO: 3376359 - RNA, 23 nt, Human
cagccucugaccccuccucacug

SEQ ID NO: 3376360 - RNA, 18 nt, Human
cagccucugagccccugg

SEQ ID NO: 3376361 - RNA, 13 nt, Human
cagccucuggcau

SEQ ID NO: 3376362 - RNA, 22 nt, Human
cagccucugggggguggccagg

SEQ ID NO: 3376363 - RNA, 11 nt, Human
cagccucuuaa

SEQ ID NO: 3376364 - RNA, 21 nt, Human
cagccucuuaaagcugccugu

SEQ ID NO: 3376365 - RNA, 20 nt, Human
cagccucuuucccuuccagu

SEQ ID NO: 3376366 - RNA, 16 nt, Human
cagccucuuucugucc

SEQ ID NO: 3376367 - RNA, 18 nt, Human
cagccugagcgacaguga

SEQ ID NO: 3376368 - RNA, 23 nt, Human
cagccugaggcagccacuucggc

SEQ ID NO: 3376369 - RNA, 18 nt, Human
cagccugaggcugagacu

SEQ ID NO: 3376370 - RNA, 15 nt, Human
cagccugagucuccu

SEQ ID NO: 3376371 - RNA, 22 nt, Human
cagccugagucuccugugccca

SEQ ID NO: 3376372 - RNA, 14 nt, Human
cagccugcguggcu

SEQ ID NO: 3376373 - RNA, 15 nt, Human
cagccugcguggcug

SEQ ID NO: 3376374 - RNA, 19 nt, Human
cagccugcguggcugaccc

SEQ ID NO: 3376375 - RNA, 23 nt, Human
cagccugcguggcugaccccccu

SEQ ID NO: 3376376 - RNA, 23 nt, Human
cagccugcuagcuagcucaacua

SEQ ID NO: 3376377 - RNA, 20 nt, Human
cagccugcuccuucccagga

SEQ ID NO: 3376378 - RNA, 21 nt, Human
cagccugcuccuucccaggag

SEQ ID NO: 3376379 - RNA, 22 nt, Human
cagccugcuccuucccaggagu

SEQ ID NO: 3376380 - RNA, 23 nt, Human
cagccugcuucccaccucccugc

SEQ ID NO: 3376381 - RNA, 15 nt, Human
cagccuggaccccca

SEQ ID NO: 3376382 - RNA, 16 nt, Human
cagccuggacccccag

SEQ ID NO: 3376383 - RNA, 16 nt, Human
cagccuggagaugaaa

SEQ ID NO: 3376384 - RNA, 16 nt, Human
cagccuggaugccauc

SEQ ID NO: 3376385 - RNA, 19 nt, Human
cagccuggccacgcagcca

SEQ ID NO: 3376386 - RNA, 20 nt, Human
cagccuggccacgcagccag

SEQ ID NO: 3376387 - RNA, 15 nt, Human
cagccuggcccagcu

SEQ ID NO: 3376388 - RNA, 19 nt, Human
cagccuggcccagcucccc

SEQ ID NO: 3376389 - RNA, 14 nt, Human
cagccuggccuccu

SEQ ID NO: 3376390 - RNA, 18 nt, Human
cagccuggccuccugccu

SEQ ID NO: 3376391 - RNA, 12 nt, Human
cagccuggcucc

SEQ ID NO: 3376392 - RNA, 23 nt, Human
cagccuggcucccacaggcagcu

SEQ ID NO: 3376393 - RNA, 14 nt, Human
cagccuggcuggga

SEQ ID NO: 3376394 - RNA, 15 nt, Human
cagccuggcuucugg

SEQ ID NO: 3376395 - RNA, 20 nt, Human
cagccugggaaagccccugc

SEQ ID NO: 3376396 - RNA, 23 nt, Human
cagccugggacaguuuaucauga

SEQ ID NO: 3376397 - RNA, 16 nt, Human
cagccugggaggcaca

SEQ ID NO: 3376398 - RNA, 20 nt, Human
cagccugggcaacacagcga

SEQ ID NO: 3376399 - RNA, 12 nt, Human
cagccugggccc

SEQ ID NO: 3376400 - RNA, 18 nt, Human
cagccugggcccaucucc

SEQ ID NO: 3376401 - RNA, 13 nt, Human
cagccugggccua

SEQ ID NO: 3376402 - RNA, 20 nt, Human
cagccugggccuauggagag

SEQ ID NO: 3376403 - RNA, 15 nt, Human
cagccugggcgcugg

SEQ ID NO: 3376404 - RNA, 23 nt, Human
cagccugggcgcugguccuuucu

SEQ ID NO: 3376405 - RNA, 15 nt, Human
cagccuggggccugg

SEQ ID NO: 3376406 - RNA, 19 nt, Human
cagccuggggccuggcagg

SEQ ID NO: 3376407 - RNA, 20 nt, Human
cagccuggggccuggcaggg

SEQ ID NO: 3376408 - RNA, 22 nt, Human
cagccuggggccuggcagggag

SEQ ID NO: 3376409 - RNA, 20 nt, Human
cagccuggucaacaugguga

SEQ ID NO: 3376410 - RNA, 23 nt, Human
cagccugguccaugcagggggcu

SEQ ID NO: 3376411 - RNA, 15 nt, Human
cagccuggugggccu

SEQ ID NO: 3376412 - RNA, 17 nt, Human
cagccuggugggccucc

SEQ ID NO: 3376413 - RNA, 18 nt, Human
cagccuggugggccuccu

SEQ ID NO: 3376414 - RNA, 21 nt, Human
cagccugucagauccaggagc

SEQ ID NO: 3376415 - RNA, 15 nt, Human
cagccuguccugggc

SEQ ID NO: 3376416 - RNA, 19 nt, Human
cagccuguccugggcuggu

SEQ ID NO: 3376417 - RNA, 16 nt, Human
cagccugucucuucca

SEQ ID NO: 3376418 - RNA, 17 nt, Human
cagccugucucuuccau

SEQ ID NO: 3376419 - RNA, 12 nt, Human
cagccuguggca

SEQ ID NO: 3376420 - RNA, 15 nt, Human
cagccuguggcaucu

SEQ ID NO: 3376421 - RNA, 19 nt, Human
cagccuguggcaucuuugc

SEQ ID NO: 3376422 - RNA, 20 nt, Human
cagccuguggcggugccugg

SEQ ID NO: 3376423 - RNA, 23 nt, Human
cagccugugucuuuaaaugcugc

SEQ ID NO: 3376424 - RNA, 14 nt, Human
cagccuuaauauuu

SEQ ID NO: 3376425 - RNA, 19 nt, Human
cagccuuagcucucccaac

SEQ ID NO: 3376426 - RNA, 21 nt, Human
cagccuuagcucucccaacuc

SEQ ID NO: 3376427 - RNA, 21 nt, Human
cagccuuccccuugcccaggg

SEQ ID NO: 3376428 - RNA, 15 nt, Human
cagccuuccucugca

SEQ ID NO: 3376429 - RNA, 16 nt, Human
cagccuucuuccaucc

SEQ ID NO: 3376430 - RNA, 21 nt, Human
cagccuucuuccaucccagga

SEQ ID NO: 3376431 - RNA, 14 nt, Human
cagccuucuuugcu

SEQ ID NO: 3376432 - RNA, 21 nt, Human
cagccuucuuugcuugccucu

SEQ ID NO: 3376433 - RNA, 18 nt, Human
cagccuugaacucugggc

SEQ ID NO: 3376434 - RNA, 17 nt, Human
cagccuugaccauucuc

SEQ ID NO: 3376435 - RNA, 23 nt, Human
cagccuugaccauucuccaccug

SEQ ID NO: 3376436 - RNA, 16 nt, Human
cagccuugccagagau

SEQ ID NO: 3376437 - RNA, 18 nt, Human
cagccuuucucccaggcc

SEQ ID NO: 3376438 - RNA, 18 nt, Human
cagccuuuggccuuggcu

SEQ ID NO: 3376439 - RNA, 14 nt, Human
cagccuuugggaaa

SEQ ID NO: 3376440 - RNA, 14 nt, Human
cagccuuuguuccc

SEQ ID NO: 3376441 - RNA, 15 nt, Human
cagccuuuguucccc

SEQ ID NO: 3376442 - RNA, 20 nt, Human
cagccuuuguuccccacugg

SEQ ID NO: 3376443 - RNA, 21 nt, Human
cagccuuuguuccccacugga

SEQ ID NO: 3376444 - RNA, 18 nt, Human
cagccuuuuuguuucaau

SEQ ID NO: 3376445 - RNA, 22 nt, Human
cagcgaaguagcuugcucccug

SEQ ID NO: 3376446 - RNA, 13 nt, Human
cagcgaaugacaa

SEQ ID NO: 3376447 - RNA, 20 nt, Human
cagcgaccaccccugccucc

SEQ ID NO: 3376448 - RNA, 21 nt, Human
cagcgaccaccccugccucca

SEQ ID NO: 3376449 - RNA, 17 nt, Human
cagcgaccgcccccucc

SEQ ID NO: 3376450 - RNA, 18 nt, Human
cagcgaccuuccucaucc

SEQ ID NO: 3376451 - RNA, 21 nt, Human
cagcgacuccguuggccacuc

SEQ ID NO: 3376452 - RNA, 22 nt, Human
cagcgacuccguuggccacucc

SEQ ID NO: 3376453 - RNA, 20 nt, Human
cagcgagaggcagagaaaga

SEQ ID NO: 3376454 - RNA, 20 nt, Human
cagcgagcccugguggcagu

SEQ ID NO: 3376455 - RNA, 14 nt, Human
cagcgagccugcua

SEQ ID NO: 3376456 - RNA, 17 nt, Human
cagcgaggaggcuccag

SEQ ID NO: 3376457 - RNA, 18 nt, Human
cagcgagggcagcugcua

SEQ ID NO: 3376458 - RNA, 21 nt, Human
cagcgauucccucucccaggc

SEQ ID NO: 3376459 - RNA, 13 nt, Human
cagcgcacagcug

SEQ ID NO: 3376460 - RNA, 14 nt, Human
cagcgcacagcugc

SEQ ID NO: 3376461 - RNA, 17 nt, Human
cagcgccaagcaaccug

SEQ ID NO: 3376462 - RNA, 18 nt, Human
cagcgccaagugcgugcc

SEQ ID NO: 3376463 - RNA, 14 nt, Human
cagcgccagccugu

SEQ ID NO: 3376464 - RNA, 12 nt, Human
cagcgccaggcu

SEQ ID NO: 3376465 - RNA, 21 nt, Human
cagcgccaggcugaccacagc

SEQ ID NO: 3376466 - RNA, 22 nt, Human
cagcgccaggcugaccacagca

SEQ ID NO: 3376467 - RNA, 16 nt, Human
cagcgcccgcugggcu

SEQ ID NO: 3376468 - RNA, 17 nt, Human
cagcgcccgcugggcug

SEQ ID NO: 3376469 - RNA, 14 nt, Human
cagcgcccuuccuc

SEQ ID NO: 3376470 - RNA, 16 nt, Human
cagcgcccuuccucuc

SEQ ID NO: 3376471 - RNA, 20 nt, Human
cagcgcccuuccucuccacc

SEQ ID NO: 3376472 - RNA, 23 nt, Human
cagcgccuaguggggucucccuc

SEQ ID NO: 3376473 - RNA, 12 nt, Human
cagcgccucccu

SEQ ID NO: 3376474 - RNA, 15 nt, Human
cagcgccucccucca

SEQ ID NO: 3376475 - RNA, 20 nt, Human
cagcgcggacauccccugcu

SEQ ID NO: 3376476 - RNA, 17 nt, Human
cagcgcggcccucccga

SEQ ID NO: 3376477 - RNA, 12 nt, Human
cagcgcugacgu

SEQ ID NO: 3376478 - RNA, 24 nt, Human
cagcgcuggccgggaccccgagcc

SEQ ID NO: 3376479 - RNA, 20 nt, Human
caggcacaggaugcuguguu

SEQ ID NO: 3376480 - RNA, 14 nt, Human
caggcacaggcagg

SEQ ID NO: 3376481 - RNA, 19 nt, Human
caggcacaggcagggcagg

SEQ ID NO: 3376482 - RNA, 16 nt, Human
caggcaccaaaagaag

SEQ ID NO: 3376483 - RNA, 19 nt, Human
caggcaccaaaagaaguaa

SEQ ID NO: 3376484 - RNA, 18 nt, Human
caggcacccaccaucaug

SEQ ID NO: 3376485 - RNA, 16 nt, Human
caggcacccccuggag

SEQ ID NO: 3376486 - RNA, 17 nt, Human
caggcacccccuggaga

SEQ ID NO: 3376487 - RNA, 21 nt, Human
caggcacccccuggagagaag

SEQ ID NO: 3376488 - RNA, 23 nt, Human
caggcacccuucuuuccucuucc

SEQ ID NO: 3376489 - RNA, 19 nt, Human
caggcaccuagcaauucca

SEQ ID NO: 3376490 - RNA, 15 nt, Human
caggcaccucuuccu

SEQ ID NO: 3376491 - RNA, 19 nt, Human
auuuuaugcuuuaaacauu

SEQ ID NO: 3376492 - RNA, 14 nt, Human
auuuuauggugcau

SEQ ID NO: 3376493 - RNA, 22 nt, Human
auuuuauggugccuaguauuga

SEQ ID NO: 3376494 - RNA, 23 nt, Human
auuuuaugguuauguuuuucugu

SEQ ID NO: 3376495 - RNA, 16 nt, Human
auuuuauguauguuua

SEQ ID NO: 3376496 - RNA, 14 nt, Human
auuuuauguuauau

SEQ ID NO: 3376497 - RNA, 15 nt, Human
auuuuauguuauaua

SEQ ID NO: 3376498 - RNA, 23 nt, Human
auuuuauguuauauauaaauaua

SEQ ID NO: 3376499 - RNA, 14 nt, Human
auuuuauguugaca

SEQ ID NO: 3376500 - RNA, 20 nt, Human
auuuuauuacaucuuucaca

SEQ ID NO: 3376501 - RNA, 21 nt, Human
auuuuauuacuggcguggauu

SEQ ID NO: 3376502 - RNA, 16 nt, Human
auuuuauuacuguuua

SEQ ID NO: 3376503 - RNA, 13 nt, Human
auuuuauuaugaa

SEQ ID NO: 3376504 - RNA, 15 nt, Human
auuuuauuaugaaga

SEQ ID NO: 3376505 - RNA, 22 nt, Human
auuuuauuaugaagaaggugaa

SEQ ID NO: 3376506 - RNA, 13 nt, Human
auuuuauuaugca

SEQ ID NO: 3376507 - RNA, 14 nt, Human
auuuuauuaugcau

SEQ ID NO: 3376508 - RNA, 15 nt, Human
auuuuauuaugcaug

SEQ ID NO: 3376509 - RNA, 17 nt, Human
auuuuauuaugcaugaa

SEQ ID NO: 3376510 - RNA, 13 nt, Human
auuuuauuaugua

SEQ ID NO: 3376511 - RNA, 14 nt, Human
auuuuauuauguaa

SEQ ID NO: 3376512 - RNA, 14 nt, Human
auuuuauucaaggu

SEQ ID NO: 3376513 - RNA, 16 nt, Human
auuuuauucuugauca

SEQ ID NO: 3376514 - RNA, 18 nt, Human
auuuuauucuugaucagu

SEQ ID NO: 3376515 - RNA, 14 nt, Human
auuuuauuguaaca

SEQ ID NO: 3376516 - RNA, 15 nt, Human
auuuuauuguaacag

SEQ ID NO: 3376517 - RNA, 16 nt, Human
auuuuauuguaacaga

SEQ ID NO: 3376518 - RNA, 22 nt, Human
auuuuauuguaacagacauugu

SEQ ID NO: 3376519 - RNA, 18 nt, Human
auuuuauuucaauguaau

SEQ ID NO: 3376520 - RNA, 19 nt, Human
auuuuauuucaauguaauu

SEQ ID NO: 3376521 - RNA, 21 nt, Human
auuuuauuucaauguaauuaa

SEQ ID NO: 3376522 - RNA, 17 nt, Human
auuuuauuuguuuuuca

SEQ ID NO: 3376523 - RNA, 15 nt, Human
auuuuauuuuagcag

SEQ ID NO: 3376524 - RNA, 18 nt, Human
auuuuauuuuauuaugca

SEQ ID NO: 3376525 - RNA, 23 nt, Human
auuuuauuuugaaauggaaauua

SEQ ID NO: 3376526 - RNA, 23 nt, Human
auuuuauuuugugcucauuuaag

SEQ ID NO: 3376527 - RNA, 18 nt, Human
auuuuauuuuuagaauuu

SEQ ID NO: 3376528 - RNA, 22 nt, Human
auuuucaaaagcauuaauuuuu

SEQ ID NO: 3376529 - RNA, 21 nt, Human
auuuucaacauuucaaaauga

SEQ ID NO: 3376530 - RNA, 20 nt, Human
auuuucaacgcagcccugcu

SEQ ID NO: 3376531 - RNA, 23 nt, Human
auuuucaagaaacugaggaauuu

SEQ ID NO: 3376532 - RNA, 24 nt, Human
auuuucaagaauaaucacgcuuuc

SEQ ID NO: 3376533 - RNA, 20 nt, Human
auuuucaagcagcaucuucu

SEQ ID NO: 3376534 - RNA, 20 nt, Human
auuuucaaggcccucagcau

SEQ ID NO: 3376535 - RNA, 17 nt, Human
auuuucaauagccacua

SEQ ID NO: 3376536 - RNA, 14 nt, Human
auuuucaaugugau

SEQ ID NO: 3376537 - RNA, 20 nt, Human
auuuucacaaugucaguauu

SEQ ID NO: 3376538 - RNA, 15 nt, Human
auuuucacauaaaau

SEQ ID NO: 3376539 - RNA, 19 nt, Human
auuuucacauucuuggcuu

SEQ ID NO: 3376540 - RNA, 15 nt, Human
auuuucaccccaccc

SEQ ID NO: 3376541 - RNA, 13 nt, Human
auuuucacugugu

SEQ ID NO: 3376542 - RNA, 14 nt, Human
auuuucacuuugug

SEQ ID NO: 3376543 - RNA, 12 nt, Human
auuuucagaauc

SEQ ID NO: 3376544 - RNA, 20 nt, Human
auuuucagaaucugaaugua

SEQ ID NO: 3376545 - RNA, 22 nt, Human
auuuucagaaucugaauguaau

SEQ ID NO: 3376546 - RNA, 13 nt, Human
auuuucagauuca

SEQ ID NO: 3376547 - RNA, 13 nt, Human
auuuucagauuug

SEQ ID NO: 3376548 - RNA, 15 nt, Human
auuuucagauuugca

SEQ ID NO: 3376549 - RNA, 11 nt, Human
auuuucaguau

SEQ ID NO: 3376550 - RNA, 15 nt, Human
auuuucauaacuuau

SEQ ID NO: 3376551 - RNA, 19 nt, Human
auuuucauaacuuauugcu

SEQ ID NO: 3376552 - RNA, 22 nt, Human
auuuucauaacuuauugcugau

SEQ ID NO: 3376553 - RNA, 13 nt, Human
auuuucaugacuu

SEQ ID NO: 3376554 - RNA, 17 nt, Human
auuuucauguauaugug

SEQ ID NO: 3376555 - RNA, 11 nt, Human
auuuucauguu

SEQ ID NO: 3376556 - RNA, 15 nt, Human
auuuucauuacaaug

SEQ ID NO: 3376557 - RNA, 13 nt, Human
auuuucauuuguu

SEQ ID NO: 3376558 - RNA, 17 nt, Human
auuuucauuuucugcaa

SEQ ID NO: 3376559 - RNA, 23 nt, Human
auuuucauuuucugcaagccugc

SEQ ID NO: 3376560 - RNA, 14 nt, Human
auuuuccaaagagu

SEQ ID NO: 3376561 - RNA, 19 nt, Human
auuuuccaggacuguuuca

SEQ ID NO: 3376562 - RNA, 21 nt, Human
auuuuccaggcuucugcuggg

SEQ ID NO: 3376563 - RNA, 20 nt, Human
auuuuccaucuaaaaauaua

SEQ ID NO: 3376564 - RNA, 15 nt, Human
auuuuccaugaaaau

SEQ ID NO: 3376565 - RNA, 22 nt, Human
auuuucccaauagcacuuucau

SEQ ID NO: 3376566 - RNA, 20 nt, Human
auuuucccccacuacugcag

SEQ ID NO: 3376567 - RNA, 21 nt, Human
auuuucccccacuacugcagc

SEQ ID NO: 3376568 - RNA, 21 nt, Human
auuuuccccccacucucccca

SEQ ID NO: 3376569 - RNA, 22 nt, Human
auuuucccccuuuucugcauuu

SEQ ID NO: 3376570 - RNA, 19 nt, Human
auuuucccuauuagagaag

SEQ ID NO: 3376571 - RNA, 20 nt, Human
auuuuccuauauuacgguuu

SEQ ID NO: 3376572 - RNA, 12 nt, Human
auuuuccucuga

SEQ ID NO: 3376573 - RNA, 15 nt, Human
auuuuccucuuguga

SEQ ID NO: 3376574 - RNA, 13 nt, Human
auuuuccugaaaa

SEQ ID NO: 3376575 - RNA, 14 nt, Human
auuuuccugaaaac

SEQ ID NO: 3376576 - RNA, 18 nt, Human
auuuuccuggugccaauu

SEQ ID NO: 3376577 - RNA, 22 nt, Human
auuuuccuggugccaauuucaa

SEQ ID NO: 3376578 - RNA, 22 nt, Human
auuuuccuguccucuuucagcu

SEQ ID NO: 3376579 - RNA, 19 nt, Human
auuuuccuguugucaagaa

SEQ ID NO: 3376580 - RNA, 16 nt, Human
auuuuccuugaagccg

SEQ ID NO: 3376581 - RNA, 13 nt, Human
auuuuccuuuaau

SEQ ID NO: 3376582 - RNA, 14 nt, Human
auuuuccuuuucaa

SEQ ID NO: 3376583 - RNA, 18 nt, Human
auuuuccuuuuuuauaca

SEQ ID NO: 3376584 - RNA, 21 nt, Human
auuuuccuuuuuuauacacau

SEQ ID NO: 3376585 - RNA, 15 nt, Human
auuuucguaugaaaa

SEQ ID NO: 3376586 - RNA, 18 nt, Human
auuuucguaugaaaauga

SEQ ID NO: 3376587 - RNA, 14 nt, Human
auuuucuaaaaaag

SEQ ID NO: 3376588 - RNA, 19 nt, Human
auuuucuaaaagcuuucau

SEQ ID NO: 3376589 - RNA, 16 nt, Human
auuuucuaagaaacau

SEQ ID NO: 3376590 - RNA, 18 nt, Human
auuuucuagacuuucugu

SEQ ID NO: 3376591 - RNA, 16 nt, Human
auuuucuagauacaau

SEQ ID NO: 3376592 - RNA, 19 nt, Human
auuuucuagauacaauaaa

SEQ ID NO: 3376593 - RNA, 14 nt, Human
auuuucuauaauuu

SEQ ID NO: 3376594 - RNA, 15 nt, Human
auuuucuauaauuua

SEQ ID NO: 3376595 - RNA, 16 nt, Human
auuuucuauuuuaaga

SEQ ID NO: 3376596 - RNA, 23 nt, Human
auuuucuauuuuaagacugauuu

SEQ ID NO: 3376597 - RNA, 17 nt, Human
auuuucucccaggaagc

SEQ ID NO: 3376598 - RNA, 16 nt, Human
auuuucucuguacuuu

SEQ ID NO: 3376599 - RNA, 13 nt, Human
auuuucucuuaga

SEQ ID NO: 3376600 - RNA, 16 nt, Human
auuuucugcaucucca

SEQ ID NO: 3376601 - RNA, 15 nt, Human
auuuucugcuacuuu

SEQ ID NO: 3376602 - RNA, 18 nt, Human
auuuucugguagauagaa

SEQ ID NO: 3376603 - RNA, 20 nt, Human
auuuucugucagaugagaac

SEQ ID NO: 3376604 - RNA, 11 nt, Human
auuuucugugu

SEQ ID NO: 3376605 - RNA, 12 nt, Human
auuuucugugug

SEQ ID NO: 3376606 - RNA, 17 nt, Human
auuuucuguguguuccu

SEQ ID NO: 3376607 - RNA, 15 nt, Human
auuuucuuaaccagu

SEQ ID NO: 3376608 - RNA, 19 nt, Human
auuuucuuaucuucugcaa

SEQ ID NO: 3376609 - RNA, 17 nt, Human
auuuucuucaguuggug

SEQ ID NO: 3376610 - RNA, 21 nt, Human
auuuucuuccaagcaaaggug

SEQ ID NO: 3376611 - RNA, 16 nt, Human
auuuucuucuaaguga

SEQ ID NO: 3376612 - RNA, 19 nt, Human
auuuucuuuaaaagaaugg

SEQ ID NO: 3376613 - RNA, 18 nt, Human
auuuucuuuaaugcuuuu

SEQ ID NO: 3376614 - RNA, 19 nt, Human
auuuucuuuaaugcuuuua

SEQ ID NO: 3376615 - RNA, 14 nt, Human
auuuucuuucaaaa

SEQ ID NO: 3376616 - RNA, 21 nt, Human
auuuucuuucucuacuuugag

SEQ ID NO: 3376617 - RNA, 17 nt, Human
auuuugaaaaauuccua

SEQ ID NO: 3376618 - RNA, 14 nt, Human
auuuugaaaagcuu

SEQ ID NO: 3376619 - RNA, 16 nt, Human
auuuugaaaaguaaua

SEQ ID NO: 3376620 - RNA, 20 nt, Human
auuuugaaagucuguccuug

SEQ ID NO: 3376621 - RNA, 20 nt, Human
auuuugaaaucaugaagaua

SEQ ID NO: 3376622 - RNA, 15 nt, Human
auuuugaaauguggu

SEQ ID NO: 3376623 - RNA, 20 nt, Human
auuuugaaccugaugaaaau

SEQ ID NO: 3376624 - RNA, 12 nt, Human
auuuugaagcua

SEQ ID NO: 3376625 - RNA, 18 nt, Human
auuuugaagcuaauuauu

SEQ ID NO: 3376626 - RNA, 13 nt, Human
auuuugaagugcu

SEQ ID NO: 3376627 - RNA, 15 nt, Human
auuuugaaguuuaca

SEQ ID NO: 3376628 - RNA, 17 nt, Human
auuuugaaguuuacauu

SEQ ID NO: 3376629 - RNA, 20 nt, Human
auuuugaauaaauaaaugua

SEQ ID NO: 3376630 - RNA, 18 nt, Human
auuuugaaucaauaauau

SEQ ID NO: 3376631 - RNA, 18 nt, Human
auuuugacacugaaauaa

SEQ ID NO: 3376632 - RNA, 19 nt, Human
auuuugagaacaaagauga

SEQ ID NO: 3376633 - RNA, 22 nt, Human
auuuugagaaugcugacacuuu

SEQ ID NO: 3376634 - RNA, 13 nt, Human
auuuugagaugua

SEQ ID NO: 3376635 - RNA, 17 nt, Human
auuuugagguaaagaua

SEQ ID NO: 3376636 - RNA, 16 nt, Human
caggaaaagcugcuga

SEQ ID NO: 3376637 - RNA, 18 nt, Human
caggaaaagcugcugaca

SEQ ID NO: 3376638 - RNA, 20 nt, Human
caggaaaagcugcugacagu

SEQ ID NO: 3376639 - RNA, 13 nt, Human
caggaaaaggccu

SEQ ID NO: 3376640 - RNA, 13 nt, Human
caggaaaauugaa

SEQ ID NO: 3376641 - RNA, 17 nt, Human
caggaaaauugaaugca

SEQ ID NO: 3376642 - RNA, 18 nt, Human
caggaaaccaacacccaa

SEQ ID NO: 3376643 - RNA, 20 nt, Human
caggaaacccagucgcccuu

SEQ ID NO: 3376644 - RNA, 20 nt, Human
caggaaacuccacaucugcc

SEQ ID NO: 3376645 - RNA, 21 nt, Human
caggaaacuccugugaccaca

SEQ ID NO: 3376646 - RNA, 16 nt, Human
caggaaagaagcauuu

SEQ ID NO: 3376647 - RNA, 12 nt, Human
caggaaagaaua

SEQ ID NO: 3376648 - RNA, 13 nt, Human
caggaaagaauag

SEQ ID NO: 3376649 - RNA, 19 nt, Human
caggaaagcgccuccaacc

SEQ ID NO: 3376650 - RNA, 15 nt, Human
caggaaaggaaucau

SEQ ID NO: 3376651 - RNA, 19 nt, Human
caggaaaggaaucauuucu

SEQ ID NO: 3376652 - RNA, 14 nt, Human
caggaaaggcucca

SEQ ID NO: 3376653 - RNA, 19 nt, Human
caggaaaggcuccaggagc

SEQ ID NO: 3376654 - RNA, 23 nt, Human
caggaaaggcuccaggagcagcc

SEQ ID NO: 3376655 - RNA, 17 nt, Human
caggaaagggaaggccc

SEQ ID NO: 3376656 - RNA, 22 nt, Human
caggaaaguggcaccugucugc

SEQ ID NO: 3376657 - RNA, 22 nt, Human
caggaaaguucagaguuuucug

SEQ ID NO: 3376658 - RNA, 16 nt, Human
caggaaauauauaugu

SEQ ID NO: 3376659 - RNA, 19 nt, Human
caggaaaucaaauaugcaa

SEQ ID NO: 3376660 - RNA, 21 nt, Human
caggaaaucaaauaugcaaag

SEQ ID NO: 3376661 - RNA, 13 nt, Human
caggaaaugaaaa

SEQ ID NO: 3376662 - RNA, 20 nt, Human
caggaaaugaaaaugucuug

SEQ ID NO: 3376663 - RNA, 20 nt, Human
caggaaaugcugacccaugg

SEQ ID NO: 3376664 - RNA, 21 nt, Human
caggaaaugcugacccauggg

SEQ ID NO: 3376665 - RNA, 22 nt, Human
caggaacacccgacuccucaaa

SEQ ID NO: 3376666 - RNA, 17 nt, Human
caggaaccgaggcaggg

SEQ ID NO: 3376667 - RNA, 23 nt, Human
caggaaccucgaguacugugggc

SEQ ID NO: 3376668 - RNA, 15 nt, Human
caggaacuauaaaaa

SEQ ID NO: 3376669 - RNA, 14 nt, Human
caggaacucccagc

SEQ ID NO: 3376670 - RNA, 16 nt, Human
caggaacucccagcaa

SEQ ID NO: 3376671 - RNA, 12 nt, Human
caggaacugggc

SEQ ID NO: 3376672 - RNA, 17 nt, Human
caggaagaaagaauguu

SEQ ID NO: 3376673 - RNA, 15 nt, Human
caggaagagaaggag

SEQ ID NO: 3376674 - RNA, 23 nt, Human
caggaagcaaacuaagcccccgc

SEQ ID NO: 3376675 - RNA, 14 nt, Human
caggaagcacccca

SEQ ID NO: 3376676 - RNA, 17 nt, Human
caggaagcaccccaugc

SEQ ID NO: 3376677 - RNA, 17 nt, Human
caggaagccagcaggcu

SEQ ID NO: 3376678 - RNA, 21 nt, Human
caggaagccagcaggcucuca

SEQ ID NO: 3376679 - RNA, 18 nt, Human
caggaagcccaggagccu

SEQ ID NO: 3376680 - RNA, 20 nt, Human
caggaagcccaggagccuca

SEQ ID NO: 3376681 - RNA, 13 nt, Human
caggaagccccca

SEQ ID NO: 3376682 - RNA, 23 nt, Human
caggaagccgccaguacuuguca

SEQ ID NO: 3376683 - RNA, 19 nt, Human
caggaagccugcaguccug

SEQ ID NO: 3376684 - RNA, 16 nt, Human
caggaagcucagggcc

SEQ ID NO: 3376685 - RNA, 15 nt, Human
caggaagcugcuccg

SEQ ID NO: 3376686 - RNA, 21 nt, Human
caggaagcuuuggugagaacc

SEQ ID NO: 3376687 - RNA, 23 nt, Human
caggaagcuuuggugagaaccug

SEQ ID NO: 3376688 - RNA, 16 nt, Human
caggaaggacuaugaa

SEQ ID NO: 3376689 - RNA, 19 nt, Human
caggaaggacuaugaaaag

SEQ ID NO: 3376690 - RNA, 15 nt, Human
caggaaggagagccu

SEQ ID NO: 3376691 - RNA, 15 nt, Human
caggaaggagcugcc

SEQ ID NO: 3376692 - RNA, 17 nt, Human
caggaaggagcugccug

SEQ ID NO: 3376693 - RNA, 13 nt, Human
auuuuguaaaggu

SEQ ID NO: 3376694 - RNA, 19 nt, Human
auuuuguaacuuccaugug

SEQ ID NO: 3376695 - RNA, 20 nt, Human
auuuuguaauguaucaaaua

SEQ ID NO: 3376696 - RNA, 23 nt, Human
auuuuguaauguaucaaauacau

SEQ ID NO: 3376697 - RNA, 15 nt, Human
auuuuguaauuauga

SEQ ID NO: 3376698 - RNA, 16 nt, Human
auuuuguaauuauugu

SEQ ID NO: 3376699 - RNA, 15 nt, Human
auuuuguaauuuucu

SEQ ID NO: 3376700 - RNA, 16 nt, Human
auuuuguaauuuucuu

SEQ ID NO: 3376701 - RNA, 10 nt, Human
auuuuguaug

SEQ ID NO: 3376702 - RNA, 20 nt, Human
auuuuguaugcaagcaguuu

SEQ ID NO: 3376703 - RNA, 10 nt, Human
auuuuguauu

SEQ ID NO: 3376704 - RNA, 19 nt, Human
auuuuguauuauugcuguu

SEQ ID NO: 3376705 - RNA, 22 nt, Human
auuuuguauuauugcuguugcu

SEQ ID NO: 3376706 - RNA, 16 nt, Human
auuuugucuaaaaugc

SEQ ID NO: 3376707 - RNA, 20 nt, Human
auuuugucugccccaaguuu

SEQ ID NO: 3376708 - RNA, 24 nt, Human
auuuugugaaacagacuuguauau

SEQ ID NO: 3376709 - RNA, 12 nt, Human
auuuugugaaug

SEQ ID NO: 3376710 - RNA, 15 nt, Human
auuuugugaauggau

SEQ ID NO: 3376711 - RNA, 15 nt, Human
auuuugugaguuugu

SEQ ID NO: 3376712 - RNA, 19 nt, Human
auuuugugauauggagccc

SEQ ID NO: 3376713 - RNA, 19 nt, Human
auuuugugcccccauguaa

SEQ ID NO: 3376714 - RNA, 20 nt, Human
auuuuguggcuuucuuucuu

SEQ ID NO: 3376715 - RNA, 21 nt, Human
auuuugugggaauuuaagagc

SEQ ID NO: 3376716 - RNA, 12 nt, Human
auuuuguguaaa

SEQ ID NO: 3376717 - RNA, 16 nt, Human
auuuuguguaagaaau

SEQ ID NO: 3376718 - RNA, 18 nt, Human
auuuuguguaagaaauac

SEQ ID NO: 3376719 - RNA, 14 nt, Human
auuuugugugacca

SEQ ID NO: 3376720 - RNA, 17 nt, Human
auuuugugugaccaacu

SEQ ID NO: 3376721 - RNA, 20 nt, Human
auuuugugugaccaacugug

SEQ ID NO: 3376722 - RNA, 12 nt, Human
auuuuguucaua

SEQ ID NO: 3376723 - RNA, 18 nt, Human
auuuuguucuaguuuuca

SEQ ID NO: 3376724 - RNA, 15 nt, Human
auuuuguucucuggg

SEQ ID NO: 3376725 - RNA, 18 nt, Human
auuuuguucucugggaga

SEQ ID NO: 3376726 - RNA, 21 nt, Human
auuuuguuggcauagcucugg

SEQ ID NO: 3376727 - RNA, 14 nt, Human
auuuuguuguaaaa

SEQ ID NO: 3376728 - RNA, 18 nt, Human
auuuuguuguaaaaagaa

SEQ ID NO: 3376729 - RNA, 23 nt, Human
auuuuguuguguguaugcugcuu

SEQ ID NO: 3376730 - RNA, 14 nt, Human
auuuuguuugguau

SEQ ID NO: 3376731 - RNA, 19 nt, Human
auuuuguuugguauuguau

SEQ ID NO: 3376732 - RNA, 22 nt, Human
auuuuguuugguauuguauuua

SEQ ID NO: 3376733 - RNA, 18 nt, Human
auuuuguuuugcuuuuuc

SEQ ID NO: 3376734 - RNA, 18 nt, Human
auuuuguuuuuccuucca

SEQ ID NO: 3376735 - RNA, 18 nt, Human
auuuuuaaaaaauauuuu

SEQ ID NO: 3376736 - RNA, 19 nt, Human
auuuuuaaaaaauauuuuc

SEQ ID NO: 3376737 - RNA, 13 nt, Human
auuuuuaaaaaga

SEQ ID NO: 3376738 - RNA, 13 nt, Human
auuuuuaaaagau

SEQ ID NO: 3376739 - RNA, 16 nt, Human
auuuuuaaaauauuua

SEQ ID NO: 3376740 - RNA, 14 nt, Human
auuuuuaaaaugua

SEQ ID NO: 3376741 - RNA, 13 nt, Human
auuuuuaaacaag

SEQ ID NO: 3376742 - RNA, 15 nt, Human
auuuuuaaacaagua

SEQ ID NO: 3376743 - RNA, 13 nt, Human
auuuuuaaagaaa

SEQ ID NO: 3376744 - RNA, 14 nt, Human
auuuuuaaagcaug

SEQ ID NO: 3376745 - RNA, 15 nt, Human
auuuuuaaagcaugg

SEQ ID NO: 3376746 - RNA, 15 nt, Human
auuuuuaaaggcauu

SEQ ID NO: 3376747 - RNA, 15 nt, Human
auuuuuaaauaauuu

SEQ ID NO: 3376748 - RNA, 15 nt, Human
auuuuuaaauguguu

SEQ ID NO: 3376749 - RNA, 13 nt, Human
auuuuuaaauugu

SEQ ID NO: 3376750 - RNA, 14 nt, Human
auuuuuaaauuguu

SEQ ID NO: 3376751 - RNA, 19 nt, Human
auuuuuaagauaauaauau

SEQ ID NO: 3376752 - RNA, 12 nt, Human
auuuuuaagcug

SEQ ID NO: 3376753 - RNA, 14 nt, Human
auuuuuaaggacuu

SEQ ID NO: 3376754 - RNA, 19 nt, Human
auuuuuaagugcugcauuu

SEQ ID NO: 3376755 - RNA, 11 nt, Human
auuuuuaaugg

SEQ ID NO: 3376756 - RNA, 16 nt, Human
auuuuuaauggcagca

SEQ ID NO: 3376757 - RNA, 12 nt, Human
auuuuuaauggg

SEQ ID NO: 3376758 - RNA, 15 nt, Human
auuuuuaaugggggu

SEQ ID NO: 3376759 - RNA, 14 nt, Human
auuuuuacaauaaa

SEQ ID NO: 3376760 - RNA, 19 nt, Human
auuuuuacaauguaauuau

SEQ ID NO: 3376761 - RNA, 22 nt, Human
auuuuuacagaauugcuuguuu

SEQ ID NO: 3376762 - RNA, 16 nt, Human
auuuuuacaguuauag

SEQ ID NO: 3376763 - RNA, 16 nt, Human
auuuuuacauucugaa

SEQ ID NO: 3376764 - RNA, 14 nt, Human
auuuuuacauuuaa

SEQ ID NO: 3376765 - RNA, 12 nt, Human
auuuuuaccagu

SEQ ID NO: 3376766 - RNA, 19 nt, Human
auuuuuacccuaaugucuu

SEQ ID NO: 3376767 - RNA, 19 nt, Human
auuuuuaccguuucuuccc

SEQ ID NO: 3376768 - RNA, 19 nt, Human
auuuuuagaauaagaauuu

SEQ ID NO: 3376769 - RNA, 21 nt, Human
auuuuuagaauaagaauuugc

SEQ ID NO: 3376770 - RNA, 14 nt, Human
auuuuuagacagag

SEQ ID NO: 3376771 - RNA, 21 nt, Human
auuuuuaggaaguuuucugua

SEQ ID NO: 3376772 - RNA, 22 nt, Human
auuuuuaggaaguuuucuguag

SEQ ID NO: 3376773 - RNA, 22 nt, Human
auuuuuaguagagacugguuuc

SEQ ID NO: 3376774 - RNA, 18 nt, Human
auuuuuauaacaucuuua

SEQ ID NO: 3376775 - RNA, 13 nt, Human
auuuuuauagcaa

SEQ ID NO: 3376776 - RNA, 21 nt, Human
auuuuuauagcaacaacaauu

SEQ ID NO: 3376777 - RNA, 21 nt, Human
auuuuuauauaauaucuaaag

SEQ ID NO: 3376778 - RNA, 23 nt, Human
auuuuuauauaauaucuaaaguu

SEQ ID NO: 3376779 - RNA, 17 nt, Human
auuuuuauaucaugcaa

SEQ ID NO: 3376780 - RNA, 22 nt, Human
auuuuuauaucaugcaaaauau

SEQ ID NO: 3376781 - RNA, 16 nt, Human
aucuugaggugguagu

SEQ ID NO: 3376782 - RNA, 22 nt, Human
aucuugaguauaagaaaugcau

SEQ ID NO: 3376783 - RNA, 15 nt, Human
aucuugauacauuca

SEQ ID NO: 3376784 - RNA, 21 nt, Human
aucuugaucugcucagcccug

SEQ ID NO: 3376785 - RNA, 22 nt, Human
aucuugaucugcucagcccugg

SEQ ID NO: 3376786 - RNA, 23 nt, Human
aucuugaucugcucagcccugga

SEQ ID NO: 3376787 - RNA, 21 nt, Human
aucuugcaguaucggcacugu

SEQ ID NO: 3376788 - RNA, 18 nt, Human
aucuugcauuaugcaauu

SEQ ID NO: 3376789 - RNA, 21 nt, Human
aucuugccuccaggugcagag

SEQ ID NO: 3376790 - RNA, 16 nt, Human
aucuugcgaauccaag

SEQ ID NO: 3376791 - RNA, 21 nt, Human
aucuugcgaauccaagcuccc

SEQ ID NO: 3376792 - RNA, 23 nt, Human
aucuugcuaccaguauuuagaag

SEQ ID NO: 3376793 - RNA, 17 nt, Human
aucuugcuacuaccguu

SEQ ID NO: 3376794 - RNA, 15 nt, Human
aucuugcucugcuug

SEQ ID NO: 3376795 - RNA, 14 nt, Human
aucuugcuucccua

SEQ ID NO: 3376796 - RNA, 15 nt, Human
aucuugcuucccuaa

SEQ ID NO: 3376797 - RNA, 21 nt, Human
aucuuggacugacauuuagcg

SEQ ID NO: 3376798 - RNA, 12 nt, Human
aucuuggcaggg

SEQ ID NO: 3376799 - RNA, 15 nt, Human
aucuuggcucacugc

SEQ ID NO: 3376800 - RNA, 13 nt, Human
aucuugggacugg

SEQ ID NO: 3376801 - RNA, 12 nt, Human
aucuugguaaau

SEQ ID NO: 3376802 - RNA, 18 nt, Human
aucuugguguguuaagag

SEQ ID NO: 3376803 - RNA, 20 nt, Human
aucuugguugaugccaaaaa

SEQ ID NO: 3376804 - RNA, 14 nt, Human
aucuugguuugccu

SEQ ID NO: 3376805 - RNA, 17 nt, Human
aucuugguuugccuucc

SEQ ID NO: 3376806 - RNA, 12 nt, Human
aucuugucaugu

SEQ ID NO: 3376807 - RNA, 19 nt, Human
aucuugucauguguauaaa

SEQ ID NO: 3376808 - RNA, 17 nt, Human
aucuuguccccaacacc

SEQ ID NO: 3376809 - RNA, 14 nt, Human
aucuugucucaaug

SEQ ID NO: 3376810 - RNA, 16 nt, Human
aucuugucucaaugcu

SEQ ID NO: 3376811 - RNA, 23 nt, Human
aucuugucucaaugcucauaacg

SEQ ID NO: 3376812 - RNA, 19 nt, Human
aucuugugaaaauaauuga

SEQ ID NO: 3376813 - RNA, 20 nt, Human
aucuugugaaauggccagga

SEQ ID NO: 3376814 - RNA, 18 nt, Human
aucuugugcuagaauacu

SEQ ID NO: 3376815 - RNA, 20 nt, Human
aucuugugcuagaauacuuu

SEQ ID NO: 3376816 - RNA, 22 nt, Human
aucuugugugauuaacuuauuu

SEQ ID NO: 3376817 - RNA, 12 nt, Human
aucuuuaaaaua

SEQ ID NO: 3376818 - RNA, 11 nt, Human
aucuuuaauua

SEQ ID NO: 3376819 - RNA, 18 nt, Human
aucuuuaauuaaaaccug

SEQ ID NO: 3376820 - RNA, 15 nt, Human
aucuuuagugcuuuc

SEQ ID NO: 3376821 - RNA, 12 nt, Human
aucuuucagaaa

SEQ ID NO: 3376822 - RNA, 16 nt, Human
aucuuucagaaauaua

SEQ ID NO: 3376823 - RNA, 12 nt, Human
aucuuucaggaa

SEQ ID NO: 3376824 - RNA, 20 nt, Human
aucuuucaucaaucauugua

SEQ ID NO: 3376825 - RNA, 17 nt, Human
aucuuuccauauccaua

SEQ ID NO: 3376826 - RNA, 19 nt, Human
aucuuucccuccuugguga

SEQ ID NO: 3376827 - RNA, 12 nt, Human
aucuuuccuguc

SEQ ID NO: 3376828 - RNA, 16 nt, Human
aucuuucgcacagcag

SEQ ID NO: 3376829 - RNA, 21 nt, Human
aucuuucugcacacaaauauu

SEQ ID NO: 3376830 - RNA, 19 nt, Human
aucuuucuucuauuuuauu

SEQ ID NO: 3376831 - RNA, 13 nt, Human
aucuuucuugauc

SEQ ID NO: 3376832 - RNA, 18 nt, Human
aucuuucuuuaccugaga

SEQ ID NO: 3376833 - RNA, 21 nt, Human
aucuuucuuuaccugagacca

SEQ ID NO: 3376834 - RNA, 15 nt, Human
aucuuucuuucuuag

SEQ ID NO: 3376835 - RNA, 21 nt, Human
aucuuucuuucuuagaaauuu

SEQ ID NO: 3376836 - RNA, 14 nt, Human
caagcucucuugcc

SEQ ID NO: 3376837 - RNA, 14 nt, Human
caagcucugcuccu

SEQ ID NO: 3376838 - RNA, 15 nt, Human
caagcucugcuccuc

SEQ ID NO: 3376839 - RNA, 16 nt, Human
caagcucugcuccucu

SEQ ID NO: 3376840 - RNA, 20 nt, Human
caagcugaaauuuuagaaau

SEQ ID NO: 3376841 - RNA, 19 nt, Human
caagcugaggugcccagga

SEQ ID NO: 3376842 - RNA, 21 nt, Human
caagcugaggugcccaggaga

SEQ ID NO: 3376843 - RNA, 14 nt, Human
caagcugaguuucc

SEQ ID NO: 3376844 - RNA, 16 nt, Human
caagcugaguuuccua

SEQ ID NO: 3376845 - RNA, 14 nt, Human
caagcugcacccuc

SEQ ID NO: 3376846 - RNA, 18 nt, Human
caagcugcacccucaggc

SEQ ID NO: 3376847 - RNA, 22 nt, Human
caagcugcacccucaggcaggu

SEQ ID NO: 3376848 - RNA, 13 nt, Human
caagcugccuccc

SEQ ID NO: 3376849 - RNA, 20 nt, Human
caagcugccucccuguccac

SEQ ID NO: 3376850 - RNA, 15 nt, Human
caagcugcucugagc

SEQ ID NO: 3376851 - RNA, 13 nt, Human
caagcuggaagca

SEQ ID NO: 3376852 - RNA, 14 nt, Human
caagcuggcugggg

SEQ ID NO: 3376853 - RNA, 11 nt, Human
caagcugggcc

SEQ ID NO: 3376854 - RNA, 15 nt, Human
caagcugggccccag

SEQ ID NO: 3376855 - RNA, 20 nt, Human
caagcugggccccagcccac

SEQ ID NO: 3376856 - RNA, 17 nt, Human
caagcuggucccacuca

SEQ ID NO: 3376857 - RNA, 19 nt, Human
caagcuggucccacucagu

SEQ ID NO: 3376858 - RNA, 21 nt, Human
caagcuggucccacucagucc

SEQ ID NO: 3376859 - RNA, 18 nt, Human
caagcuguccagagaaaa

SEQ ID NO: 3376860 - RNA, 18 nt, Human
caagcugugagacagugg

SEQ ID NO: 3376861 - RNA, 12 nt, Human
caagcugugcca

SEQ ID NO: 3376862 - RNA, 15 nt, Human
caagcugugccaccc

SEQ ID NO: 3376863 - RNA, 21 nt, Human
caagcugugccacccugggcu

SEQ ID NO: 3376864 - RNA, 16 nt, Human
caagcuguuuucuucu

SEQ ID NO: 3376865 - RNA, 21 nt, Human
caagcuuccauagcugcugcc

SEQ ID NO: 3376866 - RNA, 13 nt, Human
caagcuuggcagc

SEQ ID NO: 3376867 - RNA, 14 nt, Human
caagcuuggcagcc

SEQ ID NO: 3376868 - RNA, 20 nt, Human
caagcuuggcagccgagcuc

SEQ ID NO: 3376869 - RNA, 20 nt, Human
caagcuuguuaucagcuuuc

SEQ ID NO: 3376870 - RNA, 14 nt, Human
caagcuuuaaauua

SEQ ID NO: 3376871 - RNA, 16 nt, Human
caagcuuuaaauuaug

SEQ ID NO: 3376872 - RNA, 20 nt, Human
caagcuuugauuuagauuga

SEQ ID NO: 3376873 - RNA, 15 nt, Human
caagcuuuuccuaau

SEQ ID NO: 3376874 - RNA, 20 nt, Human
caaggaaaaaauaacaauga

SEQ ID NO: 3376875 - RNA, 13 nt, Human
caaggaaaaagaa

SEQ ID NO: 3376876 - RNA, 16 nt, Human
caaggaaaacugcaug

SEQ ID NO: 3376877 - RNA, 14 nt, Human
caaggaaaccacag

SEQ ID NO: 3376878 - RNA, 14 nt, Human
caaggaaaggccug

SEQ ID NO: 3376879 - RNA, 20 nt, Human
caaggaaagggggucccagu

SEQ ID NO: 3376880 - RNA, 20 nt, Human
caaggaaauacccuucuuuu

SEQ ID NO: 3376881 - RNA, 18 nt, Human
caaggaacaaaaaaacca

SEQ ID NO: 3376882 - RNA, 13 nt, Human
caaggaaggaaag

SEQ ID NO: 3376883 - RNA, 16 nt, Human
caaggaaggaaagaaa

SEQ ID NO: 3376884 - RNA, 18 nt, Human
caaggaaggaaagaaaga

SEQ ID NO: 3376885 - RNA, 23 nt, Human
caaggaaggaaagaaagaaggaa

SEQ ID NO: 3376886 - RNA, 19 nt, Human
caaggaaguagaaacaaaa

SEQ ID NO: 3376887 - RNA, 12 nt, Human
caaggaauuucu

SEQ ID NO: 3376888 - RNA, 18 nt, Human
caaggaauuucuuaacuu

SEQ ID NO: 3376889 - RNA, 11 nt, Human
caaggacaaag

SEQ ID NO: 3376890 - RNA, 17 nt, Human
caaggacaaagucucca

SEQ ID NO: 3376891 - RNA, 19 nt, Human
caaggacaaagucuccagc

SEQ ID NO: 3376892 - RNA, 23 nt, Human
caaggacaaagucuccagcccac

SEQ ID NO: 3376893 - RNA, 18 nt, Human
caaggacagccccuccuc

SEQ ID NO: 3376894 - RNA, 16 nt, Human
caaggaccaggacucc

SEQ ID NO: 3376895 - RNA, 20 nt, Human
caaggaccaggacucccucc

SEQ ID NO: 3376896 - RNA, 21 nt, Human
caaggaccaggacucccuccu

SEQ ID NO: 3376897 - RNA, 22 nt, Human
caaggacccagccugagauggu

SEQ ID NO: 3376898 - RNA, 20 nt, Human
caaggaccccucaccuugca

SEQ ID NO: 3376899 - RNA, 21 nt, Human
caaggacgcuucacaggacag

SEQ ID NO: 3376900 - RNA, 20 nt, Human
caaggacuacguuaagggaa

SEQ ID NO: 3376901 - RNA, 20 nt, Human
caaggacuaggguccugggg

SEQ ID NO: 3376902 - RNA, 21 nt, Human
caaggacuaggguccugggga

SEQ ID NO: 3376903 - RNA, 14 nt, Human
caaggacugaggga

SEQ ID NO: 3376904 - RNA, 15 nt, Human
caaggacuuuguaca

SEQ ID NO: 3376905 - RNA, 16 nt, Human
caaggacuuuguacau

SEQ ID NO: 3376906 - RNA, 14 nt, Human
caaggagaaacaga

SEQ ID NO: 3376907 - RNA, 16 nt, Human
caaggagaaacagaga

SEQ ID NO: 3376908 - RNA, 13 nt, Human
caaggagaggagg

SEQ ID NO: 3376909 - RNA, 16 nt, Human
caaggagcacaagcca

SEQ ID NO: 3376910 - RNA, 18 nt, Human
caaggagcacagguccca

SEQ ID NO: 3376911 - RNA, 13 nt, Human
caaggagcugaga

SEQ ID NO: 3376912 - RNA, 22 nt, Human
caaggagcugagaauagaagga

SEQ ID NO: 3376913 - RNA, 13 nt, Human
caaggaggaaaaa

SEQ ID NO: 3376914 - RNA, 20 nt, Human
caaggaggaaaaacagacaa

SEQ ID NO: 3376915 - RNA, 16 nt, Human
caaggaggcuggcugg

SEQ ID NO: 3376916 - RNA, 19 nt, Human
caaggaggcuggcuggggc

SEQ ID NO: 3376917 - RNA, 21 nt, Human
caaggaggcuggcuggggccu

SEQ ID NO: 3376918 - RNA, 15 nt, Human
caaggagggcacagg

SEQ ID NO: 3376919 - RNA, 19 nt, Human
caaggagggugagugcaag

SEQ ID NO: 3376920 - RNA, 23 nt, Human
caaggaggguguaauggagcauc

SEQ ID NO: 3376921 - RNA, 17 nt, Human
caaggaggucugugcca

SEQ ID NO: 3376922 - RNA, 17 nt, Human
caaggagucacugagac

SEQ ID NO: 3376923 - RNA, 16 nt, Human
caaggagucagacauu

SEQ ID NO: 3376924 - RNA, 15 nt, Human
caaggauagaugcug

SEQ ID NO: 3376925 - RNA, 20 nt, Human
caaggauagaugcuggccca

SEQ ID NO: 3376926 - RNA, 13 nt, Human
cacaagaaaugaa

SEQ ID NO: 3376927 - RNA, 23 nt, Human
cacaagaaaugaaagcagggacu

SEQ ID NO: 3376928 - RNA, 13 nt, Human
cacaagaauggau

SEQ ID NO: 3376929 - RNA, 14 nt, Human
cacaagaauggauc

SEQ ID NO: 3376930 - RNA, 11 nt, Human
cacaagacuga

SEQ ID NO: 3376931 - RNA, 20 nt, Human
cacaagacugacgccagggu

SEQ ID NO: 3376932 - RNA, 16 nt, Human
cacaagacugcacauc

SEQ ID NO: 3376933 - RNA, 22 nt, Human
cacaagauggaauuuaucaaac

SEQ ID NO: 3376934 - RNA, 17 nt, Human
cacaagauucccagaga

SEQ ID NO: 3376935 - RNA, 19 nt, Human
cacaagauucccagagaca

SEQ ID NO: 3376936 - RNA, 22 nt, Human
cacaagauucccagagacagga

SEQ ID NO: 3376937 - RNA, 21 nt, Human
cacaagcagagugcacagcug

SEQ ID NO: 3376938 - RNA, 23 nt, Human
cacaagcagagugcacagcuguc

SEQ ID NO: 3376939 - RNA, 13 nt, Human
cacaagccugagg

SEQ ID NO: 3376940 - RNA, 13 nt, Human
cacaagcuccaag

SEQ ID NO: 3376941 - RNA, 20 nt, Human
cacaagcuccaagcucccag

SEQ ID NO: 3376942 - RNA, 21 nt, Human
cacaagcuccaagcucccagg

SEQ ID NO: 3376943 - RNA, 23 nt, Human
cacaagcuccaagcucccaggca

SEQ ID NO: 3376944 - RNA, 15 nt, Human
cacaagcugccuccc

SEQ ID NO: 3376945 - RNA, 13 nt, Human
cacaagcuggaag

SEQ ID NO: 3376946 - RNA, 12 nt, Human
cacaaggacuuc

SEQ ID NO: 3376947 - RNA, 16 nt, Human
cacaaggacuuccugu

SEQ ID NO: 3376948 - RNA, 22 nt, Human
cacaaggauagaugcuggccca

SEQ ID NO: 3376949 - RNA, 18 nt, Human
cacaaggcugaccaagag

SEQ ID NO: 3376950 - RNA, 21 nt, Human
cacaaggcugaccaagagaga

SEQ ID NO: 3376951 - RNA, 20 nt, Human
cacaaggucauggccacacu

SEQ ID NO: 3376952 - RNA, 15 nt, Human
cacaaggugggcagg

SEQ ID NO: 3376953 - RNA, 13 nt, Human
cacaaguaaacau

SEQ ID NO: 3376954 - RNA, 22 nt, Human
cacaaguaagagacucagccug

SEQ ID NO: 3376955 - RNA, 21 nt, Human
cacaagugcccuccaggcuuu

SEQ ID NO: 3376956 - RNA, 21 nt, Human
cacaaguggguacccccagga

SEQ ID NO: 3376957 - RNA, 14 nt, Human
cacaagugguggua

SEQ ID NO: 3376958 - RNA, 21 nt, Human
cacaaguggugguaacccugg

SEQ ID NO: 3376959 - RNA, 16 nt, Human
cacaauaaauggcugu

SEQ ID NO: 3376960 - RNA, 20 nt, Human
cacaauaaauguauucaaau

SEQ ID NO: 3376961 - RNA, 14 nt, Human
cacaauagaauuau

SEQ ID NO: 3376962 - RNA, 22 nt, Human
cacaaucaccgaugcaaacauu

SEQ ID NO: 3376963 - RNA, 20 nt, Human
cacaauccuaacacauuauc

SEQ ID NO: 3376964 - RNA, 24 nt, Human
cacaaucucggcucacugcauccu

SEQ ID NO: 3376965 - RNA, 18 nt, Human
cacaaucuuaaggggcag

SEQ ID NO: 3376966 - RNA, 19 nt, Human
cacaaucuuaaggggcagc

SEQ ID NO: 3376967 - RNA, 22 nt, Human
cacaaugaaaugcucuccuuuc

SEQ ID NO: 3376968 - RNA, 18 nt, Human
cacaaugcaguucugagc

SEQ ID NO: 3376969 - RNA, 20 nt, Human
cacaauggcuaauucccaga

SEQ ID NO: 3376970 - RNA, 17 nt, Human
cacaaugguuuuuaaau

SEQ ID NO: 3376971 - RNA, 22 nt, Human
cacaaugguuuuuaaauuuugu

SEQ ID NO: 3376972 - RNA, 12 nt, Human
cacaaugucuug

SEQ ID NO: 3376973 - RNA, 16 nt, Human
cacaauguucuuuaua

SEQ ID NO: 3376974 - RNA, 11 nt, Human
cacaauuccau

SEQ ID NO: 3376975 - RNA, 14 nt, Human
cacaauuuuuaaug

SEQ ID NO: 3376976 - RNA, 15 nt, Human
cacaauuuuuaaugg

SEQ ID NO: 3376977 - RNA, 22 nt, Human
cacaauuuuuaauggcagcaga

SEQ ID NO: 3376978 - RNA, 13 nt, Human
cacacaaaacaac

SEQ ID NO: 3376979 - RNA, 18 nt, Human
cacacaaaccuucugccu

SEQ ID NO: 3376980 - RNA, 18 nt, Human
cacacaaagguauaauuu

SEQ ID NO: 3376981 - RNA, 18 nt, Human
cacacaaauaacaagaau

SEQ ID NO: 3376982 - RNA, 21 nt, Human
cacacaaauuaucuuaaaacu

SEQ ID NO: 3376983 - RNA, 18 nt, Human
cacacaagaagaagggca

SEQ ID NO: 3376984 - RNA, 16 nt, Human
cacacaagcccacagc

SEQ ID NO: 3376985 - RNA, 16 nt, Human
cacacaagggaaggac

SEQ ID NO: 3376986 - RNA, 20 nt, Human
cacacaaguaagagacucag

SEQ ID NO: 3376987 - RNA, 21 nt, Human
cacacaaguaagagacucagc

SEQ ID NO: 3376988 - RNA, 23 nt, Human
cacacaaguaagagacucagccu

SEQ ID NO: 3376989 - RNA, 14 nt, Human
cacacacaaaaaaa

SEQ ID NO: 3376990 - RNA, 16 nt, Human
cacacacaacagccaa

SEQ ID NO: 3376991 - RNA, 20 nt, Human
aucuuucuuuggaugggacu

SEQ ID NO: 3376992 - RNA, 21 nt, Human
aucuuucuuuugauucuuccu

SEQ ID NO: 3376993 - RNA, 17 nt, Human
aucuuugaaauuaugua

SEQ ID NO: 3376994 - RNA, 20 nt, Human
aucuuugaaauuauguaaau

SEQ ID NO: 3376995 - RNA, 15 nt, Human
aucuuugaauaugua

SEQ ID NO: 3376996 - RNA, 12 nt, Human
aucuuugaugug

SEQ ID NO: 3376997 - RNA, 15 nt, Human
aucuuugauucuccu

SEQ ID NO: 3376998 - RNA, 16 nt, Human
aucuuugauucuccuu

SEQ ID NO: 3376999 - RNA, 17 nt, Human
aucuuugauucuccuuc

SEQ ID NO: 3377000 - RNA, 18 nt, Human
aucuuugcagacaggcaa

SEQ ID NO: 3377001 - RNA, 14 nt, Human
aucuuugccacccu

SEQ ID NO: 3377002 - RNA, 23 nt, Human
aucuuuggacagaagcagcucuu

SEQ ID NO: 3377003 - RNA, 12 nt, Human
aucuuugugaag

SEQ ID NO: 3377004 - RNA, 13 nt, Human
aucuuugugaagg

SEQ ID NO: 3377005 - RNA, 17 nt, Human
aucuuugugaaggccuc

SEQ ID NO: 3377006 - RNA, 17 nt, Human
aucuuuuaaaguguuac

SEQ ID NO: 3377007 - RNA, 20 nt, Human
aucuuuuaaaguguuacuuu

SEQ ID NO: 3377008 - RNA, 22 nt, Human
aucuuuuaaaguguuacuuuuu

SEQ ID NO: 3377009 - RNA, 22 nt, Human
aucuuuuacaacugccucgaaa

SEQ ID NO: 3377010 - RNA, 11 nt, Human
aucuuuuacau

SEQ ID NO: 3377011 - RNA, 17 nt, Human
aucuuuuauguuugaau

SEQ ID NO: 3377012 - RNA, 18 nt, Human
aucuuuuauguuugaaua

SEQ ID NO: 3377013 - RNA, 13 nt, Human
aucuuuucacaaa

SEQ ID NO: 3377014 - RNA, 15 nt, Human
aucuuuucuacagca

SEQ ID NO: 3377015 - RNA, 20 nt, Human
aucuuuucuacagcaaauuu

SEQ ID NO: 3377016 - RNA, 13 nt, Human
aucuuuucuauuu

SEQ ID NO: 3377017 - RNA, 18 nt, Human
aucuuuucugaaucuucu

SEQ ID NO: 3377018 - RNA, 23 nt, Human
aucuuuucuugccucuguccccu

SEQ ID NO: 3377019 - RNA, 22 nt, Human
aucuuuucuuuagagaacugaa

SEQ ID NO: 3377020 - RNA, 13 nt, Human
aucuuuugagaac

SEQ ID NO: 3377021 - RNA, 14 nt, Human
aucuuuugggggaa

SEQ ID NO: 3377022 - RNA, 14 nt, Human
aucuuuugugagau

SEQ ID NO: 3377023 - RNA, 22 nt, Human
aucuuuuguuuccuuuuuuccc

SEQ ID NO: 3377024 - RNA, 19 nt, Human
aucuuuuuaaccucuguuc

SEQ ID NO: 3377025 - RNA, 18 nt, Human
aucuuuuuauugaugugc

SEQ ID NO: 3377026 - RNA, 22 nt, Human
aucuuuuuauugaugugcaaaa

SEQ ID NO: 3377027 - RNA, 14 nt, Human
aucuuuuucucuaa

SEQ ID NO: 3377028 - RNA, 16 nt, Human
aucuuuuuuagcauaa

SEQ ID NO: 3377029 - RNA, 14 nt, Human
aucuuuuuucaaaa

SEQ ID NO: 3377030 - RNA, 23 nt, Human
aucuuuuuuucauuuuuaaaugu

SEQ ID NO: 3377031 - RNA, 22 nt, Human
augaaaaaauauauaucaaaua

SEQ ID NO: 3377032 - RNA, 19 nt, Human
augaaaaauagugucuuug

SEQ ID NO: 3377033 - RNA, 20 nt, Human
augaaaaauagugucuuugu

SEQ ID NO: 3377034 - RNA, 17 nt, Human
augaaaaaugaaagaug

SEQ ID NO: 3377035 - RNA, 13 nt, Human
augaaaaauucuc

SEQ ID NO: 3377036 - RNA, 17 nt, Human
augaaaacaguguguaa

SEQ ID NO: 3377037 - RNA, 18 nt, Human
augaaaacguuuuauugu

SEQ ID NO: 3377038 - RNA, 14 nt, Human
augaaaacuauaca

SEQ ID NO: 3377039 - RNA, 12 nt, Human
augaaaacucau

SEQ ID NO: 3377040 - RNA, 12 nt, Human
augaaaacuuau

SEQ ID NO: 3377041 - RNA, 18 nt, Human
augaaaagacaagaaaau

SEQ ID NO: 3377042 - RNA, 19 nt, Human
augaaaagauucuucugug

SEQ ID NO: 3377043 - RNA, 15 nt, Human
augaaaagauuuaag

SEQ ID NO: 3377044 - RNA, 14 nt, Human
augaaaauaaagaa

SEQ ID NO: 3377045 - RNA, 16 nt, Human
augaaaauaaauagcu

SEQ ID NO: 3377046 - RNA, 17 nt, Human
augaaaauaaucucuga

SEQ ID NO: 3377047 - RNA, 13 nt, Human
augaaaauacaac

SEQ ID NO: 3377048 - RNA, 17 nt, Human
augaaaauacaacuuaa

SEQ ID NO: 3377049 - RNA, 14 nt, Human
augaaaauaccauu

SEQ ID NO: 3377050 - RNA, 12 nt, Human
augaaaauauuu

SEQ ID NO: 3377051 - RNA, 15 nt, Human
augaaaauccuacca

SEQ ID NO: 3377052 - RNA, 21 nt, Human
augaaaauccuaccaaccucu

SEQ ID NO: 3377053 - RNA, 12 nt, Human
augaaaauggaa

SEQ ID NO: 3377054 - RNA, 12 nt, Human
augaaaauguca

SEQ ID NO: 3377055 - RNA, 19 nt, Human
augaaaaugucagaaacca

SEQ ID NO: 3377056 - RNA, 14 nt, Human
augaaaauguccau

SEQ ID NO: 3377057 - RNA, 16 nt, Human
augaaaaugucuugug

SEQ ID NO: 3377058 - RNA, 14 nt, Human
augaaaauuguauu

SEQ ID NO: 3377059 - RNA, 16 nt, Human
augaaacaaauaauca

SEQ ID NO: 3377060 - RNA, 20 nt, Human
augaaacacucaguuguuca

SEQ ID NO: 3377061 - RNA, 18 nt, Human
augaaacagaaacaaaaa

SEQ ID NO: 3377062 - RNA, 16 nt, Human
augaaacccccacaca

SEQ ID NO: 3377063 - RNA, 17 nt, Human
augaaacccccacacac

SEQ ID NO: 3377064 - RNA, 19 nt, Human
augaaacccccacacacac

SEQ ID NO: 3377065 - RNA, 20 nt, Human
augaaacuaaagcaauagaa

SEQ ID NO: 3377066 - RNA, 21 nt, Human
augaaacuaaagcaauagaaa

SEQ ID NO: 3377067 - RNA, 19 nt, Human
augaaacuuguuucacuga

SEQ ID NO: 3377068 - RNA, 18 nt, Human
augaaagaaaacuuuuau

SEQ ID NO: 3377069 - RNA, 18 nt, Human
augaaagaauauauuuau

SEQ ID NO: 3377070 - RNA, 16 nt, Human
augaaagacuguacaa

SEQ ID NO: 3377071 - RNA, 13 nt, Human
caaguauagaaaa

SEQ ID NO: 3377072 - RNA, 21 nt, Human
caaguaugaauaaagacaccu

SEQ ID NO: 3377073 - RNA, 15 nt, Human
caaguaugugagugu

SEQ ID NO: 3377074 - RNA, 17 nt, Human
caaguauguuuuagcau

SEQ ID NO: 3377075 - RNA, 14 nt, Human
caaguauuagaaua

SEQ ID NO: 3377076 - RNA, 20 nt, Human
caaguauuagaauaccacag

SEQ ID NO: 3377077 - RNA, 12 nt, Human
caaguauuauaa

SEQ ID NO: 3377078 - RNA, 13 nt, Human
caaguauuauacc

SEQ ID NO: 3377079 - RNA, 23 nt, Human
caaguauucugccuuugcagaaa

SEQ ID NO: 3377080 - RNA, 19 nt, Human
caaguauuuguuaauuuag

SEQ ID NO: 3377081 - RNA, 11 nt, Human
caaguauuuuu

SEQ ID NO: 3377082 - RNA, 14 nt, Human
caagucaaauuaau

SEQ ID NO: 3377083 - RNA, 16 nt, Human
caagucaaauuaauaa

SEQ ID NO: 3377084 - RNA, 14 nt, Human
caagucaaucauuu

SEQ ID NO: 3377085 - RNA, 14 nt, Human
caagucacaaagga

SEQ ID NO: 3377086 - RNA, 16 nt, Human
caagucacaaaggaau

SEQ ID NO: 3377087 - RNA, 19 nt, Human
caagucacaaaggaaugga

SEQ ID NO: 3377088 - RNA, 20 nt, Human
caagucaccaaaagacacug

SEQ ID NO: 3377089 - RNA, 15 nt, Human
caagucagcuccagc

SEQ ID NO: 3377090 - RNA, 16 nt, Human
caagucagcuccagcu

SEQ ID NO: 3377091 - RNA, 19 nt, Human
caagucaggcccuuauuuu

SEQ ID NO: 3377092 - RNA, 21 nt, Human
caagucagucauucagauaug

SEQ ID NO: 3377093 - RNA, 16 nt, Human
caagucaguuucuaca

SEQ ID NO: 3377094 - RNA, 18 nt, Human
caagucauagccauaaau

SEQ ID NO: 3377095 - RNA, 13 nt, Human
caagucauggcug

SEQ ID NO: 3377096 - RNA, 17 nt, Human
caagucauuuuaacuuu

SEQ ID NO: 3377097 - RNA, 15 nt, Human
caaguccaauaagac

SEQ ID NO: 3377098 - RNA, 17 nt, Human
caaguccacaguggaac

SEQ ID NO: 3377099 - RNA, 17 nt, Human
caaguccagguccuggu

SEQ ID NO: 3377100 - RNA, 20 nt, Human
caaguccaggucgggcucag

SEQ ID NO: 3377101 - RNA, 20 nt, Human
caagucccugacucucugug

SEQ ID NO: 3377102 - RNA, 21 nt, Human
caagucccugacucucuguga

SEQ ID NO: 3377103 - RNA, 23 nt, Human
caagucccugacucucugugacc

SEQ ID NO: 3377104 - RNA, 19 nt, Human
caaguccgcagaagcccug

SEQ ID NO: 3377105 - RNA, 19 nt, Human
caaguccuggauguugugu

SEQ ID NO: 3377106 - RNA, 17 nt, Human
caaguccugugaauuuc

SEQ ID NO: 3377107 - RNA, 18 nt, Human
caaguccugugaauuucu

SEQ ID NO: 3377108 - RNA, 15 nt, Human
caaguccuuaccucu

SEQ ID NO: 3377109 - RNA, 22 nt, Human
caaguccuuaccucuuccggag

SEQ ID NO: 3377110 - RNA, 15 nt, Human
caaguccuuuuguaa

SEQ ID NO: 3377111 - RNA, 17 nt, Human
caagucggaacagcaga

SEQ ID NO: 3377112 - RNA, 16 nt, Human
caagucuacagaguga

SEQ ID NO: 3377113 - RNA, 19 nt, Human
caagucuacagagugauag

SEQ ID NO: 3377114 - RNA, 14 nt, Human
caagucuaccaauu

SEQ ID NO: 3377115 - RNA, 13 nt, Human
caagucugcagcc

SEQ ID NO: 3377116 - RNA, 14 nt, Human
caagucugugccug

SEQ ID NO: 3377117 - RNA, 16 nt, Human
caagucugugccugga

SEQ ID NO: 3377118 - RNA, 18 nt, Human
caagucugugccuggagc

SEQ ID NO: 3377119 - RNA, 19 nt, Human
caagucugugccuggagcu

SEQ ID NO: 3377120 - RNA, 22 nt, Human
caagucuuuaggucuuuguaag

SEQ ID NO: 3377121 - RNA, 19 nt, Human
caagucuuucucuuucccu

SEQ ID NO: 3377122 - RNA, 21 nt, Human
caagucuuucucuuucccugg

SEQ ID NO: 3377123 - RNA, 21 nt, Human
caagucuuugcuauugugaau

SEQ ID NO: 3377124 - RNA, 20 nt, Human
caagugaaauuauuuuggag

SEQ ID NO: 3377125 - RNA, 11 nt, Human
caagugaaggu

SEQ ID NO: 3377126 - RNA, 14 nt, Human
caagugaagguuua

SEQ ID NO: 3377127 - RNA, 19 nt, Human
caagugacuguaucugugu

SEQ ID NO: 3377128 - RNA, 21 nt, Human
caagugacuguaucuguguag

SEQ ID NO: 3377129 - RNA, 15 nt, Human
caagugagagcuggg

SEQ ID NO: 3377130 - RNA, 19 nt, Human
caagugaggugugucacaa

SEQ ID NO: 3377131 - RNA, 18 nt, Human
caagugagucucucuggg

SEQ ID NO: 3377132 - RNA, 19 nt, Human
caagugauucuccugccuc

SEQ ID NO: 3377133 - RNA, 13 nt, Human
caagugcaggcug

SEQ ID NO: 3377134 - RNA, 20 nt, Human
caagugcaggcuggcaccgc

SEQ ID NO: 3377135 - RNA, 22 nt, Human
caagugcagggccuguaauccc

SEQ ID NO: 3377136 - RNA, 16 nt, Human
caagugccaaaugcuc

SEQ ID NO: 3377137 - RNA, 22 nt, Human
caagugccacugcccgagcugg

SEQ ID NO: 3377138 - RNA, 23 nt, Human
caagugccacugcccgagcuggu

SEQ ID NO: 3377139 - RNA, 16 nt, Human
caagugccgcaaauug

SEQ ID NO: 3377140 - RNA, 16 nt, Human
caagugcugaacagug

SEQ ID NO: 3377141 - RNA, 20 nt, Human
caagugcugaacaguggagg

SEQ ID NO: 3377142 - RNA, 20 nt, Human
caagugcuggagucuccuga

SEQ ID NO: 3377143 - RNA, 21 nt, Human
caaguggagccugacagccag

SEQ ID NO: 3377144 - RNA, 17 nt, Human
caaguggcaugugcugu

SEQ ID NO: 3377145 - RNA, 22 nt, Human
caagugggaucugucacaccag

SEQ ID NO: 3377146 - RNA, 11 nt, Human
cacacacacaa

SEQ ID NO: 3377147 - RNA, 15 nt, Human
cacacacacaaaccu

SEQ ID NO: 3377148 - RNA, 12 nt, Human
cacacacacaca

SEQ ID NO: 3377149 - RNA, 14 nt, Human
cacacacacacaaa

SEQ ID NO: 3377150 - RNA, 15 nt, Human
cacacacacacacaa

SEQ ID NO: 3377151 - RNA, 13 nt, Human
cacacacacacag

SEQ ID NO: 3377152 - RNA, 16 nt, Human
cacacacacacagcca

SEQ ID NO: 3377153 - RNA, 13 nt, Human
cacacacacacau

SEQ ID NO: 3377154 - RNA, 14 nt, Human
cacacacacacauc

SEQ ID NO: 3377155 - RNA, 14 nt, Human
cacacacacagcca

SEQ ID NO: 3377156 - RNA, 13 nt, Human
cacacacacauac

SEQ ID NO: 3377157 - RNA, 15 nt, Human
cacacacacauacac

SEQ ID NO: 3377158 - RNA, 12 nt, Human
cacacacacaug

SEQ ID NO: 3377159 - RNA, 13 nt, Human
cacacacacccac

SEQ ID NO: 3377160 - RNA, 14 nt, Human
cacacacacgcacg

SEQ ID NO: 3377161 - RNA, 14 nt, Human
cacacacacucacu

SEQ ID NO: 3377162 - RNA, 13 nt, Human
cacacacagaaaa

SEQ ID NO: 3377163 - RNA, 12 nt, Human
cacacacagagg

SEQ ID NO: 3377164 - RNA, 13 nt, Human
cacacacauacac

SEQ ID NO: 3377165 - RNA, 17 nt, Human
cacacacaugcauacac

SEQ ID NO: 3377166 - RNA, 15 nt, Human
cacacaccagagccc

SEQ ID NO: 3377167 - RNA, 15 nt, Human
cacacacccugaggu

SEQ ID NO: 3377168 - RNA, 14 nt, Human
cacacaccucacca

SEQ ID NO: 3377169 - RNA, 15 nt, Human
cacacacgcacgcac

SEQ ID NO: 3377170 - RNA, 16 nt, Human
cacacacgcacgcaca

SEQ ID NO: 3377171 - RNA, 12 nt, Human
cacacacguuau

SEQ ID NO: 3377172 - RNA, 12 nt, Human
cacacacucacu

SEQ ID NO: 3377173 - RNA, 21 nt, Human
cacacacucgcccgcccacug

SEQ ID NO: 3377174 - RNA, 14 nt, Human
cacacacuuuggcu

SEQ ID NO: 3377175 - RNA, 15 nt, Human
cacacagaaaauaua

SEQ ID NO: 3377176 - RNA, 12 nt, Human
cacacagaaggg

SEQ ID NO: 3377177 - RNA, 20 nt, Human
cacacagacucauauuacug

SEQ ID NO: 3377178 - RNA, 12 nt, Human
cacacagaggaa

SEQ ID NO: 3377179 - RNA, 19 nt, Human
cacacagaggcugccucuc

SEQ ID NO: 3377180 - RNA, 15 nt, Human
cacacagaguggucu

SEQ ID NO: 3377181 - RNA, 20 nt, Human
cacacagaguggucuuucug

SEQ ID NO: 3377182 - RNA, 18 nt, Human
cacacagauuugagcuca

SEQ ID NO: 3377183 - RNA, 20 nt, Human
cacacagauuugagcucagc

SEQ ID NO: 3377184 - RNA, 19 nt, Human
cacacagcaagucaggguu

SEQ ID NO: 3377185 - RNA, 20 nt, Human
cacacagccacacacacaga

SEQ ID NO: 3377186 - RNA, 22 nt, Human
cacacagccacacacacagaaa

SEQ ID NO: 3377187 - RNA, 14 nt, Human
cacacagccaggug

SEQ ID NO: 3377188 - RNA, 15 nt, Human
cacacagccuagcac

SEQ ID NO: 3377189 - RNA, 13 nt, Human
cacacagcuccca

SEQ ID NO: 3377190 - RNA, 13 nt, Human
cacacagcucugu

SEQ ID NO: 3377191 - RNA, 15 nt, Human
cacacagcugcagag

SEQ ID NO: 3377192 - RNA, 17 nt, Human
cacacaggacccccuuc

SEQ ID NO: 3377193 - RNA, 18 nt, Human
cacacaggcauuuccugg

SEQ ID NO: 3377194 - RNA, 19 nt, Human
cacacaggcauuuccuggg

SEQ ID NO: 3377195 - RNA, 23 nt, Human
cacacaguauuacuucugcuaca

SEQ ID NO: 3377196 - RNA, 23 nt, Human
cacacagugagucgaggacaggg

SEQ ID NO: 3377197 - RNA, 18 nt, Human
cacacagugcucaaggcc

SEQ ID NO: 3377198 - RNA, 22 nt, Human
cacacauagauuaauggcacug

SEQ ID NO: 3377199 - RNA, 20 nt, Human
cacacauauauauuacaagg

SEQ ID NO: 3377200 - RNA, 21 nt, Human
cacacaucaucuguaagcugu

SEQ ID NO: 3377201 - RNA, 16 nt, Human
cacacauccaccccag

SEQ ID NO: 3377202 - RNA, 13 nt, Human
cacacaucccagc

SEQ ID NO: 3377203 - RNA, 17 nt, Human
cacacaugaaguccaag

SEQ ID NO: 3377204 - RNA, 22 nt, Human
cacacaugaaguccaagcauuu

SEQ ID NO: 3377205 - RNA, 22 nt, Human
cacacaugagcaucaggccagg

SEQ ID NO: 3377206 - RNA, 18 nt, Human
cacacaugcuucccuuuc

SEQ ID NO: 3377207 - RNA, 10 nt, Human
cacacauuuu

SEQ ID NO: 3377208 - RNA, 16 nt, Human
cacacauuuuuuaaau

SEQ ID NO: 3377209 - RNA, 18 nt, Human
cacaccaagcagcaacag

SEQ ID NO: 3377210 - RNA, 18 nt, Human
cacaccaagcugugccac

SEQ ID NO: 3377211 - RNA, 23 nt, Human
cacaccaaucuuacuuuguaaau

SEQ ID NO: 3377212 - RNA, 14 nt, Human
cacaccacuagccu

SEQ ID NO: 3377213 - RNA, 19 nt, Human
cacaccacuagccucaggg

SEQ ID NO: 3377214 - RNA, 14 nt, Human
cacaccaggauaga

SEQ ID NO: 3377215 - RNA, 22 nt, Human
cacaccaggccguccucccggg

SEQ ID NO: 3377216 - RNA, 23 nt, Human
cacaccaggccguccucccgggc

SEQ ID NO: 3377217 - RNA, 22 nt, Human
cacaaguggguacccccaggac

SEQ ID NO: 3377218 - RNA, 13 nt, Human
cacaagugguggu

SEQ ID NO: 3377219 - RNA, 20 nt, Human
cacaaguggugguaacccug

SEQ ID NO: 3377220 - RNA, 15 nt, Human
cacaaguguaaugaa

SEQ ID NO: 3377221 - RNA, 19 nt, Human
cacaauaacacuaaaauuu

SEQ ID NO: 3377222 - RNA, 16 nt, Human
cacaauaacuccuccc

SEQ ID NO: 3377223 - RNA, 17 nt, Human
cacaauaacuccuccca

SEQ ID NO: 3377224 - RNA, 13 nt, Human
cacaauaagcaaa

SEQ ID NO: 3377225 - RNA, 15 nt, Human
cacaauaauuuucua

SEQ ID NO: 3377226 - RNA, 21 nt, Human
cacaauaccuuauuuaaguaa

SEQ ID NO: 3377227 - RNA, 15 nt, Human
cacaauagaauuaua

SEQ ID NO: 3377228 - RNA, 20 nt, Human
cacaauagccgauaucagaa

SEQ ID NO: 3377229 - RNA, 23 nt, Human
cacaauccuaacacauuaucggg

SEQ ID NO: 3377230 - RNA, 22 nt, Human
cacaaucucauugaggagcauu

SEQ ID NO: 3377231 - RNA, 20 nt, Human
cacaaucucggcucacugca

SEQ ID NO: 3377232 - RNA, 23 nt, Human
cacaaucucggcucacugcaucc

SEQ ID NO: 3377233 - RNA, 19 nt, Human
cacaaucugacauucucag

SEQ ID NO: 3377234 - RNA, 22 nt, Human
cacaaugcagugccuuucuucu

SEQ ID NO: 3377235 - RNA, 18 nt, Human
cacaaugucaguauuuca

SEQ ID NO: 3377236 - RNA, 11 nt, Human
cacaaugucuu

SEQ ID NO: 3377237 - RNA, 18 nt, Human
cacaauguucuuuauaua

SEQ ID NO: 3377238 - RNA, 13 nt, Human
cacaauuuuuaau

SEQ ID NO: 3377239 - RNA, 13 nt, Human
cacacaaaaaaag

SEQ ID NO: 3377240 - RNA, 21 nt, Human
cacacaaaauguacccaguau

SEQ ID NO: 3377241 - RNA, 14 nt, Human
cacacaaagagagu

SEQ ID NO: 3377242 - RNA, 12 nt, Human
cacacaaagcag

SEQ ID NO: 3377243 - RNA, 13 nt, Human
cacacaacaaaaa

SEQ ID NO: 3377244 - RNA, 19 nt, Human
cacacaaggauagaugcug

SEQ ID NO: 3377245 - RNA, 19 nt, Human
cacacaaggggcccuugga

SEQ ID NO: 3377246 - RNA, 14 nt, Human
cacacaagugcagu

SEQ ID NO: 3377247 - RNA, 15 nt, Human
cacacacaaagagag

SEQ ID NO: 3377248 - RNA, 9 nt, Human
cacacacac

SEQ ID NO: 3377249 - RNA, 12 nt, Human
cacacacacaag

SEQ ID NO: 3377250 - RNA, 11 nt, Human
cacacacacac

SEQ ID NO: 3377251 - RNA, 14 nt, Human
cacacacacacaca

SEQ ID NO: 3377252 - RNA, 15 nt, Human
cacacacacacacac

SEQ ID NO: 3377253 - RNA, 16 nt, Human
cacacacacacacagg

SEQ ID NO: 3377254 - RNA, 14 nt, Human
cacacacacacaug

SEQ ID NO: 3377255 - RNA, 13 nt, Human
cacacacacacuc

SEQ ID NO: 3377256 - RNA, 12 nt, Human
cacacacacagc

SEQ ID NO: 3377257 - RNA, 13 nt, Human
cacacacacagcc

SEQ ID NO: 3377258 - RNA, 12 nt, Human
cacacacacaua

SEQ ID NO: 3377259 - RNA, 13 nt, Human
cacacacacaugc

SEQ ID NO: 3377260 - RNA, 15 nt, Human
cacacacacaugcau

SEQ ID NO: 3377261 - RNA, 14 nt, Human
cacacacacaugcu

SEQ ID NO: 3377262 - RNA, 13 nt, Human
cacacacacucua

SEQ ID NO: 3377263 - RNA, 11 nt, Human
cacacacagaa

SEQ ID NO: 3377264 - RNA, 14 nt, Human
cacacacagaaaau

SEQ ID NO: 3377265 - RNA, 15 nt, Human
cacacacagaaaaua

SEQ ID NO: 3377266 - RNA, 16 nt, Human
cacacacagaaaauau

SEQ ID NO: 3377267 - RNA, 23 nt, Human
cacacacagaaaauauacuguaa

SEQ ID NO: 3377268 - RNA, 14 nt, Human
cacacacagaggaa

SEQ ID NO: 3377269 - RNA, 14 nt, Human
cacacacagccaca

SEQ ID NO: 3377270 - RNA, 11 nt, Human
cacacacagcu

SEQ ID NO: 3377271 - RNA, 12 nt, Human
cacacacagcuu

SEQ ID NO: 3377272 - RNA, 12 nt, Human
cacacacaggag

SEQ ID NO: 3377273 - RNA, 13 nt, Human
cacacacaggagc

SEQ ID NO: 3377274 - RNA, 18 nt, Human
cacacacaugcauacaca

SEQ ID NO: 3377275 - RNA, 14 nt, Human
cacacaccagagcc

SEQ ID NO: 3377276 - RNA, 13 nt, Human
cacacaccccaau

SEQ ID NO: 3377277 - RNA, 18 nt, Human
cacacacccugaggucag

SEQ ID NO: 3377278 - RNA, 11 nt, Human
cacacaccugu

SEQ ID NO: 3377279 - RNA, 13 nt, Human
cacacaccuguag

SEQ ID NO: 3377280 - RNA, 19 nt, Human
cacacaccuguagucccag

SEQ ID NO: 3377281 - RNA, 18 nt, Human
cacacacgcacgcacaca

SEQ ID NO: 3377282 - RNA, 19 nt, Human
cacacacgcacgcacacac

SEQ ID NO: 3377283 - RNA, 23 nt, Human
cacacacgcacgcacacacacaa

SEQ ID NO: 3377284 - RNA, 21 nt, Human
cacacacgcgcgcgcacacac

SEQ ID NO: 3377285 - RNA, 20 nt, Human
cacacacggaggcauccuac

SEQ ID NO: 3377286 - RNA, 15 nt, Human
cacacacgugagaau

SEQ ID NO: 3377287 - RNA, 15 nt, Human
cacacacucacugcg

SEQ ID NO: 3377288 - RNA, 12 nt, Human
cacacacuuuug

SEQ ID NO: 3377289 - RNA, 17 nt, Human
cacacagaaaauauacu

SEQ ID NO: 3377290 - RNA, 20 nt, Human
cacacagaaaauauacugua

SEQ ID NO: 3377291 - RNA, 21 nt, Human
cacacagaaauauauauacau

SEQ ID NO: 3377292 - RNA, 22 nt, Human
cacacagaaauauauauacaua

SEQ ID NO: 3377293 - RNA, 22 nt, Human
cacacagaaggggacugccacc

SEQ ID NO: 3377294 - RNA, 15 nt, Human
cacacagaaugcaac

SEQ ID NO: 3377295 - RNA, 15 nt, Human
cacacagacuguugu

SEQ ID NO: 3377296 - RNA, 14 nt, Human
cacacagagugguc

SEQ ID NO: 3377297 - RNA, 18 nt, Human
cacacagauacacacaca

SEQ ID NO: 3377298 - RNA, 22 nt, Human
cacacagauuugagcucagccc

SEQ ID NO: 3377299 - RNA, 15 nt, Human
cacacagcagcaguu

SEQ ID NO: 3377300 - RNA, 12 nt, Human
cacacagccaca

SEQ ID NO: 3377301 - RNA, 18 nt, Human
cacacagcuacucucccc

SEQ ID NO: 3377302 - RNA, 14 nt, Human
cacacagcucuguc

SEQ ID NO: 3377303 - RNA, 17 nt, Human
cacacagcucuguccug

SEQ ID NO: 3377304 - RNA, 20 nt, Human
cacacagcucuguccuggga

SEQ ID NO: 3377305 - RNA, 13 nt, Human
cacacagcugccg

SEQ ID NO: 3377306 - RNA, 22 nt, Human
cacacagcuuuuaguacccacc

SEQ ID NO: 3377307 - RNA, 16 nt, Human
cacacaggcauuuccu

SEQ ID NO: 3377308 - RNA, 21 nt, Human
cacacaggcauuuccugggug

SEQ ID NO: 3377309 - RNA, 22 nt, Human
cacacaggggaggugauagcau

SEQ ID NO: 3377310 - RNA, 19 nt, Human
cacacaggggccacccggg

SEQ ID NO: 3377311 - RNA, 23 nt, Human
cacacagggucugcaaggucuuu

SEQ ID NO: 3377312 - RNA, 20 nt, Human
cacacagguggugucacugu

SEQ ID NO: 3377313 - RNA, 22 nt, Human
cacacagguggugucacugucc

SEQ ID NO: 3377314 - RNA, 17 nt, Human
cacacaguauuaaguga

SEQ ID NO: 3377315 - RNA, 13 nt, Human
cacacauaaagga

SEQ ID NO: 3377316 - RNA, 14 nt, Human
cacacaucaucugu

SEQ ID NO: 3377317 - RNA, 16 nt, Human
cacacaucccagccca

SEQ ID NO: 3377318 - RNA, 13 nt, Human
cacacaugcacac

SEQ ID NO: 3377319 - RNA, 14 nt, Human
cacacaugcauaca

SEQ ID NO: 3377320 - RNA, 15 nt, Human
cacacaugcauacac

SEQ ID NO: 3377321 - RNA, 17 nt, Human
cacacaugcauacacac

SEQ ID NO: 3377322 - RNA, 22 nt, Human
cacacauggaaacccauaggcc

SEQ ID NO: 3377323 - RNA, 18 nt, Human
cacacauggcuaauuuuu

SEQ ID NO: 3377324 - RNA, 13 nt, Human
cacacauugcugu

SEQ ID NO: 3377325 - RNA, 22 nt, Human
cacacauuucacugucugucug

SEQ ID NO: 3377326 - RNA, 11 nt, Human
cacacauuuuu

SEQ ID NO: 3377327 - RNA, 12 nt, Human
cacacauuuuuu

SEQ ID NO: 3377328 - RNA, 19 nt, Human
cacacauuuuuuaaaugca

SEQ ID NO: 3377329 - RNA, 16 nt, Human
cacaccaagcugugcc

SEQ ID NO: 3377330 - RNA, 17 nt, Human
cacaccaagcugugcca

SEQ ID NO: 3377331 - RNA, 22 nt, Human
cacaccaagcugugccacccug

SEQ ID NO: 3377332 - RNA, 23 nt, Human
cacaccaagcugugccacccugg

SEQ ID NO: 3377333 - RNA, 21 nt, Human
cacaccaaucuuacuuuguaa

SEQ ID NO: 3377334 - RNA, 15 nt, Human
cacaccagagcccac

SEQ ID NO: 3377335 - RNA, 21 nt, Human
cacaccaggcuugccugcagg

SEQ ID NO: 3377336 - RNA, 22 nt, Human
cacaccaggcuugccugcaggc

SEQ ID NO: 3377337 - RNA, 20 nt, Human
cacaccagggccagccucua

SEQ ID NO: 3377338 - RNA, 16 nt, Human
cacaccagucacauga

SEQ ID NO: 3377339 - RNA, 23 nt, Human
cacaccauaagcuacugccaucc

SEQ ID NO: 3377340 - RNA, 22 nt, Human
cacacccaaagcugagccugca

SEQ ID NO: 3377341 - RNA, 14 nt, Human
cacacccaccgucc

SEQ ID NO: 3377342 - RNA, 15 nt, Human
cacacccacucagcu

SEQ ID NO: 3377343 - RNA, 13 nt, Human
cacacccagccca

SEQ ID NO: 3377344 - RNA, 14 nt, Human
cacacccagccuca

SEQ ID NO: 3377345 - RNA, 14 nt, Human
cacacccagcuacu

SEQ ID NO: 3377346 - RNA, 16 nt, Human
cacaccccaccugcgc

SEQ ID NO: 3377347 - RNA, 17 nt, Human
cacacccucucccagga

SEQ ID NO: 3377348 - RNA, 12 nt, Human
cacacccugagg

SEQ ID NO: 3377349 - RNA, 11 nt, Human
cacacccugca

SEQ ID NO: 3377350 - RNA, 14 nt, Human
cacacccuguuuua

SEQ ID NO: 3377351 - RNA, 17 nt, Human
cacaccgggcacucaga

SEQ ID NO: 3377352 - RNA, 16 nt, Human
cacaccuaagggacau

SEQ ID NO: 3377353 - RNA, 20 nt, Human
cacaccucaguucccuuggc

SEQ ID NO: 3377354 - RNA, 22 nt, Human
cacaccucaguucccuuggccu

SEQ ID NO: 3377355 - RNA, 17 nt, Human
caccaaaguucuaauaa

SEQ ID NO: 3377356 - RNA, 22 nt, Human
caccaaaguucuaauaauuucu

SEQ ID NO: 3377357 - RNA, 16 nt, Human
caccaaaucaaaaucu

SEQ ID NO: 3377358 - RNA, 22 nt, Human
caccaaaucguagcguuuguua

SEQ ID NO: 3377359 - RNA, 13 nt, Human
caccaaaugugcu

SEQ ID NO: 3377360 - RNA, 17 nt, Human
caccaacauacucccau

SEQ ID NO: 3377361 - RNA, 21 nt, Human
caccaacauacucccaucugu

SEQ ID NO: 3377362 - RNA, 23 nt, Human
caccaacaucccauugcccuggu

SEQ ID NO: 3377363 - RNA, 20 nt, Human
caccaacccagccgcugccc

SEQ ID NO: 3377364 - RNA, 15 nt, Human
augcauugcucugga

SEQ ID NO: 3377365 - RNA, 22 nt, Human
caccaugcagugccccuagcuu

SEQ ID NO: 3377366 - RNA, 21 nt, Human
caccaugccaggcuaauuuuu

SEQ ID NO: 3377367 - RNA, 17 nt, Human
caccaugcugcugggga

SEQ ID NO: 3377368 - RNA, 12 nt, Human
caccauggccag

SEQ ID NO: 3377369 - RNA, 22 nt, Human
caccauggcuaaggcaccagcc

SEQ ID NO: 3377370 - RNA, 15 nt, Human
caccauguaaaacaa

SEQ ID NO: 3377371 - RNA, 16 nt, Human
caccauguaaaacaaa

SEQ ID NO: 3377372 - RNA, 18 nt, Human
caccauguuggccaggcu

SEQ ID NO: 3377373 - RNA, 14 nt, Human
caccauuaaaaggg

SEQ ID NO: 3377374 - RNA, 22 nt, Human
caccauuaaaagggauuaccca

SEQ ID NO: 3377375 - RNA, 16 nt, Human
caccauuauaaugaau

SEQ ID NO: 3377376 - RNA, 15 nt, Human
caccauucaggaacc

SEQ ID NO: 3377377 - RNA, 19 nt, Human
caccauugcaacaaaauac

SEQ ID NO: 3377378 - RNA, 15 nt, Human
caccauuuccccagg

SEQ ID NO: 3377379 - RNA, 20 nt, Human
caccauuuccccagggcacg

SEQ ID NO: 3377380 - RNA, 17 nt, Human
caccauuuggauccugu

SEQ ID NO: 3377381 - RNA, 19 nt, Human
caccauuuggcaucccugg

SEQ ID NO: 3377382 - RNA, 24 nt, Human
caccauuuggcaucccugggccuu

SEQ ID NO: 3377383 - RNA, 20 nt, Human
caccauuuuaagucccuguc

SEQ ID NO: 3377384 - RNA, 15 nt, Human
cacccaaaccccggg

SEQ ID NO: 3377385 - RNA, 15 nt, Human
cacccaaccccaagc

SEQ ID NO: 3377386 - RNA, 14 nt, Human
cacccaacgcucca

SEQ ID NO: 3377387 - RNA, 19 nt, Human
cacccaagagauuguuguu

SEQ ID NO: 3377388 - RNA, 16 nt, Human
cacccaagcaggaggc

SEQ ID NO: 3377389 - RNA, 13 nt, Human
cacccaagggccu

SEQ ID NO: 3377390 - RNA, 21 nt, Human
cacccaagggccuggccugag

SEQ ID NO: 3377391 - RNA, 23 nt, Human
cacccaagggccuggccugagcu

SEQ ID NO: 3377392 - RNA, 19 nt, Human
cacccaaucaagggaagaa

SEQ ID NO: 3377393 - RNA, 21 nt, Human
cacccaaucaagggaagaagg

SEQ ID NO: 3377394 - RNA, 17 nt, Human
cacccacagaaagagag

SEQ ID NO: 3377395 - RNA, 19 nt, Human
cacccacaugugacacaua

SEQ ID NO: 3377396 - RNA, 18 nt, Human
cacccaccaacccucagg

SEQ ID NO: 3377397 - RNA, 20 nt, Human
cacccaccaacccucagggc

SEQ ID NO: 3377398 - RNA, 15 nt, Human
cacccaccagggcga

SEQ ID NO: 3377399 - RNA, 22 nt, Human
cacccaccaucaugucuggcua

SEQ ID NO: 3377400 - RNA, 18 nt, Human
cacccaccucagccuccc

SEQ ID NO: 3377401 - RNA, 13 nt, Human
cacccaccucccu

SEQ ID NO: 3377402 - RNA, 13 nt, Human
cacccacucagcu

SEQ ID NO: 3377403 - RNA, 14 nt, Human
cacccacucagcuc

SEQ ID NO: 3377404 - RNA, 15 nt, Human
cacccacucagcucc

SEQ ID NO: 3377405 - RNA, 21 nt, Human
cacccacucuccucugccuca

SEQ ID NO: 3377406 - RNA, 16 nt, Human
cacccagacagcuccc

SEQ ID NO: 3377407 - RNA, 22 nt, Human
cacccagacagcucccucugcc

SEQ ID NO: 3377408 - RNA, 15 nt, Human
cacccagacauaaag

SEQ ID NO: 3377409 - RNA, 23 nt, Human
cacccagacauaaaggaaaagac

SEQ ID NO: 3377410 - RNA, 20 nt, Human
cacccagaugccccuuucug

SEQ ID NO: 3377411 - RNA, 21 nt, Human
cacccagaugggggaaagcac

SEQ ID NO: 3377412 - RNA, 13 nt, Human
cacccagcaauag

SEQ ID NO: 3377413 - RNA, 16 nt, Human
cacccagcccacuucu

SEQ ID NO: 3377414 - RNA, 17 nt, Human
cacccagcccacuucug

SEQ ID NO: 3377415 - RNA, 15 nt, Human
cacccagcccauucu

SEQ ID NO: 3377416 - RNA, 23 nt, Human
cacccagcccauucucucuccug

SEQ ID NO: 3377417 - RNA, 18 nt, Human
cacccagcccuggucuca

SEQ ID NO: 3377418 - RNA, 14 nt, Human
cacccagccucagu

SEQ ID NO: 3377419 - RNA, 11 nt, Human
cacccagccug

SEQ ID NO: 3377420 - RNA, 18 nt, Human
cacccaggaacuccugac

SEQ ID NO: 3377421 - RNA, 16 nt, Human
cacccaggagccccga

SEQ ID NO: 3377422 - RNA, 11 nt, Human
cacccaggagg

SEQ ID NO: 3377423 - RNA, 21 nt, Human
cacccaggccuauguugaucc

SEQ ID NO: 3377424 - RNA, 20 nt, Human
cacccaggcuggagugcagu

SEQ ID NO: 3377425 - RNA, 13 nt, Human
cacccaggggcag

SEQ ID NO: 3377426 - RNA, 16 nt, Human
cacccaggggcagccc

SEQ ID NO: 3377427 - RNA, 17 nt, Human
cacccagucuguucccc

SEQ ID NO: 3377428 - RNA, 17 nt, Human
cacccagugagcacucc

SEQ ID NO: 3377429 - RNA, 20 nt, Human
cacccagugagcacucccaa

SEQ ID NO: 3377430 - RNA, 16 nt, Human
cacccagugcccucuc

SEQ ID NO: 3377431 - RNA, 13 nt, Human
cacccauaucaug

SEQ ID NO: 3377432 - RNA, 14 nt, Human
cacccauccuagag

SEQ ID NO: 3377433 - RNA, 23 nt, Human
cacccauccuaucagccugucuc

SEQ ID NO: 3377434 - RNA, 14 nt, Human
cacccaugaagaca

SEQ ID NO: 3377435 - RNA, 17 nt, Human
cacccauguuucucugg

SEQ ID NO: 3377436 - RNA, 15 nt, Human
cacccauuuuuccuu

SEQ ID NO: 3377437 - RNA, 18 nt, Human
cacccauuuuuccuuuug

SEQ ID NO: 3377438 - RNA, 13 nt, Human
caccccacccucc

SEQ ID NO: 3377439 - RNA, 15 nt, Human
caccccacccucccu

SEQ ID NO: 3377440 - RNA, 12 nt, Human
caccccaccucu

SEQ ID NO: 3377441 - RNA, 15 nt, Human
caccccaccucuucc

SEQ ID NO: 3377442 - RNA, 14 nt, Human
caccccaccugcag

SEQ ID NO: 3377443 - RNA, 17 nt, Human
caccccagagccacaca

SEQ ID NO: 3377444 - RNA, 18 nt, Human
caccccagagccacacau

SEQ ID NO: 3377445 - RNA, 12 nt, Human
caccccagcccc

SEQ ID NO: 3377446 - RNA, 18 nt, Human
caccccagcugcuccccu

SEQ ID NO: 3377447 - RNA, 22 nt, Human
caccccagcugcuccccucccu

SEQ ID NO: 3377448 - RNA, 16 nt, Human
caccccagggcagcca

SEQ ID NO: 3377449 - RNA, 17 nt, Human
caccccagugcacccac

SEQ ID NO: 3377450 - RNA, 22 nt, Human
caccccauagugaccggcugcu

SEQ ID NO: 3377451 - RNA, 15 nt, Human
caccccaucccacac

SEQ ID NO: 3377452 - RNA, 12 nt, Human
caccccauccuc

SEQ ID NO: 3377453 - RNA, 12 nt, Human
caccccaugcca

SEQ ID NO: 3377454 - RNA, 15 nt, Human
caccccaugccaaag

SEQ ID NO: 3377455 - RNA, 11 nt, Human
cacccccacca

SEQ ID NO: 3377456 - RNA, 14 nt, Human
cacccccaccccuu

SEQ ID NO: 3377457 - RNA, 13 nt, Human
cacccccagcccc

SEQ ID NO: 3377458 - RNA, 19 nt, Human
cacccccagccccgacucc

SEQ ID NO: 3377459 - RNA, 23 nt, Human
cacccccagccccgacuccagcc

SEQ ID NO: 3377460 - RNA, 12 nt, Human
cacccccagccu

SEQ ID NO: 3377461 - RNA, 13 nt, Human
cacccccagccug

SEQ ID NO: 3377462 - RNA, 15 nt, Human
cacccccagccuggg

SEQ ID NO: 3377463 - RNA, 16 nt, Human
cacccccagccugggc

SEQ ID NO: 3377464 - RNA, 18 nt, Human
cacccccagccugggccu

SEQ ID NO: 3377465 - RNA, 13 nt, Human
cacccccagcuca

SEQ ID NO: 3377466 - RNA, 14 nt, Human
cacccccagcucaa

SEQ ID NO: 3377467 - RNA, 12 nt, Human
cacccccagcuu

SEQ ID NO: 3377468 - RNA, 13 nt, Human
cacccccaucucu

SEQ ID NO: 3377469 - RNA, 15 nt, Human
caccccccaagcugu

SEQ ID NO: 3377470 - RNA, 12 nt, Human
caccccccucau

SEQ ID NO: 3377471 - RNA, 14 nt, Human
cacccccgcuggag

SEQ ID NO: 3377472 - RNA, 11 nt, Human
cacccccuccc

SEQ ID NO: 3377473 - RNA, 14 nt, Human
cacccccucccacc

SEQ ID NO: 3377474 - RNA, 15 nt, Human
cacccccucccaccc

SEQ ID NO: 3377475 - RNA, 18 nt, Human
cacccccuccccagggga

SEQ ID NO: 3377476 - RNA, 16 nt, Human
cacccccuccccgccc

SEQ ID NO: 3377477 - RNA, 16 nt, Human
cacccccucccuggcc

SEQ ID NO: 3377478 - RNA, 16 nt, Human
cacccccuccugcugc

SEQ ID NO: 3377479 - RNA, 13 nt, Human
cacccccugcagc

SEQ ID NO: 3377480 - RNA, 14 nt, Human
cacccccugcagcu

SEQ ID NO: 3377481 - RNA, 17 nt, Human
cacccccuucagugccc

SEQ ID NO: 3377482 - RNA, 13 nt, Human
cacccccuucccc

SEQ ID NO: 3377483 - RNA, 22 nt, Human
cacccccuucucugcccauucc

SEQ ID NO: 3377484 - RNA, 23 nt, Human
cacccccuucucugcccauuccc

SEQ ID NO: 3377485 - RNA, 18 nt, Human
cacccccuucucugcucc

SEQ ID NO: 3377486 - RNA, 14 nt, Human
cacccccuuuccug

SEQ ID NO: 3377487 - RNA, 16 nt, Human
caccccgacuuuuguu

SEQ ID NO: 3377488 - RNA, 15 nt, Human
caccccgagggcuga

SEQ ID NO: 3377489 - RNA, 19 nt, Human
caccccggcaggcccugca

SEQ ID NO: 3377490 - RNA, 20 nt, Human
caccccggcaggcccugcag

SEQ ID NO: 3377491 - RNA, 16 nt, Human
caccccggccaccugc

SEQ ID NO: 3377492 - RNA, 17 nt, Human
caccccggggacccugu

SEQ ID NO: 3377493 - RNA, 15 nt, Human
caccccguagauucc

SEQ ID NO: 3377494 - RNA, 23 nt, Human
caccccgucugggguucagcccc

SEQ ID NO: 3377495 - RNA, 23 nt, Human
caccccuaaaagaaacccugcac

SEQ ID NO: 3377496 - RNA, 14 nt, Human
caccccuaaagaga

SEQ ID NO: 3377497 - RNA, 12 nt, Human
caccccuaccac

SEQ ID NO: 3377498 - RNA, 17 nt, Human
caccccuaccccuggcu

SEQ ID NO: 3377499 - RNA, 12 nt, Human
caccccuaggac

SEQ ID NO: 3377500 - RNA, 17 nt, Human
caccccucacucuggcc

SEQ ID NO: 3377501 - RNA, 18 nt, Human
caccccucaguugugcag

SEQ ID NO: 3377502 - RNA, 22 nt, Human
caccccuccagaacacggcuca

SEQ ID NO: 3377503 - RNA, 15 nt, Human
caccccucccuuucu

SEQ ID NO: 3377504 - RNA, 18 nt, Human
caccccucccuuucuccc

SEQ ID NO: 3377505 - RNA, 14 nt, Human
caccccuccuuccu

SEQ ID NO: 3377506 - RNA, 15 nt, Human
caccccucucugcau

SEQ ID NO: 3377507 - RNA, 14 nt, Human
caccccugccccca

SEQ ID NO: 3377508 - RNA, 15 nt, Human
caccccugcccuggg

SEQ ID NO: 3377509 - RNA, 18 nt, Human
caccccugccuccacccu

SEQ ID NO: 3377510 - RNA, 14 nt, Human
caccccugggggcu

SEQ ID NO: 3377511 - RNA, 17 nt, Human
caccgccuugcccagcc

SEQ ID NO: 3377512 - RNA, 18 nt, Human
caccgccuugcccagccu

SEQ ID NO: 3377513 - RNA, 19 nt, Human
caccgcgggugugggaaag

SEQ ID NO: 3377514 - RNA, 14 nt, Human
caccgcuccccagc

SEQ ID NO: 3377515 - RNA, 17 nt, Human
caccgcuccccagccca

SEQ ID NO: 3377516 - RNA, 22 nt, Human
caccgcugccuaaguggcugcu

SEQ ID NO: 3377517 - RNA, 21 nt, Human
caccggauccuggguggucug

SEQ ID NO: 3377518 - RNA, 22 nt, Human
caccggauccuggguggucugc

SEQ ID NO: 3377519 - RNA, 15 nt, Human
caccggcuggccugg

SEQ ID NO: 3377520 - RNA, 16 nt, Human
caccggcuggccuggc

SEQ ID NO: 3377521 - RNA, 18 nt, Human
caccgggccacagagaaa

SEQ ID NO: 3377522 - RNA, 14 nt, Human
caccgggccacucc

SEQ ID NO: 3377523 - RNA, 17 nt, Human
caccggggccucggacu

SEQ ID NO: 3377524 - RNA, 17 nt, Human
caccgguccagcuggcc

SEQ ID NO: 3377525 - RNA, 14 nt, Human
caccguacugugga

SEQ ID NO: 3377526 - RNA, 15 nt, Human
caccgucauggcuua

SEQ ID NO: 3377527 - RNA, 19 nt, Human
caccgucauggcuuaaugu

SEQ ID NO: 3377528 - RNA, 23 nt, Human
caccgucauggcuuaauguuuau

SEQ ID NO: 3377529 - RNA, 15 nt, Human
caccguccgcccugc

SEQ ID NO: 3377530 - RNA, 20 nt, Human
caccgugccuggccacgccc

SEQ ID NO: 3377531 - RNA, 18 nt, Human
caccguggaccuuccugc

SEQ ID NO: 3377532 - RNA, 19 nt, Human
cacagccaggggagcagag

SEQ ID NO: 3377533 - RNA, 19 nt, Human
cacagccaggugccuugga

SEQ ID NO: 3377534 - RNA, 17 nt, Human
cacagccaucccagccu

SEQ ID NO: 3377535 - RNA, 20 nt, Human
cacagccaucccagccuugg

SEQ ID NO: 3377536 - RNA, 17 nt, Human
cacagcccacguccugu

SEQ ID NO: 3377537 - RNA, 13 nt, Human
cacagcccagcca

SEQ ID NO: 3377538 - RNA, 14 nt, Human
cacagcccagcccg

SEQ ID NO: 3377539 - RNA, 14 nt, Human
cacagccccaucug

SEQ ID NO: 3377540 - RNA, 18 nt, Human
cacagcccgcaugcagca

SEQ ID NO: 3377541 - RNA, 21 nt, Human
cacagcccgcaugcagcagcu

SEQ ID NO: 3377542 - RNA, 18 nt, Human
cacagcccucccgccccu

SEQ ID NO: 3377543 - RNA, 10 nt, Human
cacagcccug

SEQ ID NO: 3377544 - RNA, 13 nt, Human
cacagcccuguca

SEQ ID NO: 3377545 - RNA, 16 nt, Human
cacagcccugucagca

SEQ ID NO: 3377546 - RNA, 19 nt, Human
cacagcccugucagcauga

SEQ ID NO: 3377547 - RNA, 23 nt, Human
cacagcccugucagugcagcccg

SEQ ID NO: 3377548 - RNA, 14 nt, Human
cacagccgcagccu

SEQ ID NO: 3377549 - RNA, 21 nt, Human
cacagccgcagccucccucug

SEQ ID NO: 3377550 - RNA, 19 nt, Human
cacagccggggccugccua

SEQ ID NO: 3377551 - RNA, 13 nt, Human
cacagccuagcac

SEQ ID NO: 3377552 - RNA, 21 nt, Human
cacagccuauaggccaaugca

SEQ ID NO: 3377553 - RNA, 17 nt, Human
cacagccuccccugcca

SEQ ID NO: 3377554 - RNA, 20 nt, Human
cacagccuccccugccaggg

SEQ ID NO: 3377555 - RNA, 21 nt, Human
cacagccuccccugccagggc

SEQ ID NO: 3377556 - RNA, 14 nt, Human
cacagccuccucug

SEQ ID NO: 3377557 - RNA, 15 nt, Human
cacagccuccucugu

SEQ ID NO: 3377558 - RNA, 19 nt, Human
cacagccuccucugucugc

SEQ ID NO: 3377559 - RNA, 13 nt, Human
cacagccugcacu

SEQ ID NO: 3377560 - RNA, 19 nt, Human
cacagccugggccccagcu

SEQ ID NO: 3377561 - RNA, 14 nt, Human
cacagcgccagccu

SEQ ID NO: 3377562 - RNA, 22 nt, Human
cacagcgcuggccgggaccccg

SEQ ID NO: 3377563 - RNA, 20 nt, Human
cacagcggagguguggagcc

SEQ ID NO: 3377564 - RNA, 20 nt, Human
cacagcgucccuagcaguga

SEQ ID NO: 3377565 - RNA, 22 nt, Human
cacagcguuaugugucugccac

SEQ ID NO: 3377566 - RNA, 21 nt, Human
cacagcuaacacacagcuccc

SEQ ID NO: 3377567 - RNA, 15 nt, Human
cacagcuaacaugga

SEQ ID NO: 3377568 - RNA, 15 nt, Human
cacagcucaggaggc

SEQ ID NO: 3377569 - RNA, 14 nt, Human
cacagcucccaccc

SEQ ID NO: 3377570 - RNA, 15 nt, Human
cacagcucccacccc

SEQ ID NO: 3377571 - RNA, 22 nt, Human
cacagcucccaccccacccccu

SEQ ID NO: 3377572 - RNA, 14 nt, Human
cacagcucccugcc

SEQ ID NO: 3377573 - RNA, 13 nt, Human
cacagcuccuuuu

SEQ ID NO: 3377574 - RNA, 16 nt, Human
cacagcucuguccugg

SEQ ID NO: 3377575 - RNA, 14 nt, Human
cacagcucuucucc

SEQ ID NO: 3377576 - RNA, 20 nt, Human
cacagcucuucuccaggcug

SEQ ID NO: 3377577 - RNA, 14 nt, Human
cacagcugccucuu

SEQ ID NO: 3377578 - RNA, 15 nt, Human
cacagcugccucuuc

SEQ ID NO: 3377579 - RNA, 12 nt, Human
cacagcugcugg

SEQ ID NO: 3377580 - RNA, 14 nt, Human
cacagcugcuuucu

SEQ ID NO: 3377581 - RNA, 20 nt, Human
cacagcugcuuucuguuguc

SEQ ID NO: 3377582 - RNA, 21 nt, Human
cacagcuggagcucucaaacu

SEQ ID NO: 3377583 - RNA, 14 nt, Human
cacagcuggccucc

SEQ ID NO: 3377584 - RNA, 22 nt, Human
cacagcugggguggggaccuca

SEQ ID NO: 3377585 - RNA, 23 nt, Human
cacagcugggguggggaccucag

SEQ ID NO: 3377586 - RNA, 14 nt, Human
cacagcuguagugg

SEQ ID NO: 3377587 - RNA, 17 nt, Human
cacagcuguucuucugu

SEQ ID NO: 3377588 - RNA, 19 nt, Human
cacagcuucagccaggagc

SEQ ID NO: 3377589 - RNA, 22 nt, Human
cacagcuucauuuccugugucu

SEQ ID NO: 3377590 - RNA, 16 nt, Human
cacagcuuccccucuc

SEQ ID NO: 3377591 - RNA, 23 nt, Human
cacagcuuccccucucuccuccu

SEQ ID NO: 3377592 - RNA, 21 nt, Human
cacagcuuccuguccccaucu

SEQ ID NO: 3377593 - RNA, 22 nt, Human
cacagcuuccuguccccaucug

SEQ ID NO: 3377594 - RNA, 21 nt, Human
cacagcuugaccugaggcugu

SEQ ID NO: 3377595 - RNA, 22 nt, Human
cacagcuugaccugaggcugug

SEQ ID NO: 3377596 - RNA, 12 nt, Human
cacagcuugggg

SEQ ID NO: 3377597 - RNA, 15 nt, Human
cacagcuuggggcca

SEQ ID NO: 3377598 - RNA, 18 nt, Human
cacagcuuggggccaucg

SEQ ID NO: 3377599 - RNA, 14 nt, Human
cacagcuuguuuug

SEQ ID NO: 3377600 - RNA, 16 nt, Human
cacagcuuguuuugga

SEQ ID NO: 3377601 - RNA, 12 nt, Human
cacagcuuuugc

SEQ ID NO: 3377602 - RNA, 13 nt, Human
cacagcuuuugca

SEQ ID NO: 3377603 - RNA, 14 nt, Human
cacagcuuuugcaa

SEQ ID NO: 3377604 - RNA, 23 nt, Human
cacaggaaaccaacacccaaagc

SEQ ID NO: 3377605 - RNA, 13 nt, Human
cacaggaaaccag

SEQ ID NO: 3377606 - RNA, 22 nt, Human
cacaggaagccugcaguccugg

SEQ ID NO: 3377607 - RNA, 22 nt, Human
cacaggacaugcgguagccagc

SEQ ID NO: 3377608 - RNA, 15 nt, Human
cacaggacauuucuc

SEQ ID NO: 3377609 - RNA, 15 nt, Human
cacaggagacacugu

SEQ ID NO: 3377610 - RNA, 19 nt, Human
cacaggagaggauggccca

SEQ ID NO: 3377611 - RNA, 15 nt, Human
cacaggagcuaccug

SEQ ID NO: 3377612 - RNA, 16 nt, Human
cacaggagcuaccugu

SEQ ID NO: 3377613 - RNA, 20 nt, Human
cacaggagcuaccugugugg

SEQ ID NO: 3377614 - RNA, 14 nt, Human
cacaggaggcaggc

SEQ ID NO: 3377615 - RNA, 19 nt, Human
cacaggagggagggggaag

SEQ ID NO: 3377616 - RNA, 16 nt, Human
cacaggaguguccucu

SEQ ID NO: 3377617 - RNA, 12 nt, Human
cacaggaucagu

SEQ ID NO: 3377618 - RNA, 19 nt, Human
cacaggauccuauucucac

SEQ ID NO: 3377619 - RNA, 16 nt, Human
cacaggaugaaggcaa

SEQ ID NO: 3377620 - RNA, 16 nt, Human
cacaggaugcuggccu

SEQ ID NO: 3377621 - RNA, 17 nt, Human
cacaggaugcuguguug

SEQ ID NO: 3377622 - RNA, 20 nt, Human
cacaggauggucucugccau

SEQ ID NO: 3377623 - RNA, 20 nt, Human
cacaggcaaaauccuugcuu

SEQ ID NO: 3377624 - RNA, 23 nt, Human
cacaggcaacugaggcagacagc

SEQ ID NO: 3377625 - RNA, 14 nt, Human
cacaggcagcauuu

SEQ ID NO: 3377626 - RNA, 11 nt, Human
cacaggcagcu

SEQ ID NO: 3377627 - RNA, 21 nt, Human
cacaggcagcuggaugagacu

SEQ ID NO: 3377628 - RNA, 16 nt, Human
cacaggcagcuuucua

SEQ ID NO: 3377629 - RNA, 18 nt, Human
cacaggcagcuuucuaga

SEQ ID NO: 3377630 - RNA, 12 nt, Human
cacaggcagggc

SEQ ID NO: 3377631 - RNA, 13 nt, Human
cacaggcagggca

SEQ ID NO: 3377632 - RNA, 14 nt, Human
cacaggcagggcag

SEQ ID NO: 3377633 - RNA, 20 nt, Human
cacaggcauuuccugggugg

SEQ ID NO: 3377634 - RNA, 16 nt, Human
cacaggccacccugug

SEQ ID NO: 3377635 - RNA, 20 nt, Human
cacaggcccggcuccaggcu

SEQ ID NO: 3377636 - RNA, 15 nt, Human
cacaggcccuuccuc

SEQ ID NO: 3377637 - RNA, 20 nt, Human
cacaggcccuuuccucaggc

SEQ ID NO: 3377638 - RNA, 22 nt, Human
cacaggcccuuuccucaggcaa

SEQ ID NO: 3377639 - RNA, 12 nt, Human
cacaggccuccc

SEQ ID NO: 3377640 - RNA, 13 nt, Human
cacaggccucccu

SEQ ID NO: 3377641 - RNA, 15 nt, Human
cacaggccucccugu

SEQ ID NO: 3377642 - RNA, 19 nt, Human
cacaggccugagauuucau

SEQ ID NO: 3377643 - RNA, 18 nt, Human
cacaggccuguguagcug

SEQ ID NO: 3377644 - RNA, 23 nt, Human
cacaggccuguguagcugugacc

SEQ ID NO: 3377645 - RNA, 13 nt, Human
cacaggcucaggc

SEQ ID NO: 3377646 - RNA, 16 nt, Human
cacaggcucaggcagg

SEQ ID NO: 3377647 - RNA, 14 nt, Human
cacaggcugagugc

SEQ ID NO: 3377648 - RNA, 17 nt, Human
cacaggcugagugcagg

SEQ ID NO: 3377649 - RNA, 21 nt, Human
cacaggcugagugcaggccca

SEQ ID NO: 3377650 - RNA, 22 nt, Human
cacaggcugagugcaggcccac

SEQ ID NO: 3377651 - RNA, 13 nt, Human
cacaggcugggcu

SEQ ID NO: 3377652 - RNA, 16 nt, Human
cacaggcugggcuggg

SEQ ID NO: 3377653 - RNA, 19 nt, Human
cacaggcugggcugggcac

SEQ ID NO: 3377654 - RNA, 13 nt, Human
cacagggaagugg

SEQ ID NO: 3377655 - RNA, 14 nt, Human
cacagggcagagcc

SEQ ID NO: 3377656 - RNA, 19 nt, Human
cacccguucugcuggccug

SEQ ID NO: 3377657 - RNA, 12 nt, Human
cacccuaccugu

SEQ ID NO: 3377658 - RNA, 14 nt, Human
cacccuaccuguuc

SEQ ID NO: 3377659 - RNA, 16 nt, Human
cacccuaguuucccug

SEQ ID NO: 3377660 - RNA, 15 nt, Human
cacccucacucugcc

SEQ ID NO: 3377661 - RNA, 18 nt, Human
cacccucacucugccagg

SEQ ID NO: 3377662 - RNA, 22 nt, Human
cacccucacucugccagggcag

SEQ ID NO: 3377663 - RNA, 20 nt, Human
cacccucagaugcacaugag

SEQ ID NO: 3377664 - RNA, 17 nt, Human
cacccucagcaccccuu

SEQ ID NO: 3377665 - RNA, 21 nt, Human
cacccucagcaccccuuccau

SEQ ID NO: 3377666 - RNA, 13 nt, Human
cacccucaugcug

SEQ ID NO: 3377667 - RNA, 14 nt, Human
cacccucaugcugu

SEQ ID NO: 3377668 - RNA, 13 nt, Human
cacccuccacccu

SEQ ID NO: 3377669 - RNA, 14 nt, Human
cacccuccaccucu

SEQ ID NO: 3377670 - RNA, 17 nt, Human
cacccuccaccuuccau

SEQ ID NO: 3377671 - RNA, 16 nt, Human
cacccuccagagacaa

SEQ ID NO: 3377672 - RNA, 16 nt, Human
cacccucccacccggc

SEQ ID NO: 3377673 - RNA, 14 nt, Human
cacccuccccuccc

SEQ ID NO: 3377674 - RNA, 13 nt, Human
cacccuccccucu

SEQ ID NO: 3377675 - RNA, 17 nt, Human
cacccuccccucucuug

SEQ ID NO: 3377676 - RNA, 23 nt, Human
cacccucccuccgauccuuccuc

SEQ ID NO: 3377677 - RNA, 16 nt, Human
cacccuccugucuucc

SEQ ID NO: 3377678 - RNA, 18 nt, Human
cacccuccugucuuccca

SEQ ID NO: 3377679 - RNA, 22 nt, Human
cacccuccugucuucccagggu

SEQ ID NO: 3377680 - RNA, 14 nt, Human
cacccuccuuccca

SEQ ID NO: 3377681 - RNA, 23 nt, Human
cacccuccuucccacucuucuca

SEQ ID NO: 3377682 - RNA, 12 nt, Human
cacccucugagc

SEQ ID NO: 3377683 - RNA, 12 nt, Human
cacccucuuccu

SEQ ID NO: 3377684 - RNA, 18 nt, Human
cacccugaaugguuccau

SEQ ID NO: 3377685 - RNA, 18 nt, Human
cacccugaggagucugag

SEQ ID NO: 3377686 - RNA, 12 nt, Human
cacccugagggc

SEQ ID NO: 3377687 - RNA, 13 nt, Human
cacccugcaaggc

SEQ ID NO: 3377688 - RNA, 14 nt, Human
cacccugcaaggcc

SEQ ID NO: 3377689 - RNA, 21 nt, Human
cacccugcaaggcccacagga

SEQ ID NO: 3377690 - RNA, 23 nt, Human
cacccugcaaggcccacaggagg

SEQ ID NO: 3377691 - RNA, 13 nt, Human
cacccugccugcc

SEQ ID NO: 3377692 - RNA, 19 nt, Human
cacccugccuuaucuugca

SEQ ID NO: 3377693 - RNA, 12 nt, Human
cacccugcucuc

SEQ ID NO: 3377694 - RNA, 17 nt, Human
cacccugcugcuggugc

SEQ ID NO: 3377695 - RNA, 20 nt, Human
cacccugcugcuggugcaca

SEQ ID NO: 3377696 - RNA, 11 nt, Human
cacccuggagg

SEQ ID NO: 3377697 - RNA, 21 nt, Human
cacccuggccgaguccaagcu

SEQ ID NO: 3377698 - RNA, 22 nt, Human
cacccuggccgaguccaagcug

SEQ ID NO: 3377699 - RNA, 17 nt, Human
cacccugggagacagac

SEQ ID NO: 3377700 - RNA, 12 nt, Human
cacccugggccc

SEQ ID NO: 3377701 - RNA, 23 nt, Human
cacccugggcccugggcuggaau

SEQ ID NO: 3377702 - RNA, 12 nt, Human
cacccugggcuc

SEQ ID NO: 3377703 - RNA, 15 nt, Human
cacccugggcucugu

SEQ ID NO: 3377704 - RNA, 15 nt, Human
cacccuggggagaaa

SEQ ID NO: 3377705 - RNA, 16 nt, Human
cacccuggggagaaag

SEQ ID NO: 3377706 - RNA, 14 nt, Human
cacccuggggccug

SEQ ID NO: 3377707 - RNA, 20 nt, Human
cacccuggggccuggaccug

SEQ ID NO: 3377708 - RNA, 15 nt, Human
cacccuggugggcca

SEQ ID NO: 3377709 - RNA, 16 nt, Human
cacccuggugggccaa

SEQ ID NO: 3377710 - RNA, 16 nt, Human
cacccuguacuguucu

SEQ ID NO: 3377711 - RNA, 15 nt, Human
cacccugucccccag

SEQ ID NO: 3377712 - RNA, 19 nt, Human
cacccugucccccagcucu

SEQ ID NO: 3377713 - RNA, 15 nt, Human
cacccugugaugggg

SEQ ID NO: 3377714 - RNA, 18 nt, Human
cacccuguggucuuccuc

SEQ ID NO: 3377715 - RNA, 17 nt, Human
cacccuguuccugcugc

SEQ ID NO: 3377716 - RNA, 18 nt, Human
cacccuguuuggauuuuu

SEQ ID NO: 3377717 - RNA, 19 nt, Human
cacccuucucccacucucc

SEQ ID NO: 3377718 - RNA, 23 nt, Human
cacccuucucccacucuccuagg

SEQ ID NO: 3377719 - RNA, 13 nt, Human
cacccuucuuucc

SEQ ID NO: 3377720 - RNA, 18 nt, Human
cacccuucuuuccucuuc

SEQ ID NO: 3377721 - RNA, 19 nt, Human
cacccuucuuuccucuucc

SEQ ID NO: 3377722 - RNA, 13 nt, Human
cacccuucuuuuc

SEQ ID NO: 3377723 - RNA, 15 nt, Human
cacccuucuuuucuc

SEQ ID NO: 3377724 - RNA, 19 nt, Human
cacccuucuuuucucaugu

SEQ ID NO: 3377725 - RNA, 20 nt, Human
cacccuuggagcucugaguu

SEQ ID NO: 3377726 - RNA, 22 nt, Human
cacccuuggaggcugucuucuc

SEQ ID NO: 3377727 - RNA, 12 nt, Human
cacccuuggccu

SEQ ID NO: 3377728 - RNA, 13 nt, Human
cacccuuggccug

SEQ ID NO: 3377729 - RNA, 18 nt, Human
cacccuuggccugucuca

SEQ ID NO: 3377730 - RNA, 21 nt, Human
cacccuuggccugucucaucc

SEQ ID NO: 3377731 - RNA, 19 nt, Human
cacccuuucuugacaaaac

SEQ ID NO: 3377732 - RNA, 22 nt, Human
cacccuuugcugugaggcuguc

SEQ ID NO: 3377733 - RNA, 21 nt, Human
cacccuuuuccagcuggauga

SEQ ID NO: 3377734 - RNA, 15 nt, Human
augggaaugaagcuu

SEQ ID NO: 3377735 - RNA, 20 nt, Human
augggacauuugcucaugga

SEQ ID NO: 3377736 - RNA, 13 nt, Human
augggacauuuuu

SEQ ID NO: 3377737 - RNA, 13 nt, Human
augggacugggag

SEQ ID NO: 3377738 - RNA, 16 nt, Human
augggacugggagggc

SEQ ID NO: 3377739 - RNA, 23 nt, Human
augggacuucuuuucacauucuu

SEQ ID NO: 3377740 - RNA, 19 nt, Human
augggagagaagagaaugc

SEQ ID NO: 3377741 - RNA, 15 nt, Human
augggagaguagaug

SEQ ID NO: 3377742 - RNA, 23 nt, Human
augggagagugucaaccagacag

SEQ ID NO: 3377743 - RNA, 20 nt, Human
augggagcaguccaugcaug

SEQ ID NO: 3377744 - RNA, 13 nt, Human
augggagcucaug

SEQ ID NO: 3377745 - RNA, 15 nt, Human
augggagcuccucuc

SEQ ID NO: 3377746 - RNA, 21 nt, Human
augggagcugucaagcaugua

SEQ ID NO: 3377747 - RNA, 18 nt, Human
augggaggaaagagagca

SEQ ID NO: 3377748 - RNA, 15 nt, Human
augggaggcuggagu

SEQ ID NO: 3377749 - RNA, 23 nt, Human
augggagggggcuugaagccaaa

SEQ ID NO: 3377750 - RNA, 16 nt, Human
augggagugagacaga

SEQ ID NO: 3377751 - RNA, 14 nt, Human
augggauaaaugcc

SEQ ID NO: 3377752 - RNA, 18 nt, Human
augggaugauugaagaaa

SEQ ID NO: 3377753 - RNA, 18 nt, Human
augggaugguggagggcc

SEQ ID NO: 3377754 - RNA, 21 nt, Human
augggauguaugaauacagca

SEQ ID NO: 3377755 - RNA, 14 nt, Human
augggauucuggac

SEQ ID NO: 3377756 - RNA, 17 nt, Human
augggcaaaacugaauu

SEQ ID NO: 3377757 - RNA, 19 nt, Human
augggcaacccccagccug

SEQ ID NO: 3377758 - RNA, 13 nt, Human
augggcagagcag

SEQ ID NO: 3377759 - RNA, 15 nt, Human
augggcagagcagag

SEQ ID NO: 3377760 - RNA, 14 nt, Human
augggcagagccca

SEQ ID NO: 3377761 - RNA, 13 nt, Human
augggcaggagac

SEQ ID NO: 3377762 - RNA, 13 nt, Human
augggcauggugu

SEQ ID NO: 3377763 - RNA, 13 nt, Human
augggccaccgcc

SEQ ID NO: 3377764 - RNA, 23 nt, Human
augggccacugaaaucugucaag

SEQ ID NO: 3377765 - RNA, 15 nt, Human
augggccagccccuc

SEQ ID NO: 3377766 - RNA, 18 nt, Human
augggccuccugugugug

SEQ ID NO: 3377767 - RNA, 12 nt, Human
augggccugagu

SEQ ID NO: 3377768 - RNA, 18 nt, Human
augggccugccgggcuga

SEQ ID NO: 3377769 - RNA, 20 nt, Human
augggccugccgggcugagg

SEQ ID NO: 3377770 - RNA, 22 nt, Human
augggccugccgggcugagggc

SEQ ID NO: 3377771 - RNA, 20 nt, Human
augggccuggccaccucucu

SEQ ID NO: 3377772 - RNA, 21 nt, Human
augggcgccccccccucccca

SEQ ID NO: 3377773 - RNA, 16 nt, Human
augggcuaaugaagau

SEQ ID NO: 3377774 - RNA, 20 nt, Human
augggcuucacuguauaaau

SEQ ID NO: 3377775 - RNA, 20 nt, Human
auggggaaaaaaaucaucua

SEQ ID NO: 3377776 - RNA, 23 nt, Human
auggggagaucggggccagaggc

SEQ ID NO: 3377777 - RNA, 14 nt, Human
auggggaggaggag

SEQ ID NO: 3377778 - RNA, 11 nt, Human
auggggagggg

SEQ ID NO: 3377779 - RNA, 22 nt, Human
auggggauaaaaugacuacuua

SEQ ID NO: 3377780 - RNA, 17 nt, Human
auggggaucacagagac

SEQ ID NO: 3377781 - RNA, 12 nt, Human
auggggaugcag

SEQ ID NO: 3377782 - RNA, 12 nt, Human
auggggccacag

SEQ ID NO: 3377783 - RNA, 15 nt, Human
auggggccagaucca

SEQ ID NO: 3377784 - RNA, 22 nt, Human
auggggccagauccagccuggg

SEQ ID NO: 3377785 - RNA, 20 nt, Human
auggggcccugccuccuuug

SEQ ID NO: 3377786 - RNA, 12 nt, Human
auggggccucug

SEQ ID NO: 3377787 - RNA, 19 nt, Human
auggggcugaacggggaga

SEQ ID NO: 3377788 - RNA, 22 nt, Human
auggggcugaacggggagaaaa

SEQ ID NO: 3377789 - RNA, 19 nt, Human
auggggcugacagcacuaa

SEQ ID NO: 3377790 - RNA, 24 nt, Human
auggggcugcaccggcuggccugg

SEQ ID NO: 3377791 - RNA, 21 nt, Human
augggggaaagcaaagcacag

SEQ ID NO: 3377792 - RNA, 22 nt, Human
augggggaaagcacaggugggc

SEQ ID NO: 3377793 - RNA, 18 nt, Human
augggggaacucagaucc

SEQ ID NO: 3377794 - RNA, 19 nt, Human
augggggaacucagaucca

SEQ ID NO: 3377795 - RNA, 19 nt, Human
augggggaggggggaagga

SEQ ID NO: 3377796 - RNA, 21 nt, Human
augggggagucugaagcagau

SEQ ID NO: 3377797 - RNA, 15 nt, Human
augggggcagggcug

SEQ ID NO: 3377798 - RNA, 15 nt, Human
augggggccuggauu

SEQ ID NO: 3377799 - RNA, 16 nt, Human
auggggguagcagcug

SEQ ID NO: 3377800 - RNA, 19 nt, Human
auggggguagcagcuggac

SEQ ID NO: 3377801 - RNA, 21 nt, Human
cacucugggcacacucugcca

SEQ ID NO: 3377802 - RNA, 14 nt, Human
cacucugggcucca

SEQ ID NO: 3377803 - RNA, 18 nt, Human
cacucuggucuuggaauu

SEQ ID NO: 3377804 - RNA, 17 nt, Human
cacucuguucauuccuc

SEQ ID NO: 3377805 - RNA, 18 nt, Human
cacucuguucauuccucc

SEQ ID NO: 3377806 - RNA, 22 nt, Human
cacucuguucauuccuccaggu

SEQ ID NO: 3377807 - RNA, 14 nt, Human
cacucuuaaagcaa

SEQ ID NO: 3377808 - RNA, 16 nt, Human
cacucuuaagcuuccg

SEQ ID NO: 3377809 - RNA, 22 nt, Human
cacucuuagcccaugcuguuuu

SEQ ID NO: 3377810 - RNA, 19 nt, Human
cacucuuaggcacuuuggg

SEQ ID NO: 3377811 - RNA, 19 nt, Human
cacucuuauugcccacgcu

SEQ ID NO: 3377812 - RNA, 21 nt, Human
cacucuuauugcccacgcugg

SEQ ID NO: 3377813 - RNA, 17 nt, Human
cacucuuccugcaagga

SEQ ID NO: 3377814 - RNA, 13 nt, Human
cacucuucucagc

SEQ ID NO: 3377815 - RNA, 22 nt, Human
cacucuuguggauguuuuaauu

SEQ ID NO: 3377816 - RNA, 17 nt, Human
cacucuuguucccacac

SEQ ID NO: 3377817 - RNA, 16 nt, Human
cacugaaaaaauauau

SEQ ID NO: 3377818 - RNA, 22 nt, Human
cacugaaaauaccaucaggccu

SEQ ID NO: 3377819 - RNA, 20 nt, Human
cacugaaaccuuuaagaaaa

SEQ ID NO: 3377820 - RNA, 20 nt, Human
cacugaaagcucuguugcaa

SEQ ID NO: 3377821 - RNA, 17 nt, Human
cacugaaaguuuuguaa

SEQ ID NO: 3377822 - RNA, 19 nt, Human
cacugaaaguuuuguaaaa

SEQ ID NO: 3377823 - RNA, 20 nt, Human
cacugaaaguuuuguaaaag

SEQ ID NO: 3377824 - RNA, 16 nt, Human
cacugaaauauacaca

SEQ ID NO: 3377825 - RNA, 20 nt, Human
cacugaaauauacacacagc

SEQ ID NO: 3377826 - RNA, 20 nt, Human
cacugaaccugggaaagaga

SEQ ID NO: 3377827 - RNA, 20 nt, Human
cacugaacuuugcugagccu

SEQ ID NO: 3377828 - RNA, 11 nt, Human
cacugaagacg

SEQ ID NO: 3377829 - RNA, 11 nt, Human
cacugaagagg

SEQ ID NO: 3377830 - RNA, 17 nt, Human
cacugaagcuuuuuagu

SEQ ID NO: 3377831 - RNA, 19 nt, Human
cacugaagggaaucacauc

SEQ ID NO: 3377832 - RNA, 15 nt, Human
cacugaaguuugaua

SEQ ID NO: 3377833 - RNA, 21 nt, Human
cacugaaguuugauaaauagu

SEQ ID NO: 3377834 - RNA, 22 nt, Human
cacugaaguuugauaaauagug

SEQ ID NO: 3377835 - RNA, 13 nt, Human
cacugaauauuua

SEQ ID NO: 3377836 - RNA, 14 nt, Human
cacugaauuuugga

SEQ ID NO: 3377837 - RNA, 17 nt, Human
cacugacaccuuugcag

SEQ ID NO: 3377838 - RNA, 21 nt, Human
cacugacaccuuugcaggcau

SEQ ID NO: 3377839 - RNA, 15 nt, Human
cacugacagccuccc

SEQ ID NO: 3377840 - RNA, 14 nt, Human
cacugaccagaacu

SEQ ID NO: 3377841 - RNA, 16 nt, Human
cacugaccauccacuc

SEQ ID NO: 3377842 - RNA, 22 nt, Human
cacugacccacagccucugccu

SEQ ID NO: 3377843 - RNA, 16 nt, Human
cacugacccuuccaga

SEQ ID NO: 3377844 - RNA, 18 nt, Human
cacugacccuuccagaca

SEQ ID NO: 3377845 - RNA, 21 nt, Human
cacugacccuuccagacauac

SEQ ID NO: 3377846 - RNA, 14 nt, Human
cacugacucuggaa

SEQ ID NO: 3377847 - RNA, 20 nt, Human
cacugacugggaccaggcac

SEQ ID NO: 3377848 - RNA, 15 nt, Human
cacugacuucuaagu

SEQ ID NO: 3377849 - RNA, 16 nt, Human
cacugacuucuaagua

SEQ ID NO: 3377850 - RNA, 20 nt, Human
cacugacuucuaaguaaaac

SEQ ID NO: 3377851 - RNA, 21 nt, Human
cacugacuucuaaguaaaacc

SEQ ID NO: 3377852 - RNA, 16 nt, Human
cacugagaauguaaga

SEQ ID NO: 3377853 - RNA, 14 nt, Human
cacugagacagccc

SEQ ID NO: 3377854 - RNA, 19 nt, Human
cacugagacagcccgggcu

SEQ ID NO: 3377855 - RNA, 23 nt, Human
cacugagaccccaggcuguuagg

SEQ ID NO: 3377856 - RNA, 17 nt, Human
cacugagagccuuuuug

SEQ ID NO: 3377857 - RNA, 21 nt, Human
cacugagaggacagagagaaa

SEQ ID NO: 3377858 - RNA, 23 nt, Human
cacugagauaccagcgaggaggc

SEQ ID NO: 3377859 - RNA, 13 nt, Human
cacugagcacugu

SEQ ID NO: 3377860 - RNA, 11 nt, Human
cacugagcccc

SEQ ID NO: 3377861 - RNA, 17 nt, Human
cacugagcuccaugugc

SEQ ID NO: 3377862 - RNA, 15 nt, Human
cacugagcugucaug

SEQ ID NO: 3377863 - RNA, 18 nt, Human
cacugaggcagggaaguc

SEQ ID NO: 3377864 - RNA, 19 nt, Human
cacugaggcagggaagucc

SEQ ID NO: 3377865 - RNA, 22 nt, Human
cacugaggccugagacccagga

SEQ ID NO: 3377866 - RNA, 13 nt, Human
cacugauauucag

SEQ ID NO: 3377867 - RNA, 19 nt, Human
cacugaugcugccccucau

SEQ ID NO: 3377868 - RNA, 24 nt, Human
cacugaugggcaacccccagccug

SEQ ID NO: 3377869 - RNA, 18 nt, Human
cacugauuucacaacaga

SEQ ID NO: 3377870 - RNA, 21 nt, Human
cacugauuugacauagucugg

SEQ ID NO: 3377871 - RNA, 22 nt, Human
cacugcaaaaccagguuuuguu

SEQ ID NO: 3377872 - RNA, 21 nt, Human
cacugcaaaccgccaccuccc

SEQ ID NO: 3377873 - RNA, 14 nt, Human
cacugcaaccucca

SEQ ID NO: 3377874 - RNA, 19 nt, Human
cacugcaaccuccaccucc

SEQ ID NO: 3377875 - RNA, 22 nt, Human
cacugcaaccuucgccaccugg

SEQ ID NO: 3377876 - RNA, 17 nt, Human
cacugcaacuucugccu

SEQ ID NO: 3377877 - RNA, 17 nt, Human
cacugcaagagccuugg

SEQ ID NO: 3377878 - RNA, 18 nt, Human
cacugcaagagccuuggu

SEQ ID NO: 3377879 - RNA, 20 nt, Human
cacugcaagagccuuggugu

SEQ ID NO: 3377880 - RNA, 22 nt, Human
cacugcaaguccuuuuguaaag

SEQ ID NO: 3377881 - RNA, 18 nt, Human
cacugcacacaccucaga

SEQ ID NO: 3377882 - RNA, 22 nt, Human
cacugcacacaccucagaggcu

SEQ ID NO: 3377883 - RNA, 22 nt, Human
cacugcacagagcucuccagcu

SEQ ID NO: 3377884 - RNA, 18 nt, Human
cacugcacagugcaucuc

SEQ ID NO: 3377885 - RNA, 15 nt, Human
cacugcacccccucc

SEQ ID NO: 3377886 - RNA, 20 nt, Human
cacugcacccccuccugcug

SEQ ID NO: 3377887 - RNA, 18 nt, Human
cacugcacuauagccuag

SEQ ID NO: 3377888 - RNA, 17 nt, Human
cacugcacuccagccug

SEQ ID NO: 3377889 - RNA, 13 nt, Human
cacugcacuccgg

SEQ ID NO: 3377890 - RNA, 13 nt, Human
cacugcacucuag

SEQ ID NO: 3377891 - RNA, 21 nt, Human
cacugcagaacagcuucaugu

SEQ ID NO: 3377892 - RNA, 13 nt, Human
cacugcagccuca

SEQ ID NO: 3377893 - RNA, 14 nt, Human
cacugcagccucaa

SEQ ID NO: 3377894 - RNA, 16 nt, Human
cacugcauaccaaccu

SEQ ID NO: 3377895 - RNA, 14 nt, Human
cacugcauccuccg

SEQ ID NO: 3377896 - RNA, 16 nt, Human
cacugcauccuccgcc

SEQ ID NO: 3377897 - RNA, 18 nt, Human
cacugcauuauucucuuu

SEQ ID NO: 3377898 - RNA, 18 nt, Human
cacugccacuuugcacau

SEQ ID NO: 3377899 - RNA, 20 nt, Human
cacugccacuuugcacauuu

SEQ ID NO: 3377900 - RNA, 19 nt, Human
cacugccagcagcagcagg

SEQ ID NO: 3377901 - RNA, 15 nt, Human
cacugccaggaggga

SEQ ID NO: 3377902 - RNA, 17 nt, Human
cacugccaggagggaca

SEQ ID NO: 3377903 - RNA, 12 nt, Human
cacugccaggcc

SEQ ID NO: 3377904 - RNA, 19 nt, Human
caccugcagccucccuccg

SEQ ID NO: 3377905 - RNA, 12 nt, Human
caccugcagcuc

SEQ ID NO: 3377906 - RNA, 16 nt, Human
caccugcaucuggggc

SEQ ID NO: 3377907 - RNA, 23 nt, Human
caccugccacccugggccuggca

SEQ ID NO: 3377908 - RNA, 21 nt, Human
caccugccacuaggcugggug

SEQ ID NO: 3377909 - RNA, 15 nt, Human
caccugccagccugg

SEQ ID NO: 3377910 - RNA, 16 nt, Human
caccugccagccuggc

SEQ ID NO: 3377911 - RNA, 17 nt, Human
caccugccagccuggcu

SEQ ID NO: 3377912 - RNA, 11 nt, Human
caccugccagg

SEQ ID NO: 3377913 - RNA, 12 nt, Human
caccugccaggg

SEQ ID NO: 3377914 - RNA, 13 nt, Human
caccugcccagau

SEQ ID NO: 3377915 - RNA, 15 nt, Human
caccugcccccuucu

SEQ ID NO: 3377916 - RNA, 14 nt, Human
caccugccccucaa

SEQ ID NO: 3377917 - RNA, 16 nt, Human
caccugccccucaacu

SEQ ID NO: 3377918 - RNA, 13 nt, Human
caccugcccuacc

SEQ ID NO: 3377919 - RNA, 20 nt, Human
caccugcccuaccugcccca

SEQ ID NO: 3377920 - RNA, 13 nt, Human
caccugcccugcc

SEQ ID NO: 3377921 - RNA, 16 nt, Human
caccugcccugcccug

SEQ ID NO: 3377922 - RNA, 19 nt, Human
caccugcccugcccugcca

SEQ ID NO: 3377923 - RNA, 22 nt, Human
caccugcccugcccugccaccu

SEQ ID NO: 3377924 - RNA, 22 nt, Human
caccugcccuuuuuucugccuc

SEQ ID NO: 3377925 - RNA, 21 nt, Human
caccugccgaccucguccucc

SEQ ID NO: 3377926 - RNA, 24 nt, Human
caccugccguggacuuggggucag

SEQ ID NO: 3377927 - RNA, 11 nt, Human
caccugccugc

SEQ ID NO: 3377928 - RNA, 14 nt, Human
caccugccugcguc

SEQ ID NO: 3377929 - RNA, 15 nt, Human
caccugccugcgucu

SEQ ID NO: 3377930 - RNA, 19 nt, Human
caccugccuggccggccag

SEQ ID NO: 3377931 - RNA, 22 nt, Human
caccugccuggccggccagcca

SEQ ID NO: 3377932 - RNA, 23 nt, Human
caccugccuguuaggagaagcug

SEQ ID NO: 3377933 - RNA, 19 nt, Human
caccugcucccaggccagu

SEQ ID NO: 3377934 - RNA, 22 nt, Human
caccugcugagagacccaagga

SEQ ID NO: 3377935 - RNA, 15 nt, Human
caccugcuggaguga

SEQ ID NO: 3377936 - RNA, 15 nt, Human
caccugcuggccccu

SEQ ID NO: 3377937 - RNA, 17 nt, Human
caccugcuggccccuca

SEQ ID NO: 3377938 - RNA, 18 nt, Human
caccugcuucucugccca

SEQ ID NO: 3377939 - RNA, 11 nt, Human
caccuggaccc

SEQ ID NO: 3377940 - RNA, 11 nt, Human
caccuggccac

SEQ ID NO: 3377941 - RNA, 19 nt, Human
caccuggccaccugaggug

SEQ ID NO: 3377942 - RNA, 20 nt, Human
caccuggccaccugaggugg

SEQ ID NO: 3377943 - RNA, 13 nt, Human
caccuggcccugc

SEQ ID NO: 3377944 - RNA, 15 nt, Human
caccuggcccugcuu

SEQ ID NO: 3377945 - RNA, 11 nt, Human
cagaaagaguu

SEQ ID NO: 3377946 - RNA, 22 nt, Human
cagaaagcaguugagacaagaa

SEQ ID NO: 3377947 - RNA, 22 nt, Human
cagaaagcaucccucacccauc

SEQ ID NO: 3377948 - RNA, 21 nt, Human
cagaaagccccacccaggcca

SEQ ID NO: 3377949 - RNA, 16 nt, Human
cagaaagccuaucaaa

SEQ ID NO: 3377950 - RNA, 22 nt, Human
cagaaagccugggugacauuug

SEQ ID NO: 3377951 - RNA, 18 nt, Human
cagaaagcugugaacagg

SEQ ID NO: 3377952 - RNA, 18 nt, Human
cagaaagcuuuauuuuga

SEQ ID NO: 3377953 - RNA, 19 nt, Human
cagaaaggaaaaacaaacu

SEQ ID NO: 3377954 - RNA, 20 nt, Human
cagaaaggacuccuccuuuu

SEQ ID NO: 3377955 - RNA, 16 nt, Human
cagaaaggauauuuaa

SEQ ID NO: 3377956 - RNA, 22 nt, Human
cagaaaggauauuuaagaaaau

SEQ ID NO: 3377957 - RNA, 22 nt, Human
cagaaagggagcagagaaggcc

SEQ ID NO: 3377958 - RNA, 16 nt, Human
cagaaagggagggcuc

SEQ ID NO: 3377959 - RNA, 17 nt, Human
cagaaagggagggcucu

SEQ ID NO: 3377960 - RNA, 17 nt, Human
cagaaagggcaacaaua

SEQ ID NO: 3377961 - RNA, 21 nt, Human
cagaaagguucugcccgggaa

SEQ ID NO: 3377962 - RNA, 20 nt, Human
cagaaagguuuucuucuuuu

SEQ ID NO: 3377963 - RNA, 17 nt, Human
cagaaagugccuuucag

SEQ ID NO: 3377964 - RNA, 18 nt, Human
cagaaaguggugcucagu

SEQ ID NO: 3377965 - RNA, 19 nt, Human
cagaaaguggugcucaguu

SEQ ID NO: 3377966 - RNA, 14 nt, Human
cagaaaguguaaau

SEQ ID NO: 3377967 - RNA, 22 nt, Human
cagaaagugugcuuuaugcuga

SEQ ID NO: 3377968 - RNA, 14 nt, Human
cagaaauacaauuu

SEQ ID NO: 3377969 - RNA, 21 nt, Human
cagaaauacagucuuccacaa

SEQ ID NO: 3377970 - RNA, 16 nt, Human
cagaaauacauauuuc

SEQ ID NO: 3377971 - RNA, 22 nt, Human
cagaaauaccaaaauuauuuca

SEQ ID NO: 3377972 - RNA, 13 nt, Human
cagaaauauauau

SEQ ID NO: 3377973 - RNA, 16 nt, Human
cagaaauauauauaca

SEQ ID NO: 3377974 - RNA, 21 nt, Human
cagaaauauuugugacaaaaa

SEQ ID NO: 3377975 - RNA, 20 nt, Human
cagaaaucaguaauauuuau

SEQ ID NO: 3377976 - RNA, 19 nt, Human
cagaaaucuagaagacugu

SEQ ID NO: 3377977 - RNA, 14 nt, Human
cagaaaucugagga

SEQ ID NO: 3377978 - RNA, 15 nt, Human
cagaaaucugaggaa

SEQ ID NO: 3377979 - RNA, 18 nt, Human
cagaaaugaggaggaugc

SEQ ID NO: 3377980 - RNA, 20 nt, Human
cagaaaugaggccauggacu

SEQ ID NO: 3377981 - RNA, 20 nt, Human
cagaaaugcugccugccugu

SEQ ID NO: 3377982 - RNA, 15 nt, Human
cagaaaugcugcugg

SEQ ID NO: 3377983 - RNA, 19 nt, Human
cagaaaugcugcuggccaa

SEQ ID NO: 3377984 - RNA, 15 nt, Human
cagaaauggaaagca

SEQ ID NO: 3377985 - RNA, 17 nt, Human
cagaaaugucccuuucu

SEQ ID NO: 3377986 - RNA, 21 nt, Human
cagaaaugucuaaaugcugaa

SEQ ID NO: 3377987 - RNA, 22 nt, Human
cagaaauguugagucuguacua

SEQ ID NO: 3377988 - RNA, 22 nt, Human
cagaaauucuguuuuuaaaaau

SEQ ID NO: 3377989 - RNA, 20 nt, Human
cagaaauugguaccuugcac

SEQ ID NO: 3377990 - RNA, 23 nt, Human
cagaaauugguaccuugcacaca

SEQ ID NO: 3377991 - RNA, 15 nt, Human
cagaaauuguauauu

SEQ ID NO: 3377992 - RNA, 15 nt, Human
cagaaauuuuuauuu

SEQ ID NO: 3377993 - RNA, 13 nt, Human
cagaacacuaacc

SEQ ID NO: 3377994 - RNA, 21 nt, Human
cagaacacuaaccugaccgug

SEQ ID NO: 3377995 - RNA, 21 nt, Human
cagaacagcagagguucuuuu

SEQ ID NO: 3377996 - RNA, 12 nt, Human
cagaacagccgc

SEQ ID NO: 3377997 - RNA, 20 nt, Human
cagaacagccgcuccugucu

SEQ ID NO: 3377998 - RNA, 17 nt, Human
cagaacagcuucagguu

SEQ ID NO: 3377999 - RNA, 18 nt, Human
cagaacaucauuagaaca

SEQ ID NO: 3378000 - RNA, 17 nt, Human
cagaaccaauuauuuuc

SEQ ID NO: 3378001 - RNA, 20 nt, Human
cagaaccaauuauuuucauc

SEQ ID NO: 3378002 - RNA, 21 nt, Human
cagaaccacacuugaaaccuu

SEQ ID NO: 3378003 - RNA, 20 nt, Human
cagaaccacagggcuauuuu

SEQ ID NO: 3378004 - RNA, 13 nt, Human
cagaacccagggc

SEQ ID NO: 3378005 - RNA, 23 nt, Human
cagaaccccuggcuccaggccag

SEQ ID NO: 3378006 - RNA, 18 nt, Human
cagaacccugccauggaa

SEQ ID NO: 3378007 - RNA, 15 nt, Human
cagaaccucuucccc

SEQ ID NO: 3378008 - RNA, 21 nt, Human
cagaaccuuguuauuucucag

SEQ ID NO: 3378009 - RNA, 18 nt, Human
cagaacguggcucugcug

SEQ ID NO: 3378010 - RNA, 17 nt, Human
cagaacuaaacucauuu

SEQ ID NO: 3378011 - RNA, 14 nt, Human
cagaacuaaauguu

SEQ ID NO: 3378012 - RNA, 19 nt, Human
cagaacuaccaccugacau

SEQ ID NO: 3378013 - RNA, 13 nt, Human
cagaacuacuucu

SEQ ID NO: 3378014 - RNA, 13 nt, Human
cagaacuagaauu

SEQ ID NO: 3378015 - RNA, 15 nt, Human
cagaacuagaauuug

SEQ ID NO: 3378016 - RNA, 17 nt, Human
cagaacucugccugccc

SEQ ID NO: 3378017 - RNA, 18 nt, Human
cagaacucugccugcccu

SEQ ID NO: 3378018 - RNA, 22 nt, Human
cagaacucugccugcccuuugu

SEQ ID NO: 3378019 - RNA, 13 nt, Human
cagaacucuuccu

SEQ ID NO: 3378020 - RNA, 16 nt, Human
cagaacucuuccucca

SEQ ID NO: 3378021 - RNA, 15 nt, Human
cagaacugagcuccu

SEQ ID NO: 3378022 - RNA, 23 nt, Human
cagaacugagcuccucugggcag

SEQ ID NO: 3378023 - RNA, 19 nt, Human
cagaacugcagucacugca

SEQ ID NO: 3378024 - RNA, 11 nt, Human
cagaacugcca

SEQ ID NO: 3378025 - RNA, 14 nt, Human
cagaacugccauua

SEQ ID NO: 3378026 - RNA, 22 nt, Human
cagaacugccauuauuuucugu

SEQ ID NO: 3378027 - RNA, 18 nt, Human
cagaacuggacucaggau

SEQ ID NO: 3378028 - RNA, 17 nt, Human
cagaacugugccacaau

SEQ ID NO: 3378029 - RNA, 17 nt, Human
cagaacuucagaaagac

SEQ ID NO: 3378030 - RNA, 20 nt, Human
cagaacuucagaaagacuug

SEQ ID NO: 3378031 - RNA, 20 nt, Human
cagaacuugaagccugcucc

SEQ ID NO: 3378032 - RNA, 21 nt, Human
cagaacuugacccugagcuga

SEQ ID NO: 3378033 - RNA, 14 nt, Human
cagaacuugcugcu

SEQ ID NO: 3378034 - RNA, 20 nt, Human
cagaacuugcugcugucuug

SEQ ID NO: 3378035 - RNA, 15 nt, Human
cagaagaaaggaaca

SEQ ID NO: 3378036 - RNA, 15 nt, Human
cagaagaacccuggc

SEQ ID NO: 3378037 - RNA, 20 nt, Human
cagaagaagagaagcugcug

SEQ ID NO: 3378038 - RNA, 14 nt, Human
cagaagaauauuca

SEQ ID NO: 3378039 - RNA, 17 nt, Human
cagaagaauauucagga

SEQ ID NO: 3378040 - RNA, 20 nt, Human
cagaagaauauucaggacuu

SEQ ID NO: 3378041 - RNA, 20 nt, Human
cagaagaauugaacccagga

SEQ ID NO: 3378042 - RNA, 14 nt, Human
cagaagacaccaga

SEQ ID NO: 3378043 - RNA, 16 nt, Human
cagaagacaccagagc

SEQ ID NO: 3378044 - RNA, 18 nt, Human
cagaagacaccagagcag

SEQ ID NO: 3378045 - RNA, 20 nt, Human
cagaagacaccagagcagau

SEQ ID NO: 3378046 - RNA, 16 nt, Human
cagaagagaggggaag

SEQ ID NO: 3378047 - RNA, 20 nt, Human
cagaagagaugggcuuguuu

SEQ ID NO: 3378048 - RNA, 21 nt, Human
cagaagagaugggcuuguuuu

SEQ ID NO: 3378049 - RNA, 15 nt, Human
cagaagauaacuuga

SEQ ID NO: 3378050 - RNA, 20 nt, Human
cagaagauagcuucacccca

SEQ ID NO: 3378051 - RNA, 13 nt, Human
cagaagcagcucu

SEQ ID NO: 3378052 - RNA, 16 nt, Human
cagaagcaggcuggag

SEQ ID NO: 3378053 - RNA, 23 nt, Human
cagaagcaguugagucgucauca

SEQ ID NO: 3378054 - RNA, 14 nt, Human
cagaagcauuugua

SEQ ID NO: 3378055 - RNA, 17 nt, Human
cagaagcauuuguauuu

SEQ ID NO: 3378056 - RNA, 20 nt, Human
cagaagcauuuguauuuugu

SEQ ID NO: 3378057 - RNA, 18 nt, Human
cagaagccacccaaagca

SEQ ID NO: 3378058 - RNA, 19 nt, Human
cagaagccacccaaagcag

SEQ ID NO: 3378059 - RNA, 17 nt, Human
cagaagccuauuguaaa

SEQ ID NO: 3378060 - RNA, 20 nt, Human
cagaagccucacugcaagca

SEQ ID NO: 3378061 - RNA, 19 nt, Human
cagaagccucuggcuagag

SEQ ID NO: 3378062 - RNA, 13 nt, Human
cagaagccugggg

SEQ ID NO: 3378063 - RNA, 18 nt, Human
cagaagcucccccagcaa

SEQ ID NO: 3378064 - RNA, 21 nt, Human
cagaagcucccccagcaaagc

SEQ ID NO: 3378065 - RNA, 20 nt, Human
cagaagcucuuacucuuucc

SEQ ID NO: 3378066 - RNA, 21 nt, Human
cagaagcucuuacucuuuccu

SEQ ID NO: 3378067 - RNA, 21 nt, Human
cagaagcugagcaccagggga

SEQ ID NO: 3378068 - RNA, 19 nt, Human
cagaaggaagacuucaucc

SEQ ID NO: 3378069 - RNA, 22 nt, Human
cagaaggaaggcagggaggagg

SEQ ID NO: 3378070 - RNA, 20 nt, Human
cagaaggagaaggaaggaga

SEQ ID NO: 3378071 - RNA, 13 nt, Human
cagaaggagacag

SEQ ID NO: 3378072 - RNA, 18 nt, Human
cagaaggauuuuuuaaag

SEQ ID NO: 3378073 - RNA, 20 nt, Human
cagaaggcaaaugacuuugg

SEQ ID NO: 3378074 - RNA, 14 nt, Human
cagaaggccaagag

SEQ ID NO: 3378075 - RNA, 15 nt, Human
cagaagggagaagga

SEQ ID NO: 3378076 - RNA, 19 nt, Human
cagaagggagcuagccaga

SEQ ID NO: 3378077 - RNA, 19 nt, Human
cagaagggagcuggcucca

SEQ ID NO: 3378078 - RNA, 12 nt, Human
cagaagggaggc

SEQ ID NO: 3378079 - RNA, 16 nt, Human
cagaagggagggcaga

SEQ ID NO: 3378080 - RNA, 17 nt, Human
cagaagggagggcagag

SEQ ID NO: 3378081 - RNA, 23 nt, Human
cagaagggagggcagagcuggug

SEQ ID NO: 3378082 - RNA, 15 nt, Human
cagaaggggacugcc

SEQ ID NO: 3378083 - RNA, 19 nt, Human
cagaaggggacugccaccu

SEQ ID NO: 3378084 - RNA, 20 nt, Human
cagaaggggacugccaccuc

SEQ ID NO: 3378085 - RNA, 20 nt, Human
cagaaggggaggggagacag

SEQ ID NO: 3378086 - RNA, 14 nt, Human
cagaagggggccau

SEQ ID NO: 3378087 - RNA, 18 nt, Human
cagaagggggccaugagg

SEQ ID NO: 3378088 - RNA, 15 nt, Human
cagacagcaggcagc

SEQ ID NO: 3378089 - RNA, 12 nt, Human
cagacagccugu

SEQ ID NO: 3378090 - RNA, 16 nt, Human
cagacagccuguaucu

SEQ ID NO: 3378091 - RNA, 19 nt, Human
cagacagcucccucugccu

SEQ ID NO: 3378092 - RNA, 15 nt, Human
cagacagcugccugg

SEQ ID NO: 3378093 - RNA, 16 nt, Human
cagacagcugccuggg

SEQ ID NO: 3378094 - RNA, 17 nt, Human
cagacagcugccuggga

SEQ ID NO: 3378095 - RNA, 15 nt, Human
cagacaggaccaggg

SEQ ID NO: 3378096 - RNA, 16 nt, Human
cagacaggaccaggga

SEQ ID NO: 3378097 - RNA, 24 nt, Human
cagacaggaccagggauuuccaug

SEQ ID NO: 3378098 - RNA, 13 nt, Human
cagacaggagaaa

SEQ ID NO: 3378099 - RNA, 13 nt, Human
cagacaggcaagc

SEQ ID NO: 3378100 - RNA, 20 nt, Human
cagacaggcaagcaccuccu

SEQ ID NO: 3378101 - RNA, 22 nt, Human
cagacaggcaagcaccuccugc

SEQ ID NO: 3378102 - RNA, 20 nt, Human
cagacaggcucuuagcagcu

SEQ ID NO: 3378103 - RNA, 17 nt, Human
cagacauaaaggaaaag

SEQ ID NO: 3378104 - RNA, 19 nt, Human
cagacauaaaggaaaagac

SEQ ID NO: 3378105 - RNA, 19 nt, Human
cagacauacuaaccagcag

SEQ ID NO: 3378106 - RNA, 19 nt, Human
cagacauagaauuaacaca

SEQ ID NO: 3378107 - RNA, 13 nt, Human
cagacauauuuaa

SEQ ID NO: 3378108 - RNA, 14 nt, Human
cagacauauuuaac

SEQ ID NO: 3378109 - RNA, 22 nt, Human
cagacauccaaacuaaaaggaa

SEQ ID NO: 3378110 - RNA, 23 nt, Human
cagacauccauguuuguaaaacu

SEQ ID NO: 3378111 - RNA, 17 nt, Human
cagacaucucugcaccc

SEQ ID NO: 3378112 - RNA, 20 nt, Human
cagacaucugagguuuuauu

SEQ ID NO: 3378113 - RNA, 18 nt, Human
cagacaugccacaaggac

SEQ ID NO: 3378114 - RNA, 18 nt, Human
cagacauguggugggaca

SEQ ID NO: 3378115 - RNA, 18 nt, Human
cagacauguuuuccguga

SEQ ID NO: 3378116 - RNA, 22 nt, Human
cagacauucuaauuauauuuua

SEQ ID NO: 3378117 - RNA, 21 nt, Human
cagacauucugccaggccccc

SEQ ID NO: 3378118 - RNA, 14 nt, Human
cagacauuggcacc

SEQ ID NO: 3378119 - RNA, 21 nt, Human
cagacauugucagcaaauuaa

SEQ ID NO: 3378120 - RNA, 11 nt, Human
cagacauuguu

SEQ ID NO: 3378121 - RNA, 22 nt, Human
cagacauuguuuugccaacauu

SEQ ID NO: 3378122 - RNA, 21 nt, Human
cagaccaacguuacucagggc

SEQ ID NO: 3378123 - RNA, 16 nt, Human
cagaccacaugcccca

SEQ ID NO: 3378124 - RNA, 14 nt, Human
cacugcaaccuucg

SEQ ID NO: 3378125 - RNA, 23 nt, Human
cacugcaaccuucgccaccuggg

SEQ ID NO: 3378126 - RNA, 13 nt, Human
cacugcaagagcc

SEQ ID NO: 3378127 - RNA, 16 nt, Human
cacugcaagagccuug

SEQ ID NO: 3378128 - RNA, 12 nt, Human
cacugcaagucc

SEQ ID NO: 3378129 - RNA, 19 nt, Human
cacugcaaguccuuuugua

SEQ ID NO: 3378130 - RNA, 20 nt, Human
cacugcaaguccuuuuguaa

SEQ ID NO: 3378131 - RNA, 21 nt, Human
cacugcaaguccuuuuguaaa

SEQ ID NO: 3378132 - RNA, 15 nt, Human
cacugcaauaucuuc

SEQ ID NO: 3378133 - RNA, 16 nt, Human
cacugcaauccugucu

SEQ ID NO: 3378134 - RNA, 22 nt, Human
cacugcacaauaacuccuccca

SEQ ID NO: 3378135 - RNA, 19 nt, Human
cacugcacacaccucagag

SEQ ID NO: 3378136 - RNA, 14 nt, Human
cacugcacagagcu

SEQ ID NO: 3378137 - RNA, 16 nt, Human
cacugcacagagcucu

SEQ ID NO: 3378138 - RNA, 18 nt, Human
cacugcacccccuccugc

SEQ ID NO: 3378139 - RNA, 17 nt, Human
cacugcacguuuucauc

SEQ ID NO: 3378140 - RNA, 17 nt, Human
cacugcacucaaccuua

SEQ ID NO: 3378141 - RNA, 12 nt, Human
cacugcacucca

SEQ ID NO: 3378142 - RNA, 20 nt, Human
cacugcacuccagccugggc

SEQ ID NO: 3378143 - RNA, 15 nt, Human
cacugcacuccaggc

SEQ ID NO: 3378144 - RNA, 21 nt, Human
cacugcagaagacaguauggc

SEQ ID NO: 3378145 - RNA, 12 nt, Human
cacugcagccuc

SEQ ID NO: 3378146 - RNA, 19 nt, Human
cacugcagccuccgcuucc

SEQ ID NO: 3378147 - RNA, 22 nt, Human
cacugcagccuccgcuucccug

SEQ ID NO: 3378148 - RNA, 13 nt, Human
cacugcagccucg

SEQ ID NO: 3378149 - RNA, 20 nt, Human
cacugcaggcaucacagcua

SEQ ID NO: 3378150 - RNA, 13 nt, Human
cacugcaggcccc

SEQ ID NO: 3378151 - RNA, 22 nt, Human
cacugcaugagcuuuuauacua

SEQ ID NO: 3378152 - RNA, 16 nt, Human
cacugcauguuuguga

SEQ ID NO: 3378153 - RNA, 19 nt, Human
cacugcauuauucucuuuu

SEQ ID NO: 3378154 - RNA, 20 nt, Human
cacugccacacucuccauca

SEQ ID NO: 3378155 - RNA, 22 nt, Human
cacugccacuuugcacauuuug

SEQ ID NO: 3378156 - RNA, 19 nt, Human
cacugccagagauaaacua

SEQ ID NO: 3378157 - RNA, 21 nt, Human
cacugccagcagcagcaggug

SEQ ID NO: 3378158 - RNA, 12 nt, Human
cacugccaggag

SEQ ID NO: 3378159 - RNA, 13 nt, Human
cacugccaggagg

SEQ ID NO: 3378160 - RNA, 13 nt, Human
cacugccaggcca

SEQ ID NO: 3378161 - RNA, 20 nt, Human
cacugccaggccagccuccg

SEQ ID NO: 3378162 - RNA, 20 nt, Human
cacugccaucaaacuguaaa

SEQ ID NO: 3378163 - RNA, 21 nt, Human
cacugcccaaagugcuuccaa

SEQ ID NO: 3378164 - RNA, 15 nt, Human
cacugcccacccccu

SEQ ID NO: 3378165 - RNA, 17 nt, Human
cacugcccacccccuca

SEQ ID NO: 3378166 - RNA, 18 nt, Human
cacugcccacccccucaa

SEQ ID NO: 3378167 - RNA, 19 nt, Human
cacugcccccugcugccau

SEQ ID NO: 3378168 - RNA, 21 nt, Human
cacugcccgagcuggugcauu

SEQ ID NO: 3378169 - RNA, 18 nt, Human
cacugcccucgcacggcc

SEQ ID NO: 3378170 - RNA, 12 nt, Human
cacugcccucug

SEQ ID NO: 3378171 - RNA, 15 nt, Human
cacugccuacugcau

SEQ ID NO: 3378172 - RNA, 16 nt, Human
cacugccuacugcauc

SEQ ID NO: 3378173 - RNA, 21 nt, Human
cacugccucgggaaccucacu

SEQ ID NO: 3378174 - RNA, 22 nt, Human
cacugccucgggaaccucacuc

SEQ ID NO: 3378175 - RNA, 15 nt, Human
cacugccucucacag

SEQ ID NO: 3378176 - RNA, 17 nt, Human
cacugccucucacagcu

SEQ ID NO: 3378177 - RNA, 13 nt, Human
cacugccucuccc

SEQ ID NO: 3378178 - RNA, 14 nt, Human
cacugccucucccu

SEQ ID NO: 3378179 - RNA, 19 nt, Human
cacugccucucccuggccc

SEQ ID NO: 3378180 - RNA, 15 nt, Human
cacugccucuggaau

SEQ ID NO: 3378181 - RNA, 19 nt, Human
cacugccucuuccucccuc

SEQ ID NO: 3378182 - RNA, 14 nt, Human
cacugccugccuua

SEQ ID NO: 3378183 - RNA, 21 nt, Human
cacugccugcucccauccugu

SEQ ID NO: 3378184 - RNA, 15 nt, Human
cacugccugggcuga

SEQ ID NO: 3378185 - RNA, 13 nt, Human
cacugccuguaua

SEQ ID NO: 3378186 - RNA, 15 nt, Human
cacugccuguauacu

SEQ ID NO: 3378187 - RNA, 17 nt, Human
cacugccuguauacuuu

SEQ ID NO: 3378188 - RNA, 18 nt, Human
cacugccuucgcuucuug

SEQ ID NO: 3378189 - RNA, 19 nt, Human
cacugccuucgcuucuugc

SEQ ID NO: 3378190 - RNA, 21 nt, Human
cacugccuucgcuucuugccu

SEQ ID NO: 3378191 - RNA, 20 nt, Human
cacugccuucucaacuccaa

SEQ ID NO: 3378192 - RNA, 19 nt, Human
cacugccuuuuuauuuaua

SEQ ID NO: 3378193 - RNA, 20 nt, Human
cacugcggagaaccuugugc

SEQ ID NO: 3378194 - RNA, 21 nt, Human
cacugcggagaaccuugugcc

SEQ ID NO: 3378195 - RNA, 22 nt, Human
cacugcggagaaccuugugccu

SEQ ID NO: 3378196 - RNA, 16 nt, Human
cacugcuaggugggcc

SEQ ID NO: 3378197 - RNA, 22 nt, Human
cacugcuaggugggccagcccc

SEQ ID NO: 3378198 - RNA, 23 nt, Human
cacugcuaggugggccagccccu

SEQ ID NO: 3378199 - RNA, 12 nt, Human
cacugcucccua

SEQ ID NO: 3378200 - RNA, 17 nt, Human
cacugcucccugaagcc

SEQ ID NO: 3378201 - RNA, 23 nt, Human
cacugcucccugaagccagccuu

SEQ ID NO: 3378202 - RNA, 12 nt, Human
cacugcuccugu

SEQ ID NO: 3378203 - RNA, 19 nt, Human
cacugcucuaacagcccuc

SEQ ID NO: 3378204 - RNA, 14 nt, Human
cacugcucucaccu

SEQ ID NO: 3378205 - RNA, 23 nt, Human
cacugcucuccagccugggaggc

SEQ ID NO: 3378206 - RNA, 20 nt, Human
cacugcucugaugaagagga

SEQ ID NO: 3378207 - RNA, 17 nt, Human
cacugcugcaaggccuu

SEQ ID NO: 3378208 - RNA, 22 nt, Human
cacugcugcaaggccuuucugu

SEQ ID NO: 3378209 - RNA, 13 nt, Human
cacugcugcagua

SEQ ID NO: 3378210 - RNA, 17 nt, Human
cacugcugcccagccuc

SEQ ID NO: 3378211 - RNA, 16 nt, Human
cacugcugcugccuuu

SEQ ID NO: 3378212 - RNA, 15 nt, Human
cacugcuggcugccu

SEQ ID NO: 3378213 - RNA, 19 nt, Human
cacugcuggguggcccauc

SEQ ID NO: 3378214 - RNA, 10 nt, Human
cacugcuguc

SEQ ID NO: 3378215 - RNA, 11 nt, Human
cacugcuguca

SEQ ID NO: 3378216 - RNA, 21 nt, Human
cacugcugugcugugcccaag

SEQ ID NO: 3378217 - RNA, 16 nt, Human
cacugcuuccagugag

SEQ ID NO: 3378218 - RNA, 18 nt, Human
cacugcuuccagugaggc

SEQ ID NO: 3378219 - RNA, 17 nt, Human
cacugcuugaacuaggc

SEQ ID NO: 3378220 - RNA, 20 nt, Human
cacugcuugaggaaaacaag

SEQ ID NO: 3378221 - RNA, 23 nt, Human
cacugcuugaugaagcaaggaag

SEQ ID NO: 3378222 - RNA, 13 nt, Human
cacugcuuuuccc

SEQ ID NO: 3378223 - RNA, 20 nt, Human
cacugcuuuuggucugugug

SEQ ID NO: 3378224 - RNA, 23 nt, Human
cacugcuuuuggucugugugaug

SEQ ID NO: 3378225 - RNA, 24 nt, Human
cacuggaaaggggagagccugcug

SEQ ID NO: 3378226 - RNA, 15 nt, Human
cacuggacucaccuc

SEQ ID NO: 3378227 - RNA, 16 nt, Human
cacuggagcaccaggc

SEQ ID NO: 3378228 - RNA, 21 nt, Human
cacuggagcaccaggcacgaa

SEQ ID NO: 3378229 - RNA, 23 nt, Human
cacuggagcagaaggggagaugg

SEQ ID NO: 3378230 - RNA, 13 nt, Human
cacuggagcccag

SEQ ID NO: 3378231 - RNA, 18 nt, Human
cacuggaggagagaagaa

SEQ ID NO: 3378232 - RNA, 13 nt, Human
auacggugggggu

SEQ ID NO: 3378233 - RNA, 14 nt, Human
auacguccaccaug

SEQ ID NO: 3378234 - RNA, 19 nt, Human
auacgugggcauucaaaug

SEQ ID NO: 3378235 - RNA, 13 nt, Human
auacguguagcua

SEQ ID NO: 3378236 - RNA, 18 nt, Human
auacgugucaaugugugc

SEQ ID NO: 3378237 - RNA, 21 nt, Human
auacguuucaaaaacaccccc

SEQ ID NO: 3378238 - RNA, 17 nt, Human
auacuaaaaagaagugc

SEQ ID NO: 3378239 - RNA, 12 nt, Human
auacuaaaauau

SEQ ID NO: 3378240 - RNA, 13 nt, Human
auacuaaaauaug

SEQ ID NO: 3378241 - RNA, 15 nt, Human
auacuacaucuuuaa

SEQ ID NO: 3378242 - RNA, 15 nt, Human
auacuaccuugaaaa

SEQ ID NO: 3378243 - RNA, 18 nt, Human
auacuacugaaacagauu

SEQ ID NO: 3378244 - RNA, 18 nt, Human
auacuagccagagcuccu

SEQ ID NO: 3378245 - RNA, 14 nt, Human
auacuaguugugac

SEQ ID NO: 3378246 - RNA, 14 nt, Human
auacuauaguacca

SEQ ID NO: 3378247 - RNA, 16 nt, Human
auacuaugaaauaugu

SEQ ID NO: 3378248 - RNA, 19 nt, Human
auacuauguggaugugaca

SEQ ID NO: 3378249 - RNA, 18 nt, Human
auacuauuaaacaugcug

SEQ ID NO: 3378250 - RNA, 21 nt, Human
auacuauuuaaagccuccuca

SEQ ID NO: 3378251 - RNA, 18 nt, Human
auacuauuuaagauguga

SEQ ID NO: 3378252 - RNA, 19 nt, Human
auacuauuuaagaugugaa

SEQ ID NO: 3378253 - RNA, 23 nt, Human
auacuauuuaguuuuuguaauuu

SEQ ID NO: 3378254 - RNA, 13 nt, Human
auacucagccugc

SEQ ID NO: 3378255 - RNA, 16 nt, Human
auacucagccugcugc

SEQ ID NO: 3378256 - RNA, 15 nt, Human
auacucauaauguga

SEQ ID NO: 3378257 - RNA, 18 nt, Human
auacucauccuuguauaa

SEQ ID NO: 3378258 - RNA, 12 nt, Human
auacucaugugu

SEQ ID NO: 3378259 - RNA, 13 nt, Human
auacucaugugua

SEQ ID NO: 3378260 - RNA, 15 nt, Human
auacucauguguaug

SEQ ID NO: 3378261 - RNA, 23 nt, Human
auacucauuagaauuaccauuug

SEQ ID NO: 3378262 - RNA, 16 nt, Human
auacucauuaggaugg

SEQ ID NO: 3378263 - RNA, 16 nt, Human
auacucauuucuaaaa

SEQ ID NO: 3378264 - RNA, 21 nt, Human
auacucauuucuaaaagaaua

SEQ ID NO: 3378265 - RNA, 17 nt, Human
auacucauuuuucauga

SEQ ID NO: 3378266 - RNA, 15 nt, Human
auacucuaauucuaa

SEQ ID NO: 3378267 - RNA, 20 nt, Human
auacucuagauuuuguuuug

SEQ ID NO: 3378268 - RNA, 13 nt, Human
auacucugucaga

SEQ ID NO: 3378269 - RNA, 14 nt, Human
auacucugucuccc

SEQ ID NO: 3378270 - RNA, 16 nt, Human
auacucuguuguacua

SEQ ID NO: 3378271 - RNA, 14 nt, Human
auacucuuucugua

SEQ ID NO: 3378272 - RNA, 17 nt, Human
auacucuuucuguauau

SEQ ID NO: 3378273 - RNA, 19 nt, Human
auacugaaccacuuguaga

SEQ ID NO: 3378274 - RNA, 15 nt, Human
auacugaaggaaaaa

SEQ ID NO: 3378275 - RNA, 19 nt, Human
auacugacugagaauauaa

SEQ ID NO: 3378276 - RNA, 14 nt, Human
auacugauggaauu

SEQ ID NO: 3378277 - RNA, 21 nt, Human
auacugcaaacuauuuaaaga

SEQ ID NO: 3378278 - RNA, 16 nt, Human
auacugcaagaaaaug

SEQ ID NO: 3378279 - RNA, 15 nt, Human
auuucaaaaugcuuu

SEQ ID NO: 3378280 - RNA, 16 nt, Human
auuucaaaaugcuuuu

SEQ ID NO: 3378281 - RNA, 23 nt, Human
auuucaaacagucucccuuccua

SEQ ID NO: 3378282 - RNA, 16 nt, Human
auuucaaacggccuca

SEQ ID NO: 3378283 - RNA, 18 nt, Human
auuucaaaguuuuguugu

SEQ ID NO: 3378284 - RNA, 13 nt, Human
auuucaagaaaaa

SEQ ID NO: 3378285 - RNA, 23 nt, Human
auuucaagaaguccccucuccuc

SEQ ID NO: 3378286 - RNA, 15 nt, Human
auuucaagguucuaa

SEQ ID NO: 3378287 - RNA, 13 nt, Human
auuucaauguaau

SEQ ID NO: 3378288 - RNA, 15 nt, Human
auuucaauguguaua

SEQ ID NO: 3378289 - RNA, 14 nt, Human
auuucaauucucaa

SEQ ID NO: 3378290 - RNA, 15 nt, Human
auuucaauucucaaa

SEQ ID NO: 3378291 - RNA, 13 nt, Human
auuucacaacaga

SEQ ID NO: 3378292 - RNA, 19 nt, Human
auuucacaacagccugaca

SEQ ID NO: 3378293 - RNA, 19 nt, Human
auuucacacgcuguucuaa

SEQ ID NO: 3378294 - RNA, 22 nt, Human
auuucacauuaauauuugcuga

SEQ ID NO: 3378295 - RNA, 23 nt, Human
auuucaccccaucccuccuuaag

SEQ ID NO: 3378296 - RNA, 20 nt, Human
auuucaccccucccuuucuc

SEQ ID NO: 3378297 - RNA, 16 nt, Human
auuucaccuguaaacc

SEQ ID NO: 3378298 - RNA, 19 nt, Human
auuucaccuguaaaccuga

SEQ ID NO: 3378299 - RNA, 19 nt, Human
auuucacgucauaggaagu

SEQ ID NO: 3378300 - RNA, 12 nt, Human
auuucacucucc

SEQ ID NO: 3378301 - RNA, 12 nt, Human
auuucacuggag

SEQ ID NO: 3378302 - RNA, 17 nt, Human
auuucacuggagcacaa

SEQ ID NO: 3378303 - RNA, 19 nt, Human
auuucacuggagcacaaua

SEQ ID NO: 3378304 - RNA, 13 nt, Human
auuucacugucuu

SEQ ID NO: 3378305 - RNA, 12 nt, Human
auuucacuugau

SEQ ID NO: 3378306 - RNA, 12 nt, Human
auuucacuuguc

SEQ ID NO: 3378307 - RNA, 15 nt, Human
auuucacuuuagaug

SEQ ID NO: 3378308 - RNA, 13 nt, Human
auuucagaaauac

SEQ ID NO: 3378309 - RNA, 12 nt, Human
auuucagaaguu

SEQ ID NO: 3378310 - RNA, 15 nt, Human
auuucagaaguuuaa

SEQ ID NO: 3378311 - RNA, 22 nt, Human
auuucagagaggccuuuuggaa

SEQ ID NO: 3378312 - RNA, 16 nt, Human
auuucagaugcuuuag

SEQ ID NO: 3378313 - RNA, 17 nt, Human
auuucagauguaauguu

SEQ ID NO: 3378314 - RNA, 19 nt, Human
auuucagauguaauguuuu

SEQ ID NO: 3378315 - RNA, 20 nt, Human
auuucagauguaauguuuuc

SEQ ID NO: 3378316 - RNA, 17 nt, Human
auuucagauuuugauaa

SEQ ID NO: 3378317 - RNA, 22 nt, Human
auuucagauuuugauaacuguu

SEQ ID NO: 3378318 - RNA, 15 nt, Human
auuucaggagcagcc

SEQ ID NO: 3378319 - RNA, 22 nt, Human
auuucaggaggaauacugaaca

SEQ ID NO: 3378320 - RNA, 15 nt, Human
auuucaggagggauu

SEQ ID NO: 3378321 - RNA, 19 nt, Human
auuucaggauacucuguca

SEQ ID NO: 3378322 - RNA, 19 nt, Human
auuucaggcauuggauauu

SEQ ID NO: 3378323 - RNA, 17 nt, Human
auuucaggcuccccaga

SEQ ID NO: 3378324 - RNA, 12 nt, Human
auuucagggugc

SEQ ID NO: 3378325 - RNA, 19 nt, Human
auuucaguaaaccugucug

SEQ ID NO: 3378326 - RNA, 21 nt, Human
auuucaguaagaucaagcucc

SEQ ID NO: 3378327 - RNA, 18 nt, Human
auuucaguacuucagcaa

SEQ ID NO: 3378328 - RNA, 22 nt, Human
auuucaguacuucagcaagaga

SEQ ID NO: 3378329 - RNA, 19 nt, Human
auuucaguguaaagugugu

SEQ ID NO: 3378330 - RNA, 20 nt, Human
auuucaguguaguuaauuua

SEQ ID NO: 3378331 - RNA, 16 nt, Human
auuucauaauuuguuu

SEQ ID NO: 3378332 - RNA, 21 nt, Human
auuucauaccucagaauguaa

SEQ ID NO: 3378333 - RNA, 13 nt, Human
auuucauaguuca

SEQ ID NO: 3378334 - RNA, 18 nt, Human
auuucaucauuguuucug

SEQ ID NO: 3378335 - RNA, 22 nt, Human
auuucauccuuucacuucuuuc

SEQ ID NO: 3378336 - RNA, 14 nt, Human
auuucaucuauuuc

SEQ ID NO: 3378337 - RNA, 19 nt, Human
auuucaucuauuucugaga

SEQ ID NO: 3378338 - RNA, 14 nt, Human
auuucaucuauuuu

SEQ ID NO: 3378339 - RNA, 22 nt, Human
auuucaucucauuuaagggaaa

SEQ ID NO: 3378340 - RNA, 23 nt, Human
auuucaucucauuuaagggaaaa

SEQ ID NO: 3378341 - RNA, 14 nt, Human
auuucaucugcucu

SEQ ID NO: 3378342 - RNA, 15 nt, Human
auuucaucugcucuc

SEQ ID NO: 3378343 - RNA, 18 nt, Human
auuucaucugcucuccuu

SEQ ID NO: 3378344 - RNA, 15 nt, Human
auuucaugauuagaa

SEQ ID NO: 3378345 - RNA, 18 nt, Human
auuucaugcuaucucugu

SEQ ID NO: 3378346 - RNA, 20 nt, Human
auuucauguaaaacagaaaa

SEQ ID NO: 3378347 - RNA, 18 nt, Human
auuucauguccuguguca

SEQ ID NO: 3378348 - RNA, 13 nt, Human
auuucauuccauu

SEQ ID NO: 3378349 - RNA, 19 nt, Human
auuucauugguuaauuuuu

SEQ ID NO: 3378350 - RNA, 12 nt, Human
auuucauuguau

SEQ ID NO: 3378351 - RNA, 17 nt, Human
auuucauuguaugaugu

SEQ ID NO: 3378352 - RNA, 19 nt, Human
auuucauuguaugaugugu

SEQ ID NO: 3378353 - RNA, 21 nt, Human
auuucauuguaugauguguug

SEQ ID NO: 3378354 - RNA, 21 nt, Human
auuucauuuuguaacaaauga

SEQ ID NO: 3378355 - RNA, 19 nt, Human
auuucauuuuuacccuuac

SEQ ID NO: 3378356 - RNA, 22 nt, Human
auuucauuuuuugcaucaguau

SEQ ID NO: 3378357 - RNA, 15 nt, Human
auuuccaaauaaaau

SEQ ID NO: 3378358 - RNA, 17 nt, Human
auuuccaaauucacaag

SEQ ID NO: 3378359 - RNA, 20 nt, Human
auuuccaacaccacagacac

SEQ ID NO: 3378360 - RNA, 19 nt, Human
auuuccaacucgaaucugu

SEQ ID NO: 3378361 - RNA, 20 nt, Human
auuuccaacucgaaucugug

SEQ ID NO: 3378362 - RNA, 15 nt, Human
auuuccaagagcuga

SEQ ID NO: 3378363 - RNA, 14 nt, Human
auuuccagccaggg

SEQ ID NO: 3378364 - RNA, 17 nt, Human
auuuccaguaccuuugu

SEQ ID NO: 3378365 - RNA, 20 nt, Human
auuuccagugaaaucaguua

SEQ ID NO: 3378366 - RNA, 21 nt, Human
auuuccaguguucuaugaaca

SEQ ID NO: 3378367 - RNA, 15 nt, Human
auuuccauauggauu

SEQ ID NO: 3378368 - RNA, 22 nt, Human
auuuccaugauguuuuccauga

SEQ ID NO: 3378369 - RNA, 17 nt, Human
auuuccauguaugcaua

SEQ ID NO: 3378370 - RNA, 23 nt, Human
auuuccauguccccucccagagc

SEQ ID NO: 3378371 - RNA, 15 nt, Human
auuuccauuccagaa

SEQ ID NO: 3378372 - RNA, 13 nt, Human
auuuccauugcuu

SEQ ID NO: 3378373 - RNA, 19 nt, Human
auuuccauuuacuuaagac

SEQ ID NO: 3378374 - RNA, 22 nt, Human
auuuccauuuacuuaagacuua

SEQ ID NO: 3378375 - RNA, 19 nt, Human
auuucccaaagcagugcau

SEQ ID NO: 3378376 - RNA, 18 nt, Human
auuucccaacacaaagau

SEQ ID NO: 3378377 - RNA, 14 nt, Human
auugucuuuauaug

SEQ ID NO: 3378378 - RNA, 20 nt, Human
auugucuuuugucauguggc

SEQ ID NO: 3378379 - RNA, 15 nt, Human
auugucuuuuuguau

SEQ ID NO: 3378380 - RNA, 23 nt, Human
auugugaaauaaaacuggcuuug

SEQ ID NO: 3378381 - RNA, 18 nt, Human
auugugaacauuugugau

SEQ ID NO: 3378382 - RNA, 14 nt, Human
auugugaaguacau

SEQ ID NO: 3378383 - RNA, 16 nt, Human
auugugagccaccacg

SEQ ID NO: 3378384 - RNA, 21 nt, Human
auugugaucuaucaauaguca

SEQ ID NO: 3378385 - RNA, 23 nt, Human
auugugauuagacagaacaccua

SEQ ID NO: 3378386 - RNA, 15 nt, Human
auugugauuggccug

SEQ ID NO: 3378387 - RNA, 16 nt, Human
auugugauuucccgug

SEQ ID NO: 3378388 - RNA, 12 nt, Human
auugugauuuga

SEQ ID NO: 3378389 - RNA, 16 nt, Human
auugugauuugacugu

SEQ ID NO: 3378390 - RNA, 23 nt, Human
auugugauuugacuguuuuuacc

SEQ ID NO: 3378391 - RNA, 17 nt, Human
auugugccaauauguau

SEQ ID NO: 3378392 - RNA, 18 nt, Human
auugugccaugucaaaca

SEQ ID NO: 3378393 - RNA, 21 nt, Human
auugugccaugucaaacaaau

SEQ ID NO: 3378394 - RNA, 22 nt, Human
auugugccaugucaaacaaaua

SEQ ID NO: 3378395 - RNA, 17 nt, Human
auugugcuucuccccag

SEQ ID NO: 3378396 - RNA, 18 nt, Human
auugugcuucuccccaga

SEQ ID NO: 3378397 - RNA, 21 nt, Human
auuguggauaacaaagauauc

SEQ ID NO: 3378398 - RNA, 20 nt, Human
auuguggcuccuaucugugu

SEQ ID NO: 3378399 - RNA, 18 nt, Human
auuguggcugucagcagg

SEQ ID NO: 3378400 - RNA, 20 nt, Human
auugugggucuauuucuagu

SEQ ID NO: 3378401 - RNA, 16 nt, Human
auuguggguguuaauu

SEQ ID NO: 3378402 - RNA, 21 nt, Human
auugugguaggccuuuuaaca

SEQ ID NO: 3378403 - RNA, 12 nt, Human
auuguggugcca

SEQ ID NO: 3378404 - RNA, 18 nt, Human
auuguggugugagcuuca

SEQ ID NO: 3378405 - RNA, 20 nt, Human
auugugguuauuuuuauaca

SEQ ID NO: 3378406 - RNA, 18 nt, Human
auuguguagccuuuuugu

SEQ ID NO: 3378407 - RNA, 17 nt, Human
auugugucccauucccc

SEQ ID NO: 3378408 - RNA, 23 nt, Human
auugugucucuugguccugcugc

SEQ ID NO: 3378409 - RNA, 14 nt, Human
auugugucugcagg

SEQ ID NO: 3378410 - RNA, 18 nt, Human
auugugucuuuugcauga

SEQ ID NO: 3378411 - RNA, 20 nt, Human
auugugugauauuucagaaa

SEQ ID NO: 3378412 - RNA, 13 nt, Human
auugugugauguu

SEQ ID NO: 3378413 - RNA, 19 nt, Human
auugugugugcagacuuca

SEQ ID NO: 3378414 - RNA, 19 nt, Human
auugugugugcucugcuuc

SEQ ID NO: 3378415 - RNA, 20 nt, Human
auugugugugcucugcuuca

SEQ ID NO: 3378416 - RNA, 15 nt, Human
auuguguucccauuu

SEQ ID NO: 3378417 - RNA, 13 nt, Human
auuguguugacau

SEQ ID NO: 3378418 - RNA, 18 nt, Human
auuguguugacuuuauaa

SEQ ID NO: 3378419 - RNA, 19 nt, Human
auuguguugacuuuauaaa

SEQ ID NO: 3378420 - RNA, 22 nt, Human
auuguguugacuuuauaaauuu

SEQ ID NO: 3378421 - RNA, 14 nt, Human
auuguguugugaau

SEQ ID NO: 3378422 - RNA, 19 nt, Human
auuguguuuacauuuuaug

SEQ ID NO: 3378423 - RNA, 22 nt, Human
auuguguuucuaccggagagag

SEQ ID NO: 3378424 - RNA, 13 nt, Human
auuguguuuguca

SEQ ID NO: 3378425 - RNA, 19 nt, Human
auuguguuugucauuagcc

SEQ ID NO: 3378426 - RNA, 23 nt, Human
auuguuaagucuaaauauuuccu

SEQ ID NO: 3378427 - RNA, 14 nt, Human
auuguuaauacaag

SEQ ID NO: 3378428 - RNA, 17 nt, Human
auuguuaaucucuguua

SEQ ID NO: 3378429 - RNA, 16 nt, Human
auuguuaauugcugag

SEQ ID NO: 3378430 - RNA, 14 nt, Human
auuguuaauuucag

SEQ ID NO: 3378431 - RNA, 17 nt, Human
auuguuaauuuuuccua

SEQ ID NO: 3378432 - RNA, 15 nt, Human
auuguuagauguuug

SEQ ID NO: 3378433 - RNA, 16 nt, Human
auuguuagauguuugu

SEQ ID NO: 3378434 - RNA, 12 nt, Human
auuguuaucaaa

SEQ ID NO: 3378435 - RNA, 17 nt, Human
auuguuauuuucaguga

SEQ ID NO: 3378436 - RNA, 14 nt, Human
auuguucaaacaau

SEQ ID NO: 3378437 - RNA, 16 nt, Human
auuguucaaacaauau

SEQ ID NO: 3378438 - RNA, 24 nt, Human
auuguucaaacaauaucauaucau

SEQ ID NO: 3378439 - RNA, 15 nt, Human
auuguucaauuccca

SEQ ID NO: 3378440 - RNA, 18 nt, Human
auuguucaccuuuguagc

SEQ ID NO: 3378441 - RNA, 18 nt, Human
auuguucauuuugagcug

SEQ ID NO: 3378442 - RNA, 12 nt, Human
auuguuccaaga

SEQ ID NO: 3378443 - RNA, 15 nt, Human
auuguuccaagacau

SEQ ID NO: 3378444 - RNA, 20 nt, Human
auuguuccaagacauuguca

SEQ ID NO: 3378445 - RNA, 21 nt, Human
auuguuccaagacauugucaa

SEQ ID NO: 3378446 - RNA, 22 nt, Human
auuguuccaagacauugucaau

SEQ ID NO: 3378447 - RNA, 16 nt, Human
auuguuccagagacaa

SEQ ID NO: 3378448 - RNA, 19 nt, Human
auuguucccagugacacuu

SEQ ID NO: 3378449 - RNA, 20 nt, Human
auuguuccuaaguucuuaga

SEQ ID NO: 3378450 - RNA, 23 nt, Human
auuguuccuaaguucuuagauau

SEQ ID NO: 3378451 - RNA, 20 nt, Human
auuguuccuuggagaaauga

SEQ ID NO: 3378452 - RNA, 14 nt, Human
auuguucucagaau

SEQ ID NO: 3378453 - RNA, 17 nt, Human
auuguugacaguucuga

SEQ ID NO: 3378454 - RNA, 13 nt, Human
auuugauacauaa

SEQ ID NO: 3378455 - RNA, 15 nt, Human
auuugauacauaaua

SEQ ID NO: 3378456 - RNA, 12 nt, Human
auuugauacuua

SEQ ID NO: 3378457 - RNA, 14 nt, Human
auuugauaucacag

SEQ ID NO: 3378458 - RNA, 15 nt, Human
auuugaugccaggac

SEQ ID NO: 3378459 - RNA, 14 nt, Human
auuugaugcuaaau

SEQ ID NO: 3378460 - RNA, 17 nt, Human
auuugaugcuggagagg

SEQ ID NO: 3378461 - RNA, 23 nt, Human
auuugaugcuguuugacaaaguu

SEQ ID NO: 3378462 - RNA, 13 nt, Human
auuugauguaaua

SEQ ID NO: 3378463 - RNA, 17 nt, Human
auuugauguaauacuuc

SEQ ID NO: 3378464 - RNA, 16 nt, Human
auuugauuauuuaaga

SEQ ID NO: 3378465 - RNA, 18 nt, Human
auuugauugggaugaaug

SEQ ID NO: 3378466 - RNA, 17 nt, Human
auuugauuuauuaacuu

SEQ ID NO: 3378467 - RNA, 12 nt, Human
auuugcaacauu

SEQ ID NO: 3378468 - RNA, 18 nt, Human
auuugcaagucauggcug

SEQ ID NO: 3378469 - RNA, 18 nt, Human
auuugcaauaacagcugc

SEQ ID NO: 3378470 - RNA, 19 nt, Human
auuugcaauaacagcugca

SEQ ID NO: 3378471 - RNA, 20 nt, Human
auuugcaauaacagcugcaa

SEQ ID NO: 3378472 - RNA, 21 nt, Human
auuugcaauauuccuuugggc

SEQ ID NO: 3378473 - RNA, 18 nt, Human
auuugcaaugggauguau

SEQ ID NO: 3378474 - RNA, 21 nt, Human
auuugcaaugggauguaugaa

SEQ ID NO: 3378475 - RNA, 14 nt, Human
auuugcacauuaaa

SEQ ID NO: 3378476 - RNA, 19 nt, Human
auuugcacauuaaaugacu

SEQ ID NO: 3378477 - RNA, 21 nt, Human
auuugcacauuaaaugacucu

SEQ ID NO: 3378478 - RNA, 19 nt, Human
auuugcagagacaggaccu

SEQ ID NO: 3378479 - RNA, 10 nt, Human
auuugcaguc

SEQ ID NO: 3378480 - RNA, 21 nt, Human
auuugcauaacaauuccucua

SEQ ID NO: 3378481 - RNA, 15 nt, Human
auuugcaucugaaau

SEQ ID NO: 3378482 - RNA, 19 nt, Human
auuugcauuaaauucacaa

SEQ ID NO: 3378483 - RNA, 16 nt, Human
auuugcauugaacaca

SEQ ID NO: 3378484 - RNA, 21 nt, Human
auuugcauugaacacaaacug

SEQ ID NO: 3378485 - RNA, 14 nt, Human
auuugccaaaauaa

SEQ ID NO: 3378486 - RNA, 15 nt, Human
auuugccaauaauaa

SEQ ID NO: 3378487 - RNA, 15 nt, Human
auuugccauagagua

SEQ ID NO: 3378488 - RNA, 15 nt, Human
auuugccaugggcuu

SEQ ID NO: 3378489 - RNA, 19 nt, Human
auuugcccauuuacacuuu

SEQ ID NO: 3378490 - RNA, 14 nt, Human
auuugcccucccau

SEQ ID NO: 3378491 - RNA, 12 nt, Human
auuugcccuggg

SEQ ID NO: 3378492 - RNA, 18 nt, Human
auuugcccugggaaaccc

SEQ ID NO: 3378493 - RNA, 21 nt, Human
auuugccuaauaugaugacug

SEQ ID NO: 3378494 - RNA, 21 nt, Human
auuugccugcagaguuuggau

SEQ ID NO: 3378495 - RNA, 11 nt, Human
auuugccugua

SEQ ID NO: 3378496 - RNA, 15 nt, Human
auuugccuguaacaa

SEQ ID NO: 3378497 - RNA, 14 nt, Human
auuugccuugcaga

SEQ ID NO: 3378498 - RNA, 18 nt, Human
auuugccuugcagaacug

SEQ ID NO: 3378499 - RNA, 22 nt, Human
auuugccuugcagaacugccau

SEQ ID NO: 3378500 - RNA, 14 nt, Human
auuugccuuuaaaa

SEQ ID NO: 3378501 - RNA, 13 nt, Human
auuugcuaauuuu

SEQ ID NO: 3378502 - RNA, 19 nt, Human
auuugcuaauuuuuauuaa

SEQ ID NO: 3378503 - RNA, 15 nt, Human
auuugcuacuguaca

SEQ ID NO: 3378504 - RNA, 15 nt, Human
auuugcuaucucuau

SEQ ID NO: 3378505 - RNA, 16 nt, Human
auuugcuaugagcugg

SEQ ID NO: 3378506 - RNA, 20 nt, Human
auuugcuaugagcuggggau

SEQ ID NO: 3378507 - RNA, 22 nt, Human
auuugcugacaaccauuaaagu

SEQ ID NO: 3378508 - RNA, 11 nt, Human
auuugcugcug

SEQ ID NO: 3378509 - RNA, 22 nt, Human
auuugcuuaaauauccauauua

SEQ ID NO: 3378510 - RNA, 14 nt, Human
auuugcuuuggaag

SEQ ID NO: 3378511 - RNA, 18 nt, Human
auuugcuuuuugugauau

SEQ ID NO: 3378512 - RNA, 16 nt, Human
auuuggaaacuaauaa

SEQ ID NO: 3378513 - RNA, 17 nt, Human
auuuggaaacuaauaaa

SEQ ID NO: 3378514 - RNA, 23 nt, Human
auuuggaaacuaauaaaauauuu

SEQ ID NO: 3378515 - RNA, 18 nt, Human
auuuggaaaggaaugcaa

SEQ ID NO: 3378516 - RNA, 17 nt, Human
auuuggaaauaaaguca

SEQ ID NO: 3378517 - RNA, 11 nt, Human
auuuggaaauc

SEQ ID NO: 3378518 - RNA, 21 nt, Human
auuuggaaauccuaguuuccu

SEQ ID NO: 3378519 - RNA, 21 nt, Human
auuuggaagaaaaaaaucuuc

SEQ ID NO: 3378520 - RNA, 18 nt, Human
auuuggaauuuauauaca

SEQ ID NO: 3378521 - RNA, 18 nt, Human
auuuggaccauuuuccug

SEQ ID NO: 3378522 - RNA, 18 nt, Human
auuucauauucuuucaau

SEQ ID NO: 3378523 - RNA, 14 nt, Human
auuucaucauuguu

SEQ ID NO: 3378524 - RNA, 14 nt, Human
auuucauccagaag

SEQ ID NO: 3378525 - RNA, 20 nt, Human
auuucauccuuucacuucuu

SEQ ID NO: 3378526 - RNA, 15 nt, Human
auuucaucuauuucu

SEQ ID NO: 3378527 - RNA, 17 nt, Human
auuucaugcucugcaaa

SEQ ID NO: 3378528 - RNA, 12 nt, Human
auuucauguacu

SEQ ID NO: 3378529 - RNA, 21 nt, Human
auuucauguccugugucaguu

SEQ ID NO: 3378530 - RNA, 14 nt, Human
auuucaugugucaa

SEQ ID NO: 3378531 - RNA, 22 nt, Human
auuucaugugucaacuucaaca

SEQ ID NO: 3378532 - RNA, 16 nt, Human
auuucauguuuuugau

SEQ ID NO: 3378533 - RNA, 12 nt, Human
auuucauuccau

SEQ ID NO: 3378534 - RNA, 16 nt, Human
auuucauuccauugcc

SEQ ID NO: 3378535 - RNA, 18 nt, Human
auuucauuccauugccua

SEQ ID NO: 3378536 - RNA, 21 nt, Human
auuucauucgggccccaccug

SEQ ID NO: 3378537 - RNA, 14 nt, Human
auuucauugccugu

SEQ ID NO: 3378538 - RNA, 18 nt, Human
auuucauuucaacuguuu

SEQ ID NO: 3378539 - RNA, 19 nt, Human
auuuccaacaccacagaca

SEQ ID NO: 3378540 - RNA, 22 nt, Human
auuuccaacaccacagacacac

SEQ ID NO: 3378541 - RNA, 14 nt, Human
auuuccacaccaag

SEQ ID NO: 3378542 - RNA, 18 nt, Human
auuuccagccagggcugc

SEQ ID NO: 3378543 - RNA, 14 nt, Human
auuuccagggauau

SEQ ID NO: 3378544 - RNA, 20 nt, Human
auuuccaguaccuuugucac

SEQ ID NO: 3378545 - RNA, 17 nt, Human
auuuccagucuccacca

SEQ ID NO: 3378546 - RNA, 14 nt, Human
auuuccauguaugc

SEQ ID NO: 3378547 - RNA, 20 nt, Human
auuuccauuuacuuaagacu

SEQ ID NO: 3378548 - RNA, 14 nt, Human
auuucccaaagcag

SEQ ID NO: 3378549 - RNA, 14 nt, Human
auuucccaagcugg

SEQ ID NO: 3378550 - RNA, 23 nt, Human
auuucccacaccguguaaaccaa

SEQ ID NO: 3378551 - RNA, 20 nt, Human
auuucccagcacaugaaacc

SEQ ID NO: 3378552 - RNA, 23 nt, Human
auuucccagcccucuucuucuca

SEQ ID NO: 3378553 - RNA, 13 nt, Human
auuucccaggacc

SEQ ID NO: 3378554 - RNA, 19 nt, Human
auuucccaggacccugaag

SEQ ID NO: 3378555 - RNA, 16 nt, Human
auuuccccaacagugu

SEQ ID NO: 3378556 - RNA, 18 nt, Human
auuuccccaacaguguga

SEQ ID NO: 3378557 - RNA, 19 nt, Human
auuuccccaacagugugaa

SEQ ID NO: 3378558 - RNA, 20 nt, Human
auuuccccaggggaaaauga

SEQ ID NO: 3378559 - RNA, 21 nt, Human
auuucccccaccccauuucuc

SEQ ID NO: 3378560 - RNA, 23 nt, Human
auuucccccaccccauuucucuc

SEQ ID NO: 3378561 - RNA, 16 nt, Human
auuuccccuccuuccc

SEQ ID NO: 3378562 - RNA, 22 nt, Human
auuuccccucugcacccagaac

SEQ ID NO: 3378563 - RNA, 19 nt, Human
auuucccguggccccagcc

SEQ ID NO: 3378564 - RNA, 20 nt, Human
auuucccguggccccagccu

SEQ ID NO: 3378565 - RNA, 23 nt, Human
auuucccguggccccagccuggc

SEQ ID NO: 3378566 - RNA, 21 nt, Human
auuucccuaaaauacauuuaa

SEQ ID NO: 3378567 - RNA, 16 nt, Human
auuucccuuccuuccu

SEQ ID NO: 3378568 - RNA, 20 nt, Human
auuucccuuccuuccucucc

SEQ ID NO: 3378569 - RNA, 18 nt, Human
auuucccuucuucuguca

SEQ ID NO: 3378570 - RNA, 23 nt, Human
auuucccuugaaauuuuaaacua

SEQ ID NO: 3378571 - RNA, 14 nt, Human
auuuccguaauucu

SEQ ID NO: 3378572 - RNA, 16 nt, Human
auuuccguaauucuua

SEQ ID NO: 3378573 - RNA, 17 nt, Human
auuuccuaauacuguca

SEQ ID NO: 3378574 - RNA, 19 nt, Human
auuuccuaauuuugagaaa

SEQ ID NO: 3378575 - RNA, 19 nt, Human
auuuccuacacaaaugaua

SEQ ID NO: 3378576 - RNA, 15 nt, Human
auuuccuaguucugu

SEQ ID NO: 3378577 - RNA, 20 nt, Human
auuuccuaguucuguagaaa

SEQ ID NO: 3378578 - RNA, 22 nt, Human
auuuccuaguucuguagaaaug

SEQ ID NO: 3378579 - RNA, 18 nt, Human
auuuccuaucaccuauuu

SEQ ID NO: 3378580 - RNA, 20 nt, Human
auuuccuaugauguauacug

SEQ ID NO: 3378581 - RNA, 19 nt, Human
auuuccuauuuuuggaaga

SEQ ID NO: 3378582 - RNA, 24 nt, Human
auuuccucaacguugcuccccauc

SEQ ID NO: 3378583 - RNA, 21 nt, Human
auuuccucagcuuaucucuuu

SEQ ID NO: 3378584 - RNA, 16 nt, Human
auuuccuccacaaauu

SEQ ID NO: 3378585 - RNA, 21 nt, Human
auuuccucccucugccccucc

SEQ ID NO: 3378586 - RNA, 17 nt, Human
auuuccucgcagccucu

SEQ ID NO: 3378587 - RNA, 13 nt, Human
auuuccugcccuu

SEQ ID NO: 3378588 - RNA, 20 nt, Human
auuuccugcccuuccucagu

SEQ ID NO: 3378589 - RNA, 22 nt, Human
auuuccugggagcuuuuguaga

SEQ ID NO: 3378590 - RNA, 12 nt, Human
auuuccuguguc

SEQ ID NO: 3378591 - RNA, 14 nt, Human
auuuccugugucuu

SEQ ID NO: 3378592 - RNA, 21 nt, Human
auuuccuguuggauuuguuua

SEQ ID NO: 3378593 - RNA, 23 nt, Human
auuuccuguuggauuuguuuaaa

SEQ ID NO: 3378594 - RNA, 13 nt, Human
auuuccuuuauaa

SEQ ID NO: 3378595 - RNA, 17 nt, Human
auuuccuuuaugugaau

SEQ ID NO: 3378596 - RNA, 19 nt, Human
auuuccuuuaugugaauuu

SEQ ID NO: 3378597 - RNA, 18 nt, Human
auuuccuuuuugacacug

SEQ ID NO: 3378598 - RNA, 19 nt, Human
auuucggauuuuuuccaaa

SEQ ID NO: 3378599 - RNA, 20 nt, Human
auuucgguugagaauggaaa

SEQ ID NO: 3378600 - RNA, 22 nt, Human
auuucgugggucuguuuuccuu

SEQ ID NO: 3378601 - RNA, 14 nt, Human
auuucuaaaaagau

SEQ ID NO: 3378602 - RNA, 15 nt, Human
auuucuaaauaaaag

SEQ ID NO: 3378603 - RNA, 20 nt, Human
auuucuaacucugauguaaa

SEQ ID NO: 3378604 - RNA, 21 nt, Human
auuucuaacucugauguaaau

SEQ ID NO: 3378605 - RNA, 22 nt, Human
auuucuaauuauguagcucuuu

SEQ ID NO: 3378606 - RNA, 18 nt, Human
auuucuaccauuucagag

SEQ ID NO: 3378607 - RNA, 21 nt, Human
auuucuacucucccauggcuu

SEQ ID NO: 3378608 - RNA, 20 nt, Human
auuucuacucuuaaguuucu

SEQ ID NO: 3378609 - RNA, 18 nt, Human
auuucuacuuugaaguca

SEQ ID NO: 3378610 - RNA, 23 nt, Human
auuucuagaacaucccugccagc

SEQ ID NO: 3378611 - RNA, 19 nt, Human
auuucuagccugcacuuug

SEQ ID NO: 3378612 - RNA, 18 nt, Human
auuucuagcuuuuuaauu

SEQ ID NO: 3378613 - RNA, 19 nt, Human
auuucuaggaagaauuuua

SEQ ID NO: 3378614 - RNA, 20 nt, Human
auuucuaggaagaauuuuaa

SEQ ID NO: 3378615 - RNA, 17 nt, Human
auuucuaggacugaauu

SEQ ID NO: 3378616 - RNA, 18 nt, Human
auuucuaggacugaauua

SEQ ID NO: 3378617 - RNA, 22 nt, Human
auuucuagggcugggaaacacu

SEQ ID NO: 3378618 - RNA, 16 nt, Human
auuucuaguuauuuau

SEQ ID NO: 3378619 - RNA, 14 nt, Human
auuucuauaaauag

SEQ ID NO: 3378620 - RNA, 21 nt, Human
auuucuauaaauagaugcugu

SEQ ID NO: 3378621 - RNA, 23 nt, Human
auuucuauagccaaaaauagcua

SEQ ID NO: 3378622 - RNA, 19 nt, Human
auuucuauauuuucauucu

SEQ ID NO: 3378623 - RNA, 19 nt, Human
auuucuaucuuguuccaag

SEQ ID NO: 3378624 - RNA, 15 nt, Human
auuucuaugaaauau

SEQ ID NO: 3378625 - RNA, 22 nt, Human
auuucuaugcugaguuugugcu

SEQ ID NO: 3378626 - RNA, 23 nt, Human
auuucuauucaagguggccaaau

SEQ ID NO: 3378627 - RNA, 16 nt, Human
auuucucagacuuugg

SEQ ID NO: 3378628 - RNA, 21 nt, Human
auuucucagacuuuggaaaau

SEQ ID NO: 3378629 - RNA, 14 nt, Human
auuucucaucacag

SEQ ID NO: 3378630 - RNA, 12 nt, Human
auuucuccccag

SEQ ID NO: 3378631 - RNA, 20 nt, Human
auuucuccuccaugggagaa

SEQ ID NO: 3378632 - RNA, 14 nt, Human
auuucuccucccuu

SEQ ID NO: 3378633 - RNA, 12 nt, Human
auuucuccuuuu

SEQ ID NO: 3378634 - RNA, 20 nt, Human
auuucuccuuuuguguucca

SEQ ID NO: 3378635 - RNA, 17 nt, Human
auuucucuaguaguuaa

SEQ ID NO: 3378636 - RNA, 23 nt, Human
auuucucuguuccauaguuaaag

SEQ ID NO: 3378637 - RNA, 18 nt, Human
auuucucuuacugcaaau

SEQ ID NO: 3378638 - RNA, 13 nt, Human
auuucucuuugaa

SEQ ID NO: 3378639 - RNA, 16 nt, Human
auuucucuuugaaaca

SEQ ID NO: 3378640 - RNA, 18 nt, Human
auuucugaaguggacucu

SEQ ID NO: 3378641 - RNA, 17 nt, Human
auuucugagaagguccu

SEQ ID NO: 3378642 - RNA, 23 nt, Human
auuucugaguuucauucuccugc

SEQ ID NO: 3378643 - RNA, 15 nt, Human
auuucugccuuccuu

SEQ ID NO: 3378644 - RNA, 17 nt, Human
auuucugccuuccuugc

SEQ ID NO: 3378645 - RNA, 16 nt, Human
auuucugcugaauuuu

SEQ ID NO: 3378646 - RNA, 19 nt, Human
auuucugggggaggaugua

SEQ ID NO: 3378647 - RNA, 20 nt, Human
auuucugggucuuuugcuac

SEQ ID NO: 3378648 - RNA, 11 nt, Human
auuucuguaaa

SEQ ID NO: 3378649 - RNA, 13 nt, Human
auuucugucagaa

SEQ ID NO: 3378650 - RNA, 11 nt, Human
auuucugugcc

SEQ ID NO: 3378651 - RNA, 18 nt, Human
auuucuguguccuguuuu

SEQ ID NO: 3378652 - RNA, 14 nt, Human
auuucuguuuagau

SEQ ID NO: 3378653 - RNA, 22 nt, Human
auuuuuacaagaaguuuauucu

SEQ ID NO: 3378654 - RNA, 13 nt, Human
auuuuuacaauaa

SEQ ID NO: 3378655 - RNA, 19 nt, Human
auuuuuacauggagaaaac

SEQ ID NO: 3378656 - RNA, 17 nt, Human
auuuuuacauucugaau

SEQ ID NO: 3378657 - RNA, 22 nt, Human
auuuuuacccuaaugucuucau

SEQ ID NO: 3378658 - RNA, 20 nt, Human
auuuuuaccuuuuuccuucc

SEQ ID NO: 3378659 - RNA, 24 nt, Human
auuuuuagaauaagaauuugcaua

SEQ ID NO: 3378660 - RNA, 21 nt, Human
auuuuuagauaguuagaaccu

SEQ ID NO: 3378661 - RNA, 22 nt, Human
auuuuuagaugguuacacuguu

SEQ ID NO: 3378662 - RNA, 14 nt, Human
auuuuuauaagaaa

SEQ ID NO: 3378663 - RNA, 12 nt, Human
auuuuuauaauu

SEQ ID NO: 3378664 - RNA, 21 nt, Human
auuuuuauaauuguacaaaau

SEQ ID NO: 3378665 - RNA, 20 nt, Human
auuuuuuuuucauacacuua

SEQ ID NO: 3378666 - RNA, 12 nt, Human
auuuuuuuuucc

SEQ ID NO: 3378667 - RNA, 16 nt, Human
auuuuuuuuuccuuca

SEQ ID NO: 3378668 - RNA, 23 nt, Human
auuuuuuuuuccuucagugccuu

SEQ ID NO: 3378669 - RNA, 14 nt, Human
auuuuuuuuucuaa

SEQ ID NO: 3378670 - RNA, 18 nt, Human
auuuuuuuuucuaagaga

SEQ ID NO: 3378671 - RNA, 16 nt, Human
auuuuuuuuuuaaauc

SEQ ID NO: 3378672 - RNA, 21 nt, Human
auuuuuuuuuuuaaucuacug

SEQ ID NO: 3378673 - RNA, 19 nt, Human
auuuuuuuuuuuuuuuccu

SEQ ID NO: 3378674 - RNA, 20 nt, Human
caaaaaaaaaaaaaaauuag

SEQ ID NO: 3378675 - RNA, 22 nt, Human
caaaaaaaaaaaaaagcaucua

SEQ ID NO: 3378676 - RNA, 20 nt, Human
caaaaaaaaaaaaagaagac

SEQ ID NO: 3378677 - RNA, 21 nt, Human
caaaaaaaaaaaaagaagacc

SEQ ID NO: 3378678 - RNA, 14 nt, Human
caaaaaaaaauaca

SEQ ID NO: 3378679 - RNA, 21 nt, Human
caaaaaaaaauuuuaaagacc

SEQ ID NO: 3378680 - RNA, 17 nt, Human
caaaaaaaauuuaaaaa

SEQ ID NO: 3378681 - RNA, 19 nt, Human
caaaaaaaauuuagccggg

SEQ ID NO: 3378682 - RNA, 13 nt, Human
caaaaaaaguugu

SEQ ID NO: 3378683 - RNA, 14 nt, Human
caaaaaaaguugua

SEQ ID NO: 3378684 - RNA, 16 nt, Human
caaaaaaaguuguaug

SEQ ID NO: 3378685 - RNA, 22 nt, Human
caaaaaaaguuguaugaucugu

SEQ ID NO: 3378686 - RNA, 16 nt, Human
caaaaaaauaaggugu

SEQ ID NO: 3378687 - RNA, 18 nt, Human
caaaaaaauauauuuaau

SEQ ID NO: 3378688 - RNA, 23 nt, Human
caaaaaaauauauuuaaugauaa

SEQ ID NO: 3378689 - RNA, 16 nt, Human
caaaaaaaucugcaga

SEQ ID NO: 3378690 - RNA, 21 nt, Human
caaaaaaaucugcagaaggaa

SEQ ID NO: 3378691 - RNA, 21 nt, Human
caaaaaaauuaaaauggaugc

SEQ ID NO: 3378692 - RNA, 15 nt, Human
caaaaaacucgagga

SEQ ID NO: 3378693 - RNA, 12 nt, Human
caaaaaagaaaa

SEQ ID NO: 3378694 - RNA, 19 nt, Human
caaaaaauacuuuuucuaa

SEQ ID NO: 3378695 - RNA, 23 nt, Human
caaaaaauaucuaguaauauauu

SEQ ID NO: 3378696 - RNA, 12 nt, Human
caaaaaaugagc

SEQ ID NO: 3378697 - RNA, 16 nt, Human
caaaaaaugcuugcuu

SEQ ID NO: 3378698 - RNA, 15 nt, Human
caaaaaauguuuuaa

SEQ ID NO: 3378699 - RNA, 15 nt, Human
caaaaaauuaaagca

SEQ ID NO: 3378700 - RNA, 18 nt, Human
caaaaaauuaaagcauuu

SEQ ID NO: 3378701 - RNA, 19 nt, Human
caaaaaauuaaagcauuua

SEQ ID NO: 3378702 - RNA, 13 nt, Human
caaaaacacagca

SEQ ID NO: 3378703 - RNA, 22 nt, Human
caaaaacacaguguuuuuguaa

SEQ ID NO: 3378704 - RNA, 23 nt, Human
caaaaacacaguguuuuuguaaa

SEQ ID NO: 3378705 - RNA, 14 nt, Human
caaaaacagccuca

SEQ ID NO: 3378706 - RNA, 20 nt, Human
caaaaacagguauauacuuu

SEQ ID NO: 3378707 - RNA, 20 nt, Human
caaaaaccaguauuguacaa

SEQ ID NO: 3378708 - RNA, 17 nt, Human
caaaaacgaaagcuggg

SEQ ID NO: 3378709 - RNA, 16 nt, Human
caaaaacuacacauau

SEQ ID NO: 3378710 - RNA, 22 nt, Human
caaaaacuguauugaugacagu

SEQ ID NO: 3378711 - RNA, 14 nt, Human
caaaaagaaaugac

SEQ ID NO: 3378712 - RNA, 21 nt, Human
caaaaagaacaaaaaaaucug

SEQ ID NO: 3378713 - RNA, 18 nt, Human
caaaaagaaucugcauuu

SEQ ID NO: 3378714 - RNA, 19 nt, Human
caaaaagaaucugcauuua

SEQ ID NO: 3378715 - RNA, 22 nt, Human
caaaaagaaucugcauuuagca

SEQ ID NO: 3378716 - RNA, 23 nt, Human
caaaaagaaucugcauuuagcac

SEQ ID NO: 3378717 - RNA, 14 nt, Human
caaaaagacaaaca

SEQ ID NO: 3378718 - RNA, 12 nt, Human
caaaaagcacau

SEQ ID NO: 3378719 - RNA, 13 nt, Human
caaaaaggcagga

SEQ ID NO: 3378720 - RNA, 13 nt, Human
caaaaaggcuuau

SEQ ID NO: 3378721 - RNA, 15 nt, Human
caaaaagugaaauaa

SEQ ID NO: 3378722 - RNA, 21 nt, Human
caaaaaguggggcagagccuc

SEQ ID NO: 3378723 - RNA, 11 nt, Human
caaaaaguguu

SEQ ID NO: 3378724 - RNA, 12 nt, Human
caaaaaguguuu

SEQ ID NO: 3378725 - RNA, 12 nt, Human
caaaaauaaaua

SEQ ID NO: 3378726 - RNA, 23 nt, Human
caaaaauauaaaauaugaagaca

SEQ ID NO: 3378727 - RNA, 14 nt, Human
caaaaauauuuaua

SEQ ID NO: 3378728 - RNA, 22 nt, Human
caaaaauauuuauaaaacuucu

SEQ ID NO: 3378729 - RNA, 21 nt, Human
caaaaauauuuuaugauccag

SEQ ID NO: 3378730 - RNA, 23 nt, Human
caaaaauauuuuaugauccagca

SEQ ID NO: 3378731 - RNA, 20 nt, Human
caaaaaucugaagauuguuu

SEQ ID NO: 3378732 - RNA, 19 nt, Human
caaaaaugaaagcaugucu

SEQ ID NO: 3378733 - RNA, 19 nt, Human
caaaaauguacaaaauaaa

SEQ ID NO: 3378734 - RNA, 23 nt, Human
caaaaauuaucuauuuguauaua

SEQ ID NO: 3378735 - RNA, 22 nt, Human
caaaaauuucuguaaaacaggu

SEQ ID NO: 3378736 - RNA, 11 nt, Human
caaaaauuuuu

SEQ ID NO: 3378737 - RNA, 18 nt, Human
caaaaauuuuuggauuga

SEQ ID NO: 3378738 - RNA, 10 nt, Human
caaaacaaaa

SEQ ID NO: 3378739 - RNA, 18 nt, Human
caaaacaaaaagaugucu

SEQ ID NO: 3378740 - RNA, 14 nt, Human
caaaacaaaacaaa

SEQ ID NO: 3378741 - RNA, 15 nt, Human
caaaacaaaacaaaa

SEQ ID NO: 3378742 - RNA, 14 nt, Human
caaaacaaaacuau

SEQ ID NO: 3378743 - RNA, 14 nt, Human
caaaacaaacucau

SEQ ID NO: 3378744 - RNA, 21 nt, Human
caaaacaaagcaauucuuuca

SEQ ID NO: 3378745 - RNA, 15 nt, Human
caaaacaaaggccua

SEQ ID NO: 3378746 - RNA, 16 nt, Human
caaaacaaaggccuaa

SEQ ID NO: 3378747 - RNA, 16 nt, Human
caaaacaagccuggua

SEQ ID NO: 3378748 - RNA, 14 nt, Human
caaaacaauguuua

SEQ ID NO: 3378749 - RNA, 19 nt, Human
caaaacacucggcauuuca

SEQ ID NO: 3378750 - RNA, 18 nt, Human
caaaaccaaaaguuauua

SEQ ID NO: 3378751 - RNA, 13 nt, Human
caaaaccacagcc

SEQ ID NO: 3378752 - RNA, 18 nt, Human
caaaaccacagcccuguc

SEQ ID NO: 3378753 - RNA, 22 nt, Human
caaaaccagguccaaugagcuu

SEQ ID NO: 3378754 - RNA, 23 nt, Human
caaaaccagguccaaugagcuuu

SEQ ID NO: 3378755 - RNA, 13 nt, Human
caaaacccagacc

SEQ ID NO: 3378756 - RNA, 15 nt, Human
caaaacccagaccug

SEQ ID NO: 3378757 - RNA, 14 nt, Human
caaaacccaugugg

SEQ ID NO: 3378758 - RNA, 19 nt, Human
caaaaccccacuacacagu

SEQ ID NO: 3378759 - RNA, 12 nt, Human
caaaaccgccag

SEQ ID NO: 3378760 - RNA, 14 nt, Human
caaaaccgccagcu

SEQ ID NO: 3378761 - RNA, 18 nt, Human
caaaaccugauguuaaaa

SEQ ID NO: 3378762 - RNA, 21 nt, Human
caaaaccuuuuacugguugca

SEQ ID NO: 3378763 - RNA, 16 nt, Human
caaaacgcgcagaugu

SEQ ID NO: 3378764 - RNA, 15 nt, Human
caaaacuauacuuga

SEQ ID NO: 3378765 - RNA, 17 nt, Human
caaaacuauacuugaac

SEQ ID NO: 3378766 - RNA, 18 nt, Human
caaaacuauacuugaaca

SEQ ID NO: 3378767 - RNA, 23 nt, Human
caaaacuauacuugaacaaaagg

SEQ ID NO: 3378768 - RNA, 20 nt, Human
caaaacucuccucugcugcu

SEQ ID NO: 3378769 - RNA, 15 nt, Human
caaaacuucuuguca

SEQ ID NO: 3378770 - RNA, 20 nt, Human
caaaacuugguauuuuucag

SEQ ID NO: 3378771 - RNA, 15 nt, Human
caaaacuuuuaaacu

SEQ ID NO: 3378772 - RNA, 16 nt, Human
caaaagaacuuacccc

SEQ ID NO: 3378773 - RNA, 15 nt, Human
caaaagaagaaguuu

SEQ ID NO: 3378774 - RNA, 20 nt, Human
caaaagaagaaguuucauca

SEQ ID NO: 3378775 - RNA, 16 nt, Human
caaaagaagcccccag

SEQ ID NO: 3378776 - RNA, 20 nt, Human
caaaagaagcccggcuccug

SEQ ID NO: 3378777 - RNA, 22 nt, Human
caaaagaagcccggcuccuggu

SEQ ID NO: 3378778 - RNA, 18 nt, Human
caaaagaaguaaaagcaa

SEQ ID NO: 3378779 - RNA, 22 nt, Human
caaaagaaguaacaagagugau

SEQ ID NO: 3378780 - RNA, 15 nt, Human
caaaagaaucagaaa

SEQ ID NO: 3378781 - RNA, 19 nt, Human
caaaagaauggcagaaaag

SEQ ID NO: 3378782 - RNA, 12 nt, Human
caaaagacaauu

SEQ ID NO: 3378783 - RNA, 15 nt, Human
caaaagacaauucuu

SEQ ID NO: 3378784 - RNA, 14 nt, Human
caaaagacacugca

SEQ ID NO: 3378785 - RNA, 15 nt, Human
caaaagacauguugu

SEQ ID NO: 3378786 - RNA, 15 nt, Human
caaaagagaugaaag

SEQ ID NO: 3378787 - RNA, 19 nt, Human
caaaagaugcucuucugug

SEQ ID NO: 3378788 - RNA, 18 nt, Human
caaaagaugcuucucacu

SEQ ID NO: 3378789 - RNA, 18 nt, Human
caaaagauugcugaaaaa

SEQ ID NO: 3378790 - RNA, 15 nt, Human
caaaagcaaaugaga

SEQ ID NO: 3378791 - RNA, 19 nt, Human
caaaagcauuuaucauucu

SEQ ID NO: 3378792 - RNA, 15 nt, Human
caaaagcccauucau

SEQ ID NO: 3378793 - RNA, 19 nt, Human
caaaagcccauucauucca

SEQ ID NO: 3378794 - RNA, 20 nt, Human
caaaagcccauucauuccau

SEQ ID NO: 3378795 - RNA, 22 nt, Human
caaaagcccauucauuccauuc

SEQ ID NO: 3378796 - RNA, 11 nt, Human
caaaagccucu

SEQ ID NO: 3378797 - RNA, 13 nt, Human
caaaagccucuca

SEQ ID NO: 3378798 - RNA, 23 nt, Human
caaaagcgugagcuuaaaauaca

SEQ ID NO: 3378799 - RNA, 21 nt, Human
caaaagcuauuuaaagcaucu

SEQ ID NO: 3378800 - RNA, 12 nt, Human
caaaagcugcuc

SEQ ID NO: 3378801 - RNA, 16 nt, Human
caaaagcuucaaauua

SEQ ID NO: 3378802 - RNA, 13 nt, Human
caaaagcuucccu

SEQ ID NO: 3378803 - RNA, 17 nt, Human
caaaaggaaaaagcucc

SEQ ID NO: 3378804 - RNA, 16 nt, Human
caaaaggaaagcugug

SEQ ID NO: 3378805 - RNA, 14 nt, Human
caaaaggaauagau

SEQ ID NO: 3378806 - RNA, 15 nt, Human
caaaaggcagaagca

SEQ ID NO: 3378807 - RNA, 19 nt, Human
caaaaggcaguggggcugg

SEQ ID NO: 3378808 - RNA, 19 nt, Human
caaaaggcuccauauauau

SEQ ID NO: 3378809 - RNA, 14 nt, Human
caaaagggaaaaga

SEQ ID NO: 3378810 - RNA, 20 nt, Human
aucaaucaugucagucugcu

SEQ ID NO: 3378811 - RNA, 14 nt, Human
aucaaucauuguac

SEQ ID NO: 3378812 - RNA, 15 nt, Human
aucaaucauuguaca

SEQ ID NO: 3378813 - RNA, 13 nt, Human
aucaauccugauu

SEQ ID NO: 3378814 - RNA, 14 nt, Human
aucaauccuuuauu

SEQ ID NO: 3378815 - RNA, 21 nt, Human
aucaaucuuuagaaaaggcau

SEQ ID NO: 3378816 - RNA, 15 nt, Human
aucaaugaauauuga

SEQ ID NO: 3378817 - RNA, 22 nt, Human
aucaauggcgcagugccucugg

SEQ ID NO: 3378818 - RNA, 21 nt, Human
aucaauguucacgcaacuuga

SEQ ID NO: 3378819 - RNA, 23 nt, Human
aucaauguucacgcaacuugaaa

SEQ ID NO: 3378820 - RNA, 13 nt, Human
aucaauguucauu

SEQ ID NO: 3378821 - RNA, 14 nt, Human
aucaauguucauug

SEQ ID NO: 3378822 - RNA, 18 nt, Human
aucaauguucauuguaau

SEQ ID NO: 3378823 - RNA, 13 nt, Human
aucaauuaaaugu

SEQ ID NO: 3378824 - RNA, 16 nt, Human
aucaauucauaucuau

SEQ ID NO: 3378825 - RNA, 16 nt, Human
aucaauuuaaacccau

SEQ ID NO: 3378826 - RNA, 20 nt, Human
aucaauuuguaauugcuuac

SEQ ID NO: 3378827 - RNA, 19 nt, Human
aucaauuugucauuuugaa

SEQ ID NO: 3378828 - RNA, 22 nt, Human
aucaauuuugacuuaaugugau

SEQ ID NO: 3378829 - RNA, 14 nt, Human
aucacaaaugacuu

SEQ ID NO: 3378830 - RNA, 19 nt, Human
aucacaaaugacuuuauua

SEQ ID NO: 3378831 - RNA, 19 nt, Human
aucacaaauuucacuuaua

SEQ ID NO: 3378832 - RNA, 16 nt, Human
aucacaacaagaaauu

SEQ ID NO: 3378833 - RNA, 21 nt, Human
aucacaaccaccguuacaagu

SEQ ID NO: 3378834 - RNA, 17 nt, Human
aucacaacgugcauugu

SEQ ID NO: 3378835 - RNA, 15 nt, Human
aucacaauuuuuaau

SEQ ID NO: 3378836 - RNA, 13 nt, Human
aucacacaaagca

SEQ ID NO: 3378837 - RNA, 12 nt, Human
aucacacacaug

SEQ ID NO: 3378838 - RNA, 13 nt, Human
aucacacacauug

SEQ ID NO: 3378839 - RNA, 20 nt, Human
aucacacacauugcugugaa

SEQ ID NO: 3378840 - RNA, 16 nt, Human
aucacacauguucaga

SEQ ID NO: 3378841 - RNA, 20 nt, Human
aucacaccaucgcuggcccc

SEQ ID NO: 3378842 - RNA, 16 nt, Human
aucacacuucugugag

SEQ ID NO: 3378843 - RNA, 16 nt, Human
aucacagagacauucc

SEQ ID NO: 3378844 - RNA, 14 nt, Human
aucacagcuucagc

SEQ ID NO: 3378845 - RNA, 21 nt, Human
aucacagcuucagccaggagc

SEQ ID NO: 3378846 - RNA, 22 nt, Human
aucacagcuucagccaggagcu

SEQ ID NO: 3378847 - RNA, 14 nt, Human
aucacagcuuguuu

SEQ ID NO: 3378848 - RNA, 22 nt, Human
aucacaggcugggcugggcacu

SEQ ID NO: 3378849 - RNA, 23 nt, Human
aucacaggcugggcugggcacug

SEQ ID NO: 3378850 - RNA, 12 nt, Human
aucacagggcag

SEQ ID NO: 3378851 - RNA, 15 nt, Human
aucacagggcagagc

SEQ ID NO: 3378852 - RNA, 21 nt, Human
aucacagggugggccucggcc

SEQ ID NO: 3378853 - RNA, 23 nt, Human
aucacaggguugggcccagaucu

SEQ ID NO: 3378854 - RNA, 18 nt, Human
aucacagucuaauuuuua

SEQ ID NO: 3378855 - RNA, 22 nt, Human
aucacaguuuugguugcuuuaa

SEQ ID NO: 3378856 - RNA, 17 nt, Human
aucacaguuuuuccugg

SEQ ID NO: 3378857 - RNA, 18 nt, Human
aucacaguuuuuccugga

SEQ ID NO: 3378858 - RNA, 17 nt, Human
aucacauagugaaaguu

SEQ ID NO: 3378859 - RNA, 20 nt, Human
caaauaaguguauuuugaaa

SEQ ID NO: 3378860 - RNA, 21 nt, Human
caaauaaguguauuuugaaau

SEQ ID NO: 3378861 - RNA, 13 nt, Human
caaauaaucacau

SEQ ID NO: 3378862 - RNA, 16 nt, Human
caaauaaugucucugu

SEQ ID NO: 3378863 - RNA, 23 nt, Human
caaauaaugucucugugagacuc

SEQ ID NO: 3378864 - RNA, 19 nt, Human
caaauacauuuaaaacauu

SEQ ID NO: 3378865 - RNA, 22 nt, Human
caaauacgugggcauucaaaug

SEQ ID NO: 3378866 - RNA, 23 nt, Human
caaauacucauuuuaggaaaaaa

SEQ ID NO: 3378867 - RNA, 21 nt, Human
caaauacuguguuucagaagc

SEQ ID NO: 3378868 - RNA, 18 nt, Human
caaauacuuauucauugu

SEQ ID NO: 3378869 - RNA, 21 nt, Human
caaauacuuauucauuguggu

SEQ ID NO: 3378870 - RNA, 12 nt, Human
caaauacuuuaa

SEQ ID NO: 3378871 - RNA, 21 nt, Human
caaauaggcaucaucaauaaa

SEQ ID NO: 3378872 - RNA, 20 nt, Human
caaauaggcuauuaaaaaag

SEQ ID NO: 3378873 - RNA, 21 nt, Human
caaauagugugaaauauauua

SEQ ID NO: 3378874 - RNA, 17 nt, Human
caaauauaaaacuuaca

SEQ ID NO: 3378875 - RNA, 22 nt, Human
caaauauaagaauaaaauguug

SEQ ID NO: 3378876 - RNA, 13 nt, Human
caaauauagagau

SEQ ID NO: 3378877 - RNA, 12 nt, Human
caaauauauuca

SEQ ID NO: 3378878 - RNA, 18 nt, Human
caaauauauucucuuugg

SEQ ID NO: 3378879 - RNA, 20 nt, Human
caaauauauucucuuuggug

SEQ ID NO: 3378880 - RNA, 15 nt, Human
caaauauauuguuaa

SEQ ID NO: 3378881 - RNA, 17 nt, Human
caaauaucuuguguugu

SEQ ID NO: 3378882 - RNA, 22 nt, Human
caaauaucuuguguuguccuuu

SEQ ID NO: 3378883 - RNA, 18 nt, Human
caaauaugcaaagcacug

SEQ ID NO: 3378884 - RNA, 17 nt, Human
caaauaugcuaauuugg

SEQ ID NO: 3378885 - RNA, 14 nt, Human
caaauauguccugg

SEQ ID NO: 3378886 - RNA, 13 nt, Human
caaauauuaaaaa

SEQ ID NO: 3378887 - RNA, 23 nt, Human
caaauauuaaaaagucuuuuaaa

SEQ ID NO: 3378888 - RNA, 16 nt, Human
caaauauuagauguga

SEQ ID NO: 3378889 - RNA, 18 nt, Human
caaauauucacuggcccc

SEQ ID NO: 3378890 - RNA, 13 nt, Human
caaauauucagaa

SEQ ID NO: 3378891 - RNA, 13 nt, Human
caaauauuccaga

SEQ ID NO: 3378892 - RNA, 18 nt, Human
caaauauuguugacaacu

SEQ ID NO: 3378893 - RNA, 21 nt, Human
caaauauuuagauguaauuuu

SEQ ID NO: 3378894 - RNA, 23 nt, Human
caaauauuuagauguaauuuugu

SEQ ID NO: 3378895 - RNA, 16 nt, Human
caaauauuuauuuucu

SEQ ID NO: 3378896 - RNA, 17 nt, Human
caaaucaacagaagcau

SEQ ID NO: 3378897 - RNA, 14 nt, Human
caaaucaagcuuca

SEQ ID NO: 3378898 - RNA, 16 nt, Human
caaaucaaguuuccaa

SEQ ID NO: 3378899 - RNA, 21 nt, Human
caaaucaaguuuccaagcaaa

SEQ ID NO: 3378900 - RNA, 23 nt, Human
caaaucaaguuuccaagcaaaug

SEQ ID NO: 3378901 - RNA, 17 nt, Human
caaaucaaucuguaaaa

SEQ ID NO: 3378902 - RNA, 16 nt, Human
caaaucaauuacuggu

SEQ ID NO: 3378903 - RNA, 14 nt, Human
caaaucacauauuu

SEQ ID NO: 3378904 - RNA, 20 nt, Human
caaaucaccacaaacuguaa

SEQ ID NO: 3378905 - RNA, 13 nt, Human
caaaucagcugcu

SEQ ID NO: 3378906 - RNA, 13 nt, Human
caaaucaggcuuu

SEQ ID NO: 3378907 - RNA, 23 nt, Human
caaaucagguuuucuuuuaagaa

SEQ ID NO: 3378908 - RNA, 14 nt, Human
caaaucaguuacua

SEQ ID NO: 3378909 - RNA, 20 nt, Human
caaaucaguuacuaagaaga

SEQ ID NO: 3378910 - RNA, 16 nt, Human
caaaucaguuaguuuu

SEQ ID NO: 3378911 - RNA, 13 nt, Human
caaaucauagcug

SEQ ID NO: 3378912 - RNA, 18 nt, Human
caaauccaggacccugcc

SEQ ID NO: 3378913 - RNA, 20 nt, Human
caaauccaggacccugccag

SEQ ID NO: 3378914 - RNA, 22 nt, Human
caaauccaggacccugccaggc

SEQ ID NO: 3378915 - RNA, 16 nt, Human
caaauccauccagaau

SEQ ID NO: 3378916 - RNA, 22 nt, Human
caaauccgaaccuccucuguga

SEQ ID NO: 3378917 - RNA, 17 nt, Human
caaauccgcucucuucc

SEQ ID NO: 3378918 - RNA, 22 nt, Human
caaauccgcucucuuccugccc

SEQ ID NO: 3378919 - RNA, 15 nt, Human
caaauccuaugugau

SEQ ID NO: 3378920 - RNA, 16 nt, Human
caaauccuaugugauu

SEQ ID NO: 3378921 - RNA, 21 nt, Human
caaauccuaugugauuuuaac

SEQ ID NO: 3378922 - RNA, 21 nt, Human
caaauccuuagaucuggcaug

SEQ ID NO: 3378923 - RNA, 18 nt, Human
caaauccuuccaaaaauu

SEQ ID NO: 3378924 - RNA, 19 nt, Human
caaauccuuccaaaaauua

SEQ ID NO: 3378925 - RNA, 19 nt, Human
caaauccuugaagauuuac

SEQ ID NO: 3378926 - RNA, 18 nt, Human
caaaucguagcguuuguu

SEQ ID NO: 3378927 - RNA, 21 nt, Human
caaaucguccagcgaccuucc

SEQ ID NO: 3378928 - RNA, 16 nt, Human
caaaucguuuauuuca

SEQ ID NO: 3378929 - RNA, 18 nt, Human
caaaucuaccacuguaug

SEQ ID NO: 3378930 - RNA, 13 nt, Human
caaaucuauucag

SEQ ID NO: 3378931 - RNA, 14 nt, Human
caaaucuauucaga

SEQ ID NO: 3378932 - RNA, 16 nt, Human
caaaucuauucagaca

SEQ ID NO: 3378933 - RNA, 17 nt, Human
caaaucuauuuaauuag

SEQ ID NO: 3378934 - RNA, 21 nt, Human
caaaucugccuauugcagcug

SEQ ID NO: 3378935 - RNA, 12 nt, Human
caaaucugugua

SEQ ID NO: 3378936 - RNA, 13 nt, Human
caaaucuguguau

SEQ ID NO: 3378937 - RNA, 15 nt, Human
caaaucuguguauau

SEQ ID NO: 3378938 - RNA, 16 nt, Human
caaaucuguguauauu

SEQ ID NO: 3378939 - RNA, 22 nt, Human
caaaucuugguugaugccaaaa

SEQ ID NO: 3378940 - RNA, 20 nt, Human
caaaucuuuccauauccaua

SEQ ID NO: 3378941 - RNA, 19 nt, Human
caaaucuuuuagucauuau

SEQ ID NO: 3378942 - RNA, 13 nt, Human
caaaugaaaugua

SEQ ID NO: 3378943 - RNA, 18 nt, Human
caaaugaaauguaugcau

SEQ ID NO: 3378944 - RNA, 19 nt, Human
caaaugaagacaaaacaua

SEQ ID NO: 3378945 - RNA, 15 nt, Human
caaaugacaugcacu

SEQ ID NO: 3378946 - RNA, 16 nt, Human
caaaugacaugcacug

SEQ ID NO: 3378947 - RNA, 22 nt, Human
caaaugaccagcagauucaaau

SEQ ID NO: 3378948 - RNA, 17 nt, Human
caaaugacccaaagacc

SEQ ID NO: 3378949 - RNA, 20 nt, Human
caaaugacuuuauuauuuau

SEQ ID NO: 3378950 - RNA, 13 nt, Human
caaaugagccaug

SEQ ID NO: 3378951 - RNA, 16 nt, Human
caaaugagcucugaaa

SEQ ID NO: 3378952 - RNA, 20 nt, Human
caaaugagcucugaaaucuu

SEQ ID NO: 3378953 - RNA, 20 nt, Human
caaaugaugugccugcuuca

SEQ ID NO: 3378954 - RNA, 14 nt, Human
caacaauugguaaa

SEQ ID NO: 3378955 - RNA, 16 nt, Human
caacaauuuaugaauu

SEQ ID NO: 3378956 - RNA, 13 nt, Human
caacaauuuucag

SEQ ID NO: 3378957 - RNA, 23 nt, Human
caacaauuuucagauuugcacaa

SEQ ID NO: 3378958 - RNA, 16 nt, Human
caacacaaagagaaaa

SEQ ID NO: 3378959 - RNA, 17 nt, Human
caacacaagcuggaagc

SEQ ID NO: 3378960 - RNA, 21 nt, Human
caacacaaggugggcagggag

SEQ ID NO: 3378961 - RNA, 11 nt, Human
caacacacaga

SEQ ID NO: 3378962 - RNA, 21 nt, Human
caacacacagauuugagcuca

SEQ ID NO: 3378963 - RNA, 16 nt, Human
caacacagaggaauuu

SEQ ID NO: 3378964 - RNA, 14 nt, Human
caacacagaggcag

SEQ ID NO: 3378965 - RNA, 22 nt, Human
caacacagccugggccccagcu

SEQ ID NO: 3378966 - RNA, 15 nt, Human
caacaccaagcacag

SEQ ID NO: 3378967 - RNA, 13 nt, Human
caacaccacagac

SEQ ID NO: 3378968 - RNA, 14 nt, Human
caacaccagccccu

SEQ ID NO: 3378969 - RNA, 22 nt, Human
caacaccaucacagcuuguuuu

SEQ ID NO: 3378970 - RNA, 19 nt, Human
caacaccaugauuccuuua

SEQ ID NO: 3378971 - RNA, 20 nt, Human
caacaccucugcacaagcug

SEQ ID NO: 3378972 - RNA, 18 nt, Human
caacaccucuuggggagu

SEQ ID NO: 3378973 - RNA, 23 nt, Human
caacaccuucagaggcugaggug

SEQ ID NO: 3378974 - RNA, 15 nt, Human
caacacgagcaggcu

SEQ ID NO: 3378975 - RNA, 15 nt, Human
caacacgcaccugcc

SEQ ID NO: 3378976 - RNA, 13 nt, Human
caacacugccagc

SEQ ID NO: 3378977 - RNA, 20 nt, Human
caacacugggaaacagaggc

SEQ ID NO: 3378978 - RNA, 22 nt, Human
caacacuggugugaccugaggg

SEQ ID NO: 3378979 - RNA, 23 nt, Human
caacacuggugugaccugagggc

SEQ ID NO: 3378980 - RNA, 13 nt, Human
caacacugugccc

SEQ ID NO: 3378981 - RNA, 14 nt, Human
caacacugugcccu

SEQ ID NO: 3378982 - RNA, 18 nt, Human
caacacugugcccuggug

SEQ ID NO: 3378983 - RNA, 19 nt, Human
caacacugugcccuggugg

SEQ ID NO: 3378984 - RNA, 22 nt, Human
caacacugugcccugguggaga

SEQ ID NO: 3378985 - RNA, 13 nt, Human
caacacugugggu

SEQ ID NO: 3378986 - RNA, 16 nt, Human
caacagaagcuucaga

SEQ ID NO: 3378987 - RNA, 17 nt, Human
caacagaagcuucagaa

SEQ ID NO: 3378988 - RNA, 15 nt, Human
caacagaagcuucca

SEQ ID NO: 3378989 - RNA, 13 nt, Human
caacagaaugaaa

SEQ ID NO: 3378990 - RNA, 18 nt, Human
caacagaaugaaaaauga

SEQ ID NO: 3378991 - RNA, 19 nt, Human
caacagaaugaaaaaugaa

SEQ ID NO: 3378992 - RNA, 19 nt, Human
caacagagugagacccugu

SEQ ID NO: 3378993 - RNA, 21 nt, Human
caacagaugcuuuucugucuc

SEQ ID NO: 3378994 - RNA, 15 nt, Human
caacagauuggauuu

SEQ ID NO: 3378995 - RNA, 23 nt, Human
caacagauuggauuuuauguuga

SEQ ID NO: 3378996 - RNA, 14 nt, Human
caacagauuuguga

SEQ ID NO: 3378997 - RNA, 16 nt, Human
caacagauuugugaac

SEQ ID NO: 3378998 - RNA, 17 nt, Human
caacagcaaacaggugc

SEQ ID NO: 3378999 - RNA, 12 nt, Human
caacagcacugg

SEQ ID NO: 3379000 - RNA, 22 nt, Human
caacagcacuggcucucuccag

SEQ ID NO: 3379001 - RNA, 23 nt, Human
caacagcgacauagcccaucccu

SEQ ID NO: 3379002 - RNA, 15 nt, Human
caacagcguuccuag

SEQ ID NO: 3379003 - RNA, 14 nt, Human
caacagcuacaaca

SEQ ID NO: 3379004 - RNA, 18 nt, Human
caacagcucgauccaaau

SEQ ID NO: 3379005 - RNA, 16 nt, Human
caacagcuggacccug

SEQ ID NO: 3379006 - RNA, 20 nt, Human
caacagcuggacccugacca

SEQ ID NO: 3379007 - RNA, 14 nt, Human
caacaggaacugug

SEQ ID NO: 3379008 - RNA, 15 nt, Human
caacaggagcuggga

SEQ ID NO: 3379009 - RNA, 19 nt, Human
caacaggaggacaauucau

SEQ ID NO: 3379010 - RNA, 15 nt, Human
caacaggccucaggg

SEQ ID NO: 3379011 - RNA, 12 nt, Human
caacaggcuggg

SEQ ID NO: 3379012 - RNA, 14 nt, Human
caacaggcugggcu

SEQ ID NO: 3379013 - RNA, 17 nt, Human
caacaggcugggcuuca

SEQ ID NO: 3379014 - RNA, 20 nt, Human
caacaggcuguucugcacug

SEQ ID NO: 3379015 - RNA, 23 nt, Human
caacaggcuguucugcacugaaa

SEQ ID NO: 3379016 - RNA, 24 nt, Human
caacaggcuguucugcacugaaaa

SEQ ID NO: 3379017 - RNA, 13 nt, Human
caacagguuuuau

SEQ ID NO: 3379018 - RNA, 16 nt, Human
aucacauguauguuuu

SEQ ID NO: 3379019 - RNA, 15 nt, Human
aucacauuauuugca

SEQ ID NO: 3379020 - RNA, 14 nt, Human
aucacauuucuaug

SEQ ID NO: 3379021 - RNA, 19 nt, Human
aucaccaacgucugugcca

SEQ ID NO: 3379022 - RNA, 20 nt, Human
aucaccaacgucugugccau

SEQ ID NO: 3379023 - RNA, 13 nt, Human
aucaccagacagg

SEQ ID NO: 3379024 - RNA, 15 nt, Human
aucaccagcccggcc

SEQ ID NO: 3379025 - RNA, 23 nt, Human
aucacccgcuaagagggagggag

SEQ ID NO: 3379026 - RNA, 16 nt, Human
aucacccucuuccugu

SEQ ID NO: 3379027 - RNA, 21 nt, Human
aucaccgaaaacguggcugcu

SEQ ID NO: 3379028 - RNA, 19 nt, Human
aucaccgaugcaaacauug

SEQ ID NO: 3379029 - RNA, 15 nt, Human
aucaccuagaaacuu

SEQ ID NO: 3379030 - RNA, 19 nt, Human
aucaccucagauggcagcu

SEQ ID NO: 3379031 - RNA, 22 nt, Human
aucaccucagauggcagcuuuu

SEQ ID NO: 3379032 - RNA, 15 nt, Human
aucaccucaggccag

SEQ ID NO: 3379033 - RNA, 13 nt, Human
aucaccuccccuc

SEQ ID NO: 3379034 - RNA, 20 nt, Human
aucaccucuguaauuuuuca

SEQ ID NO: 3379035 - RNA, 12 nt, Human
aucaccugccug

SEQ ID NO: 3379036 - RNA, 12 nt, Human
aucaccugucuu

SEQ ID NO: 3379037 - RNA, 21 nt, Human
aucaccugucuugccuuuuuc

SEQ ID NO: 3379038 - RNA, 17 nt, Human
aucaccuuaggcaggga

SEQ ID NO: 3379039 - RNA, 18 nt, Human
aucacgauguaaauuauu

SEQ ID NO: 3379040 - RNA, 13 nt, Human
aucacgccacugc

SEQ ID NO: 3379041 - RNA, 15 nt, Human
aucacgccacugcac

SEQ ID NO: 3379042 - RNA, 20 nt, Human
aucacgccacugcacuccag

SEQ ID NO: 3379043 - RNA, 14 nt, Human
aucacgcuuuccug

SEQ ID NO: 3379044 - RNA, 21 nt, Human
aucacguaaagcuagaaauga

SEQ ID NO: 3379045 - RNA, 13 nt, Human
aucacguguacug

SEQ ID NO: 3379046 - RNA, 17 nt, Human
aucacguuaaaguagga

SEQ ID NO: 3379047 - RNA, 21 nt, Human
aucacguuagaggaaaaauau

SEQ ID NO: 3379048 - RNA, 20 nt, Human
aucacuaauacuaauucauu

SEQ ID NO: 3379049 - RNA, 23 nt, Human
aucacuacaguauuacucuuaca

SEQ ID NO: 3379050 - RNA, 13 nt, Human
aucacuacugcag

SEQ ID NO: 3379051 - RNA, 14 nt, Human
aucacuagccuguc

SEQ ID NO: 3379052 - RNA, 12 nt, Human
aucacucaccau

SEQ ID NO: 3379053 - RNA, 15 nt, Human
aucacucauuaauua

SEQ ID NO: 3379054 - RNA, 16 nt, Human
aucacucauuaauuaa

SEQ ID NO: 3379055 - RNA, 16 nt, Human
aucacucugugucuga

SEQ ID NO: 3379056 - RNA, 21 nt, Human
aucacucuguucauuccucca

SEQ ID NO: 3379057 - RNA, 22 nt, Human
aucacugaaaccuuuaagaaaa

SEQ ID NO: 3379058 - RNA, 17 nt, Human
aucacugaacaaacuaa

SEQ ID NO: 3379059 - RNA, 20 nt, Human
aucacugaacaaacuaaagg

SEQ ID NO: 3379060 - RNA, 15 nt, Human
aucacugaguuuucc

SEQ ID NO: 3379061 - RNA, 12 nt, Human
aucacugccaca

SEQ ID NO: 3379062 - RNA, 21 nt, Human
aucacugccacacucuccauc

SEQ ID NO: 3379063 - RNA, 19 nt, Human
aucacuggagcaccaggca

SEQ ID NO: 3379064 - RNA, 17 nt, Human
aucacuggagcccagga

SEQ ID NO: 3379065 - RNA, 16 nt, Human
aucacuggcaaugaaa

SEQ ID NO: 3379066 - RNA, 19 nt, Human
aucacuguaucauuuucuu

SEQ ID NO: 3379067 - RNA, 15 nt, Human
aucacugucuuuccu

SEQ ID NO: 3379068 - RNA, 22 nt, Human
aucacugugcaguugcuguuua

SEQ ID NO: 3379069 - RNA, 14 nt, Human
aucacuguggcugu

SEQ ID NO: 3379070 - RNA, 18 nt, Human
aucacuguguauauuuga

SEQ ID NO: 3379071 - RNA, 16 nt, Human
aucacuguucaugcug

SEQ ID NO: 3379072 - RNA, 15 nt, Human
aucacuguuuagauu

SEQ ID NO: 3379073 - RNA, 16 nt, Human
aucacuguuuagauuu

SEQ ID NO: 3379074 - RNA, 18 nt, Human
aucacuuaaaacacguuu

SEQ ID NO: 3379075 - RNA, 14 nt, Human
aucacuuaaaguca

SEQ ID NO: 3379076 - RNA, 14 nt, Human
aucacuuccaugac

SEQ ID NO: 3379077 - RNA, 17 nt, Human
aucacuuguuguuuuac

SEQ ID NO: 3379078 - RNA, 20 nt, Human
aucacuuucucaguuuucau

SEQ ID NO: 3379079 - RNA, 22 nt, Human
aucacuuugagccugggaaaua

SEQ ID NO: 3379080 - RNA, 23 nt, Human
aucacuuugagccugggaaauaa

SEQ ID NO: 3379081 - RNA, 12 nt, Human
aucacuuugcuc

SEQ ID NO: 3379082 - RNA, 15 nt, Human
aucacuuuuugaacu

SEQ ID NO: 3379083 - RNA, 16 nt, Human
aucacuuuuugaacua

SEQ ID NO: 3379084 - RNA, 21 nt, Human
aucacuuuuugaacuaagaaa

SEQ ID NO: 3379085 - RNA, 22 nt, Human
aucacuuuuugaacuaagaaac

SEQ ID NO: 3379086 - RNA, 17 nt, Human
aucagaaaaauggagca

SEQ ID NO: 3379087 - RNA, 20 nt, Human
aucagaaacacccucacacu

SEQ ID NO: 3379088 - RNA, 19 nt, Human
aucagaaagcuuuauuuug

SEQ ID NO: 3379089 - RNA, 16 nt, Human
aucagaaagggagggc

SEQ ID NO: 3379090 - RNA, 17 nt, Human
aucagaaagggagggcu

SEQ ID NO: 3379091 - RNA, 19 nt, Human
aucagaaagggagggcucu

SEQ ID NO: 3379092 - RNA, 11 nt, Human
aucagaaaugu

SEQ ID NO: 3379093 - RNA, 13 nt, Human
aucagaacagcug

SEQ ID NO: 3379094 - RNA, 23 nt, Human
aucagaacucaaauggggccaga

SEQ ID NO: 3379095 - RNA, 22 nt, Human
aucagaagaccacaaaaauuga

SEQ ID NO: 3379096 - RNA, 23 nt, Human
aucagaagccuauuguaaauaca

SEQ ID NO: 3379097 - RNA, 12 nt, Human
aucagaauucuc

SEQ ID NO: 3379098 - RNA, 18 nt, Human
aucagacccuaccccacc

SEQ ID NO: 3379099 - RNA, 17 nt, Human
caaccauggacuuuaua

SEQ ID NO: 3379100 - RNA, 14 nt, Human
caaccauuccagac

SEQ ID NO: 3379101 - RNA, 22 nt, Human
caaccauuccagacugcuucca

SEQ ID NO: 3379102 - RNA, 13 nt, Human
caaccauuuaucu

SEQ ID NO: 3379103 - RNA, 16 nt, Human
caaccauuuaucuuga

SEQ ID NO: 3379104 - RNA, 17 nt, Human
caaccauuuaucuugaa

SEQ ID NO: 3379105 - RNA, 22 nt, Human
caaccauuuaucuugaaggaaa

SEQ ID NO: 3379106 - RNA, 16 nt, Human
caacccaaaccuggag

SEQ ID NO: 3379107 - RNA, 14 nt, Human
caacccaaugggcu

SEQ ID NO: 3379108 - RNA, 11 nt, Human
caacccagccg

SEQ ID NO: 3379109 - RNA, 14 nt, Human
caacccagccgcug

SEQ ID NO: 3379110 - RNA, 18 nt, Human
caacccagccgcugcccg

SEQ ID NO: 3379111 - RNA, 18 nt, Human
caaccccaaacccaagug

SEQ ID NO: 3379112 - RNA, 16 nt, Human
caaccccacccuguuu

SEQ ID NO: 3379113 - RNA, 16 nt, Human
caaccccagacacugg

SEQ ID NO: 3379114 - RNA, 15 nt, Human
caaccccagccgcuc

SEQ ID NO: 3379115 - RNA, 13 nt, Human
caaccccaggcug

SEQ ID NO: 3379116 - RNA, 14 nt, Human
caaccccaguucug

SEQ ID NO: 3379117 - RNA, 20 nt, Human
caaccccaguucugcuccuc

SEQ ID NO: 3379118 - RNA, 12 nt, Human
caacccccaccc

SEQ ID NO: 3379119 - RNA, 17 nt, Human
caacccccaccccacac

SEQ ID NO: 3379120 - RNA, 15 nt, Human
caacccccagcaccc

SEQ ID NO: 3379121 - RNA, 17 nt, Human
caacccccagccugcua

SEQ ID NO: 3379122 - RNA, 16 nt, Human
caacccccagcucccg

SEQ ID NO: 3379123 - RNA, 17 nt, Human
caaccccccaccugcca

SEQ ID NO: 3379124 - RNA, 16 nt, Human
caaccccccagcacug

SEQ ID NO: 3379125 - RNA, 21 nt, Human
caaccccuccccuccaucccu

SEQ ID NO: 3379126 - RNA, 22 nt, Human
caaccccuccccuccaucccug

SEQ ID NO: 3379127 - RNA, 12 nt, Human
caaccccuggac

SEQ ID NO: 3379128 - RNA, 12 nt, Human
caaccccugugg

SEQ ID NO: 3379129 - RNA, 22 nt, Human
caaccccuucgcuccugugucu

SEQ ID NO: 3379130 - RNA, 16 nt, Human
caacccgaggcccgca

SEQ ID NO: 3379131 - RNA, 17 nt, Human
caacccguggaggcugc

SEQ ID NO: 3379132 - RNA, 18 nt, Human
caacccuagguucccugu

SEQ ID NO: 3379133 - RNA, 22 nt, Human
caacccuagguucccuguucuu

SEQ ID NO: 3379134 - RNA, 16 nt, Human
caacccuaucuccuga

SEQ ID NO: 3379135 - RNA, 22 nt, Human
caacccuaucuccugacagaag

SEQ ID NO: 3379136 - RNA, 21 nt, Human
caacccucagggcaaagccag

SEQ ID NO: 3379137 - RNA, 22 nt, Human
caacccucagggcaaagccagg

SEQ ID NO: 3379138 - RNA, 18 nt, Human
caacccucaggggaaaac

SEQ ID NO: 3379139 - RNA, 12 nt, Human
caacccucauca

SEQ ID NO: 3379140 - RNA, 18 nt, Human
caacccucccucagcccc

SEQ ID NO: 3379141 - RNA, 19 nt, Human
caacccuccuaaaaguuca

SEQ ID NO: 3379142 - RNA, 22 nt, Human
caacccugcaaaggacuguuuu

SEQ ID NO: 3379143 - RNA, 23 nt, Human
caacccugccccugccccgucac

SEQ ID NO: 3379144 - RNA, 20 nt, Human
caacccugccgucaccacca

SEQ ID NO: 3379145 - RNA, 20 nt, Human
caacccuggggaaggagcca

SEQ ID NO: 3379146 - RNA, 21 nt, Human
caacccuggggaaggagccag

SEQ ID NO: 3379147 - RNA, 13 nt, Human
caacccuguuucc

SEQ ID NO: 3379148 - RNA, 19 nt, Human
caacccuuaccccuuagcc

SEQ ID NO: 3379149 - RNA, 22 nt, Human
caacccuuaccccuuagccucc

SEQ ID NO: 3379150 - RNA, 13 nt, Human
caacccuucccca

SEQ ID NO: 3379151 - RNA, 20 nt, Human
caacccuucuccucuuguaa

SEQ ID NO: 3379152 - RNA, 19 nt, Human
caacccuucuucauguuca

SEQ ID NO: 3379153 - RNA, 19 nt, Human
caacccuuuugucugccuc

SEQ ID NO: 3379154 - RNA, 18 nt, Human
caaccgacaggcccuggc

SEQ ID NO: 3379155 - RNA, 14 nt, Human
caaccgagaagguu

SEQ ID NO: 3379156 - RNA, 17 nt, Human
caaccgaugcuccagcc

SEQ ID NO: 3379157 - RNA, 18 nt, Human
caaccguggcccuuccug

SEQ ID NO: 3379158 - RNA, 14 nt, Human
caaccuaaccugug

SEQ ID NO: 3379159 - RNA, 17 nt, Human
caaccuaaccugugucu

SEQ ID NO: 3379160 - RNA, 19 nt, Human
caaccuaaccugugucugc

SEQ ID NO: 3379161 - RNA, 22 nt, Human
caaccuaccaccccuuccuguc

SEQ ID NO: 3379162 - RNA, 16 nt, Human
caaccuauuuugaagu

SEQ ID NO: 3379163 - RNA, 11 nt, Human
caaccucagca

SEQ ID NO: 3379164 - RNA, 14 nt, Human
caaccucagcaacc

SEQ ID NO: 3379165 - RNA, 15 nt, Human
caaccucagggcucc

SEQ ID NO: 3379166 - RNA, 20 nt, Human
caaccucagggcucccaggg

SEQ ID NO: 3379167 - RNA, 15 nt, Human
caaccucauccucuc

SEQ ID NO: 3379168 - RNA, 14 nt, Human
caaccucauugaca

SEQ ID NO: 3379169 - RNA, 17 nt, Human
caaccucccaacccaga

SEQ ID NO: 3379170 - RNA, 13 nt, Human
caaccucccucuu

SEQ ID NO: 3379171 - RNA, 15 nt, Human
caaccucccucuugu

SEQ ID NO: 3379172 - RNA, 18 nt, Human
caaccucccucuuguuuu

SEQ ID NO: 3379173 - RNA, 20 nt, Human
caaccucccucuuguuuugu

SEQ ID NO: 3379174 - RNA, 19 nt, Human
caaccuccgccucccgggu

SEQ ID NO: 3379175 - RNA, 17 nt, Human
caaccucgcuccaacuc

SEQ ID NO: 3379176 - RNA, 16 nt, Human
caaccucgcugagggc

SEQ ID NO: 3379177 - RNA, 17 nt, Human
caaccucggcuccugga

SEQ ID NO: 3379178 - RNA, 15 nt, Human
caaaaagugcuucau

SEQ ID NO: 3379179 - RNA, 17 nt, Human
caaaaaguguuuauuuu

SEQ ID NO: 3379180 - RNA, 23 nt, Human
caaaaauaaacuauaaaacaaaa

SEQ ID NO: 3379181 - RNA, 14 nt, Human
caaaaauaaauuua

SEQ ID NO: 3379182 - RNA, 22 nt, Human
caaaaauauuuuaugauccagc

SEQ ID NO: 3379183 - RNA, 14 nt, Human
caaaaaucagccag

SEQ ID NO: 3379184 - RNA, 17 nt, Human
caaaaaucagccagaca

SEQ ID NO: 3379185 - RNA, 19 nt, Human
caaaaaucucaauauuuca

SEQ ID NO: 3379186 - RNA, 17 nt, Human
caaaaaucugaagauug

SEQ ID NO: 3379187 - RNA, 21 nt, Human
caaaaaucugaagauuguuua

SEQ ID NO: 3379188 - RNA, 15 nt, Human
caaaaaugcuaauau

SEQ ID NO: 3379189 - RNA, 21 nt, Human
caaaaaugcuaauauuaaaag

SEQ ID NO: 3379190 - RNA, 21 nt, Human
caaaaauguacaaaauaaagu

SEQ ID NO: 3379191 - RNA, 11 nt, Human
caaaaauguug

SEQ ID NO: 3379192 - RNA, 14 nt, Human
caaaaauguugaac

SEQ ID NO: 3379193 - RNA, 17 nt, Human
caaaaauuagccgggca

SEQ ID NO: 3379194 - RNA, 17 nt, Human
caaaaauuaucuauagc

SEQ ID NO: 3379195 - RNA, 19 nt, Human
caaaaauuaucuauagcua

SEQ ID NO: 3379196 - RNA, 21 nt, Human
caaaaauuaucuauuuguaua

SEQ ID NO: 3379197 - RNA, 20 nt, Human
caaaaauucacaagcugccu

SEQ ID NO: 3379198 - RNA, 23 nt, Human
caaaaauucacaagcugccuccc

SEQ ID NO: 3379199 - RNA, 21 nt, Human
caaaaauuucuguaaaacagg

SEQ ID NO: 3379200 - RNA, 22 nt, Human
caaaaauuugaaccaaaacauu

SEQ ID NO: 3379201 - RNA, 20 nt, Human
caaaaauuuggaauucuguu

SEQ ID NO: 3379202 - RNA, 21 nt, Human
caaaaauuuuuggauugacag

SEQ ID NO: 3379203 - RNA, 11 nt, Human
caaaacaaaaa

SEQ ID NO: 3379204 - RNA, 17 nt, Human
caaaacaaaacaaaacu

SEQ ID NO: 3379205 - RNA, 12 nt, Human
caaaacaaaggc

SEQ ID NO: 3379206 - RNA, 16 nt, Human
caaaacaaagucuuug

SEQ ID NO: 3379207 - RNA, 15 nt, Human
caaaacaacauuuug

SEQ ID NO: 3379208 - RNA, 16 nt, Human
caaaacaauguuuaaa

SEQ ID NO: 3379209 - RNA, 18 nt, Human
caaaacaauguuuaaacc

SEQ ID NO: 3379210 - RNA, 22 nt, Human
caaaacacacgcgcgcacacac

SEQ ID NO: 3379211 - RNA, 23 nt, Human
caaaacagcguuuaagacuguaa

SEQ ID NO: 3379212 - RNA, 22 nt, Human
caaaacaugcuaccugauccca

SEQ ID NO: 3379213 - RNA, 17 nt, Human
caaaaccaaaaguuauu

SEQ ID NO: 3379214 - RNA, 15 nt, Human
caaaacccagcugca

SEQ ID NO: 3379215 - RNA, 18 nt, Human
caaaacccagcugcaccc

SEQ ID NO: 3379216 - RNA, 16 nt, Human
caaaacccaugcauuu

SEQ ID NO: 3379217 - RNA, 17 nt, Human
caaaaccgccagcucug

SEQ ID NO: 3379218 - RNA, 18 nt, Human
caaaaccgccagcucugu

SEQ ID NO: 3379219 - RNA, 20 nt, Human
caaaaccgccagcucuguuc

SEQ ID NO: 3379220 - RNA, 15 nt, Human
caaaaccuuuuacug

SEQ ID NO: 3379221 - RNA, 21 nt, Human
caaaacgguuuuacugcagcu

SEQ ID NO: 3379222 - RNA, 13 nt, Human
caaaacgucuuau

SEQ ID NO: 3379223 - RNA, 18 nt, Human
caaaacuccgcccccagc

SEQ ID NO: 3379224 - RNA, 16 nt, Human
caaaacuccugucuuu

SEQ ID NO: 3379225 - RNA, 19 nt, Human
caaaacucuacuuaaucca

SEQ ID NO: 3379226 - RNA, 22 nt, Human
caaaacucuccucugcugcugg

SEQ ID NO: 3379227 - RNA, 14 nt, Human
caaaacugcacugu

SEQ ID NO: 3379228 - RNA, 21 nt, Human
caaaacuucguuuaaugaaug

SEQ ID NO: 3379229 - RNA, 11 nt, Human
caaaacuucuu

SEQ ID NO: 3379230 - RNA, 20 nt, Human
caaaacuucuugucagacau

SEQ ID NO: 3379231 - RNA, 18 nt, Human
caaaagaaagaaaaucag

SEQ ID NO: 3379232 - RNA, 19 nt, Human
caaaagaacaagaauuucu

SEQ ID NO: 3379233 - RNA, 13 nt, Human
caaaagaagcccc

SEQ ID NO: 3379234 - RNA, 17 nt, Human
caaaagaaguaaaagca

SEQ ID NO: 3379235 - RNA, 19 nt, Human
caaaagaaguaaaagcaaa

SEQ ID NO: 3379236 - RNA, 19 nt, Human
caaaagaaguaacaagagu

SEQ ID NO: 3379237 - RNA, 13 nt, Human
caaaagacaauuc

SEQ ID NO: 3379238 - RNA, 21 nt, Human
caaaagacaauucuuuauaca

SEQ ID NO: 3379239 - RNA, 23 nt, Human
caaaagacaauucuuuauacaac

SEQ ID NO: 3379240 - RNA, 14 nt, Human
caaaagagaaaaaa

SEQ ID NO: 3379241 - RNA, 15 nt, Human
caaaagaguguaaaa

SEQ ID NO: 3379242 - RNA, 19 nt, Human
caaaagcaucuaugugaga

SEQ ID NO: 3379243 - RNA, 18 nt, Human
caaaagccuuguguauau

SEQ ID NO: 3379244 - RNA, 19 nt, Human
auccugaacugcuucucca

SEQ ID NO: 3379245 - RNA, 24 nt, Human
auccugaccagcugcuccgaggac

SEQ ID NO: 3379246 - RNA, 21 nt, Human
auccugacuauuauguuguua

SEQ ID NO: 3379247 - RNA, 15 nt, Human
auccugacucugccc

SEQ ID NO: 3379248 - RNA, 23 nt, Human
auccugacuucuaauaucauuca

SEQ ID NO: 3379249 - RNA, 12 nt, Human
auccugagccag

SEQ ID NO: 3379250 - RNA, 15 nt, Human
auccugagccagauu

SEQ ID NO: 3379251 - RNA, 17 nt, Human
auccugagccagauuuc

SEQ ID NO: 3379252 - RNA, 13 nt, Human
auccugagccccg

SEQ ID NO: 3379253 - RNA, 11 nt, Human
auccugaggcu

SEQ ID NO: 3379254 - RNA, 16 nt, Human
auccugaggcuccacu

SEQ ID NO: 3379255 - RNA, 15 nt, Human
auccugcacugacuc

SEQ ID NO: 3379256 - RNA, 20 nt, Human
auccugcagccuccuccuga

SEQ ID NO: 3379257 - RNA, 13 nt, Human
auccugccagccc

SEQ ID NO: 3379258 - RNA, 21 nt, Human
auccugccagccccacacagc

SEQ ID NO: 3379259 - RNA, 22 nt, Human
auccugcccccugaaacuuauu

SEQ ID NO: 3379260 - RNA, 12 nt, Human
auccugccugcc

SEQ ID NO: 3379261 - RNA, 22 nt, Human
auccugccuuagagccaggcac

SEQ ID NO: 3379262 - RNA, 23 nt, Human
auccugccuuagagccaggcaca

SEQ ID NO: 3379263 - RNA, 21 nt, Human
auccugccuucauggaacuca

SEQ ID NO: 3379264 - RNA, 20 nt, Human
auccuggaacaauauuuuau

SEQ ID NO: 3379265 - RNA, 19 nt, Human
auccuggaggcccaguuca

SEQ ID NO: 3379266 - RNA, 20 nt, Human
auccuggaggcccaguucac

SEQ ID NO: 3379267 - RNA, 17 nt, Human
auccuggcacccggccc

SEQ ID NO: 3379268 - RNA, 21 nt, Human
auccuggcacccggccccugc

SEQ ID NO: 3379269 - RNA, 19 nt, Human
auccuggcagcccagagac

SEQ ID NO: 3379270 - RNA, 17 nt, Human
auccuggccaacauggu

SEQ ID NO: 3379271 - RNA, 12 nt, Human
auccuggcccau

SEQ ID NO: 3379272 - RNA, 13 nt, Human
auccuggcccauc

SEQ ID NO: 3379273 - RNA, 16 nt, Human
auccuggcccaucagu

SEQ ID NO: 3379274 - RNA, 16 nt, Human
auccuggggcucccuu

SEQ ID NO: 3379275 - RNA, 20 nt, Human
auccuggggcucccuucauc

SEQ ID NO: 3379276 - RNA, 11 nt, Human
auccuggguaa

SEQ ID NO: 3379277 - RNA, 22 nt, Human
auccugguuccuaggggaauga

SEQ ID NO: 3379278 - RNA, 16 nt, Human
auccuguauucagaca

SEQ ID NO: 3379279 - RNA, 21 nt, Human
auccuguauucagacagauga

SEQ ID NO: 3379280 - RNA, 20 nt, Human
auccugucaucugagaauga

SEQ ID NO: 3379281 - RNA, 21 nt, Human
auccugucgauuagacuggac

SEQ ID NO: 3379282 - RNA, 18 nt, Human
auccugucuuucugagca

SEQ ID NO: 3379283 - RNA, 12 nt, Human
auccugugaagu

SEQ ID NO: 3379284 - RNA, 15 nt, Human
auccugugacaugua

SEQ ID NO: 3379285 - RNA, 21 nt, Human
auccugugacugucucacuua

SEQ ID NO: 3379286 - RNA, 11 nt, Human
auccugugagg

SEQ ID NO: 3379287 - RNA, 14 nt, Human
auccuguguagcau

SEQ ID NO: 3379288 - RNA, 16 nt, Human
auccuguguggagagg

SEQ ID NO: 3379289 - RNA, 18 nt, Human
auccuguguggagaggga

SEQ ID NO: 3379290 - RNA, 19 nt, Human
auccuguguggagagggaa

SEQ ID NO: 3379291 - RNA, 21 nt, Human
auccuguguggagagggaaug

SEQ ID NO: 3379292 - RNA, 22 nt, Human
auccuguguggagagggaaugu

SEQ ID NO: 3379293 - RNA, 11 nt, Human
auccugugugu

SEQ ID NO: 3379294 - RNA, 12 nt, Human
auccuguguguu

SEQ ID NO: 3379295 - RNA, 19 nt, Human
auccuguguguuaagcucu

SEQ ID NO: 3379296 - RNA, 14 nt, Human
auccuguugaaaag

SEQ ID NO: 3379297 - RNA, 15 nt, Human
auccuguugaaaagc

SEQ ID NO: 3379298 - RNA, 15 nt, Human
auccuuaaaucuuaa

SEQ ID NO: 3379299 - RNA, 22 nt, Human
auccuuaaaucuuaauguuccu

SEQ ID NO: 3379300 - RNA, 14 nt, Human
auccuuacaaauga

SEQ ID NO: 3379301 - RNA, 17 nt, Human
auccuuacaaaugauug

SEQ ID NO: 3379302 - RNA, 21 nt, Human
auccuuacaaaugauugcuuu

SEQ ID NO: 3379303 - RNA, 19 nt, Human
auccuuagagguccucugg

SEQ ID NO: 3379304 - RNA, 20 nt, Human
auccuuagagguccucugga

SEQ ID NO: 3379305 - RNA, 14 nt, Human
auccuuagaucugg

SEQ ID NO: 3379306 - RNA, 15 nt, Human
auccuuagcaacagc

SEQ ID NO: 3379307 - RNA, 15 nt, Human
auccuuaucagagcu

SEQ ID NO: 3379308 - RNA, 16 nt, Human
auccuuaucagagcua

SEQ ID NO: 3379309 - RNA, 20 nt, Human
auccuucaagaacucugggc

SEQ ID NO: 3379310 - RNA, 17 nt, Human
auccuucaucuuuuaaa

SEQ ID NO: 3379311 - RNA, 20 nt, Human
auccuuccaaaaauuauuau

SEQ ID NO: 3379312 - RNA, 23 nt, Human
auccuuccaaaaauuauuauaag

SEQ ID NO: 3379313 - RNA, 20 nt, Human
auccuuccaaagaauucuua

SEQ ID NO: 3379314 - RNA, 14 nt, Human
auccuuccauucca

SEQ ID NO: 3379315 - RNA, 12 nt, Human
auccuucccaag

SEQ ID NO: 3379316 - RNA, 22 nt, Human
auccuucccaaguaagaggcug

SEQ ID NO: 3379317 - RNA, 15 nt, Human
auccuuccuauaacu

SEQ ID NO: 3379318 - RNA, 17 nt, Human
auccuuccuauaacuug

SEQ ID NO: 3379319 - RNA, 22 nt, Human
auccuuccuauaacuugaugca

SEQ ID NO: 3379320 - RNA, 17 nt, Human
auccuuccucacaccag

SEQ ID NO: 3379321 - RNA, 11 nt, Human
auccuuccucc

SEQ ID NO: 3379322 - RNA, 13 nt, Human
auccuuccuccca

SEQ ID NO: 3379323 - RNA, 15 nt, Human
auccuuccucuccuu

SEQ ID NO: 3379324 - RNA, 16 nt, Human
auccuuccuucccacc

SEQ ID NO: 3379325 - RNA, 13 nt, Human
auccuucuaaucu

SEQ ID NO: 3379326 - RNA, 13 nt, Human
auccuucugccuu

SEQ ID NO: 3379327 - RNA, 21 nt, Human
auccuucuggcagauucaaau

SEQ ID NO: 3379328 - RNA, 15 nt, Human
auccuugaagguaua

SEQ ID NO: 3379329 - RNA, 23 nt, Human
auccuugaagguauaucuagguu

SEQ ID NO: 3379330 - RNA, 22 nt, Human
auccuugaugcaagugcaaccu

SEQ ID NO: 3379331 - RNA, 15 nt, Human
auccuuggcaccaaa

SEQ ID NO: 3379332 - RNA, 15 nt, Human
auccuugucaguugu

SEQ ID NO: 3379333 - RNA, 21 nt, Human
auccuuuaggguucugccucu

SEQ ID NO: 3379334 - RNA, 18 nt, Human
auccuuucacuucuuucc

SEQ ID NO: 3379335 - RNA, 20 nt, Human
auccuuucauauaguuagcu

SEQ ID NO: 3379336 - RNA, 19 nt, Human
auccuuuccucauuaaauu

SEQ ID NO: 3379337 - RNA, 22 nt, Human
auccuuuccucauuaaauuacc

SEQ ID NO: 3379338 - RNA, 15 nt, Human
auccuuucuauugaa

SEQ ID NO: 3379339 - RNA, 19 nt, Human
auccuuucugccucucaac

SEQ ID NO: 3379340 - RNA, 15 nt, Human
auccuuugugaaaaa

SEQ ID NO: 3379341 - RNA, 17 nt, Human
auccuuuuagucugcau

SEQ ID NO: 3379342 - RNA, 19 nt, Human
auccuuuuagucugcauau

SEQ ID NO: 3379343 - RNA, 12 nt, Human
auccuuuucucc

SEQ ID NO: 3379344 - RNA, 15 nt, Human
auccuuuucugcaga

SEQ ID NO: 3379345 - RNA, 13 nt, Human
auccuuuuguaga

SEQ ID NO: 3379346 - RNA, 13 nt, Human
auccuuuuuuaaa

SEQ ID NO: 3379347 - RNA, 20 nt, Human
aucgaaauaacaauguuaag

SEQ ID NO: 3379348 - RNA, 23 nt, Human
aucgaaauaacaauguuaaggaa

SEQ ID NO: 3379349 - RNA, 20 nt, Human
aucgaaucuacuaauuccac

SEQ ID NO: 3379350 - RNA, 14 nt, Human
aucgaccugccucg

SEQ ID NO: 3379351 - RNA, 15 nt, Human
aucgagaccauccug

SEQ ID NO: 3379352 - RNA, 16 nt, Human
aucgagaccauccugg

SEQ ID NO: 3379353 - RNA, 21 nt, Human
aucgagugagacaaaauuuua

SEQ ID NO: 3379354 - RNA, 21 nt, Human
aucgagugccgcaucucacag

SEQ ID NO: 3379355 - RNA, 22 nt, Human
aucgagugccgcaucucacagc

SEQ ID NO: 3379356 - RNA, 13 nt, Human
aucgaugcagugc

SEQ ID NO: 3379357 - RNA, 23 nt, Human
aucgaugggggagucugaagcag

SEQ ID NO: 3379358 - RNA, 20 nt, Human
aucgaugggggaugcuucau

SEQ ID NO: 3379359 - RNA, 21 nt, Human
aucgaugggggaugcuucaug

SEQ ID NO: 3379360 - RNA, 13 nt, Human
aucgauguuaugu

SEQ ID NO: 3379361 - RNA, 12 nt, Human
aucgauuggcuu

SEQ ID NO: 3379362 - RNA, 17 nt, Human
aucgcacucuggcagca

SEQ ID NO: 3379363 - RNA, 20 nt, Human
aucgcacucuggcagcaccg

SEQ ID NO: 3379364 - RNA, 19 nt, Human
aucgccagaggugcuucac

SEQ ID NO: 3379365 - RNA, 19 nt, Human
aucgcccuccacaucccug

SEQ ID NO: 3379366 - RNA, 12 nt, Human
aucgccuucccc

SEQ ID NO: 3379367 - RNA, 21 nt, Human
aucgcucguguguucuaucca

SEQ ID NO: 3379368 - RNA, 23 nt, Human
aucgcucguguguucuauccaaa

SEQ ID NO: 3379369 - RNA, 15 nt, Human
aucgcugacuucaug

SEQ ID NO: 3379370 - RNA, 21 nt, Human
aucgcugggaaaugagaugac

SEQ ID NO: 3379371 - RNA, 22 nt, Human
aucgcuguguguuaguucccaa

SEQ ID NO: 3379372 - RNA, 13 nt, Human
aucggaaaaauaa

SEQ ID NO: 3379373 - RNA, 15 nt, Human
aucggaaaaauaauc

SEQ ID NO: 3379374 - RNA, 14 nt, Human
caaaucuaccacug

SEQ ID NO: 3379375 - RNA, 22 nt, Human
caaaucuauucagacaagcaac

SEQ ID NO: 3379376 - RNA, 21 nt, Human
caaaucucaaugaagccagcu

SEQ ID NO: 3379377 - RNA, 16 nt, Human
caaaucugauggccuu

SEQ ID NO: 3379378 - RNA, 21 nt, Human
caaaucuggcuccuuuacaaa

SEQ ID NO: 3379379 - RNA, 21 nt, Human
caaaucuuaacuugaaggagu

SEQ ID NO: 3379380 - RNA, 14 nt, Human
caaaucuuaagaaa

SEQ ID NO: 3379381 - RNA, 22 nt, Human
caaaucuuccuggucgaaaguu

SEQ ID NO: 3379382 - RNA, 12 nt, Human
caaaucuugaaa

SEQ ID NO: 3379383 - RNA, 13 nt, Human
caaaucuugaaau

SEQ ID NO: 3379384 - RNA, 19 nt, Human
caaaucuugaaauuaagaa

SEQ ID NO: 3379385 - RNA, 18 nt, Human
caaaugaaauauauuuaa

SEQ ID NO: 3379386 - RNA, 22 nt, Human
caaaugaauaaugccuuuguaa

SEQ ID NO: 3379387 - RNA, 14 nt, Human
caaaugacaugcac

SEQ ID NO: 3379388 - RNA, 15 nt, Human
aucuauuuuuggagg

SEQ ID NO: 3379389 - RNA, 23 nt, Human
aucuauuuuuggcagucugaauu

SEQ ID NO: 3379390 - RNA, 15 nt, Human
aucucaaaacugcac

SEQ ID NO: 3379391 - RNA, 20 nt, Human
aucucaaaacugcacuguca

SEQ ID NO: 3379392 - RNA, 15 nt, Human
aucucaaacaauuga

SEQ ID NO: 3379393 - RNA, 14 nt, Human
aucucaaauaacua

SEQ ID NO: 3379394 - RNA, 15 nt, Human
caagguucuccaaca

SEQ ID NO: 3379395 - RNA, 21 nt, Human
caagguuggagcccagggcau

SEQ ID NO: 3379396 - RNA, 20 nt, Human
caagguuuaaagagucuaga

SEQ ID NO: 3379397 - RNA, 21 nt, Human
caagguuuaggcugguggccc

SEQ ID NO: 3379398 - RNA, 23 nt, Human
caagguuuaggcugguggcccag

SEQ ID NO: 3379399 - RNA, 24 nt, Human
caagguuuaggcugguggcccagg

SEQ ID NO: 3379400 - RNA, 13 nt, Human
caagguuuuaggu

SEQ ID NO: 3379401 - RNA, 20 nt, Human
caagguuuuagguucuaaag

SEQ ID NO: 3379402 - RNA, 21 nt, Human
caagguuuuagguucuaaagu

SEQ ID NO: 3379403 - RNA, 10 nt, Human
caaguaaaaa

SEQ ID NO: 3379404 - RNA, 22 nt, Human
caaguaagaagacaugaaccaa

SEQ ID NO: 3379405 - RNA, 20 nt, Human
caaguaagaggcuggaguug

SEQ ID NO: 3379406 - RNA, 15 nt, Human
caaguaauacaaacu

SEQ ID NO: 3379407 - RNA, 16 nt, Human
caaguaauucugcugu

SEQ ID NO: 3379408 - RNA, 19 nt, Human
caaguacaaccacacccac

SEQ ID NO: 3379409 - RNA, 13 nt, Human
caaguagaaucuc

SEQ ID NO: 3379410 - RNA, 16 nt, Human
caaguagaaucucagu

SEQ ID NO: 3379411 - RNA, 23 nt, Human
caaguagaaucucaguugauuuu

SEQ ID NO: 3379412 - RNA, 17 nt, Human
caaguagacuacuguuc

SEQ ID NO: 3379413 - RNA, 17 nt, Human
caaguagauaaauauuu

SEQ ID NO: 3379414 - RNA, 18 nt, Human
caaguagauaaauauuug

SEQ ID NO: 3379415 - RNA, 16 nt, Human
caaguagucugcucac

SEQ ID NO: 3379416 - RNA, 21 nt, Human
caaguaguucuguauuugaaa

SEQ ID NO: 3379417 - RNA, 23 nt, Human
caaguaguucuguauuugaaagu

SEQ ID NO: 3379418 - RNA, 14 nt, Human
caaguauaaacuuu

SEQ ID NO: 3379419 - RNA, 14 nt, Human
caaguauagaaaau

SEQ ID NO: 3379420 - RNA, 19 nt, Human
caaguauuacuaaauugac

SEQ ID NO: 3379421 - RNA, 23 nt, Human
caaguauuacuaaauugaccuuu

SEQ ID NO: 3379422 - RNA, 17 nt, Human
caaguauuauaccuuuu

SEQ ID NO: 3379423 - RNA, 14 nt, Human
caaguauucugccu

SEQ ID NO: 3379424 - RNA, 15 nt, Human
caaguauucugccuu

SEQ ID NO: 3379425 - RNA, 19 nt, Human
caaguauuugggaagugaa

SEQ ID NO: 3379426 - RNA, 16 nt, Human
caaguauuuguuaauu

SEQ ID NO: 3379427 - RNA, 22 nt, Human
caaguauuuguuaauuuagaaa

SEQ ID NO: 3379428 - RNA, 11 nt, Human
caaguauuuug

SEQ ID NO: 3379429 - RNA, 23 nt, Human
caagucaaaauauuuuuaaaaga

SEQ ID NO: 3379430 - RNA, 17 nt, Human
caagucaaucauuucuc

SEQ ID NO: 3379431 - RNA, 15 nt, Human
caagucagaggaugg

SEQ ID NO: 3379432 - RNA, 21 nt, Human
caagucagaggauggccagug

SEQ ID NO: 3379433 - RNA, 22 nt, Human
caagucagaggauggccagugu

SEQ ID NO: 3379434 - RNA, 23 nt, Human
caagucagaggauggccaguguc

SEQ ID NO: 3379435 - RNA, 19 nt, Human
caagucagcuuugccuucc

SEQ ID NO: 3379436 - RNA, 23 nt, Human
caagucaguccaggaugcuaaca

SEQ ID NO: 3379437 - RNA, 14 nt, Human
caagucauguaaau

SEQ ID NO: 3379438 - RNA, 17 nt, Human
caagucaugugcauuuc

SEQ ID NO: 3379439 - RNA, 12 nt, Human
caagucauuuua

SEQ ID NO: 3379440 - RNA, 22 nt, Human
caagucccaccgguugcuucug

SEQ ID NO: 3379441 - RNA, 20 nt, Human
caaguccccgucugccuggc

SEQ ID NO: 3379442 - RNA, 11 nt, Human
caagucccugu

SEQ ID NO: 3379443 - RNA, 21 nt, Human
caagucccuguuuucugagcc

SEQ ID NO: 3379444 - RNA, 14 nt, Human
caaguccucuuuuc

SEQ ID NO: 3379445 - RNA, 21 nt, Human
caaguccucuuuucugagagg

SEQ ID NO: 3379446 - RNA, 16 nt, Human
caaguccugaagaggc

SEQ ID NO: 3379447 - RNA, 19 nt, Human
caaguccugaagaggcggg

SEQ ID NO: 3379448 - RNA, 23 nt, Human
caaguccugaagaggcgggccag

SEQ ID NO: 3379449 - RNA, 18 nt, Human
caaguccugccucuuaaa

SEQ ID NO: 3379450 - RNA, 18 nt, Human
caagucggaacagcagau

SEQ ID NO: 3379451 - RNA, 15 nt, Human
caagucuacagagug

SEQ ID NO: 3379452 - RNA, 18 nt, Human
caagucuaugaugcuguu

SEQ ID NO: 3379453 - RNA, 21 nt, Human
caagucuaugaugcuguugcc

SEQ ID NO: 3379454 - RNA, 14 nt, Human
caagucuccuuccc

SEQ ID NO: 3379455 - RNA, 13 nt, Human
caagucuggaucu

SEQ ID NO: 3379456 - RNA, 18 nt, Human
caagucuggaucugggac

SEQ ID NO: 3379457 - RNA, 19 nt, Human
caagucuggaucugggacc

SEQ ID NO: 3379458 - RNA, 14 nt, Human
caagucuguuuacu

SEQ ID NO: 3379459 - RNA, 15 nt, Human
caagucuucccugau

SEQ ID NO: 3379460 - RNA, 12 nt, Human
caagugaaaaau

SEQ ID NO: 3379461 - RNA, 20 nt, Human
caagugaaauaacaaaaugg

SEQ ID NO: 3379462 - RNA, 21 nt, Human
caagugaaauaacaaaaugga

SEQ ID NO: 3379463 - RNA, 13 nt, Human
caagugaaauuau

SEQ ID NO: 3379464 - RNA, 14 nt, Human
caagugaagaaaag

SEQ ID NO: 3379465 - RNA, 13 nt, Human
caagugaaucuaa

SEQ ID NO: 3379466 - RNA, 16 nt, Human
caagugacaucucuuu

SEQ ID NO: 3379467 - RNA, 17 nt, Human
caagugacgaaaacauu

SEQ ID NO: 3379468 - RNA, 19 nt, Human
caagugagacccugucuca

SEQ ID NO: 3379469 - RNA, 14 nt, Human
caagugagagcugg

SEQ ID NO: 3379470 - RNA, 19 nt, Human
caagugagcaaaccugccc

SEQ ID NO: 3379471 - RNA, 18 nt, Human
caagugaugcuaaaaccu

SEQ ID NO: 3379472 - RNA, 17 nt, Human
caagugauucucaugcc

SEQ ID NO: 3379473 - RNA, 20 nt, Human
caagugauucucaugccuca

SEQ ID NO: 3379474 - RNA, 14 nt, Human
caagugauucuccu

SEQ ID NO: 3379475 - RNA, 20 nt, Human
caagugauucuccugccuca

SEQ ID NO: 3379476 - RNA, 21 nt, Human
caagugauucuccugccucag

SEQ ID NO: 3379477 - RNA, 22 nt, Human
caagugauucuccugccucagc

SEQ ID NO: 3379478 - RNA, 18 nt, Human
caagugauugggacagag

SEQ ID NO: 3379479 - RNA, 19 nt, Human
caagugcaugcucucugca

SEQ ID NO: 3379480 - RNA, 15 nt, Human
caagugccaaaugcu

SEQ ID NO: 3379481 - RNA, 21 nt, Human
caagugccagaggugggcagg

SEQ ID NO: 3379482 - RNA, 22 nt, Human
caagugccagaggugggcaggu

SEQ ID NO: 3379483 - RNA, 20 nt, Human
caagugccagucuugugucu

SEQ ID NO: 3379484 - RNA, 17 nt, Human
caagugccgcaaauugu

SEQ ID NO: 3379485 - RNA, 21 nt, Human
caagugcuggagucuccugag

SEQ ID NO: 3379486 - RNA, 12 nt, Human
caagugcuggca

SEQ ID NO: 3379487 - RNA, 14 nt, Human
caagugcugugcaa

SEQ ID NO: 3379488 - RNA, 12 nt, Human
caaguggaccuu

SEQ ID NO: 3379489 - RNA, 18 nt, Human
caaguggagccugacagc

SEQ ID NO: 3379490 - RNA, 18 nt, Human
caaguggcagagcuugga

SEQ ID NO: 3379491 - RNA, 17 nt, Human
caagugggaucugucac

SEQ ID NO: 3379492 - RNA, 20 nt, Human
caagugggaucugucacacc

SEQ ID NO: 3379493 - RNA, 17 nt, Human
caaguggguacccccag

SEQ ID NO: 3379494 - RNA, 20 nt, Human
caagugguagcaagaaguga

SEQ ID NO: 3379495 - RNA, 13 nt, Human
caaguggugccua

SEQ ID NO: 3379496 - RNA, 20 nt, Human
caaguggugguaacccuggu

SEQ ID NO: 3379497 - RNA, 22 nt, Human
caaguggugguaacccuggugg

SEQ ID NO: 3379498 - RNA, 22 nt, Human
caagugguuuccacaugcucug

SEQ ID NO: 3379499 - RNA, 17 nt, Human
caagugucucaguccac

SEQ ID NO: 3379500 - RNA, 15 nt, Human
caagugucuuccauc

SEQ ID NO: 3379501 - RNA, 18 nt, Human
caagugugcauauuguac

SEQ ID NO: 3379502 - RNA, 22 nt, Human
caagugugcauauuguacacuu

SEQ ID NO: 3379503 - RNA, 19 nt, Human
caagugugcuaaaaaugag

SEQ ID NO: 3379504 - RNA, 23 nt, Human
caaguguguaugugcgugugugc

SEQ ID NO: 3379505 - RNA, 20 nt, Human
caagugugugcacaugugug

SEQ ID NO: 3379506 - RNA, 22 nt, Human
caagugugugcacaugugugcg

SEQ ID NO: 3379507 - RNA, 20 nt, Human
caagugugugcaugugugcg

SEQ ID NO: 3379508 - RNA, 17 nt, Human
caagugugugugcgugu

SEQ ID NO: 3379509 - RNA, 18 nt, Human
caaguuaaagugaauaac

SEQ ID NO: 3379510 - RNA, 18 nt, Human
caaguuaagagaaacuuu

SEQ ID NO: 3379511 - RNA, 13 nt, Human
caaguuaagauuc

SEQ ID NO: 3379512 - RNA, 13 nt, Human
caaguuagcucag

SEQ ID NO: 3379513 - RNA, 15 nt, Human
caaguuauuaauuuc

SEQ ID NO: 3379514 - RNA, 21 nt, Human
caaguuauuaauuucuucaca

SEQ ID NO: 3379515 - RNA, 17 nt, Human
caaguucaaucuguuuu

SEQ ID NO: 3379516 - RNA, 23 nt, Human
caaguucacaccugcagauucua

SEQ ID NO: 3379517 - RNA, 18 nt, Human
caaguuccaaguugcuaa

SEQ ID NO: 3379518 - RNA, 22 nt, Human
caaguuccaugggauacaaccu

SEQ ID NO: 3379519 - RNA, 13 nt, Human
caaguucuaagau

SEQ ID NO: 3379520 - RNA, 15 nt, Human
caaguucuaagauuc

SEQ ID NO: 3379521 - RNA, 21 nt, Human
caaguucuaagauucuaauga

SEQ ID NO: 3379522 - RNA, 23 nt, Human
caaguucuagagaagaggcuggu

SEQ ID NO: 3379523 - RNA, 15 nt, Human
caaguugaauugagg

SEQ ID NO: 3379524 - RNA, 23 nt, Human
caaguugcgacggagagaaaaaa

SEQ ID NO: 3379525 - RNA, 15 nt, Human
caaguugcuaauaca

SEQ ID NO: 3379526 - RNA, 15 nt, Human
caaguuggagucacu

SEQ ID NO: 3379527 - RNA, 16 nt, Human
caaguugucagguuau

SEQ ID NO: 3379528 - RNA, 18 nt, Human
caaguugugcuugagcca

SEQ ID NO: 3379529 - RNA, 17 nt, Human
caaguugugcuuguuua

SEQ ID NO: 3379530 - RNA, 17 nt, Human
caaguuguggugcugac

SEQ ID NO: 3379531 - RNA, 15 nt, Human
cccucacucugccag

SEQ ID NO: 3379532 - RNA, 21 nt, Human
cccucacucugccagggcagu

SEQ ID NO: 3379533 - RNA, 20 nt, Human
cccucacuggcucuccuggc

SEQ ID NO: 3379534 - RNA, 17 nt, Human
cccucagaacccuuggc

SEQ ID NO: 3379535 - RNA, 17 nt, Human
cccucagccccucuugc

SEQ ID NO: 3379536 - RNA, 23 nt, Human
cccucagccccucuugcccccca

SEQ ID NO: 3379537 - RNA, 20 nt, Human
cccucagccucuccccugcc

SEQ ID NO: 3379538 - RNA, 19 nt, Human
cccucagcucggcucagcu

SEQ ID NO: 3379539 - RNA, 22 nt, Human
cccucaggacccucgcuggccc

SEQ ID NO: 3379540 - RNA, 13 nt, Human
cccucaggacugc

SEQ ID NO: 3379541 - RNA, 19 nt, Human
cccucaggcauaggccugg

SEQ ID NO: 3379542 - RNA, 22 nt, Human
cccucaggcauaggccugggug

SEQ ID NO: 3379543 - RNA, 21 nt, Human
cccucagggcaaagccagguc

SEQ ID NO: 3379544 - RNA, 22 nt, Human
cccucaggggaaaacuguuacc

SEQ ID NO: 3379545 - RNA, 18 nt, Human
cccucagggucccuggug

SEQ ID NO: 3379546 - RNA, 19 nt, Human
cccucagggucccuggugg

SEQ ID NO: 3379547 - RNA, 20 nt, Human
cccucagucuggcccuuccu

SEQ ID NO: 3379548 - RNA, 16 nt, Human
cccucaguugugcagc

SEQ ID NO: 3379549 - RNA, 19 nt, Human
cccucaguuucccuaucuc

SEQ ID NO: 3379550 - RNA, 13 nt, Human
cccucauagcccu

SEQ ID NO: 3379551 - RNA, 19 nt, Human
cccucauagcccucacccu

SEQ ID NO: 3379552 - RNA, 16 nt, Human
cccucaucaaggacac

SEQ ID NO: 3379553 - RNA, 17 nt, Human
cccucaucccgagcacc

SEQ ID NO: 3379554 - RNA, 20 nt, Human
cccucauccucauacccacc

SEQ ID NO: 3379555 - RNA, 22 nt, Human
cccucauccucauacccacccc

SEQ ID NO: 3379556 - RNA, 13 nt, Human
cccucaucugucc

SEQ ID NO: 3379557 - RNA, 13 nt, Human
cccucaucugucu

SEQ ID NO: 3379558 - RNA, 18 nt, Human
cccucaucuugaagggcc

SEQ ID NO: 3379559 - RNA, 14 nt, Human
cccucaucuuucuu

SEQ ID NO: 3379560 - RNA, 17 nt, Human
cccucauuacugggccu

SEQ ID NO: 3379561 - RNA, 16 nt, Human
cccucauucaggaaaa

SEQ ID NO: 3379562 - RNA, 20 nt, Human
cccuccaaauggagaagcug

SEQ ID NO: 3379563 - RNA, 21 nt, Human
cccuccaagaccuucuccuuc

SEQ ID NO: 3379564 - RNA, 14 nt, Human
cccuccacaucccu

SEQ ID NO: 3379565 - RNA, 13 nt, Human
cccuccaccccag

SEQ ID NO: 3379566 - RNA, 14 nt, Human
cccuccacccuguc

SEQ ID NO: 3379567 - RNA, 19 nt, Human
cccuccaccgcagaaggaa

SEQ ID NO: 3379568 - RNA, 21 nt, Human
cccuccaccgcagaaggaagg

SEQ ID NO: 3379569 - RNA, 12 nt, Human
cccuccacucuc

SEQ ID NO: 3379570 - RNA, 23 nt, Human
cccuccacucuccucuuccaggc

SEQ ID NO: 3379571 - RNA, 14 nt, Human
cccuccacugcccu

SEQ ID NO: 3379572 - RNA, 18 nt, Human
cccuccagcacaaacaca

SEQ ID NO: 3379573 - RNA, 23 nt, Human
cccuccagccuuuggccuuggcu

SEQ ID NO: 3379574 - RNA, 14 nt, Human
cccuccaucccugg

SEQ ID NO: 3379575 - RNA, 19 nt, Human
cccucccacacccaaagcu

SEQ ID NO: 3379576 - RNA, 12 nt, Human
cccucccacagc

SEQ ID NO: 3379577 - RNA, 14 nt, Human
cccucccaccacag

SEQ ID NO: 3379578 - RNA, 14 nt, Human
cccucccacccacc

SEQ ID NO: 3379579 - RNA, 13 nt, Human
cccucccaccccc

SEQ ID NO: 3379580 - RNA, 15 nt, Human
cccucccaccuccag

SEQ ID NO: 3379581 - RNA, 14 nt, Human
cccucccaccucug

SEQ ID NO: 3379582 - RNA, 15 nt, Human
cccucccaccucugu

SEQ ID NO: 3379583 - RNA, 10 nt, Human
cccucccaga

SEQ ID NO: 3379584 - RNA, 17 nt, Human
cccucccagagcaccug

SEQ ID NO: 3379585 - RNA, 13 nt, Human
cccucccagaggc

SEQ ID NO: 3379586 - RNA, 13 nt, Human
cccucccagcucu

SEQ ID NO: 3379587 - RNA, 20 nt, Human
cccucccagcugacaguccu

SEQ ID NO: 3379588 - RNA, 13 nt, Human
cccucccagggag

SEQ ID NO: 3379589 - RNA, 22 nt, Human
cccucccagggccagggcccug

SEQ ID NO: 3379590 - RNA, 13 nt, Human
cccucccaucugg

SEQ ID NO: 3379591 - RNA, 14 nt, Human
cccucccaucuggg

SEQ ID NO: 3379592 - RNA, 16 nt, Human
cccucccaucugggag

SEQ ID NO: 3379593 - RNA, 15 nt, Human
cccucccauuaggac

SEQ ID NO: 3379594 - RNA, 16 nt, Human
cccuccccaaaguccc

SEQ ID NO: 3379595 - RNA, 15 nt, Human
cccuccccagagcac

SEQ ID NO: 3379596 - RNA, 13 nt, Human
cccuccccaggaa

SEQ ID NO: 3379597 - RNA, 14 nt, Human
cccuccccauggag

SEQ ID NO: 3379598 - RNA, 14 nt, Human
cccucccccacugc

SEQ ID NO: 3379599 - RNA, 20 nt, Human
cccucccccccaugcacugu

SEQ ID NO: 3379600 - RNA, 14 nt, Human
cccucccccugcca

SEQ ID NO: 3379601 - RNA, 17 nt, Human
cccucccccuucuccca

SEQ ID NO: 3379602 - RNA, 15 nt, Human
cccucccccuugucc

SEQ ID NO: 3379603 - RNA, 16 nt, Human
cccuccccgcaccccc

SEQ ID NO: 3379604 - RNA, 17 nt, Human
cccuccccgcacccccc

SEQ ID NO: 3379605 - RNA, 17 nt, Human
cccuccccuccccugcu

SEQ ID NO: 3379606 - RNA, 16 nt, Human
cccuccccucucuugc

SEQ ID NO: 3379607 - RNA, 16 nt, Human
cccuccccugcccuag

SEQ ID NO: 3379608 - RNA, 21 nt, Human
cccuccccuugccugugccag

SEQ ID NO: 3379609 - RNA, 23 nt, Human
cccucccgccccuucccacucac

SEQ ID NO: 3379610 - RNA, 16 nt, Human
cccucccggcauggga

SEQ ID NO: 3379611 - RNA, 13 nt, Human
cccucccuaccuc

SEQ ID NO: 3379612 - RNA, 16 nt, Human
cccucccucagccccu

SEQ ID NO: 3379613 - RNA, 12 nt, Human
cccucccuccac

SEQ ID NO: 3379614 - RNA, 14 nt, Human
cccucccuccuucc

SEQ ID NO: 3379615 - RNA, 23 nt, Human
cccucccucuacugggagccuac

SEQ ID NO: 3379616 - RNA, 14 nt, Human
cccucccucuccag

SEQ ID NO: 3379617 - RNA, 13 nt, Human
cccucccucuuuc

SEQ ID NO: 3379618 - RNA, 12 nt, Human
cccucccugcug

SEQ ID NO: 3379619 - RNA, 13 nt, Human
cccucccugcugu

SEQ ID NO: 3379620 - RNA, 15 nt, Human
cccucccugcugucc

SEQ ID NO: 3379621 - RNA, 17 nt, Human
cccucccuggccuguuc

SEQ ID NO: 3379622 - RNA, 11 nt, Human
cccucccuguc

SEQ ID NO: 3379623 - RNA, 16 nt, Human
cccucccuucucccug

SEQ ID NO: 3379624 - RNA, 20 nt, Human
cccuccgauccuuccuccca

SEQ ID NO: 3379625 - RNA, 16 nt, Human
cccuccgccaggcgag

SEQ ID NO: 3379626 - RNA, 15 nt, Human
cccuccgcccugcca

SEQ ID NO: 3379627 - RNA, 16 nt, Human
cccuccgcccugccac

SEQ ID NO: 3379628 - RNA, 16 nt, Human
cccuccgccuccagga

SEQ ID NO: 3379629 - RNA, 18 nt, Human
cccuccggacuggugccc

SEQ ID NO: 3379630 - RNA, 18 nt, Human
cccuccuacccugcgccc

SEQ ID NO: 3379631 - RNA, 13 nt, Human
cccuccucaccuc

SEQ ID NO: 3379632 - RNA, 18 nt, Human
cccuccucaccucuggac

SEQ ID NO: 3379633 - RNA, 21 nt, Human
cccuccucacucccaccugca

SEQ ID NO: 3379634 - RNA, 14 nt, Human
cccuccuccacucu

SEQ ID NO: 3379635 - RNA, 19 nt, Human
cccuccuccagccccuguc

SEQ ID NO: 3379636 - RNA, 19 nt, Human
cccuccuccaggccugccu

SEQ ID NO: 3379637 - RNA, 23 nt, Human
cccuccuccaggccugccuccca

SEQ ID NO: 3379638 - RNA, 19 nt, Human
cccuccucccaugucacug

SEQ ID NO: 3379639 - RNA, 16 nt, Human
cccuccucccucccag

SEQ ID NO: 3379640 - RNA, 22 nt, Human
cccuccucccuucuacugcuuc

SEQ ID NO: 3379641 - RNA, 16 nt, Human
cccuccuccuggacuc

SEQ ID NO: 3379642 - RNA, 15 nt, Human
cccuccucucccauc

SEQ ID NO: 3379643 - RNA, 14 nt, Human
cccuccucugaaac

SEQ ID NO: 3379644 - RNA, 15 nt, Human
cccuccucugaaaca

SEQ ID NO: 3379645 - RNA, 21 nt, Human
cccuccucugaaacagcugcc

SEQ ID NO: 3379646 - RNA, 16 nt, Human
cccuccucugccaccu

SEQ ID NO: 3379647 - RNA, 20 nt, Human
cccuccugagggaggaccug

SEQ ID NO: 3379648 - RNA, 21 nt, Human
cccuccugagggaggaccugg

SEQ ID NO: 3379649 - RNA, 22 nt, Human
cccuccugagggaggaccuggg

SEQ ID NO: 3379650 - RNA, 12 nt, Human
cccuccugcugc

SEQ ID NO: 3379651 - RNA, 12 nt, Human
cccagcucugcg

SEQ ID NO: 3379652 - RNA, 13 nt, Human
cccagcucuggcu

SEQ ID NO: 3379653 - RNA, 12 nt, Human
cccagcucuggu

SEQ ID NO: 3379654 - RNA, 16 nt, Human
cccagcucugguccau

SEQ ID NO: 3379655 - RNA, 20 nt, Human
cccagcucuggugagucuug

SEQ ID NO: 3379656 - RNA, 17 nt, Human
cccagcugacaguccuc

SEQ ID NO: 3379657 - RNA, 19 nt, Human
cccagcugacaguccucuc

SEQ ID NO: 3379658 - RNA, 22 nt, Human
cccagcugacaguccucuccac

SEQ ID NO: 3379659 - RNA, 22 nt, Human
cccagcugcaccugccagccug

SEQ ID NO: 3379660 - RNA, 15 nt, Human
cccagcugccccucc

SEQ ID NO: 3379661 - RNA, 18 nt, Human
cccagcugcucugcccag

SEQ ID NO: 3379662 - RNA, 20 nt, Human
cccagcugcucugcccagag

SEQ ID NO: 3379663 - RNA, 11 nt, Human
cccagcuggcc

SEQ ID NO: 3379664 - RNA, 20 nt, Human
cccagcugggaggcaagagg

SEQ ID NO: 3379665 - RNA, 21 nt, Human
cccagcugggaggcaagaggg

SEQ ID NO: 3379666 - RNA, 18 nt, Human
cccagcugggcucugcca

SEQ ID NO: 3379667 - RNA, 23 nt, Human
cccagcuggggccaggcuggguc

SEQ ID NO: 3379668 - RNA, 19 nt, Human
cccagcuggugggaagcgu

SEQ ID NO: 3379669 - RNA, 16 nt, Human
cccagcugugagccuu

SEQ ID NO: 3379670 - RNA, 22 nt, Human
cccagcuucacuucugacucuu

SEQ ID NO: 3379671 - RNA, 15 nt, Human
cccagcuuccagcag

SEQ ID NO: 3379672 - RNA, 18 nt, Human
cccagcuuccagcaggag

SEQ ID NO: 3379673 - RNA, 19 nt, Human
cccagcuuccagcaggagg

SEQ ID NO: 3379674 - RNA, 22 nt, Human
cccagcuugggcagaucuccca

SEQ ID NO: 3379675 - RNA, 23 nt, Human
cccagcuugggcccagcugggcu

SEQ ID NO: 3379676 - RNA, 17 nt, Human
cccaggaaaggcuccag

SEQ ID NO: 3379677 - RNA, 13 nt, Human
caggaaccuggac

SEQ ID NO: 3379678 - RNA, 21 nt, Human
caggaaccuggaccaaagcug

SEQ ID NO: 3379679 - RNA, 19 nt, Human
caggaacuagacugccugg

SEQ ID NO: 3379680 - RNA, 17 nt, Human
caggaacucccagcaac

SEQ ID NO: 3379681 - RNA, 13 nt, Human
caggaacugggcc

SEQ ID NO: 3379682 - RNA, 14 nt, Human
caggaagaaagaau

SEQ ID NO: 3379683 - RNA, 21 nt, Human
caggaagaaaucacagaauca

SEQ ID NO: 3379684 - RNA, 22 nt, Human
caggaagacccaacacauggga

SEQ ID NO: 3379685 - RNA, 17 nt, Human
caggaagagaaggagca

SEQ ID NO: 3379686 - RNA, 14 nt, Human
caggaagagagcau

SEQ ID NO: 3379687 - RNA, 21 nt, Human
caggaagaugaaagaggaggu

SEQ ID NO: 3379688 - RNA, 15 nt, Human
caggaagcaccccau

SEQ ID NO: 3379689 - RNA, 20 nt, Human
caggaagcauucagagagca

SEQ ID NO: 3379690 - RNA, 22 nt, Human
caggaagcauucagagagcagc

SEQ ID NO: 3379691 - RNA, 18 nt, Human
caggaagccagcaggcuc

SEQ ID NO: 3379692 - RNA, 19 nt, Human
caggaagccagcaggcucu

SEQ ID NO: 3379693 - RNA, 19 nt, Human
caggaagcccaggagccuc

SEQ ID NO: 3379694 - RNA, 13 nt, Human
caggaagccugca

SEQ ID NO: 3379695 - RNA, 21 nt, Human
caggaagccugcaguccugga

SEQ ID NO: 3379696 - RNA, 14 nt, Human
caggaagccuuccc

SEQ ID NO: 3379697 - RNA, 12 nt, Human
caggaagcucag

SEQ ID NO: 3379698 - RNA, 17 nt, Human
caggaagcucagacugg

SEQ ID NO: 3379699 - RNA, 13 nt, Human
caggaagcucagg

SEQ ID NO: 3379700 - RNA, 20 nt, Human
caggaagcucagggccuggc

SEQ ID NO: 3379701 - RNA, 21 nt, Human
caggaagcucagggccuggcu

SEQ ID NO: 3379702 - RNA, 22 nt, Human
caggaagcucagggccuggcuc

SEQ ID NO: 3379703 - RNA, 13 nt, Human
caggaagcuguga

SEQ ID NO: 3379704 - RNA, 14 nt, Human
caggaagcugugag

SEQ ID NO: 3379705 - RNA, 22 nt, Human
caggaagcuuuggugagaaccu

SEQ ID NO: 3379706 - RNA, 14 nt, Human
caggaaggaaguca

SEQ ID NO: 3379707 - RNA, 14 nt, Human
caggaaggagcugc

SEQ ID NO: 3379708 - RNA, 16 nt, Human
caggaaggagcugccu

SEQ ID NO: 3379709 - RNA, 23 nt, Human
caggaaggaggagccgaccggga

SEQ ID NO: 3379710 - RNA, 15 nt, Human
caggaaggcuaaagg

SEQ ID NO: 3379711 - RNA, 21 nt, Human
caggaagggcaggaaggagag

SEQ ID NO: 3379712 - RNA, 18 nt, Human
cccugcuuugggcugccc

SEQ ID NO: 3379713 - RNA, 18 nt, Human
cccugcuuugggcuuggg

SEQ ID NO: 3379714 - RNA, 22 nt, Human
cccugcuuugggcuugggccua

SEQ ID NO: 3379715 - RNA, 22 nt, Human
cccuggaaaccuuccacccagu

SEQ ID NO: 3379716 - RNA, 17 nt, Human
cccuggaagagcccagu

SEQ ID NO: 3379717 - RNA, 18 nt, Human
cccuggaagagcccaguc

SEQ ID NO: 3379718 - RNA, 21 nt, Human
cccuggaagcagugcccaggu

SEQ ID NO: 3379719 - RNA, 22 nt, Human
cccuggaagccggcggcccaag

SEQ ID NO: 3379720 - RNA, 17 nt, Human
cccuggaccagaugcug

SEQ ID NO: 3379721 - RNA, 17 nt, Human
cccuggaccaguggucu

SEQ ID NO: 3379722 - RNA, 19 nt, Human
cccuggaccccagccucaa

SEQ ID NO: 3379723 - RNA, 14 nt, Human
cccuggacugggag

SEQ ID NO: 3379724 - RNA, 23 nt, Human
cccuggacugguggccccugccu

SEQ ID NO: 3379725 - RNA, 17 nt, Human
cccuggacuugccucug

SEQ ID NO: 3379726 - RNA, 22 nt, Human
cccuggagaccccaccagccuc

SEQ ID NO: 3379727 - RNA, 16 nt, Human
cccuggagccaacugc

SEQ ID NO: 3379728 - RNA, 19 nt, Human
cccuggagccaacugcugc

SEQ ID NO: 3379729 - RNA, 21 nt, Human
cccuggagccaacugcugcuu

SEQ ID NO: 3379730 - RNA, 13 nt, Human
cccuggagccaga

SEQ ID NO: 3379731 - RNA, 20 nt, Human
cccuggagccagacucuggu

SEQ ID NO: 3379732 - RNA, 21 nt, Human
cccuggagccagacucugguc

SEQ ID NO: 3379733 - RNA, 12 nt, Human
cccuggagccca

SEQ ID NO: 3379734 - RNA, 13 nt, Human
cccuggagguggc

SEQ ID NO: 3379735 - RNA, 18 nt, Human
cccuggagucaugccaag

SEQ ID NO: 3379736 - RNA, 20 nt, Human
cccuggaguguggcugagga

SEQ ID NO: 3379737 - RNA, 21 nt, Human
cccuggauagacgaguugauu

SEQ ID NO: 3379738 - RNA, 22 nt, Human
cccuggaucacgacgcugcaga

SEQ ID NO: 3379739 - RNA, 15 nt, Human
cccuggaucagaaca

SEQ ID NO: 3379740 - RNA, 19 nt, Human
cccuggaucagcguggccu

SEQ ID NO: 3379741 - RNA, 23 nt, Human
cccuggaucaguccuuugaucag

SEQ ID NO: 3379742 - RNA, 19 nt, Human
cccuggauccaucaggcca

SEQ ID NO: 3379743 - RNA, 20 nt, Human
cccuggauuuuuaccagucu

SEQ ID NO: 3379744 - RNA, 13 nt, Human
cccuggcagcccc

SEQ ID NO: 3379745 - RNA, 14 nt, Human
cccuggcagccccu

SEQ ID NO: 3379746 - RNA, 16 nt, Human
cccuggcagccccugu

SEQ ID NO: 3379747 - RNA, 15 nt, Human
cccuggcagcccgca

SEQ ID NO: 3379748 - RNA, 22 nt, Human
cccuggcaggaugacccugcga

SEQ ID NO: 3379749 - RNA, 14 nt, Human
cccuggcaggcagg

SEQ ID NO: 3379750 - RNA, 15 nt, Human
cccuggcaggcaggg

SEQ ID NO: 3379751 - RNA, 23 nt, Human
cccuggccaccaccccccacucu

SEQ ID NO: 3379752 - RNA, 14 nt, Human
cccuggccaucucu

SEQ ID NO: 3379753 - RNA, 15 nt, Human
cccuggccaucucug

SEQ ID NO: 3379754 - RNA, 12 nt, Human
cccuggcccccu

SEQ ID NO: 3379755 - RNA, 17 nt, Human
cccuggccccucucccu

SEQ ID NO: 3379756 - RNA, 23 nt, Human
cccuggcccucaaggccucccac

SEQ ID NO: 3379757 - RNA, 15 nt, Human
cccuggccucugugc

SEQ ID NO: 3379758 - RNA, 18 nt, Human
cccuggccucugugccuu

SEQ ID NO: 3379759 - RNA, 21 nt, Human
cccuggccuugggcccucugg

SEQ ID NO: 3379760 - RNA, 18 nt, Human
cccuggcucccacaggcc

SEQ ID NO: 3379761 - RNA, 20 nt, Human
cccuggcucccacaggcccu

SEQ ID NO: 3379762 - RNA, 12 nt, Human
cccuggcucccu

SEQ ID NO: 3379763 - RNA, 16 nt, Human
cccuggcucccuccuc

SEQ ID NO: 3379764 - RNA, 19 nt, Human
cccuggcucucagaaggua

SEQ ID NO: 3379765 - RNA, 23 nt, Human
cccuggcugaccccaaagagccu

SEQ ID NO: 3379766 - RNA, 19 nt, Human
cccuggcugcccuggcccu

SEQ ID NO: 3379767 - RNA, 15 nt, Human
cccuggcugcugccc

SEQ ID NO: 3379768 - RNA, 20 nt, Human
cccuggcugguaagggccaa

SEQ ID NO: 3379769 - RNA, 13 nt, Human
cccuggcuucugu

SEQ ID NO: 3379770 - RNA, 14 nt, Human
cccuggcuucugug

SEQ ID NO: 3379771 - RNA, 23 nt, Human
cccuggcuuguaacuccaccaac

SEQ ID NO: 3379772 - RNA, 18 nt, Human
cccugggaaggccucuug

SEQ ID NO: 3379773 - RNA, 24 nt, Human
cccugggagaaucgcuccugcagc

SEQ ID NO: 3379774 - RNA, 16 nt, Human
cccugggaggccccuu

SEQ ID NO: 3379775 - RNA, 24 nt, Human
cccugggaggcgggcgcacugccu

SEQ ID NO: 3379776 - RNA, 22 nt, Human
cccugggaggcucuggagccca

SEQ ID NO: 3379777 - RNA, 18 nt, Human
cccugggagggacaugcu

SEQ ID NO: 3379778 - RNA, 18 nt, Human
cccugggaucuggugguc

SEQ ID NO: 3379779 - RNA, 17 nt, Human
cccugggauucaggaaa

SEQ ID NO: 3379780 - RNA, 16 nt, Human
cccugggccagggucu

SEQ ID NO: 3379781 - RNA, 18 nt, Human
cccugggccccaccaccu

SEQ ID NO: 3379782 - RNA, 19 nt, Human
cccugggcccugggcugga

SEQ ID NO: 3379783 - RNA, 19 nt, Human
cccugggccugcugcugag

SEQ ID NO: 3379784 - RNA, 18 nt, Human
cccugggccuugggcucc

SEQ ID NO: 3379785 - RNA, 15 nt, Human
cccugggcucugccc

SEQ ID NO: 3379786 - RNA, 13 nt, Human
cccugggcugaga

SEQ ID NO: 3379787 - RNA, 14 nt, Human
cccugggcuggaau

SEQ ID NO: 3379788 - RNA, 17 nt, Human
cccugggcuuggccugc

SEQ ID NO: 3379789 - RNA, 20 nt, Human
cccugggcuuggccugcugu

SEQ ID NO: 3379790 - RNA, 18 nt, Human
cccuggggaaggagccag

SEQ ID NO: 3379791 - RNA, 20 nt, Human
cccuggggacagcaagggcu

SEQ ID NO: 3379792 - RNA, 15 nt, Human
cccuggggccuagac

SEQ ID NO: 3379793 - RNA, 17 nt, Human
cccuggggccuggaccu

SEQ ID NO: 3379794 - RNA, 18 nt, Human
cccuggggccuggaccug

SEQ ID NO: 3379795 - RNA, 21 nt, Human
cccuggggccuggaccugccu

SEQ ID NO: 3379796 - RNA, 17 nt, Human
cccuggggccuguacug

SEQ ID NO: 3379797 - RNA, 20 nt, Human
cccuggggccuguacugccu

SEQ ID NO: 3379798 - RNA, 20 nt, Human
cccuggggcugaucucaggg

SEQ ID NO: 3379799 - RNA, 13 nt, Human
cccuggggcuggc

SEQ ID NO: 3379800 - RNA, 21 nt, Human
cccuggggcuucuccugaccc

SEQ ID NO: 3379801 - RNA, 20 nt, Human
cccugggggaagcccuggau

SEQ ID NO: 3379802 - RNA, 18 nt, Human
cccugggugggcucugug

SEQ ID NO: 3379803 - RNA, 20 nt, Human
cccugggugggcucugugca

SEQ ID NO: 3379804 - RNA, 21 nt, Human
cccugggugggugguggggag

SEQ ID NO: 3379805 - RNA, 23 nt, Human
cccuggguguccccgcugcugug

SEQ ID NO: 3379806 - RNA, 15 nt, Human
cccugguaagaaaaa

SEQ ID NO: 3379807 - RNA, 16 nt, Human
cccugguaauagcugu

SEQ ID NO: 3379808 - RNA, 16 nt, Human
cccugguccagggaag

SEQ ID NO: 3379809 - RNA, 11 nt, Human
cccuggucccu

SEQ ID NO: 3379810 - RNA, 13 nt, Human
cccugguccuucc

SEQ ID NO: 3379811 - RNA, 16 nt, Human
cccugguccuuccagg

SEQ ID NO: 3379812 - RNA, 13 nt, Human
cccuggucucagc

SEQ ID NO: 3379813 - RNA, 13 nt, Human
cccuggugacauc

SEQ ID NO: 3379814 - RNA, 15 nt, Human
cccuggugccuggcu

SEQ ID NO: 3379815 - RNA, 18 nt, Human
cccugguggacaguccug

SEQ ID NO: 3379816 - RNA, 20 nt, Human
cccugguggcagcucaccuc

SEQ ID NO: 3379817 - RNA, 13 nt, Human
cccuggugguuca

SEQ ID NO: 3379818 - RNA, 21 nt, Human
cccugguguuucuagcacugg

SEQ ID NO: 3379819 - RNA, 14 nt, Human
cccugguucucauc

SEQ ID NO: 3379820 - RNA, 23 nt, Human
cccugguucugaugaugugccug

SEQ ID NO: 3379821 - RNA, 18 nt, Human
cccugagaucucugcagg

SEQ ID NO: 3379822 - RNA, 21 nt, Human
cccugagcaaugucugugcua

SEQ ID NO: 3379823 - RNA, 18 nt, Human
cccugagccagggucucc

SEQ ID NO: 3379824 - RNA, 19 nt, Human
cccugagccagggucucca

SEQ ID NO: 3379825 - RNA, 12 nt, Human
cccugagcccac

SEQ ID NO: 3379826 - RNA, 21 nt, Human
cccugagccccuuccuugcuc

SEQ ID NO: 3379827 - RNA, 22 nt, Human
cccugagcgccuggauuucugg

SEQ ID NO: 3379828 - RNA, 17 nt, Human
cccugagcugaggcagc

SEQ ID NO: 3379829 - RNA, 14 nt, Human
cccugagcugaggg

SEQ ID NO: 3379830 - RNA, 14 nt, Human
cccugaggagucug

SEQ ID NO: 3379831 - RNA, 16 nt, Human
cccugaggagucugag

SEQ ID NO: 3379832 - RNA, 21 nt, Human
cccugaggagucugagguccu

SEQ ID NO: 3379833 - RNA, 21 nt, Human
cccugaggaugggucagagcu

SEQ ID NO: 3379834 - RNA, 17 nt, Human
cccugaggcaggucccc

SEQ ID NO: 3379835 - RNA, 12 nt, Human
cccugaggccca

SEQ ID NO: 3379836 - RNA, 16 nt, Human
cccugaggcccagagg

SEQ ID NO: 3379837 - RNA, 12 nt, Human
cccugaggcuca

SEQ ID NO: 3379838 - RNA, 18 nt, Human
cccugaggcucagggaaa

SEQ ID NO: 3379839 - RNA, 16 nt, Human
cccugaggcuggacuc

SEQ ID NO: 3379840 - RNA, 23 nt, Human
cccugaggcuggacuccagaucu

SEQ ID NO: 3379841 - RNA, 20 nt, Human
cccugaggugaaagggagcu

SEQ ID NO: 3379842 - RNA, 21 nt, Human
cccugaggugugggggcugca

SEQ ID NO: 3379843 - RNA, 22 nt, Human
cccugaggugugggggcugcag

SEQ ID NO: 3379844 - RNA, 23 nt, Human
cccugaggugugggggcugcagc

SEQ ID NO: 3379845 - RNA, 22 nt, Human
cccugaguaaucgcuuaaagau

SEQ ID NO: 3379846 - RNA, 17 nt, Human
cccugagucaccaggaa

SEQ ID NO: 3379847 - RNA, 23 nt, Human
cccugaguggaucuccaaggacc

SEQ ID NO: 3379848 - RNA, 18 nt, Human
cccugauaacaaccugga

SEQ ID NO: 3379849 - RNA, 19 nt, Human
cccugauaacaaccuggag

SEQ ID NO: 3379850 - RNA, 14 nt, Human
cccugaucccagag

SEQ ID NO: 3379851 - RNA, 17 nt, Human
cccugaucccagagagc

SEQ ID NO: 3379852 - RNA, 20 nt, Human
cccugaucccagagagcccg

SEQ ID NO: 3379853 - RNA, 18 nt, Human
cccugaucccauuuuccu

SEQ ID NO: 3379854 - RNA, 23 nt, Human
cccugaucccuuccaccugcucu

SEQ ID NO: 3379855 - RNA, 17 nt, Human
cccugauugaccugcuc

SEQ ID NO: 3379856 - RNA, 24 nt, Human
cccugauugaccugcuccgcugcu

SEQ ID NO: 3379857 - RNA, 21 nt, Human
cccugauuuaggagaagccag

SEQ ID NO: 3379858 - RNA, 23 nt, Human
cccugauuuaggagaagccagga

SEQ ID NO: 3379859 - RNA, 18 nt, Human
cccugauuugcugggcag

SEQ ID NO: 3379860 - RNA, 23 nt, Human
cccugcaaaauuugaugccagga

SEQ ID NO: 3379861 - RNA, 18 nt, Human
cccugcaaacagaacagg

SEQ ID NO: 3379862 - RNA, 24 nt, Human
cccugcaaacagaacagggucaug

SEQ ID NO: 3379863 - RNA, 16 nt, Human
cccugcaaagcccagc

SEQ ID NO: 3379864 - RNA, 20 nt, Human
cccugcaaagcccagcuuga

SEQ ID NO: 3379865 - RNA, 15 nt, Human
cccugcaaaggacug

SEQ ID NO: 3379866 - RNA, 22 nt, Human
cccugcaaccugauugugucuc

SEQ ID NO: 3379867 - RNA, 15 nt, Human
cccugcaauaaaaug

SEQ ID NO: 3379868 - RNA, 20 nt, Human
cccugcaauguaucccuucu

SEQ ID NO: 3379869 - RNA, 23 nt, Human
cccugcaauguaucccuucucac

SEQ ID NO: 3379870 - RNA, 16 nt, Human
cccugcacaagccagg

SEQ ID NO: 3379871 - RNA, 13 nt, Human
cccugcacagcag

SEQ ID NO: 3379872 - RNA, 20 nt, Human
cccugcacagugacuucuga

SEQ ID NO: 3379873 - RNA, 13 nt, Human
cccugcacgucau

SEQ ID NO: 3379874 - RNA, 14 nt, Human
cccugcacgucaug

SEQ ID NO: 3379875 - RNA, 19 nt, Human
cccugcacuaaagccagcc

SEQ ID NO: 3379876 - RNA, 10 nt, Human
cccugcacug

SEQ ID NO: 3379877 - RNA, 23 nt, Human
cccugcacuggaguccagucucu

SEQ ID NO: 3379878 - RNA, 17 nt, Human
cccugcacuguaaaaug

SEQ ID NO: 3379879 - RNA, 19 nt, Human
cccugcacuugcagacucu

SEQ ID NO: 3379880 - RNA, 22 nt, Human
cccugcacuugcagacucuaca

SEQ ID NO: 3379881 - RNA, 19 nt, Human
cccugcagacccugcccuu

SEQ ID NO: 3379882 - RNA, 21 nt, Human
cccugcagcacggacaauaaa

SEQ ID NO: 3379883 - RNA, 22 nt, Human
cccugcagcacggacaauaaac

SEQ ID NO: 3379884 - RNA, 14 nt, Human
cccugcagcccugg

SEQ ID NO: 3379885 - RNA, 20 nt, Human
cccugcagcuuguagccagc

SEQ ID NO: 3379886 - RNA, 22 nt, Human
cccugcagcuuguagccagccg

SEQ ID NO: 3379887 - RNA, 21 nt, Human
cccugcaggaaggagcugccu

SEQ ID NO: 3379888 - RNA, 22 nt, Human
cccugcaguuccccuggaagca

SEQ ID NO: 3379889 - RNA, 12 nt, Human
cccugcaucccc

SEQ ID NO: 3379890 - RNA, 20 nt, Human
cccugcaugggccagccccu

SEQ ID NO: 3379891 - RNA, 23 nt, Human
cccugcauuggaacuggaggcag

SEQ ID NO: 3379892 - RNA, 17 nt, Human
cccugccacccugggga

SEQ ID NO: 3379893 - RNA, 18 nt, Human
cccugccacccuggggag

SEQ ID NO: 3379894 - RNA, 14 nt, Human
cccugccaccuccc

SEQ ID NO: 3379895 - RNA, 18 nt, Human
cccugccaccugucuguc

SEQ ID NO: 3379896 - RNA, 13 nt, Human
cccugccacucac

SEQ ID NO: 3379897 - RNA, 23 nt, Human
cccugccagcacccccacgcccu

SEQ ID NO: 3379898 - RNA, 13 nt, Human
cccugccagcucu

SEQ ID NO: 3379899 - RNA, 22 nt, Human
cccugccaggagcuuuggaccu

SEQ ID NO: 3379900 - RNA, 13 nt, Human
cccugccaggcac

SEQ ID NO: 3379901 - RNA, 14 nt, Human
cccugccaggcaca

SEQ ID NO: 3379902 - RNA, 20 nt, Human
cccugccaggcacaggcagg

SEQ ID NO: 3379903 - RNA, 14 nt, Human
cccugccagggcag

SEQ ID NO: 3379904 - RNA, 20 nt, Human
cccugccaucauguuuacag

SEQ ID NO: 3379905 - RNA, 13 nt, Human
cccugccaucuuc

SEQ ID NO: 3379906 - RNA, 17 nt, Human
cccugccaucuucccag

SEQ ID NO: 3379907 - RNA, 17 nt, Human
cccugcccacaccuccu

SEQ ID NO: 3379908 - RNA, 20 nt, Human
cccugcccacccucuggaga

SEQ ID NO: 3379909 - RNA, 14 nt, Human
cccugcccagauca

SEQ ID NO: 3379910 - RNA, 22 nt, Human
cccugcccagaucagccagaag

SEQ ID NO: 3379911 - RNA, 22 nt, Human
cccugcccaggccggccagccu

SEQ ID NO: 3379912 - RNA, 15 nt, Human
cccugccccacaccu

SEQ ID NO: 3379913 - RNA, 18 nt, Human
cccugcccccacuuccug

SEQ ID NO: 3379914 - RNA, 20 nt, Human
cccugcccccacuuccuguu

SEQ ID NO: 3379915 - RNA, 14 nt, Human
cccugcccccagga

SEQ ID NO: 3379916 - RNA, 17 nt, Human
ccgcuacaccacucugg

SEQ ID NO: 3379917 - RNA, 19 nt, Human
ccgcuacaccacucuggca

SEQ ID NO: 3379918 - RNA, 16 nt, Human
ccgcuaccucccuccc

SEQ ID NO: 3379919 - RNA, 20 nt, Human
ccgcuagagcagcccaaauu

SEQ ID NO: 3379920 - RNA, 15 nt, Human
ccgcuagaggccuga

SEQ ID NO: 3379921 - RNA, 16 nt, Human
ccgcuagaggccugag

SEQ ID NO: 3379922 - RNA, 17 nt, Human
ccgcuagaggccugagg

SEQ ID NO: 3379923 - RNA, 19 nt, Human
ccgcucagcccucccugcc

SEQ ID NO: 3379924 - RNA, 21 nt, Human
ccgcucagcccucccugcccc

SEQ ID NO: 3379925 - RNA, 22 nt, Human
ccgcucagcccucccugccccu

SEQ ID NO: 3379926 - RNA, 11 nt, Human
ccgcuccagag

SEQ ID NO: 3379927 - RNA, 12 nt, Human
ccgcuccagagu

SEQ ID NO: 3379928 - RNA, 20 nt, Human
ccgcuccagguaccuugacc

SEQ ID NO: 3379929 - RNA, 14 nt, Human
ccgcucccaguguc

SEQ ID NO: 3379930 - RNA, 12 nt, Human
ccgcuccccagc

SEQ ID NO: 3379931 - RNA, 18 nt, Human
ccgcucuacaucuucugc

SEQ ID NO: 3379932 - RNA, 19 nt, Human
ccgcucuacaucuucugcc

SEQ ID NO: 3379933 - RNA, 16 nt, Human
ccgcucuccugccaca

SEQ ID NO: 3379934 - RNA, 13 nt, Human
ccgcucucuuccu

SEQ ID NO: 3379935 - RNA, 16 nt, Human
ccgcucucuuccugcc

SEQ ID NO: 3379936 - RNA, 22 nt, Human
ccgcucugcaugcggcccagcc

SEQ ID NO: 3379937 - RNA, 14 nt, Human
ccgcucuggaccaa

SEQ ID NO: 3379938 - RNA, 15 nt, Human
ccgcugauucucagg

SEQ ID NO: 3379939 - RNA, 15 nt, Human
ccgcugccacccacc

SEQ ID NO: 3379940 - RNA, 24 nt, Human
ccgcugccacccaccucccugccu

SEQ ID NO: 3379941 - RNA, 16 nt, Human
ccgcugcugcugcugc

SEQ ID NO: 3379942 - RNA, 12 nt, Human
ccgcuggaggau

SEQ ID NO: 3379943 - RNA, 14 nt, Human
ccgcugggcugagc

SEQ ID NO: 3379944 - RNA, 15 nt, Human
ccgcuguaugucuua

SEQ ID NO: 3379945 - RNA, 20 nt, Human
ccgcugugagccccuggucc

SEQ ID NO: 3379946 - RNA, 15 nt, Human
ccgcuucccuauuua

SEQ ID NO: 3379947 - RNA, 23 nt, Human
ccgcuugaaaagcuaguguaccu

SEQ ID NO: 3379948 - RNA, 21 nt, Human
ccgcuugccucggcuccugcu

SEQ ID NO: 3379949 - RNA, 22 nt, Human
ccgcuugccucggcuccugcug

SEQ ID NO: 3379950 - RNA, 20 nt, Human
ccgcuuggagcuauuuucca

SEQ ID NO: 3379951 - RNA, 16 nt, Human
ccgcuuguccagcgcc

SEQ ID NO: 3379952 - RNA, 16 nt, Human
ccgcuuguggggaccc

SEQ ID NO: 3379953 - RNA, 17 nt, Human
ccgcuuguggggaccca

SEQ ID NO: 3379954 - RNA, 19 nt, Human
ccgcuuguggggacccagg

SEQ ID NO: 3379955 - RNA, 21 nt, Human
ccgcuuguggggacccaggcu

SEQ ID NO: 3379956 - RNA, 23 nt, Human
ccgcuuguggggacccaggcucc

SEQ ID NO: 3379957 - RNA, 19 nt, Human
ccgcuuucuacccagcgag

SEQ ID NO: 3379958 - RNA, 23 nt, Human
ccgcuuucuacccagcgagcccu

SEQ ID NO: 3379959 - RNA, 16 nt, Human
ccgcuuuggccugagu

SEQ ID NO: 3379960 - RNA, 17 nt, Human
ccggacacuccuagaga

SEQ ID NO: 3379961 - RNA, 16 nt, Human
ccggaccagccuggcc

SEQ ID NO: 3379962 - RNA, 13 nt, Human
ccggacuccucuc

SEQ ID NO: 3379963 - RNA, 13 nt, Human
ccggacuggugcc

SEQ ID NO: 3379964 - RNA, 23 nt, Human
caggcgggagcgguggcccuguc

SEQ ID NO: 3379965 - RNA, 18 nt, Human
caggcgugaccugccagg

SEQ ID NO: 3379966 - RNA, 13 nt, Human
caggcgugagcca

SEQ ID NO: 3379967 - RNA, 21 nt, Human
caggcgugagccaccgugccu

SEQ ID NO: 3379968 - RNA, 23 nt, Human
caggcuaauguuggcagaugcag

SEQ ID NO: 3379969 - RNA, 13 nt, Human
caggcuaauuuuu

SEQ ID NO: 3379970 - RNA, 13 nt, Human
caggcuacacuga

SEQ ID NO: 3379971 - RNA, 14 nt, Human
caggcuacuagaau

SEQ ID NO: 3379972 - RNA, 19 nt, Human
caggcuagauguauguacu

SEQ ID NO: 3379973 - RNA, 18 nt, Human
caggcuagcuggagccug

SEQ ID NO: 3379974 - RNA, 18 nt, Human
caggcuaguccggaccca

SEQ ID NO: 3379975 - RNA, 23 nt, Human
caggcuaguccggacccaccuca

SEQ ID NO: 3379976 - RNA, 17 nt, Human
caggcuauguauaaaau

SEQ ID NO: 3379977 - RNA, 18 nt, Human
caggcucaaacaaugaca

SEQ ID NO: 3379978 - RNA, 20 nt, Human
caggcucacucacagaguca

SEQ ID NO: 3379979 - RNA, 15 nt, Human
caggcucacugccag

SEQ ID NO: 3379980 - RNA, 21 nt, Human
caggcucacugccaggccagc

SEQ ID NO: 3379981 - RNA, 15 nt, Human
caggcucaggcaggg

SEQ ID NO: 3379982 - RNA, 22 nt, Human
caggcucauagggaagaccugc

SEQ ID NO: 3379983 - RNA, 24 nt, Human
caggcucccaggagccugcccagc

SEQ ID NO: 3379984 - RNA, 23 nt, Human
caggcucccagggacaccuggga

SEQ ID NO: 3379985 - RNA, 16 nt, Human
caggcuccccugagga

SEQ ID NO: 3379986 - RNA, 17 nt, Human
caggcuccgcccuuagu

SEQ ID NO: 3379987 - RNA, 18 nt, Human
caggcuccgcccuuaguc

SEQ ID NO: 3379988 - RNA, 15 nt, Human
caggcuccugccacc

SEQ ID NO: 3379989 - RNA, 20 nt, Human
caggcuccuuccugucuucc

SEQ ID NO: 3379990 - RNA, 20 nt, Human
caggcuccuuuagcgcccag

SEQ ID NO: 3379991 - RNA, 14 nt, Human
caggcucggccugc

SEQ ID NO: 3379992 - RNA, 20 nt, Human
caggcucgggcuccccagcc

SEQ ID NO: 3379993 - RNA, 14 nt, Human
caggcucucaggcc

SEQ ID NO: 3379994 - RNA, 16 nt, Human
caggcucucaggccag

SEQ ID NO: 3379995 - RNA, 17 nt, Human
caggcucucaggccagc

SEQ ID NO: 3379996 - RNA, 16 nt, Human
caggcucucugggcug

SEQ ID NO: 3379997 - RNA, 12 nt, Human
caggcucucuuu

SEQ ID NO: 3379998 - RNA, 23 nt, Human
caggcucugcccugcccuagcuc

SEQ ID NO: 3379999 - RNA, 13 nt, Human
caggcucugugcu

SEQ ID NO: 3380000 - RNA, 21 nt, Human
caggcucugugcugacccucc

SEQ ID NO: 3380001 - RNA, 15 nt, Human
caggcucuuagcagc

SEQ ID NO: 3380002 - RNA, 12 nt, Human
caggcucuucuc

SEQ ID NO: 3380003 - RNA, 15 nt, Human
caggcucuucuccuu

SEQ ID NO: 3380004 - RNA, 22 nt, Human
caggcucuucuccuuucacaac

SEQ ID NO: 3380005 - RNA, 15 nt, Human
caggcugaaaacaau

SEQ ID NO: 3380006 - RNA, 22 nt, Human
caggcugaccacagcacagcca

SEQ ID NO: 3380007 - RNA, 17 nt, Human
caggcugacguuccggg

SEQ ID NO: 3380008 - RNA, 18 nt, Human
caggcugacguuccgggc

SEQ ID NO: 3380009 - RNA, 20 nt, Human
caggcugagccacucucuuc

SEQ ID NO: 3380010 - RNA, 12 nt, Human
caggcugagccu

SEQ ID NO: 3380011 - RNA, 13 nt, Human
caggcugagccuc

SEQ ID NO: 3380012 - RNA, 15 nt, Human
caggcugagccucag

SEQ ID NO: 3380013 - RNA, 16 nt, Human
caggcugagccucagu

SEQ ID NO: 3380014 - RNA, 20 nt, Human
caggcugagugcaggcccac

SEQ ID NO: 3380015 - RNA, 21 nt, Human
caggcugagugcaggcccacc

SEQ ID NO: 3380016 - RNA, 23 nt, Human
caggcugagugcaggcccacccu

SEQ ID NO: 3380017 - RNA, 16 nt, Human
caggcugcauagaagg

SEQ ID NO: 3380018 - RNA, 16 nt, Human
caggcugccagugccu

SEQ ID NO: 3380019 - RNA, 11 nt, Human
caggcugccug

SEQ ID NO: 3380020 - RNA, 12 nt, Human
caggcugccuga

SEQ ID NO: 3380021 - RNA, 15 nt, Human
caggcugccugaguc

SEQ ID NO: 3380022 - RNA, 15 nt, Human
caggcugcggccccu

SEQ ID NO: 3380023 - RNA, 19 nt, Human
caggcugcggccccucccc

SEQ ID NO: 3380024 - RNA, 16 nt, Human
caggcugcuggaggaa

SEQ ID NO: 3380025 - RNA, 18 nt, Human
caggcugcuggcgccucu

SEQ ID NO: 3380026 - RNA, 20 nt, Human
caggcugcuggcgccucugc

SEQ ID NO: 3380027 - RNA, 22 nt, Human
caggcugcuucaaucccagccu

SEQ ID NO: 3380028 - RNA, 20 nt, Human
caggcuggaagauagcugug

SEQ ID NO: 3380029 - RNA, 20 nt, Human
caggcuggagguaaggccuu

SEQ ID NO: 3380030 - RNA, 16 nt, Human
caggcuggagugcagu

SEQ ID NO: 3380031 - RNA, 16 nt, Human
caggcuggcagcucuc

SEQ ID NO: 3380032 - RNA, 20 nt, Human
caggcuggcagcucuccagu

SEQ ID NO: 3380033 - RNA, 16 nt, Human
caggcuggccagcccc

SEQ ID NO: 3380034 - RNA, 20 nt, Human
caggcuggccagccccacag

SEQ ID NO: 3380035 - RNA, 18 nt, Human
caggcuggccaguccagg

SEQ ID NO: 3380036 - RNA, 19 nt, Human
caggcuggccaguccaggc

SEQ ID NO: 3380037 - RNA, 20 nt, Human
caggcuggcccugcccuggu

SEQ ID NO: 3380038 - RNA, 18 nt, Human
caggcuggcgcagccaag

SEQ ID NO: 3380039 - RNA, 17 nt, Human
caggcuggcgugcagug

SEQ ID NO: 3380040 - RNA, 14 nt, Human
caggcugggagagc

SEQ ID NO: 3380041 - RNA, 15 nt, Human
caggcugggagagcc

SEQ ID NO: 3380042 - RNA, 23 nt, Human
caggcugggagagccuuccaggg

SEQ ID NO: 3380043 - RNA, 11 nt, Human
caggcugggcc

SEQ ID NO: 3380044 - RNA, 18 nt, Human
caggcugggccaugucca

SEQ ID NO: 3380045 - RNA, 14 nt, Human
caggcugggcuuca

SEQ ID NO: 3380046 - RNA, 13 nt, Human
caggcuggggcug

SEQ ID NO: 3380047 - RNA, 18 nt, Human
caggcuggggcugaccuu

SEQ ID NO: 3380048 - RNA, 23 nt, Human
caggcugggugacagagcgagac

SEQ ID NO: 3380049 - RNA, 16 nt, Human
caggcuggucuaaaac

SEQ ID NO: 3380050 - RNA, 20 nt, Human
caggcuggucucgaacuccu

SEQ ID NO: 3380051 - RNA, 18 nt, Human
caggcuggugggaggggc

SEQ ID NO: 3380052 - RNA, 21 nt, Human
caggcuguaggaaaucuaguu

SEQ ID NO: 3380053 - RNA, 20 nt, Human
caggcuguaucccaugagcc

SEQ ID NO: 3380054 - RNA, 22 nt, Human
caggcuguaucccaugagccuc

SEQ ID NO: 3380055 - RNA, 14 nt, Human
caggcugugaguuu

SEQ ID NO: 3380056 - RNA, 19 nt, Human
caggcugugcgcugacaac

SEQ ID NO: 3380057 - RNA, 17 nt, Human
caggcugugggccucaa

SEQ ID NO: 3380058 - RNA, 16 nt, Human
caggcuuaauaaaaau

SEQ ID NO: 3380059 - RNA, 17 nt, Human
caggcuuagggacagga

SEQ ID NO: 3380060 - RNA, 16 nt, Human
caggcuuagucacuga

SEQ ID NO: 3380061 - RNA, 22 nt, Human
caggcuucacccugaaugguuc

SEQ ID NO: 3380062 - RNA, 14 nt, Human
caggcuuccuuggc

SEQ ID NO: 3380063 - RNA, 21 nt, Human
caggcuucugagcagcgagcc

SEQ ID NO: 3380064 - RNA, 14 nt, Human
caggcuucugcugg

SEQ ID NO: 3380065 - RNA, 15 nt, Human
caggcuugccugcag

SEQ ID NO: 3380066 - RNA, 16 nt, Human
caggcuugccugcagg

SEQ ID NO: 3380067 - RNA, 17 nt, Human
caggcuugccugcaggc

SEQ ID NO: 3380068 - RNA, 13 nt, Human
caggcuuucccac

SEQ ID NO: 3380069 - RNA, 13 nt, Human
caggcuuucuaga

SEQ ID NO: 3380070 - RNA, 23 nt, Human
caggcuuuuuuaucaugugaaau

SEQ ID NO: 3380071 - RNA, 17 nt, Human
cagggaaaagcagcucu

SEQ ID NO: 3380072 - RNA, 19 nt, Human
cagggaaaagcagcucucc

SEQ ID NO: 3380073 - RNA, 22 nt, Human
cagggaaacagcuaaugggaca

SEQ ID NO: 3380074 - RNA, 23 nt, Human
cagggaaaggcucugaaagccag

SEQ ID NO: 3380075 - RNA, 13 nt, Human
cagggaacaguau

SEQ ID NO: 3380076 - RNA, 18 nt, Human
cagggaacauggggagga

SEQ ID NO: 3380077 - RNA, 20 nt, Human
cagggaacauggggaggagg

SEQ ID NO: 3380078 - RNA, 22 nt, Human
cagggaacccugcuugcacuuu

SEQ ID NO: 3380079 - RNA, 18 nt, Human
cagggaacgugauuagug

SEQ ID NO: 3380080 - RNA, 20 nt, Human
ccguugggccccagccuucu

SEQ ID NO: 3380081 - RNA, 23 nt, Human
ccguuuccuuucauuuacugugg

SEQ ID NO: 3380082 - RNA, 15 nt, Human
ccguuucuucccugu

SEQ ID NO: 3380083 - RNA, 12 nt, Human
ccguuuucccca

SEQ ID NO: 3380084 - RNA, 19 nt, Human
ccguuuugucacuuuuucu

SEQ ID NO: 3380085 - RNA, 18 nt, Human
ccuaaaaaagauauauua

SEQ ID NO: 3380086 - RNA, 14 nt, Human
ccuaaaaacacaga

SEQ ID NO: 3380087 - RNA, 18 nt, Human
ccuaaaacaaaagcucau

SEQ ID NO: 3380088 - RNA, 20 nt, Human
ccuaaaacuggccugacuug

SEQ ID NO: 3380089 - RNA, 13 nt, Human
ccuaaaagcacuc

SEQ ID NO: 3380090 - RNA, 22 nt, Human
ccuaaaaggaaaucucacccca

SEQ ID NO: 3380091 - RNA, 23 nt, Human
ccuaaaaggaaaucucaccccau

SEQ ID NO: 3380092 - RNA, 14 nt, Human
ccuaaaaggcccag

SEQ ID NO: 3380093 - RNA, 22 nt, Human
ccuaaaaguucauaacagugcc

SEQ ID NO: 3380094 - RNA, 18 nt, Human
ccuaaaauaauugguucu

SEQ ID NO: 3380095 - RNA, 13 nt, Human
ccuaaacauauga

SEQ ID NO: 3380096 - RNA, 16 nt, Human
ccuaaaccaaaaacug

SEQ ID NO: 3380097 - RNA, 15 nt, Human
ccuaaaccccugucc

SEQ ID NO: 3380098 - RNA, 15 nt, Human
ccuaaaccuuugccc

SEQ ID NO: 3380099 - RNA, 14 nt, Human
ccuaaacuaucuuu

SEQ ID NO: 3380100 - RNA, 20 nt, Human
ccuaaagaaaaauaucuugg

SEQ ID NO: 3380101 - RNA, 14 nt, Human
ccuaaagaacaaag

SEQ ID NO: 3380102 - RNA, 15 nt, Human
ccuaaagaacaaagu

SEQ ID NO: 3380103 - RNA, 15 nt, Human
ccuaaagauuuugau

SEQ ID NO: 3380104 - RNA, 16 nt, Human
ccuaaagauuuugauc

SEQ ID NO: 3380105 - RNA, 21 nt, Human
ccuaaagugcugggauuacag

SEQ ID NO: 3380106 - RNA, 23 nt, Human
ccuaaauaaacacauagauucac

SEQ ID NO: 3380107 - RNA, 19 nt, Human
ccuaaauccauuuggaaau

SEQ ID NO: 3380108 - RNA, 14 nt, Human
cagucaccccggcc

SEQ ID NO: 3380109 - RNA, 16 nt, Human
cagucaccccggccac

SEQ ID NO: 3380110 - RNA, 19 nt, Human
cagucaccccggccaccug

SEQ ID NO: 3380111 - RNA, 22 nt, Human
cagucaccccggccaccugcgg

SEQ ID NO: 3380112 - RNA, 18 nt, Human
cagucacguggaggagca

SEQ ID NO: 3380113 - RNA, 20 nt, Human
cagucacucuagucaaugac

SEQ ID NO: 3380114 - RNA, 21 nt, Human
cagucacucuagucaaugaca

SEQ ID NO: 3380115 - RNA, 17 nt, Human
cagucacugaauuccau

SEQ ID NO: 3380116 - RNA, 14 nt, Human
cagucacuggaggu

SEQ ID NO: 3380117 - RNA, 23 nt, Human
cagucacuucggccagagcugaa

SEQ ID NO: 3380118 - RNA, 16 nt, Human
cagucagaaaacuuua

SEQ ID NO: 3380119 - RNA, 19 nt, Human
cagucagaaaacuuuaaaa

SEQ ID NO: 3380120 - RNA, 17 nt, Human
cagucagccucucuccc

SEQ ID NO: 3380121 - RNA, 15 nt, Human
cagucagcucuucau

SEQ ID NO: 3380122 - RNA, 18 nt, Human
cagucagcucuucaucug

SEQ ID NO: 3380123 - RNA, 15 nt, Human
cagucaggaaagaga

SEQ ID NO: 3380124 - RNA, 21 nt, Human
cagucaggaaaggaaucauuu

SEQ ID NO: 3380125 - RNA, 18 nt, Human
cagucaggcucucugggc

SEQ ID NO: 3380126 - RNA, 23 nt, Human
cagucagggaaggugccucugga

SEQ ID NO: 3380127 - RNA, 21 nt, Human
cagucagguaguugcaauuga

SEQ ID NO: 3380128 - RNA, 13 nt, Human
cagucaucaucag

SEQ ID NO: 3380129 - RNA, 17 nt, Human
cagucaucaucagggcc

SEQ ID NO: 3380130 - RNA, 22 nt, Human
cagucaucgaguggcccaacag

SEQ ID NO: 3380131 - RNA, 17 nt, Human
cagucaugcauaaauau

SEQ ID NO: 3380132 - RNA, 18 nt, Human
cagucaugcauaaauaug

SEQ ID NO: 3380133 - RNA, 22 nt, Human
cagucauggagaaccaccuacc

SEQ ID NO: 3380134 - RNA, 23 nt, Human
cagucauguuuuaaauguacagu

SEQ ID NO: 3380135 - RNA, 19 nt, Human
cagucauuauguuaauauu

SEQ ID NO: 3380136 - RNA, 13 nt, Human
cagucauuggcug

SEQ ID NO: 3380137 - RNA, 14 nt, Human
caguccaaaauacu

SEQ ID NO: 3380138 - RNA, 24 nt, Human
caguccaaggaaaccacagcugcu

SEQ ID NO: 3380139 - RNA, 16 nt, Human
caguccaccugagcug

SEQ ID NO: 3380140 - RNA, 23 nt, Human
caguccaccugaggaacugucuc

SEQ ID NO: 3380141 - RNA, 18 nt, Human
caguccacuucugacagc

SEQ ID NO: 3380142 - RNA, 14 nt, Human
caguccagccugga

SEQ ID NO: 3380143 - RNA, 15 nt, Human
caguccagccuggag

SEQ ID NO: 3380144 - RNA, 16 nt, Human
caguccagccuggaga

SEQ ID NO: 3380145 - RNA, 15 nt, Human
caguccaggaacaag

SEQ ID NO: 3380146 - RNA, 18 nt, Human
caguccaggcugccgugg

SEQ ID NO: 3380147 - RNA, 21 nt, Human
caguccaguccuaucugggcu

SEQ ID NO: 3380148 - RNA, 14 nt, Human
caguccauugaaag

SEQ ID NO: 3380149 - RNA, 16 nt, Human
cagucccaaauccuuc

SEQ ID NO: 3380150 - RNA, 18 nt, Human
cagucccaaauccuuccc

SEQ ID NO: 3380151 - RNA, 12 nt, Human
cagucccagcag

SEQ ID NO: 3380152 - RNA, 20 nt, Human
cagucccagcggugggaccu

SEQ ID NO: 3380153 - RNA, 19 nt, Human
cagucccaucagagagcga

SEQ ID NO: 3380154 - RNA, 12 nt, Human
caguccccaccc

SEQ ID NO: 3380155 - RNA, 14 nt, Human
caguccccaccccu

SEQ ID NO: 3380156 - RNA, 20 nt, Human
caguccccaccccugccccc

SEQ ID NO: 3380157 - RNA, 21 nt, Human
caguccccaccccugccccca

SEQ ID NO: 3380158 - RNA, 19 nt, Human
caguccccagaacucugcc

SEQ ID NO: 3380159 - RNA, 21 nt, Human
caguccccagaacucugccug

SEQ ID NO: 3380160 - RNA, 16 nt, Human
caacuauggaucagaa

SEQ ID NO: 3380161 - RNA, 21 nt, Human
caacuauuuauugacucuggg

SEQ ID NO: 3380162 - RNA, 20 nt, Human
caacuauuuuuccaaaauaa

SEQ ID NO: 3380163 - RNA, 18 nt, Human
caacucaccccagcccca

SEQ ID NO: 3380164 - RNA, 15 nt, Human
caacucacuccuuuu

SEQ ID NO: 3380165 - RNA, 18 nt, Human
caacucacuccuuuuaaa

SEQ ID NO: 3380166 - RNA, 12 nt, Human
caacucagacua

SEQ ID NO: 3380167 - RNA, 23 nt, Human
caacucagagaaaaaugcucccc

SEQ ID NO: 3380168 - RNA, 23 nt, Human
caacucagucccuaaaaacacag

SEQ ID NO: 3380169 - RNA, 17 nt, Human
caacucauauuuucaug

SEQ ID NO: 3380170 - RNA, 14 nt, Human
caacucauuccaga

SEQ ID NO: 3380171 - RNA, 16 nt, Human
caacucauuccagauc

SEQ ID NO: 3380172 - RNA, 20 nt, Human
caacuccaacauccacucuc

SEQ ID NO: 3380173 - RNA, 22 nt, Human
caacuccagcaacuucuucucc

SEQ ID NO: 3380174 - RNA, 16 nt, Human
caacuccuaguucuag

SEQ ID NO: 3380175 - RNA, 22 nt, Human
caacuccuaguucuagaaaaac

SEQ ID NO: 3380176 - RNA, 13 nt, Human
caacuccucccau

SEQ ID NO: 3380177 - RNA, 17 nt, Human
caacuccuggaagcugu

SEQ ID NO: 3380178 - RNA, 14 nt, Human
caacuccugucuaa

SEQ ID NO: 3380179 - RNA, 14 nt, Human
caacucgcuuuagg

SEQ ID NO: 3380180 - RNA, 15 nt, Human
caacucgggcucccg

SEQ ID NO: 3380181 - RNA, 19 nt, Human
caacucuccuccagaguca

SEQ ID NO: 3380182 - RNA, 13 nt, Human
caacucucuuauu

SEQ ID NO: 3380183 - RNA, 21 nt, Human
caacucugcugaggguccaga

SEQ ID NO: 3380184 - RNA, 19 nt, Human
caacucuucgaagccuugc

SEQ ID NO: 3380185 - RNA, 12 nt, Human
caacucuugauu

SEQ ID NO: 3380186 - RNA, 13 nt, Human
caacucuuuguua

SEQ ID NO: 3380187 - RNA, 14 nt, Human
caacucuuuguuau

SEQ ID NO: 3380188 - RNA, 22 nt, Human
caacugaaaagacucaguguuc

SEQ ID NO: 3380189 - RNA, 15 nt, Human
caacugaaaguguuu

SEQ ID NO: 3380190 - RNA, 19 nt, Human
caacugaaaguguuuccuu

SEQ ID NO: 3380191 - RNA, 15 nt, Human
caacugaacaaaaaa

SEQ ID NO: 3380192 - RNA, 11 nt, Human
caacugacaca

SEQ ID NO: 3380193 - RNA, 17 nt, Human
caacugaccagccucca

SEQ ID NO: 3380194 - RNA, 14 nt, Human
caacugaucuguua

SEQ ID NO: 3380195 - RNA, 19 nt, Human
caacugcaaagaaaguggg

SEQ ID NO: 3380196 - RNA, 12 nt, Human
caacugcaacuc

SEQ ID NO: 3380197 - RNA, 22 nt, Human
caacugcaagucacaaaggaau

SEQ ID NO: 3380198 - RNA, 15 nt, Human
caacugccuacucca

SEQ ID NO: 3380199 - RNA, 18 nt, Human
caacugccuacuccaaaa

SEQ ID NO: 3380200 - RNA, 21 nt, Human
caacugccucgaaacacagaa

SEQ ID NO: 3380201 - RNA, 13 nt, Human
caacugccugccu

SEQ ID NO: 3380202 - RNA, 18 nt, Human
caacugcucccaccuccu

SEQ ID NO: 3380203 - RNA, 19 nt, Human
caacugcucccaccuccug

SEQ ID NO: 3380204 - RNA, 20 nt, Human
caacugcugaugcucauggu

SEQ ID NO: 3380205 - RNA, 21 nt, Human
caacugcugaugcucaugguc

SEQ ID NO: 3380206 - RNA, 14 nt, Human
caacugcugcccca

SEQ ID NO: 3380207 - RNA, 21 nt, Human
caacugcugccccaaaggaag

SEQ ID NO: 3380208 - RNA, 14 nt, Human
caacugcugcuuuu

SEQ ID NO: 3380209 - RNA, 14 nt, Human
caacuggaagcaca

SEQ ID NO: 3380210 - RNA, 12 nt, Human
caacuggcaggc

SEQ ID NO: 3380211 - RNA, 14 nt, Human
caacuggcaggcag

SEQ ID NO: 3380212 - RNA, 19 nt, Human
caacuggcccuauuuagau

SEQ ID NO: 3380213 - RNA, 14 nt, Human
caacuggcccucuu

SEQ ID NO: 3380214 - RNA, 19 nt, Human
caacuggguccagaagaga

SEQ ID NO: 3380215 - RNA, 21 nt, Human
caacugucuauuucugcugaa

SEQ ID NO: 3380216 - RNA, 21 nt, Human
caacugucuccuaccucugcu

SEQ ID NO: 3380217 - RNA, 23 nt, Human
caacugucucgaugcaaugaaca

SEQ ID NO: 3380218 - RNA, 14 nt, Human
caacuguguagcau

SEQ ID NO: 3380219 - RNA, 15 nt, Human
caacuguguuguauu

SEQ ID NO: 3380220 - RNA, 16 nt, Human
caacuguguuguauua

SEQ ID NO: 3380221 - RNA, 18 nt, Human
caacuuacaaaaacacuu

SEQ ID NO: 3380222 - RNA, 17 nt, Human
caacuucaagugcaugc

SEQ ID NO: 3380223 - RNA, 14 nt, Human
caacuucaguccaa

SEQ ID NO: 3380224 - RNA, 15 nt, Human
caacuucucuugcuu

SEQ ID NO: 3380225 - RNA, 22 nt, Human
caacuucugccucccaugcuua

SEQ ID NO: 3380226 - RNA, 23 nt, Human
caacuugaaauuauaucuguggu

SEQ ID NO: 3380227 - RNA, 18 nt, Human
caacuugagcauguuacu

SEQ ID NO: 3380228 - RNA, 12 nt, Human
caacuugcaaaa

SEQ ID NO: 3380229 - RNA, 18 nt, Human
caacuugcaaaaucaguu

SEQ ID NO: 3380230 - RNA, 19 nt, Human
caacuugcaaaaucaguuu

SEQ ID NO: 3380231 - RNA, 14 nt, Human
caacuugcaagggc

SEQ ID NO: 3380232 - RNA, 14 nt, Human
caacuugcuuauca

SEQ ID NO: 3380233 - RNA, 16 nt, Human
caacuuggcugcagga

SEQ ID NO: 3380234 - RNA, 18 nt, Human
caacuuggcuuccuuucu

SEQ ID NO: 3380235 - RNA, 13 nt, Human
caacuuggcuuuc

SEQ ID NO: 3380236 - RNA, 20 nt, Human
caacuuguauccaggccugg

SEQ ID NO: 3380237 - RNA, 17 nt, Human
caacuugucuuuuucug

SEQ ID NO: 3380238 - RNA, 19 nt, Human
caacuugucuuuuucugga

SEQ ID NO: 3380239 - RNA, 16 nt, Human
caacuuuacuguccua

SEQ ID NO: 3380240 - RNA, 15 nt, Human
caacuuucucuugua

SEQ ID NO: 3380241 - RNA, 16 nt, Human
caacuuucuguaaacu

SEQ ID NO: 3380242 - RNA, 23 nt, Human
caacuuucuguaaacucaaaacu

SEQ ID NO: 3380243 - RNA, 12 nt, Human
caacuuugaaua

SEQ ID NO: 3380244 - RNA, 16 nt, Human
caacuuugaauaaaga

SEQ ID NO: 3380245 - RNA, 22 nt, Human
caacuuugaauaaagaauacuu

SEQ ID NO: 3380246 - RNA, 23 nt, Human
caacuuugaauaaagaauacuug

SEQ ID NO: 3380247 - RNA, 11 nt, Human
caacuuuguau

SEQ ID NO: 3380248 - RNA, 20 nt, Human
caacuuuuccuuugaauccu

SEQ ID NO: 3380249 - RNA, 21 nt, Human
caacuuuuguguaaugaaaau

SEQ ID NO: 3380250 - RNA, 21 nt, Human
caacuuuuuauugccuucuca

SEQ ID NO: 3380251 - RNA, 16 nt, Human
caagaaaaauaaagaa

SEQ ID NO: 3380252 - RNA, 21 nt, Human
caugaugacaacuacagaaaa

SEQ ID NO: 3380253 - RNA, 22 nt, Human
caugaugacuuaguacaaaguu

SEQ ID NO: 3380254 - RNA, 18 nt, Human
caugaugagcuccucuuc

SEQ ID NO: 3380255 - RNA, 14 nt, Human
caugaugcagucuc

SEQ ID NO: 3380256 - RNA, 23 nt, Human
caugaugcagucuccucuuuaaa

SEQ ID NO: 3380257 - RNA, 16 nt, Human
caugaugccucugucu

SEQ ID NO: 3380258 - RNA, 17 nt, Human
caugaugccucugucuu

SEQ ID NO: 3380259 - RNA, 16 nt, Human
caugaugcuuuuacug

SEQ ID NO: 3380260 - RNA, 19 nt, Human
caugauggagucagguuug

SEQ ID NO: 3380261 - RNA, 18 nt, Human
caugauggucacuuaaaa

SEQ ID NO: 3380262 - RNA, 13 nt, Human
caugauguuugcc

SEQ ID NO: 3380263 - RNA, 15 nt, Human
caugauguuugccca

SEQ ID NO: 3380264 - RNA, 22 nt, Human
caugauuaaccacuucagcuga

SEQ ID NO: 3380265 - RNA, 23 nt, Human
caugauuaaccacuucagcugac

SEQ ID NO: 3380266 - RNA, 16 nt, Human
caugauucaugccaau

SEQ ID NO: 3380267 - RNA, 18 nt, Human
caugauucauuuuaacau

SEQ ID NO: 3380268 - RNA, 17 nt, Human
caugauuccagccauca

SEQ ID NO: 3380269 - RNA, 22 nt, Human
caugauuccuuuaacaacaugu

SEQ ID NO: 3380270 - RNA, 21 nt, Human
caugauugguuucuaggcagu

SEQ ID NO: 3380271 - RNA, 16 nt, Human
caugauuuacagagaa

SEQ ID NO: 3380272 - RNA, 22 nt, Human
caugauuucacaaauauuaaaa

SEQ ID NO: 3380273 - RNA, 14 nt, Human
caugauuucaugua

SEQ ID NO: 3380274 - RNA, 20 nt, Human
caugauuucauguacugcau

SEQ ID NO: 3380275 - RNA, 14 nt, Human
caugauuuccuuga

SEQ ID NO: 3380276 - RNA, 24 nt, Human
caugauuuugaaaucaugaagaua

SEQ ID NO: 3380277 - RNA, 17 nt, Human
caugcaaaaagaaauga

SEQ ID NO: 3380278 - RNA, 14 nt, Human
caugcaaacucuuu

SEQ ID NO: 3380279 - RNA, 14 nt, Human
caugcaaaggcugg

SEQ ID NO: 3380280 - RNA, 16 nt, Human
caugcaaaggcuggga

SEQ ID NO: 3380281 - RNA, 20 nt, Human
caugcaaaugagcucugaaa

SEQ ID NO: 3380282 - RNA, 22 nt, Human
caugcaagcagaggaccagggc

SEQ ID NO: 3380283 - RNA, 20 nt, Human
caugcaaggggaaaaucuca

SEQ ID NO: 3380284 - RNA, 15 nt, Human
caugcaaggucauuu

SEQ ID NO: 3380285 - RNA, 16 nt, Human
caugcaaguauucuca

SEQ ID NO: 3380286 - RNA, 16 nt, Human
caugcaaugacaucuu

SEQ ID NO: 3380287 - RNA, 18 nt, Human
caugcaauuuauuaaaau

SEQ ID NO: 3380288 - RNA, 10 nt, Human
caugcacaca

SEQ ID NO: 3380289 - RNA, 14 nt, Human
caugcacaccuccc

SEQ ID NO: 3380290 - RNA, 19 nt, Human
caugcacaguauuuguaau

SEQ ID NO: 3380291 - RNA, 20 nt, Human
caugcacaguauuuguaauu

SEQ ID NO: 3380292 - RNA, 12 nt, Human
caugcaccaaac

SEQ ID NO: 3380293 - RNA, 16 nt, Human
caugcacccucauaca

SEQ ID NO: 3380294 - RNA, 16 nt, Human
caugcacgugugugca

SEQ ID NO: 3380295 - RNA, 15 nt, Human
caugcacucagcucu

SEQ ID NO: 3380296 - RNA, 17 nt, Human
caugcacugacccuucc

SEQ ID NO: 3380297 - RNA, 10 nt, Human
caugcacugu

SEQ ID NO: 3380298 - RNA, 19 nt, Human
caugcacuguucccccugu

SEQ ID NO: 3380299 - RNA, 17 nt, Human
caugcacuuaaagaagu

SEQ ID NO: 3380300 - RNA, 14 nt, Human
caugcagaaagcau

SEQ ID NO: 3380301 - RNA, 19 nt, Human
caugcagauggggcucccg

SEQ ID NO: 3380302 - RNA, 12 nt, Human
caugcagcagcu

SEQ ID NO: 3380303 - RNA, 22 nt, Human
caugcagccuaaggcuguauga

SEQ ID NO: 3380304 - RNA, 13 nt, Human
caugcaggcccuu

SEQ ID NO: 3380305 - RNA, 17 nt, Human
caugcaguuugaaauuc

SEQ ID NO: 3380306 - RNA, 21 nt, Human
caugcaguuugaaauucugaa

SEQ ID NO: 3380307 - RNA, 16 nt, Human
caugcauaaauaugca

SEQ ID NO: 3380308 - RNA, 18 nt, Human
caugcauaaauaugcagu

SEQ ID NO: 3380309 - RNA, 12 nt, Human
caugcauacaca

SEQ ID NO: 3380310 - RNA, 15 nt, Human
caugcauacacucuc

SEQ ID NO: 3380311 - RNA, 18 nt, Human
caugcauagucccagcua

SEQ ID NO: 3380312 - RNA, 21 nt, Human
caugcauauaaugaauaaauc

SEQ ID NO: 3380313 - RNA, 14 nt, Human
caugcaucaaguua

SEQ ID NO: 3380314 - RNA, 14 nt, Human
caugcaucaucuca

SEQ ID NO: 3380315 - RNA, 13 nt, Human
caugcaucuguuu

SEQ ID NO: 3380316 - RNA, 15 nt, Human
caugcaucuguuuau

SEQ ID NO: 3380317 - RNA, 16 nt, Human
caugcaucuuacugaa

SEQ ID NO: 3380318 - RNA, 17 nt, Human
caugcaucuuacugaag

SEQ ID NO: 3380319 - RNA, 19 nt, Human
caugcaugacagccucuau

SEQ ID NO: 3380320 - RNA, 17 nt, Human
caugcauggaaauuccc

SEQ ID NO: 3380321 - RNA, 14 nt, Human
caugcaugugcuug

SEQ ID NO: 3380322 - RNA, 17 nt, Human
caugcauuacugcaugc

SEQ ID NO: 3380323 - RNA, 14 nt, Human
caugcauucauaca

SEQ ID NO: 3380324 - RNA, 17 nt, Human
caugcauuguugaggug

SEQ ID NO: 3380325 - RNA, 16 nt, Human
caugccaacaagaaug

SEQ ID NO: 3380326 - RNA, 12 nt, Human
caagacaaauca

SEQ ID NO: 3380327 - RNA, 21 nt, Human
caagacaaaucaacagaagca

SEQ ID NO: 3380328 - RNA, 13 nt, Human
caagacacaguga

SEQ ID NO: 3380329 - RNA, 13 nt, Human
caagacagaugcc

SEQ ID NO: 3380330 - RNA, 14 nt, Human
caagacaugucugu

SEQ ID NO: 3380331 - RNA, 15 nt, Human
caagacaugucuguu

SEQ ID NO: 3380332 - RNA, 18 nt, Human
caagaccaaaaugacaau

SEQ ID NO: 3380333 - RNA, 15 nt, Human
caagaccaaauggaa

SEQ ID NO: 3380334 - RNA, 19 nt, Human
caagaccaccacuucgaaa

SEQ ID NO: 3380335 - RNA, 18 nt, Human
caagaccacguuucuaaa

SEQ ID NO: 3380336 - RNA, 12 nt, Human
caagaccagacu

SEQ ID NO: 3380337 - RNA, 14 nt, Human
caagacccccagca

SEQ ID NO: 3380338 - RNA, 15 nt, Human
caagacccccagcac

SEQ ID NO: 3380339 - RNA, 15 nt, Human
caagaccccugucuu

SEQ ID NO: 3380340 - RNA, 15 nt, Human
caagacccugucucu

SEQ ID NO: 3380341 - RNA, 19 nt, Human
caagacccuugugguccca

SEQ ID NO: 3380342 - RNA, 16 nt, Human
caagaccucacacaca

SEQ ID NO: 3380343 - RNA, 15 nt, Human
caagaccucagggca

SEQ ID NO: 3380344 - RNA, 17 nt, Human
caagaccucagugccuu

SEQ ID NO: 3380345 - RNA, 13 nt, Human
caagaccugacuc

SEQ ID NO: 3380346 - RNA, 13 nt, Human
caagaccuucucc

SEQ ID NO: 3380347 - RNA, 18 nt, Human
caagaccuucuccuucac

SEQ ID NO: 3380348 - RNA, 20 nt, Human
caagacgcugugcugcccug

SEQ ID NO: 3380349 - RNA, 21 nt, Human
caagacgcugugcugcccugc

SEQ ID NO: 3380350 - RNA, 22 nt, Human
caagacgcugugcugcccugcc

SEQ ID NO: 3380351 - RNA, 23 nt, Human
caagacgcugugcugcccugccc

SEQ ID NO: 3380352 - RNA, 14 nt, Human
caagacucccauga

SEQ ID NO: 3380353 - RNA, 18 nt, Human
caagacucccaugaggga

SEQ ID NO: 3380354 - RNA, 18 nt, Human
caagacucuuuggacacu

SEQ ID NO: 3380355 - RNA, 20 nt, Human
caagacugcuguggccagga

SEQ ID NO: 3380356 - RNA, 22 nt, Human
caagacuggaagguggggacag

SEQ ID NO: 3380357 - RNA, 16 nt, Human
caagacuguuagcccu

SEQ ID NO: 3380358 - RNA, 21 nt, Human
caagacuucucuuugccucaa

SEQ ID NO: 3380359 - RNA, 17 nt, Human
caagacuugaaggugcc

SEQ ID NO: 3380360 - RNA, 18 nt, Human
caagacuugaaggugccu

SEQ ID NO: 3380361 - RNA, 15 nt, Human
caagacuuggcaaca

SEQ ID NO: 3380362 - RNA, 15 nt, Human
caagacuuuucuuug

SEQ ID NO: 3380363 - RNA, 17 nt, Human
caagacuuuucuuugaa

SEQ ID NO: 3380364 - RNA, 14 nt, Human
caagagaaacuucc

SEQ ID NO: 3380365 - RNA, 20 nt, Human
caagagaaaggccugcacac

SEQ ID NO: 3380366 - RNA, 22 nt, Human
caagagaacucgcgcucaguaa

SEQ ID NO: 3380367 - RNA, 24 nt, Human
caagagaacucgcgcucaguaaac

SEQ ID NO: 3380368 - RNA, 19 nt, Human
caagagaaggggaagcacu

SEQ ID NO: 3380369 - RNA, 22 nt, Human
caagagaauugcuugaacccag

SEQ ID NO: 3380370 - RNA, 20 nt, Human
caagagagggccaugcaauu

SEQ ID NO: 3380371 - RNA, 16 nt, Human
caagagauugcuaauu

SEQ ID NO: 3380372 - RNA, 20 nt, Human
caagagauugcuaauugcug

SEQ ID NO: 3380373 - RNA, 13 nt, Human
caagagcacacuu

SEQ ID NO: 3380374 - RNA, 18 nt, Human
caagagcaucaugccucu

SEQ ID NO: 3380375 - RNA, 21 nt, Human
caagagcaucaugccucugag

SEQ ID NO: 3380376 - RNA, 13 nt, Human
caagagccacagu

SEQ ID NO: 3380377 - RNA, 13 nt, Human
caagagcccaggc

SEQ ID NO: 3380378 - RNA, 14 nt, Human
caagagcccaggcc

SEQ ID NO: 3380379 - RNA, 15 nt, Human
caagagcccaggccu

SEQ ID NO: 3380380 - RNA, 13 nt, Human
caagagcccuguc

SEQ ID NO: 3380381 - RNA, 13 nt, Human
caagagccugaga

SEQ ID NO: 3380382 - RNA, 12 nt, Human
caagagccugau

SEQ ID NO: 3380383 - RNA, 14 nt, Human
caagagccugaucu

SEQ ID NO: 3380384 - RNA, 16 nt, Human
caagagccugaucucu

SEQ ID NO: 3380385 - RNA, 20 nt, Human
caagagccugaucucuuccu

SEQ ID NO: 3380386 - RNA, 22 nt, Human
caagagccugaucucuuccugu

SEQ ID NO: 3380387 - RNA, 21 nt, Human
caagagccuugguguccaccu

SEQ ID NO: 3380388 - RNA, 22 nt, Human
caagagccuugguguccaccug

SEQ ID NO: 3380389 - RNA, 16 nt, Human
caagaggagcccccac

SEQ ID NO: 3380390 - RNA, 17 nt, Human
caagaggcaaaggaauc

SEQ ID NO: 3380391 - RNA, 19 nt, Human
caagaggcaagcugaaauu

SEQ ID NO: 3380392 - RNA, 11 nt, Human
caagaggcuga

SEQ ID NO: 3380393 - RNA, 16 nt, Human
caagaggcugcagcca

SEQ ID NO: 3380394 - RNA, 14 nt, Human
caagaggcugguuu

SEQ ID NO: 3380395 - RNA, 16 nt, Human
caagaggcugguuuug

SEQ ID NO: 3380396 - RNA, 13 nt, Human
caagagggcacug

SEQ ID NO: 3380397 - RNA, 22 nt, Human
caagaggguccuuuaguaccug

SEQ ID NO: 3380398 - RNA, 22 nt, Human
cauaaccaugugaaaaggcaaa

SEQ ID NO: 3380399 - RNA, 12 nt, Human
cauaaccugucu

SEQ ID NO: 3380400 - RNA, 18 nt, Human
cauaacguuuuuccuuua

SEQ ID NO: 3380401 - RNA, 17 nt, Human
cauaacuaaauuugaua

SEQ ID NO: 3380402 - RNA, 18 nt, Human
cauaacuaaauuugauac

SEQ ID NO: 3380403 - RNA, 21 nt, Human
cauaacuaaauuugauacuua

SEQ ID NO: 3380404 - RNA, 22 nt, Human
cauaacucuguaaaaacacuga

SEQ ID NO: 3380405 - RNA, 12 nt, Human
cauaacugccuu

SEQ ID NO: 3380406 - RNA, 23 nt, Human
cauaacugccuugaaccugugag

SEQ ID NO: 3380407 - RNA, 16 nt, Human
cauaacuuauugcuga

SEQ ID NO: 3380408 - RNA, 19 nt, Human
cauaacuuauugcugauuu

SEQ ID NO: 3380409 - RNA, 21 nt, Human
cauaagaaugaauaauaauua

SEQ ID NO: 3380410 - RNA, 23 nt, Human
cauaagaccauaacagccaacag

SEQ ID NO: 3380411 - RNA, 20 nt, Human
cauaagacccuaagccuccu

SEQ ID NO: 3380412 - RNA, 17 nt, Human
cauaagaucacugccag

SEQ ID NO: 3380413 - RNA, 17 nt, Human
cauaagccaauuuuucu

SEQ ID NO: 3380414 - RNA, 20 nt, Human
cauaagcuacugccauccug

SEQ ID NO: 3380415 - RNA, 20 nt, Human
cauaagcuauuuuucuaacu

SEQ ID NO: 3380416 - RNA, 13 nt, Human
cauaagcuuccau

SEQ ID NO: 3380417 - RNA, 22 nt, Human
cauaaggaauguagcugguuuc

SEQ ID NO: 3380418 - RNA, 18 nt, Human
cauaaggucagcucagag

SEQ ID NO: 3380419 - RNA, 18 nt, Human
cauaaguaauucaagaaa

SEQ ID NO: 3380420 - RNA, 19 nt, Human
cauaaguauuaugucucuu

SEQ ID NO: 3380421 - RNA, 17 nt, Human
cauaaguauuuggaauu

SEQ ID NO: 3380422 - RNA, 16 nt, Human
cauaagugaauuuaua

SEQ ID NO: 3380423 - RNA, 18 nt, Human
cauaagugcuauugcaga

SEQ ID NO: 3380424 - RNA, 17 nt, Human
cauaauaaaugcuucag

SEQ ID NO: 3380425 - RNA, 15 nt, Human
cauaauacugaacca

SEQ ID NO: 3380426 - RNA, 15 nt, Human
cauaauacuugcuuu

SEQ ID NO: 3380427 - RNA, 23 nt, Human
cauaauagacuucccacucuagg

SEQ ID NO: 3380428 - RNA, 15 nt, Human
cauaaucacucuaau

SEQ ID NO: 3380429 - RNA, 21 nt, Human
cauaaucuggacuccucuguc

SEQ ID NO: 3380430 - RNA, 22 nt, Human
cauaaucuucugccuucucaug

SEQ ID NO: 3380431 - RNA, 22 nt, Human
cauaaugaaaauauuuuuuaca

SEQ ID NO: 3380432 - RNA, 20 nt, Human
cauaaugcauucuucucugu

SEQ ID NO: 3380433 - RNA, 14 nt, Human
cauaaugcuacugu

SEQ ID NO: 3380434 - RNA, 19 nt, Human
cauaaugcuuaauuucuaa

SEQ ID NO: 3380435 - RNA, 17 nt, Human
cauaauguuacauuauu

SEQ ID NO: 3380436 - RNA, 18 nt, Human
cauaauguuucuggauuu

SEQ ID NO: 3380437 - RNA, 21 nt, Human
cauaauguuucuggauuucau

SEQ ID NO: 3380438 - RNA, 23 nt, Human
cauaauguuucuggauuucauac

SEQ ID NO: 3380439 - RNA, 14 nt, Human
cauaauuaaagugu

SEQ ID NO: 3380440 - RNA, 13 nt, Human
cauaauuaacacu

SEQ ID NO: 3380441 - RNA, 16 nt, Human
cauaauuagauccauu

SEQ ID NO: 3380442 - RNA, 22 nt, Human
cauaauuagauccauuaauuua

SEQ ID NO: 3380443 - RNA, 15 nt, Human
cauaauuaugacagu

SEQ ID NO: 3380444 - RNA, 17 nt, Human
cauaauuaugacaguua

SEQ ID NO: 3380445 - RNA, 14 nt, Human
cauaauucacucug

SEQ ID NO: 3380446 - RNA, 23 nt, Human
cauaauucacucugaguguuuua

SEQ ID NO: 3380447 - RNA, 11 nt, Human
cauaauuccua

SEQ ID NO: 3380448 - RNA, 18 nt, Human
cauaauuccuacagcacu

SEQ ID NO: 3380449 - RNA, 19 nt, Human
cauaauuccuacagcacua

SEQ ID NO: 3380450 - RNA, 14 nt, Human
cauaauucuuauua

SEQ ID NO: 3380451 - RNA, 18 nt, Human
cauaauugcauugacuuu

SEQ ID NO: 3380452 - RNA, 21 nt, Human
cauaauugugauuagacagaa

SEQ ID NO: 3380453 - RNA, 14 nt, Human
cauaauuuaaaaau

SEQ ID NO: 3380454 - RNA, 18 nt, Human
cauaauuuaaaaauauau

SEQ ID NO: 3380455 - RNA, 18 nt, Human
cauaauuuaguuguuucu

SEQ ID NO: 3380456 - RNA, 13 nt, Human
cauaauuuauaca

SEQ ID NO: 3380457 - RNA, 15 nt, Human
cauaauuuggaggga

SEQ ID NO: 3380458 - RNA, 15 nt, Human
cauaauuuguacaua

SEQ ID NO: 3380459 - RNA, 18 nt, Human
cauaauuuguuuccagca

SEQ ID NO: 3380460 - RNA, 14 nt, Human
cauaauuuucuuca

SEQ ID NO: 3380461 - RNA, 20 nt, Human
cauaauuuucuucaugcaau

SEQ ID NO: 3380462 - RNA, 20 nt, Human
cauacaaaugcaucuuugau

SEQ ID NO: 3380463 - RNA, 22 nt, Human
cauacaaaugcaucuuugaugu

SEQ ID NO: 3380464 - RNA, 16 nt, Human
cauacaacacaaagag

SEQ ID NO: 3380465 - RNA, 17 nt, Human
cauacaacacaaagaga

SEQ ID NO: 3380466 - RNA, 19 nt, Human
cauacaaguuuauaaagag

SEQ ID NO: 3380467 - RNA, 22 nt, Human
cauacacaagcgugucaggcug

SEQ ID NO: 3380468 - RNA, 12 nt, Human
cauacacacaca

SEQ ID NO: 3380469 - RNA, 19 nt, Human
cauacacacacacacacag

SEQ ID NO: 3380470 - RNA, 23 nt, Human
cauacacacacacacacagccac

SEQ ID NO: 3380471 - RNA, 21 nt, Human
cauacacccccucuucugagc

SEQ ID NO: 3380472 - RNA, 20 nt, Human
cauacaccuaugucauuuca

SEQ ID NO: 3380473 - RNA, 16 nt, Human
cauacacuuguauaaa

SEQ ID NO: 3380474 - RNA, 20 nt, Human
cauacacuuguauaaaugua

SEQ ID NO: 3380475 - RNA, 21 nt, Human
cauacacuuguauaaauguau

SEQ ID NO: 3380476 - RNA, 12 nt, Human
cauacagcucua

SEQ ID NO: 3380477 - RNA, 23 nt, Human
cauacaggaagguagaaauaucu

SEQ ID NO: 3380478 - RNA, 16 nt, Human
cauacagggauggugu

SEQ ID NO: 3380479 - RNA, 21 nt, Human
cauacaguuuuaugcucuuuu

SEQ ID NO: 3380480 - RNA, 22 nt, Human
cauacaguuuuaugcucuuuuu

SEQ ID NO: 3380481 - RNA, 14 nt, Human
cauacauaaaagaa

SEQ ID NO: 3380482 - RNA, 12 nt, Human
cauacauauuuu

SEQ ID NO: 3380483 - RNA, 21 nt, Human
cauacaucaguuauucauucu

SEQ ID NO: 3380484 - RNA, 22 nt, Human
cauacauuuauaauguuugcua

SEQ ID NO: 3380485 - RNA, 23 nt, Human
cauacauuuauaauguuugcuau

SEQ ID NO: 3380486 - RNA, 24 nt, Human
cauacauuuauaauguuugcuauu

SEQ ID NO: 3380487 - RNA, 18 nt, Human
cauacauuuucuaagaaa

SEQ ID NO: 3380488 - RNA, 15 nt, Human
cauaccacuuuuguu

SEQ ID NO: 3380489 - RNA, 19 nt, Human
cauaccacuuuuguucuug

SEQ ID NO: 3380490 - RNA, 23 nt, Human
cauaccagcucgcaccccccugu

SEQ ID NO: 3380491 - RNA, 11 nt, Human
cauacccaccc

SEQ ID NO: 3380492 - RNA, 18 nt, Human
cauacccacccccaccca

SEQ ID NO: 3380493 - RNA, 21 nt, Human
cauacccacccccacccaagg

SEQ ID NO: 3380494 - RNA, 13 nt, Human
cauacccccuccc

SEQ ID NO: 3380495 - RNA, 18 nt, Human
cauaccccuuacaaauga

SEQ ID NO: 3380496 - RNA, 20 nt, Human
cauacccgccuagcugcugu

SEQ ID NO: 3380497 - RNA, 19 nt, Human
cauacccugaccuggcccc

SEQ ID NO: 3380498 - RNA, 22 nt, Human
cauaccucagaauguaaaagaa

SEQ ID NO: 3380499 - RNA, 21 nt, Human
cauaccuccuauggguuguca

SEQ ID NO: 3380500 - RNA, 18 nt, Human
cauaccugcuggugcaga

SEQ ID NO: 3380501 - RNA, 13 nt, Human
cauaccuuccuuc

SEQ ID NO: 3380502 - RNA, 21 nt, Human
cauaccuuccuucccugggcu

SEQ ID NO: 3380503 - RNA, 17 nt, Human
cauacgcucagcucauc

SEQ ID NO: 3380504 - RNA, 22 nt, Human
cauacgcuuuuaaugaaaagga

SEQ ID NO: 3380505 - RNA, 23 nt, Human
cauacggucagguuuaacauuug

SEQ ID NO: 3380506 - RNA, 17 nt, Human
cauacguacacauuuua

SEQ ID NO: 3380507 - RNA, 16 nt, Human
cauacgugugcaugug

SEQ ID NO: 3380508 - RNA, 23 nt, Human
cauacuacauugaguagacacau

SEQ ID NO: 3380509 - RNA, 18 nt, Human
cauacuauuaaacaugcu

SEQ ID NO: 3380510 - RNA, 19 nt, Human
cauacucaauguuacuauc

SEQ ID NO: 3380511 - RNA, 18 nt, Human
cauacucagccugcugcc

SEQ ID NO: 3380512 - RNA, 21 nt, Human
cauacucagccugcugcccag

SEQ ID NO: 3380513 - RNA, 20 nt, Human
cauacucauuucuaaaagaa

SEQ ID NO: 3380514 - RNA, 23 nt, Human
cauacuccaucaguuagagcuga

SEQ ID NO: 3380515 - RNA, 16 nt, Human
cauacucccaucugug

SEQ ID NO: 3380516 - RNA, 20 nt, Human
cauacucccaucugugaaag

SEQ ID NO: 3380517 - RNA, 11 nt, Human
cauacucugcu

SEQ ID NO: 3380518 - RNA, 20 nt, Human
cauacugagggaccaacugg

SEQ ID NO: 3380519 - RNA, 20 nt, Human
cauacuggccucgccuggcc

SEQ ID NO: 3380520 - RNA, 22 nt, Human
cauacuggccucgccuggccug

SEQ ID NO: 3380521 - RNA, 13 nt, Human
cauacuggccugg

SEQ ID NO: 3380522 - RNA, 15 nt, Human
cauacuggccuggac

SEQ ID NO: 3380523 - RNA, 17 nt, Human
cauacuggcuucaccau

SEQ ID NO: 3380524 - RNA, 17 nt, Human
cauacugugcuggagcc

SEQ ID NO: 3380525 - RNA, 18 nt, Human
cauacuuaccuagugaaa

SEQ ID NO: 3380526 - RNA, 14 nt, Human
cauacuucaaaagu

SEQ ID NO: 3380527 - RNA, 22 nt, Human
cauacuucaaaaguauuuuccu

SEQ ID NO: 3380528 - RNA, 22 nt, Human
cauacuugaacguuuucuaauu

SEQ ID NO: 3380529 - RNA, 13 nt, Human
cauacuugaaggg

SEQ ID NO: 3380530 - RNA, 20 nt, Human
cauacuugaagggccagagc

SEQ ID NO: 3380531 - RNA, 12 nt, Human
cauacuuuauca

SEQ ID NO: 3380532 - RNA, 22 nt, Human
cauguggggagguuaaucuagg

SEQ ID NO: 3380533 - RNA, 23 nt, Human
cauguggugaugauguguauaua

SEQ ID NO: 3380534 - RNA, 21 nt, Human
cauguggugggacagggaccc

SEQ ID NO: 3380535 - RNA, 17 nt, Human
caugugguuaaugccau

SEQ ID NO: 3380536 - RNA, 23 nt, Human
caugugguuacacagugugaaua

SEQ ID NO: 3380537 - RNA, 23 nt, Human
caugugguuugguuccucucugg

SEQ ID NO: 3380538 - RNA, 23 nt, Human
cauguguaaucaauaaacgauuu

SEQ ID NO: 3380539 - RNA, 16 nt, Human
cauguguagccugugc

SEQ ID NO: 3380540 - RNA, 14 nt, Human
cauauccugagcca

SEQ ID NO: 3380541 - RNA, 13 nt, Human
cauauccugccuc

SEQ ID NO: 3380542 - RNA, 15 nt, Human
cauauccugccucag

SEQ ID NO: 3380543 - RNA, 18 nt, Human
cauaucgcugacuucaug

SEQ ID NO: 3380544 - RNA, 22 nt, Human
cauaucgcugacuucauggaau

SEQ ID NO: 3380545 - RNA, 15 nt, Human
cauaucuaguaugaa

SEQ ID NO: 3380546 - RNA, 16 nt, Human
cauuacucuuguaaga

SEQ ID NO: 3380547 - RNA, 16 nt, Human
cauuacugcaugcacu

SEQ ID NO: 3380548 - RNA, 18 nt, Human
cauuagaccaagcuuguc

SEQ ID NO: 3380549 - RNA, 16 nt, Human
cauuagacuccuccuc

SEQ ID NO: 3380550 - RNA, 19 nt, Human
cauuagagaacauccuggc

SEQ ID NO: 3380551 - RNA, 19 nt, Human
cauuagauuuuauuuuacu

SEQ ID NO: 3380552 - RNA, 21 nt, Human
cauuagauuuuauuuuacuau

SEQ ID NO: 3380553 - RNA, 18 nt, Human
cauuagcaguuugcuuug

SEQ ID NO: 3380554 - RNA, 14 nt, Human
cauuagccugagua

SEQ ID NO: 3380555 - RNA, 19 nt, Human
cauuagccugaguagaaag

SEQ ID NO: 3380556 - RNA, 23 nt, Human
cauuagccugaguagaaaggccu

SEQ ID NO: 3380557 - RNA, 19 nt, Human
cauuaggaaaaguugcuau

SEQ ID NO: 3380558 - RNA, 17 nt, Human
cauuagggggaacucua

SEQ ID NO: 3380559 - RNA, 15 nt, Human
cauuagguugugaau

SEQ ID NO: 3380560 - RNA, 16 nt, Human
cauuagguugugaaug

SEQ ID NO: 3380561 - RNA, 17 nt, Human
cauuaguaaaugucuuu

SEQ ID NO: 3380562 - RNA, 21 nt, Human
cauuaguaaaugucuuuguaa

SEQ ID NO: 3380563 - RNA, 22 nt, Human
cauuaguaaaugucuuuguaag

SEQ ID NO: 3380564 - RNA, 21 nt, Human
cauuaguacacagcaccagaa

SEQ ID NO: 3380565 - RNA, 15 nt, Human
cauuaguacuuuaua

SEQ ID NO: 3380566 - RNA, 13 nt, Human
cauuauaaaaaga

SEQ ID NO: 3380567 - RNA, 13 nt, Human
cauuauaaacgcu

SEQ ID NO: 3380568 - RNA, 16 nt, Human
cauuauaaccuuaauu

SEQ ID NO: 3380569 - RNA, 18 nt, Human
cauuauaacugaaggaga

SEQ ID NO: 3380570 - RNA, 18 nt, Human
cauuauaaucaccagggc

SEQ ID NO: 3380571 - RNA, 15 nt, Human
cauuauaaugaauuu

SEQ ID NO: 3380572 - RNA, 17 nt, Human
cauuauagaucccccag

SEQ ID NO: 3380573 - RNA, 19 nt, Human
cauuauauuucuauuuuau

SEQ ID NO: 3380574 - RNA, 13 nt, Human
cauuaucaugugu

SEQ ID NO: 3380575 - RNA, 22 nt, Human
cauuaucauguguaaucaauaa

SEQ ID NO: 3380576 - RNA, 13 nt, Human
cauuaucccugaa

SEQ ID NO: 3380577 - RNA, 16 nt, Human
cauuaucuagauacug

SEQ ID NO: 3380578 - RNA, 17 nt, Human
cauuaucuagauacugu

SEQ ID NO: 3380579 - RNA, 16 nt, Human
cauuaugagaggcaau

SEQ ID NO: 3380580 - RNA, 22 nt, Human
cauuaugagaggcaaugauugu

SEQ ID NO: 3380581 - RNA, 12 nt, Human
cauuaugagguc

SEQ ID NO: 3380582 - RNA, 15 nt, Human
cauuaugaggucaga

SEQ ID NO: 3380583 - RNA, 13 nt, Human
cauuaugauucuu

SEQ ID NO: 3380584 - RNA, 18 nt, Human
cauuaugccacuuccuuu

SEQ ID NO: 3380585 - RNA, 23 nt, Human
cauuaugccacuuccuuuuaacu

SEQ ID NO: 3380586 - RNA, 17 nt, Human
cauuauguaaaauguuu

SEQ ID NO: 3380587 - RNA, 20 nt, Human
cauuauguaaaauguuuuag

SEQ ID NO: 3380588 - RNA, 17 nt, Human
cauuauguccacugugu

SEQ ID NO: 3380589 - RNA, 17 nt, Human
cauuaugugguuuuaga

SEQ ID NO: 3380590 - RNA, 18 nt, Human
cauuaugugugcaugugu

SEQ ID NO: 3380591 - RNA, 23 nt, Human
cauuauuacuuuuccucuuagaa

SEQ ID NO: 3380592 - RNA, 16 nt, Human
cauuauuacuuuugcu

SEQ ID NO: 3380593 - RNA, 22 nt, Human
cauuauuauauaaaucaugaug

SEQ ID NO: 3380594 - RNA, 22 nt, Human
cauuauucguagauauuggaca

SEQ ID NO: 3380595 - RNA, 14 nt, Human
cauuauugcuuauu

SEQ ID NO: 3380596 - RNA, 18 nt, Human
cauuauuggaauauaauu

SEQ ID NO: 3380597 - RNA, 20 nt, Human
cauuauuggaauuaaccugg

SEQ ID NO: 3380598 - RNA, 23 nt, Human
cauuauuuauauggggaauauau

SEQ ID NO: 3380599 - RNA, 12 nt, Human
cauuauuuggau

SEQ ID NO: 3380600 - RNA, 12 nt, Human
cauuauuuguca

SEQ ID NO: 3380601 - RNA, 13 nt, Human
cauuauuugucaa

SEQ ID NO: 3380602 - RNA, 17 nt, Human
cauuauuuuauuaugaa

SEQ ID NO: 3380603 - RNA, 15 nt, Human
cauuauuuucuguca

SEQ ID NO: 3380604 - RNA, 17 nt, Human
cauuauuuucugucaga

SEQ ID NO: 3380605 - RNA, 18 nt, Human
cauuauuuucugucagau

SEQ ID NO: 3380606 - RNA, 20 nt, Human
cauuauuuuuccacuuuguu

SEQ ID NO: 3380607 - RNA, 13 nt, Human
cauucaaaaauuu

SEQ ID NO: 3380608 - RNA, 18 nt, Human
cauucaaaaguugaaauu

SEQ ID NO: 3380609 - RNA, 19 nt, Human
cauucaaaaguugaaauua

SEQ ID NO: 3380610 - RNA, 20 nt, Human
cauucaaauguauuacagug

SEQ ID NO: 3380611 - RNA, 23 nt, Human
cauucaaauuaaggguuaagaaa

SEQ ID NO: 3380612 - RNA, 21 nt, Human
cauucaauauugacauuugua

SEQ ID NO: 3380613 - RNA, 17 nt, Human
cauucacaucgcagauu

SEQ ID NO: 3380614 - RNA, 13 nt, Human
cauucacccagac

SEQ ID NO: 3380615 - RNA, 20 nt, Human
cauucacccagacagcuccc

SEQ ID NO: 3380616 - RNA, 13 nt, Human
cauucacucuucc

SEQ ID NO: 3380617 - RNA, 14 nt, Human
cauucacucuucca

SEQ ID NO: 3380618 - RNA, 11 nt, Human
cauucacuuca

SEQ ID NO: 3380619 - RNA, 18 nt, Human
cauucacuucacugugcu

SEQ ID NO: 3380620 - RNA, 13 nt, Human
cauucagaaaaaa

SEQ ID NO: 3380621 - RNA, 14 nt, Human
cauucagaaauguu

SEQ ID NO: 3380622 - RNA, 15 nt, Human
cauucagaaauguug

SEQ ID NO: 3380623 - RNA, 23 nt, Human
cauucagaaauguugagucugua

SEQ ID NO: 3380624 - RNA, 13 nt, Human
cauucagaagaaa

SEQ ID NO: 3380625 - RNA, 18 nt, Human
cauucagaagaaaaagaa

SEQ ID NO: 3380626 - RNA, 12 nt, Human
cauucagagagc

SEQ ID NO: 3380627 - RNA, 23 nt, Human
cauucagaucacugaauuuauaa

SEQ ID NO: 3380628 - RNA, 19 nt, Human
cauucagcagcaaauuuuc

SEQ ID NO: 3380629 - RNA, 17 nt, Human
cauucaggaagaugaaa

SEQ ID NO: 3380630 - RNA, 19 nt, Human
cauucaggaauucuuggag

SEQ ID NO: 3380631 - RNA, 15 nt, Human
cauucauacuuaaaa

SEQ ID NO: 3380632 - RNA, 18 nt, Human
cauucauacuuaaaaauu

SEQ ID NO: 3380633 - RNA, 13 nt, Human
cauucaucucauu

SEQ ID NO: 3380634 - RNA, 19 nt, Human
cauucauggaccacuguuu

SEQ ID NO: 3380635 - RNA, 22 nt, Human
cauucauggaccacuguuucuu

SEQ ID NO: 3380636 - RNA, 16 nt, Human
cauucauuccauucug

SEQ ID NO: 3380637 - RNA, 17 nt, Human
cauucauuccauucugg

SEQ ID NO: 3380638 - RNA, 15 nt, Human
cauucauucuuagcu

SEQ ID NO: 3380639 - RNA, 16 nt, Human
cauucauuuuuauagc

SEQ ID NO: 3380640 - RNA, 17 nt, Human
cauucauuuuuguuguu

SEQ ID NO: 3380641 - RNA, 19 nt, Human
cauuccaaaggggaccccu

SEQ ID NO: 3380642 - RNA, 12 nt, Human
cauuccaaaguu

SEQ ID NO: 3380643 - RNA, 12 nt, Human
cauuccaacaaa

SEQ ID NO: 3380644 - RNA, 16 nt, Human
cauuccaacagugagu

SEQ ID NO: 3380645 - RNA, 13 nt, Human
cauuccaagacag

SEQ ID NO: 3380646 - RNA, 14 nt, Human
cauuccaagacagu

SEQ ID NO: 3380647 - RNA, 15 nt, Human
cauuccaagacagua

SEQ ID NO: 3380648 - RNA, 17 nt, Human
cauuccaagacucuaga

SEQ ID NO: 3380649 - RNA, 22 nt, Human
cauuccaaggaguuggaaguga

SEQ ID NO: 3380650 - RNA, 13 nt, Human
cauuccacacaga

SEQ ID NO: 3380651 - RNA, 22 nt, Human
cauuccaccuucccaugcccug

SEQ ID NO: 3380652 - RNA, 13 nt, Human
cauuccagaggaa

SEQ ID NO: 3380653 - RNA, 17 nt, Human
cauuccagaucccaggc

SEQ ID NO: 3380654 - RNA, 15 nt, Human
cauuccagccccucu

SEQ ID NO: 3380655 - RNA, 18 nt, Human
cauuccagccccucuggu

SEQ ID NO: 3380656 - RNA, 22 nt, Human
cauuccagccccucuggucgcu

SEQ ID NO: 3380657 - RNA, 12 nt, Human
cauuccaggcag

SEQ ID NO: 3380658 - RNA, 18 nt, Human
cauuccaggcagccucug

SEQ ID NO: 3380659 - RNA, 21 nt, Human
cauuccaggcagccucuguca

SEQ ID NO: 3380660 - RNA, 17 nt, Human
cauuccaggcccgaagc

SEQ ID NO: 3380661 - RNA, 12 nt, Human
cauuccauccuu

SEQ ID NO: 3380662 - RNA, 14 nt, Human
cauuccauccuuga

SEQ ID NO: 3380663 - RNA, 15 nt, Human
cauuccauucuggaa

SEQ ID NO: 3380664 - RNA, 16 nt, Human
cauuccauugccuagc

SEQ ID NO: 3380665 - RNA, 17 nt, Human
cauuccccaggaggcca

SEQ ID NO: 3380666 - RNA, 18 nt, Human
cauuccccaggaggccag

SEQ ID NO: 3380667 - RNA, 13 nt, Human
cauuccccaggug

SEQ ID NO: 3380668 - RNA, 23 nt, Human
cauuccccagguggcugacccag

SEQ ID NO: 3380669 - RNA, 13 nt, Human
cauuccccauggg

SEQ ID NO: 3380670 - RNA, 19 nt, Human
cauucccucgucuuuccca

SEQ ID NO: 3380671 - RNA, 18 nt, Human
cauucccugagucaccag

SEQ ID NO: 3380672 - RNA, 20 nt, Human
cauucccuucgacagcauuu

SEQ ID NO: 3380673 - RNA, 22 nt, Human
cauuccgacaaccgaugcucca

SEQ ID NO: 3380674 - RNA, 13 nt, Human
cauuccgcagccc

SEQ ID NO: 3380675 - RNA, 16 nt, Human
cauuccuaaaaugcuu

SEQ ID NO: 3380676 - RNA, 13 nt, Human
cauuccuauuucu

SEQ ID NO: 3380677 - RNA, 17 nt, Human
cauuccucaugaaugua

SEQ ID NO: 3380678 - RNA, 19 nt, Human
cauuccucaugaauguaaa

SEQ ID NO: 3380679 - RNA, 14 nt, Human
cauuccucugcccu

SEQ ID NO: 3380680 - RNA, 13 nt, Human
cauuccugaaaga

SEQ ID NO: 3380681 - RNA, 19 nt, Human
cauuccugaaagaaacagu

SEQ ID NO: 3380682 - RNA, 14 nt, Human
cauuccugaacagg

SEQ ID NO: 3380683 - RNA, 21 nt, Human
cauuccugauaugauuuaaaa

SEQ ID NO: 3380684 - RNA, 22 nt, Human
cauuccugaugcuucuucagag

SEQ ID NO: 3380685 - RNA, 23 nt, Human
cauuccugaugcuucuucagaga

SEQ ID NO: 3380686 - RNA, 23 nt, Human
cauuucugcaucagcugcugaaa

SEQ ID NO: 3380687 - RNA, 18 nt, Human
cauuucugccuuuuguuc

SEQ ID NO: 3380688 - RNA, 24 nt, Human
cauuucugccuuuuguucauuuca

SEQ ID NO: 3380689 - RNA, 12 nt, Human
cauuucuuagac

SEQ ID NO: 3380690 - RNA, 21 nt, Human
cauuucuuccacaagagccca

SEQ ID NO: 3380691 - RNA, 17 nt, Human
cauuucuugggcccucc

SEQ ID NO: 3380692 - RNA, 13 nt, Human
cauuucuuuucug

SEQ ID NO: 3380693 - RNA, 22 nt, Human
cauuucuuuuugggagagacuu

SEQ ID NO: 3380694 - RNA, 17 nt, Human
cauuugaaaauuuugau

SEQ ID NO: 3380695 - RNA, 15 nt, Human
cauuugaaagaaagg

SEQ ID NO: 3380696 - RNA, 19 nt, Human
cauuugaaagaaaggacuc

SEQ ID NO: 3380697 - RNA, 23 nt, Human
cauuugaaaucuaugaaauauca

SEQ ID NO: 3380698 - RNA, 14 nt, Human
cauuugaaugcauu

SEQ ID NO: 3380699 - RNA, 15 nt, Human
cauuugaaugcauuu

SEQ ID NO: 3380700 - RNA, 14 nt, Human
cauuugagcagggc

SEQ ID NO: 3380701 - RNA, 17 nt, Human
cauuugagcagggcuca

SEQ ID NO: 3380702 - RNA, 18 nt, Human
cauuugagcagggcucag

SEQ ID NO: 3380703 - RNA, 17 nt, Human
cauuugaggucuguucu

SEQ ID NO: 3380704 - RNA, 16 nt, Human
cauuugauaccccugg

SEQ ID NO: 3380705 - RNA, 16 nt, Human
cauuugaugcaugucu

SEQ ID NO: 3380706 - RNA, 17 nt, Human
cauuugaugcaugucuu

SEQ ID NO: 3380707 - RNA, 22 nt, Human
cauuugaugcaugucuuuuaaa

SEQ ID NO: 3380708 - RNA, 14 nt, Human
cauuugaugcuaaa

SEQ ID NO: 3380709 - RNA, 13 nt, Human
cauuugauuugua

SEQ ID NO: 3380710 - RNA, 21 nt, Human
cauuugcaauaacagcugcaa

SEQ ID NO: 3380711 - RNA, 15 nt, Human
cauuugcacccuccg

SEQ ID NO: 3380712 - RNA, 18 nt, Human
cauuugcagaguccugca

SEQ ID NO: 3380713 - RNA, 19 nt, Human
cauuugcagaguccugcac

SEQ ID NO: 3380714 - RNA, 17 nt, Human
cauuugccaauuuuccu

SEQ ID NO: 3380715 - RNA, 14 nt, Human
cauuugccuauucc

SEQ ID NO: 3380716 - RNA, 15 nt, Human
cauuugccuauuccc

SEQ ID NO: 3380717 - RNA, 19 nt, Human
cauuugccuauucccacac

SEQ ID NO: 3380718 - RNA, 20 nt, Human
cauuugccuugcagaacugc

SEQ ID NO: 3380719 - RNA, 21 nt, Human
cauuugccuugcagaacugcc

SEQ ID NO: 3380720 - RNA, 16 nt, Human
cauuugcucauggaau

SEQ ID NO: 3380721 - RNA, 14 nt, Human
cauuugcuccuuuc

SEQ ID NO: 3380722 - RNA, 19 nt, Human
cauuugcucuuucaucucu

SEQ ID NO: 3380723 - RNA, 15 nt, Human
cauuugcuuuggaag

SEQ ID NO: 3380724 - RNA, 15 nt, Human
cauuugcuuuuugug

SEQ ID NO: 3380725 - RNA, 17 nt, Human
cauuuggaauuuuugcu

SEQ ID NO: 3380726 - RNA, 18 nt, Human
cauuuggagggccugggc

SEQ ID NO: 3380727 - RNA, 14 nt, Human
cauuuggauugggg

SEQ ID NO: 3380728 - RNA, 19 nt, Human
cauuuggcagagcuucuuc

SEQ ID NO: 3380729 - RNA, 16 nt, Human
cauuuggcaucccugg

SEQ ID NO: 3380730 - RNA, 20 nt, Human
cauuuggcaucccugggccu

SEQ ID NO: 3380731 - RNA, 18 nt, Human
cauuuggcauuuauuugu

SEQ ID NO: 3380732 - RNA, 20 nt, Human
cauuugggagacaugugaca

SEQ ID NO: 3380733 - RNA, 16 nt, Human
cauuugggcagagagg

SEQ ID NO: 3380734 - RNA, 17 nt, Human
cauuugggguagcuaga

SEQ ID NO: 3380735 - RNA, 16 nt, Human
cauuuggguaaaucau

SEQ ID NO: 3380736 - RNA, 17 nt, Human
cauuugggugguaagag

SEQ ID NO: 3380737 - RNA, 21 nt, Human
cauuugguucauuaauucuau

SEQ ID NO: 3380738 - RNA, 11 nt, Human
cauuuguaaaa

SEQ ID NO: 3380739 - RNA, 14 nt, Human
cauuuguaaauauu

SEQ ID NO: 3380740 - RNA, 16 nt, Human
cauuuguaaauauuaa

SEQ ID NO: 3380741 - RNA, 14 nt, Human
cauuuguaaaugcu

SEQ ID NO: 3380742 - RNA, 12 nt, Human
cauuuguaauaa

SEQ ID NO: 3380743 - RNA, 17 nt, Human
cauuuguaauaaaguau

SEQ ID NO: 3380744 - RNA, 14 nt, Human
cauuuguauaaaau

SEQ ID NO: 3380745 - RNA, 17 nt, Human
cauuuguauaaaauaau

SEQ ID NO: 3380746 - RNA, 20 nt, Human
cauuuguaugucaaagcuuu

SEQ ID NO: 3380747 - RNA, 15 nt, Human
cauuugucauuuuca

SEQ ID NO: 3380748 - RNA, 17 nt, Human
cauuugucauuuucauu

SEQ ID NO: 3380749 - RNA, 18 nt, Human
cauuugucauuuucauua

SEQ ID NO: 3380750 - RNA, 16 nt, Human
cauuugucucuacuuu

SEQ ID NO: 3380751 - RNA, 16 nt, Human
cauuugugaaaugaug

SEQ ID NO: 3380752 - RNA, 12 nt, Human
cauuugugaggc

SEQ ID NO: 3380753 - RNA, 15 nt, Human
cauuugugaggccca

SEQ ID NO: 3380754 - RNA, 16 nt, Human
cauuugugcguaugca

SEQ ID NO: 3380755 - RNA, 21 nt, Human
caucuucgucuucacucuuag

SEQ ID NO: 3380756 - RNA, 16 nt, Human
caucuucucacucccu

SEQ ID NO: 3380757 - RNA, 17 nt, Human
caucuucucacucccuu

SEQ ID NO: 3380758 - RNA, 17 nt, Human
caucuucucagcuccca

SEQ ID NO: 3380759 - RNA, 14 nt, Human
caucuucuccaucu

SEQ ID NO: 3380760 - RNA, 13 nt, Human
caucuucugccuu

SEQ ID NO: 3380761 - RNA, 13 nt, Human
caucuucuggagu

SEQ ID NO: 3380762 - RNA, 22 nt, Human
caucuugaauacucugcccucu

SEQ ID NO: 3380763 - RNA, 17 nt, Human
caucuugaauccuucca

SEQ ID NO: 3380764 - RNA, 15 nt, Human
caucuugaccaagca

SEQ ID NO: 3380765 - RNA, 21 nt, Human
caucuugaccaagcaggaagc

SEQ ID NO: 3380766 - RNA, 22 nt, Human
caucuugaccaagcaggaagcu

SEQ ID NO: 3380767 - RNA, 24 nt, Human
caucuugaccaagcaggaagcuca

SEQ ID NO: 3380768 - RNA, 13 nt, Human
caucuugcauuau

SEQ ID NO: 3380769 - RNA, 19 nt, Human
caucuugccuccaggugca

SEQ ID NO: 3380770 - RNA, 20 nt, Human
caucuugccuccauggugcc

SEQ ID NO: 3380771 - RNA, 16 nt, Human
caucuugcucugcuga

SEQ ID NO: 3380772 - RNA, 13 nt, Human
caucuugcuggcu

SEQ ID NO: 3380773 - RNA, 16 nt, Human
caucuuggaacugcau

SEQ ID NO: 3380774 - RNA, 16 nt, Human
caucuuggggacaucu

SEQ ID NO: 3380775 - RNA, 20 nt, Human
caucuuggggacaucucuuu

SEQ ID NO: 3380776 - RNA, 11 nt, Human
caucuuggggg

SEQ ID NO: 3380777 - RNA, 23 nt, Human
caucuugguuauuucugaaggua

SEQ ID NO: 3380778 - RNA, 22 nt, Human
caucuuucaucaaucauuguac

SEQ ID NO: 3380779 - RNA, 13 nt, Human
caucuuuccuguc

SEQ ID NO: 3380780 - RNA, 16 nt, Human
caucuuucuucuauuu

SEQ ID NO: 3380781 - RNA, 14 nt, Human
caucuuucuuugga

SEQ ID NO: 3380782 - RNA, 12 nt, Human
caucuuugaaau

SEQ ID NO: 3380783 - RNA, 18 nt, Human
caucuuugaaauuaugua

SEQ ID NO: 3380784 - RNA, 22 nt, Human
caucuuugaaauuauguaaauu

SEQ ID NO: 3380785 - RNA, 19 nt, Human
caucuuugacacucugcag

SEQ ID NO: 3380786 - RNA, 12 nt, Human
caucuuugaugu

SEQ ID NO: 3380787 - RNA, 18 nt, Human
caucuuugauguguuguu

SEQ ID NO: 3380788 - RNA, 15 nt, Human
caucuuugccuuggg

SEQ ID NO: 3380789 - RNA, 17 nt, Human
caucuuugccuugggcu

SEQ ID NO: 3380790 - RNA, 11 nt, Human
caucuuugggg

SEQ ID NO: 3380791 - RNA, 15 nt, Human
caucuuuuaaagaaa

SEQ ID NO: 3380792 - RNA, 14 nt, Human
caucuuuuaagaca

SEQ ID NO: 3380793 - RNA, 12 nt, Human
caucuuuuauuc

SEQ ID NO: 3380794 - RNA, 15 nt, Human
caucuuuuauucuuu

SEQ ID NO: 3380795 - RNA, 14 nt, Human
caucuuuuguauua

SEQ ID NO: 3380796 - RNA, 21 nt, Human
caucuuuuuaaagcuuaucca

SEQ ID NO: 3380797 - RNA, 22 nt, Human
caucuuuuuaaagcuuauccau

SEQ ID NO: 3380798 - RNA, 23 nt, Human
caucuuuuuaaagcuuauccaua

SEQ ID NO: 3380799 - RNA, 17 nt, Human
caugaaaacacauuuuu

SEQ ID NO: 3380800 - RNA, 19 nt, Human
caugaaaacacauuuuucu

SEQ ID NO: 3380801 - RNA, 13 nt, Human
caugaaaacguuu

SEQ ID NO: 3380802 - RNA, 17 nt, Human
caugaaaacguuuuauu

SEQ ID NO: 3380803 - RNA, 21 nt, Human
caugaaaacguuuuauugugu

SEQ ID NO: 3380804 - RNA, 24 nt, Human
caugaaaauaccauuuaguaagaa

SEQ ID NO: 3380805 - RNA, 21 nt, Human
caugaaaauccuaccaaccuc

SEQ ID NO: 3380806 - RNA, 22 nt, Human
caugaaaauccuaccaaccucu

SEQ ID NO: 3380807 - RNA, 15 nt, Human
caugaaaaugugugu

SEQ ID NO: 3380808 - RNA, 13 nt, Human
caugaaaauuuua

SEQ ID NO: 3380809 - RNA, 13 nt, Human
caugaaacagaaa

SEQ ID NO: 3380810 - RNA, 22 nt, Human
caugaaacuuguuucacugaaa

SEQ ID NO: 3380811 - RNA, 14 nt, Human
caugaaagauucaa

SEQ ID NO: 3380812 - RNA, 14 nt, Human
caugaaauaaaaua

SEQ ID NO: 3380813 - RNA, 15 nt, Human
caugaaaugaacaca

SEQ ID NO: 3380814 - RNA, 22 nt, Human
caugaaaugauagauuugaccu

SEQ ID NO: 3380815 - RNA, 19 nt, Human
caugaaaugcuaugucauu

SEQ ID NO: 3380816 - RNA, 13 nt, Human
caugaaaugugaa

SEQ ID NO: 3380817 - RNA, 14 nt, Human
caugaaaugugaau

SEQ ID NO: 3380818 - RNA, 18 nt, Human
caugaaauuuuuguaaau

SEQ ID NO: 3380819 - RNA, 18 nt, Human
caugaacacacugugucc

SEQ ID NO: 3380820 - RNA, 13 nt, Human
caugaacauguac

SEQ ID NO: 3380821 - RNA, 15 nt, Human
caugaacauguacug

SEQ ID NO: 3380822 - RNA, 19 nt, Human
caugaaccucaagcugcau

SEQ ID NO: 3380823 - RNA, 21 nt, Human
caugaacuucgcaucaaaaga

SEQ ID NO: 3380824 - RNA, 18 nt, Human
caugaagaauagaaacaa

SEQ ID NO: 3380825 - RNA, 12 nt, Human
caugaagacaga

SEQ ID NO: 3380826 - RNA, 15 nt, Human
caugaagacaggaca

SEQ ID NO: 3380827 - RNA, 17 nt, Human
caugaagacaggacagu

SEQ ID NO: 3380828 - RNA, 20 nt, Human
caugaagaccuuuuucugca

SEQ ID NO: 3380829 - RNA, 16 nt, Human
caugaagagaagcaau

SEQ ID NO: 3380830 - RNA, 18 nt, Human
caugaagagauuuuucau

SEQ ID NO: 3380831 - RNA, 18 nt, Human
caugaagaggaugcugug

SEQ ID NO: 3380832 - RNA, 21 nt, Human
caugauguuuuuaaaaucuua

SEQ ID NO: 3380833 - RNA, 22 nt, Human
caugauguuuuuaaaaucuuau

SEQ ID NO: 3380834 - RNA, 12 nt, Human
caugauuagcaa

SEQ ID NO: 3380835 - RNA, 21 nt, Human
caugauucaugccaauuagca

SEQ ID NO: 3380836 - RNA, 14 nt, Human
caugauucauuuua

SEQ ID NO: 3380837 - RNA, 14 nt, Human
caugauuccagcca

SEQ ID NO: 3380838 - RNA, 16 nt, Human
caugauuccagccauc

SEQ ID NO: 3380839 - RNA, 19 nt, Human
caugauuccuuccuguucu

SEQ ID NO: 3380840 - RNA, 16 nt, Human
caugauuccuuuaaca

SEQ ID NO: 3380841 - RNA, 12 nt, Human
caugauuucaca

SEQ ID NO: 3380842 - RNA, 14 nt, Human
caugauuucacaaa

SEQ ID NO: 3380843 - RNA, 16 nt, Human
caugauuucacaaaua

SEQ ID NO: 3380844 - RNA, 18 nt, Human
caugauuucacaaauauu

SEQ ID NO: 3380845 - RNA, 13 nt, Human
caugauuucaugu

SEQ ID NO: 3380846 - RNA, 16 nt, Human
caugauuucauguacu

SEQ ID NO: 3380847 - RNA, 12 nt, Human
caugauuuccuu

SEQ ID NO: 3380848 - RNA, 18 nt, Human
caugauuuccuugaaugu

SEQ ID NO: 3380849 - RNA, 21 nt, Human
caugauuuuaaguuucucugc

SEQ ID NO: 3380850 - RNA, 24 nt, Human
caugauuuuaaguuucucugcaga

SEQ ID NO: 3380851 - RNA, 16 nt, Human
caugcaaaugagcucu

SEQ ID NO: 3380852 - RNA, 16 nt, Human
caugcaaaugcuguau

SEQ ID NO: 3380853 - RNA, 23 nt, Human
caugcaagcagaggaccagggcc

SEQ ID NO: 3380854 - RNA, 12 nt, Human
caugcaagguca

SEQ ID NO: 3380855 - RNA, 15 nt, Human
caugcaauaaaauuu

SEQ ID NO: 3380856 - RNA, 18 nt, Human
caugcaauaaaauuuaaa

SEQ ID NO: 3380857 - RNA, 22 nt, Human
caugcacacaauuagauuucuc

SEQ ID NO: 3380858 - RNA, 11 nt, Human
caugcacacac

SEQ ID NO: 3380859 - RNA, 17 nt, Human
caugcacaguauuugua

SEQ ID NO: 3380860 - RNA, 22 nt, Human
caugcacaguauuuguaauuaa

SEQ ID NO: 3380861 - RNA, 20 nt, Human
caugcacccucauacacaga

SEQ ID NO: 3380862 - RNA, 20 nt, Human
caugcacugacccuuccaga

SEQ ID NO: 3380863 - RNA, 18 nt, Human
caugcacugugaaggacc

SEQ ID NO: 3380864 - RNA, 22 nt, Human
caugcacugugaaggacccuug

SEQ ID NO: 3380865 - RNA, 17 nt, Human
caugcacuuggcugcau

SEQ ID NO: 3380866 - RNA, 18 nt, Human
caugcagaaagggagcag

SEQ ID NO: 3380867 - RNA, 19 nt, Human
caugcagaacaaaugaaga

SEQ ID NO: 3380868 - RNA, 17 nt, Human
caugcagaguauuucua

SEQ ID NO: 3380869 - RNA, 14 nt, Human
caugcagcagcuug

SEQ ID NO: 3380870 - RNA, 17 nt, Human
caugcagccacugugcu

SEQ ID NO: 3380871 - RNA, 16 nt, Human
caugcagcccaugccc

SEQ ID NO: 3380872 - RNA, 19 nt, Human
caugcagcccaugcccacc

SEQ ID NO: 3380873 - RNA, 17 nt, Human
caugcagccgugaucaa

SEQ ID NO: 3380874 - RNA, 15 nt, Human
caugcagcugcaccc

SEQ ID NO: 3380875 - RNA, 22 nt, Human
caugcagguggugucgggcccu

SEQ ID NO: 3380876 - RNA, 23 nt, Human
caugcagucuaaaaugcuucagu

SEQ ID NO: 3380877 - RNA, 22 nt, Human
caugcagucugggaguggggaa

SEQ ID NO: 3380878 - RNA, 13 nt, Human
caugcaguuugaa

SEQ ID NO: 3380879 - RNA, 14 nt, Human
caugcaguuugaaa

SEQ ID NO: 3380880 - RNA, 15 nt, Human
caugcauaaauaugc

SEQ ID NO: 3380881 - RNA, 17 nt, Human
caugcauaaauaugcag

SEQ ID NO: 3380882 - RNA, 13 nt, Human
caugcauacacac

SEQ ID NO: 3380883 - RNA, 14 nt, Human
caugcauacacaca

SEQ ID NO: 3380884 - RNA, 15 nt, Human
caugcauacacacac

SEQ ID NO: 3380885 - RNA, 20 nt, Human
caugcauacuucaaaaguau

SEQ ID NO: 3380886 - RNA, 21 nt, Human
caugcauacuucaaaaguauu

SEQ ID NO: 3380887 - RNA, 20 nt, Human
caugcauagagugugaugua

SEQ ID NO: 3380888 - RNA, 16 nt, Human
caugcaucuccaccug

SEQ ID NO: 3380889 - RNA, 17 nt, Human
caugcaucuccaccugc

SEQ ID NO: 3380890 - RNA, 15 nt, Human
caugcauggaaauuc

SEQ ID NO: 3380891 - RNA, 17 nt, Human
caugcauguccuguaaa

SEQ ID NO: 3380892 - RNA, 18 nt, Human
caugcauguuaugcuuua

SEQ ID NO: 3380893 - RNA, 15 nt, Human
caugcauuacugcau

SEQ ID NO: 3380894 - RNA, 11 nt, Human
caugcauuguu

SEQ ID NO: 3380895 - RNA, 17 nt, Human
caugcauuugaggucaa

SEQ ID NO: 3380896 - RNA, 14 nt, Human
caugcauuuugcag

SEQ ID NO: 3380897 - RNA, 21 nt, Human
caugccacaaggacuuccugu

SEQ ID NO: 3380898 - RNA, 19 nt, Human
caugccacguuccacaguu

SEQ ID NO: 3380899 - RNA, 19 nt, Human
caugccaggaaccuguccu

SEQ ID NO: 3380900 - RNA, 16 nt, Human
caugccaggcuaauuu

SEQ ID NO: 3380901 - RNA, 17 nt, Human
caugccagugacacuuc

SEQ ID NO: 3380902 - RNA, 18 nt, Human
caugccauuuguacugac

SEQ ID NO: 3380903 - RNA, 23 nt, Human
caugcccacccccugcccugcac

SEQ ID NO: 3380904 - RNA, 13 nt, Human
caugccccccuca

SEQ ID NO: 3380905 - RNA, 23 nt, Human
caugccccccucaaaccuccucu

SEQ ID NO: 3380906 - RNA, 16 nt, Human
caugcccccugcagac

SEQ ID NO: 3380907 - RNA, 15 nt, Human
caugcccccuuucag

SEQ ID NO: 3380908 - RNA, 16 nt, Human
caugccccggccaccu

SEQ ID NO: 3380909 - RNA, 17 nt, Human
caugccccggccaccuc

SEQ ID NO: 3380910 - RNA, 19 nt, Human
caugccccggccaccucug

SEQ ID NO: 3380911 - RNA, 17 nt, Human
caugcccggucccaccc

SEQ ID NO: 3380912 - RNA, 14 nt, Human
caugcccucccuuc

SEQ ID NO: 3380913 - RNA, 22 nt, Human
caugcccucccuucucccugga

SEQ ID NO: 3380914 - RNA, 14 nt, Human
caugcccuccucuc

SEQ ID NO: 3380915 - RNA, 15 nt, Human
caugcccuccucucc

SEQ ID NO: 3380916 - RNA, 16 nt, Human
caugcccucucaggcc

SEQ ID NO: 3380917 - RNA, 21 nt, Human
caugcccucucaggccggcag

SEQ ID NO: 3380918 - RNA, 16 nt, Human
caugccgucugccgga

SEQ ID NO: 3380919 - RNA, 17 nt, Human
caugccuaccaauauuu

SEQ ID NO: 3380920 - RNA, 21 nt, Human
caugccuauaugagaagaaua

SEQ ID NO: 3380921 - RNA, 18 nt, Human
ccaaaauaaaacuuuuua

SEQ ID NO: 3380922 - RNA, 14 nt, Human
ccaaaauaaugucu

SEQ ID NO: 3380923 - RNA, 16 nt, Human
ccaaaauccccuucuc

SEQ ID NO: 3380924 - RNA, 23 nt, Human
ccaaaauguaggcuuaguuugug

SEQ ID NO: 3380925 - RNA, 20 nt, Human
ccaaaaugugagugguugaa

SEQ ID NO: 3380926 - RNA, 17 nt, Human
ccaaaauguugaaauau

SEQ ID NO: 3380927 - RNA, 15 nt, Human
ccaaaauuaaggugu

SEQ ID NO: 3380928 - RNA, 16 nt, Human
ccaaaauuauuucaga

SEQ ID NO: 3380929 - RNA, 20 nt, Human
ccaaaauuguuuugagcuuu

SEQ ID NO: 3380930 - RNA, 16 nt, Human
ccaaaauuuauuuuau

SEQ ID NO: 3380931 - RNA, 15 nt, Human
ccaaaauuuuaaaaa

SEQ ID NO: 3380932 - RNA, 13 nt, Human
ccaaacacacaga

SEQ ID NO: 3380933 - RNA, 15 nt, Human
ccaaacaccuuccag

SEQ ID NO: 3380934 - RNA, 19 nt, Human
ccaaacagcaaaccaagag

SEQ ID NO: 3380935 - RNA, 16 nt, Human
ccaaacaggcucagag

SEQ ID NO: 3380936 - RNA, 17 nt, Human
ccaaacagugcuguuuc

SEQ ID NO: 3380937 - RNA, 18 nt, Human
ccaaacauccuacaagac

SEQ ID NO: 3380938 - RNA, 20 nt, Human
ccaaacauccucuuccauau

SEQ ID NO: 3380939 - RNA, 22 nt, Human
ccaaacauuaauguugauuucu

SEQ ID NO: 3380940 - RNA, 17 nt, Human
ccaaaccaccagaagcc

SEQ ID NO: 3380941 - RNA, 20 nt, Human
ccaaaccaccagaagcccag

SEQ ID NO: 3380942 - RNA, 18 nt, Human
ccaaacccaaaagaaacu

SEQ ID NO: 3380943 - RNA, 16 nt, Human
ccaaacccacccuuuc

SEQ ID NO: 3380944 - RNA, 20 nt, Human
ccaaacccacccuuucuacu

SEQ ID NO: 3380945 - RNA, 13 nt, Human
ccaaacccuaggu

SEQ ID NO: 3380946 - RNA, 23 nt, Human
ccaaacccuagguucccgguccc

SEQ ID NO: 3380947 - RNA, 16 nt, Human
ccaaacccuucagugc

SEQ ID NO: 3380948 - RNA, 12 nt, Human
ccaaaccucugu

SEQ ID NO: 3380949 - RNA, 13 nt, Human
ccaaaccucuguu

SEQ ID NO: 3380950 - RNA, 14 nt, Human
ccaaaccucuguuc

SEQ ID NO: 3380951 - RNA, 13 nt, Human
ccaaaccuggaga

SEQ ID NO: 3380952 - RNA, 22 nt, Human
ccaaacgcccuuuccuccucag

SEQ ID NO: 3380953 - RNA, 13 nt, Human
ccaaacgccuccc

SEQ ID NO: 3380954 - RNA, 13 nt, Human
ccaaacucugcca

SEQ ID NO: 3380955 - RNA, 22 nt, Human
ccaaacugacucuuaagaagac

SEQ ID NO: 3380956 - RNA, 16 nt, Human
ccaaacuguucaagaa

SEQ ID NO: 3380957 - RNA, 15 nt, Human
ccaaacuucacucug

SEQ ID NO: 3380958 - RNA, 18 nt, Human
ccaaacuuggauuuuuga

SEQ ID NO: 3380959 - RNA, 12 nt, Human
ccaaagaaaguu

SEQ ID NO: 3380960 - RNA, 14 nt, Human
ccaaagaaaugaac

SEQ ID NO: 3380961 - RNA, 16 nt, Human
ccaaagaaaugaacau

SEQ ID NO: 3380962 - RNA, 17 nt, Human
ccaaagaaauguaaggg

SEQ ID NO: 3380963 - RNA, 17 nt, Human
ccaaagagacuggagca

SEQ ID NO: 3380964 - RNA, 21 nt, Human
ccaaagagacuggagcaucug

SEQ ID NO: 3380965 - RNA, 14 nt, Human
ccaaagagcacaaa

SEQ ID NO: 3380966 - RNA, 14 nt, Human
ccaaagagccugga

SEQ ID NO: 3380967 - RNA, 20 nt, Human
ccaaagagccuggagaagcu

SEQ ID NO: 3380968 - RNA, 21 nt, Human
ccaaagaggcugccccucuca

SEQ ID NO: 3380969 - RNA, 22 nt, Human
ccaaagaggcugccccucucac

SEQ ID NO: 3380970 - RNA, 23 nt, Human
ccaaagaggcugccccucucacc

SEQ ID NO: 3380971 - RNA, 22 nt, Human
ccaaagaguagaauugcauuga

SEQ ID NO: 3380972 - RNA, 15 nt, Human
ccaaagagugauagu

SEQ ID NO: 3380973 - RNA, 19 nt, Human
ccaaagauagacagguccu

SEQ ID NO: 3380974 - RNA, 14 nt, Human
ccaaagcagacagc

SEQ ID NO: 3380975 - RNA, 15 nt, Human
ccaaagcagggucug

SEQ ID NO: 3380976 - RNA, 23 nt, Human
ccaaagcagugcaugcugucccu

SEQ ID NO: 3380977 - RNA, 17 nt, Human
cauguuuccagcauucc

SEQ ID NO: 3380978 - RNA, 22 nt, Human
cauguuuccagcauucccaggu

SEQ ID NO: 3380979 - RNA, 11 nt, Human
cauguuucuuu

SEQ ID NO: 3380980 - RNA, 17 nt, Human
cauguuuggugcauaga

SEQ ID NO: 3380981 - RNA, 12 nt, Human
cauguuugugau

SEQ ID NO: 3380982 - RNA, 20 nt, Human
cauguuuuaacaaaaaccaa

SEQ ID NO: 3380983 - RNA, 23 nt, Human
cauguuuuagacaaauacucaug

SEQ ID NO: 3380984 - RNA, 16 nt, Human
cauguuuucaacugcc

SEQ ID NO: 3380985 - RNA, 14 nt, Human
cauguuuuccguga

SEQ ID NO: 3380986 - RNA, 14 nt, Human
cauguuuugauaaa

SEQ ID NO: 3380987 - RNA, 15 nt, Human
cauguuuugcaugua

SEQ ID NO: 3380988 - RNA, 17 nt, Human
cauguuuugugacuaua

SEQ ID NO: 3380989 - RNA, 23 nt, Human
cauguuuugugacuauauagaga

SEQ ID NO: 3380990 - RNA, 18 nt, Human
cauguuuuuaaagggcua

SEQ ID NO: 3380991 - RNA, 17 nt, Human
cauguuuuuguuuucuu

SEQ ID NO: 3380992 - RNA, 23 nt, Human
cauuaaaaaaaugugccuaguuu

SEQ ID NO: 3380993 - RNA, 21 nt, Human
cauuaaaaaaugaaauauuuu

SEQ ID NO: 3380994 - RNA, 13 nt, Human
cauuaaaaaugga

SEQ ID NO: 3380995 - RNA, 21 nt, Human
cauuaaaacaauauuguuucu

SEQ ID NO: 3380996 - RNA, 13 nt, Human
cauuaaaacugcu

SEQ ID NO: 3380997 - RNA, 16 nt, Human
cauuaaaacugcuuuu

SEQ ID NO: 3380998 - RNA, 17 nt, Human
cauuaaaagaaaauaaa

SEQ ID NO: 3380999 - RNA, 13 nt, Human
cauuaaaagaaua

SEQ ID NO: 3381000 - RNA, 14 nt, Human
cauuaaaauauaau

SEQ ID NO: 3381001 - RNA, 23 nt, Human
cauuaaaccaucucccuggugcu

SEQ ID NO: 3381002 - RNA, 12 nt, Human
cauuaaaccugu

SEQ ID NO: 3381003 - RNA, 13 nt, Human
cauuaaaccuguc

SEQ ID NO: 3381004 - RNA, 19 nt, Human
cauuaaacuaguguuauac

SEQ ID NO: 3381005 - RNA, 14 nt, Human
cauuaaacuuuuuu

SEQ ID NO: 3381006 - RNA, 15 nt, Human
cauuaaagaagaccu

SEQ ID NO: 3381007 - RNA, 21 nt, Human
cauuaaagccugaguuugcuu

SEQ ID NO: 3381008 - RNA, 20 nt, Human
cauuaaaggcauaaaugacu

SEQ ID NO: 3381009 - RNA, 17 nt, Human
cauuaaaggcuucucuc

SEQ ID NO: 3381010 - RNA, 17 nt, Human
cauuaaagucagaaguu

SEQ ID NO: 3381011 - RNA, 18 nt, Human
cauuaaagucagaaguuu

SEQ ID NO: 3381012 - RNA, 21 nt, Human
cauuaaagucgagcuuuucua

SEQ ID NO: 3381013 - RNA, 12 nt, Human
cauuaaaguucu

SEQ ID NO: 3381014 - RNA, 13 nt, Human
cauuaaauaaauu

SEQ ID NO: 3381015 - RNA, 18 nt, Human
cauuaaaugaauauuuug

SEQ ID NO: 3381016 - RNA, 13 nt, Human
cauuaaaugacuc

SEQ ID NO: 3381017 - RNA, 14 nt, Human
cauuaaaugacucu

SEQ ID NO: 3381018 - RNA, 14 nt, Human
cauuaaauuacaga

SEQ ID NO: 3381019 - RNA, 13 nt, Human
cauuaaauuaccu

SEQ ID NO: 3381020 - RNA, 14 nt, Human
cauuaaauucacaa

SEQ ID NO: 3381021 - RNA, 17 nt, Human
cauuaacaguuuuccau

SEQ ID NO: 3381022 - RNA, 20 nt, Human
cauuaacaguuuuccaugaa

SEQ ID NO: 3381023 - RNA, 22 nt, Human
cauuaacaguuuuccaugaaaa

SEQ ID NO: 3381024 - RNA, 23 nt, Human
cauuaacaguuuuccaugaaaac

SEQ ID NO: 3381025 - RNA, 16 nt, Human
cauuaacuaaucuauu

SEQ ID NO: 3381026 - RNA, 18 nt, Human
cauuaacuaaucuauugg

SEQ ID NO: 3381027 - RNA, 16 nt, Human
cauuaacuucucugga

SEQ ID NO: 3381028 - RNA, 14 nt, Human
cauuaagaaaauca

SEQ ID NO: 3381029 - RNA, 15 nt, Human
cauuaagcaucacaa

SEQ ID NO: 3381030 - RNA, 19 nt, Human
cauuaagcaucacaaauga

SEQ ID NO: 3381031 - RNA, 17 nt, Human
cauuaagcccucuucca

SEQ ID NO: 3381032 - RNA, 16 nt, Human
cauuaagccuuccaca

SEQ ID NO: 3381033 - RNA, 21 nt, Human
cauuaaggggaagaaugaaag

SEQ ID NO: 3381034 - RNA, 20 nt, Human
cauuaaguaaucaauaaaga

SEQ ID NO: 3381035 - RNA, 20 nt, Human
cauuaaucaguucauuagaa

SEQ ID NO: 3381036 - RNA, 16 nt, Human
cauuaaucauuucccc

SEQ ID NO: 3381037 - RNA, 17 nt, Human
cauuaaucauuucccca

SEQ ID NO: 3381038 - RNA, 12 nt, Human
cauuaaucugcc

SEQ ID NO: 3381039 - RNA, 18 nt, Human
cauuaaucugccucccuc

SEQ ID NO: 3381040 - RNA, 23 nt, Human
cauuaaugccugcuuuuuggaaa

SEQ ID NO: 3381041 - RNA, 14 nt, Human
cauuaauguguugg

SEQ ID NO: 3381042 - RNA, 20 nt, Human
cauuaauguugauuucuagu

SEQ ID NO: 3381043 - RNA, 13 nt, Human
cauuacaauggaa

SEQ ID NO: 3381044 - RNA, 15 nt, Human
cauuacagagaggag

SEQ ID NO: 3381045 - RNA, 18 nt, Human
cauuacagagaggagaaa

SEQ ID NO: 3381046 - RNA, 21 nt, Human
cauuacagagaggagaaacac

SEQ ID NO: 3381047 - RNA, 21 nt, Human
cauuacagagguauuaaaacu

SEQ ID NO: 3381048 - RNA, 14 nt, Human
cauuacagcuuaau

SEQ ID NO: 3381049 - RNA, 16 nt, Human
cauuacagcuuaauca

SEQ ID NO: 3381050 - RNA, 22 nt, Human
cauuacauuccuugauaauguu

SEQ ID NO: 3381051 - RNA, 15 nt, Human
cauuaccauguaaug

SEQ ID NO: 3381052 - RNA, 16 nt, Human
cauuacccuucccugc

SEQ ID NO: 3381053 - RNA, 21 nt, Human
cauuaccucagugagaagcca

SEQ ID NO: 3381054 - RNA, 23 nt, Human
cauuaccucuuuggaaaaggaag

SEQ ID NO: 3381055 - RNA, 18 nt, Human
cauuaccuuuuaccagcu

SEQ ID NO: 3381056 - RNA, 15 nt, Human
cauuacggcuccucu

SEQ ID NO: 3381057 - RNA, 13 nt, Human
cauuacgugagcc

SEQ ID NO: 3381058 - RNA, 17 nt, Human
cauuacuauaagaacuu

SEQ ID NO: 3381059 - RNA, 23 nt, Human
cauuacuauaagaacuuugagcu

SEQ ID NO: 3381060 - RNA, 17 nt, Human
cauuacucuuguaagau

SEQ ID NO: 3381061 - RNA, 22 nt, Human
cauuacucuuguaagauuuuga

SEQ ID NO: 3381062 - RNA, 23 nt, Human
cauuacugcaugcacuucuuaca

SEQ ID NO: 3381063 - RNA, 14 nt, Human
cauuagaaauauuu

SEQ ID NO: 3381064 - RNA, 15 nt, Human
cauuagaaauauuuu

SEQ ID NO: 3381065 - RNA, 18 nt, Human
cauuagaaauauuuuaaa

SEQ ID NO: 3381066 - RNA, 19 nt, Human
cauuagaagacaauugaca

SEQ ID NO: 3381067 - RNA, 22 nt, Human
cauuagaagauauuagucuugg

SEQ ID NO: 3381068 - RNA, 14 nt, Human
cauuagaauuauuu

SEQ ID NO: 3381069 - RNA, 19 nt, Human
cauuagaauuauuuaaaca

SEQ ID NO: 3381070 - RNA, 17 nt, Human
cauuagacuccuccucc

SEQ ID NO: 3381071 - RNA, 11 nt, Human
cauuagagcag

SEQ ID NO: 3381072 - RNA, 14 nt, Human
cauuagagcaggcg

SEQ ID NO: 3381073 - RNA, 17 nt, Human
cauuagcaaaaaaaguu

SEQ ID NO: 3381074 - RNA, 18 nt, Human
cauuagcaaaaaaaguug

SEQ ID NO: 3381075 - RNA, 19 nt, Human
cauuagcaaaaaaaguugu

SEQ ID NO: 3381076 - RNA, 20 nt, Human
cauuagcaaaaaaaguugua

SEQ ID NO: 3381077 - RNA, 20 nt, Human
cauuagcacagauuuuaauu

SEQ ID NO: 3381078 - RNA, 21 nt, Human
cauuagcacagauuuuaauug

SEQ ID NO: 3381079 - RNA, 22 nt, Human
cauuagcacagauuuuaauugu

SEQ ID NO: 3381080 - RNA, 17 nt, Human
cauuagcaguuugcuuu

SEQ ID NO: 3381081 - RNA, 14 nt, Human
cauuagccaaggau

SEQ ID NO: 3381082 - RNA, 19 nt, Human
cauuagccagauuugucuu

SEQ ID NO: 3381083 - RNA, 21 nt, Human
cauuaggaauuaaguuaucuu

SEQ ID NO: 3381084 - RNA, 19 nt, Human
cauuaggacaaucaguccc

SEQ ID NO: 3381085 - RNA, 16 nt, Human
cauuaggccagcaacg

SEQ ID NO: 3381086 - RNA, 20 nt, Human
cauuaggccagcaacgcuug

SEQ ID NO: 3381087 - RNA, 20 nt, Human
cauuagggaugccuccuuuc

SEQ ID NO: 3381088 - RNA, 14 nt, Human
cauuagguugugaa

SEQ ID NO: 3381089 - RNA, 14 nt, Human
cauuaguaaauguc

SEQ ID NO: 3381090 - RNA, 19 nt, Human
cauuaguaaaugucuuugu

SEQ ID NO: 3381091 - RNA, 21 nt, Human
cauuaguaacauaauaaauua

SEQ ID NO: 3381092 - RNA, 13 nt, Human
cauuagugggaaa

SEQ ID NO: 3381093 - RNA, 16 nt, Human
cauuaguuuugaagau

SEQ ID NO: 3381094 - RNA, 20 nt, Human
cauuauaacugaaggagaag

SEQ ID NO: 3381095 - RNA, 15 nt, Human
cauuauauugcaaug

SEQ ID NO: 3381096 - RNA, 19 nt, Human
cauuauauuuauuacugua

SEQ ID NO: 3381097 - RNA, 12 nt, Human
cauuaucaugug

SEQ ID NO: 3381098 - RNA, 15 nt, Human
cauuaucauguguaa

SEQ ID NO: 3381099 - RNA, 18 nt, Human
cauuaucauguguaauca

SEQ ID NO: 3381100 - RNA, 17 nt, Human
cauuaucgggagcagug

SEQ ID NO: 3381101 - RNA, 19 nt, Human
cauuaucuaacugugcuca

SEQ ID NO: 3381102 - RNA, 17 nt, Human
cauuaucuacuugugua

SEQ ID NO: 3381103 - RNA, 18 nt, Human
cauuaucuagauacugua

SEQ ID NO: 3381104 - RNA, 24 nt, Human
cauuaucuaguucauugaaucauu

SEQ ID NO: 3381105 - RNA, 13 nt, Human
cauuaucucaaaa

SEQ ID NO: 3381106 - RNA, 19 nt, Human
cauuaugcaauuuuuauau

SEQ ID NO: 3381107 - RNA, 16 nt, Human
cauuaugccacuuccu

SEQ ID NO: 3381108 - RNA, 20 nt, Human
cauuauguccacuguguaua

SEQ ID NO: 3381109 - RNA, 21 nt, Human
cauuauguccacuguguauag

SEQ ID NO: 3381110 - RNA, 19 nt, Human
cauuaugugugcaugugug

SEQ ID NO: 3381111 - RNA, 20 nt, Human
ccaaguaacugggauuacag

SEQ ID NO: 3381112 - RNA, 15 nt, Human
ccaaguaagaggcug

SEQ ID NO: 3381113 - RNA, 16 nt, Human
ccaaguaagaggcugg

SEQ ID NO: 3381114 - RNA, 17 nt, Human
ccaaguaagaggcugga

SEQ ID NO: 3381115 - RNA, 16 nt, Human
ccaaguaauauaaugg

SEQ ID NO: 3381116 - RNA, 15 nt, Human
ccaaguagccucucc

SEQ ID NO: 3381117 - RNA, 20 nt, Human
ccaaguagcugggauuacag

SEQ ID NO: 3381118 - RNA, 15 nt, Human
ccaaguagucugcuc

SEQ ID NO: 3381119 - RNA, 19 nt, Human
ccaagucagcccaacaggc

SEQ ID NO: 3381120 - RNA, 14 nt, Human
ccaaguccaaaugu

SEQ ID NO: 3381121 - RNA, 23 nt, Human
ccaaguccaaauguuuacaggga

SEQ ID NO: 3381122 - RNA, 20 nt, Human
caccauuccaagucuccacc

SEQ ID NO: 3381123 - RNA, 14 nt, Human
caccauuccuggaa

SEQ ID NO: 3381124 - RNA, 23 nt, Human
caccauuccuggaaaccacaguc

SEQ ID NO: 3381125 - RNA, 22 nt, Human
caccauucguacauaauacuga

SEQ ID NO: 3381126 - RNA, 13 nt, Human
caccauucugacu

SEQ ID NO: 3381127 - RNA, 13 nt, Human
caccauugaaggc

SEQ ID NO: 3381128 - RNA, 14 nt, Human
caccauugaaggcu

SEQ ID NO: 3381129 - RNA, 13 nt, Human
caccauugcugcu

SEQ ID NO: 3381130 - RNA, 17 nt, Human
caccauugcugcuccuu

SEQ ID NO: 3381131 - RNA, 21 nt, Human
caccauuuggcaucccugggc

SEQ ID NO: 3381132 - RNA, 23 nt, Human
caccauuuggcaucccugggccu

SEQ ID NO: 3381133 - RNA, 21 nt, Human
cacccaaaccggcaggugcga

SEQ ID NO: 3381134 - RNA, 22 nt, Human
cacccaaagagguauuuaucuu

SEQ ID NO: 3381135 - RNA, 12 nt, Human
cacccaaagcug

SEQ ID NO: 3381136 - RNA, 22 nt, Human
cacccaacccuaucuccugaca

SEQ ID NO: 3381137 - RNA, 20 nt, Human
cacccaagaccucagggcac

SEQ ID NO: 3381138 - RNA, 14 nt, Human
cacccaagcuuggc

SEQ ID NO: 3381139 - RNA, 14 nt, Human
cacccaagggccug

SEQ ID NO: 3381140 - RNA, 19 nt, Human
cacccaagggccuggccug

SEQ ID NO: 3381141 - RNA, 15 nt, Human
cacccacaccauaag

SEQ ID NO: 3381142 - RNA, 15 nt, Human
cacccacagaaagag

SEQ ID NO: 3381143 - RNA, 13 nt, Human
cacccacagggcu

SEQ ID NO: 3381144 - RNA, 12 nt, Human
cacccacaugug

SEQ ID NO: 3381145 - RNA, 14 nt, Human
cacccacccagcac

SEQ ID NO: 3381146 - RNA, 14 nt, Human
cacccacccuggga

SEQ ID NO: 3381147 - RNA, 20 nt, Human
cacccaccguccgcccugcu

SEQ ID NO: 3381148 - RNA, 23 nt, Human
cacccaccguccgcccugcuccu

SEQ ID NO: 3381149 - RNA, 13 nt, Human
cacccaccgugga

SEQ ID NO: 3381150 - RNA, 17 nt, Human
cacccaccucagccucc

SEQ ID NO: 3381151 - RNA, 16 nt, Human
cacccaccucccugcc

SEQ ID NO: 3381152 - RNA, 14 nt, Human
cacccagacagcuc

SEQ ID NO: 3381153 - RNA, 12 nt, Human
cacccagcccag

SEQ ID NO: 3381154 - RNA, 13 nt, Human
cacccagcccaga

SEQ ID NO: 3381155 - RNA, 22 nt, Human
cacccagcccauucucucuccu

SEQ ID NO: 3381156 - RNA, 13 nt, Human
cacccagcccugg

SEQ ID NO: 3381157 - RNA, 14 nt, Human
cacccagcccuggu

SEQ ID NO: 3381158 - RNA, 16 nt, Human
cacccagcccuggucu

SEQ ID NO: 3381159 - RNA, 19 nt, Human
cacccagcccuggucucag

SEQ ID NO: 3381160 - RNA, 22 nt, Human
cacccagccucaguccuccccu

SEQ ID NO: 3381161 - RNA, 12 nt, Human
cacccagccugg

SEQ ID NO: 3381162 - RNA, 24 nt, Human
cacccaggagccccgaggccuucu

SEQ ID NO: 3381163 - RNA, 21 nt, Human
cacccaggaggggaacacugc

SEQ ID NO: 3381164 - RNA, 20 nt, Human
cacccaggcuggagugcaau

SEQ ID NO: 3381165 - RNA, 21 nt, Human
cacccagggaacuaggaaggc

SEQ ID NO: 3381166 - RNA, 20 nt, Human
cacccagguuggagugcagu

SEQ ID NO: 3381167 - RNA, 19 nt, Human
cacccagucucugcuccac

SEQ ID NO: 3381168 - RNA, 23 nt, Human
cacccauccuaccaaugcaugca

SEQ ID NO: 3381169 - RNA, 13 nt, Human
cacccaucuguuu

SEQ ID NO: 3381170 - RNA, 18 nt, Human
cacccaucuguuuuuugu

SEQ ID NO: 3381171 - RNA, 22 nt, Human
cacccaugaagacaggacagug

SEQ ID NO: 3381172 - RNA, 19 nt, Human
cacccaugaaucaaagaca

SEQ ID NO: 3381173 - RNA, 20 nt, Human
cacccaugggcucugacaga

SEQ ID NO: 3381174 - RNA, 18 nt, Human
cacccauguuucucuggc

SEQ ID NO: 3381175 - RNA, 19 nt, Human
caccccaaagcuuuccugc

SEQ ID NO: 3381176 - RNA, 17 nt, Human
caccccaacacuuccag

SEQ ID NO: 3381177 - RNA, 22 nt, Human
caccccaaguagucugcucaca

SEQ ID NO: 3381178 - RNA, 15 nt, Human
caccccaauccuccc

SEQ ID NO: 3381179 - RNA, 11 nt, Human
caccccacacu

SEQ ID NO: 3381180 - RNA, 24 nt, Human
caccccacuuaucccucuccauaa

SEQ ID NO: 3381181 - RNA, 11 nt, Human
caccccagagc

SEQ ID NO: 3381182 - RNA, 19 nt, Human
caccccagccuaagaugaa

SEQ ID NO: 3381183 - RNA, 16 nt, Human
caccccagcugcuccc

SEQ ID NO: 3381184 - RNA, 19 nt, Human
caccccagcugcuccccuc

SEQ ID NO: 3381185 - RNA, 20 nt, Human
caccccagcugcuccccucc

SEQ ID NO: 3381186 - RNA, 17 nt, Human
caccccagggccugagc

SEQ ID NO: 3381187 - RNA, 12 nt, Human
caccccauccca

SEQ ID NO: 3381188 - RNA, 12 nt, Human
caccccaugcug

SEQ ID NO: 3381189 - RNA, 14 nt, Human
caccccaugcuggc

SEQ ID NO: 3381190 - RNA, 20 nt, Human
caccccaugcuggccuugcc

SEQ ID NO: 3381191 - RNA, 22 nt, Human
caccccaugcuguugauugcua

SEQ ID NO: 3381192 - RNA, 15 nt, Human
caccccauucccgca

SEQ ID NO: 3381193 - RNA, 12 nt, Human
cacccccacacc

SEQ ID NO: 3381194 - RNA, 15 nt, Human
cacccccaccaaggg

SEQ ID NO: 3381195 - RNA, 17 nt, Human
cacccccagccugggcc

SEQ ID NO: 3381196 - RNA, 13 nt, Human
cacccccagcugc

SEQ ID NO: 3381197 - RNA, 17 nt, Human
cacccccaucucucccu

SEQ ID NO: 3381198 - RNA, 14 nt, Human
caccccccaagcug

SEQ ID NO: 3381199 - RNA, 13 nt, Human
caccccccagaac

SEQ ID NO: 3381200 - RNA, 19 nt, Human
caccccccagaaccugucc

SEQ ID NO: 3381201 - RNA, 16 nt, Human
cacccccuccccaggg

SEQ ID NO: 3381202 - RNA, 17 nt, Human
cacccccuccccagggg

SEQ ID NO: 3381203 - RNA, 14 nt, Human
cacccccuccugcu

SEQ ID NO: 3381204 - RNA, 12 nt, Human
cacccccugcag

SEQ ID NO: 3381205 - RNA, 17 nt, Human
cacccccugcagcuugu

SEQ ID NO: 3381206 - RNA, 14 nt, Human
cacccccugcccug

SEQ ID NO: 3381207 - RNA, 16 nt, Human
cacccccugcccugca

SEQ ID NO: 3381208 - RNA, 21 nt, Human
cacccccuucagugcccacca

SEQ ID NO: 3381209 - RNA, 12 nt, Human
cacccccuuccc

SEQ ID NO: 3381210 - RNA, 13 nt, Human
cacccccuucucu

SEQ ID NO: 3381211 - RNA, 22 nt, Human
cacccccuucucugcuccacca

SEQ ID NO: 3381212 - RNA, 12 nt, Human
cacccccuuucc

SEQ ID NO: 3381213 - RNA, 22 nt, Human
caccccggcaggcccugcagug

SEQ ID NO: 3381214 - RNA, 14 nt, Human
caccccggccaccu

SEQ ID NO: 3381215 - RNA, 15 nt, Human
caccccggccaccug

SEQ ID NO: 3381216 - RNA, 17 nt, Human
caccccggccaccugcg

SEQ ID NO: 3381217 - RNA, 19 nt, Human
caccccggggacccuguga

SEQ ID NO: 3381218 - RNA, 18 nt, Human
caccccuaccccuggcug

SEQ ID NO: 3381219 - RNA, 24 nt, Human
caccccuaccccuggcuguacugc

SEQ ID NO: 3381220 - RNA, 20 nt, Human
caccccucaacaccucugca

SEQ ID NO: 3381221 - RNA, 13 nt, Human
caccccuccagga

SEQ ID NO: 3381222 - RNA, 12 nt, Human
caccccucccau

SEQ ID NO: 3381223 - RNA, 16 nt, Human
caccccucugcccuca

SEQ ID NO: 3381224 - RNA, 13 nt, Human
caccccugcacag

SEQ ID NO: 3381225 - RNA, 11 nt, Human
caccccugccc

SEQ ID NO: 3381226 - RNA, 21 nt, Human
caccccugcccccacuuccug

SEQ ID NO: 3381227 - RNA, 13 nt, Human
caccccugccucc

SEQ ID NO: 3381228 - RNA, 16 nt, Human
caccccugccuccacc

SEQ ID NO: 3381229 - RNA, 20 nt, Human
caccccugccuccacccucu

SEQ ID NO: 3381230 - RNA, 18 nt, Human
caccccugguucucaucu

SEQ ID NO: 3381231 - RNA, 20 nt, Human
caccccuguccucacugcuc

SEQ ID NO: 3381232 - RNA, 12 nt, Human
caccccugugcu

SEQ ID NO: 3381233 - RNA, 23 nt, Human
caccccugugcuccgugccucca

SEQ ID NO: 3381234 - RNA, 18 nt, Human
caccccuuccccacugcc

SEQ ID NO: 3381235 - RNA, 22 nt, Human
caccccuuccugucccaccucu

SEQ ID NO: 3381236 - RNA, 12 nt, Human
caccccuucucu

SEQ ID NO: 3381237 - RNA, 21 nt, Human
caccccuucucuccuccccaa

SEQ ID NO: 3381238 - RNA, 16 nt, Human
cacccgacuccagucc

SEQ ID NO: 3381239 - RNA, 18 nt, Human
cacccgaggcugcccacu

SEQ ID NO: 3381240 - RNA, 14 nt, Human
cacccgaugcugcu

SEQ ID NO: 3381241 - RNA, 16 nt, Human
cacccgaugcugcuuu

SEQ ID NO: 3381242 - RNA, 16 nt, Human
cacccgccuuuuauaa

SEQ ID NO: 3381243 - RNA, 13 nt, Human
cacccggccccug

SEQ ID NO: 3381244 - RNA, 14 nt, Human
cacccggccccugc

SEQ ID NO: 3381245 - RNA, 23 nt, Human
cacccgggcucagggaccacagc

SEQ ID NO: 3381246 - RNA, 18 nt, Human
cacccgugagcgccugug

SEQ ID NO: 3381247 - RNA, 23 nt, Human
cacccgugagcgccugugcacac

SEQ ID NO: 3381248 - RNA, 17 nt, Human
cacccguggagauggga

SEQ ID NO: 3381249 - RNA, 18 nt, Human
cacccguucugcuggccu

SEQ ID NO: 3381250 - RNA, 17 nt, Human
cacccuagucccuuccc

SEQ ID NO: 3381251 - RNA, 18 nt, Human
cacccucaaccucuucug

SEQ ID NO: 3381252 - RNA, 17 nt, Human
cacccucacucugccag

SEQ ID NO: 3381253 - RNA, 21 nt, Human
cacccucacucugccagggca

SEQ ID NO: 3381254 - RNA, 16 nt, Human
cacccucagcaccccu

SEQ ID NO: 3381255 - RNA, 18 nt, Human
cacccucagcaccccuuc

SEQ ID NO: 3381256 - RNA, 21 nt, Human
cacccucaugcugugugacuc

SEQ ID NO: 3381257 - RNA, 13 nt, Human
cacccuccaccuu

SEQ ID NO: 3381258 - RNA, 15 nt, Human
cacccuccacucagc

SEQ ID NO: 3381259 - RNA, 22 nt, Human
cacccucccagaccugccucuu

SEQ ID NO: 3381260 - RNA, 14 nt, Human
cacccucccagcuc

SEQ ID NO: 3381261 - RNA, 16 nt, Human
cacccucccagcucug

SEQ ID NO: 3381262 - RNA, 13 nt, Human
cacccuccccucc

SEQ ID NO: 3381263 - RNA, 15 nt, Human
cacccuccccucucu

SEQ ID NO: 3381264 - RNA, 15 nt, Human
cacccucccuggagu

SEQ ID NO: 3381265 - RNA, 11 nt, Human
cacccuccugg

SEQ ID NO: 3381266 - RNA, 19 nt, Human
cacccuccuggccucagac

SEQ ID NO: 3381267 - RNA, 17 nt, Human
cacccuccugucuuccc

SEQ ID NO: 3381268 - RNA, 12 nt, Human
caccuaugugcc

SEQ ID NO: 3381269 - RNA, 17 nt, Human
caccuaugugccaacug

SEQ ID NO: 3381270 - RNA, 15 nt, Human
caccuauuaucccag

SEQ ID NO: 3381271 - RNA, 23 nt, Human
caccucaagaagaagaggggcau

SEQ ID NO: 3381272 - RNA, 16 nt, Human
caccucaccccacuua

SEQ ID NO: 3381273 - RNA, 16 nt, Human
caccucacucagcacc

SEQ ID NO: 3381274 - RNA, 17 nt, Human
caccucacucagcacca

SEQ ID NO: 3381275 - RNA, 20 nt, Human
caccucacucagcaccacuc

SEQ ID NO: 3381276 - RNA, 21 nt, Human
caccucacucagcaccacuca

SEQ ID NO: 3381277 - RNA, 14 nt, Human
caccucacuccugu

SEQ ID NO: 3381278 - RNA, 13 nt, Human
caccucagagccc

SEQ ID NO: 3381279 - RNA, 16 nt, Human
caccucagagccccgc

SEQ ID NO: 3381280 - RNA, 13 nt, Human
caccucagauggc

SEQ ID NO: 3381281 - RNA, 17 nt, Human
caccucagauggcagcu

SEQ ID NO: 3381282 - RNA, 14 nt, Human
caccucagccuccc

SEQ ID NO: 3381283 - RNA, 16 nt, Human
caccucagccucccaa

SEQ ID NO: 3381284 - RNA, 18 nt, Human
caccucaguucccuuggc

SEQ ID NO: 3381285 - RNA, 19 nt, Human
caccucaguucccuuggcc

SEQ ID NO: 3381286 - RNA, 20 nt, Human
caccucaguucccuuggccu

SEQ ID NO: 3381287 - RNA, 12 nt, Human
caccucaugccc

SEQ ID NO: 3381288 - RNA, 17 nt, Human
cauuguauguaucuauu

SEQ ID NO: 3381289 - RNA, 23 nt, Human
cauuguauucagaguugaugguu

SEQ ID NO: 3381290 - RNA, 19 nt, Human
cauuguccaauccuauguu

SEQ ID NO: 3381291 - RNA, 13 nt, Human
cauugucccucug

SEQ ID NO: 3381292 - RNA, 19 nt, Human
cauugucccucugccccau

SEQ ID NO: 3381293 - RNA, 19 nt, Human
cauugucuccuauauauuu

SEQ ID NO: 3381294 - RNA, 21 nt, Human
cauugucuccuauauauuucu

SEQ ID NO: 3381295 - RNA, 15 nt, Human
cauugucugucugca

SEQ ID NO: 3381296 - RNA, 15 nt, Human
cauugucuuguucug

SEQ ID NO: 3381297 - RNA, 16 nt, Human
cauugucuuuauauga

SEQ ID NO: 3381298 - RNA, 14 nt, Human
cauugucuuuuuag

SEQ ID NO: 3381299 - RNA, 20 nt, Human
cauugucuuuuuagaugccc

SEQ ID NO: 3381300 - RNA, 16 nt, Human
cauugugauuggccug

SEQ ID NO: 3381301 - RNA, 17 nt, Human
cauugugcuucuuucuu

SEQ ID NO: 3381302 - RNA, 13 nt, Human
cauugugggaagg

SEQ ID NO: 3381303 - RNA, 17 nt, Human
cauugugguuauuuuua

SEQ ID NO: 3381304 - RNA, 18 nt, Human
cauugugguuauuuuuau

SEQ ID NO: 3381305 - RNA, 20 nt, Human
cauugugguuauuuuuauac

SEQ ID NO: 3381306 - RNA, 21 nt, Human
cauugugguuauuuuuauaca

SEQ ID NO: 3381307 - RNA, 23 nt, Human
cauugugguuauuuuuauacagu

SEQ ID NO: 3381308 - RNA, 14 nt, Human
cauuguguuaccug

SEQ ID NO: 3381309 - RNA, 16 nt, Human
cauuguguugacauua

SEQ ID NO: 3381310 - RNA, 18 nt, Human
cauuguuaccucuauaua

SEQ ID NO: 3381311 - RNA, 13 nt, Human
cauuguuauuuuc

SEQ ID NO: 3381312 - RNA, 19 nt, Human
cauuguuauuuucagugau

SEQ ID NO: 3381313 - RNA, 17 nt, Human
cauuguuggccaaagcc

SEQ ID NO: 3381314 - RNA, 14 nt, Human
cauuguuuaaaaau

SEQ ID NO: 3381315 - RNA, 14 nt, Human
cauuguuugcuuau

SEQ ID NO: 3381316 - RNA, 18 nt, Human
cauuguuugcuuauuguu

SEQ ID NO: 3381317 - RNA, 20 nt, Human
cauuguuugcuuauuguucc

SEQ ID NO: 3381318 - RNA, 15 nt, Human
cauuguuuggagaca

SEQ ID NO: 3381319 - RNA, 23 nt, Human
cauuguuuuaaaaagaaacaaga

SEQ ID NO: 3381320 - RNA, 14 nt, Human
cauuguuuugaaac

SEQ ID NO: 3381321 - RNA, 13 nt, Human
cauuguuuugaau

SEQ ID NO: 3381322 - RNA, 22 nt, Human
cauuguuuugaauauuacuccu

SEQ ID NO: 3381323 - RNA, 15 nt, Human
cauuuaaaaaaauca

SEQ ID NO: 3381324 - RNA, 13 nt, Human
cauuuaaaacaga

SEQ ID NO: 3381325 - RNA, 12 nt, Human
cauuuaaaacau

SEQ ID NO: 3381326 - RNA, 16 nt, Human
cauuuaaaagauacag

SEQ ID NO: 3381327 - RNA, 12 nt, Human
cauuuaaaauga

SEQ ID NO: 3381328 - RNA, 13 nt, Human
cauuuaaaaugau

SEQ ID NO: 3381329 - RNA, 15 nt, Human
cauuuaaaaugauua

SEQ ID NO: 3381330 - RNA, 15 nt, Human
cauuuaaagcauugc

SEQ ID NO: 3381331 - RNA, 17 nt, Human
cauuuaaauacagucuu

SEQ ID NO: 3381332 - RNA, 18 nt, Human
cauuuaaauacagucuuc

SEQ ID NO: 3381333 - RNA, 20 nt, Human
cauuuaaauacagucuucca

SEQ ID NO: 3381334 - RNA, 16 nt, Human
cauuuaaauaucugaa

SEQ ID NO: 3381335 - RNA, 20 nt, Human
cauuuaaauguguacaaugu

SEQ ID NO: 3381336 - RNA, 19 nt, Human
cauuuaaccccccuguaca

SEQ ID NO: 3381337 - RNA, 20 nt, Human
cauuuaaccccccuguacac

SEQ ID NO: 3381338 - RNA, 19 nt, Human
cauuuaagagacagucacc

SEQ ID NO: 3381339 - RNA, 15 nt, Human
cauuuaagggaaaaa

SEQ ID NO: 3381340 - RNA, 18 nt, Human
cauuuaagggaaaaauau

SEQ ID NO: 3381341 - RNA, 14 nt, Human
cauuuaauaauaua

SEQ ID NO: 3381342 - RNA, 20 nt, Human
cauuuaauaauauacuugug

SEQ ID NO: 3381343 - RNA, 14 nt, Human
cauuuaauaauuau

SEQ ID NO: 3381344 - RNA, 15 nt, Human
cauuuaauaauuaua

SEQ ID NO: 3381345 - RNA, 21 nt, Human
cauuuaauguagccaugggac

SEQ ID NO: 3381346 - RNA, 12 nt, Human
cauuuaauuuag

SEQ ID NO: 3381347 - RNA, 19 nt, Human
cauuuacacuuuugagacu

SEQ ID NO: 3381348 - RNA, 20 nt, Human
cauuuacauguauuauuuca

SEQ ID NO: 3381349 - RNA, 15 nt, Human
cauuuaccuuuuuga

SEQ ID NO: 3381350 - RNA, 13 nt, Human
cauuuacuaaaca

SEQ ID NO: 3381351 - RNA, 20 nt, Human
cauuuacugcauucuucuga

SEQ ID NO: 3381352 - RNA, 13 nt, Human
cauuuacuguggc

SEQ ID NO: 3381353 - RNA, 14 nt, Human
cauuuacuguggcu

SEQ ID NO: 3381354 - RNA, 17 nt, Human
cauuuacugugucuuug

SEQ ID NO: 3381355 - RNA, 14 nt, Human
cauuuacuuaagac

SEQ ID NO: 3381356 - RNA, 15 nt, Human
cauuuacuuaagacu

SEQ ID NO: 3381357 - RNA, 12 nt, Human
cauuuagaaaag

SEQ ID NO: 3381358 - RNA, 22 nt, Human
cauuuagaaaauagagcuuuua

SEQ ID NO: 3381359 - RNA, 16 nt, Human
cauuuagaagaaagau

SEQ ID NO: 3381360 - RNA, 10 nt, Human
cauuuagaau

SEQ ID NO: 3381361 - RNA, 12 nt, Human
cauuuagaaugg

SEQ ID NO: 3381362 - RNA, 19 nt, Human
cauuuagauugaaaacuuu

SEQ ID NO: 3381363 - RNA, 16 nt, Human
cauuuagcauguuguu

SEQ ID NO: 3381364 - RNA, 17 nt, Human
cauuuagccaccaucuu

SEQ ID NO: 3381365 - RNA, 17 nt, Human
cauuuagccuguccugu

SEQ ID NO: 3381366 - RNA, 17 nt, Human
cauuuaggccaugggac

SEQ ID NO: 3381367 - RNA, 20 nt, Human
cauuuagggaguauucuaau

SEQ ID NO: 3381368 - RNA, 17 nt, Human
cauuuagucaugugacc

SEQ ID NO: 3381369 - RNA, 15 nt, Human
cauuuagucucuuua

SEQ ID NO: 3381370 - RNA, 17 nt, Human
cauuuagucucuuuauu

SEQ ID NO: 3381371 - RNA, 22 nt, Human
cauuuagucucuuuauuccuag

SEQ ID NO: 3381372 - RNA, 19 nt, Human
cauuuagugaguuauuccu

SEQ ID NO: 3381373 - RNA, 14 nt, Human
cauuuaguucuuug

SEQ ID NO: 3381374 - RNA, 23 nt, Human
cauuuaguuugauuauucagugu

SEQ ID NO: 3381375 - RNA, 16 nt, Human
cauuuauaagaagaga

SEQ ID NO: 3381376 - RNA, 14 nt, Human
cauuuauaauguuu

SEQ ID NO: 3381377 - RNA, 17 nt, Human
cauuuauaauguuugcu

SEQ ID NO: 3381378 - RNA, 21 nt, Human
cauuuauaauguuugcuauug

SEQ ID NO: 3381379 - RNA, 12 nt, Human
cauuuauacaaa

SEQ ID NO: 3381380 - RNA, 15 nt, Human
cauuuauacaaauua

SEQ ID NO: 3381381 - RNA, 15 nt, Human
cauuuauacucuuuu

SEQ ID NO: 3381382 - RNA, 15 nt, Human
cauuuauauaugaaa

SEQ ID NO: 3381383 - RNA, 20 nt, Human
cauuuauauaugaaaacuau

SEQ ID NO: 3381384 - RNA, 15 nt, Human
cauuuauauauugaa

SEQ ID NO: 3381385 - RNA, 14 nt, Human
cauuuauauugaua

SEQ ID NO: 3381386 - RNA, 18 nt, Human
cauuuaucaaucaguaua

SEQ ID NO: 3381387 - RNA, 15 nt, Human
cauuuaucauucuug

SEQ ID NO: 3381388 - RNA, 20 nt, Human
cauuuaucuaaauauggacu

SEQ ID NO: 3381389 - RNA, 23 nt, Human
cauuuaucuacccaagggcagaa

SEQ ID NO: 3381390 - RNA, 14 nt, Human
cauuuaucuauaau

SEQ ID NO: 3381391 - RNA, 22 nt, Human
cauuuaucuauaauuuaccuaa

SEQ ID NO: 3381392 - RNA, 12 nt, Human
cauuuaucuuga

SEQ ID NO: 3381393 - RNA, 16 nt, Human
cauuuaugaagcaagc

SEQ ID NO: 3381394 - RNA, 23 nt, Human
cauuuaugaguaacuauuauuau

SEQ ID NO: 3381395 - RNA, 16 nt, Human
cauuuaugauuuaaua

SEQ ID NO: 3381396 - RNA, 23 nt, Human
cauuuaugauuuaauaaaauaau

SEQ ID NO: 3381397 - RNA, 20 nt, Human
cauuuauggucaacacuuaa

SEQ ID NO: 3381398 - RNA, 14 nt, Human
cauuuauucugcuc

SEQ ID NO: 3381399 - RNA, 16 nt, Human
cauuuauucugcucac

SEQ ID NO: 3381400 - RNA, 18 nt, Human
cauuuauuguuuauguaa

SEQ ID NO: 3381401 - RNA, 17 nt, Human
cauuuauuuauccagaa

SEQ ID NO: 3381402 - RNA, 15 nt, Human
cauuuauuuuaugag

SEQ ID NO: 3381403 - RNA, 16 nt, Human
cauuuauuuuaugaga

SEQ ID NO: 3381404 - RNA, 19 nt, Human
cauuuauuuuaugagaaau

SEQ ID NO: 3381405 - RNA, 18 nt, Human
cauuuauuuuucucauga

SEQ ID NO: 3381406 - RNA, 17 nt, Human
cauuuauuuuuuacauu

SEQ ID NO: 3381407 - RNA, 21 nt, Human
cauuuauuuuuuuuaaagaaa

SEQ ID NO: 3381408 - RNA, 14 nt, Human
cauuucaagaaguc

SEQ ID NO: 3381409 - RNA, 13 nt, Human
cauuucaccccuc

SEQ ID NO: 3381410 - RNA, 14 nt, Human
cauuucaccccucc

SEQ ID NO: 3381411 - RNA, 20 nt, Human
cauuucaccccucccuuucu

SEQ ID NO: 3381412 - RNA, 21 nt, Human
cauuucaccccucccuuucuc

SEQ ID NO: 3381413 - RNA, 15 nt, Human
cauuucacugucugu

SEQ ID NO: 3381414 - RNA, 17 nt, Human
cacuccagugccagcaa

SEQ ID NO: 3381415 - RNA, 15 nt, Human
cacuccauucccaac

SEQ ID NO: 3381416 - RNA, 12 nt, Human
cacucccaagcc

SEQ ID NO: 3381417 - RNA, 19 nt, Human
cacucccaagguuggagcc

SEQ ID NO: 3381418 - RNA, 17 nt, Human
cacucccacaugggccc

SEQ ID NO: 3381419 - RNA, 14 nt, Human
cacucccacuuccc

SEQ ID NO: 3381420 - RNA, 15 nt, Human
cacucccacuucccu

SEQ ID NO: 3381421 - RNA, 13 nt, Human
cacucccagugcu

SEQ ID NO: 3381422 - RNA, 14 nt, Human
cacuccccaccuuc

SEQ ID NO: 3381423 - RNA, 16 nt, Human
cacuccccagccagcc

SEQ ID NO: 3381424 - RNA, 22 nt, Human
cacuccccagccagccuggcug

SEQ ID NO: 3381425 - RNA, 18 nt, Human
cacuccccaugccacguu

SEQ ID NO: 3381426 - RNA, 18 nt, Human
cacuccccgaagucuuuu

SEQ ID NO: 3381427 - RNA, 20 nt, Human
cacuccccgccguacaguuc

SEQ ID NO: 3381428 - RNA, 16 nt, Human
cacuccccuccacucu

SEQ ID NO: 3381429 - RNA, 13 nt, Human
cacuccccugcac

SEQ ID NO: 3381430 - RNA, 17 nt, Human
cacuccccugcacugga

SEQ ID NO: 3381431 - RNA, 12 nt, Human
cacuccccugcu

SEQ ID NO: 3381432 - RNA, 13 nt, Human
cacuccccugcug

SEQ ID NO: 3381433 - RNA, 21 nt, Human
cacucccggcacuccaugcuu

SEQ ID NO: 3381434 - RNA, 20 nt, Human
cacucccuccagcacaaaca

SEQ ID NO: 3381435 - RNA, 14 nt, Human
cacucccuccauca

SEQ ID NO: 3381436 - RNA, 15 nt, Human
cacucccuccaucaa

SEQ ID NO: 3381437 - RNA, 17 nt, Human
cacucccuucuaccugc

SEQ ID NO: 3381438 - RNA, 20 nt, Human
cacucccuucuaccugccac

SEQ ID NO: 3381439 - RNA, 23 nt, Human
cacucccuucuaccugccacuca

SEQ ID NO: 3381440 - RNA, 22 nt, Human
cacucccuugcuggccccagcc

SEQ ID NO: 3381441 - RNA, 16 nt, Human
cacucccuugggcucc

SEQ ID NO: 3381442 - RNA, 18 nt, Human
cacuccggcccuccagag

SEQ ID NO: 3381443 - RNA, 20 nt, Human
cacuccggcccuccagagcc

SEQ ID NO: 3381444 - RNA, 20 nt, Human
cacuccggccugaugacaga

SEQ ID NO: 3381445 - RNA, 19 nt, Human
cacuccggugugccugcag

SEQ ID NO: 3381446 - RNA, 21 nt, Human
cacuccggugugccugcagcc

SEQ ID NO: 3381447 - RNA, 18 nt, Human
cacuccuacaccuaacuc

SEQ ID NO: 3381448 - RNA, 13 nt, Human
cacuccuaccugg

SEQ ID NO: 3381449 - RNA, 19 nt, Human
cacuccuagagaacgcagc

SEQ ID NO: 3381450 - RNA, 17 nt, Human
cacuccuaggacauguu

SEQ ID NO: 3381451 - RNA, 16 nt, Human
cacuccucagggcagc

SEQ ID NO: 3381452 - RNA, 13 nt, Human
cacuccuccuagc

SEQ ID NO: 3381453 - RNA, 18 nt, Human
cacuccuccuagccaccc

SEQ ID NO: 3381454 - RNA, 20 nt, Human
cacuccucugacucagggcu

SEQ ID NO: 3381455 - RNA, 14 nt, Human
cacuccucugcuga

SEQ ID NO: 3381456 - RNA, 21 nt, Human
cacuccucugcugaccugcug

SEQ ID NO: 3381457 - RNA, 22 nt, Human
cacuccucugcugaccugcuga

SEQ ID NO: 3381458 - RNA, 20 nt, Human
cacuccugagaccccuggcc

SEQ ID NO: 3381459 - RNA, 13 nt, Human
cacuccugcugua

SEQ ID NO: 3381460 - RNA, 10 nt, Human
cacuccuggg

SEQ ID NO: 3381461 - RNA, 19 nt, Human
cacuccuggggccucuugg

SEQ ID NO: 3381462 - RNA, 18 nt, Human
cacuccuguuacuuaccu

SEQ ID NO: 3381463 - RNA, 14 nt, Human
cacuccuucacaga

SEQ ID NO: 3381464 - RNA, 17 nt, Human
cacuccuuccugcccca

SEQ ID NO: 3381465 - RNA, 15 nt, Human
cacuccuugcaucaa

SEQ ID NO: 3381466 - RNA, 23 nt, Human
cacuccuuuagauagcagccugg

SEQ ID NO: 3381467 - RNA, 13 nt, Human
cacucgacaugaa

SEQ ID NO: 3381468 - RNA, 17 nt, Human
cacucgcccgcccacug

SEQ ID NO: 3381469 - RNA, 21 nt, Human
cacucgcuagcaguggcaggc

SEQ ID NO: 3381470 - RNA, 22 nt, Human
cacucggcggcagcauggagcu

SEQ ID NO: 3381471 - RNA, 14 nt, Human
cacucggguuucuc

SEQ ID NO: 3381472 - RNA, 20 nt, Human
cacucgugugcaacagacaa

SEQ ID NO: 3381473 - RNA, 20 nt, Human
cacucuaaaagguucaggga

SEQ ID NO: 3381474 - RNA, 18 nt, Human
cacucuaacuguauauuu

SEQ ID NO: 3381475 - RNA, 13 nt, Human
cacucuaagaugu

SEQ ID NO: 3381476 - RNA, 18 nt, Human
cacucuaagauguuauau

SEQ ID NO: 3381477 - RNA, 19 nt, Human
cacucuaagauguuauauu

SEQ ID NO: 3381478 - RNA, 15 nt, Human
cacucuacccuccca

SEQ ID NO: 3381479 - RNA, 18 nt, Human
cacucuacccucccaccc

SEQ ID NO: 3381480 - RNA, 19 nt, Human
cacucuagggcaguggagu

SEQ ID NO: 3381481 - RNA, 18 nt, Human
cacucuagucaaugacau

SEQ ID NO: 3381482 - RNA, 17 nt, Human
cacucuccauuuaauaa

SEQ ID NO: 3381483 - RNA, 12 nt, Human
cacucuccccac

SEQ ID NO: 3381484 - RNA, 11 nt, Human
cacucuccugg

SEQ ID NO: 3381485 - RNA, 12 nt, Human
cacucuccuggg

SEQ ID NO: 3381486 - RNA, 13 nt, Human
cacucuccugggc

SEQ ID NO: 3381487 - RNA, 18 nt, Human
cacucuccugggccccuc

SEQ ID NO: 3381488 - RNA, 23 nt, Human
cacucuccugggccccucccuac

SEQ ID NO: 3381489 - RNA, 14 nt, Human
cacucucucuuguu

SEQ ID NO: 3381490 - RNA, 13 nt, Human
cacucucuggaag

SEQ ID NO: 3381491 - RNA, 17 nt, Human
cacucucuucccuuucc

SEQ ID NO: 3381492 - RNA, 20 nt, Human
cacucugccagcaaagagga

SEQ ID NO: 3381493 - RNA, 14 nt, Human
cacucugccagggc

SEQ ID NO: 3381494 - RNA, 16 nt, Human
cacucugccagggcag

SEQ ID NO: 3381495 - RNA, 12 nt, Human
ccaacccugccg

SEQ ID NO: 3381496 - RNA, 16 nt, Human
ccaacccuguccuccc

SEQ ID NO: 3381497 - RNA, 12 nt, Human
ccaacccugucu

SEQ ID NO: 3381498 - RNA, 21 nt, Human
ccaacccuucuccucuuguaa

SEQ ID NO: 3381499 - RNA, 15 nt, Human
ccaacccuucuucau

SEQ ID NO: 3381500 - RNA, 13 nt, Human
ccaaccuaaccug

SEQ ID NO: 3381501 - RNA, 16 nt, Human
ccaaccuaaccugugu

SEQ ID NO: 3381502 - RNA, 14 nt, Human
ccaaccuauuuuga

SEQ ID NO: 3381503 - RNA, 12 nt, Human
ccaaccucagca

SEQ ID NO: 3381504 - RNA, 18 nt, Human
ccaaccucagggcuccca

SEQ ID NO: 3381505 - RNA, 13 nt, Human
ccaaccucuuccu

SEQ ID NO: 3381506 - RNA, 14 nt, Human
ccaaccucuuccuc

SEQ ID NO: 3381507 - RNA, 16 nt, Human
ccaaccugaccaacau

SEQ ID NO: 3381508 - RNA, 17 nt, Human
ccaaccugcaaagaucu

SEQ ID NO: 3381509 - RNA, 13 nt, Human
ccaaccugcucuc

SEQ ID NO: 3381510 - RNA, 17 nt, Human
ccaaccuguaauaaaua

SEQ ID NO: 3381511 - RNA, 19 nt, Human
ccaaccuguaauaaauaug

SEQ ID NO: 3381512 - RNA, 22 nt, Human
ccaaccuguaauaaauaugagu

SEQ ID NO: 3381513 - RNA, 23 nt, Human
ccaaccuuagauguucuaagucu

SEQ ID NO: 3381514 - RNA, 15 nt, Human
ccaaccuuucccuca

SEQ ID NO: 3381515 - RNA, 16 nt, Human
ccaaccuuucccucac

SEQ ID NO: 3381516 - RNA, 19 nt, Human
ccaaccuuucccucacccc

SEQ ID NO: 3381517 - RNA, 19 nt, Human
ccaacgaaaagcacaucca

SEQ ID NO: 3381518 - RNA, 22 nt, Human
ccaacgcgaaaccaauuccuca

SEQ ID NO: 3381519 - RNA, 22 nt, Human
ccaacggagagcgccugccccu

SEQ ID NO: 3381520 - RNA, 24 nt, Human
ccaacggcaagggaacaaguacuu

SEQ ID NO: 3381521 - RNA, 21 nt, Human
ccaacggcccugcagccagcu

SEQ ID NO: 3381522 - RNA, 15 nt, Human
ccaacgucugugcca

SEQ ID NO: 3381523 - RNA, 20 nt, Human
ccaacguggggcagcacaga

SEQ ID NO: 3381524 - RNA, 22 nt, Human
ccaacguuuggaagauccugug

SEQ ID NO: 3381525 - RNA, 23 nt, Human
ccaacguuuggaagauccuguga

SEQ ID NO: 3381526 - RNA, 20 nt, Human
ccaacuaaugccuuacucuu

SEQ ID NO: 3381527 - RNA, 23 nt, Human
ccaacuacaaccaagcucucugc

SEQ ID NO: 3381528 - RNA, 16 nt, Human
ccaacuagacauucug

SEQ ID NO: 3381529 - RNA, 15 nt, Human
ccaacuagccccugg

SEQ ID NO: 3381530 - RNA, 15 nt, Human
ccaacuauggccugu

SEQ ID NO: 3381531 - RNA, 16 nt, Human
ccaacuauggccugug

SEQ ID NO: 3381532 - RNA, 11 nt, Human
ccaacuauuua

SEQ ID NO: 3381533 - RNA, 23 nt, Human
ccaacuauuuauugacucugggu

SEQ ID NO: 3381534 - RNA, 14 nt, Human
ccaacucaccccag

SEQ ID NO: 3381535 - RNA, 17 nt, Human
ccaacucaccccagccc

SEQ ID NO: 3381536 - RNA, 21 nt, Human
ccaacucaccccagccccaaa

SEQ ID NO: 3381537 - RNA, 14 nt, Human
ccaacucagaaggg

SEQ ID NO: 3381538 - RNA, 15 nt, Human
ccaacuccagcaacu

SEQ ID NO: 3381539 - RNA, 20 nt, Human
ccaacuccaguacuggagcu

SEQ ID NO: 3381540 - RNA, 15 nt, Human
ccaacuccuaguucu

SEQ ID NO: 3381541 - RNA, 23 nt, Human
ccaacuccuaguucuagaaaaac

SEQ ID NO: 3381542 - RNA, 15 nt, Human
ccaacuccuggaagc

SEQ ID NO: 3381543 - RNA, 16 nt, Human
ccaacuccuuccagcu

SEQ ID NO: 3381544 - RNA, 21 nt, Human
ccaacucuagcuggggguggg

SEQ ID NO: 3381545 - RNA, 12 nt, Human
ccaacucuccug

SEQ ID NO: 3381546 - RNA, 23 nt, Human
ccaacugaaggcuaaaaagcaac

SEQ ID NO: 3381547 - RNA, 15 nt, Human
ccaacugaccaccuu

SEQ ID NO: 3381548 - RNA, 22 nt, Human
ccaacugagaaaacgaaacugc

SEQ ID NO: 3381549 - RNA, 14 nt, Human
ccaacugcugcuuu

SEQ ID NO: 3381550 - RNA, 15 nt, Human
ccaacuggaagcaca

SEQ ID NO: 3381551 - RNA, 11 nt, Human
ccaacuguguu

SEQ ID NO: 3381552 - RNA, 21 nt, Human
ccaacuguguuguauuaacaa

SEQ ID NO: 3381553 - RNA, 23 nt, Human
ccaacuguguuguauuaacaaaa

SEQ ID NO: 3381554 - RNA, 18 nt, Human
ccaacuucuucagagcug

SEQ ID NO: 3381555 - RNA, 19 nt, Human
ccaacuugagggcccagag

SEQ ID NO: 3381556 - RNA, 14 nt, Human
ccaacuuggcuuuc

SEQ ID NO: 3381557 - RNA, 19 nt, Human
ccaacuugguucugcuuca

SEQ ID NO: 3381558 - RNA, 22 nt, Human
ccaacuuucaagaacuuguuua

SEQ ID NO: 3381559 - RNA, 22 nt, Human
ccagcccaucuugccuccaugg

SEQ ID NO: 3381560 - RNA, 14 nt, Human
ccagcccauggaga

SEQ ID NO: 3381561 - RNA, 22 nt, Human
ccagcccauucucucuccuguc

SEQ ID NO: 3381562 - RNA, 14 nt, Human
ccagccccacacag

SEQ ID NO: 3381563 - RNA, 15 nt, Human
ccagccccacagccc

SEQ ID NO: 3381564 - RNA, 14 nt, Human
ccagccccacccag

SEQ ID NO: 3381565 - RNA, 19 nt, Human
ccagccccacugccagcag

SEQ ID NO: 3381566 - RNA, 20 nt, Human
ccagccccacugccagcagc

SEQ ID NO: 3381567 - RNA, 15 nt, Human
ccagccccagccagg

SEQ ID NO: 3381568 - RNA, 13 nt, Human
ccagccccagugc

SEQ ID NO: 3381569 - RNA, 17 nt, Human
ccagccccagugcccac

SEQ ID NO: 3381570 - RNA, 15 nt, Human
ccagccccauccucu

SEQ ID NO: 3381571 - RNA, 17 nt, Human
ccagccccauccucugu

SEQ ID NO: 3381572 - RNA, 22 nt, Human
ccagcccccuccuggugccacc

SEQ ID NO: 3381573 - RNA, 14 nt, Human
ccagccccgacucc

SEQ ID NO: 3381574 - RNA, 15 nt, Human
ccagccccgacucca

SEQ ID NO: 3381575 - RNA, 16 nt, Human
ccagccccgacuccag

SEQ ID NO: 3381576 - RNA, 17 nt, Human
ccagccccgacuccagc

SEQ ID NO: 3381577 - RNA, 18 nt, Human
ccagccccgacuccagcc

SEQ ID NO: 3381578 - RNA, 20 nt, Human
ccagccccgacuccagccag

SEQ ID NO: 3381579 - RNA, 21 nt, Human
ccagccccgacuccagccagc

SEQ ID NO: 3381580 - RNA, 22 nt, Human
ccagccccgacuccagccagcg

SEQ ID NO: 3381581 - RNA, 18 nt, Human
ccagccccggcccugggc

SEQ ID NO: 3381582 - RNA, 17 nt, Human
ccagccccggggugagu

SEQ ID NO: 3381583 - RNA, 20 nt, Human
ccagccccgguggcugggca

SEQ ID NO: 3381584 - RNA, 22 nt, Human
ccagccccuagaaacccaagcu

SEQ ID NO: 3381585 - RNA, 23 nt, Human
ccagccccuagaaacccaagcuc

SEQ ID NO: 3381586 - RNA, 16 nt, Human
ccagccccuagcccag

SEQ ID NO: 3381587 - RNA, 19 nt, Human
ccagccccuagcccaggag

SEQ ID NO: 3381588 - RNA, 11 nt, Human
ccagccccucc

SEQ ID NO: 3381589 - RNA, 12 nt, Human
ccagccccuccc

SEQ ID NO: 3381590 - RNA, 16 nt, Human
ccagccccucccccau

SEQ ID NO: 3381591 - RNA, 17 nt, Human
ccagccccucccccauc

SEQ ID NO: 3381592 - RNA, 14 nt, Human
ccagccccucuggu

SEQ ID NO: 3381593 - RNA, 18 nt, Human
ccagccccugccccagcc

SEQ ID NO: 3381594 - RNA, 20 nt, Human
ccagccccugccccagccca

SEQ ID NO: 3381595 - RNA, 11 nt, Human
ccagccccugg

SEQ ID NO: 3381596 - RNA, 13 nt, Human
ccagccccuggau

SEQ ID NO: 3381597 - RNA, 21 nt, Human
ccagccccuggaugcagccuc

SEQ ID NO: 3381598 - RNA, 13 nt, Human
ccagccccuggcc

SEQ ID NO: 3381599 - RNA, 21 nt, Human
ccagccccuggccccaggacc

SEQ ID NO: 3381600 - RNA, 21 nt, Human
ccagccccuucucagaaucua

SEQ ID NO: 3381601 - RNA, 14 nt, Human
ccagcccggccugc

SEQ ID NO: 3381602 - RNA, 15 nt, Human
ccagcccggccugcu

SEQ ID NO: 3381603 - RNA, 16 nt, Human
ccagcccgggagccua

SEQ ID NO: 3381604 - RNA, 13 nt, Human
ccagcccucaucc

SEQ ID NO: 3381605 - RNA, 14 nt, Human
ccagcccuccccau

SEQ ID NO: 3381606 - RNA, 15 nt, Human
ccagcccucccuguc

SEQ ID NO: 3381607 - RNA, 14 nt, Human
ccagcccugaguuc

SEQ ID NO: 3381608 - RNA, 13 nt, Human
ccagcccugccug

SEQ ID NO: 3381609 - RNA, 14 nt, Human
ccagcccugccugg

SEQ ID NO: 3381610 - RNA, 11 nt, Human
ccagcccugcu

SEQ ID NO: 3381611 - RNA, 14 nt, Human
ccagcccugcuggg

SEQ ID NO: 3381612 - RNA, 20 nt, Human
ccagcccugcuggggauccc

SEQ ID NO: 3381613 - RNA, 22 nt, Human
ccagcccugcuggggauccccg

SEQ ID NO: 3381614 - RNA, 14 nt, Human
ccagcccuggcuga

SEQ ID NO: 3381615 - RNA, 14 nt, Human
ccagcccuguggaa

SEQ ID NO: 3381616 - RNA, 13 nt, Human
ccagcccuguucu

SEQ ID NO: 3381617 - RNA, 15 nt, Human
ccagcccuuccucug

SEQ ID NO: 3381618 - RNA, 16 nt, Human
ccagcccuugaaguca

SEQ ID NO: 3381619 - RNA, 15 nt, Human
ccagccgacccccuc

SEQ ID NO: 3381620 - RNA, 20 nt, Human
ccagccgacccccucucccu

SEQ ID NO: 3381621 - RNA, 20 nt, Human
ccagccgagauagccaaggc

SEQ ID NO: 3381622 - RNA, 22 nt, Human
ccagccgagauagccaaggcca

SEQ ID NO: 3381623 - RNA, 23 nt, Human
ccagccgccauugccaccaggag

SEQ ID NO: 3381624 - RNA, 16 nt, Human
ccagccgcucggaggc

SEQ ID NO: 3381625 - RNA, 19 nt, Human
ccagccgcucggaggcccc

SEQ ID NO: 3381626 - RNA, 18 nt, Human
ccagccgcucuccugcca

SEQ ID NO: 3381627 - RNA, 20 nt, Human
ccagccgcucuccugccaca

SEQ ID NO: 3381628 - RNA, 22 nt, Human
ccagccgcuuggcgaugccagc

SEQ ID NO: 3381629 - RNA, 19 nt, Human
ccagccggccaauggaaac

SEQ ID NO: 3381630 - RNA, 13 nt, Human
ccagccggggccu

SEQ ID NO: 3381631 - RNA, 19 nt, Human
ccagccuaugagcauccug

SEQ ID NO: 3381632 - RNA, 22 nt, Human
ccagccuaugagcauccugagc

SEQ ID NO: 3381633 - RNA, 23 nt, Human
ccagccuaugagcauccugagcc

SEQ ID NO: 3381634 - RNA, 18 nt, Human
ccagccucaaauccagga

SEQ ID NO: 3381635 - RNA, 19 nt, Human
ccagccucaaauccaggac

SEQ ID NO: 3381636 - RNA, 17 nt, Human
ccagccucacccuugcg

SEQ ID NO: 3381637 - RNA, 16 nt, Human
ccagccucagacugga

SEQ ID NO: 3381638 - RNA, 12 nt, Human
ccagccucaguc

SEQ ID NO: 3381639 - RNA, 22 nt, Human
ccagccucaguccuccccucac

SEQ ID NO: 3381640 - RNA, 21 nt, Human
ccagccuccaagcuccaucuc

SEQ ID NO: 3381641 - RNA, 15 nt, Human
ccagccuccaugcug

SEQ ID NO: 3381642 - RNA, 16 nt, Human
ccagccuccaugcugc

SEQ ID NO: 3381643 - RNA, 11 nt, Human
ccagccucccu

SEQ ID NO: 3381644 - RNA, 21 nt, Human
ccagccucccugaagccuuug

SEQ ID NO: 3381645 - RNA, 12 nt, Human
ccagccuccucu

SEQ ID NO: 3381646 - RNA, 13 nt, Human
ccagccuccucug

SEQ ID NO: 3381647 - RNA, 14 nt, Human
ccagccuccucugg

SEQ ID NO: 3381648 - RNA, 23 nt, Human
ccagccucgcccauccccuugag

SEQ ID NO: 3381649 - RNA, 22 nt, Human
ccagccucguuggaagaggaac

SEQ ID NO: 3381650 - RNA, 22 nt, Human
ccagccucuccccugauuacac

SEQ ID NO: 3381651 - RNA, 21 nt, Human
ccagccucucuugguuuccuu

SEQ ID NO: 3381652 - RNA, 14 nt, Human
ccagccucuuuccc

SEQ ID NO: 3381653 - RNA, 13 nt, Human
ccagccugcacua

SEQ ID NO: 3381654 - RNA, 10 nt, Human
ccagccugcc

SEQ ID NO: 3381655 - RNA, 19 nt, Human
ccagccugccuggcaggcu

SEQ ID NO: 3381656 - RNA, 15 nt, Human
ccagccugcgccugc

SEQ ID NO: 3381657 - RNA, 19 nt, Human
ccagccugcgccugcugca

SEQ ID NO: 3381658 - RNA, 20 nt, Human
ccagccuggaaaccugucug

SEQ ID NO: 3381659 - RNA, 21 nt, Human
ccagccuggaaaccugucuga

SEQ ID NO: 3381660 - RNA, 19 nt, Human
ccagccuggacccccagcu

SEQ ID NO: 3381661 - RNA, 15 nt, Human
ccaagcuccaagccc

SEQ ID NO: 3381662 - RNA, 12 nt, Human
ccaagcucccag

SEQ ID NO: 3381663 - RNA, 14 nt, Human
ccaagcucccaggc

SEQ ID NO: 3381664 - RNA, 16 nt, Human
ccaagcucccaggcau

SEQ ID NO: 3381665 - RNA, 22 nt, Human
ccaagcucccaggcauucccca

SEQ ID NO: 3381666 - RNA, 22 nt, Human
ccaagcucccugccccaaauaa

SEQ ID NO: 3381667 - RNA, 22 nt, Human
ccaagcuccuccucggaaccgc

SEQ ID NO: 3381668 - RNA, 22 nt, Human
ccaagcuccuugggaggcccca

SEQ ID NO: 3381669 - RNA, 14 nt, Human
ccaagcucugcagu

SEQ ID NO: 3381670 - RNA, 12 nt, Human
ccaagcucugcu

SEQ ID NO: 3381671 - RNA, 16 nt, Human
ccaagcucugcuccuc

SEQ ID NO: 3381672 - RNA, 15 nt, Human
ccaagcugaggugcc

SEQ ID NO: 3381673 - RNA, 19 nt, Human
ccaagcugaggugcccagg

SEQ ID NO: 3381674 - RNA, 23 nt, Human
ccaagcugccuccccucuccuuc

SEQ ID NO: 3381675 - RNA, 16 nt, Human
ccaagcugggccccag

SEQ ID NO: 3381676 - RNA, 20 nt, Human
ccaagcugggccccagccca

SEQ ID NO: 3381677 - RNA, 13 nt, Human
ccaagcugugcca

SEQ ID NO: 3381678 - RNA, 15 nt, Human
ccaagcugugccacc

SEQ ID NO: 3381679 - RNA, 16 nt, Human
ccaagcugugccaccc

SEQ ID NO: 3381680 - RNA, 18 nt, Human
ccaagcugugccacccug

SEQ ID NO: 3381681 - RNA, 21 nt, Human
ccaagcugugccacccugggc

SEQ ID NO: 3381682 - RNA, 17 nt, Human
ccaagcuuccuuuguuu

SEQ ID NO: 3381683 - RNA, 17 nt, Human
ccaagcuuggcagccga

SEQ ID NO: 3381684 - RNA, 19 nt, Human
ccaaggaaaccacagcugc

SEQ ID NO: 3381685 - RNA, 23 nt, Human
ccaaggaaaccacagcugcugga

SEQ ID NO: 3381686 - RNA, 17 nt, Human
ccaaggaaacgcuaccu

SEQ ID NO: 3381687 - RNA, 22 nt, Human
ccaaggaaacgcuaccucucug

SEQ ID NO: 3381688 - RNA, 13 nt, Human
ccaaggaacaaaa

SEQ ID NO: 3381689 - RNA, 15 nt, Human
ccaaggaccccucac

SEQ ID NO: 3381690 - RNA, 20 nt, Human
ccaaggaccuccucuucccc

SEQ ID NO: 3381691 - RNA, 22 nt, Human
ccaaggaccuccucuucccccu

SEQ ID NO: 3381692 - RNA, 22 nt, Human
ccaaggacugagcacccucugg

SEQ ID NO: 3381693 - RNA, 11 nt, Human
ccaaggacugc

SEQ ID NO: 3381694 - RNA, 15 nt, Human
ccaaggacugccgac

SEQ ID NO: 3381695 - RNA, 18 nt, Human
ccaaggagaaacagagac

SEQ ID NO: 3381696 - RNA, 15 nt, Human
ccaaggagaacaaau

SEQ ID NO: 3381697 - RNA, 16 nt, Human
ccaaggagcacagguc

SEQ ID NO: 3381698 - RNA, 18 nt, Human
ccaaggagcacagguccc

SEQ ID NO: 3381699 - RNA, 17 nt, Human
ccaaggagcugagaaua

SEQ ID NO: 3381700 - RNA, 20 nt, Human
ccaaggagcugagaauagaa

SEQ ID NO: 3381701 - RNA, 16 nt, Human
ccaaggagcugcuaua

SEQ ID NO: 3381702 - RNA, 21 nt, Human
ccaaggaggaaaaacagacaa

SEQ ID NO: 3381703 - RNA, 23 nt, Human
ccaaggaggugaggagcagagca

SEQ ID NO: 3381704 - RNA, 17 nt, Human
cacuugccucuuccuug

SEQ ID NO: 3381705 - RNA, 21 nt, Human
cacuugccucuuccuugaaga

SEQ ID NO: 3381706 - RNA, 13 nt, Human
cacuugccugggu

SEQ ID NO: 3381707 - RNA, 12 nt, Human
cacuuggcagcc

SEQ ID NO: 3381708 - RNA, 18 nt, Human
cacuuggcagccuuguga

SEQ ID NO: 3381709 - RNA, 18 nt, Human
cacuuggccaagcaggga

SEQ ID NO: 3381710 - RNA, 20 nt, Human
cacuuggggcaccuugcucc

SEQ ID NO: 3381711 - RNA, 19 nt, Human
cacuugggggcucagcaag

SEQ ID NO: 3381712 - RNA, 21 nt, Human
cacuugggggcucagcaaggc

SEQ ID NO: 3381713 - RNA, 22 nt, Human
aaagaaccaaaaguuuuccuga

SEQ ID NO: 3381714 - RNA, 21 nt, Human
aaagaaccaagaaaaaggaau

SEQ ID NO: 3381715 - RNA, 18 nt, Human
aaagaaccuaacauuuau

SEQ ID NO: 3381716 - RNA, 20 nt, Human
aaagaacgcugauuuaaaga

SEQ ID NO: 3381717 - RNA, 15 nt, Human
aaagaacggaagaag

SEQ ID NO: 3381718 - RNA, 19 nt, Human
aaagaacggaagaagagau

SEQ ID NO: 3381719 - RNA, 17 nt, Human
aaagaagaaacgucuau

SEQ ID NO: 3381720 - RNA, 10 nt, Human
aaagaagaag

SEQ ID NO: 3381721 - RNA, 21 nt, Human
aaagaagacauguuuuagaca

SEQ ID NO: 3381722 - RNA, 22 nt, Human
aaagaagaccugagaauguauc

SEQ ID NO: 3381723 - RNA, 15 nt, Human
aaagaagauguugaa

SEQ ID NO: 3381724 - RNA, 13 nt, Human
aaagaagauguuu

SEQ ID NO: 3381725 - RNA, 20 nt, Human
aaagaagcccaauauuauaa

SEQ ID NO: 3381726 - RNA, 18 nt, Human
aaagaaguggggacagag

SEQ ID NO: 3381727 - RNA, 19 nt, Human
aaagaaguguccgagaacu

SEQ ID NO: 3381728 - RNA, 15 nt, Human
aaagaauacagaaag

SEQ ID NO: 3381729 - RNA, 15 nt, Human
aaagaauacuugaac

SEQ ID NO: 3381730 - RNA, 14 nt, Human
aaagaauagaaaga

SEQ ID NO: 3381731 - RNA, 14 nt, Human
aaagaauaggacuu

SEQ ID NO: 3381732 - RNA, 19 nt, Human
aaagaauaggacuuguuuu

SEQ ID NO: 3381733 - RNA, 18 nt, Human
aaagaauauauuuauuua

SEQ ID NO: 3381734 - RNA, 22 nt, Human
aaagaauauucagagaauauca

SEQ ID NO: 3381735 - RNA, 21 nt, Human
aaagaaucccuguucauugua

SEQ ID NO: 3381736 - RNA, 19 nt, Human
aaagaaucuacuauacuuu

SEQ ID NO: 3381737 - RNA, 22 nt, Human
aaagaaugagaaggagucagaa

SEQ ID NO: 3381738 - RNA, 12 nt, Human
aaagaaugggca

SEQ ID NO: 3381739 - RNA, 17 nt, Human
aaagaauguuagagcac

SEQ ID NO: 3381740 - RNA, 19 nt, Human
aaagaauucuuauacacau

SEQ ID NO: 3381741 - RNA, 21 nt, Human
aaagaauuucaauuuguucag

SEQ ID NO: 3381742 - RNA, 12 nt, Human
aaagacaauucu

SEQ ID NO: 3381743 - RNA, 19 nt, Human
aaagacaauucuuuauaca

SEQ ID NO: 3381744 - RNA, 14 nt, Human
aaagacacugcaga

SEQ ID NO: 3381745 - RNA, 19 nt, Human
aaagacacugccugggcug

SEQ ID NO: 3381746 - RNA, 22 nt, Human
aaagacagggcugauaagcuaa

SEQ ID NO: 3381747 - RNA, 13 nt, Human
aaagacagugaaa

SEQ ID NO: 3381748 - RNA, 13 nt, Human
aaagacaucuuuc

SEQ ID NO: 3381749 - RNA, 23 nt, Human
aaagacaucuuucucuuuucuaa

SEQ ID NO: 3381750 - RNA, 16 nt, Human
aaagacaugaagccac

SEQ ID NO: 3381751 - RNA, 15 nt, Human
aaagaccauuuuucc

SEQ ID NO: 3381752 - RNA, 15 nt, Human
aaagacccaggggga

SEQ ID NO: 3381753 - RNA, 19 nt, Human
aaagacccuaaaucugagg

SEQ ID NO: 3381754 - RNA, 23 nt, Human
aaagaccuuguguguauguguac

SEQ ID NO: 3381755 - RNA, 23 nt, Human
aaagacgaccagcauuuaaccaa

SEQ ID NO: 3381756 - RNA, 23 nt, Human
aaagacgcacuuuggcuuauaau

SEQ ID NO: 3381757 - RNA, 14 nt, Human
aaagacuaauuuaa

SEQ ID NO: 3381758 - RNA, 20 nt, Human
aaagacuaauuuaaaaaaua

SEQ ID NO: 3381759 - RNA, 17 nt, Human
aaagacuauucaaacag

SEQ ID NO: 3381760 - RNA, 18 nt, Human
aaagacuauucaaacagu

SEQ ID NO: 3381761 - RNA, 19 nt, Human
aaagacuauucaaacaguc

SEQ ID NO: 3381762 - RNA, 10 nt, Human
aaagacucau

SEQ ID NO: 3381763 - RNA, 17 nt, Human
aaagacucuauucucaa

SEQ ID NO: 3381764 - RNA, 15 nt, Human
aaagacucuugggag

SEQ ID NO: 3381765 - RNA, 16 nt, Human
aaagacugagcucaag

SEQ ID NO: 3381766 - RNA, 11 nt, Human
aaagacuggca

SEQ ID NO: 3381767 - RNA, 21 nt, Human
aaagacuggcuuuuauuaaug

SEQ ID NO: 3381768 - RNA, 23 nt, Human
aaagacuggcuuuuauuaaugca

SEQ ID NO: 3381769 - RNA, 17 nt, Human
aaagacugguuuucugc

SEQ ID NO: 3381770 - RNA, 12 nt, Human
aaagacuuaagc

SEQ ID NO: 3381771 - RNA, 19 nt, Human
aaagacuuccaaagaaugu

SEQ ID NO: 3381772 - RNA, 14 nt, Human
aaagacuucccuaa

SEQ ID NO: 3381773 - RNA, 18 nt, Human
aaagacuugguugguagg

SEQ ID NO: 3381774 - RNA, 19 nt, Human
aaagacuuguaauauuuuu

SEQ ID NO: 3381775 - RNA, 18 nt, Human
aaagagaaaaaaaguuug

SEQ ID NO: 3381776 - RNA, 22 nt, Human
aaagagaaaauugaauuuaaca

SEQ ID NO: 3381777 - RNA, 22 nt, Human
aaagagaaacaguugguaacuu

SEQ ID NO: 3381778 - RNA, 13 nt, Human
aaagagaagaaga

SEQ ID NO: 3381779 - RNA, 14 nt, Human
aaagagacaggcag

SEQ ID NO: 3381780 - RNA, 13 nt, Human
aaagagacaguga

SEQ ID NO: 3381781 - RNA, 15 nt, Human
aaagagacagugaua

SEQ ID NO: 3381782 - RNA, 20 nt, Human
aaagagaccacccauaucau

SEQ ID NO: 3381783 - RNA, 17 nt, Human
aaagagaccuaccucag

SEQ ID NO: 3381784 - RNA, 18 nt, Human
aaagagaccuaccucagg

SEQ ID NO: 3381785 - RNA, 20 nt, Human
aaagagaccuaccucagguu

SEQ ID NO: 3381786 - RNA, 21 nt, Human
aaagagaccuaccucagguug

SEQ ID NO: 3381787 - RNA, 18 nt, Human
aaagagagaaaaacaaau

SEQ ID NO: 3381788 - RNA, 22 nt, Human
aaagagagaaaacuuauuugag

SEQ ID NO: 3381789 - RNA, 14 nt, Human
aaagagagaaaaua

SEQ ID NO: 3381790 - RNA, 18 nt, Human
aaagagagaaaauaaaaa

SEQ ID NO: 3381791 - RNA, 21 nt, Human
aaagagagaaaauaaaaaguu

SEQ ID NO: 3381792 - RNA, 22 nt, Human
aaagagagaaaauaaaaaguua

SEQ ID NO: 3381793 - RNA, 11 nt, Human
aaagagagguu

SEQ ID NO: 3381794 - RNA, 12 nt, Human
aaagagagguua

SEQ ID NO: 3381795 - RNA, 23 nt, Human
aaagagaguuuuuaauagaacca

SEQ ID NO: 3381796 - RNA, 17 nt, Human
aaagagauaugggaaca

SEQ ID NO: 3381797 - RNA, 24 nt, Human
aaagagauccaggaagcaugagug

SEQ ID NO: 3381798 - RNA, 22 nt, Human
aaagagaugaugaaaauauuua

SEQ ID NO: 3381799 - RNA, 21 nt, Human
aaagagauuuaaacucugaau

SEQ ID NO: 3381800 - RNA, 12 nt, Human
aaagagcacuua

SEQ ID NO: 3381801 - RNA, 21 nt, Human
aaagagcacuuaagagaauau

SEQ ID NO: 3381802 - RNA, 18 nt, Human
aaagagcccuugccuccc

SEQ ID NO: 3381803 - RNA, 12 nt, Human
aaagagcugccu

SEQ ID NO: 3381804 - RNA, 22 nt, Human
aaagagcuuuaguccuagagga

SEQ ID NO: 3381805 - RNA, 14 nt, Human
aaagaggaaagaau

SEQ ID NO: 3381806 - RNA, 19 nt, Human
aaagaggacucgcuuguaa

SEQ ID NO: 3381807 - RNA, 15 nt, Human
aaagaggcacagagc

SEQ ID NO: 3381808 - RNA, 15 nt, Human
aaagaggcagcuuga

SEQ ID NO: 3381809 - RNA, 20 nt, Human
aaagaggcgucuguauauuu

SEQ ID NO: 3381810 - RNA, 20 nt, Human
aaagaggcugaaagaggcca

SEQ ID NO: 3381811 - RNA, 20 nt, Human
aaagaggcugaggccuggac

SEQ ID NO: 3381812 - RNA, 21 nt, Human
aaagaggcugaggccuggacu

SEQ ID NO: 3381813 - RNA, 23 nt, Human
aaagaggcugccccucucaccaa

SEQ ID NO: 3381814 - RNA, 19 nt, Human
aaagaggugaccccagggc

SEQ ID NO: 3381815 - RNA, 24 nt, Human
aaagaggugacugggcccugccuc

SEQ ID NO: 3381816 - RNA, 13 nt, Human
aaagaggugugca

SEQ ID NO: 3381817 - RNA, 19 nt, Human
aaagaguaaaggaaaugau

SEQ ID NO: 3381818 - RNA, 23 nt, Human
aaagaguagacauuucucuuacu

SEQ ID NO: 3381819 - RNA, 13 nt, Human
aaagagucuagau

SEQ ID NO: 3381820 - RNA, 21 nt, Human
aaagagucuagauucaaaggu

SEQ ID NO: 3381821 - RNA, 14 nt, Human
aaagagucuuucuu

SEQ ID NO: 3381822 - RNA, 16 nt, Human
aaagaguguaaaauau

SEQ ID NO: 3381823 - RNA, 13 nt, Human
aaagaguuaagaa

SEQ ID NO: 3381824 - RNA, 12 nt, Human
aaagaguuagaa

SEQ ID NO: 3381825 - RNA, 16 nt, Human
aaagaguucaagaaau

SEQ ID NO: 3381826 - RNA, 24 nt, Human
aaagaguucuggaaaagaacuguu

SEQ ID NO: 3381827 - RNA, 19 nt, Human
aaagaguuugagaccugaa

SEQ ID NO: 3381828 - RNA, 12 nt, Human
aaagauaaacac

SEQ ID NO: 3381829 - RNA, 16 nt, Human
aaagauaaacacaaga

SEQ ID NO: 3381830 - RNA, 17 nt, Human
aaagauaaacacaagau

SEQ ID NO: 3381831 - RNA, 16 nt, Human
aaagauaaauauuaua

SEQ ID NO: 3381832 - RNA, 17 nt, Human
aaagauaauauuacugu

SEQ ID NO: 3381833 - RNA, 14 nt, Human
aaagauacauuugu

SEQ ID NO: 3381834 - RNA, 16 nt, Human
aaagauacauuuguau

SEQ ID NO: 3381835 - RNA, 17 nt, Human
aaagauagacagguccu

SEQ ID NO: 3381836 - RNA, 19 nt, Human
aaagauagagucauugcug

SEQ ID NO: 3381837 - RNA, 15 nt, Human
aaagauauaagugcu

SEQ ID NO: 3381838 - RNA, 21 nt, Human
aaagauauaagugcuguauaa

SEQ ID NO: 3381839 - RNA, 12 nt, Human
aaagauauuauu

SEQ ID NO: 3381840 - RNA, 22 nt, Human
aaagauauuguucaaacaauau

SEQ ID NO: 3381841 - RNA, 16 nt, Human
aaagauauuuugcuuu

SEQ ID NO: 3381842 - RNA, 14 nt, Human
aaagaucaaaauaa

SEQ ID NO: 3381843 - RNA, 16 nt, Human
aaagaucaaaauaaaa

SEQ ID NO: 3381844 - RNA, 13 nt, Human
aaagaucccaaau

SEQ ID NO: 3381845 - RNA, 16 nt, Human
aaagaucuacaugaau

SEQ ID NO: 3381846 - RNA, 21 nt, Human
aaagaucuguccucagccuug

SEQ ID NO: 3381847 - RNA, 15 nt, Human
aaagaucuucaaaag

SEQ ID NO: 3381848 - RNA, 12 nt, Human
ccacuucugcac

SEQ ID NO: 3381849 - RNA, 18 nt, Human
ccacuucuggucaaucaa

SEQ ID NO: 3381850 - RNA, 17 nt, Human
ccacuucuguccauauu

SEQ ID NO: 3381851 - RNA, 17 nt, Human
ccacuucuuccuuucuc

SEQ ID NO: 3381852 - RNA, 19 nt, Human
ccacuucuuguuccccacu

SEQ ID NO: 3381853 - RNA, 16 nt, Human
ccacuucuuuuauaac

SEQ ID NO: 3381854 - RNA, 14 nt, Human
ccacuugaaauguu

SEQ ID NO: 3381855 - RNA, 18 nt, Human
ccacuugagugucaagcu

SEQ ID NO: 3381856 - RNA, 13 nt, Human
ccacuugccucuu

SEQ ID NO: 3381857 - RNA, 21 nt, Human
ccacuuggaggccuuucaucc

SEQ ID NO: 3381858 - RNA, 12 nt, Human
ccacuuggucug

SEQ ID NO: 3381859 - RNA, 16 nt, Human
ccacuuggucugugag

SEQ ID NO: 3381860 - RNA, 17 nt, Human
ccacuuggucugugaga

SEQ ID NO: 3381861 - RNA, 12 nt, Human
ccacuuguagau

SEQ ID NO: 3381862 - RNA, 17 nt, Human
ccacuuguagauuugau

SEQ ID NO: 3381863 - RNA, 18 nt, Human
ccacuuguagauuugauu

SEQ ID NO: 3381864 - RNA, 17 nt, Human
ccacuuguccaugugaa

SEQ ID NO: 3381865 - RNA, 17 nt, Human
ccacuuuaagagagaaa

SEQ ID NO: 3381866 - RNA, 18 nt, Human
ccacuuuacccaccuaga

SEQ ID NO: 3381867 - RNA, 19 nt, Human
ccacuuuacccaccuagaa

SEQ ID NO: 3381868 - RNA, 13 nt, Human
ccacuuucuagcc

SEQ ID NO: 3381869 - RNA, 18 nt, Human
ccacuuucuagccagagg

SEQ ID NO: 3381870 - RNA, 20 nt, Human
ccacuuucuagccagaggag

SEQ ID NO: 3381871 - RNA, 14 nt, Human
ccacuuugcacauu

SEQ ID NO: 3381872 - RNA, 15 nt, Human
ccacuuugcacauuu

SEQ ID NO: 3381873 - RNA, 16 nt, Human
ccacuuugcuguuccu

SEQ ID NO: 3381874 - RNA, 21 nt, Human
ccacuuuggucccgugcagcu

SEQ ID NO: 3381875 - RNA, 13 nt, Human
ccacuuuuugcag

SEQ ID NO: 3381876 - RNA, 16 nt, Human
ccacuuuuugcagcuu

SEQ ID NO: 3381877 - RNA, 16 nt, Human
ccagaaaaccccagca

SEQ ID NO: 3381878 - RNA, 21 nt, Human
ccagucccccaaccccagccg

SEQ ID NO: 3381879 - RNA, 14 nt, Human
ccagucccccuauc

SEQ ID NO: 3381880 - RNA, 22 nt, Human
ccaguccccgugccccgccucc

SEQ ID NO: 3381881 - RNA, 12 nt, Human
ccagucccuggg

SEQ ID NO: 3381882 - RNA, 22 nt, Human
ccagucccugggggaagcccug

SEQ ID NO: 3381883 - RNA, 23 nt, Human
ccagucccugggggaagcccugg

SEQ ID NO: 3381884 - RNA, 18 nt, Human
ccagucccuguccggaau

SEQ ID NO: 3381885 - RNA, 19 nt, Human
ccaguccuaucugggcuuc

SEQ ID NO: 3381886 - RNA, 16 nt, Human
ccaguccugcccgcca

SEQ ID NO: 3381887 - RNA, 12 nt, Human
ccaguccugcua

SEQ ID NO: 3381888 - RNA, 13 nt, Human
ccaguccugcucu

SEQ ID NO: 3381889 - RNA, 15 nt, Human
ccaguccugcucucu

SEQ ID NO: 3381890 - RNA, 12 nt, Human
ccaguccuggcc

SEQ ID NO: 3381891 - RNA, 18 nt, Human
ccagucgauaucucacuu

SEQ ID NO: 3381892 - RNA, 16 nt, Human
ccagucgcgcugccug

SEQ ID NO: 3381893 - RNA, 17 nt, Human
ccagucgcgcugccugu

SEQ ID NO: 3381894 - RNA, 20 nt, Human
ccagucuccaccaggaaccu

SEQ ID NO: 3381895 - RNA, 21 nt, Human
ccagucuccaccaggaaccuc

SEQ ID NO: 3381896 - RNA, 16 nt, Human
ccagucucucuuaaag

SEQ ID NO: 3381897 - RNA, 12 nt, Human
ccagucucuucu

SEQ ID NO: 3381898 - RNA, 12 nt, Human
ccagucugaagu

SEQ ID NO: 3381899 - RNA, 17 nt, Human
ccagucugaaguuucau

SEQ ID NO: 3381900 - RNA, 18 nt, Human
ccagucugcugcccucca

SEQ ID NO: 3381901 - RNA, 23 nt, Human
ccagucugcugcccuccaucccg

SEQ ID NO: 3381902 - RNA, 18 nt, Human
ccagucuggaaugcagug

SEQ ID NO: 3381903 - RNA, 19 nt, Human
ccagucuggaaugcagugg

SEQ ID NO: 3381904 - RNA, 20 nt, Human
ccagucuggaaugcaguggu

SEQ ID NO: 3381905 - RNA, 13 nt, Human
ccagucuguggau

SEQ ID NO: 3381906 - RNA, 22 nt, Human
ccagucuuccugacacuuuaau

SEQ ID NO: 3381907 - RNA, 12 nt, Human
ccagucuugugu

SEQ ID NO: 3381908 - RNA, 21 nt, Human
ccagucuuuaaaggcccagcc

SEQ ID NO: 3381909 - RNA, 13 nt, Human
ccagucuuuuguc

SEQ ID NO: 3381910 - RNA, 20 nt, Human
ccagugaauucuugaaggaa

SEQ ID NO: 3381911 - RNA, 16 nt, Human
ccagugacacuucaga

SEQ ID NO: 3381912 - RNA, 23 nt, Human
ccagugacacuucagagagcugg

SEQ ID NO: 3381913 - RNA, 17 nt, Human
ccagugacagacaggcu

SEQ ID NO: 3381914 - RNA, 18 nt, Human
ccagugacagucagggaa

SEQ ID NO: 3381915 - RNA, 13 nt, Human
ccagugaccucuc

SEQ ID NO: 3381916 - RNA, 19 nt, Human
ccagugaccucucucucug

SEQ ID NO: 3381917 - RNA, 18 nt, Human
ccagugaccugcugggua

SEQ ID NO: 3381918 - RNA, 20 nt, Human
ccagugaccuggaaggccca

SEQ ID NO: 3381919 - RNA, 13 nt, Human
ccagugacuccag

SEQ ID NO: 3381920 - RNA, 13 nt, Human
ccagugagacagc

SEQ ID NO: 3381921 - RNA, 18 nt, Human
ccagugagacagcucugc

SEQ ID NO: 3381922 - RNA, 13 nt, Human
ccagugagaugca

SEQ ID NO: 3381923 - RNA, 18 nt, Human
ccagugagcacucccaag

SEQ ID NO: 3381924 - RNA, 19 nt, Human
ccagugagcagccuggagc

SEQ ID NO: 3381925 - RNA, 15 nt, Human
ccagugaggcucugc

SEQ ID NO: 3381926 - RNA, 16 nt, Human
ccagugaggcucugcc

SEQ ID NO: 3381927 - RNA, 22 nt, Human
ccagugagggacgucagacuug

SEQ ID NO: 3381928 - RNA, 21 nt, Human
ccagugaugcuaaagguugua

SEQ ID NO: 3381929 - RNA, 14 nt, Human
ccagugcaacacug

SEQ ID NO: 3381930 - RNA, 14 nt, Human
ccagugcacccacu

SEQ ID NO: 3381931 - RNA, 15 nt, Human
ccagugcagaaugua

SEQ ID NO: 3381932 - RNA, 16 nt, Human
ccagugcagaauguaa

SEQ ID NO: 3381933 - RNA, 13 nt, Human
ccagugcaggcug

SEQ ID NO: 3381934 - RNA, 21 nt, Human
ccagugcaggcuggccagccg

SEQ ID NO: 3381935 - RNA, 14 nt, Human
ccagugccaaggac

SEQ ID NO: 3381936 - RNA, 19 nt, Human
ccagugcccaaagucugug

SEQ ID NO: 3381937 - RNA, 18 nt, Human
ccagugcccugagccagg

SEQ ID NO: 3381938 - RNA, 22 nt, Human
ccagugcccuggggcugaucuc

SEQ ID NO: 3381939 - RNA, 14 nt, Human
ccagugccucuccc

SEQ ID NO: 3381940 - RNA, 13 nt, Human
ccagugccugggu

SEQ ID NO: 3381941 - RNA, 18 nt, Human
ccagugccuuaccuccug

SEQ ID NO: 3381942 - RNA, 20 nt, Human
ccagugccuuaccuccugcc

SEQ ID NO: 3381943 - RNA, 15 nt, Human
ccagugcgauucugg

SEQ ID NO: 3381944 - RNA, 22 nt, Human
ccagugcugaauuucccucucu

SEQ ID NO: 3381945 - RNA, 22 nt, Human
ccagugcuguccaugcuucuca

SEQ ID NO: 3381946 - RNA, 19 nt, Human
ccagugcuuagcaaaaaau

SEQ ID NO: 3381947 - RNA, 17 nt, Human
ccagugcuuuauguugu

SEQ ID NO: 3381948 - RNA, 19 nt, Human
ccaguggaugccacagccc

SEQ ID NO: 3381949 - RNA, 16 nt, Human
ccaguggcagggcaca

SEQ ID NO: 3381950 - RNA, 15 nt, Human
ccaguggccacucag

SEQ ID NO: 3381951 - RNA, 21 nt, Human
ccaguggccacucagcuuccu

SEQ ID NO: 3381952 - RNA, 19 nt, Human
ccaguggccuuaccccugc

SEQ ID NO: 3381953 - RNA, 22 nt, Human
ccaguggccuuaccccugccuu

SEQ ID NO: 3381954 - RNA, 22 nt, Human
ccaguggcggaagugaccgcac

SEQ ID NO: 3381955 - RNA, 13 nt, Human
ccaguggcugcug

SEQ ID NO: 3381956 - RNA, 14 nt, Human
ccaguggcugcugc

SEQ ID NO: 3381957 - RNA, 17 nt, Human
ccaguggcuguucugga

SEQ ID NO: 3381958 - RNA, 11 nt, Human
ccagugggagg

SEQ ID NO: 3381959 - RNA, 13 nt, Human
ccagugggagggg

SEQ ID NO: 3381960 - RNA, 14 nt, Human
ccagugggaggggc

SEQ ID NO: 3381961 - RNA, 17 nt, Human
ccagugggaggggcagg

SEQ ID NO: 3381962 - RNA, 18 nt, Human
ccagugggaggggcaggc

SEQ ID NO: 3381963 - RNA, 22 nt, Human
ccagugggaggggcaggcugac

SEQ ID NO: 3381964 - RNA, 13 nt, Human
ccaguggggccug

SEQ ID NO: 3381965 - RNA, 18 nt, Human
ccaguggggccuguggaa

SEQ ID NO: 3381966 - RNA, 14 nt, Human
ccaguggugccuug

SEQ ID NO: 3381967 - RNA, 22 nt, Human
ccagugguuccuaauccucuag

SEQ ID NO: 3381968 - RNA, 22 nt, Human
ccagugucaaguugugcuuguu

SEQ ID NO: 3381969 - RNA, 20 nt, Human
ccagugucauuucucaucca

SEQ ID NO: 3381970 - RNA, 19 nt, Human
ccaguguccugagccccag

SEQ ID NO: 3381971 - RNA, 22 nt, Human
ccaguguccugagccccaggga

SEQ ID NO: 3381972 - RNA, 23 nt, Human
ccaguguccugagccccagggag

SEQ ID NO: 3381973 - RNA, 18 nt, Human
ccaguguccugagcucag

SEQ ID NO: 3381974 - RNA, 20 nt, Human
ccaguguccugagcucagcg

SEQ ID NO: 3381975 - RNA, 16 nt, Human
ccaguguccuuagaac

SEQ ID NO: 3381976 - RNA, 15 nt, Human
ccagugucugucccg

SEQ ID NO: 3381977 - RNA, 18 nt, Human
ccagugucugucccgggg

SEQ ID NO: 3381978 - RNA, 21 nt, Human
ccagugucugucccggggucc

SEQ ID NO: 3381979 - RNA, 15 nt, Human
ccagugucuuccugu

SEQ ID NO: 3381980 - RNA, 12 nt, Human
ccagugucuuuc

SEQ ID NO: 3381981 - RNA, 15 nt, Human
ccagugugaucccaa

SEQ ID NO: 3381982 - RNA, 22 nt, Human
ccagugugaucccaagugccag

SEQ ID NO: 3381983 - RNA, 22 nt, Human
ccagugugggaaugcggcaaga

SEQ ID NO: 3381984 - RNA, 16 nt, Human
ccaguguguggcuuuc

SEQ ID NO: 3381985 - RNA, 22 nt, Human
ccaguguguggcuuucagagcc

SEQ ID NO: 3381986 - RNA, 23 nt, Human
ccaguguguggcuuucagagccu

SEQ ID NO: 3381987 - RNA, 19 nt, Human
ccaguguugccuaaguauu

SEQ ID NO: 3381988 - RNA, 22 nt, Human
ccaguguuguggauuuaacaga

SEQ ID NO: 3381989 - RNA, 20 nt, Human
ccaguguuguuuguaaauaa

SEQ ID NO: 3381990 - RNA, 22 nt, Human
ccaguguuguuuguaaauaaga

SEQ ID NO: 3381991 - RNA, 13 nt, Human
ccaguguuuaaaa

SEQ ID NO: 3381992 - RNA, 21 nt, Human
ccaguguuugggaugaccagg

SEQ ID NO: 3381993 - RNA, 17 nt, Human
aaaggagagcuagcagc

SEQ ID NO: 3381994 - RNA, 21 nt, Human
aaaggagagcuagcagcaggg

SEQ ID NO: 3381995 - RNA, 14 nt, Human
aaaggagauaaauc

SEQ ID NO: 3381996 - RNA, 15 nt, Human
aaaggagauaaaucu

SEQ ID NO: 3381997 - RNA, 23 nt, Human
aaaggagccugugaacccaggac

SEQ ID NO: 3381998 - RNA, 14 nt, Human
aaaggaggcuggca

SEQ ID NO: 3381999 - RNA, 11 nt, Human
aaaggaguuua

SEQ ID NO: 3382000 - RNA, 15 nt, Human
aaaggaguuuauguu

SEQ ID NO: 3382001 - RNA, 19 nt, Human
aaaggauaaacuuuuagaa

SEQ ID NO: 3382002 - RNA, 14 nt, Human
aaaggauaaagaag

SEQ ID NO: 3382003 - RNA, 16 nt, Human
aaaggauacuguaaca

SEQ ID NO: 3382004 - RNA, 18 nt, Human
aaaggauacuguaacacu

SEQ ID NO: 3382005 - RNA, 15 nt, Human
aaaggauacuuauuu

SEQ ID NO: 3382006 - RNA, 21 nt, Human
aaaggauagaucaaagucaaa

SEQ ID NO: 3382007 - RNA, 21 nt, Human
aaaggauaguaagcauagaaa

SEQ ID NO: 3382008 - RNA, 18 nt, Human
aaaggauaguauuuuuau

SEQ ID NO: 3382009 - RNA, 16 nt, Human
aaaggauauuuaagaa

SEQ ID NO: 3382010 - RNA, 12 nt, Human
aaaggauauuuu

SEQ ID NO: 3382011 - RNA, 19 nt, Human
aaaggaucuuuguggccaa

SEQ ID NO: 3382012 - RNA, 20 nt, Human
aaaggaugaucaaaaauaau

SEQ ID NO: 3382013 - RNA, 14 nt, Human
aaaggcaagcacuu

SEQ ID NO: 3382014 - RNA, 17 nt, Human
aaaggcaccaucuaaua

SEQ ID NO: 3382015 - RNA, 17 nt, Human
aaaggcaccuauaaaac

SEQ ID NO: 3382016 - RNA, 14 nt, Human
aaaggcagaagcaa

SEQ ID NO: 3382017 - RNA, 19 nt, Human
aaaggcagaagcaacccaa

SEQ ID NO: 3382018 - RNA, 22 nt, Human
aaaggcagcuguugucucuucu

SEQ ID NO: 3382019 - RNA, 21 nt, Human
aaaggcaggccuauuucauca

SEQ ID NO: 3382020 - RNA, 16 nt, Human
aaaggcaguauuuugu

SEQ ID NO: 3382021 - RNA, 19 nt, Human
aaaggcaguggggcugggg

SEQ ID NO: 3382022 - RNA, 15 nt, Human
aaaggcaguuaccau

SEQ ID NO: 3382023 - RNA, 13 nt, Human
aaaggcaguuuuc

SEQ ID NO: 3382024 - RNA, 14 nt, Human
aaaggcaguuuucu

SEQ ID NO: 3382025 - RNA, 18 nt, Human
aaaggcauucucugaaga

SEQ ID NO: 3382026 - RNA, 20 nt, Human
aaaggccaaaccucuguuca

SEQ ID NO: 3382027 - RNA, 14 nt, Human
aaaggccauggaga

SEQ ID NO: 3382028 - RNA, 19 nt, Human
aaaggccauggagagcugg

SEQ ID NO: 3382029 - RNA, 20 nt, Human
aaaggcccagccaccgaagc

SEQ ID NO: 3382030 - RNA, 13 nt, Human
aaaggcccagccc

SEQ ID NO: 3382031 - RNA, 10 nt, Human
aaaggccugg

SEQ ID NO: 3382032 - RNA, 12 nt, Human
aaaggccugggg

SEQ ID NO: 3382033 - RNA, 21 nt, Human
aaaggcgcagugcuucucuac

SEQ ID NO: 3382034 - RNA, 17 nt, Human
aaaggcuaccuuauugu

SEQ ID NO: 3382035 - RNA, 19 nt, Human
aaaggcucagucucaggag

SEQ ID NO: 3382036 - RNA, 20 nt, Human
aaaggcuccaggagcagcca

SEQ ID NO: 3382037 - RNA, 17 nt, Human
aaaggcucgauuuugua

SEQ ID NO: 3382038 - RNA, 20 nt, Human
aaaggcuguauucagcaagg

SEQ ID NO: 3382039 - RNA, 15 nt, Human
aaaggcuguuaaaua

SEQ ID NO: 3382040 - RNA, 19 nt, Human
aaaggcuguuaaauacagg

SEQ ID NO: 3382041 - RNA, 16 nt, Human
aaaggcuugaagcugu

SEQ ID NO: 3382042 - RNA, 17 nt, Human
aaaggcuugaagcugug

SEQ ID NO: 3382043 - RNA, 14 nt, Human
aaagggaaacuauu

SEQ ID NO: 3382044 - RNA, 21 nt, Human
aaagggaacugaacauuccag

SEQ ID NO: 3382045 - RNA, 14 nt, Human
aaagggaauuauga

SEQ ID NO: 3382046 - RNA, 16 nt, Human
aaagggacugagaaau

SEQ ID NO: 3382047 - RNA, 22 nt, Human
aaagggacuuggaagcuccgcu

SEQ ID NO: 3382048 - RNA, 17 nt, Human
aaagggagggcucugag

SEQ ID NO: 3382049 - RNA, 17 nt, Human
aaagggagucugccagg

SEQ ID NO: 3382050 - RNA, 15 nt, Human
aaagggaguuuuuga

SEQ ID NO: 3382051 - RNA, 13 nt, Human
aaagggauauuuu

SEQ ID NO: 3382052 - RNA, 20 nt, Human
aaagggaucaucaugcagcu

SEQ ID NO: 3382053 - RNA, 20 nt, Human
aaagggauggcaagaugugg

SEQ ID NO: 3382054 - RNA, 18 nt, Human
aaagggcacagcaucugu

SEQ ID NO: 3382055 - RNA, 23 nt, Human
aaagggcccacagugacuuuugc

SEQ ID NO: 3382056 - RNA, 17 nt, Human
aaagggcccuccuuccu

SEQ ID NO: 3382057 - RNA, 19 nt, Human
aaagggcccuccuuccuaa

SEQ ID NO: 3382058 - RNA, 16 nt, Human
aaaggggacaggccuc

SEQ ID NO: 3382059 - RNA, 19 nt, Human
aaaggggaucauaaaguua

SEQ ID NO: 3382060 - RNA, 18 nt, Human
aaaggggcagaaaaacuc

SEQ ID NO: 3382061 - RNA, 18 nt, Human
aaaggggggagggggagg

SEQ ID NO: 3382062 - RNA, 21 nt, Human
aaagggguaggguuuaaagau

SEQ ID NO: 3382063 - RNA, 18 nt, Human
aaaggggucccauagagg

SEQ ID NO: 3382064 - RNA, 15 nt, Human
aaaggggugcuuuua

SEQ ID NO: 3382065 - RNA, 20 nt, Human
aaagggguuggggugacagu

SEQ ID NO: 3382066 - RNA, 22 nt, Human
aaagggucaaugcuauuuuugu

SEQ ID NO: 3382067 - RNA, 22 nt, Human
aaagggucuccgaaaugcuguc

SEQ ID NO: 3382068 - RNA, 17 nt, Human
aaagggugaaaauuauu

SEQ ID NO: 3382069 - RNA, 19 nt, Human
aaagggugaagcuauuuau

SEQ ID NO: 3382070 - RNA, 21 nt, Human
aaagggugaagcuauuuaucu

SEQ ID NO: 3382071 - RNA, 17 nt, Human
aaaggguucuguaaaau

SEQ ID NO: 3382072 - RNA, 16 nt, Human
aaagguaaugugugga

SEQ ID NO: 3382073 - RNA, 16 nt, Human
aaagguacuuugcagg

SEQ ID NO: 3382074 - RNA, 15 nt, Human
aaagguagacuuuua

SEQ ID NO: 3382075 - RNA, 13 nt, Human
aaaggucuaugca

SEQ ID NO: 3382076 - RNA, 18 nt, Human
aaaggucuuuuuaaacca

SEQ ID NO: 3382077 - RNA, 15 nt, Human
aaaggugaaggaaua

SEQ ID NO: 3382078 - RNA, 16 nt, Human
aaaggugaaggaauau

SEQ ID NO: 3382079 - RNA, 21 nt, Human
aaaggugaaggaauauauggc

SEQ ID NO: 3382080 - RNA, 24 nt, Human
aaaggugaaggaauauauggcaga

SEQ ID NO: 3382081 - RNA, 23 nt, Human
aaaggugaguuugagcugccuuc

SEQ ID NO: 3382082 - RNA, 17 nt, Human
aaaggugauaaaaucau

SEQ ID NO: 3382083 - RNA, 18 nt, Human
aaaggugauaaaaucaua

SEQ ID NO: 3382084 - RNA, 19 nt, Human
ccagccucaguccuccccu

SEQ ID NO: 3382085 - RNA, 21 nt, Human
ccagccucaguccuccccuca

SEQ ID NO: 3382086 - RNA, 15 nt, Human
ccagccucccugaag

SEQ ID NO: 3382087 - RNA, 18 nt, Human
ccagccuccgagagggag

SEQ ID NO: 3382088 - RNA, 19 nt, Human
ccagccuccgagagggaga

SEQ ID NO: 3382089 - RNA, 19 nt, Human
ccagccuccguauuucaga

SEQ ID NO: 3382090 - RNA, 16 nt, Human
ccagccuccucuggac

SEQ ID NO: 3382091 - RNA, 19 nt, Human
ccagccucguuggaagagg

SEQ ID NO: 3382092 - RNA, 17 nt, Human
ccagccucuagggaccc

SEQ ID NO: 3382093 - RNA, 12 nt, Human
ccagccucucuu

SEQ ID NO: 3382094 - RNA, 15 nt, Human
ccagccucucuuccu

SEQ ID NO: 3382095 - RNA, 21 nt, Human
ccagccucucuuccuauccca

SEQ ID NO: 3382096 - RNA, 22 nt, Human
ccagccucucuugguuuccuuc

SEQ ID NO: 3382097 - RNA, 15 nt, Human
ccagccucuggcauu

SEQ ID NO: 3382098 - RNA, 11 nt, Human
ccagccucugu

SEQ ID NO: 3382099 - RNA, 15 nt, Human
ccagccucuuucccu

SEQ ID NO: 3382100 - RNA, 18 nt, Human
ccagccugaacagaagcu

SEQ ID NO: 3382101 - RNA, 19 nt, Human
ccagccugcccaagcccag

SEQ ID NO: 3382102 - RNA, 22 nt, Human
ccagccugcccaagcccaggcc

SEQ ID NO: 3382103 - RNA, 20 nt, Human
ccagccugccuggcaggcug

SEQ ID NO: 3382104 - RNA, 21 nt, Human
ccagccugccuggcaggcugu

SEQ ID NO: 3382105 - RNA, 21 nt, Human
ccagccugcgccugcugcaug

SEQ ID NO: 3382106 - RNA, 12 nt, Human
ccagccugcuag

SEQ ID NO: 3382107 - RNA, 13 nt, Human
ccagccugcuagc

SEQ ID NO: 3382108 - RNA, 18 nt, Human
ccagccuggacccccagc

SEQ ID NO: 3382109 - RNA, 15 nt, Human
ccagccuggaugcca

SEQ ID NO: 3382110 - RNA, 10 nt, Human
ccagccuggc

SEQ ID NO: 3382111 - RNA, 16 nt, Human
ccagccuggccacgca

SEQ ID NO: 3382112 - RNA, 17 nt, Human
ccagccuggcccagcuc

SEQ ID NO: 3382113 - RNA, 18 nt, Human
ccagccuggcccagcucc

SEQ ID NO: 3382114 - RNA, 13 nt, Human
ccagccuggccuc

SEQ ID NO: 3382115 - RNA, 21 nt, Human
ccagccuggcucccacaggca

SEQ ID NO: 3382116 - RNA, 20 nt, Human
ccagccuggcugggacuggg

SEQ ID NO: 3382117 - RNA, 20 nt, Human
ccagccugggaaagccccug

SEQ ID NO: 3382118 - RNA, 20 nt, Human
ccagccugggaggcacagca

SEQ ID NO: 3382119 - RNA, 11 nt, Human
ccagccugggc

SEQ ID NO: 3382120 - RNA, 18 nt, Human
ccagccugggcaacaaag

SEQ ID NO: 3382121 - RNA, 12 nt, Human
ccagccugggcc

SEQ ID NO: 3382122 - RNA, 18 nt, Human
ccagccugggcccaucuc

SEQ ID NO: 3382123 - RNA, 13 nt, Human
ccagccugggccu

SEQ ID NO: 3382124 - RNA, 19 nt, Human
ccagccugggccuauggag

SEQ ID NO: 3382125 - RNA, 14 nt, Human
ccagccuggggccu

SEQ ID NO: 3382126 - RNA, 13 nt, Human
ccagccugggguc

SEQ ID NO: 3382127 - RNA, 13 nt, Human
ccagccuggguga

SEQ ID NO: 3382128 - RNA, 18 nt, Human
ccagccugucagauccag

SEQ ID NO: 3382129 - RNA, 19 nt, Human
ccagccugucccauggaca

SEQ ID NO: 3382130 - RNA, 14 nt, Human
ccagccuguuggac

SEQ ID NO: 3382131 - RNA, 16 nt, Human
ccagccuuccucugca

SEQ ID NO: 3382132 - RNA, 22 nt, Human
ccagccuuccucugcagcugac

SEQ ID NO: 3382133 - RNA, 22 nt, Human
ccagccuucuuccaucccagga

SEQ ID NO: 3382134 - RNA, 18 nt, Human
ccagccuucuuugcuugc

SEQ ID NO: 3382135 - RNA, 19 nt, Human
ccagccuugaccauucucc

SEQ ID NO: 3382136 - RNA, 20 nt, Human
ccagccuugagcccuggcug

SEQ ID NO: 3382137 - RNA, 15 nt, Human
ccagccuuucuccca

SEQ ID NO: 3382138 - RNA, 16 nt, Human
cagacuacuauuuucu

SEQ ID NO: 3382139 - RNA, 21 nt, Human
cagacuagauggaccugccug

SEQ ID NO: 3382140 - RNA, 19 nt, Human
cagacucacaaccugaacc

SEQ ID NO: 3382141 - RNA, 20 nt, Human
cagacucacaaccugaaccu

SEQ ID NO: 3382142 - RNA, 21 nt, Human
cagacucacaaccugaaccua

SEQ ID NO: 3382143 - RNA, 16 nt, Human
cagacucagagcucuc

SEQ ID NO: 3382144 - RNA, 17 nt, Human
cagacucagagcucucu

SEQ ID NO: 3382145 - RNA, 18 nt, Human
cagacucauacagaaggu

SEQ ID NO: 3382146 - RNA, 19 nt, Human
cagacucauacagaaggug

SEQ ID NO: 3382147 - RNA, 21 nt, Human
cagacucauacagaagguggg

SEQ ID NO: 3382148 - RNA, 13 nt, Human
cagacucauccug

SEQ ID NO: 3382149 - RNA, 23 nt, Human
cagacuccugacugucucccggg

SEQ ID NO: 3382150 - RNA, 13 nt, Human
cagacuccugagg

SEQ ID NO: 3382151 - RNA, 16 nt, Human
cagacuccugaggaca

SEQ ID NO: 3382152 - RNA, 19 nt, Human
cagacucggaaucuauuuu

SEQ ID NO: 3382153 - RNA, 23 nt, Human
cagacucggaaucuauuuucuca

SEQ ID NO: 3382154 - RNA, 14 nt, Human
cagacucuaagaaa

SEQ ID NO: 3382155 - RNA, 19 nt, Human
cagacucuacagaggccau

SEQ ID NO: 3382156 - RNA, 15 nt, Human
cagacucucagccca

SEQ ID NO: 3382157 - RNA, 17 nt, Human
cagacucucugugaacc

SEQ ID NO: 3382158 - RNA, 15 nt, Human
cagacucuuuaugcu

SEQ ID NO: 3382159 - RNA, 18 nt, Human
cagacugcacccaggagg

SEQ ID NO: 3382160 - RNA, 12 nt, Human
cagacugcaggu

SEQ ID NO: 3382161 - RNA, 18 nt, Human
cagacugcgauuuguccc

SEQ ID NO: 3382162 - RNA, 13 nt, Human
cagacugcuagug

SEQ ID NO: 3382163 - RNA, 13 nt, Human
cagacugcuggga

SEQ ID NO: 3382164 - RNA, 16 nt, Human
cagacugcugggacug

SEQ ID NO: 3382165 - RNA, 20 nt, Human
cagacugcuuccaauuuucu

SEQ ID NO: 3382166 - RNA, 13 nt, Human
cagacuggaagca

SEQ ID NO: 3382167 - RNA, 12 nt, Human
cagacuggaggg

SEQ ID NO: 3382168 - RNA, 19 nt, Human
cagacuggauaguccgucu

SEQ ID NO: 3382169 - RNA, 17 nt, Human
cagacuggcacaguuuu

SEQ ID NO: 3382170 - RNA, 18 nt, Human
cagacuggcacaguuuuc

SEQ ID NO: 3382171 - RNA, 22 nt, Human
cagacuggcacaguuuucugag

SEQ ID NO: 3382172 - RNA, 14 nt, Human
cagacuggggcauc

SEQ ID NO: 3382173 - RNA, 22 nt, Human
cagacuggggcauccugugcca

SEQ ID NO: 3382174 - RNA, 15 nt, Human
cagacuggguuucua

SEQ ID NO: 3382175 - RNA, 20 nt, Human
cagacuggguuucuagccca

SEQ ID NO: 3382176 - RNA, 12 nt, Human
cagacuguguau

SEQ ID NO: 3382177 - RNA, 16 nt, Human
cagacuguuaauuaua

SEQ ID NO: 3382178 - RNA, 14 nt, Human
cagacuuaccagga

SEQ ID NO: 3382179 - RNA, 22 nt, Human
cagacuucccacggcuccucga

SEQ ID NO: 3382180 - RNA, 14 nt, Human
cagacuucccagcu

SEQ ID NO: 3382181 - RNA, 15 nt, Human
cagacuucccagcua

SEQ ID NO: 3382182 - RNA, 21 nt, Human
cagacuucccugaauguauug

SEQ ID NO: 3382183 - RNA, 18 nt, Human
cagacuugccaugugacu

SEQ ID NO: 3382184 - RNA, 15 nt, Human
cagacuuguauauuc

SEQ ID NO: 3382185 - RNA, 16 nt, Human
cagacuuguauauucu

SEQ ID NO: 3382186 - RNA, 13 nt, Human
cagacuugucaag

SEQ ID NO: 3382187 - RNA, 19 nt, Human
cagacuuuggaaaaugcau

SEQ ID NO: 3382188 - RNA, 12 nt, Human
cagagaaaaagg

SEQ ID NO: 3382189 - RNA, 18 nt, Human
cagagaaaaaugcucccc

SEQ ID NO: 3382190 - RNA, 21 nt, Human
cagagaaagaagagacaggag

SEQ ID NO: 3382191 - RNA, 22 nt, Human
cagagaaagaagagacaggagg

SEQ ID NO: 3382192 - RNA, 15 nt, Human
cagagaaagaggaag

SEQ ID NO: 3382193 - RNA, 17 nt, Human
cagagaaagaggaagcu

SEQ ID NO: 3382194 - RNA, 15 nt, Human
cagagaaagcgcaga

SEQ ID NO: 3382195 - RNA, 16 nt, Human
cagagaaagcgcagau

SEQ ID NO: 3382196 - RNA, 23 nt, Human
cagagaaaguacuucuccacccu

SEQ ID NO: 3382197 - RNA, 16 nt, Human
cagagaaaugucuguc

SEQ ID NO: 3382198 - RNA, 16 nt, Human
cagagaacccagccca

SEQ ID NO: 3382199 - RNA, 18 nt, Human
cagagaacuaacacuauu

SEQ ID NO: 3382200 - RNA, 22 nt, Human
cagagaacuaacacuauuuuau

SEQ ID NO: 3382201 - RNA, 23 nt, Human
cagagaacuaacacuauuuuaug

SEQ ID NO: 3382202 - RNA, 14 nt, Human
cagagaagaaagaa

SEQ ID NO: 3382203 - RNA, 11 nt, Human
cagagaagcca

SEQ ID NO: 3382204 - RNA, 20 nt, Human
cagagaagccaaaagauugg

SEQ ID NO: 3382205 - RNA, 17 nt, Human
cagagaagccagcuugu

SEQ ID NO: 3382206 - RNA, 19 nt, Human
cagagaagccagcuuguuu

SEQ ID NO: 3382207 - RNA, 21 nt, Human
cagagaagccagcuuguuuac

SEQ ID NO: 3382208 - RNA, 15 nt, Human
cagagaagccccuuc

SEQ ID NO: 3382209 - RNA, 24 nt, Human
cagagaagccccuuccccauggga

SEQ ID NO: 3382210 - RNA, 14 nt, Human
cagagaagccuuca

SEQ ID NO: 3382211 - RNA, 16 nt, Human
cagagaagccuucaag

SEQ ID NO: 3382212 - RNA, 19 nt, Human
cagagaagccuucaagcuc

SEQ ID NO: 3382213 - RNA, 20 nt, Human
cagagaagccuucaagcucu

SEQ ID NO: 3382214 - RNA, 14 nt, Human
cagagaaggaaugu

SEQ ID NO: 3382215 - RNA, 14 nt, Human
cagagaaggcagga

SEQ ID NO: 3382216 - RNA, 17 nt, Human
cagagaaggcaggaaug

SEQ ID NO: 3382217 - RNA, 11 nt, Human
cagagaagggc

SEQ ID NO: 3382218 - RNA, 21 nt, Human
cagagaagggcuccugcaggc

SEQ ID NO: 3382219 - RNA, 17 nt, Human
cagagaagugacaggga

SEQ ID NO: 3382220 - RNA, 18 nt, Human
cagagaagugacagggaa

SEQ ID NO: 3382221 - RNA, 20 nt, Human
cagagaagugacagggaagc

SEQ ID NO: 3382222 - RNA, 11 nt, Human
cagagaaguuc

SEQ ID NO: 3382223 - RNA, 13 nt, Human
cagagaauuucua

SEQ ID NO: 3382224 - RNA, 22 nt, Human
cagagaauuucuaccauuucag

SEQ ID NO: 3382225 - RNA, 14 nt, Human
cagagacaacaggu

SEQ ID NO: 3382226 - RNA, 15 nt, Human
cagagacaaguaauu

SEQ ID NO: 3382227 - RNA, 15 nt, Human
cagagacacaagccu

SEQ ID NO: 3382228 - RNA, 17 nt, Human
cagagacacaagccuuc

SEQ ID NO: 3382229 - RNA, 16 nt, Human
cagagacagagaggac

SEQ ID NO: 3382230 - RNA, 12 nt, Human
cagagacagaua

SEQ ID NO: 3382231 - RNA, 17 nt, Human
cagagacauacuugaag

SEQ ID NO: 3382232 - RNA, 23 nt, Human
cagagacauacuugaagggccag

SEQ ID NO: 3382233 - RNA, 18 nt, Human
cagagaccaggcuguguc

SEQ ID NO: 3382234 - RNA, 14 nt, Human
cagagaccaucccu

SEQ ID NO: 3382235 - RNA, 19 nt, Human
cagagaccaucccugaagg

SEQ ID NO: 3382236 - RNA, 15 nt, Human
cagagacccucugcc

SEQ ID NO: 3382237 - RNA, 19 nt, Human
cagagaccguccucacccc

SEQ ID NO: 3382238 - RNA, 17 nt, Human
cagagaccucccuguuc

SEQ ID NO: 3382239 - RNA, 22 nt, Human
cagagacucagggccccagcac

SEQ ID NO: 3382240 - RNA, 15 nt, Human
cagagacuccugcag

SEQ ID NO: 3382241 - RNA, 17 nt, Human
cagagacuccugcaggc

SEQ ID NO: 3382242 - RNA, 14 nt, Human
cagagacugcugug

SEQ ID NO: 3382243 - RNA, 21 nt, Human
cagagacugucccugaaaccu

SEQ ID NO: 3382244 - RNA, 15 nt, Human
cagagacuugggaca

SEQ ID NO: 3382245 - RNA, 18 nt, Human
cagagacuugggacauug

SEQ ID NO: 3382246 - RNA, 20 nt, Human
cagagacuugggacauugcc

SEQ ID NO: 3382247 - RNA, 22 nt, Human
cagagagaagagccccacucuc

SEQ ID NO: 3382248 - RNA, 18 nt, Human
cccacccaagcuuggcag

SEQ ID NO: 3382249 - RNA, 20 nt, Human
cccacccaagggccuggccu

SEQ ID NO: 3382250 - RNA, 13 nt, Human
cccacccaggcca

SEQ ID NO: 3382251 - RNA, 17 nt, Human
cccacccaggccaggca

SEQ ID NO: 3382252 - RNA, 21 nt, Human
cccacccaggccaggcaugug

SEQ ID NO: 3382253 - RNA, 13 nt, Human
cccacccagucuc

SEQ ID NO: 3382254 - RNA, 16 nt, Human
cccacccagucucugc

SEQ ID NO: 3382255 - RNA, 18 nt, Human
cccaccccaaccugcucu

SEQ ID NO: 3382256 - RNA, 22 nt, Human
cccaccccaaccugcucuccuc

SEQ ID NO: 3382257 - RNA, 17 nt, Human
cccaccccacccccacc

SEQ ID NO: 3382258 - RNA, 16 nt, Human
cccaccccaccugcag

SEQ ID NO: 3382259 - RNA, 13 nt, Human
cccaccccauccu

SEQ ID NO: 3382260 - RNA, 15 nt, Human
cccacccccacccaa

SEQ ID NO: 3382261 - RNA, 17 nt, Human
cccacccccacccaagg

SEQ ID NO: 3382262 - RNA, 16 nt, Human
cccacccccagccccg

SEQ ID NO: 3382263 - RNA, 15 nt, Human
cccacccccucaagc

SEQ ID NO: 3382264 - RNA, 19 nt, Human
cccacccccuccccagggg

SEQ ID NO: 3382265 - RNA, 18 nt, Human
cccacccccugcccugca

SEQ ID NO: 3382266 - RNA, 22 nt, Human
cccacccccuucucugcuccac

SEQ ID NO: 3382267 - RNA, 20 nt, Human
cccaccccggggacccugug

SEQ ID NO: 3382268 - RNA, 13 nt, Human
cccaccccucccu

SEQ ID NO: 3382269 - RNA, 11 nt, Human
cccaccccugc

SEQ ID NO: 3382270 - RNA, 17 nt, Human
cccaccccuuccccacu

SEQ ID NO: 3382271 - RNA, 15 nt, Human
cccacccgaugcugc

SEQ ID NO: 3382272 - RNA, 14 nt, Human
cccacccucccugg

SEQ ID NO: 3382273 - RNA, 14 nt, Human
cccacccuccuguc

SEQ ID NO: 3382274 - RNA, 15 nt, Human
cccacccucuuccua

SEQ ID NO: 3382275 - RNA, 12 nt, Human
cccacccugcug

SEQ ID NO: 3382276 - RNA, 17 nt, Human
cccacccugcugcuggu

SEQ ID NO: 3382277 - RNA, 18 nt, Human
cccacccuguuccugcug

SEQ ID NO: 3382278 - RNA, 20 nt, Human
cccacccuguuccugcugcu

SEQ ID NO: 3382279 - RNA, 19 nt, Human
cccaccgcagacaggacca

SEQ ID NO: 3382280 - RNA, 14 nt, Human
cccaccgcaugccc

SEQ ID NO: 3382281 - RNA, 22 nt, Human
cccaccgcaugcccccucgugc

SEQ ID NO: 3382282 - RNA, 23 nt, Human
cccaccgggccacuccuuccugc

SEQ ID NO: 3382283 - RNA, 19 nt, Human
cuagugggguuuccuggca

SEQ ID NO: 3382284 - RNA, 13 nt, Human
cuaguguagaauu

SEQ ID NO: 3382285 - RNA, 18 nt, Human
cuaguguaucaaaaugcu

SEQ ID NO: 3382286 - RNA, 19 nt, Human
cuagugugguguuuccugg

SEQ ID NO: 3382287 - RNA, 22 nt, Human
cuagugugguguuuccuggcac

SEQ ID NO: 3382288 - RNA, 15 nt, Human
cuaguguucugucua

SEQ ID NO: 3382289 - RNA, 14 nt, Human
cuaguguugcuugg

SEQ ID NO: 3382290 - RNA, 22 nt, Human
cuaguguuuucaauuuuaaaca

SEQ ID NO: 3382291 - RNA, 18 nt, Human
cuaguuaaagaaaggaaa

SEQ ID NO: 3382292 - RNA, 18 nt, Human
cuaguuacugugguaugg

SEQ ID NO: 3382293 - RNA, 23 nt, Human
cuaguuauacuuauuuguauaug

SEQ ID NO: 3382294 - RNA, 20 nt, Human
cuaguuauuuacaggaacuu

SEQ ID NO: 3382295 - RNA, 13 nt, Human
cuaguuauuuauu

SEQ ID NO: 3382296 - RNA, 19 nt, Human
cuaguuauuuauucuggga

SEQ ID NO: 3382297 - RNA, 18 nt, Human
cuaguucauccaauccuc

SEQ ID NO: 3382298 - RNA, 19 nt, Human
cuaguucauccaauccuca

SEQ ID NO: 3382299 - RNA, 16 nt, Human
cuaguucaucccuucu

SEQ ID NO: 3382300 - RNA, 23 nt, Human
cuaguucaucccuucucuuccag

SEQ ID NO: 3382301 - RNA, 14 nt, Human
cuaguuccaccauc

SEQ ID NO: 3382302 - RNA, 18 nt, Human
cuaguuccccuguuuauu

SEQ ID NO: 3382303 - RNA, 21 nt, Human
cuaguuccccuguuuauucau

SEQ ID NO: 3382304 - RNA, 18 nt, Human
cuaguucccucugcucag

SEQ ID NO: 3382305 - RNA, 22 nt, Human
cuaguucccucugcucagccaa

SEQ ID NO: 3382306 - RNA, 20 nt, Human
cuaguuccugaugacccagg

SEQ ID NO: 3382307 - RNA, 22 nt, Human
cuaguuccugaugacccaggcu

SEQ ID NO: 3382308 - RNA, 15 nt, Human
cuaguucuagaaaaa

SEQ ID NO: 3382309 - RNA, 16 nt, Human
cuaguucugccaggag

SEQ ID NO: 3382310 - RNA, 17 nt, Human
cuaguucuguagaaaug

SEQ ID NO: 3382311 - RNA, 21 nt, Human
cuaguucuucaucccacucca

SEQ ID NO: 3382312 - RNA, 13 nt, Human
cuaguugaauacu

SEQ ID NO: 3382313 - RNA, 20 nt, Human
cuaguugaauacuugaacca

SEQ ID NO: 3382314 - RNA, 20 nt, Human
cuaguugccaaaucuggcuc

SEQ ID NO: 3382315 - RNA, 18 nt, Human
cuaguuggugagaaaccu

SEQ ID NO: 3382316 - RNA, 19 nt, Human
cuaguuggugagaaaccug

SEQ ID NO: 3382317 - RNA, 23 nt, Human
cuaguuguuugauucagacagcu

SEQ ID NO: 3382318 - RNA, 16 nt, Human
cuaguuuacuguuuug

SEQ ID NO: 3382319 - RNA, 18 nt, Human
cuaguuuccucuccuucg

SEQ ID NO: 3382320 - RNA, 13 nt, Human
cuaguuugauuaa

SEQ ID NO: 3382321 - RNA, 18 nt, Human
cuaguuugggaggagcag

SEQ ID NO: 3382322 - RNA, 23 nt, Human
cuaguuuuaaaaaaauaaaacau

SEQ ID NO: 3382323 - RNA, 20 nt, Human
cuaguuuuaguuuucucuua

SEQ ID NO: 3382324 - RNA, 22 nt, Human
cuaguuuucaguuuguauauac

SEQ ID NO: 3382325 - RNA, 18 nt, Human
cuaguuuucuuuccuccu

SEQ ID NO: 3382326 - RNA, 21 nt, Human
cuaguuuucuuuccuccuuuc

SEQ ID NO: 3382327 - RNA, 13 nt, Human
cuauaaaacaggu

SEQ ID NO: 3382328 - RNA, 15 nt, Human
cuauaaaagaaacac

SEQ ID NO: 3382329 - RNA, 11 nt, Human
cuauaaaauag

SEQ ID NO: 3382330 - RNA, 18 nt, Human
cuauaaaaugucuucaag

SEQ ID NO: 3382331 - RNA, 19 nt, Human
cuauaaaaugucuucaagg

SEQ ID NO: 3382332 - RNA, 23 nt, Human
cuauaaagaagaacuugcaugga

SEQ ID NO: 3382333 - RNA, 13 nt, Human
cuauaaagagaag

SEQ ID NO: 3382334 - RNA, 15 nt, Human
cuauaaagcauuuaa

SEQ ID NO: 3382335 - RNA, 16 nt, Human
cuauaaaguaaagcua

SEQ ID NO: 3382336 - RNA, 14 nt, Human
cuauaaauguugcu

SEQ ID NO: 3382337 - RNA, 20 nt, Human
cuauaacaccugccaccacu

SEQ ID NO: 3382338 - RNA, 21 nt, Human
cuauaacauauguacauaaau

SEQ ID NO: 3382339 - RNA, 23 nt, Human
cuauaaggugcucucuuucuguc

SEQ ID NO: 3382340 - RNA, 19 nt, Human
cuauaaucccagcacuuug

SEQ ID NO: 3382341 - RNA, 18 nt, Human
cuauaaucugucaaaaca

SEQ ID NO: 3382342 - RNA, 19 nt, Human
cuauaaucugucaaaacac

SEQ ID NO: 3382343 - RNA, 15 nt, Human
cuauaaugaagcuuu

SEQ ID NO: 3382344 - RNA, 19 nt, Human
cuauaaugaagcuuuauac

SEQ ID NO: 3382345 - RNA, 11 nt, Human
cuauaauguga

SEQ ID NO: 3382346 - RNA, 13 nt, Human
cuauaaugugaaa

SEQ ID NO: 3382347 - RNA, 20 nt, Human
cuauaauucccuaucuuuua

SEQ ID NO: 3382348 - RNA, 22 nt, Human
cuauaauuuaccugaagucuuu

SEQ ID NO: 3382349 - RNA, 14 nt, Human
cuauaauuuuacaa

SEQ ID NO: 3382350 - RNA, 14 nt, Human
cuauaauuuugaua

SEQ ID NO: 3382351 - RNA, 16 nt, Human
cuauaauuuugauagu

SEQ ID NO: 3382352 - RNA, 20 nt, Human
cuauacauaucuuuauuaau

SEQ ID NO: 3382353 - RNA, 22 nt, Human
cuauacauaucuuuauuaauca

SEQ ID NO: 3382354 - RNA, 16 nt, Human
cuauacaucucucccc

SEQ ID NO: 3382355 - RNA, 18 nt, Human
cuauacaucucuccccaa

SEQ ID NO: 3382356 - RNA, 19 nt, Human
cuauaccccuuacuuagca

SEQ ID NO: 3382357 - RNA, 20 nt, Human
cuauaccccuuacuuagcau

SEQ ID NO: 3382358 - RNA, 13 nt, Human
cuauaccuguguu

SEQ ID NO: 3382359 - RNA, 14 nt, Human
ccaggcuccgcccu

SEQ ID NO: 3382360 - RNA, 17 nt, Human
ccaggcuccgcccuuag

SEQ ID NO: 3382361 - RNA, 14 nt, Human
ccaggcuccucccu

SEQ ID NO: 3382362 - RNA, 16 nt, Human
ccaggcucggccugcc

SEQ ID NO: 3382363 - RNA, 20 nt, Human
ccaggcucguggacugagug

SEQ ID NO: 3382364 - RNA, 14 nt, Human
ccaggcucugugcu

SEQ ID NO: 3382365 - RNA, 16 nt, Human
ccaggcugaccacagc

SEQ ID NO: 3382366 - RNA, 19 nt, Human
ccaggcugaccacagcaca

SEQ ID NO: 3382367 - RNA, 21 nt, Human
ccaggcugaccacagcacagc

SEQ ID NO: 3382368 - RNA, 13 nt, Human
ccaggcugagccu

SEQ ID NO: 3382369 - RNA, 19 nt, Human
ccaggcugagccucagucu

SEQ ID NO: 3382370 - RNA, 21 nt, Human
ccaggcugccguccccuagag

SEQ ID NO: 3382371 - RNA, 15 nt, Human
ccaggcugccguggg

SEQ ID NO: 3382372 - RNA, 14 nt, Human
ccaggcuggcgcag

SEQ ID NO: 3382373 - RNA, 12 nt, Human
ccaggcuggcgu

SEQ ID NO: 3382374 - RNA, 19 nt, Human
ccaggcuggcgugcagugg

SEQ ID NO: 3382375 - RNA, 18 nt, Human
ccaggcugggagagccuu

SEQ ID NO: 3382376 - RNA, 23 nt, Human
ccaggcugggagagccuuccagg

SEQ ID NO: 3382377 - RNA, 20 nt, Human
ccaggcugggcaaggaggcc

SEQ ID NO: 3382378 - RNA, 16 nt, Human
ccaggcugggucgccc

SEQ ID NO: 3382379 - RNA, 24 nt, Human
ccaggcugggucgcccuggacugu

SEQ ID NO: 3382380 - RNA, 14 nt, Human
ccaggcuggucuca

SEQ ID NO: 3382381 - RNA, 19 nt, Human
ccaggcuggucucaaacuc

SEQ ID NO: 3382382 - RNA, 21 nt, Human
ccaggcuggucucgaacuccu

SEQ ID NO: 3382383 - RNA, 21 nt, Human
ccaggcugguuucgaacuccu

SEQ ID NO: 3382384 - RNA, 20 nt, Human
ccaggcugugcagcgcagcu

SEQ ID NO: 3382385 - RNA, 17 nt, Human
ccaggcugugggccuca

SEQ ID NO: 3382386 - RNA, 21 nt, Human
ccaggcugugggccucaagga

SEQ ID NO: 3382387 - RNA, 16 nt, Human
ccaggcuucacccuga

SEQ ID NO: 3382388 - RNA, 13 nt, Human
ccaggcuucugcu

SEQ ID NO: 3382389 - RNA, 20 nt, Human
ccaggcuucugcuggggccu

SEQ ID NO: 3382390 - RNA, 14 nt, Human
ccaggcuuggccuu

SEQ ID NO: 3382391 - RNA, 17 nt, Human
ccagggaagagaaagug

SEQ ID NO: 3382392 - RNA, 23 nt, Human
ccagggaagcagcagccucgccc

SEQ ID NO: 3382393 - RNA, 15 nt, Human
ccagggaauccaagc

SEQ ID NO: 3382394 - RNA, 18 nt, Human
ccagggaauccaagccuc

SEQ ID NO: 3382395 - RNA, 17 nt, Human
ccagggacaccagccag

SEQ ID NO: 3382396 - RNA, 20 nt, Human
ccagggacaccagccaggcu

SEQ ID NO: 3382397 - RNA, 22 nt, Human
ccagggacaccagccaggcucu

SEQ ID NO: 3382398 - RNA, 18 nt, Human
ccagggacaccugggaga

SEQ ID NO: 3382399 - RNA, 20 nt, Human
ccagggacaccugggagaaa

SEQ ID NO: 3382400 - RNA, 13 nt, Human
ccagggacagagg

SEQ ID NO: 3382401 - RNA, 18 nt, Human
ccagggacagaggcccca

SEQ ID NO: 3382402 - RNA, 20 nt, Human
ccagggacagaggccccagc

SEQ ID NO: 3382403 - RNA, 23 nt, Human
ccagggacagaggccccagccuc

SEQ ID NO: 3382404 - RNA, 19 nt, Human
ccagggacgaagaagagcc

SEQ ID NO: 3382405 - RNA, 20 nt, Human
ccagggacgaagaagagcca

SEQ ID NO: 3382406 - RNA, 21 nt, Human
ccagggacgaagaagagccac

SEQ ID NO: 3382407 - RNA, 23 nt, Human
ccagggacgaagaagagccacag

SEQ ID NO: 3382408 - RNA, 14 nt, Human
ccagggagaagcuc

SEQ ID NO: 3382409 - RNA, 21 nt, Human
ccagggagacagagcucacaa

SEQ ID NO: 3382410 - RNA, 16 nt, Human
ccagggagaccuggac

SEQ ID NO: 3382411 - RNA, 17 nt, Human
ccagggagaccuggaca

SEQ ID NO: 3382412 - RNA, 21 nt, Human
ccagggagaccuggacacagg

SEQ ID NO: 3382413 - RNA, 15 nt, Human
ccagggagagcccag

SEQ ID NO: 3382414 - RNA, 23 nt, Human
ccagggagcaugagaggaggcag

SEQ ID NO: 3382415 - RNA, 20 nt, Human
ccagggagcauuuuccucca

SEQ ID NO: 3382416 - RNA, 13 nt, Human
ccagggagccuuu

SEQ ID NO: 3382417 - RNA, 19 nt, Human
ccagggagcggaaagcagc

SEQ ID NO: 3382418 - RNA, 13 nt, Human
ccagggagucccc

SEQ ID NO: 3382419 - RNA, 22 nt, Human
ccagggauuuguccuuggggac

SEQ ID NO: 3382420 - RNA, 21 nt, Human
ccagggcaaggguuaaggccu

SEQ ID NO: 3382421 - RNA, 16 nt, Human
ccagggcacaggagcu

SEQ ID NO: 3382422 - RNA, 23 nt, Human
ccagggcacccuguggcccuggc

SEQ ID NO: 3382423 - RNA, 19 nt, Human
ccagggcagccagggagag

SEQ ID NO: 3382424 - RNA, 13 nt, Human
ccagggcagggcc

SEQ ID NO: 3382425 - RNA, 19 nt, Human
ccagggcaucuugcuggcu

SEQ ID NO: 3382426 - RNA, 23 nt, Human
cuauguccuaaggacacacuaau

SEQ ID NO: 3382427 - RNA, 13 nt, Human
cuaugucuuguuu

SEQ ID NO: 3382428 - RNA, 14 nt, Human
cuaugugagaccau

SEQ ID NO: 3382429 - RNA, 19 nt, Human
cuaugugauuuuaacucug

SEQ ID NO: 3382430 - RNA, 21 nt, Human
cuaugugauuuuaacucuguc

SEQ ID NO: 3382431 - RNA, 19 nt, Human
cuaugugccuuauguugaa

SEQ ID NO: 3382432 - RNA, 22 nt, Human
cuaugugccuuauguugaaaaa

SEQ ID NO: 3382433 - RNA, 18 nt, Human
cuauguggauuuuuuccu

SEQ ID NO: 3382434 - RNA, 13 nt, Human
cuauguguaaggu

SEQ ID NO: 3382435 - RNA, 22 nt, Human
cuauguguagggcgggaggaug

SEQ ID NO: 3382436 - RNA, 14 nt, Human
cuauguuaauauuu

SEQ ID NO: 3382437 - RNA, 18 nt, Human
cuauguucuaagaaguga

SEQ ID NO: 3382438 - RNA, 18 nt, Human
cuauguugcccaggcagg

SEQ ID NO: 3382439 - RNA, 15 nt, Human
cuauguuucaucuug

SEQ ID NO: 3382440 - RNA, 12 nt, Human
cuauguuuuugu

SEQ ID NO: 3382441 - RNA, 23 nt, Human
cuauuaaaaaagucuacaacaua

SEQ ID NO: 3382442 - RNA, 13 nt, Human
cuauuaaaagacu

SEQ ID NO: 3382443 - RNA, 17 nt, Human
cuauuaaaagacucauc

SEQ ID NO: 3382444 - RNA, 20 nt, Human
cuauuaaaagacucauccgu

SEQ ID NO: 3382445 - RNA, 19 nt, Human
cuauuaacaauuaauuguc

SEQ ID NO: 3382446 - RNA, 17 nt, Human
cuauuaagauuuccaag

SEQ ID NO: 3382447 - RNA, 22 nt, Human
cuauuaagcaguaaaaacuguu

SEQ ID NO: 3382448 - RNA, 17 nt, Human
cuauuaauauauguauu

SEQ ID NO: 3382449 - RNA, 21 nt, Human
cuauuaauauauguauuauuu

SEQ ID NO: 3382450 - RNA, 11 nt, Human
cuauuaauauu

SEQ ID NO: 3382451 - RNA, 22 nt, Human
cuauuaauauuuguuuaguuca

SEQ ID NO: 3382452 - RNA, 12 nt, Human
cuauuacaaaua

SEQ ID NO: 3382453 - RNA, 16 nt, Human
cuauuaccacugaaga

SEQ ID NO: 3382454 - RNA, 17 nt, Human
cuauuaccaugagaaga

SEQ ID NO: 3382455 - RNA, 20 nt, Human
cuauuagacuuuagaaauaa

SEQ ID NO: 3382456 - RNA, 16 nt, Human
cuauuagccaggauca

SEQ ID NO: 3382457 - RNA, 22 nt, Human
cuauuagccaggaucauggugu

SEQ ID NO: 3382458 - RNA, 17 nt, Human
cuauuaguguuauauga

SEQ ID NO: 3382459 - RNA, 15 nt, Human
cuauuauaauuuaau

SEQ ID NO: 3382460 - RNA, 17 nt, Human
cuauuauaauuuaaugc

SEQ ID NO: 3382461 - RNA, 16 nt, Human
cuauuauacuguauua

SEQ ID NO: 3382462 - RNA, 18 nt, Human
cuauuaucccagcugccu

SEQ ID NO: 3382463 - RNA, 22 nt, Human
cuauuaugaaugugaagccuuc

SEQ ID NO: 3382464 - RNA, 16 nt, Human
cuauuauuuuuauaau

SEQ ID NO: 3382465 - RNA, 23 nt, Human
cuauucaagguggccaaauuauu

SEQ ID NO: 3382466 - RNA, 16 nt, Human
cuauucacuaaaauua

SEQ ID NO: 3382467 - RNA, 17 nt, Human
cuauucagacaagcaac

SEQ ID NO: 3382468 - RNA, 23 nt, Human
cuauucagcacaaggaaauaaaa

SEQ ID NO: 3382469 - RNA, 23 nt, Human
cuauucagcuucguuuauuuuca

SEQ ID NO: 3382470 - RNA, 21 nt, Human
cuauucaggagaguagaacag

SEQ ID NO: 3382471 - RNA, 17 nt, Human
cuauucaguaauaacuc

SEQ ID NO: 3382472 - RNA, 17 nt, Human
cuauucaguucccagaa

SEQ ID NO: 3382473 - RNA, 15 nt, Human
cuauucaguuguguu

SEQ ID NO: 3382474 - RNA, 18 nt, Human
cuauucauuaaauguuug

SEQ ID NO: 3382475 - RNA, 15 nt, Human
cuauuccaauaaacu

SEQ ID NO: 3382476 - RNA, 17 nt, Human
cuauuccagcucauuca

SEQ ID NO: 3382477 - RNA, 16 nt, Human
cuauuccagcuguccc

SEQ ID NO: 3382478 - RNA, 20 nt, Human
cuauucccacaccuccacag

SEQ ID NO: 3382479 - RNA, 14 nt, Human
cuauuccuuucccu

SEQ ID NO: 3382480 - RNA, 17 nt, Human
cuauuccuuucccuucc

SEQ ID NO: 3382481 - RNA, 15 nt, Human
cuauucgaaugaaaa

SEQ ID NO: 3382482 - RNA, 17 nt, Human
cuauucuagccugcauu

SEQ ID NO: 3382483 - RNA, 22 nt, Human
cuauucuauaaaacucugcaug

SEQ ID NO: 3382484 - RNA, 15 nt, Human
cuauucucaccagga

SEQ ID NO: 3382485 - RNA, 14 nt, Human
cuauucucuccaaa

SEQ ID NO: 3382486 - RNA, 16 nt, Human
cuauucucuccucaga

SEQ ID NO: 3382487 - RNA, 15 nt, Human
cuauucugagaaaac

SEQ ID NO: 3382488 - RNA, 16 nt, Human
cuauucugagaaaaca

SEQ ID NO: 3382489 - RNA, 17 nt, Human
cuauucugagaaaacaa

SEQ ID NO: 3382490 - RNA, 15 nt, Human
cuauucugagaugac

SEQ ID NO: 3382491 - RNA, 16 nt, Human
cuauucugagaugacu

SEQ ID NO: 3382492 - RNA, 24 nt, Human
cuauucuguguugcauuauucauu

SEQ ID NO: 3382493 - RNA, 17 nt, Human
cuauucuugauguaaaa

SEQ ID NO: 3382494 - RNA, 18 nt, Human
cuauucuugauguaaaau

SEQ ID NO: 3382495 - RNA, 22 nt, Human
cuauucuuuaacucccauuacc

SEQ ID NO: 3382496 - RNA, 21 nt, Human
cuauucuuucgaaagaagaaa

SEQ ID NO: 3382497 - RNA, 12 nt, Human
cuauugacaaua

SEQ ID NO: 3382498 - RNA, 17 nt, Human
cuauugacaauaaaaua

SEQ ID NO: 3382499 - RNA, 16 nt, Human
cuauugagucuucaug

SEQ ID NO: 3382500 - RNA, 14 nt, Human
cuauugauacucuu

SEQ ID NO: 3382501 - RNA, 20 nt, Human
cuauugauguacagucuguc

SEQ ID NO: 3382502 - RNA, 21 nt, Human
cuauugauguacagucuguca

SEQ ID NO: 3382503 - RNA, 18 nt, Human
cuauugauuuuuacuuca

SEQ ID NO: 3382504 - RNA, 22 nt, Human
cuauugcaaagguuccaacugu

SEQ ID NO: 3382505 - RNA, 18 nt, Human
cuauugcaguuauagaaa

SEQ ID NO: 3382506 - RNA, 19 nt, Human
cuauugcauuuauauguac

SEQ ID NO: 3382507 - RNA, 14 nt, Human
cuauugccucugag

SEQ ID NO: 3382508 - RNA, 19 nt, Human
cuauugcuagagcuccucc

SEQ ID NO: 3382509 - RNA, 15 nt, Human
cuauuggguucauua

SEQ ID NO: 3382510 - RNA, 16 nt, Human
cuauuggguucauuau

SEQ ID NO: 3382511 - RNA, 14 nt, Human
cuauuguaaauaug

SEQ ID NO: 3382512 - RNA, 17 nt, Human
cuauuguaaauauguuu

SEQ ID NO: 3382513 - RNA, 15 nt, Human
cuauuguaagauaaa

SEQ ID NO: 3382514 - RNA, 16 nt, Human
cuauuguaagauaaaa

SEQ ID NO: 3382515 - RNA, 20 nt, Human
cuauuguaauauagaaaaaa

SEQ ID NO: 3382516 - RNA, 22 nt, Human
cuauuguccccuagcaaggcau

SEQ ID NO: 3382517 - RNA, 17 nt, Human
cuauugugauuugacug

SEQ ID NO: 3382518 - RNA, 16 nt, Human
cuauuguuacucuggu

SEQ ID NO: 3382519 - RNA, 20 nt, Human
cuauuguuacucugguucuu

SEQ ID NO: 3382520 - RNA, 21 nt, Human
cuauuuaaaaaaaaagucaga

SEQ ID NO: 3382521 - RNA, 16 nt, Human
cuauuuaaaacuugua

SEQ ID NO: 3382522 - RNA, 18 nt, Human
cuauuuaaacuuauaaau

SEQ ID NO: 3382523 - RNA, 18 nt, Human
ccaggguugaccccagag

SEQ ID NO: 3382524 - RNA, 16 nt, Human
ccaggguugaucacac

SEQ ID NO: 3382525 - RNA, 17 nt, Human
ccaggguuucgagaagc

SEQ ID NO: 3382526 - RNA, 23 nt, Human
ccagguaagcaggaggaggugcc

SEQ ID NO: 3382527 - RNA, 18 nt, Human
ccagguaaugagggacug

SEQ ID NO: 3382528 - RNA, 15 nt, Human
ccagguaccagcugc

SEQ ID NO: 3382529 - RNA, 19 nt, Human
ccagguaccagcugcgcuu

SEQ ID NO: 3382530 - RNA, 23 nt, Human
ccagguaccagcugcgcuugcuu

SEQ ID NO: 3382531 - RNA, 15 nt, Human
ccagguacgcacaga

SEQ ID NO: 3382532 - RNA, 16 nt, Human
ccagguacuugagaaa

SEQ ID NO: 3382533 - RNA, 14 nt, Human
ccagguagaaacuu

SEQ ID NO: 3382534 - RNA, 20 nt, Human
ccagguagaggguguguaag

SEQ ID NO: 3382535 - RNA, 20 nt, Human
ccagguagcugggauuacag

SEQ ID NO: 3382536 - RNA, 14 nt, Human
ccagguaggccaag

SEQ ID NO: 3382537 - RNA, 21 nt, Human
ccagguaggccaagguguccu

SEQ ID NO: 3382538 - RNA, 22 nt, Human
ccagguauagagaaaggucuau

SEQ ID NO: 3382539 - RNA, 19 nt, Human
ccagguauccaaaaaugug

SEQ ID NO: 3382540 - RNA, 22 nt, Human
ccagguauccaaaaauguguaa

SEQ ID NO: 3382541 - RNA, 16 nt, Human
ccagguaucuccagga

SEQ ID NO: 3382542 - RNA, 14 nt, Human
ccagguauggcucu

SEQ ID NO: 3382543 - RNA, 19 nt, Human
ccaggucaacagaaugaaa

SEQ ID NO: 3382544 - RNA, 21 nt, Human
ccaggucaacagaaugaaaaa

SEQ ID NO: 3382545 - RNA, 20 nt, Human
ccaggucacccuuugcugug

SEQ ID NO: 3382546 - RNA, 17 nt, Human
ccagguccaaugagcuu

SEQ ID NO: 3382547 - RNA, 19 nt, Human
ccagguccaaugagcuuuc

SEQ ID NO: 3382548 - RNA, 20 nt, Human
ccagguccaaugagcuuucu

SEQ ID NO: 3382549 - RNA, 13 nt, Human
ccagguccagcuc

SEQ ID NO: 3382550 - RNA, 17 nt, Human
ccagguccagcucugga

SEQ ID NO: 3382551 - RNA, 15 nt, Human
ccaggucccccugca

SEQ ID NO: 3382552 - RNA, 13 nt, Human
ccaggucccucuc

SEQ ID NO: 3382553 - RNA, 16 nt, Human
ccaggucccucucauu

SEQ ID NO: 3382554 - RNA, 19 nt, Human
ccagguccugguggggcag

SEQ ID NO: 3382555 - RNA, 17 nt, Human
ccaggucgggcucagcu

SEQ ID NO: 3382556 - RNA, 20 nt, Human
ccaggucgggcucagcucug

SEQ ID NO: 3382557 - RNA, 21 nt, Human
ccaggucgggcucagcucugg

SEQ ID NO: 3382558 - RNA, 23 nt, Human
ccaggucuaccccucccggcccu

SEQ ID NO: 3382559 - RNA, 13 nt, Human
ccaggucucccug

SEQ ID NO: 3382560 - RNA, 21 nt, Human
ccaggucuccuccaccgccau

SEQ ID NO: 3382561 - RNA, 20 nt, Human
ccaggugaaggaggcuccag

SEQ ID NO: 3382562 - RNA, 21 nt, Human
ccaggugaguccuagagcuac

SEQ ID NO: 3382563 - RNA, 18 nt, Human
ccaggugcacaagcucca

SEQ ID NO: 3382564 - RNA, 13 nt, Human
ccaggugcacaga

SEQ ID NO: 3382565 - RNA, 14 nt, Human
ccaggugcagccag

SEQ ID NO: 3382566 - RNA, 16 nt, Human
ccaggugcagccagag

SEQ ID NO: 3382567 - RNA, 22 nt, Human
ccaggugcaguggcucacgccu

SEQ ID NO: 3382568 - RNA, 13 nt, Human
ccaggugccaguu

SEQ ID NO: 3382569 - RNA, 13 nt, Human
ccaggugcccagc

SEQ ID NO: 3382570 - RNA, 20 nt, Human
cucaggaggcgcccuuggcu

SEQ ID NO: 3382571 - RNA, 15 nt, Human
cucaggaggcugagg

SEQ ID NO: 3382572 - RNA, 20 nt, Human
cucaggaggcugaggcagaa

SEQ ID NO: 3382573 - RNA, 20 nt, Human
cucaggaggcugaggcagga

SEQ ID NO: 3382574 - RNA, 23 nt, Human
cucaggaguuugagaccaaccug

SEQ ID NO: 3382575 - RNA, 12 nt, Human
cucaggauccaa

SEQ ID NO: 3382576 - RNA, 16 nt, Human
cucaggaugagggaaa

SEQ ID NO: 3382577 - RNA, 20 nt, Human
cucaggaugagggaaaagaa

SEQ ID NO: 3382578 - RNA, 22 nt, Human
cucaggaugagggaaaagaaaa

SEQ ID NO: 3382579 - RNA, 14 nt, Human
cucaggaugcccag

SEQ ID NO: 3382580 - RNA, 16 nt, Human
cucaggaugcccaggg

SEQ ID NO: 3382581 - RNA, 19 nt, Human
cucaggaugcccagggcca

SEQ ID NO: 3382582 - RNA, 19 nt, Human
cucaggauuuaaaaacugg

SEQ ID NO: 3382583 - RNA, 19 nt, Human
cucaggauuucgugggucu

SEQ ID NO: 3382584 - RNA, 18 nt, Human
cucaggcacacagcuacu

SEQ ID NO: 3382585 - RNA, 14 nt, Human
cucaggcacuagcc

SEQ ID NO: 3382586 - RNA, 15 nt, Human
cucaggcacuagccu

SEQ ID NO: 3382587 - RNA, 15 nt, Human
cucaggcagguggga

SEQ ID NO: 3382588 - RNA, 16 nt, Human
cucaggcaugccugug

SEQ ID NO: 3382589 - RNA, 17 nt, Human
cucaggcaugccugugu

SEQ ID NO: 3382590 - RNA, 18 nt, Human
cucaggcaugccugugug

SEQ ID NO: 3382591 - RNA, 19 nt, Human
cucaggccaaacucaccug

SEQ ID NO: 3382592 - RNA, 15 nt, Human
cucaggccacaccgg

SEQ ID NO: 3382593 - RNA, 16 nt, Human
cucaggccaccugccc

SEQ ID NO: 3382594 - RNA, 16 nt, Human
cucaggccagcugcuu

SEQ ID NO: 3382595 - RNA, 15 nt, Human
cucaggccaggugca

SEQ ID NO: 3382596 - RNA, 18 nt, Human
cucaggccaggugcagug

SEQ ID NO: 3382597 - RNA, 21 nt, Human
cucaggcccccaccuggcuca

SEQ ID NO: 3382598 - RNA, 20 nt, Human
cucaggccggcagccccagc

SEQ ID NO: 3382599 - RNA, 11 nt, Human
cucaggccugg

SEQ ID NO: 3382600 - RNA, 13 nt, Human
cucaggccugggg

SEQ ID NO: 3382601 - RNA, 22 nt, Human
cucaggccugggggcugggcag

SEQ ID NO: 3382602 - RNA, 20 nt, Human
cucaggcgauccaccugucu

SEQ ID NO: 3382603 - RNA, 13 nt, Human
cucaggcucucca

SEQ ID NO: 3382604 - RNA, 13 nt, Human
cucaggcucugcc

SEQ ID NO: 3382605 - RNA, 15 nt, Human
cucaggcucugcccu

SEQ ID NO: 3382606 - RNA, 13 nt, Human
cucaggcugcagc

SEQ ID NO: 3382607 - RNA, 16 nt, Human
cucaggcugcagcugg

SEQ ID NO: 3382608 - RNA, 17 nt, Human
cucaggcugcagcugga

SEQ ID NO: 3382609 - RNA, 22 nt, Human
cucaggcugcagcuggacagag

SEQ ID NO: 3382610 - RNA, 16 nt, Human
cucaggcugccugagu

SEQ ID NO: 3382611 - RNA, 11 nt, Human
cucaggcugcu

SEQ ID NO: 3382612 - RNA, 12 nt, Human
cucaggcugcug

SEQ ID NO: 3382613 - RNA, 24 nt, Human
cucaggcugcuggggccucagacg

SEQ ID NO: 3382614 - RNA, 20 nt, Human
cucaggcuguuuuugggugc

SEQ ID NO: 3382615 - RNA, 17 nt, Human
cucaggcuuccuuggca

SEQ ID NO: 3382616 - RNA, 21 nt, Human
cucaggcuuucacuauuuccu

SEQ ID NO: 3382617 - RNA, 22 nt, Human
cucagggaaaagcagcucuccc

SEQ ID NO: 3382618 - RNA, 17 nt, Human
cucagggaaaggccagu

SEQ ID NO: 3382619 - RNA, 18 nt, Human
cucagggaagcccagcuc

SEQ ID NO: 3382620 - RNA, 14 nt, Human
cucagggacagaga

SEQ ID NO: 3382621 - RNA, 14 nt, Human
cucagggacagagc

SEQ ID NO: 3382622 - RNA, 19 nt, Human
cucagggacagagccaugc

SEQ ID NO: 3382623 - RNA, 15 nt, Human
cucagggaccacagc

SEQ ID NO: 3382624 - RNA, 16 nt, Human
cucagggcaaagccag

SEQ ID NO: 3382625 - RNA, 10 nt, Human
cucagggcag

SEQ ID NO: 3382626 - RNA, 21 nt, Human
cucagggcagccucccccggc

SEQ ID NO: 3382627 - RNA, 18 nt, Human
cucagggccaggccucuc

SEQ ID NO: 3382628 - RNA, 20 nt, Human
cucagggccaugccugcccc

SEQ ID NO: 3382629 - RNA, 13 nt, Human
cucagggccccag

SEQ ID NO: 3382630 - RNA, 18 nt, Human
cucagggccccagcacua

SEQ ID NO: 3382631 - RNA, 13 nt, Human
cucagggccuggc

SEQ ID NO: 3382632 - RNA, 14 nt, Human
cucagggccugguc

SEQ ID NO: 3382633 - RNA, 19 nt, Human
cucagggcuccucccagcu

SEQ ID NO: 3382634 - RNA, 13 nt, Human
cucagggcuccug

SEQ ID NO: 3382635 - RNA, 15 nt, Human
cucagggcuccugcc

SEQ ID NO: 3382636 - RNA, 14 nt, Human
cucagggcuccuug

SEQ ID NO: 3382637 - RNA, 14 nt, Human
cucaggggcagcuc

SEQ ID NO: 3382638 - RNA, 17 nt, Human
cucaggggccugcccag

SEQ ID NO: 3382639 - RNA, 17 nt, Human
cucaggggcguguggcu

SEQ ID NO: 3382640 - RNA, 16 nt, Human
cucaggggcuguuuga

SEQ ID NO: 3382641 - RNA, 14 nt, Human
cucagggggcgccu

SEQ ID NO: 3382642 - RNA, 19 nt, Human
cucagggggcgccuguggu

SEQ ID NO: 3382643 - RNA, 16 nt, Human
cucagggucccuggug

SEQ ID NO: 3382644 - RNA, 14 nt, Human
cucagggucucugc

SEQ ID NO: 3382645 - RNA, 15 nt, Human
cucagggugcagagg

SEQ ID NO: 3382646 - RNA, 20 nt, Human
cucagguaaucgaccugccu

SEQ ID NO: 3382647 - RNA, 16 nt, Human
cucagguacagagaag

SEQ ID NO: 3382648 - RNA, 21 nt, Human
cucagguacagagaaggaaug

SEQ ID NO: 3382649 - RNA, 19 nt, Human
cucaggucagggugaggau

SEQ ID NO: 3382650 - RNA, 20 nt, Human
cucaggucagggugaggaug

SEQ ID NO: 3382651 - RNA, 19 nt, Human
cucaggugagaagcagagg

SEQ ID NO: 3382652 - RNA, 18 nt, Human
cucaggugauccacccac

SEQ ID NO: 3382653 - RNA, 19 nt, Human
cucaggugauccacccacc

SEQ ID NO: 3382654 - RNA, 20 nt, Human
cucaggugauccacccaccu

SEQ ID NO: 3382655 - RNA, 22 nt, Human
cucaggugauccacccaccuca

SEQ ID NO: 3382656 - RNA, 20 nt, Human
cucaggugauccaccugccu

SEQ ID NO: 3382657 - RNA, 21 nt, Human
cucagguggccagccuggauc

SEQ ID NO: 3382658 - RNA, 14 nt, Human
cucaggugggcccu

SEQ ID NO: 3382659 - RNA, 13 nt, Human
cucaggugggcgu

SEQ ID NO: 3382660 - RNA, 21 nt, Human
cucagguggggucacucuggc

SEQ ID NO: 3382661 - RNA, 15 nt, Human
cucaggugucccugc

SEQ ID NO: 3382662 - RNA, 19 nt, Human
cucaggugucccugcacuu

SEQ ID NO: 3382663 - RNA, 22 nt, Human
cucagguugcugguugcugugu

SEQ ID NO: 3382664 - RNA, 20 nt, Human
cucagguuugccugagggcg

SEQ ID NO: 3382665 - RNA, 20 nt, Human
cucaguaaacgggaacaugc

SEQ ID NO: 3382666 - RNA, 21 nt, Human
cucaguaaacgggaacaugcc

SEQ ID NO: 3382667 - RNA, 19 nt, Human
cucaguaagacgacaagga

SEQ ID NO: 3382668 - RNA, 13 nt, Human
cucaguaauuuag

SEQ ID NO: 3382669 - RNA, 18 nt, Human
cucaguauauuuaaacuc

SEQ ID NO: 3382670 - RNA, 17 nt, Human
cucaguaugaauuauuc

SEQ ID NO: 3382671 - RNA, 23 nt, Human
cucagucaugcauaaauaugcag

SEQ ID NO: 3382672 - RNA, 17 nt, Human
cucaguccaccugagcu

SEQ ID NO: 3382673 - RNA, 15 nt, Human
cucaguccauuuaua

SEQ ID NO: 3382674 - RNA, 12 nt, Human
cucaguccucaa

SEQ ID NO: 3382675 - RNA, 19 nt, Human
cucaguccucaaagcuuuu

SEQ ID NO: 3382676 - RNA, 16 nt, Human
cucaguccuccccuca

SEQ ID NO: 3382677 - RNA, 13 nt, Human
cuauuuaaagaaa

SEQ ID NO: 3382678 - RNA, 14 nt, Human
cuauuuaaauucuu

SEQ ID NO: 3382679 - RNA, 9 nt, Human
cuauuuaag

SEQ ID NO: 3382680 - RNA, 12 nt, Human
cuauuuaauauu

SEQ ID NO: 3382681 - RNA, 15 nt, Human
cuauuuaauauuuau

SEQ ID NO: 3382682 - RNA, 11 nt, Human
cuauuuaaugg

SEQ ID NO: 3382683 - RNA, 21 nt, Human
cuauuuaauuaggaaaaaaac

SEQ ID NO: 3382684 - RNA, 20 nt, Human
cuauuuaguuuuuguaauuu

SEQ ID NO: 3382685 - RNA, 23 nt, Human
cuauuuaguuuuuguaauuuauu

SEQ ID NO: 3382686 - RNA, 21 nt, Human
cuauuuauaauacagaaucuu

SEQ ID NO: 3382687 - RNA, 21 nt, Human
cuauuuaucuguaguaaacua

SEQ ID NO: 3382688 - RNA, 14 nt, Human
cuauuuaucuucau

SEQ ID NO: 3382689 - RNA, 13 nt, Human
cuauuuauuaaua

SEQ ID NO: 3382690 - RNA, 12 nt, Human
cuauuuauuuau

SEQ ID NO: 3382691 - RNA, 17 nt, Human
cuauuuauuuuccuaaa

SEQ ID NO: 3382692 - RNA, 21 nt, Human
cuauuuauuuuccuaaagaga

SEQ ID NO: 3382693 - RNA, 18 nt, Human
cuauuucaaaaauuugga

SEQ ID NO: 3382694 - RNA, 16 nt, Human
cuauuucacuggagca

SEQ ID NO: 3382695 - RNA, 17 nt, Human
cuauuucacuggagcac

SEQ ID NO: 3382696 - RNA, 12 nt, Human
cuauuucagaag

SEQ ID NO: 3382697 - RNA, 19 nt, Human
cuauuucagaaguuuaaau

SEQ ID NO: 3382698 - RNA, 19 nt, Human
cuauuucaguacuucagca

SEQ ID NO: 3382699 - RNA, 19 nt, Human
cuauuucaguguuaccugu

SEQ ID NO: 3382700 - RNA, 14 nt, Human
cuauuucaucacaa

SEQ ID NO: 3382701 - RNA, 23 nt, Human
cuauuucaucagaacagcuguug

SEQ ID NO: 3382702 - RNA, 17 nt, Human
cuauuucauguuuuuga

SEQ ID NO: 3382703 - RNA, 14 nt, Human
cuauuuccauucca

SEQ ID NO: 3382704 - RNA, 17 nt, Human
cuauuuccauuccagaa

SEQ ID NO: 3382705 - RNA, 15 nt, Human
cuauuucccaagcug

SEQ ID NO: 3382706 - RNA, 23 nt, Human
cuauuuccccaggggaaaaugaa

SEQ ID NO: 3382707 - RNA, 16 nt, Human
cuauuucccccuuucu

SEQ ID NO: 3382708 - RNA, 13 nt, Human
cuauuucggccuu

SEQ ID NO: 3382709 - RNA, 14 nt, Human
cuauuucuauauuu

SEQ ID NO: 3382710 - RNA, 15 nt, Human
cuauuucuaugagaa

SEQ ID NO: 3382711 - RNA, 12 nt, Human
cuauuucucuuu

SEQ ID NO: 3382712 - RNA, 14 nt, Human
cuauuucucuuucu

SEQ ID NO: 3382713 - RNA, 13 nt, Human
cuauuucugagaa

SEQ ID NO: 3382714 - RNA, 12 nt, Human
cuauuucugcug

SEQ ID NO: 3382715 - RNA, 16 nt, Human
cuauuugagacuccuc

SEQ ID NO: 3382716 - RNA, 14 nt, Human
cuccauccaaggcc

SEQ ID NO: 3382717 - RNA, 22 nt, Human
cuccaucccaacagccaugccc

SEQ ID NO: 3382718 - RNA, 15 nt, Human
cuccaucccucuaau

SEQ ID NO: 3382719 - RNA, 22 nt, Human
cuccaucccucuaaugagacug

SEQ ID NO: 3382720 - RNA, 15 nt, Human
cuccaucccuggccc

SEQ ID NO: 3382721 - RNA, 16 nt, Human
cuccauccuaccacaa

SEQ ID NO: 3382722 - RNA, 23 nt, Human
cuccauccuacccccugugccuu

SEQ ID NO: 3382723 - RNA, 19 nt, Human
cuccauccuccuccuuccu

SEQ ID NO: 3382724 - RNA, 14 nt, Human
aaauaauuuaacua

SEQ ID NO: 3382725 - RNA, 18 nt, Human
aaauaauuuaacuacccu

SEQ ID NO: 3382726 - RNA, 16 nt, Human
aaauaauuuacuguga

SEQ ID NO: 3382727 - RNA, 17 nt, Human
aaauaauuuuaaaaaug

SEQ ID NO: 3382728 - RNA, 18 nt, Human
aaauaauuuuaaacaaag

SEQ ID NO: 3382729 - RNA, 22 nt, Human
aaauaauuuuaugaacugcaug

SEQ ID NO: 3382730 - RNA, 14 nt, Human
aaauaauuuuguaa

SEQ ID NO: 3382731 - RNA, 15 nt, Human
aaauaauuuuuauau

SEQ ID NO: 3382732 - RNA, 23 nt, Human
aaauaauuuuuauauuugaaaua

SEQ ID NO: 3382733 - RNA, 15 nt, Human
aaauacaaaacuucc

SEQ ID NO: 3382734 - RNA, 12 nt, Human
aaauacaaacaa

SEQ ID NO: 3382735 - RNA, 19 nt, Human
aaauacaacuuaaauaaua

SEQ ID NO: 3382736 - RNA, 14 nt, Human
aaauacaagacugc

SEQ ID NO: 3382737 - RNA, 13 nt, Human
aaauacaauuuug

SEQ ID NO: 3382738 - RNA, 14 nt, Human
aaauacaauuuugu

SEQ ID NO: 3382739 - RNA, 22 nt, Human
aaauacaauuuuguuucuguac

SEQ ID NO: 3382740 - RNA, 20 nt, Human
aaauacaauuuuuauuucuu

SEQ ID NO: 3382741 - RNA, 17 nt, Human
aaauacacaaguaaaca

SEQ ID NO: 3382742 - RNA, 15 nt, Human
aaauacacacucaaa

SEQ ID NO: 3382743 - RNA, 12 nt, Human
aaauacacauuu

SEQ ID NO: 3382744 - RNA, 13 nt, Human
aaauacacauuug

SEQ ID NO: 3382745 - RNA, 15 nt, Human
aaauacacauuugcu

SEQ ID NO: 3382746 - RNA, 22 nt, Human
aaauacacauuugcuacuguug

SEQ ID NO: 3382747 - RNA, 17 nt, Human
aaauacagacacuaagu

SEQ ID NO: 3382748 - RNA, 17 nt, Human
aaauacagauuuugaua

SEQ ID NO: 3382749 - RNA, 23 nt, Human
aaauacagauuuugauagcaaag

SEQ ID NO: 3382750 - RNA, 22 nt, Human
aaauacagucuuccauuugcaa

SEQ ID NO: 3382751 - RNA, 15 nt, Human
aaauacauagugaaa

SEQ ID NO: 3382752 - RNA, 17 nt, Human
aaauacauagugaaaau

SEQ ID NO: 3382753 - RNA, 21 nt, Human
aaauacauaucgcugacuuca

SEQ ID NO: 3382754 - RNA, 12 nt, Human
aaauacaugaag

SEQ ID NO: 3382755 - RNA, 14 nt, Human
aaauacaugaagcu

SEQ ID NO: 3382756 - RNA, 20 nt, Human
aaauacaugaugauuucaga

SEQ ID NO: 3382757 - RNA, 13 nt, Human
aaauacaugcuaa

SEQ ID NO: 3382758 - RNA, 18 nt, Human
aaauacauucuuuuugcu

SEQ ID NO: 3382759 - RNA, 17 nt, Human
aaauacauuuaaaacau

SEQ ID NO: 3382760 - RNA, 20 nt, Human
aaauaccacaaucaccgaug

SEQ ID NO: 3382761 - RNA, 19 nt, Human
aaauaccagccaguaaaug

SEQ ID NO: 3382762 - RNA, 20 nt, Human
aaauaccagccaguaaaugg

SEQ ID NO: 3382763 - RNA, 17 nt, Human
aaauaccagugugguuu

SEQ ID NO: 3382764 - RNA, 22 nt, Human
aaauaccauuuaguaagaauac

SEQ ID NO: 3382765 - RNA, 18 nt, Human
aaauaccccaucauucau

SEQ ID NO: 3382766 - RNA, 21 nt, Human
aaauacccguuaccauauuua

SEQ ID NO: 3382767 - RNA, 21 nt, Human
aaauaccucaggaaagaauag

SEQ ID NO: 3382768 - RNA, 17 nt, Human
aaauaccucauguuuau

SEQ ID NO: 3382769 - RNA, 22 nt, Human
aaauaccucauguuuaugaaaa

SEQ ID NO: 3382770 - RNA, 21 nt, Human
aaauacgugggcauucaaaug

SEQ ID NO: 3382771 - RNA, 22 nt, Human
aaauacgugggcauucaaaugu

SEQ ID NO: 3382772 - RNA, 15 nt, Human
aaauacuacuccugu

SEQ ID NO: 3382773 - RNA, 21 nt, Human
aaauacuauuuaagaugugaa

SEQ ID NO: 3382774 - RNA, 16 nt, Human
aaauacuauuuuuacu

SEQ ID NO: 3382775 - RNA, 21 nt, Human
aaauacucauguguaugggca

SEQ ID NO: 3382776 - RNA, 18 nt, Human
aaauacucuaauucuaac

SEQ ID NO: 3382777 - RNA, 22 nt, Human
aaauacucuaauucuaaccaga

SEQ ID NO: 3382778 - RNA, 11 nt, Human
aaauacuguag

SEQ ID NO: 3382779 - RNA, 17 nt, Human
aaauacuguagauaauu

SEQ ID NO: 3382780 - RNA, 20 nt, Human
aaauacuguguuucagaagc

SEQ ID NO: 3382781 - RNA, 15 nt, Human
aaauacuuaaauguu

SEQ ID NO: 3382782 - RNA, 20 nt, Human
aaauacuuaaauguuaugua

SEQ ID NO: 3382783 - RNA, 14 nt, Human
aaauacuuagcaaa

SEQ ID NO: 3382784 - RNA, 15 nt, Human
aaauacuuauucauu

SEQ ID NO: 3382785 - RNA, 22 nt, Human
aaauacuugucaauauuuaaac

SEQ ID NO: 3382786 - RNA, 17 nt, Human
aaauacuuuuacucugc

SEQ ID NO: 3382787 - RNA, 17 nt, Human
aaauagaaaaguuauua

SEQ ID NO: 3382788 - RNA, 14 nt, Human
aaauagaaaauggu

SEQ ID NO: 3382789 - RNA, 12 nt, Human
aaauagaaauuu

SEQ ID NO: 3382790 - RNA, 14 nt, Human
aaauagaauguaaa

SEQ ID NO: 3382791 - RNA, 17 nt, Human
aaauagaauguaaaugu

SEQ ID NO: 3382792 - RNA, 19 nt, Human
aaauagaauguaaaugucu

SEQ ID NO: 3382793 - RNA, 21 nt, Human
aaauagauaagaguagaaacu

SEQ ID NO: 3382794 - RNA, 21 nt, Human
aaauagaugucuuuuauagug

SEQ ID NO: 3382795 - RNA, 16 nt, Human
aaauagcaaaagaaga

SEQ ID NO: 3382796 - RNA, 15 nt, Human
aaauagcaacaugcu

SEQ ID NO: 3382797 - RNA, 18 nt, Human
aaauagcauguauugugu

SEQ ID NO: 3382798 - RNA, 22 nt, Human
aaauagcauguauugugucuuu

SEQ ID NO: 3382799 - RNA, 23 nt, Human
aaauagccacuuaccuucaauaa

SEQ ID NO: 3382800 - RNA, 20 nt, Human
aaauagcguucuuguaauuu

SEQ ID NO: 3382801 - RNA, 21 nt, Human
aaauagcguucuuguaauuuu

SEQ ID NO: 3382802 - RNA, 19 nt, Human
aaauagcuaauaauguuaa

SEQ ID NO: 3382803 - RNA, 18 nt, Human
aaauagcuagacugguga

SEQ ID NO: 3382804 - RNA, 12 nt, Human
aaauagcuauau

SEQ ID NO: 3382805 - RNA, 15 nt, Human
aaauagcuuaugaaa

SEQ ID NO: 3382806 - RNA, 16 nt, Human
aaauagcuuaugaaaa

SEQ ID NO: 3382807 - RNA, 16 nt, Human
aaauaggaaacaagug

SEQ ID NO: 3382808 - RNA, 18 nt, Human
aaauaggagggaaaccuu

SEQ ID NO: 3382809 - RNA, 14 nt, Human
aaauaggcuuuuua

SEQ ID NO: 3382810 - RNA, 20 nt, Human
aaauaggguauauuuuccua

SEQ ID NO: 3382811 - RNA, 16 nt, Human
aaauaguaugaaaaug

SEQ ID NO: 3382812 - RNA, 15 nt, Human
aaauaguauuugcau

SEQ ID NO: 3382813 - RNA, 22 nt, Human
aaauagugacauaauauauucu

SEQ ID NO: 3382814 - RNA, 21 nt, Human
aaauagugcagaaucucauag

SEQ ID NO: 3382815 - RNA, 21 nt, Human
aaauaguguggaaauuaagaa

SEQ ID NO: 3382816 - RNA, 22 nt, Human
aaauaguuaagacaugauuucc

SEQ ID NO: 3382817 - RNA, 20 nt, Human
aaauaguugagccagcagac

SEQ ID NO: 3382818 - RNA, 20 nt, Human
aaauaguugcauagcaguau

SEQ ID NO: 3382819 - RNA, 23 nt, Human
aaauaguugcauagcaguauaug

SEQ ID NO: 3382820 - RNA, 23 nt, Human
aaauaguuguccauauuuucaca

SEQ ID NO: 3382821 - RNA, 12 nt, Human
aaauaguuuguu

SEQ ID NO: 3382822 - RNA, 12 nt, Human
aaauauaaaacu

SEQ ID NO: 3382823 - RNA, 12 nt, Human
aaauauaaaaua

SEQ ID NO: 3382824 - RNA, 13 nt, Human
aaauauaaaauau

SEQ ID NO: 3382825 - RNA, 18 nt, Human
aaauauaaaauuaugaga

SEQ ID NO: 3382826 - RNA, 23 nt, Human
aaauauaaacaaagauucaugau

SEQ ID NO: 3382827 - RNA, 13 nt, Human
aaauauaaacauc

SEQ ID NO: 3382828 - RNA, 13 nt, Human
aaauauaaagacg

SEQ ID NO: 3382829 - RNA, 19 nt, Human
aaauauaaagcaucuaaac

SEQ ID NO: 3382830 - RNA, 16 nt, Human
aaauauaacacauuuu

SEQ ID NO: 3382831 - RNA, 17 nt, Human
aaauauaacacauuuuu

SEQ ID NO: 3382832 - RNA, 14 nt, Human
aaauauaagaauaa

SEQ ID NO: 3382833 - RNA, 13 nt, Human
aaauauaauucug

SEQ ID NO: 3382834 - RNA, 14 nt, Human
aaauauaauugaca

SEQ ID NO: 3382835 - RNA, 15 nt, Human
aaauauacaaaacuu

SEQ ID NO: 3382836 - RNA, 15 nt, Human
aaauauacacacagc

SEQ ID NO: 3382837 - RNA, 16 nt, Human
aaauauacauguuuau

SEQ ID NO: 3382838 - RNA, 17 nt, Human
aaauauacauguuuaug

SEQ ID NO: 3382839 - RNA, 20 nt, Human
aaauauacauguuuauguaa

SEQ ID NO: 3382840 - RNA, 20 nt, Human
aaauauaccacucuuuaccu

SEQ ID NO: 3382841 - RNA, 23 nt, Human
aaauauacuguaaagaaagagag

SEQ ID NO: 3382842 - RNA, 18 nt, Human
aaauauacuuaaauggaa

SEQ ID NO: 3382843 - RNA, 13 nt, Human
aaauauacuuuua

SEQ ID NO: 3382844 - RNA, 17 nt, Human
aaauauagcuguacaaa

SEQ ID NO: 3382845 - RNA, 20 nt, Human
aaauauagcuguacaaauau

SEQ ID NO: 3382846 - RNA, 15 nt, Human
aaauauaggaacuua

SEQ ID NO: 3382847 - RNA, 9 nt, Human
aaauauaua

SEQ ID NO: 3382848 - RNA, 14 nt, Human
aaauauauaaauau

SEQ ID NO: 3382849 - RNA, 15 nt, Human
aaauauauaaauaua

SEQ ID NO: 3382850 - RNA, 16 nt, Human
aaauauauaaauauau

SEQ ID NO: 3382851 - RNA, 18 nt, Human
aaauauauaaauauauau

SEQ ID NO: 3382852 - RNA, 13 nt, Human
aaauauauacauu

SEQ ID NO: 3382853 - RNA, 18 nt, Human
aaauauauacgaacaaaa

SEQ ID NO: 3382854 - RNA, 12 nt, Human
aaauauauacua

SEQ ID NO: 3382855 - RNA, 15 nt, Human
aaauauauauacaua

SEQ ID NO: 3382856 - RNA, 18 nt, Human
aaauauauauacauaugu

SEQ ID NO: 3382857 - RNA, 20 nt, Human
aaauauauauauauauaaaa

SEQ ID NO: 3382858 - RNA, 14 nt, Human
aaauauauaucaaa

SEQ ID NO: 3382859 - RNA, 22 nt, Human
aaauauauaucuaucuauuuga

SEQ ID NO: 3382860 - RNA, 23 nt, Human
aaauauauauguguguguauguu

SEQ ID NO: 3382861 - RNA, 23 nt, Human
cuccccugugccagcccagaggc

SEQ ID NO: 3382862 - RNA, 12 nt, Human
cuccccuucccc

SEQ ID NO: 3382863 - RNA, 23 nt, Human
cuccccuucgcguauuucaggau

SEQ ID NO: 3382864 - RNA, 12 nt, Human
cuccccuucucu

SEQ ID NO: 3382865 - RNA, 16 nt, Human
cuccccuugagcugag

SEQ ID NO: 3382866 - RNA, 13 nt, Human
cuccccuugccag

SEQ ID NO: 3382867 - RNA, 22 nt, Human
cuccccuuucccucgcuaugug

SEQ ID NO: 3382868 - RNA, 23 nt, Human
cucccgaauagcugggacuacag

SEQ ID NO: 3382869 - RNA, 16 nt, Human
cucccgaccucaggug

SEQ ID NO: 3382870 - RNA, 12 nt, Human
cucccgagcucc

SEQ ID NO: 3382871 - RNA, 14 nt, Human
cucccgagcuccuc

SEQ ID NO: 3382872 - RNA, 15 nt, Human
cucccgaguagcugg

SEQ ID NO: 3382873 - RNA, 19 nt, Human
cucccgaguagcugggacu

SEQ ID NO: 3382874 - RNA, 20 nt, Human
cucccgaguagggaggacca

SEQ ID NO: 3382875 - RNA, 21 nt, Human
cucccgcccaaaccuuucccc

SEQ ID NO: 3382876 - RNA, 23 nt, Human
cucccgccccccacacuucccug

SEQ ID NO: 3382877 - RNA, 15 nt, Human
cucccgcuccgggcu

SEQ ID NO: 3382878 - RNA, 13 nt, Human
cucccgcugcugc

SEQ ID NO: 3382879 - RNA, 14 nt, Human
cucccgcugcugcu

SEQ ID NO: 3382880 - RNA, 17 nt, Human
cucccgcugcugcugcu

SEQ ID NO: 3382881 - RNA, 20 nt, Human
cucccggagguugggugggc

SEQ ID NO: 3382882 - RNA, 18 nt, Human
cucccggcacuccaugcu

SEQ ID NO: 3382883 - RNA, 19 nt, Human
cucccggcaugggaaagcc

SEQ ID NO: 3382884 - RNA, 19 nt, Human
cucccgggacucacuggca

SEQ ID NO: 3382885 - RNA, 22 nt, Human
cucccgggcccucccuuggaaa

SEQ ID NO: 3382886 - RNA, 17 nt, Human
cucccggguccuuggcc

SEQ ID NO: 3382887 - RNA, 15 nt, Human
cucccggugcccaag

SEQ ID NO: 3382888 - RNA, 14 nt, Human
cucccgucagggcc

SEQ ID NO: 3382889 - RNA, 16 nt, Human
cucccgucagggccca

SEQ ID NO: 3382890 - RNA, 22 nt, Human
cucccguguaggaaccugcaca

SEQ ID NO: 3382891 - RNA, 13 nt, Human
cucccuaccaccu

SEQ ID NO: 3382892 - RNA, 14 nt, Human
cucccuaccaccuc

SEQ ID NO: 3382893 - RNA, 15 nt, Human
cucccuaccaccucc

SEQ ID NO: 3382894 - RNA, 19 nt, Human
cucaggaaccgaggcaggg

SEQ ID NO: 3382895 - RNA, 15 nt, Human
cucaggaaugggcug

SEQ ID NO: 3382896 - RNA, 13 nt, Human
cucaggacacagg

SEQ ID NO: 3382897 - RNA, 16 nt, Human
cucaggacacaggccu

SEQ ID NO: 3382898 - RNA, 17 nt, Human
cucaggacacaggccug

SEQ ID NO: 3382899 - RNA, 14 nt, Human
cucaggacagaugc

SEQ ID NO: 3382900 - RNA, 21 nt, Human
cucaggaccaaagcuuucaug

SEQ ID NO: 3382901 - RNA, 12 nt, Human
cucaggaccagg

SEQ ID NO: 3382902 - RNA, 15 nt, Human
cucaggaccaggcaa

SEQ ID NO: 3382903 - RNA, 16 nt, Human
cucaggaccugggacc

SEQ ID NO: 3382904 - RNA, 15 nt, Human
cucaggacuccagcc

SEQ ID NO: 3382905 - RNA, 16 nt, Human
cucaggacuccagccc

SEQ ID NO: 3382906 - RNA, 16 nt, Human
cucaggacugcaacag

SEQ ID NO: 3382907 - RNA, 19 nt, Human
cucaggacugcaacaggcu

SEQ ID NO: 3382908 - RNA, 14 nt, Human
cucaggacugggag

SEQ ID NO: 3382909 - RNA, 23 nt, Human
cucaggacugggagcccccagcc

SEQ ID NO: 3382910 - RNA, 17 nt, Human
cucaggagcacaggcag

SEQ ID NO: 3382911 - RNA, 18 nt, Human
cucaggagcacaggcagc

SEQ ID NO: 3382912 - RNA, 16 nt, Human
cucaggagcccuggga

SEQ ID NO: 3382913 - RNA, 20 nt, Human
cucaggagcccugggaggcu

SEQ ID NO: 3382914 - RNA, 23 nt, Human
cucaggagcccugggaggcucug

SEQ ID NO: 3382915 - RNA, 24 nt, Human
cucaggagcccugggaggcucugg

SEQ ID NO: 3382916 - RNA, 21 nt, Human
cucaggagccgaagcccaggg

SEQ ID NO: 3382917 - RNA, 14 nt, Human
cucaggagccugug

SEQ ID NO: 3382918 - RNA, 16 nt, Human
cucaggaggcaggacc

SEQ ID NO: 3382919 - RNA, 17 nt, Human
cucaggaggcaggaccu

SEQ ID NO: 3382920 - RNA, 18 nt, Human
cucaggaggcaggaccuu

SEQ ID NO: 3382921 - RNA, 19 nt, Human
cucaggaggcgcccuuggc

SEQ ID NO: 3382922 - RNA, 18 nt, Human
cucaggaguuugagacca

SEQ ID NO: 3382923 - RNA, 20 nt, Human
cucaggauauccuuaucaga

SEQ ID NO: 3382924 - RNA, 22 nt, Human
cucaggauauccuuaucagagc

SEQ ID NO: 3382925 - RNA, 13 nt, Human
cucaggaucucuu

SEQ ID NO: 3382926 - RNA, 15 nt, Human
cucaggaugcccagg

SEQ ID NO: 3382927 - RNA, 15 nt, Human
cucaggcacacagcu

SEQ ID NO: 3382928 - RNA, 18 nt, Human
cucaggcacuagccuuug

SEQ ID NO: 3382929 - RNA, 23 nt, Human
cucaggcacuagccuuuggcucu

SEQ ID NO: 3382930 - RNA, 15 nt, Human
cucaggcagcucaag

SEQ ID NO: 3382931 - RNA, 18 nt, Human
cucaggcaggggccucca

SEQ ID NO: 3382932 - RNA, 18 nt, Human
cucaggcaggugggaugg

SEQ ID NO: 3382933 - RNA, 16 nt, Human
cucaggcauaggccug

SEQ ID NO: 3382934 - RNA, 17 nt, Human
cucaggcauaggccugg

SEQ ID NO: 3382935 - RNA, 20 nt, Human
cucaggcauaggccugggug

SEQ ID NO: 3382936 - RNA, 23 nt, Human
cucaggcauaggccugggugcug

SEQ ID NO: 3382937 - RNA, 19 nt, Human
cucaggccaacaagccaac

SEQ ID NO: 3382938 - RNA, 18 nt, Human
cucaggccaccugccccc

SEQ ID NO: 3382939 - RNA, 13 nt, Human
cucaggccagagc

SEQ ID NO: 3382940 - RNA, 18 nt, Human
cucaggccagagccaagg

SEQ ID NO: 3382941 - RNA, 15 nt, Human
cucaggccagcugcu

SEQ ID NO: 3382942 - RNA, 18 nt, Human
cucaggccagcugcuugg

SEQ ID NO: 3382943 - RNA, 20 nt, Human
cucaggccagcugcuugggc

SEQ ID NO: 3382944 - RNA, 20 nt, Human
cucaggcccccaccuggcuc

SEQ ID NO: 3382945 - RNA, 22 nt, Human
cucaggcccccaccuggcucac

SEQ ID NO: 3382946 - RNA, 19 nt, Human
cucaggccggcagccccag

SEQ ID NO: 3382947 - RNA, 13 nt, Human
cucaggccucugu

SEQ ID NO: 3382948 - RNA, 14 nt, Human
cucaggccuggggg

SEQ ID NO: 3382949 - RNA, 16 nt, Human
cucaggccugggggcu

SEQ ID NO: 3382950 - RNA, 21 nt, Human
cucaggccugggggcugggca

SEQ ID NO: 3382951 - RNA, 21 nt, Human
cucaggcgauccaccugucuc

SEQ ID NO: 3382952 - RNA, 17 nt, Human
cucaggcugaccacuuu

SEQ ID NO: 3382953 - RNA, 20 nt, Human
cucaggcugcagcuggacag

SEQ ID NO: 3382954 - RNA, 12 nt, Human
cucaggcugccu

SEQ ID NO: 3382955 - RNA, 13 nt, Human
cucaggcugccug

SEQ ID NO: 3382956 - RNA, 22 nt, Human
cucaggcuuucacuauuuccuu

SEQ ID NO: 3382957 - RNA, 17 nt, Human
cucagggaaaagcagcu

SEQ ID NO: 3382958 - RNA, 16 nt, Human
cucagggaagcccagc

SEQ ID NO: 3382959 - RNA, 17 nt, Human
cucagggaagcccagcu

SEQ ID NO: 3382960 - RNA, 19 nt, Human
cucagggaagcccagcucc

SEQ ID NO: 3382961 - RNA, 20 nt, Human
cucagggaagcccagcucca

SEQ ID NO: 3382962 - RNA, 20 nt, Human
cucagggacagagacaccug

SEQ ID NO: 3382963 - RNA, 22 nt, Human
cucagggacagagacaccugca

SEQ ID NO: 3382964 - RNA, 15 nt, Human
cucagggacagagcc

SEQ ID NO: 3382965 - RNA, 12 nt, Human
cucagggaccac

SEQ ID NO: 3382966 - RNA, 16 nt, Human
cucagggaccacagca

SEQ ID NO: 3382967 - RNA, 19 nt, Human
cucagggaccacagcaagg

SEQ ID NO: 3382968 - RNA, 18 nt, Human
cucagggagcagggaagg

SEQ ID NO: 3382969 - RNA, 18 nt, Human
cucagggcaaagccaggu

SEQ ID NO: 3382970 - RNA, 22 nt, Human
cucagggcaaagccaggucccu

SEQ ID NO: 3382971 - RNA, 16 nt, Human
cucagggcagccugcc

SEQ ID NO: 3382972 - RNA, 19 nt, Human
cucagggccaugcugaggc

SEQ ID NO: 3382973 - RNA, 12 nt, Human
cucagggcccca

SEQ ID NO: 3382974 - RNA, 14 nt, Human
cucagggccuggcu

SEQ ID NO: 3382975 - RNA, 15 nt, Human
cucagggccuggcuc

SEQ ID NO: 3382976 - RNA, 15 nt, Human
cucagggcucccagg

SEQ ID NO: 3382977 - RNA, 16 nt, Human
cucagggcucccaggg

SEQ ID NO: 3382978 - RNA, 17 nt, Human
cucagggcuccucccag

SEQ ID NO: 3382979 - RNA, 21 nt, Human
cucagggcuccucccagcuug

SEQ ID NO: 3382980 - RNA, 14 nt, Human
cucagggcuccugc

SEQ ID NO: 3382981 - RNA, 17 nt, Human
cucagggcuccuggguu

SEQ ID NO: 3382982 - RNA, 17 nt, Human
cucagggcuucuaguuu

SEQ ID NO: 3382983 - RNA, 13 nt, Human
cucaggggcagcu

SEQ ID NO: 3382984 - RNA, 20 nt, Human
cucaggggccagaggaacug

SEQ ID NO: 3382985 - RNA, 18 nt, Human
cucaggggcccuggagca

SEQ ID NO: 3382986 - RNA, 14 nt, Human
cucaggggcuguuu

SEQ ID NO: 3382987 - RNA, 19 nt, Human
cucaggggcuguuugagga

SEQ ID NO: 3382988 - RNA, 14 nt, Human
cucagggucccugg

SEQ ID NO: 3382989 - RNA, 17 nt, Human
cucagggucccuggugg

SEQ ID NO: 3382990 - RNA, 20 nt, Human
cucagggucccugguggcag

SEQ ID NO: 3382991 - RNA, 24 nt, Human
cucagggucccugguggcagcuca

SEQ ID NO: 3382992 - RNA, 13 nt, Human
cucagggucucug

SEQ ID NO: 3382993 - RNA, 17 nt, Human
cucagggucucugcugc

SEQ ID NO: 3382994 - RNA, 19 nt, Human
cucagggucucugcugccg

SEQ ID NO: 3382995 - RNA, 14 nt, Human
cucaggguguccca

SEQ ID NO: 3382996 - RNA, 23 nt, Human
cucagguagaagguugacacagu

SEQ ID NO: 3382997 - RNA, 20 nt, Human
cucaggucccuggggcuagg

SEQ ID NO: 3382998 - RNA, 14 nt, Human
cucaggugagaagc

SEQ ID NO: 3382999 - RNA, 20 nt, Human
cucaggugagaagcagagga

SEQ ID NO: 3383000 - RNA, 23 nt, Human
cucaggugauccacccaccucag

SEQ ID NO: 3383001 - RNA, 20 nt, Human
cucaggugaucuaccugccu

SEQ ID NO: 3383002 - RNA, 16 nt, Human
cucaggugcuggggcc

SEQ ID NO: 3383003 - RNA, 20 nt, Human
cucagguggccagccuggau

SEQ ID NO: 3383004 - RNA, 18 nt, Human
cucagguggccaugccuc

SEQ ID NO: 3383005 - RNA, 18 nt, Human
cccagccccuacugcugu

SEQ ID NO: 3383006 - RNA, 13 nt, Human
cccagccccuaga

SEQ ID NO: 3383007 - RNA, 14 nt, Human
cccagccccuagaa

SEQ ID NO: 3383008 - RNA, 19 nt, Human
cccagccccuagaaaccca

SEQ ID NO: 3383009 - RNA, 22 nt, Human
cccagccccuagaaacccaagc

SEQ ID NO: 3383010 - RNA, 17 nt, Human
cccagccccuagcccag

SEQ ID NO: 3383011 - RNA, 19 nt, Human
cccagccccuagcccagga

SEQ ID NO: 3383012 - RNA, 20 nt, Human
cccagccccuagcccaggag

SEQ ID NO: 3383013 - RNA, 11 nt, Human
cccagccccuu

SEQ ID NO: 3383014 - RNA, 16 nt, Human
cccagcccggcuccca

SEQ ID NO: 3383015 - RNA, 17 nt, Human
cccagcccuauggaugu

SEQ ID NO: 3383016 - RNA, 19 nt, Human
cccagcccucaucccgagc

SEQ ID NO: 3383017 - RNA, 23 nt, Human
cccagcccuccuuaucaaaggac

SEQ ID NO: 3383018 - RNA, 10 nt, Human
cccagcccug

SEQ ID NO: 3383019 - RNA, 13 nt, Human
cccagcccugcug

SEQ ID NO: 3383020 - RNA, 15 nt, Human
cccagcccugcuggg

SEQ ID NO: 3383021 - RNA, 14 nt, Human
cccagcccuggucu

SEQ ID NO: 3383022 - RNA, 18 nt, Human
cccagcccuggucucagc

SEQ ID NO: 3383023 - RNA, 15 nt, Human
cccagcccuguggaa

SEQ ID NO: 3383024 - RNA, 21 nt, Human
cccagcccuuugggaggcuga

SEQ ID NO: 3383025 - RNA, 19 nt, Human
cccagccgacccccucucc

SEQ ID NO: 3383026 - RNA, 17 nt, Human
cccagccggccucucug

SEQ ID NO: 3383027 - RNA, 18 nt, Human
cccagccggccucucugg

SEQ ID NO: 3383028 - RNA, 21 nt, Human
cccagccggccucucuggccu

SEQ ID NO: 3383029 - RNA, 20 nt, Human
cccagccucagcgcggcccu

SEQ ID NO: 3383030 - RNA, 16 nt, Human
cccagccucccugaag

SEQ ID NO: 3383031 - RNA, 15 nt, Human
cccagccucuuuccc

SEQ ID NO: 3383032 - RNA, 18 nt, Human
cccagccugcgccugcug

SEQ ID NO: 3383033 - RNA, 22 nt, Human
cccagccugcgccugcugcaug

SEQ ID NO: 3383034 - RNA, 19 nt, Human
cccagccuggaugccaucc

SEQ ID NO: 3383035 - RNA, 21 nt, Human
cccagccuggccacgcagcca

SEQ ID NO: 3383036 - RNA, 13 nt, Human
cccagccuggccc

SEQ ID NO: 3383037 - RNA, 15 nt, Human
cccagccuggcccag

SEQ ID NO: 3383038 - RNA, 20 nt, Human
cccagccuggcccagcuccc

SEQ ID NO: 3383039 - RNA, 23 nt, Human
cccagccugggauaggggcagag

SEQ ID NO: 3383040 - RNA, 18 nt, Human
cccagccugggccuaugg

SEQ ID NO: 3383041 - RNA, 19 nt, Human
cccagccugggccuaugga

SEQ ID NO: 3383042 - RNA, 11 nt, Human
cccagccuguc

SEQ ID NO: 3383043 - RNA, 18 nt, Human
cccagccugucagaucca

SEQ ID NO: 3383044 - RNA, 23 nt, Human
cccagccuucuuugcuugccucu

SEQ ID NO: 3383045 - RNA, 15 nt, Human
cccagcgagcccugg

SEQ ID NO: 3383046 - RNA, 18 nt, Human
cccagcgagcccuggugg

SEQ ID NO: 3383047 - RNA, 16 nt, Human
cccagcgagggcccca

SEQ ID NO: 3383048 - RNA, 23 nt, Human
cccagcgauucccucucccaggc

SEQ ID NO: 3383049 - RNA, 16 nt, Human
cccagcgcucugccuc

SEQ ID NO: 3383050 - RNA, 20 nt, Human
cccagcgugaagccagggcc

SEQ ID NO: 3383051 - RNA, 15 nt, Human
cccagcguggccucc

SEQ ID NO: 3383052 - RNA, 22 nt, Human
cccagcuacucagaagccugag

SEQ ID NO: 3383053 - RNA, 14 nt, Human
cccagcuacucagg

SEQ ID NO: 3383054 - RNA, 20 nt, Human
cccagcuacucaggaggcug

SEQ ID NO: 3383055 - RNA, 15 nt, Human
cccagcuacuuggga

SEQ ID NO: 3383056 - RNA, 20 nt, Human
cccagcuauaccugugccuc

SEQ ID NO: 3383057 - RNA, 21 nt, Human
cccagcuaugguucucucgca

SEQ ID NO: 3383058 - RNA, 13 nt, Human
cccagcucagggg

SEQ ID NO: 3383059 - RNA, 18 nt, Human
cccagcucaggggcagcu

SEQ ID NO: 3383060 - RNA, 20 nt, Human
cccagcucaggggcagcuca

SEQ ID NO: 3383061 - RNA, 15 nt, Human
cccagcuccagggcc

SEQ ID NO: 3383062 - RNA, 16 nt, Human
cccagcuccagggcca

SEQ ID NO: 3383063 - RNA, 16 nt, Human
cccagcucccaccucc

SEQ ID NO: 3383064 - RNA, 13 nt, Human
cccagcucccagg

SEQ ID NO: 3383065 - RNA, 17 nt, Human
cccagcuccggccuguc

SEQ ID NO: 3383066 - RNA, 12 nt, Human
cccagcuccuga

SEQ ID NO: 3383067 - RNA, 20 nt, Human
cccagcuccugacacugcug

SEQ ID NO: 3383068 - RNA, 22 nt, Human
cccagcuccugacacugcugga

SEQ ID NO: 3383069 - RNA, 16 nt, Human
cccagcucgcgggacc

SEQ ID NO: 3383070 - RNA, 14 nt, Human
cccagcucucccuc

SEQ ID NO: 3383071 - RNA, 15 nt, Human
cccagcucucccucu

SEQ ID NO: 3383072 - RNA, 16 nt, Human
cccagcucucccucug

SEQ ID NO: 3383073 - RNA, 17 nt, Human
cccagcucucccucugg

SEQ ID NO: 3383074 - RNA, 19 nt, Human
cccagcucucccucuggcc

SEQ ID NO: 3383075 - RNA, 12 nt, Human
cccagcucugaa

SEQ ID NO: 3383076 - RNA, 18 nt, Human
cccagcucugaggacugc

SEQ ID NO: 3383077 - RNA, 22 nt, Human
cccagcucugaggacugcacca

SEQ ID NO: 3383078 - RNA, 13 nt, Human
cccagcucugguc

SEQ ID NO: 3383079 - RNA, 14 nt, Human
cccagcucuggucc

SEQ ID NO: 3383080 - RNA, 15 nt, Human
cccagcucuggucca

SEQ ID NO: 3383081 - RNA, 18 nt, Human
cccagcucugguccauag

SEQ ID NO: 3383082 - RNA, 21 nt, Human
cccagcugacaguccucucca

SEQ ID NO: 3383083 - RNA, 12 nt, Human
cccagcugcacc

SEQ ID NO: 3383084 - RNA, 13 nt, Human
cccagcugcaccc

SEQ ID NO: 3383085 - RNA, 13 nt, Human
cccagcugcaccu

SEQ ID NO: 3383086 - RNA, 18 nt, Human
cccagcugcaccugccag

SEQ ID NO: 3383087 - RNA, 21 nt, Human
cccagcugcaccugccagccu

SEQ ID NO: 3383088 - RNA, 12 nt, Human
cccagcugcccc

SEQ ID NO: 3383089 - RNA, 21 nt, Human
cccagcugccccucccugcca

SEQ ID NO: 3383090 - RNA, 14 nt, Human
cccagcugcucccc

SEQ ID NO: 3383091 - RNA, 15 nt, Human
cccagcugcuccccu

SEQ ID NO: 3383092 - RNA, 21 nt, Human
cccagcugcuccccucccucc

SEQ ID NO: 3383093 - RNA, 12 nt, Human
cccagcugcucu

SEQ ID NO: 3383094 - RNA, 23 nt, Human
cccagcugcucugcccagagcug

SEQ ID NO: 3383095 - RNA, 17 nt, Human
cuccuguaagccaaaga

SEQ ID NO: 3383096 - RNA, 14 nt, Human
cuccuguaauuccu

SEQ ID NO: 3383097 - RNA, 18 nt, Human
cuccuguaauuccuaccu

SEQ ID NO: 3383098 - RNA, 16 nt, Human
cuccuguaccucuuga

SEQ ID NO: 3383099 - RNA, 21 nt, Human
cuccuguccucccauccccug

SEQ ID NO: 3383100 - RNA, 17 nt, Human
cuccugucuaacugcug

SEQ ID NO: 3383101 - RNA, 13 nt, Human
cuccugucugcca

SEQ ID NO: 3383102 - RNA, 14 nt, Human
cuccugucugccag

SEQ ID NO: 3383103 - RNA, 15 nt, Human
cuccugucugccagc

SEQ ID NO: 3383104 - RNA, 16 nt, Human
cuccugucugccagcc

SEQ ID NO: 3383105 - RNA, 22 nt, Human
cuccugucugccagccagcagc

SEQ ID NO: 3383106 - RNA, 23 nt, Human
cuccugucugccagccagcagcc

SEQ ID NO: 3383107 - RNA, 19 nt, Human
cuccugucuucccagggua

SEQ ID NO: 3383108 - RNA, 14 nt, Human
cuccugugcccaca

SEQ ID NO: 3383109 - RNA, 12 nt, Human
cuccugugcccu

SEQ ID NO: 3383110 - RNA, 11 nt, Human
cuccugugcua

SEQ ID NO: 3383111 - RNA, 14 nt, Human
cuccugugcucagc

SEQ ID NO: 3383112 - RNA, 16 nt, Human
cuccugugcucagccc

SEQ ID NO: 3383113 - RNA, 20 nt, Human
cuccugugcucagcccugag

SEQ ID NO: 3383114 - RNA, 13 nt, Human
cuccugugcuggg

SEQ ID NO: 3383115 - RNA, 19 nt, Human
cuccuguggccccacccug

SEQ ID NO: 3383116 - RNA, 21 nt, Human
cuccuguggccccacccuggg

SEQ ID NO: 3383117 - RNA, 16 nt, Human
cuccuguggggaaagg

SEQ ID NO: 3383118 - RNA, 13 nt, Human
cuccuguguacag

SEQ ID NO: 3383119 - RNA, 15 nt, Human
cuccuguguacugug

SEQ ID NO: 3383120 - RNA, 16 nt, Human
cuccuguguacugugu

SEQ ID NO: 3383121 - RNA, 17 nt, Human
cuccuguguacuguguc

SEQ ID NO: 3383122 - RNA, 18 nt, Human
cuccuguguagcugggau

SEQ ID NO: 3383123 - RNA, 15 nt, Human
cuccugugucuugca

SEQ ID NO: 3383124 - RNA, 16 nt, Human
cuccugugugugcgcc

SEQ ID NO: 3383125 - RNA, 19 nt, Human
cuccugugugugcgccuac

SEQ ID NO: 3383126 - RNA, 23 nt, Human
cuccugugugugcgccuacagga

SEQ ID NO: 3383127 - RNA, 14 nt, Human
cuccuguugggaga

SEQ ID NO: 3383128 - RNA, 18 nt, Human
cuccuguuuauucccauc

SEQ ID NO: 3383129 - RNA, 19 nt, Human
cuccuguuuugcacagcca

SEQ ID NO: 3383130 - RNA, 20 nt, Human
cuccuuaacacugagcuguc

SEQ ID NO: 3383131 - RNA, 13 nt, Human
cuccuuaaggcuc

SEQ ID NO: 3383132 - RNA, 14 nt, Human
cuccuuagaaaaaa

SEQ ID NO: 3383133 - RNA, 21 nt, Human
cuccuuagagacaucaaaauc

SEQ ID NO: 3383134 - RNA, 15 nt, Human
cuccuuagcugccaa

SEQ ID NO: 3383135 - RNA, 20 nt, Human
cuccuuaggguuuucucucu

SEQ ID NO: 3383136 - RNA, 16 nt, Human
cuccuuagucuucuca

SEQ ID NO: 3383137 - RNA, 17 nt, Human
cuccuuagucuucucau

SEQ ID NO: 3383138 - RNA, 19 nt, Human
cuccuuagucuucucauag

SEQ ID NO: 3383139 - RNA, 23 nt, Human
cuccuuauggguagggcucugac

SEQ ID NO: 3383140 - RNA, 19 nt, Human
cuccuuauuuggcgugacc

SEQ ID NO: 3383141 - RNA, 20 nt, Human
cuccuucaacaaggcuugcu

SEQ ID NO: 3383142 - RNA, 14 nt, Human
cuccuucagacacc

SEQ ID NO: 3383143 - RNA, 16 nt, Human
cuccuuccaccucccu

SEQ ID NO: 3383144 - RNA, 16 nt, Human
cuccuuccagcuagug

SEQ ID NO: 3383145 - RNA, 14 nt, Human
cuccuuccaguguc

SEQ ID NO: 3383146 - RNA, 17 nt, Human
cuccuucccacucuucu

SEQ ID NO: 3383147 - RNA, 13 nt, Human
cuccuucccagcu

SEQ ID NO: 3383148 - RNA, 19 nt, Human
cuccuucccucucuggaga

SEQ ID NO: 3383149 - RNA, 14 nt, Human
cuccuucccuugcu

SEQ ID NO: 3383150 - RNA, 11 nt, Human
cuccuuccugc

SEQ ID NO: 3383151 - RNA, 16 nt, Human
cccaggagcccauuug

SEQ ID NO: 3383152 - RNA, 22 nt, Human
cccaggagcccauuuggagggc

SEQ ID NO: 3383153 - RNA, 13 nt, Human
cccaggagccccg

SEQ ID NO: 3383154 - RNA, 14 nt, Human
cccaggagccccga

SEQ ID NO: 3383155 - RNA, 13 nt, Human
cccaggagcuccc

SEQ ID NO: 3383156 - RNA, 20 nt, Human
cccaggagcuccccucccca

SEQ ID NO: 3383157 - RNA, 19 nt, Human
cccaggaggacucccugcu

SEQ ID NO: 3383158 - RNA, 22 nt, Human
cccaggaggcagggaggcagcc

SEQ ID NO: 3383159 - RNA, 16 nt, Human
cccaggaggccagccu

SEQ ID NO: 3383160 - RNA, 24 nt, Human
cccaggaguucgaggcugcaguca

SEQ ID NO: 3383161 - RNA, 18 nt, Human
cccaggaguucugcucau

SEQ ID NO: 3383162 - RNA, 23 nt, Human
cccaggaguuugaggcugcagcg

SEQ ID NO: 3383163 - RNA, 15 nt, Human
cccaggaguuuggcc

SEQ ID NO: 3383164 - RNA, 20 nt, Human
cccaggaguuuggccagaag

SEQ ID NO: 3383165 - RNA, 17 nt, Human
cccaggauauauuuuau

SEQ ID NO: 3383166 - RNA, 15 nt, Human
cccaggauccccaag

SEQ ID NO: 3383167 - RNA, 12 nt, Human
cccaggcaggga

SEQ ID NO: 3383168 - RNA, 15 nt, Human
cccaggcagggccaa

SEQ ID NO: 3383169 - RNA, 13 nt, Human
cccaggccaggac

SEQ ID NO: 3383170 - RNA, 18 nt, Human
cccaggccaggacucugc

SEQ ID NO: 3383171 - RNA, 23 nt, Human
cccaggccaggacucugcagccu

SEQ ID NO: 3383172 - RNA, 18 nt, Human
cccaggccaggcuccuuc

SEQ ID NO: 3383173 - RNA, 14 nt, Human
cccaggccaguaag

SEQ ID NO: 3383174 - RNA, 14 nt, Human
cccaggccaucuuc

SEQ ID NO: 3383175 - RNA, 18 nt, Human
cccaggccaucuuccagg

SEQ ID NO: 3383176 - RNA, 22 nt, Human
cccaggccaucuuccagguggg

SEQ ID NO: 3383177 - RNA, 18 nt, Human
cccaggcccacugugccu

SEQ ID NO: 3383178 - RNA, 18 nt, Human
cccaggccccaggaagcc

SEQ ID NO: 3383179 - RNA, 14 nt, Human
cccaggccccauga

SEQ ID NO: 3383180 - RNA, 16 nt, Human
cccaggccccaugacc

SEQ ID NO: 3383181 - RNA, 20 nt, Human
cccaggccccaugaccucca

SEQ ID NO: 3383182 - RNA, 22 nt, Human
cccaggccccaugaccuccagc

SEQ ID NO: 3383183 - RNA, 11 nt, Human
cccaggccccu

SEQ ID NO: 3383184 - RNA, 16 nt, Human
cccaggccccugccac

SEQ ID NO: 3383185 - RNA, 16 nt, Human
cccaggccgcagcucu

SEQ ID NO: 3383186 - RNA, 13 nt, Human
cccaggccggcca

SEQ ID NO: 3383187 - RNA, 14 nt, Human
cccaggccuauguu

SEQ ID NO: 3383188 - RNA, 21 nt, Human
cccaggccuauguugauccau

SEQ ID NO: 3383189 - RNA, 17 nt, Human
cccaggccuccagcuca

SEQ ID NO: 3383190 - RNA, 18 nt, Human
cccaggccuccagcucag

SEQ ID NO: 3383191 - RNA, 17 nt, Human
cccaggccuccuacagc

SEQ ID NO: 3383192 - RNA, 16 nt, Human
cccaggccugccuguu

SEQ ID NO: 3383193 - RNA, 14 nt, Human
cccaggcugagccu

SEQ ID NO: 3383194 - RNA, 18 nt, Human
cccaggcugagccucagu

SEQ ID NO: 3383195 - RNA, 15 nt, Human
cccaggcugccgucc

SEQ ID NO: 3383196 - RNA, 22 nt, Human
cccaggcugccguccccuagag

SEQ ID NO: 3383197 - RNA, 20 nt, Human
cccaggcugccugagcaccu

SEQ ID NO: 3383198 - RNA, 19 nt, Human
cccaggcuggacaugcuga

SEQ ID NO: 3383199 - RNA, 21 nt, Human
cccaggcuggacaugcugacu

SEQ ID NO: 3383200 - RNA, 13 nt, Human
cccaggcuggagu

SEQ ID NO: 3383201 - RNA, 20 nt, Human
cccaggcuggagugcaauga

SEQ ID NO: 3383202 - RNA, 15 nt, Human
cccaggcuggccagc

SEQ ID NO: 3383203 - RNA, 17 nt, Human
cccaggcuggccagccc

SEQ ID NO: 3383204 - RNA, 13 nt, Human
cccaggcuggcgu

SEQ ID NO: 3383205 - RNA, 17 nt, Human
cccaggcuggcgugcag

SEQ ID NO: 3383206 - RNA, 19 nt, Human
cccaggcuggcgugcagug

SEQ ID NO: 3383207 - RNA, 12 nt, Human
cccaggcugggc

SEQ ID NO: 3383208 - RNA, 16 nt, Human
cccaggcuggucuuga

SEQ ID NO: 3383209 - RNA, 21 nt, Human
cccaggcugugcagcgcagcu

SEQ ID NO: 3383210 - RNA, 22 nt, Human
cccaggcuuagucacugagaca

SEQ ID NO: 3383211 - RNA, 15 nt, Human
cccagggaagcagca

SEQ ID NO: 3383212 - RNA, 19 nt, Human
cccagggaagcagcagccu

SEQ ID NO: 3383213 - RNA, 23 nt, Human
cccagggaagcagcagccucgcc

SEQ ID NO: 3383214 - RNA, 14 nt, Human
cccagggacaccag

SEQ ID NO: 3383215 - RNA, 15 nt, Human
cccagggacaccagc

SEQ ID NO: 3383216 - RNA, 18 nt, Human
cccagggacaccagccag

SEQ ID NO: 3383217 - RNA, 14 nt, Human
cccagggagaggcc

SEQ ID NO: 3383218 - RNA, 16 nt, Human
cccagggcacaggagc

SEQ ID NO: 3383219 - RNA, 13 nt, Human
cccagggcacgug

SEQ ID NO: 3383220 - RNA, 15 nt, Human
cccagggcagccagg

SEQ ID NO: 3383221 - RNA, 16 nt, Human
cccagggcaucuggga

SEQ ID NO: 3383222 - RNA, 18 nt, Human
cccagggccagggcccug

SEQ ID NO: 3383223 - RNA, 20 nt, Human
cccagggccagggcccugca

SEQ ID NO: 3383224 - RNA, 14 nt, Human
cccagggcccagag

SEQ ID NO: 3383225 - RNA, 15 nt, Human
cccagggcccagagc

SEQ ID NO: 3383226 - RNA, 16 nt, Human
cccagggcccagagcc

SEQ ID NO: 3383227 - RNA, 23 nt, Human
cccagggcccucggugggagcca

SEQ ID NO: 3383228 - RNA, 13 nt, Human
cccagggccugag

SEQ ID NO: 3383229 - RNA, 14 nt, Human
cccagggcucagcc

SEQ ID NO: 3383230 - RNA, 17 nt, Human
cccagggcucugcccca

SEQ ID NO: 3383231 - RNA, 18 nt, Human
cccagggcucugccccag

SEQ ID NO: 3383232 - RNA, 17 nt, Human
cccagggcugggaggaa

SEQ ID NO: 3383233 - RNA, 20 nt, Human
cccagggcugggaggaagga

SEQ ID NO: 3383234 - RNA, 17 nt, Human
cccagggcugucaucug

SEQ ID NO: 3383235 - RNA, 17 nt, Human
cccaggggaaaaugaag

SEQ ID NO: 3383236 - RNA, 19 nt, Human
cccaggggaacacugggga

SEQ ID NO: 3383237 - RNA, 15 nt, Human
cccaggggagagggu

SEQ ID NO: 3383238 - RNA, 16 nt, Human
cccaggggagcccucc

SEQ ID NO: 3383239 - RNA, 16 nt, Human
cccaggggaggcggca

SEQ ID NO: 3383240 - RNA, 23 nt, Human
cccaggggaggcggcacuccaac

SEQ ID NO: 3383241 - RNA, 18 nt, Human
cccaggggcccacaggga

SEQ ID NO: 3383242 - RNA, 23 nt, Human
cccaggggcucccuccgccccca

SEQ ID NO: 3383243 - RNA, 19 nt, Human
cccagggggcaugaccaga

SEQ ID NO: 3383244 - RNA, 18 nt, Human
cccaggggucucccuggc

SEQ ID NO: 3383245 - RNA, 21 nt, Human
cccaggggucucccuggcucc

SEQ ID NO: 3383246 - RNA, 17 nt, Human
cccaggggugcccccuc

SEQ ID NO: 3383247 - RNA, 15 nt, Human
cccaggguagcccgc

SEQ ID NO: 3383248 - RNA, 17 nt, Human
cccaggguagcccgccu

SEQ ID NO: 3383249 - RNA, 16 nt, Human
cccagggucuucccua

SEQ ID NO: 3383250 - RNA, 23 nt, Human
cccagggucuucccuaccucagg

SEQ ID NO: 3383251 - RNA, 22 nt, Human
cccaggguggacuuagaaagca

SEQ ID NO: 3383252 - RNA, 18 nt, Human
cccaggguggagugcagu

SEQ ID NO: 3383253 - RNA, 19 nt, Human
cccagggugggaagggcua

SEQ ID NO: 3383254 - RNA, 15 nt, Human
cccagguagcuggga

SEQ ID NO: 3383255 - RNA, 20 nt, Human
cccagguaggccaagguguc

SEQ ID NO: 3383256 - RNA, 20 nt, Human
cccagguaggggccccucuc

SEQ ID NO: 3383257 - RNA, 23 nt, Human
cccagguaggggccccucucagc

SEQ ID NO: 3383258 - RNA, 14 nt, Human
cccaggucauggaa

SEQ ID NO: 3383259 - RNA, 18 nt, Human
cccagguccagcucugga

SEQ ID NO: 3383260 - RNA, 23 nt, Human
cucccaucuuaacucuuugccuu

SEQ ID NO: 3383261 - RNA, 20 nt, Human
cucccaucuuuuguuacucu

SEQ ID NO: 3383262 - RNA, 13 nt, Human
cucccaugaagcc

SEQ ID NO: 3383263 - RNA, 14 nt, Human
cucccaugaagccu

SEQ ID NO: 3383264 - RNA, 17 nt, Human
cucccaugaagccuuuu

SEQ ID NO: 3383265 - RNA, 22 nt, Human
cucccaugaagccuuuugaaag

SEQ ID NO: 3383266 - RNA, 21 nt, Human
cucccaugaccauacugaggg

SEQ ID NO: 3383267 - RNA, 18 nt, Human
cucccaugagggagaugc

SEQ ID NO: 3383268 - RNA, 24 nt, Human
cucccaugagggagaugccaugag

SEQ ID NO: 3383269 - RNA, 15 nt, Human
cucccauggagcccc

SEQ ID NO: 3383270 - RNA, 18 nt, Human
cucccauggagccccagc

SEQ ID NO: 3383271 - RNA, 14 nt, Human
cucccauggcaccu

SEQ ID NO: 3383272 - RNA, 21 nt, Human
cucccauggcuuaaugcuucu

SEQ ID NO: 3383273 - RNA, 17 nt, Human
cucccaugucacugcag

SEQ ID NO: 3383274 - RNA, 12 nt, Human
cucccauuucua

SEQ ID NO: 3383275 - RNA, 21 nt, Human
cuccccaaaucaauacacuag

SEQ ID NO: 3383276 - RNA, 11 nt, Human
cuccccaaccc

SEQ ID NO: 3383277 - RNA, 15 nt, Human
cuccccaacccccaa

SEQ ID NO: 3383278 - RNA, 15 nt, Human
cuccccaacccccau

SEQ ID NO: 3383279 - RNA, 20 nt, Human
cuccccaacugaccaccuuu

SEQ ID NO: 3383280 - RNA, 18 nt, Human
cuccccacaggagcccug

SEQ ID NO: 3383281 - RNA, 19 nt, Human
cuccccaccaccccagcug

SEQ ID NO: 3383282 - RNA, 16 nt, Human
cuccccacccuccugg

SEQ ID NO: 3383283 - RNA, 15 nt, Human
cuccccaccuccagg

SEQ ID NO: 3383284 - RNA, 15 nt, Human
cuccccacgagggcu

SEQ ID NO: 3383285 - RNA, 18 nt, Human
cuccccacgagggcuggc

SEQ ID NO: 3383286 - RNA, 12 nt, Human
cuccccacgccc

SEQ ID NO: 3383287 - RNA, 15 nt, Human
cuccccacgcccucc

SEQ ID NO: 3383288 - RNA, 12 nt, Human
cuccccacucug

SEQ ID NO: 3383289 - RNA, 19 nt, Human
cuccccacucugcucugau

SEQ ID NO: 3383290 - RNA, 21 nt, Human
cuccccacucugcucugaugc

SEQ ID NO: 3383291 - RNA, 22 nt, Human
cuccccacucugcucugaugca

SEQ ID NO: 3383292 - RNA, 23 nt, Human
cuccccagaauucacgccucucc

SEQ ID NO: 3383293 - RNA, 23 nt, Human
cuccccagcaagugagagcuggg

SEQ ID NO: 3383294 - RNA, 19 nt, Human
cuccccagcagguggggag

SEQ ID NO: 3383295 - RNA, 14 nt, Human
cucccuccaccuac

SEQ ID NO: 3383296 - RNA, 17 nt, Human
cucccuccaccucccug

SEQ ID NO: 3383297 - RNA, 19 nt, Human
cucccuccaccucccugca

SEQ ID NO: 3383298 - RNA, 20 nt, Human
cucccuccaccucccugcaa

SEQ ID NO: 3383299 - RNA, 18 nt, Human
cucccucccagagcaccu

SEQ ID NO: 3383300 - RNA, 18 nt, Human
cucccucccccugccccu

SEQ ID NO: 3383301 - RNA, 16 nt, Human
cucccuccccgucuca

SEQ ID NO: 3383302 - RNA, 13 nt, Human
cucccuccccugc

SEQ ID NO: 3383303 - RNA, 18 nt, Human
cucccuccccuugccugu

SEQ ID NO: 3383304 - RNA, 15 nt, Human
cucccucccucuccg

SEQ ID NO: 3383305 - RNA, 18 nt, Human
cucccuccgggucuuccu

SEQ ID NO: 3383306 - RNA, 19 nt, Human
cucccuccgggucuuccua

SEQ ID NO: 3383307 - RNA, 15 nt, Human
cucccuccucaccuc

SEQ ID NO: 3383308 - RNA, 12 nt, Human
cucccuccucca

SEQ ID NO: 3383309 - RNA, 19 nt, Human
cucccuccuuccuucuugc

SEQ ID NO: 3383310 - RNA, 18 nt, Human
cucccucgaacccacacu

SEQ ID NO: 3383311 - RNA, 10 nt, Human
cucccucuca

SEQ ID NO: 3383312 - RNA, 18 nt, Human
cucccucucaacacccag

SEQ ID NO: 3383313 - RNA, 22 nt, Human
cucccucucacugucugagagu

SEQ ID NO: 3383314 - RNA, 22 nt, Human
cucccucucccccuuaccccac

SEQ ID NO: 3383315 - RNA, 19 nt, Human
cucccucuccgacucacac

SEQ ID NO: 3383316 - RNA, 15 nt, Human
cucccucuccugccu

SEQ ID NO: 3383317 - RNA, 23 nt, Human
cucccucugccccucccccagcc

SEQ ID NO: 3383318 - RNA, 14 nt, Human
cucccucugccggc

SEQ ID NO: 3383319 - RNA, 22 nt, Human
cucccucugccugaaccuucca

SEQ ID NO: 3383320 - RNA, 14 nt, Human
cucccucuggauca

SEQ ID NO: 3383321 - RNA, 16 nt, Human
cucccucuggaucaaa

SEQ ID NO: 3383322 - RNA, 18 nt, Human
cucccucuggcccugccu

SEQ ID NO: 3383323 - RNA, 17 nt, Human
cucccucuuguuuuguu

SEQ ID NO: 3383324 - RNA, 19 nt, Human
cucccugaaccaucccuga

SEQ ID NO: 3383325 - RNA, 17 nt, Human
cucccugaagccagccu

SEQ ID NO: 3383326 - RNA, 20 nt, Human
cucccugaaguaagcaaaga

SEQ ID NO: 3383327 - RNA, 15 nt, Human
cucccugacccugca

SEQ ID NO: 3383328 - RNA, 16 nt, Human
cucccugacccugcag

SEQ ID NO: 3383329 - RNA, 18 nt, Human
cucccugacccugcagag

SEQ ID NO: 3383330 - RNA, 21 nt, Human
cucccugacccugcagagaug

SEQ ID NO: 3383331 - RNA, 14 nt, Human
cucccugacccugu

SEQ ID NO: 3383332 - RNA, 22 nt, Human
cucccugacugggggcagacau

SEQ ID NO: 3383333 - RNA, 12 nt, Human
cucccugagaug

SEQ ID NO: 3383334 - RNA, 20 nt, Human
cucccugcaucugaccagca

SEQ ID NO: 3383335 - RNA, 23 nt, Human
cucccugcaucugaccagcagcg

SEQ ID NO: 3383336 - RNA, 19 nt, Human
cucccugccagaggggaag

SEQ ID NO: 3383337 - RNA, 18 nt, Human
cucccugccgccucaaug

SEQ ID NO: 3383338 - RNA, 19 nt, Human
cucccugccgccucaaugu

SEQ ID NO: 3383339 - RNA, 18 nt, Human
cucccugccucaggccuc

SEQ ID NO: 3383340 - RNA, 15 nt, Human
cucccugccuggccc

SEQ ID NO: 3383341 - RNA, 18 nt, Human
cucccugccuggccccca

SEQ ID NO: 3383342 - RNA, 19 nt, Human
cucccugcuguccccucuu

SEQ ID NO: 3383343 - RNA, 20 nt, Human
cucccugcuguccccucuug

SEQ ID NO: 3383344 - RNA, 18 nt, Human
cucccuggagccagacuc

SEQ ID NO: 3383345 - RNA, 21 nt, Human
cucccuggagccagacucugg

SEQ ID NO: 3383346 - RNA, 18 nt, Human
cucccuggaucagaacag

SEQ ID NO: 3383347 - RNA, 21 nt, Human
cucccuggcagcacaggaaaa

SEQ ID NO: 3383348 - RNA, 13 nt, Human
cucccuggcccuc

SEQ ID NO: 3383349 - RNA, 14 nt, Human
cucccuggcccuca

SEQ ID NO: 3383350 - RNA, 15 nt, Human
cucccuggccuguuc

SEQ ID NO: 3383351 - RNA, 19 nt, Human
cucccuggccuguucuguu

SEQ ID NO: 3383352 - RNA, 14 nt, Human
cucccuggcucccu

SEQ ID NO: 3383353 - RNA, 16 nt, Human
cucccuggcucucaga

SEQ ID NO: 3383354 - RNA, 13 nt, Human
cucccuggcugcc

SEQ ID NO: 3383355 - RNA, 14 nt, Human
cucccuggcugccc

SEQ ID NO: 3383356 - RNA, 18 nt, Human
cucccuggcugcccuggc

SEQ ID NO: 3383357 - RNA, 19 nt, Human
cucccuggcugcccuggcc

SEQ ID NO: 3383358 - RNA, 11 nt, Human
cucccuggggg

SEQ ID NO: 3383359 - RNA, 15 nt, Human
cucccuggugcuuau

SEQ ID NO: 3383360 - RNA, 18 nt, Human
cucccuggugcuuaugcu

SEQ ID NO: 3383361 - RNA, 22 nt, Human
cucccuggugcuuaugcucuua

SEQ ID NO: 3383362 - RNA, 14 nt, Human
cucccuguccaccc

SEQ ID NO: 3383363 - RNA, 14 nt, Human
cucccuguccuccu

SEQ ID NO: 3383364 - RNA, 17 nt, Human
cucccugucggccuggu

SEQ ID NO: 3383365 - RNA, 13 nt, Human
cucccuguuauuu

SEQ ID NO: 3383366 - RNA, 19 nt, Human
cucccuguugacgaagucu

SEQ ID NO: 3383367 - RNA, 22 nt, Human
cucccuguugacgaagucucuu

SEQ ID NO: 3383368 - RNA, 22 nt, Human
cucccuguuugaagccugcccu

SEQ ID NO: 3383369 - RNA, 20 nt, Human
cucccuucaaccauucccca

SEQ ID NO: 3383370 - RNA, 23 nt, Human
cucccuucaaccauuccccaugg

SEQ ID NO: 3383371 - RNA, 13 nt, Human
cucccuucagccc

SEQ ID NO: 3383372 - RNA, 18 nt, Human
cucccuucagcccccagc

SEQ ID NO: 3383373 - RNA, 15 nt, Human
cucccuucauccuuc

SEQ ID NO: 3383374 - RNA, 13 nt, Human
cucccuucccucc

SEQ ID NO: 3383375 - RNA, 16 nt, Human
cucccuucccuccucc

SEQ ID NO: 3383376 - RNA, 21 nt, Human
cucccuuccgacccucuggga

SEQ ID NO: 3383377 - RNA, 22 nt, Human
cucccuuccuaugcuguucacu

SEQ ID NO: 3383378 - RNA, 13 nt, Human
cucccuuccuccc

SEQ ID NO: 3383379 - RNA, 19 nt, Human
cucccuuccuuuucccugc

SEQ ID NO: 3383380 - RNA, 20 nt, Human
cucccuuccuuuucccugcu

SEQ ID NO: 3383381 - RNA, 21 nt, Human
cucccuucgguggaagagcuc

SEQ ID NO: 3383382 - RNA, 15 nt, Human
cucccuucuaccugc

SEQ ID NO: 3383383 - RNA, 17 nt, Human
cucccuucuacugcuuc

SEQ ID NO: 3383384 - RNA, 16 nt, Human
cucccuucucccugga

SEQ ID NO: 3383385 - RNA, 21 nt, Human
cucccuucuccuugauaacag

SEQ ID NO: 3383386 - RNA, 13 nt, Human
cucccuucugcua

SEQ ID NO: 3383387 - RNA, 16 nt, Human
cucccuucugcuacug

SEQ ID NO: 3383388 - RNA, 14 nt, Human
cucccuucuucccu

SEQ ID NO: 3383389 - RNA, 17 nt, Human
cucccuuggauuguccc

SEQ ID NO: 3383390 - RNA, 18 nt, Human
cucccuugggcucccugu

SEQ ID NO: 3383391 - RNA, 21 nt, Human
cucccuugggcucugaugaaa

SEQ ID NO: 3383392 - RNA, 23 nt, Human
cucccuugggcucugaugaaaaa

SEQ ID NO: 3383393 - RNA, 19 nt, Human
cucccuuggggccuaugca

SEQ ID NO: 3383394 - RNA, 18 nt, Human
cucccuuggguucugaua

SEQ ID NO: 3383395 - RNA, 17 nt, Human
cucccuuuccuuccuaa

SEQ ID NO: 3383396 - RNA, 20 nt, Human
cucccuuuuaauccuggcug

SEQ ID NO: 3383397 - RNA, 14 nt, Human
cucccuuuuuauau

SEQ ID NO: 3383398 - RNA, 15 nt, Human
cuccgaaaugcuguc

SEQ ID NO: 3383399 - RNA, 22 nt, Human
cuccgaacacccucgaagcgcg

SEQ ID NO: 3383400 - RNA, 22 nt, Human
cuccgacuugugcacaggcaga

SEQ ID NO: 3383401 - RNA, 14 nt, Human
cuccgagagguggg

SEQ ID NO: 3383402 - RNA, 15 nt, Human
cuccgaggacccagg

SEQ ID NO: 3383403 - RNA, 13 nt, Human
cuccgaggccagu

SEQ ID NO: 3383404 - RNA, 18 nt, Human
cuccgagugaacuggucu

SEQ ID NO: 3383405 - RNA, 23 nt, Human
cuccgagugaacuggucuuccuu

SEQ ID NO: 3383406 - RNA, 15 nt, Human
cuccgauccuuccuc

SEQ ID NO: 3383407 - RNA, 13 nt, Human
cuccgcaggacuu

SEQ ID NO: 3383408 - RNA, 15 nt, Human
cuccgcaguuccugu

SEQ ID NO: 3383409 - RNA, 12 nt, Human
cuccgccagccu

SEQ ID NO: 3383410 - RNA, 14 nt, Human
cuccgccccugagc

SEQ ID NO: 3383411 - RNA, 15 nt, Human
cuccgccccugagcc

SEQ ID NO: 3383412 - RNA, 17 nt, Human
cuccgccccugagccca

SEQ ID NO: 3383413 - RNA, 17 nt, Human
cuccgcccugccacuca

SEQ ID NO: 3383414 - RNA, 16 nt, Human
cuccgccucugcuggc

SEQ ID NO: 3383415 - RNA, 17 nt, Human
cuccgccuuaccaggag

SEQ ID NO: 3383416 - RNA, 19 nt, Human
cuccgccuucacauucccc

SEQ ID NO: 3383417 - RNA, 12 nt, Human
cuccgcugcucc

SEQ ID NO: 3383418 - RNA, 16 nt, Human
cuccgcugcuccuugg

SEQ ID NO: 3383419 - RNA, 14 nt, Human
cuccgcuucccugg

SEQ ID NO: 3383420 - RNA, 21 nt, Human
cuccgcuuucuacccagcgag

SEQ ID NO: 3383421 - RNA, 15 nt, Human
cccagguccucugau

SEQ ID NO: 3383422 - RNA, 15 nt, Human
cccaggugcagccag

SEQ ID NO: 3383423 - RNA, 23 nt, Human
cccaggugcuaggaacacuccuu

SEQ ID NO: 3383424 - RNA, 15 nt, Human
cccaggugggucccg

SEQ ID NO: 3383425 - RNA, 19 nt, Human
cccagguguuaacauucca

SEQ ID NO: 3383426 - RNA, 19 nt, Human
cccagguuggagugcagug

SEQ ID NO: 3383427 - RNA, 15 nt, Human
cccagguuggcucug

SEQ ID NO: 3383428 - RNA, 16 nt, Human
cccagguuggcucugc

SEQ ID NO: 3383429 - RNA, 20 nt, Human
cccagguuggcucugccagu

SEQ ID NO: 3383430 - RNA, 16 nt, Human
cccaguaaaauugcca

SEQ ID NO: 3383431 - RNA, 18 nt, Human
cccaguaaaauugccaua

SEQ ID NO: 3383432 - RNA, 22 nt, Human
cccaguacacaggggcuugacu

SEQ ID NO: 3383433 - RNA, 21 nt, Human
cccaguaccuccugucucugg

SEQ ID NO: 3383434 - RNA, 22 nt, Human
cccaguaccuccugucucuggc

SEQ ID NO: 3383435 - RNA, 21 nt, Human
cccagucaauuacauguuugg

SEQ ID NO: 3383436 - RNA, 13 nt, Human
cccagucagccuc

SEQ ID NO: 3383437 - RNA, 15 nt, Human
cccagucagccucuc

SEQ ID NO: 3383438 - RNA, 17 nt, Human
cccagucauucugggaa

SEQ ID NO: 3383439 - RNA, 19 nt, Human
cccaguccaaauguccucc

SEQ ID NO: 3383440 - RNA, 15 nt, Human
cccccgagcuggggg

SEQ ID NO: 3383441 - RNA, 21 nt, Human
cccccgagcugggggccauga

SEQ ID NO: 3383442 - RNA, 18 nt, Human
cccccgccccgccccaca

SEQ ID NO: 3383443 - RNA, 13 nt, Human
cccccgcuggagg

SEQ ID NO: 3383444 - RNA, 14 nt, Human
cccccggcagcagc

SEQ ID NO: 3383445 - RNA, 13 nt, Human
cccccggcccccu

SEQ ID NO: 3383446 - RNA, 18 nt, Human
cccccgggaggggcccgc

SEQ ID NO: 3383447 - RNA, 16 nt, Human
cccccggggcuggguu

SEQ ID NO: 3383448 - RNA, 24 nt, Human
cccccggguuuggcgggccaagga

SEQ ID NO: 3383449 - RNA, 22 nt, Human
cccccgucuaaccacagcuccu

SEQ ID NO: 3383450 - RNA, 16 nt, Human
cccccucaaaccuccu

SEQ ID NO: 3383451 - RNA, 19 nt, Human
cccccucaaaccuccucuu

SEQ ID NO: 3383452 - RNA, 15 nt, Human
cccccuccaauccug

SEQ ID NO: 3383453 - RNA, 16 nt, Human
cccccuccaauccugc

SEQ ID NO: 3383454 - RNA, 13 nt, Human
cccccuccccagg

SEQ ID NO: 3383455 - RNA, 18 nt, Human
cccccucccccagccacu

SEQ ID NO: 3383456 - RNA, 12 nt, Human
cccccuccugcu

SEQ ID NO: 3383457 - RNA, 16 nt, Human
cccccuccugcugcag

SEQ ID NO: 3383458 - RNA, 14 nt, Human
cccccucucccagu

SEQ ID NO: 3383459 - RNA, 15 nt, Human
cccccucucccugca

SEQ ID NO: 3383460 - RNA, 18 nt, Human
cccccucucccugcaugg

SEQ ID NO: 3383461 - RNA, 16 nt, Human
cccccucugcccugcg

SEQ ID NO: 3383462 - RNA, 12 nt, Human
cccccucugucc

SEQ ID NO: 3383463 - RNA, 16 nt, Human
cccccucugucuugug

SEQ ID NO: 3383464 - RNA, 14 nt, Human
cccccucuucccug

SEQ ID NO: 3383465 - RNA, 17 nt, Human
cccccugacaacacuca

SEQ ID NO: 3383466 - RNA, 19 nt, Human
cccccugacaacacucauu

SEQ ID NO: 3383467 - RNA, 11 nt, Human
cccccugcagc

SEQ ID NO: 3383468 - RNA, 14 nt, Human
cccccugcagcuug

SEQ ID NO: 3383469 - RNA, 16 nt, Human
cccccugccagugccu

SEQ ID NO: 3383470 - RNA, 21 nt, Human
cccccugccccccagccucug

SEQ ID NO: 3383471 - RNA, 23 nt, Human
cccccugccccuucuacacucuc

SEQ ID NO: 3383472 - RNA, 12 nt, Human
cccccugcccuc

SEQ ID NO: 3383473 - RNA, 19 nt, Human
cccccugcccucguggcca

SEQ ID NO: 3383474 - RNA, 13 nt, Human
cccccugcccugc

SEQ ID NO: 3383475 - RNA, 18 nt, Human
cccccugcuggcucuucu

SEQ ID NO: 3383476 - RNA, 13 nt, Human
cccccugggcucu

SEQ ID NO: 3383477 - RNA, 22 nt, Human
cucugucugcccuucaccccag

SEQ ID NO: 3383478 - RNA, 14 nt, Human
cucugucuguccgu

SEQ ID NO: 3383479 - RNA, 23 nt, Human
cucugucuucuuugcccacaaug

SEQ ID NO: 3383480 - RNA, 19 nt, Human
cucugucuugguagguuug

SEQ ID NO: 3383481 - RNA, 16 nt, Human
cucugucuuguguuuc

SEQ ID NO: 3383482 - RNA, 14 nt, Human
cucugugaccaaug

SEQ ID NO: 3383483 - RNA, 14 nt, Human
cucugugaccucag

SEQ ID NO: 3383484 - RNA, 13 nt, Human
cucugugagacuc

SEQ ID NO: 3383485 - RNA, 17 nt, Human
cucugugagacucgaga

SEQ ID NO: 3383486 - RNA, 16 nt, Human
cucugugccagagccu

SEQ ID NO: 3383487 - RNA, 16 nt, Human
cucugugcccaugggc

SEQ ID NO: 3383488 - RNA, 22 nt, Human
cucugugcccaugggcacugcu

SEQ ID NO: 3383489 - RNA, 22 nt, Human
cucugugccucccuccccagug

SEQ ID NO: 3383490 - RNA, 15 nt, Human
cucugugcugacccu

SEQ ID NO: 3383491 - RNA, 21 nt, Human
cucugugcugacccuccuguu

SEQ ID NO: 3383492 - RNA, 19 nt, Human
cucugugcuggccagcgag

SEQ ID NO: 3383493 - RNA, 15 nt, Human
cucugugcuguggaa

SEQ ID NO: 3383494 - RNA, 18 nt, Human
cucugugcuuugacucac

SEQ ID NO: 3383495 - RNA, 22 nt, Human
cucugugcuuuuaaaugcauaa

SEQ ID NO: 3383496 - RNA, 20 nt, Human
cucuguggcuccaggccaaa

SEQ ID NO: 3383497 - RNA, 14 nt, Human
cucugugggcugca

SEQ ID NO: 3383498 - RNA, 13 nt, Human
cucuguggugucu

SEQ ID NO: 3383499 - RNA, 13 nt, Human
cucugugucacug

SEQ ID NO: 3383500 - RNA, 23 nt, Human
cucugugucagguggggcagcuu

SEQ ID NO: 3383501 - RNA, 16 nt, Human
cucuguguccuucccu

SEQ ID NO: 3383502 - RNA, 21 nt, Human
cucugugucuaagauucuaga

SEQ ID NO: 3383503 - RNA, 22 nt, Human
cucugugucuaagauucuagau

SEQ ID NO: 3383504 - RNA, 14 nt, Human
cucugugucugaga

SEQ ID NO: 3383505 - RNA, 20 nt, Human
cucugugucugaguggcuuc

SEQ ID NO: 3383506 - RNA, 15 nt, Human
cucugugugcacaaa

SEQ ID NO: 3383507 - RNA, 17 nt, Human
cucugugugcacaaaua

SEQ ID NO: 3383508 - RNA, 19 nt, Human
cucuguguuuguuccuaca

SEQ ID NO: 3383509 - RNA, 22 nt, Human
cucuguuacccaggguggagug

SEQ ID NO: 3383510 - RNA, 19 nt, Human
cucuguuauguacuguacu

SEQ ID NO: 3383511 - RNA, 17 nt, Human
cucuguucaguguaaau

SEQ ID NO: 3383512 - RNA, 13 nt, Human
cucuguucauuuc

SEQ ID NO: 3383513 - RNA, 16 nt, Human
cucuguucauuuccuc

SEQ ID NO: 3383514 - RNA, 13 nt, Human
cucuguuccaugu

SEQ ID NO: 3383515 - RNA, 15 nt, Human
cucuguuccuggcuc

SEQ ID NO: 3383516 - RNA, 13 nt, Human
cucuguucuuccu

SEQ ID NO: 3383517 - RNA, 13 nt, Human
cucuguugacugg

SEQ ID NO: 3383518 - RNA, 21 nt, Human
cucuguugccaggcuggagug

SEQ ID NO: 3383519 - RNA, 22 nt, Human
cucuguuguccuccccuugggc

SEQ ID NO: 3383520 - RNA, 13 nt, Human
cucuguuuaugcu

SEQ ID NO: 3383521 - RNA, 15 nt, Human
cucuguuuaugcuuu

SEQ ID NO: 3383522 - RNA, 16 nt, Human
cucuguuucuccuucu

SEQ ID NO: 3383523 - RNA, 14 nt, Human
cucuguuucucuuu

SEQ ID NO: 3383524 - RNA, 16 nt, Human
cucuguuuuacaaguu

SEQ ID NO: 3383525 - RNA, 17 nt, Human
cucuuaaaaaauaaaaa

SEQ ID NO: 3383526 - RNA, 19 nt, Human
cucuuaaaaaauaaaaacu

SEQ ID NO: 3383527 - RNA, 20 nt, Human
cucuuaaagcugccuguagu

SEQ ID NO: 3383528 - RNA, 17 nt, Human
cucuuaacaauuucugu

SEQ ID NO: 3383529 - RNA, 14 nt, Human
cucuuaagccaucu

SEQ ID NO: 3383530 - RNA, 21 nt, Human
cucuuaagccaucuugguaaa

SEQ ID NO: 3383531 - RNA, 22 nt, Human
cucuuaagccaucuugguaaau

SEQ ID NO: 3383532 - RNA, 17 nt, Human
cucuuaccaguauuuaa

SEQ ID NO: 3383533 - RNA, 19 nt, Human
cucuuacccuucugugccc

SEQ ID NO: 3383534 - RNA, 23 nt, Human
cucuuacccuucugugcccagcu

SEQ ID NO: 3383535 - RNA, 16 nt, Human
cucuuacuaauguaaa

SEQ ID NO: 3383536 - RNA, 17 nt, Human
cucuuacuaauguaaaa

SEQ ID NO: 3383537 - RNA, 16 nt, Human
cucuuacucuuuccua

SEQ ID NO: 3383538 - RNA, 23 nt, Human
cucuuacuuuccuuuccccagcc

SEQ ID NO: 3383539 - RNA, 22 nt, Human
cucuuagaaaaggugauaaaau

SEQ ID NO: 3383540 - RNA, 18 nt, Human
cucuuagaagaauauugu

SEQ ID NO: 3383541 - RNA, 18 nt, Human
cucuuagacuucugcuuu

SEQ ID NO: 3383542 - RNA, 18 nt, Human
cucuuagauucuuaauuc

SEQ ID NO: 3383543 - RNA, 17 nt, Human
cucuuagcagcuuccag

SEQ ID NO: 3383544 - RNA, 17 nt, Human
cucuuaggcacuuuggg

SEQ ID NO: 3383545 - RNA, 22 nt, Human
cucuuaggcauguaggacccug

SEQ ID NO: 3383546 - RNA, 22 nt, Human
cucuuauagaauauuuauuacc

SEQ ID NO: 3383547 - RNA, 11 nt, Human
cucuuaucuca

SEQ ID NO: 3383548 - RNA, 17 nt, Human
cucuuaugcuguaccca

SEQ ID NO: 3383549 - RNA, 19 nt, Human
cucuuaugcuguacccagu

SEQ ID NO: 3383550 - RNA, 20 nt, Human
cucuuaugcuguacccaguu

SEQ ID NO: 3383551 - RNA, 22 nt, Human
cucuuauggauguccccagcag

SEQ ID NO: 3383552 - RNA, 13 nt, Human
cucuuauugccca

SEQ ID NO: 3383553 - RNA, 17 nt, Human
cucuuauugccucacuu

SEQ ID NO: 3383554 - RNA, 20 nt, Human
cucuuauugccucacuucag

SEQ ID NO: 3383555 - RNA, 14 nt, Human
cucuuauuucauca

SEQ ID NO: 3383556 - RNA, 12 nt, Human
cucuuauuugcu

SEQ ID NO: 3383557 - RNA, 15 nt, Human
cucuuauuuuacaau

SEQ ID NO: 3383558 - RNA, 17 nt, Human
cucuucaacugaccagc

SEQ ID NO: 3383559 - RNA, 20 nt, Human
cucuucaacugaccagccuc

SEQ ID NO: 3383560 - RNA, 18 nt, Human
cucuucaaggacuuucug

SEQ ID NO: 3383561 - RNA, 16 nt, Human
cucuucaccccccacu

SEQ ID NO: 3383562 - RNA, 17 nt, Human
cucuucagacucucagc

SEQ ID NO: 3383563 - RNA, 19 nt, Human
cucuucagaucucuaacuu

SEQ ID NO: 3383564 - RNA, 14 nt, Human
cucuucagaugcca

SEQ ID NO: 3383565 - RNA, 21 nt, Human
cucuucagaugccacuucuaa

SEQ ID NO: 3383566 - RNA, 14 nt, Human
cucuucaggccucc

SEQ ID NO: 3383567 - RNA, 15 nt, Human
cucuucaggccuccc

SEQ ID NO: 3383568 - RNA, 17 nt, Human
cucuucaggccucccuc

SEQ ID NO: 3383569 - RNA, 17 nt, Human
cucuucaucccauucca

SEQ ID NO: 3383570 - RNA, 19 nt, Human
cucuucaucccauuccagg

SEQ ID NO: 3383571 - RNA, 14 nt, Human
cucuucaucuaaua

SEQ ID NO: 3383572 - RNA, 16 nt, Human
cucuuccaaccauuua

SEQ ID NO: 3383573 - RNA, 13 nt, Human
cucuuccagaauc

SEQ ID NO: 3383574 - RNA, 23 nt, Human
cucuuccagucuuccugacacuu

SEQ ID NO: 3383575 - RNA, 14 nt, Human
cucuuccaguuugc

SEQ ID NO: 3383576 - RNA, 16 nt, Human
cucuuccaucaugucc

SEQ ID NO: 3383577 - RNA, 16 nt, Human
cucuuccaugcugugc

SEQ ID NO: 3383578 - RNA, 14 nt, Human
cucuuccccagacg

SEQ ID NO: 3383579 - RNA, 17 nt, Human
cucuucccccucuccca

SEQ ID NO: 3383580 - RNA, 15 nt, Human
cucuuccccuugccc

SEQ ID NO: 3383581 - RNA, 19 nt, Human
cucuuccccuugcccuugc

SEQ ID NO: 3383582 - RNA, 23 nt, Human
cucuucccgccgcccagcccacc

SEQ ID NO: 3383583 - RNA, 22 nt, Human
cucuucccugcgccugugaugc

SEQ ID NO: 3383584 - RNA, 21 nt, Human
cucuucccugguaagaaaaag

SEQ ID NO: 3383585 - RNA, 15 nt, Human
ccccucagcucggcu

SEQ ID NO: 3383586 - RNA, 19 nt, Human
ccccucaggacccucgcug

SEQ ID NO: 3383587 - RNA, 18 nt, Human
ccccucagggucccuggu

SEQ ID NO: 3383588 - RNA, 16 nt, Human
ccccucaguugugcag

SEQ ID NO: 3383589 - RNA, 17 nt, Human
ccccucaguugugcagc

SEQ ID NO: 3383590 - RNA, 17 nt, Human
ccccuccacucuuucuu

SEQ ID NO: 3383591 - RNA, 14 nt, Human
ccccuccacuguca

SEQ ID NO: 3383592 - RNA, 13 nt, Human
ccccuccagccuu

SEQ ID NO: 3383593 - RNA, 15 nt, Human
ccccuccagcuugug

SEQ ID NO: 3383594 - RNA, 16 nt, Human
ccccucccacccaccg

SEQ ID NO: 3383595 - RNA, 14 nt, Human
ccccucccaccucc

SEQ ID NO: 3383596 - RNA, 11 nt, Human
ccccucccaga

SEQ ID NO: 3383597 - RNA, 13 nt, Human
ccccucccagagg

SEQ ID NO: 3383598 - RNA, 14 nt, Human
ccccucccagcuga

SEQ ID NO: 3383599 - RNA, 12 nt, Human
ccccucccaggg

SEQ ID NO: 3383600 - RNA, 16 nt, Human
ccccucccccaacccc

SEQ ID NO: 3383601 - RNA, 18 nt, Human
ccccucccccaaccccca

SEQ ID NO: 3383602 - RNA, 14 nt, Human
ccccucccccuucu

SEQ ID NO: 3383603 - RNA, 21 nt, Human
ccccuccccggcccuaccagc

SEQ ID NO: 3383604 - RNA, 13 nt, Human
ccccuccccucca

SEQ ID NO: 3383605 - RNA, 15 nt, Human
ccccuccccugcugc

SEQ ID NO: 3383606 - RNA, 15 nt, Human
ccccucccucuccag

SEQ ID NO: 3383607 - RNA, 14 nt, Human
ccccucccugcuuc

SEQ ID NO: 3383608 - RNA, 13 nt, Human
ccccucccugggu

SEQ ID NO: 3383609 - RNA, 19 nt, Human
ccccuccgcccugccacuc

SEQ ID NO: 3383610 - RNA, 18 nt, Human
ccccuccggacuggugcc

SEQ ID NO: 3383611 - RNA, 23 nt, Human
ccccuccucacuggccaucccuc

SEQ ID NO: 3383612 - RNA, 13 nt, Human
ccccuccuccagc

SEQ ID NO: 3383613 - RNA, 22 nt, Human
ccccuccuccagccccuguccc

SEQ ID NO: 3383614 - RNA, 22 nt, Human
ccccuccuccuggacuccugca

SEQ ID NO: 3383615 - RNA, 18 nt, Human
ccccuccucucccauccc

SEQ ID NO: 3383616 - RNA, 23 nt, Human
ccccuccucugaaacagcugccu

SEQ ID NO: 3383617 - RNA, 14 nt, Human
ccccuccuucccaa

SEQ ID NO: 3383618 - RNA, 17 nt, Human
ccccuccuucccagcug

SEQ ID NO: 3383619 - RNA, 17 nt, Human
ccccuccuuccuugacc

SEQ ID NO: 3383620 - RNA, 15 nt, Human
ccccuccuugccucc

SEQ ID NO: 3383621 - RNA, 18 nt, Human
ccccucgcaacuguccac

SEQ ID NO: 3383622 - RNA, 21 nt, Human
ccccucgcuuggacggcuggg

SEQ ID NO: 3383623 - RNA, 14 nt, Human
ccccucgugccagu

SEQ ID NO: 3383624 - RNA, 13 nt, Human
ccccucucagccc

SEQ ID NO: 3383625 - RNA, 14 nt, Human
ccccucucagcccu

SEQ ID NO: 3383626 - RNA, 15 nt, Human
ccccucucccuuggg

SEQ ID NO: 3383627 - RNA, 22 nt, Human
ccccucucccuugggcucugau

SEQ ID NO: 3383628 - RNA, 14 nt, Human
ccccucuccuuccu

SEQ ID NO: 3383629 - RNA, 19 nt, Human
ccccucucugcaucugacc

SEQ ID NO: 3383630 - RNA, 17 nt, Human
ccccucugcacccagaa

SEQ ID NO: 3383631 - RNA, 12 nt, Human
ccccucugccca

SEQ ID NO: 3383632 - RNA, 13 nt, Human
ccccucugcccag

SEQ ID NO: 3383633 - RNA, 18 nt, Human
ccccucugcccagcuugg

SEQ ID NO: 3383634 - RNA, 16 nt, Human
ccccucugcugcuguc

SEQ ID NO: 3383635 - RNA, 13 nt, Human
ccccucugcuggc

SEQ ID NO: 3383636 - RNA, 16 nt, Human
ccccucuggccaggau

SEQ ID NO: 3383637 - RNA, 19 nt, Human
ccccucuggucgcuccugc

SEQ ID NO: 3383638 - RNA, 20 nt, Human
cucuucugccggcccugggg

SEQ ID NO: 3383639 - RNA, 21 nt, Human
cucuucugccggcccuggggc

SEQ ID NO: 3383640 - RNA, 14 nt, Human
cucuucugcuccac

SEQ ID NO: 3383641 - RNA, 16 nt, Human
cucuucugcuccaccc

SEQ ID NO: 3383642 - RNA, 22 nt, Human
cucuucugggagggcagcaggg

SEQ ID NO: 3383643 - RNA, 13 nt, Human
cucuucugucccu

SEQ ID NO: 3383644 - RNA, 12 nt, Human
cucuucuguguu

SEQ ID NO: 3383645 - RNA, 13 nt, Human
cucuucuguguuu

SEQ ID NO: 3383646 - RNA, 13 nt, Human
cucuucuuaaugu

SEQ ID NO: 3383647 - RNA, 24 nt, Human
cucuucuuaauguacauagugcua

SEQ ID NO: 3383648 - RNA, 18 nt, Human
cucuucuucuucagaaga

SEQ ID NO: 3383649 - RNA, 20 nt, Human
cucuucuugaaauuuuaacc

SEQ ID NO: 3383650 - RNA, 23 nt, Human
cucuucuugaacacucaugcuga

SEQ ID NO: 3383651 - RNA, 22 nt, Human
cucuucuuggggcccagugcau

SEQ ID NO: 3383652 - RNA, 12 nt, Human
cucuucuuuaga

SEQ ID NO: 3383653 - RNA, 22 nt, Human
cucuucuuuauacuguaauuua

SEQ ID NO: 3383654 - RNA, 24 nt, Human
cucuucuuuauacuguaauuuagu

SEQ ID NO: 3383655 - RNA, 19 nt, Human
cucuucuuucauuucuucu

SEQ ID NO: 3383656 - RNA, 16 nt, Human
cucuucuuuuggcuuc

SEQ ID NO: 3383657 - RNA, 19 nt, Human
cucuucuuuuggcuuccau

SEQ ID NO: 3383658 - RNA, 22 nt, Human
cucuugaaaaaugcccauuugc

SEQ ID NO: 3383659 - RNA, 15 nt, Human
cucuugaacuccuga

SEQ ID NO: 3383660 - RNA, 20 nt, Human
cucuugaagaugcugaaaca

SEQ ID NO: 3383661 - RNA, 13 nt, Human
cucuugacccugc

SEQ ID NO: 3383662 - RNA, 14 nt, Human
cucuugacccugca

SEQ ID NO: 3383663 - RNA, 15 nt, Human
cucuugacccugcac

SEQ ID NO: 3383664 - RNA, 21 nt, Human
cucuugacccugcacccuccu

SEQ ID NO: 3383665 - RNA, 16 nt, Human
cucuugacucuugccu

SEQ ID NO: 3383666 - RNA, 15 nt, Human
cucuugagcaguggc

SEQ ID NO: 3383667 - RNA, 13 nt, Human
cucuugagccugg

SEQ ID NO: 3383668 - RNA, 14 nt, Human
cucuugagccuggg

SEQ ID NO: 3383669 - RNA, 17 nt, Human
cucuugagccuugaacu

SEQ ID NO: 3383670 - RNA, 14 nt, Human
cucuugagcuggcc

SEQ ID NO: 3383671 - RNA, 15 nt, Human
cucuugagcuggccu

SEQ ID NO: 3383672 - RNA, 14 nt, Human
cucuugaggccagg

SEQ ID NO: 3383673 - RNA, 20 nt, Human
cucuugaguuguuuuuguau

SEQ ID NO: 3383674 - RNA, 22 nt, Human
cucuugaguuguuuuuguauau

SEQ ID NO: 3383675 - RNA, 21 nt, Human
cucuugauaccccccucuguc

SEQ ID NO: 3383676 - RNA, 15 nt, Human
cucuugaugccuggc

SEQ ID NO: 3383677 - RNA, 16 nt, Human
cucuugaugccuggcg

SEQ ID NO: 3383678 - RNA, 23 nt, Human
cucuugcaauccacaaucugaca

SEQ ID NO: 3383679 - RNA, 21 nt, Human
cucuugcacagucacugcucu

SEQ ID NO: 3383680 - RNA, 20 nt, Human
cucuugcaccaaauuaucuu

SEQ ID NO: 3383681 - RNA, 14 nt, Human
cucuugcacccgcc

SEQ ID NO: 3383682 - RNA, 21 nt, Human
cucuugcacccgccucucccg

SEQ ID NO: 3383683 - RNA, 14 nt, Human
cucuugcagagaag

SEQ ID NO: 3383684 - RNA, 18 nt, Human
cucuugcaggucucaacc

SEQ ID NO: 3383685 - RNA, 15 nt, Human
cucuugcccauccug

SEQ ID NO: 3383686 - RNA, 20 nt, Human
cucuugccccaacccccagc

SEQ ID NO: 3383687 - RNA, 16 nt, Human
cucuugccccccaccc

SEQ ID NO: 3383688 - RNA, 15 nt, Human
cucuugcccuucccu

SEQ ID NO: 3383689 - RNA, 20 nt, Human
cucuugcccuucccuguccc

SEQ ID NO: 3383690 - RNA, 22 nt, Human
cucuugcccuucccugucccuc

SEQ ID NO: 3383691 - RNA, 14 nt, Human
cucuugccuccugg

SEQ ID NO: 3383692 - RNA, 13 nt, Human
cucuugcugucuc

SEQ ID NO: 3383693 - RNA, 14 nt, Human
cucuugcugucucu

SEQ ID NO: 3383694 - RNA, 18 nt, Human
cucuugcugucucugcuc

SEQ ID NO: 3383695 - RNA, 14 nt, Human
cucuugcuuucuau

SEQ ID NO: 3383696 - RNA, 16 nt, Human
cucuuggaaaaaguga

SEQ ID NO: 3383697 - RNA, 19 nt, Human
cucuuggaccucugcucug

SEQ ID NO: 3383698 - RNA, 19 nt, Human
cucuuggagaagucucagc

SEQ ID NO: 3383699 - RNA, 21 nt, Human
cucuuggagaagucucagcua

SEQ ID NO: 3383700 - RNA, 19 nt, Human
cucuuggaggugucuguau

SEQ ID NO: 3383701 - RNA, 12 nt, Human
cucuuggcugga

SEQ ID NO: 3383702 - RNA, 14 nt, Human
cucuuggcuggacc

SEQ ID NO: 3383703 - RNA, 16 nt, Human
cucuuggcuggaccca

SEQ ID NO: 3383704 - RNA, 19 nt, Human
cucuuggcuggacccagcc

SEQ ID NO: 3383705 - RNA, 16 nt, Human
cucuugggcaauauuc

SEQ ID NO: 3383706 - RNA, 15 nt, Human
cucuugggcugagac

SEQ ID NO: 3383707 - RNA, 21 nt, Human
cucuuggggaguuuagggugg

SEQ ID NO: 3383708 - RNA, 19 nt, Human
cucuuggguucaagugauu

SEQ ID NO: 3383709 - RNA, 15 nt, Human
cucuugguccugcug

SEQ ID NO: 3383710 - RNA, 16 nt, Human
cucuugguccugcugc

SEQ ID NO: 3383711 - RNA, 20 nt, Human
cucuugguuuccuuccuugg

SEQ ID NO: 3383712 - RNA, 16 nt, Human
cucuuguaaagacugg

SEQ ID NO: 3383713 - RNA, 12 nt, Human
cucuuguaaaua

SEQ ID NO: 3383714 - RNA, 14 nt, Human
cucuuguaaauaaa

SEQ ID NO: 3383715 - RNA, 20 nt, Human
cucuuguaaauaaagcccug

SEQ ID NO: 3383716 - RNA, 13 nt, Human
cucuuguaagauu

SEQ ID NO: 3383717 - RNA, 15 nt, Human
cucuuguaagauuuu

SEQ ID NO: 3383718 - RNA, 20 nt, Human
cucuuguaagauuuugaaaa

SEQ ID NO: 3383719 - RNA, 23 nt, Human
cucuuguaagauuuugaaaacua

SEQ ID NO: 3383720 - RNA, 14 nt, Human
cucuugucccacgu

SEQ ID NO: 3383721 - RNA, 20 nt, Human
cucuugucuccccuguuccc

SEQ ID NO: 3383722 - RNA, 21 nt, Human
cucuugucuuccuauuucaga

SEQ ID NO: 3383723 - RNA, 19 nt, Human
cucuuguucuuacuuuccu

SEQ ID NO: 3383724 - RNA, 16 nt, Human
cucuuguugagccgug

SEQ ID NO: 3383725 - RNA, 17 nt, Human
cucuuguuuuguuuguc

SEQ ID NO: 3383726 - RNA, 21 nt, Human
cucuuguuuuuauuaauuuau

SEQ ID NO: 3383727 - RNA, 19 nt, Human
cucuuuaaaaggaaagaaa

SEQ ID NO: 3383728 - RNA, 17 nt, Human
cucuuuaaaucaagucc

SEQ ID NO: 3383729 - RNA, 23 nt, Human
cucuuuaacucaggacuccagcc

SEQ ID NO: 3383730 - RNA, 17 nt, Human
cucuuuaacuuguaaua

SEQ ID NO: 3383731 - RNA, 18 nt, Human
ccugcacuuugaugucau

SEQ ID NO: 3383732 - RNA, 19 nt, Human
ccugcacuuugaugucaug

SEQ ID NO: 3383733 - RNA, 22 nt, Human
ccugcacuuugaugucaugugu

SEQ ID NO: 3383734 - RNA, 22 nt, Human
ccugcagaaccggagagccagc

SEQ ID NO: 3383735 - RNA, 16 nt, Human
ccugcagacccugccc

SEQ ID NO: 3383736 - RNA, 16 nt, Human
ccugcagacucacugu

SEQ ID NO: 3383737 - RNA, 11 nt, Human
ccugcagagag

SEQ ID NO: 3383738 - RNA, 13 nt, Human
ccugcagagagaa

SEQ ID NO: 3383739 - RNA, 14 nt, Human
ccugcagagcugcg

SEQ ID NO: 3383740 - RNA, 19 nt, Human
ccugcagaggucugugcug

SEQ ID NO: 3383741 - RNA, 14 nt, Human
ccugcagaugccac

SEQ ID NO: 3383742 - RNA, 20 nt, Human
ccugcagaugccacccuagc

SEQ ID NO: 3383743 - RNA, 21 nt, Human
ccugcagcaaacacuccaccc

SEQ ID NO: 3383744 - RNA, 23 nt, Human
ccugcagcaggaauauaugugug

SEQ ID NO: 3383745 - RNA, 17 nt, Human
ccugcagcauggucccu

SEQ ID NO: 3383746 - RNA, 22 nt, Human
ccugcagcauggucccugccuu

SEQ ID NO: 3383747 - RNA, 13 nt, Human
ccugcagccagcu

SEQ ID NO: 3383748 - RNA, 22 nt, Human
ccugcagccccgcgccuccuuc

SEQ ID NO: 3383749 - RNA, 17 nt, Human
ccugcagccucccuccg

SEQ ID NO: 3383750 - RNA, 12 nt, Human
ccugcagcucuc

SEQ ID NO: 3383751 - RNA, 15 nt, Human
ccugcagcucucaug

SEQ ID NO: 3383752 - RNA, 18 nt, Human
ccugcagcuuguagccag

SEQ ID NO: 3383753 - RNA, 19 nt, Human
ccugcaggaaggagcugcc

SEQ ID NO: 3383754 - RNA, 20 nt, Human
ccugcaggaaggagcugccu

SEQ ID NO: 3383755 - RNA, 23 nt, Human
ccugcaggaaggagcugccugga

SEQ ID NO: 3383756 - RNA, 15 nt, Human
ccugcaggaccugcc

SEQ ID NO: 3383757 - RNA, 19 nt, Human
ccugcaggaccugccugua

SEQ ID NO: 3383758 - RNA, 22 nt, Human
ccugcaggaucucaccaggcag

SEQ ID NO: 3383759 - RNA, 12 nt, Human
ccugcaggcagc

SEQ ID NO: 3383760 - RNA, 13 nt, Human
ccugcaggcagcc

SEQ ID NO: 3383761 - RNA, 16 nt, Human
ccugcaggcagccagg

SEQ ID NO: 3383762 - RNA, 17 nt, Human
ccugcaggcagccaggc

SEQ ID NO: 3383763 - RNA, 21 nt, Human
ccugcaggcagccaggccaca

SEQ ID NO: 3383764 - RNA, 12 nt, Human
ccugcaggccag

SEQ ID NO: 3383765 - RNA, 18 nt, Human
ccugcaggccaggccagc

SEQ ID NO: 3383766 - RNA, 15 nt, Human
ccugcaggcugagcc

SEQ ID NO: 3383767 - RNA, 12 nt, Human
ccugcagggcca

SEQ ID NO: 3383768 - RNA, 20 nt, Human
ccugcaggguggugcuggga

SEQ ID NO: 3383769 - RNA, 22 nt, Human
ccugcaggguggugcugggacu

SEQ ID NO: 3383770 - RNA, 18 nt, Human
ccugcaggugcugcugcg

SEQ ID NO: 3383771 - RNA, 17 nt, Human
ccugcagguugggccau

SEQ ID NO: 3383772 - RNA, 21 nt, Human
ccugcagugggguuucgcagc

SEQ ID NO: 3383773 - RNA, 20 nt, Human
ccugcaguuaauuagcauuc

SEQ ID NO: 3383774 - RNA, 14 nt, Human
ccugcaucaucuug

SEQ ID NO: 3383775 - RNA, 23 nt, Human
ccugcauccauucuccugaggau

SEQ ID NO: 3383776 - RNA, 21 nt, Human
ccugcauccccuuggcuguga

SEQ ID NO: 3383777 - RNA, 23 nt, Human
ccugcauccccuuggcugugagg

SEQ ID NO: 3383778 - RNA, 18 nt, Human
ccugcaucugaccagcag

SEQ ID NO: 3383779 - RNA, 15 nt, Human
ccugcauggcauccu

SEQ ID NO: 3383780 - RNA, 16 nt, Human
ccugcauggcauccuc

SEQ ID NO: 3383781 - RNA, 21 nt, Human
ccugcauggcauccuccagcc

SEQ ID NO: 3383782 - RNA, 23 nt, Human
ccugcauggcauccuccagcccc

SEQ ID NO: 3383783 - RNA, 20 nt, Human
ccugcauguaaacacgccug

SEQ ID NO: 3383784 - RNA, 15 nt, Human
ccugcauucacccag

SEQ ID NO: 3383785 - RNA, 17 nt, Human
ccugcauucacccagac

SEQ ID NO: 3383786 - RNA, 22 nt, Human
ccugcauucugccgugugcccu

SEQ ID NO: 3383787 - RNA, 18 nt, Human
ccugcauucuuucuguau

SEQ ID NO: 3383788 - RNA, 20 nt, Human
ccugcauuggaacuggaggc

SEQ ID NO: 3383789 - RNA, 19 nt, Human
ccugccaauggacuaacuu

SEQ ID NO: 3383790 - RNA, 12 nt, Human
ccugccacagcc

SEQ ID NO: 3383791 - RNA, 12 nt, Human
ccugccaccagg

SEQ ID NO: 3383792 - RNA, 15 nt, Human
ccugccaccaggcca

SEQ ID NO: 3383793 - RNA, 14 nt, Human
ccugccacccagcc

SEQ ID NO: 3383794 - RNA, 13 nt, Human
ccugccacccugg

SEQ ID NO: 3383795 - RNA, 14 nt, Human
ccugccacccuggg

SEQ ID NO: 3383796 - RNA, 13 nt, Human
ccugccaccuccc

SEQ ID NO: 3383797 - RNA, 18 nt, Human
ccugccaccuccccccac

SEQ ID NO: 3383798 - RNA, 14 nt, Human
ccugccaccuccug

SEQ ID NO: 3383799 - RNA, 16 nt, Human
ccugccaccuccugcc

SEQ ID NO: 3383800 - RNA, 16 nt, Human
ccugccaccugcugcu

SEQ ID NO: 3383801 - RNA, 18 nt, Human
ccuggcccuuacuugcuu

SEQ ID NO: 3383802 - RNA, 20 nt, Human
ccuggccgcccccugccccc

SEQ ID NO: 3383803 - RNA, 21 nt, Human
ccuggccgcccccugcccccc

SEQ ID NO: 3383804 - RNA, 17 nt, Human
ccuggccgcgcuccggg

SEQ ID NO: 3383805 - RNA, 14 nt, Human
ccuggccuccaggc

SEQ ID NO: 3383806 - RNA, 19 nt, Human
ccuggccuccccugccacc

SEQ ID NO: 3383807 - RNA, 21 nt, Human
ccuggccuccggcgucagccu

SEQ ID NO: 3383808 - RNA, 17 nt, Human
ccuggccuccugccucu

SEQ ID NO: 3383809 - RNA, 16 nt, Human
ccuggccucugcacuc

SEQ ID NO: 3383810 - RNA, 16 nt, Human
ccuggccugagaguca

SEQ ID NO: 3383811 - RNA, 13 nt, Human
ccuggccugagcu

SEQ ID NO: 3383812 - RNA, 15 nt, Human
ccuggccuggcccug

SEQ ID NO: 3383813 - RNA, 13 nt, Human
ccuggccugucuc

SEQ ID NO: 3383814 - RNA, 11 nt, Human
ccuggccuguu

SEQ ID NO: 3383815 - RNA, 13 nt, Human
ccuggccuguucu

SEQ ID NO: 3383816 - RNA, 19 nt, Human
ccuggccuguucuguuuug

SEQ ID NO: 3383817 - RNA, 11 nt, Human
ccuggccuuca

SEQ ID NO: 3383818 - RNA, 18 nt, Human
ccuggccuucaguguacc

SEQ ID NO: 3383819 - RNA, 20 nt, Human
ccuggccuugggauccaggc

SEQ ID NO: 3383820 - RNA, 19 nt, Human
ccuggccuuguccucagcc

SEQ ID NO: 3383821 - RNA, 21 nt, Human
ccuggccuuguccucagccag

SEQ ID NO: 3383822 - RNA, 15 nt, Human
ccuggcgcagguggg

SEQ ID NO: 3383823 - RNA, 23 nt, Human
ccuggcgcaggugggcuggacuu

SEQ ID NO: 3383824 - RNA, 19 nt, Human
ccuggcgggaugggccacc

SEQ ID NO: 3383825 - RNA, 17 nt, Human
ccuggcuaacacgguga

SEQ ID NO: 3383826 - RNA, 23 nt, Human
ccuggcuacagggcgagacucug

SEQ ID NO: 3383827 - RNA, 16 nt, Human
ccuggcucagagccag

SEQ ID NO: 3383828 - RNA, 14 nt, Human
ccuggcuccaguga

SEQ ID NO: 3383829 - RNA, 20 nt, Human
ccuggcucccacaggcagcu

SEQ ID NO: 3383830 - RNA, 21 nt, Human
ccuggcucccacaggcagcuu

SEQ ID NO: 3383831 - RNA, 14 nt, Human
ccuggcucccagga

SEQ ID NO: 3383832 - RNA, 22 nt, Human
ccuggcucccaugaccauacug

SEQ ID NO: 3383833 - RNA, 14 nt, Human
ccuggcuccccugg

SEQ ID NO: 3383834 - RNA, 22 nt, Human
ccuggcucccucacucucagga

SEQ ID NO: 3383835 - RNA, 14 nt, Human
ccuggcucccuccu

SEQ ID NO: 3383836 - RNA, 20 nt, Human
ccuggcucccuccuccaggc

SEQ ID NO: 3383837 - RNA, 22 nt, Human
ccuggcucccuccuccaggccu

SEQ ID NO: 3383838 - RNA, 23 nt, Human
ccuggcucccuccuccaggccug

SEQ ID NO: 3383839 - RNA, 23 nt, Human
ccuggcuccugaggggcaucugc

SEQ ID NO: 3383840 - RNA, 13 nt, Human
ccuggcucucacc

SEQ ID NO: 3383841 - RNA, 17 nt, Human
ccuggcucucaccucua

SEQ ID NO: 3383842 - RNA, 15 nt, Human
ccuggcucucccagc

SEQ ID NO: 3383843 - RNA, 22 nt, Human
ccuggcucugcaaugggcacug

SEQ ID NO: 3383844 - RNA, 17 nt, Human
ccuggcucugcuguccc

SEQ ID NO: 3383845 - RNA, 23 nt, Human
ccuggcucuuucgucacccuugg

SEQ ID NO: 3383846 - RNA, 18 nt, Human
ccuggcugagccuggcug

SEQ ID NO: 3383847 - RNA, 19 nt, Human
ccuggcugagguuccucug

SEQ ID NO: 3383848 - RNA, 21 nt, Human
ccuggcugagguuccucugcc

SEQ ID NO: 3383849 - RNA, 15 nt, Human
ccuggcugcccauca

SEQ ID NO: 3383850 - RNA, 23 nt, Human
ccuggcugcccaucauguggccc

SEQ ID NO: 3383851 - RNA, 14 nt, Human
ccuggcugcccugg

SEQ ID NO: 3383852 - RNA, 15 nt, Human
ccuggcugccggcac

SEQ ID NO: 3383853 - RNA, 22 nt, Human
ccuggcugcugaucgccuuccc

SEQ ID NO: 3383854 - RNA, 18 nt, Human
ccuggcugcugcccccac

SEQ ID NO: 3383855 - RNA, 22 nt, Human
ccuggcugcugcccccaccccg

SEQ ID NO: 3383856 - RNA, 22 nt, Human
ccuggcuggagaauguggagaa

SEQ ID NO: 3383857 - RNA, 13 nt, Human
ccuggcuggcuga

SEQ ID NO: 3383858 - RNA, 18 nt, Human
ccuggcuggcugagggca

SEQ ID NO: 3383859 - RNA, 20 nt, Human
ccuggcugggacguggcuca

SEQ ID NO: 3383860 - RNA, 14 nt, Human
ccuggcuguacugc

SEQ ID NO: 3383861 - RNA, 19 nt, Human
ccuggcuguacugcucagg

SEQ ID NO: 3383862 - RNA, 23 nt, Human
ccuggcuguuuggacuuuguaua

SEQ ID NO: 3383863 - RNA, 19 nt, Human
ccuggcuucccauccccag

SEQ ID NO: 3383864 - RNA, 22 nt, Human
ccuggcuucccauccccagcga

SEQ ID NO: 3383865 - RNA, 23 nt, Human
ccuggcuucccauccccagcgau

SEQ ID NO: 3383866 - RNA, 15 nt, Human
ccuggcuuccuuacu

SEQ ID NO: 3383867 - RNA, 13 nt, Human
ccuggcuucugga

SEQ ID NO: 3383868 - RNA, 14 nt, Human
ccuggcuucuggag

SEQ ID NO: 3383869 - RNA, 20 nt, Human
ccuggcuucuggagcccuug

SEQ ID NO: 3383870 - RNA, 21 nt, Human
ccuggcuucuggagcccuugg

SEQ ID NO: 3383871 - RNA, 16 nt, Human
ccuggcuucugugggg

SEQ ID NO: 3383872 - RNA, 20 nt, Human
ccuggcuuguaacuccacca

SEQ ID NO: 3383873 - RNA, 22 nt, Human
ccuggcuuguaacuccaccaac

SEQ ID NO: 3383874 - RNA, 20 nt, Human
ccuggcuuugcccaaccuca

SEQ ID NO: 3383875 - RNA, 16 nt, Human
caugcucaucugcugg

SEQ ID NO: 3383876 - RNA, 17 nt, Human
caugcucaucugcuggu

SEQ ID NO: 3383877 - RNA, 15 nt, Human
caugcuccccugugc

SEQ ID NO: 3383878 - RNA, 14 nt, Human
caugcuccuggccc

SEQ ID NO: 3383879 - RNA, 17 nt, Human
caugcuccuggcccacu

SEQ ID NO: 3383880 - RNA, 13 nt, Human
caugcuccuuaau

SEQ ID NO: 3383881 - RNA, 15 nt, Human
caugcucucugcagc

SEQ ID NO: 3383882 - RNA, 16 nt, Human
caugcucucugcagcc

SEQ ID NO: 3383883 - RNA, 21 nt, Human
caugcucucugcagccagccc

SEQ ID NO: 3383884 - RNA, 13 nt, Human
caugcugaaggga

SEQ ID NO: 3383885 - RNA, 19 nt, Human
caugcugaggccugggccg

SEQ ID NO: 3383886 - RNA, 17 nt, Human
caugcugagucucccaa

SEQ ID NO: 3383887 - RNA, 19 nt, Human
caugcugagucucccaagg

SEQ ID NO: 3383888 - RNA, 15 nt, Human
caugcugccaauauc

SEQ ID NO: 3383889 - RNA, 19 nt, Human
caugcugccaauauccuaa

SEQ ID NO: 3383890 - RNA, 13 nt, Human
caugcugcccugu

SEQ ID NO: 3383891 - RNA, 16 nt, Human
caugcugcccugugag

SEQ ID NO: 3383892 - RNA, 23 nt, Human
caugcuggaaaauaauacugcug

SEQ ID NO: 3383893 - RNA, 20 nt, Human
caugcuggacaggucuggga

SEQ ID NO: 3383894 - RNA, 20 nt, Human
caugcugggaagacgccuga

SEQ ID NO: 3383895 - RNA, 19 nt, Human
caugcuguacauacuuuuu

SEQ ID NO: 3383896 - RNA, 17 nt, Human
caugcugucccuuacgu

SEQ ID NO: 3383897 - RNA, 19 nt, Human
caugcugucuggcacagcc

SEQ ID NO: 3383898 - RNA, 19 nt, Human
caugcugugauugugccua

SEQ ID NO: 3383899 - RNA, 20 nt, Human
caugcugugcgcccagggcu

SEQ ID NO: 3383900 - RNA, 16 nt, Human
caugcuguucaugaaa

SEQ ID NO: 3383901 - RNA, 16 nt, Human
caugcuguugauugcu

SEQ ID NO: 3383902 - RNA, 19 nt, Human
caugcuguugauugcuaaa

SEQ ID NO: 3383903 - RNA, 21 nt, Human
caugcuguugauugcuaaaug

SEQ ID NO: 3383904 - RNA, 13 nt, Human
caugcuuaaauuu

SEQ ID NO: 3383905 - RNA, 19 nt, Human
caugcuuagucacugccug

SEQ ID NO: 3383906 - RNA, 21 nt, Human
caugcuuagucacugccugca

SEQ ID NO: 3383907 - RNA, 17 nt, Human
caugcuuauuccaugac

SEQ ID NO: 3383908 - RNA, 19 nt, Human
caugcuuauuccaugacug

SEQ ID NO: 3383909 - RNA, 22 nt, Human
caugcuucaauaguucaaggaa

SEQ ID NO: 3383910 - RNA, 14 nt, Human
caugcuucaucauu

SEQ ID NO: 3383911 - RNA, 23 nt, Human
caugcuucaucauucccucucau

SEQ ID NO: 3383912 - RNA, 23 nt, Human
caugcuucaugaaaauccuacca

SEQ ID NO: 3383913 - RNA, 20 nt, Human
caugcuucccuuuccugagu

SEQ ID NO: 3383914 - RNA, 21 nt, Human
caugcuucucaucuugugaaa

SEQ ID NO: 3383915 - RNA, 23 nt, Human
caugcuucucaucuugugaaaug

SEQ ID NO: 3383916 - RNA, 17 nt, Human
caugcuugaugguuuau

SEQ ID NO: 3383917 - RNA, 18 nt, Human
caugcuuguguuucuuag

SEQ ID NO: 3383918 - RNA, 16 nt, Human
caugcuuuccauauuu

SEQ ID NO: 3383919 - RNA, 17 nt, Human
caugcuuugugaacaag

SEQ ID NO: 3383920 - RNA, 22 nt, Human
cauggaaaaaugccaucaaaug

SEQ ID NO: 3383921 - RNA, 17 nt, Human
cauggaaauauuaugca

SEQ ID NO: 3383922 - RNA, 22 nt, Human
cauggaaauauuaugcaaauuc

SEQ ID NO: 3383923 - RNA, 18 nt, Human
cauggaaauuuaaagcag

SEQ ID NO: 3383924 - RNA, 21 nt, Human
cauggaacacaaacacauugu

SEQ ID NO: 3383925 - RNA, 15 nt, Human
cauggaacacuucga

SEQ ID NO: 3383926 - RNA, 20 nt, Human
cauggaagaggcuacagggc

SEQ ID NO: 3383927 - RNA, 18 nt, Human
cauggaaugcuugaaaaa

SEQ ID NO: 3383928 - RNA, 20 nt, Human
cauggaaugcuugaaaaaug

SEQ ID NO: 3383929 - RNA, 14 nt, Human
cauggaaugguuau

SEQ ID NO: 3383930 - RNA, 17 nt, Human
cauggaaugguuauaaa

SEQ ID NO: 3383931 - RNA, 17 nt, Human
cauggacacuacaccca

SEQ ID NO: 3383932 - RNA, 19 nt, Human
cauggacacuacacccagc

SEQ ID NO: 3383933 - RNA, 14 nt, Human
cauggacaggcugg

SEQ ID NO: 3383934 - RNA, 18 nt, Human
cauggacaggcuggcucc

SEQ ID NO: 3383935 - RNA, 14 nt, Human
cauggaccacuguu

SEQ ID NO: 3383936 - RNA, 16 nt, Human
cauggaccacuguuuc

SEQ ID NO: 3383937 - RNA, 18 nt, Human
cauggaccacuguuucuu

SEQ ID NO: 3383938 - RNA, 13 nt, Human
cauggaccaugcu

SEQ ID NO: 3383939 - RNA, 20 nt, Human
cauggaccaugcugucuggc

SEQ ID NO: 3383940 - RNA, 21 nt, Human
cauggacucuacacugugaac

SEQ ID NO: 3383941 - RNA, 16 nt, Human
cauggacucuguccug

SEQ ID NO: 3383942 - RNA, 12 nt, Human
cauggacuugua

SEQ ID NO: 3383943 - RNA, 17 nt, Human
cauggacuuguauauuu

SEQ ID NO: 3383944 - RNA, 22 nt, Human
cauggacuuguauauuuguaca

SEQ ID NO: 3383945 - RNA, 11 nt, Human
cauggacuuug

SEQ ID NO: 3383946 - RNA, 13 nt, Human
cauggacuuuguu

SEQ ID NO: 3383947 - RNA, 16 nt, Human
cauggagaaacccugu

SEQ ID NO: 3383948 - RNA, 14 nt, Human
cauggagaaagcug

SEQ ID NO: 3383949 - RNA, 20 nt, Human
cauggagaaccaccuacccc

SEQ ID NO: 3383950 - RNA, 16 nt, Human
cauggagacgcauuuc

SEQ ID NO: 3383951 - RNA, 19 nt, Human
cauggagacuccugcccug

SEQ ID NO: 3383952 - RNA, 21 nt, Human
cauggagacuccugcccuguu

SEQ ID NO: 3383953 - RNA, 13 nt, Human
cauggagagcugg

SEQ ID NO: 3383954 - RNA, 16 nt, Human
cauggagagcuggagc

SEQ ID NO: 3383955 - RNA, 17 nt, Human
cauggagagcuggagcc

SEQ ID NO: 3383956 - RNA, 21 nt, Human
cauggagauagccccacagga

SEQ ID NO: 3383957 - RNA, 17 nt, Human
cauggagauucucauaa

SEQ ID NO: 3383958 - RNA, 18 nt, Human
cauggagauugaccugga

SEQ ID NO: 3383959 - RNA, 10 nt, Human
cauggagcca

SEQ ID NO: 3383960 - RNA, 18 nt, Human
cauggaggcccuccugug

SEQ ID NO: 3383961 - RNA, 15 nt, Human
cauggagguucuaag

SEQ ID NO: 3383962 - RNA, 14 nt, Human
cauggaguguguau

SEQ ID NO: 3383963 - RNA, 15 nt, Human
cauggaugagagucc

SEQ ID NO: 3383964 - RNA, 19 nt, Human
cauggaugggggaacucag

SEQ ID NO: 3383965 - RNA, 22 nt, Human
cauggauguuuuagccauuguu

SEQ ID NO: 3383966 - RNA, 13 nt, Human
cauggauuucuuu

SEQ ID NO: 3383967 - RNA, 19 nt, Human
cauggcaccaaagccacca

SEQ ID NO: 3383968 - RNA, 23 nt, Human
cauggcaccugucgcccagugcc

SEQ ID NO: 3383969 - RNA, 20 nt, Human
cauggcacucccuccagcac

SEQ ID NO: 3383970 - RNA, 22 nt, Human
cauggcacucccuccagcacaa

SEQ ID NO: 3383971 - RNA, 19 nt, Human
cauggcacuugcaucugug

SEQ ID NO: 3383972 - RNA, 21 nt, Human
cauggcagaauaaucuuuggg

SEQ ID NO: 3383973 - RNA, 17 nt, Human
cauggcagaguuugugu

SEQ ID NO: 3383974 - RNA, 18 nt, Human
cauggcagaguuugugug

SEQ ID NO: 3383975 - RNA, 20 nt, Human
cauggcagccuacucuccuu

SEQ ID NO: 3383976 - RNA, 14 nt, Human
cauggcagggggcu

SEQ ID NO: 3383977 - RNA, 19 nt, Human
cauggcauauuuuucacau

SEQ ID NO: 3383978 - RNA, 18 nt, Human
cauggcaucaccuccacc

SEQ ID NO: 3383979 - RNA, 15 nt, Human
cauggcauccaagac

SEQ ID NO: 3383980 - RNA, 16 nt, Human
cauggcauccuccagc

SEQ ID NO: 3383981 - RNA, 18 nt, Human
cauggcauccuccagccc

SEQ ID NO: 3383982 - RNA, 19 nt, Human
cauggcauccuccagcccc

SEQ ID NO: 3383983 - RNA, 21 nt, Human
cauggcaugggggccucaggg

SEQ ID NO: 3383984 - RNA, 18 nt, Human
cauggccaccuuuucagc

SEQ ID NO: 3383985 - RNA, 20 nt, Human
cauggccagcuggaggcagg

SEQ ID NO: 3383986 - RNA, 13 nt, Human
cauggccaggugg

SEQ ID NO: 3383987 - RNA, 13 nt, Human
cauggccccucug

SEQ ID NO: 3383988 - RNA, 15 nt, Human
cauggccccugugag

SEQ ID NO: 3383989 - RNA, 23 nt, Human
cauggcccucccaguaccuccug

SEQ ID NO: 3383990 - RNA, 16 nt, Human
cauggccuaugcacau

SEQ ID NO: 3383991 - RNA, 20 nt, Human
cauggccuauuauauuaaaa

SEQ ID NO: 3383992 - RNA, 21 nt, Human
cauggccuauuauauuaaaau

SEQ ID NO: 3383993 - RNA, 21 nt, Human
cauggccucuucagaucucua

SEQ ID NO: 3383994 - RNA, 16 nt, Human
cauggcuaacuggcga

SEQ ID NO: 3383995 - RNA, 17 nt, Human
cauggcuaagcuuaaaa

SEQ ID NO: 3383996 - RNA, 22 nt, Human
cauggcuaagcuuaaaaaaaac

SEQ ID NO: 3383997 - RNA, 16 nt, Human
cauggcuaaggcacca

SEQ ID NO: 3383998 - RNA, 22 nt, Human
cauggcuauaaacaauuacaug

SEQ ID NO: 3383999 - RNA, 17 nt, Human
cauggcuauuuuauauu

SEQ ID NO: 3384000 - RNA, 15 nt, Human
cauggcuccagucug

SEQ ID NO: 3384001 - RNA, 16 nt, Human
cauggcuccggccucu

SEQ ID NO: 3384002 - RNA, 21 nt, Human
cauggcucuggacucuaaaga

SEQ ID NO: 3384003 - RNA, 19 nt, Human
ccuuaauuuccuuuuugac

SEQ ID NO: 3384004 - RNA, 20 nt, Human
ccuuaauuuccuuuuugaca

SEQ ID NO: 3384005 - RNA, 22 nt, Human
ccuuaauuuccuuuuugacacu

SEQ ID NO: 3384006 - RNA, 24 nt, Human
ccuuaauuuccuuuuugacacuga

SEQ ID NO: 3384007 - RNA, 13 nt, Human
ccuuacauuugug

SEQ ID NO: 3384008 - RNA, 18 nt, Human
ccuuaccaacuuucugua

SEQ ID NO: 3384009 - RNA, 17 nt, Human
ccuuaccacugcucuga

SEQ ID NO: 3384010 - RNA, 14 nt, Human
ccuuaccagcagag

SEQ ID NO: 3384011 - RNA, 20 nt, Human
ccuuaccagcagagcaccuu

SEQ ID NO: 3384012 - RNA, 14 nt, Human
ccuuacccaucugc

SEQ ID NO: 3384013 - RNA, 19 nt, Human
ccuuacccucauguucuua

SEQ ID NO: 3384014 - RNA, 17 nt, Human
ccuuacccuccuuggga

SEQ ID NO: 3384015 - RNA, 15 nt, Human
ccuuacccuuagaau

SEQ ID NO: 3384016 - RNA, 14 nt, Human
ccuuaccucuuccg

SEQ ID NO: 3384017 - RNA, 23 nt, Human
ccuuacgaucaggcacaggucag

SEQ ID NO: 3384018 - RNA, 12 nt, Human
ccuuacuccugu

SEQ ID NO: 3384019 - RNA, 19 nt, Human
ccuucccagcucucccucu

SEQ ID NO: 3384020 - RNA, 22 nt, Human
ccuucccagcugccccucccug

SEQ ID NO: 3384021 - RNA, 14 nt, Human
ccuucccaucgcug

SEQ ID NO: 3384022 - RNA, 15 nt, Human
ccuucccaucgcugu

SEQ ID NO: 3384023 - RNA, 15 nt, Human
ccuucccaucucuuc

SEQ ID NO: 3384024 - RNA, 16 nt, Human
ccuucccauggaggga

SEQ ID NO: 3384025 - RNA, 13 nt, Human
ccuuccccagcau

SEQ ID NO: 3384026 - RNA, 13 nt, Human
ccuuccccagccu

SEQ ID NO: 3384027 - RNA, 15 nt, Human
ccuucccccagccca

SEQ ID NO: 3384028 - RNA, 16 nt, Human
ccuucccccucccagg

SEQ ID NO: 3384029 - RNA, 17 nt, Human
ccuucccccucccaggg

SEQ ID NO: 3384030 - RNA, 23 nt, Human
ccuuccccucagccacacccagg

SEQ ID NO: 3384031 - RNA, 13 nt, Human
ccuuccccuggca

SEQ ID NO: 3384032 - RNA, 20 nt, Human
ccuuccccuuauccucccug

SEQ ID NO: 3384033 - RNA, 14 nt, Human
ccuuccccuuccuu

SEQ ID NO: 3384034 - RNA, 18 nt, Human
ccuuccccuugcccaggg

SEQ ID NO: 3384035 - RNA, 20 nt, Human
ccuuccccuugcccagggcu

SEQ ID NO: 3384036 - RNA, 24 nt, Human
ccuucccucaccuuggcaccagac

SEQ ID NO: 3384037 - RNA, 11 nt, Human
ccuucccuccu

SEQ ID NO: 3384038 - RNA, 12 nt, Human
ccuucccuccuc

SEQ ID NO: 3384039 - RNA, 12 nt, Human
ccuucccucucc

SEQ ID NO: 3384040 - RNA, 14 nt, Human
ccuucccucucugg

SEQ ID NO: 3384041 - RNA, 15 nt, Human
ccuucccucucugga

SEQ ID NO: 3384042 - RNA, 12 nt, Human
ccuucccugcaa

SEQ ID NO: 3384043 - RNA, 14 nt, Human
ccuucccugggcug

SEQ ID NO: 3384044 - RNA, 15 nt, Human
ccuucccugucccuc

SEQ ID NO: 3384045 - RNA, 13 nt, Human
ccuucccugugcc

SEQ ID NO: 3384046 - RNA, 18 nt, Human
ccuucccuugccacuuug

SEQ ID NO: 3384047 - RNA, 16 nt, Human
ccuuccgacccucugg

SEQ ID NO: 3384048 - RNA, 13 nt, Human
ccuuccgccacug

SEQ ID NO: 3384049 - RNA, 16 nt, Human
ccuuccgccacugggg

SEQ ID NO: 3384050 - RNA, 16 nt, Human
ccuuccgcuuggagcu

SEQ ID NO: 3384051 - RNA, 19 nt, Human
ccuuccguaacccaacucu

SEQ ID NO: 3384052 - RNA, 23 nt, Human
ccuuccuaaauuuuccuguccuc

SEQ ID NO: 3384053 - RNA, 16 nt, Human
ccuuccuaagccugug

SEQ ID NO: 3384054 - RNA, 23 nt, Human
ccuuccuaagccuguggcugugg

SEQ ID NO: 3384055 - RNA, 19 nt, Human
ccuuccuaccacccggucc

SEQ ID NO: 3384056 - RNA, 11 nt, Human
ccuuccuauaa

SEQ ID NO: 3384057 - RNA, 22 nt, Human
ccuuccucaguuuaauccuucu

SEQ ID NO: 3384058 - RNA, 16 nt, Human
ccuuccucauccaccc

SEQ ID NO: 3384059 - RNA, 20 nt, Human
ccuuccucauccaccccauc

SEQ ID NO: 3384060 - RNA, 14 nt, Human
ccuuccuccauccu

SEQ ID NO: 3384061 - RNA, 19 nt, Human
ccuuccucgcagagaggcc

SEQ ID NO: 3384062 - RNA, 15 nt, Human
ccuuccucucuccag

SEQ ID NO: 3384063 - RNA, 15 nt, Human
ccuuccucugcagcu

SEQ ID NO: 3384064 - RNA, 18 nt, Human
ccuuccucugcagcugac

SEQ ID NO: 3384065 - RNA, 18 nt, Human
ccuuccugccaccugcug

SEQ ID NO: 3384066 - RNA, 23 nt, Human
ccuuccugccccaacuccuucca

SEQ ID NO: 3384067 - RNA, 15 nt, Human
ccuuccugcugcgca

SEQ ID NO: 3384068 - RNA, 17 nt, Human
ccuuccuggacagcugu

SEQ ID NO: 3384069 - RNA, 21 nt, Human
ccuuccuggacagcugugccu

SEQ ID NO: 3384070 - RNA, 17 nt, Human
ccuuccugggcacacgc

SEQ ID NO: 3384071 - RNA, 16 nt, Human
ccuuccugucccaccu

SEQ ID NO: 3384072 - RNA, 15 nt, Human
ccuuccuucccuggc

SEQ ID NO: 3384073 - RNA, 16 nt, Human
ccuuccuugaccagca

SEQ ID NO: 3384074 - RNA, 18 nt, Human
ccuuccuugcucugcacc

SEQ ID NO: 3384075 - RNA, 19 nt, Human
ccuuccuugcucugcaccc

SEQ ID NO: 3384076 - RNA, 20 nt, Human
ccuuccuugcuguccuaggc

SEQ ID NO: 3384077 - RNA, 17 nt, Human
ccuuccuuguagccuuu

SEQ ID NO: 3384078 - RNA, 13 nt, Human
ccuuccuuuuccc

SEQ ID NO: 3384079 - RNA, 16 nt, Human
ccuuccuuuucccugc

SEQ ID NO: 3384080 - RNA, 19 nt, Human
ccuuccuuuucccugcuuc

SEQ ID NO: 3384081 - RNA, 23 nt, Human
ccuuccuuuucccugcuuccagg

SEQ ID NO: 3384082 - RNA, 16 nt, Human
ccuucgacagcauuuu

SEQ ID NO: 3384083 - RNA, 22 nt, Human
ccuucgauacaccgggccugga

SEQ ID NO: 3384084 - RNA, 13 nt, Human
ccuucgccaccug

SEQ ID NO: 3384085 - RNA, 17 nt, Human
ccuucgcgguggaaggc

SEQ ID NO: 3384086 - RNA, 17 nt, Human
ccuucgcuucuugccuc

SEQ ID NO: 3384087 - RNA, 17 nt, Human
ccuucggccuccauccu

SEQ ID NO: 3384088 - RNA, 20 nt, Human
ccuucggccuccauccugag

SEQ ID NO: 3384089 - RNA, 15 nt, Human
ccuucggcgccuuaa

SEQ ID NO: 3384090 - RNA, 16 nt, Human
ccuucgggcugugccc

SEQ ID NO: 3384091 - RNA, 20 nt, Human
ccuucgguggaagagcucaa

SEQ ID NO: 3384092 - RNA, 17 nt, Human
ccuucgucuuucccaug

SEQ ID NO: 3384093 - RNA, 20 nt, Human
ccuucgugacaauguuuaca

SEQ ID NO: 3384094 - RNA, 17 nt, Human
ccuucguuaacugugua

SEQ ID NO: 3384095 - RNA, 20 nt, Human
ccuucguuuacuaugccugu

SEQ ID NO: 3384096 - RNA, 23 nt, Human
ccuucguuuacuaugccuguguc

SEQ ID NO: 3384097 - RNA, 13 nt, Human
ccuucuaaaggug

SEQ ID NO: 3384098 - RNA, 14 nt, Human
ccuucuaaaggugu

SEQ ID NO: 3384099 - RNA, 22 nt, Human
ccuucuaaagguguugucccuu

SEQ ID NO: 3384100 - RNA, 12 nt, Human
ccuucuaccugc

SEQ ID NO: 3384101 - RNA, 16 nt, Human
ccuucuaccugccacu

SEQ ID NO: 3384102 - RNA, 22 nt, Human
ccuucuacuuacacaucuucca

SEQ ID NO: 3384103 - RNA, 23 nt, Human
ccuucuacuuacacaucuuccac

SEQ ID NO: 3384104 - RNA, 14 nt, Human
ccuucuaggaagcu

SEQ ID NO: 3384105 - RNA, 20 nt, Human
ccuucuaggguuauugcauu

SEQ ID NO: 3384106 - RNA, 21 nt, Human
ccuucuauagcaucacuuaaa

SEQ ID NO: 3384107 - RNA, 22 nt, Human
ccuucucacauggaaugagggu

SEQ ID NO: 3384108 - RNA, 20 nt, Human
ccuucucaccagcugcaaag

SEQ ID NO: 3384109 - RNA, 21 nt, Human
ccuucucaccagcugcaaagu

SEQ ID NO: 3384110 - RNA, 22 nt, Human
ccuucucaccagcugcaaagug

SEQ ID NO: 3384111 - RNA, 14 nt, Human
ccuucucagaaucu

SEQ ID NO: 3384112 - RNA, 15 nt, Human
ccuucuccaaaugag

SEQ ID NO: 3384113 - RNA, 18 nt, Human
ccuucuccaccccagccc

SEQ ID NO: 3384114 - RNA, 13 nt, Human
ccuucuccaucca

SEQ ID NO: 3384115 - RNA, 14 nt, Human
ccuucuccaucucu

SEQ ID NO: 3384116 - RNA, 14 nt, Human
ccuucucccacucu

SEQ ID NO: 3384117 - RNA, 17 nt, Human
ccuucucccacucuccu

SEQ ID NO: 3384118 - RNA, 20 nt, Human
ccuucucccacucuccuagg

SEQ ID NO: 3384119 - RNA, 14 nt, Human
ccuucucccaugag

SEQ ID NO: 3384120 - RNA, 13 nt, Human
ccuucuccccagc

SEQ ID NO: 3384121 - RNA, 17 nt, Human
ccuucuccccagcuccc

SEQ ID NO: 3384122 - RNA, 18 nt, Human
ccuucuccccagcuccca

SEQ ID NO: 3384123 - RNA, 19 nt, Human
ccuucuccccagcucccag

SEQ ID NO: 3384124 - RNA, 20 nt, Human
ccuucuccccagcucccagg

SEQ ID NO: 3384125 - RNA, 23 nt, Human
ccuucuccccagcucccaggacc

SEQ ID NO: 3384126 - RNA, 13 nt, Human
ccuucuccccugc

SEQ ID NO: 3384127 - RNA, 24 nt, Human
ccuucuccccugcacuguaaaaug

SEQ ID NO: 3384128 - RNA, 14 nt, Human
ccuucucccuggau

SEQ ID NO: 3384129 - RNA, 21 nt, Human
ccuucuccuccccacccgccc

SEQ ID NO: 3384130 - RNA, 19 nt, Human
ccuucuccuucaccuuugu

SEQ ID NO: 3384131 - RNA, 19 nt, Human
ccuucuccuugauaacagc

SEQ ID NO: 3384132 - RNA, 20 nt, Human
ccuucuccuugauaacagcu

SEQ ID NO: 3384133 - RNA, 16 nt, Human
ccuucucucaccuccu

SEQ ID NO: 3384134 - RNA, 14 nt, Human
ccuucucucaucuc

SEQ ID NO: 3384135 - RNA, 15 nt, Human
ccuucucucaucucu

SEQ ID NO: 3384136 - RNA, 13 nt, Human
ccuucucuccagc

SEQ ID NO: 3384137 - RNA, 16 nt, Human
ccuucucuccucccca

SEQ ID NO: 3384138 - RNA, 20 nt, Human
ccuucucuccuccccaaauc

SEQ ID NO: 3384139 - RNA, 14 nt, Human
ccuucucucucccu

SEQ ID NO: 3384140 - RNA, 15 nt, Human
ccuucucugaacaca

SEQ ID NO: 3384141 - RNA, 21 nt, Human
ccuucucugaacacaggcagc

SEQ ID NO: 3384142 - RNA, 16 nt, Human
ccuucucugaaggaca

SEQ ID NO: 3384143 - RNA, 22 nt, Human
ccuucucugcccauuccccagc

SEQ ID NO: 3384144 - RNA, 16 nt, Human
ccuucucugcuccacc

SEQ ID NO: 3384145 - RNA, 20 nt, Human
ccuucucugcuccaccacau

SEQ ID NO: 3384146 - RNA, 22 nt, Human
ccuucucugcuccaccacaucc

SEQ ID NO: 3384147 - RNA, 13 nt, Human
ccuucucuguuca

SEQ ID NO: 3384148 - RNA, 13 nt, Human
ccuucucuuccag

SEQ ID NO: 3384149 - RNA, 19 nt, Human
ccuucucuuccaggcagcc

SEQ ID NO: 3384150 - RNA, 12 nt, Human
ccuucugaccca

SEQ ID NO: 3384151 - RNA, 17 nt, Human
ccuucugacccaugcug

SEQ ID NO: 3384152 - RNA, 22 nt, Human
ccuucugacccaugcugcccug

SEQ ID NO: 3384153 - RNA, 16 nt, Human
ccuucugacggcccug

SEQ ID NO: 3384154 - RNA, 17 nt, Human
ccuucugacggcccugc

SEQ ID NO: 3384155 - RNA, 19 nt, Human
ccuucugacggcccugcaa

SEQ ID NO: 3384156 - RNA, 21 nt, Human
ccuucugagcuccuguccccu

SEQ ID NO: 3384157 - RNA, 22 nt, Human
ccuucugagcuccuguccccug

SEQ ID NO: 3384158 - RNA, 19 nt, Human
ccuucugagcuggccucuc

SEQ ID NO: 3384159 - RNA, 13 nt, Human
ccuucugaugucu

SEQ ID NO: 3384160 - RNA, 22 nt, Human
ccuucugaugucucuaaagcac

SEQ ID NO: 3384161 - RNA, 12 nt, Human
ccuucugcucag

SEQ ID NO: 3384162 - RNA, 21 nt, Human
ccuucugcuggauaaaaugag

SEQ ID NO: 3384163 - RNA, 16 nt, Human
cauggcugagcugccc

SEQ ID NO: 3384164 - RNA, 22 nt, Human
ccuguccacacccagcucagca

SEQ ID NO: 3384165 - RNA, 13 nt, Human
ccuguccagagag

SEQ ID NO: 3384166 - RNA, 12 nt, Human
ccuguccagccu

SEQ ID NO: 3384167 - RNA, 13 nt, Human
ccuguccagcucc

SEQ ID NO: 3384168 - RNA, 14 nt, Human
ccuguccagcucca

SEQ ID NO: 3384169 - RNA, 15 nt, Human
ccuguccagcuccaa

SEQ ID NO: 3384170 - RNA, 19 nt, Human
ccuguccagcuccaaccug

SEQ ID NO: 3384171 - RNA, 11 nt, Human
ccugucccacc

SEQ ID NO: 3384172 - RNA, 19 nt, Human
ccugucccacccccuuccc

SEQ ID NO: 3384173 - RNA, 22 nt, Human
ccugucccacccccuuccccca

SEQ ID NO: 3384174 - RNA, 19 nt, Human
caugucaagauucagcuag

SEQ ID NO: 3384175 - RNA, 18 nt, Human
caugucaaggguucaaga

SEQ ID NO: 3384176 - RNA, 22 nt, Human
caugucaccguggaccuuccug

SEQ ID NO: 3384177 - RNA, 15 nt, Human
caugucacugugguc

SEQ ID NO: 3384178 - RNA, 16 nt, Human
caugucacuguggucc

SEQ ID NO: 3384179 - RNA, 14 nt, Human
caugucagacacag

SEQ ID NO: 3384180 - RNA, 22 nt, Human
caugucagcaaaaagcaaaauc

SEQ ID NO: 3384181 - RNA, 16 nt, Human
caugucaggccugugu

SEQ ID NO: 3384182 - RNA, 21 nt, Human
caugucaggccugugugugaa

SEQ ID NO: 3384183 - RNA, 19 nt, Human
caugucagucugcuuagaa

SEQ ID NO: 3384184 - RNA, 18 nt, Human
caugucauuucagaaguu

SEQ ID NO: 3384185 - RNA, 17 nt, Human
cauguccaaagaggcug

SEQ ID NO: 3384186 - RNA, 20 nt, Human
cauguccaaagaggcugccc

SEQ ID NO: 3384187 - RNA, 21 nt, Human
cauguccaaagaggcugcccc

SEQ ID NO: 3384188 - RNA, 21 nt, Human
cauguccagcaccuugugccu

SEQ ID NO: 3384189 - RNA, 22 nt, Human
caugucccuaccgagucucuuc

SEQ ID NO: 3384190 - RNA, 18 nt, Human
cauguccuaauucuucug

SEQ ID NO: 3384191 - RNA, 14 nt, Human
cauguccuguaaag

SEQ ID NO: 3384192 - RNA, 19 nt, Human
cauguccugugucaguuua

SEQ ID NO: 3384193 - RNA, 21 nt, Human
cauguccuuagcacagggggg

SEQ ID NO: 3384194 - RNA, 15 nt, Human
caugucgccucugca

SEQ ID NO: 3384195 - RNA, 22 nt, Human
caugucuauaaucccagcacuu

SEQ ID NO: 3384196 - RNA, 13 nt, Human
caugucuauuguc

SEQ ID NO: 3384197 - RNA, 14 nt, Human
caugucuauugucc

SEQ ID NO: 3384198 - RNA, 16 nt, Human
caugucuccuauccug

SEQ ID NO: 3384199 - RNA, 22 nt, Human
caugucuccuuuaagagcucug

SEQ ID NO: 3384200 - RNA, 17 nt, Human
caugucucucagaauuc

SEQ ID NO: 3384201 - RNA, 14 nt, Human
caugucuuaaugaa

SEQ ID NO: 3384202 - RNA, 18 nt, Human
caugucuuaaugaaguuu

SEQ ID NO: 3384203 - RNA, 23 nt, Human
caugucuuaaugaaguuugaaug

SEQ ID NO: 3384204 - RNA, 15 nt, Human
caugucuuguacaug

SEQ ID NO: 3384205 - RNA, 14 nt, Human
caugucuuuucuug

SEQ ID NO: 3384206 - RNA, 13 nt, Human
caugugaaaccuu

SEQ ID NO: 3384207 - RNA, 21 nt, Human
caugugaaaccuuuuuuaaga

SEQ ID NO: 3384208 - RNA, 13 nt, Human
caugugaagaggg

SEQ ID NO: 3384209 - RNA, 12 nt, Human
caugugacacau

SEQ ID NO: 3384210 - RNA, 14 nt, Human
caugugacacauau

SEQ ID NO: 3384211 - RNA, 16 nt, Human
caugugacacauaugc

SEQ ID NO: 3384212 - RNA, 14 nt, Human
caugugacauuuau

SEQ ID NO: 3384213 - RNA, 16 nt, Human
caugugacauuuauau

SEQ ID NO: 3384214 - RNA, 21 nt, Human
caugugacuccuaugaucuca

SEQ ID NO: 3384215 - RNA, 20 nt, Human
caugugacucuggcuuggcc

SEQ ID NO: 3384216 - RNA, 18 nt, Human
caugugagcucuuccuau

SEQ ID NO: 3384217 - RNA, 20 nt, Human
caugugagcugcugccauga

SEQ ID NO: 3384218 - RNA, 21 nt, Human
caugugagugacgaugaugua

SEQ ID NO: 3384219 - RNA, 12 nt, Human
caugugauccuu

SEQ ID NO: 3384220 - RNA, 15 nt, Human
caugugaugagagga

SEQ ID NO: 3384221 - RNA, 18 nt, Human
caugugaugagaggaaau

SEQ ID NO: 3384222 - RNA, 17 nt, Human
caugugauggacacucc

SEQ ID NO: 3384223 - RNA, 16 nt, Human
caugugcauaacaaau

SEQ ID NO: 3384224 - RNA, 23 nt, Human
caugugcauaacaaauucugaau

SEQ ID NO: 3384225 - RNA, 16 nt, Human
caugugcauaguuucu

SEQ ID NO: 3384226 - RNA, 18 nt, Human
caugugcauuauuuucca

SEQ ID NO: 3384227 - RNA, 16 nt, Human
caugugccgaaugugc

SEQ ID NO: 3384228 - RNA, 16 nt, Human
caugugccucuuuguc

SEQ ID NO: 3384229 - RNA, 15 nt, Human
caugugccugcacca

SEQ ID NO: 3384230 - RNA, 18 nt, Human
caugugcugcccuacagc

SEQ ID NO: 3384231 - RNA, 23 nt, Human
caugugcugugaccauuuauaau

SEQ ID NO: 3384232 - RNA, 15 nt, Human
caugugcuucugcca

SEQ ID NO: 3384233 - RNA, 21 nt, Human
cauguggaaaaaaaaaagaug

SEQ ID NO: 3384234 - RNA, 17 nt, Human
cauguggaaagugaauu

SEQ ID NO: 3384235 - RNA, 22 nt, Human
cauguggaaggcaagccaggcu

SEQ ID NO: 3384236 - RNA, 23 nt, Human
cauguggaaggcaagccaggcuc

SEQ ID NO: 3384237 - RNA, 18 nt, Human
cauguggagucagccucg

SEQ ID NO: 3384238 - RNA, 15 nt, Human
cauguggccccaccc

SEQ ID NO: 3384239 - RNA, 22 nt, Human
cauguggcuguagaucccaaga

SEQ ID NO: 3384240 - RNA, 21 nt, Human
cauguggcuuuuuuaaaaaag

SEQ ID NO: 3384241 - RNA, 23 nt, Human
caugugggccacacaagugcagu

SEQ ID NO: 3384242 - RNA, 13 nt, Human
caugugggcuuca

SEQ ID NO: 3384243 - RNA, 18 nt, Human
cauguggggccaggucac

SEQ ID NO: 3384244 - RNA, 14 nt, Human
cauguggugaugau

SEQ ID NO: 3384245 - RNA, 12 nt, Human
caugugguggga

SEQ ID NO: 3384246 - RNA, 16 nt, Human
caugugguuacacagu

SEQ ID NO: 3384247 - RNA, 15 nt, Human
caugugguuuauaga

SEQ ID NO: 3384248 - RNA, 20 nt, Human
caugugguuuauagagggcc

SEQ ID NO: 3384249 - RNA, 14 nt, Human
caugugguuugaaa

SEQ ID NO: 3384250 - RNA, 22 nt, Human
caugugguuugguuccucucug

SEQ ID NO: 3384251 - RNA, 17 nt, Human
cauguguaaucaauaaa

SEQ ID NO: 3384252 - RNA, 18 nt, Human
cauguguaaucaauaaac

SEQ ID NO: 3384253 - RNA, 20 nt, Human
cauguguacuuaauuucuuu

SEQ ID NO: 3384254 - RNA, 17 nt, Human
cauguguauaaaaauaa

SEQ ID NO: 3384255 - RNA, 12 nt, Human
cauguguauguu

SEQ ID NO: 3384256 - RNA, 17 nt, Human
caugugucacuugugcu

SEQ ID NO: 3384257 - RNA, 18 nt, Human
caugugucacuugugcuu

SEQ ID NO: 3384258 - RNA, 15 nt, Human
caugugucaugcaug

SEQ ID NO: 3384259 - RNA, 17 nt, Human
cauguguccaucccagc

SEQ ID NO: 3384260 - RNA, 18 nt, Human
caugugugcaacagggua

SEQ ID NO: 3384261 - RNA, 19 nt, Human
caugugugcgagugugugc

SEQ ID NO: 3384262 - RNA, 20 nt, Human
caugugugcucuucuucuuu

SEQ ID NO: 3384263 - RNA, 12 nt, Human
cauguguggaag

SEQ ID NO: 3384264 - RNA, 13 nt, Human
cauguguguauaa

SEQ ID NO: 3384265 - RNA, 17 nt, Human
cauguguguauauaugu

SEQ ID NO: 3384266 - RNA, 12 nt, Human
caugugugucca

SEQ ID NO: 3384267 - RNA, 23 nt, Human
cauguguguccacgacugucucc

SEQ ID NO: 3384268 - RNA, 13 nt, Human
caugugugugugu

SEQ ID NO: 3384269 - RNA, 14 nt, Human
cauguguugaaaaa

SEQ ID NO: 3384270 - RNA, 14 nt, Human
cauguguuuauccu

SEQ ID NO: 3384271 - RNA, 19 nt, Human
cauguguuugguucugggg

SEQ ID NO: 3384272 - RNA, 18 nt, Human
cauguguuuuauaaaauc

SEQ ID NO: 3384273 - RNA, 13 nt, Human
cauguuaauuuca

SEQ ID NO: 3384274 - RNA, 12 nt, Human
cauguuaccauc

SEQ ID NO: 3384275 - RNA, 16 nt, Human
cauguuagcccuuccu

SEQ ID NO: 3384276 - RNA, 19 nt, Human
cauguuaggaaaauuucac

SEQ ID NO: 3384277 - RNA, 16 nt, Human
cauguuaguaauaccu

SEQ ID NO: 3384278 - RNA, 18 nt, Human
cauguuaguaauaccucu

SEQ ID NO: 3384279 - RNA, 13 nt, Human
cauguuauauauu

SEQ ID NO: 3384280 - RNA, 20 nt, Human
cauguuaugauaaaaaauuu

SEQ ID NO: 3384281 - RNA, 22 nt, Human
cauguuaugauaaaaaauuuug

SEQ ID NO: 3384282 - RNA, 23 nt, Human
cauguuaugauaaaaaauuuugu

SEQ ID NO: 3384283 - RNA, 23 nt, Human
cauguuauuuguaauagauguuu

SEQ ID NO: 3384284 - RNA, 22 nt, Human
cauguucaaagccacauuauuu

SEQ ID NO: 3384285 - RNA, 16 nt, Human
cauguuccacuaaccc

SEQ ID NO: 3384286 - RNA, 13 nt, Human
cauguuccucaaa

SEQ ID NO: 3384287 - RNA, 20 nt, Human
cauguuccuucaagaucaug

SEQ ID NO: 3384288 - RNA, 13 nt, Human
cauguucugcccc

SEQ ID NO: 3384289 - RNA, 15 nt, Human
cauguucugccccca

SEQ ID NO: 3384290 - RNA, 16 nt, Human
cauguucugcccccag

SEQ ID NO: 3384291 - RNA, 17 nt, Human
cauguucugcccccagc

SEQ ID NO: 3384292 - RNA, 19 nt, Human
cauguucugcccccagccc

SEQ ID NO: 3384293 - RNA, 14 nt, Human
cauguucugucccu

SEQ ID NO: 3384294 - RNA, 18 nt, Human
cauguucugucccuugcc

SEQ ID NO: 3384295 - RNA, 16 nt, Human
cauguucuuaauucuu

SEQ ID NO: 3384296 - RNA, 18 nt, Human
cauguucuuaauucuuag

SEQ ID NO: 3384297 - RNA, 20 nt, Human
cauguugaucauguacuuuu

SEQ ID NO: 3384298 - RNA, 18 nt, Human
cauguugcacacccacuc

SEQ ID NO: 3384299 - RNA, 17 nt, Human
cauguugccccuuucuc

SEQ ID NO: 3384300 - RNA, 12 nt, Human
cauguuggccag

SEQ ID NO: 3384301 - RNA, 20 nt, Human
cauguuggccaggcugcucu

SEQ ID NO: 3384302 - RNA, 23 nt, Human
cauguuggccaggcugcucucaa

SEQ ID NO: 3384303 - RNA, 22 nt, Human
cauguuggucaaaagcuggauu

SEQ ID NO: 3384304 - RNA, 21 nt, Human
cauguugguugcacuuuguag

SEQ ID NO: 3384305 - RNA, 12 nt, Human
cauguuguaaug

SEQ ID NO: 3384306 - RNA, 21 nt, Human
cauguugugccucccugguga

SEQ ID NO: 3384307 - RNA, 14 nt, Human
cauguuuaagauuu

SEQ ID NO: 3384308 - RNA, 19 nt, Human
cauguuuacuuuucagggc

SEQ ID NO: 3384309 - RNA, 21 nt, Human
cgagagacuuguggccuggga

SEQ ID NO: 3384310 - RNA, 21 nt, Human
cgagagagcaccccucucugc

SEQ ID NO: 3384311 - RNA, 16 nt, Human
cgagagaggagccaga

SEQ ID NO: 3384312 - RNA, 12 nt, Human
cgagagcgcagc

SEQ ID NO: 3384313 - RNA, 15 nt, Human
cgagaggaggggccc

SEQ ID NO: 3384314 - RNA, 19 nt, Human
cgagaggccaaaggcuggu

SEQ ID NO: 3384315 - RNA, 22 nt, Human
cgagaggggccgaugcccagag

SEQ ID NO: 3384316 - RNA, 19 nt, Human
cgagaggugggccagucug

SEQ ID NO: 3384317 - RNA, 23 nt, Human
cgagaggugggccagucugugga

SEQ ID NO: 3384318 - RNA, 19 nt, Human
cgagaguagccgagagccu

SEQ ID NO: 3384319 - RNA, 15 nt, Human
cgagagucugucuca

SEQ ID NO: 3384320 - RNA, 17 nt, Human
cgagaucacgccacugc

SEQ ID NO: 3384321 - RNA, 19 nt, Human
cgagaucaguauuuaacua

SEQ ID NO: 3384322 - RNA, 13 nt, Human
cgagaucccaaca

SEQ ID NO: 3384323 - RNA, 21 nt, Human
cgagaucccaacacugccagc

SEQ ID NO: 3384324 - RNA, 22 nt, Human
cgagaucccaacacugccagca

SEQ ID NO: 3384325 - RNA, 21 nt, Human
cgagauuaucguuuucuuaaa

SEQ ID NO: 3384326 - RNA, 18 nt, Human
cgagcagggugcuguggg

SEQ ID NO: 3384327 - RNA, 17 nt, Human
cgagcaguccugccuca

SEQ ID NO: 3384328 - RNA, 15 nt, Human
cgagcaugucgugga

SEQ ID NO: 3384329 - RNA, 16 nt, Human
cgagccauuuguccca

SEQ ID NO: 3384330 - RNA, 19 nt, Human
cgagccauuugucccaagu

SEQ ID NO: 3384331 - RNA, 20 nt, Human
cgagccauuugucccaagug

SEQ ID NO: 3384332 - RNA, 22 nt, Human
cgagccauuugucccaagugcc

SEQ ID NO: 3384333 - RNA, 15 nt, Human
cgagcgcccagcucc

SEQ ID NO: 3384334 - RNA, 13 nt, Human
cgagcgcccugca

SEQ ID NO: 3384335 - RNA, 19 nt, Human
cgagcgcuaucuucacaua

SEQ ID NO: 3384336 - RNA, 15 nt, Human
cgagcuccagagcaa

SEQ ID NO: 3384337 - RNA, 17 nt, Human
cgagcucguguauccug

SEQ ID NO: 3384338 - RNA, 20 nt, Human
cgagcucguguauccugggg

SEQ ID NO: 3384339 - RNA, 20 nt, Human
cgagcugggggccaugagcu

SEQ ID NO: 3384340 - RNA, 15 nt, Human
cgagcuggugcauua

SEQ ID NO: 3384341 - RNA, 23 nt, Human
cgagcuggugcauuacagagagg

SEQ ID NO: 3384342 - RNA, 14 nt, Human
cgaggaaacucaga

SEQ ID NO: 3384343 - RNA, 14 nt, Human
cgaggaaccagagc

SEQ ID NO: 3384344 - RNA, 16 nt, Human
cgaggaaccagagcca

SEQ ID NO: 3384345 - RNA, 16 nt, Human
cgaggaaucugugggu

SEQ ID NO: 3384346 - RNA, 12 nt, Human
cgaggacaggga

SEQ ID NO: 3384347 - RNA, 20 nt, Human
cgaggacccagacccagugg

SEQ ID NO: 3384348 - RNA, 15 nt, Human
cgaggacccaggaaa

SEQ ID NO: 3384349 - RNA, 18 nt, Human
cgaggacuguauuuguga

SEQ ID NO: 3384350 - RNA, 19 nt, Human
cgaggacuguauuugugac

SEQ ID NO: 3384351 - RNA, 20 nt, Human
cgaggacuguauuugugacu

SEQ ID NO: 3384352 - RNA, 18 nt, Human
cgaggagggagagucucc

SEQ ID NO: 3384353 - RNA, 23 nt, Human
cgaggagggagagucucccaggg

SEQ ID NO: 3384354 - RNA, 23 nt, Human
cgaggaggugccuggagugccca

SEQ ID NO: 3384355 - RNA, 20 nt, Human
cgaggaggugucucaggcug

SEQ ID NO: 3384356 - RNA, 15 nt, Human
cgaggcagaggacag

SEQ ID NO: 3384357 - RNA, 19 nt, Human
cgaggccaguaccuuucca

SEQ ID NO: 3384358 - RNA, 21 nt, Human
cgaggcccucgggcccagccc

SEQ ID NO: 3384359 - RNA, 15 nt, Human
cgaggcccugcaugg

SEQ ID NO: 3384360 - RNA, 16 nt, Human
cgaggcuggagcuggc

SEQ ID NO: 3384361 - RNA, 17 nt, Human
cgaggcugggccaagcc

SEQ ID NO: 3384362 - RNA, 18 nt, Human
cgaggcugggccaagcca

SEQ ID NO: 3384363 - RNA, 14 nt, Human
cauucaaaaauuuc

SEQ ID NO: 3384364 - RNA, 17 nt, Human
cauucaaaaguugaaau

SEQ ID NO: 3384365 - RNA, 12 nt, Human
cauucaaauuaa

SEQ ID NO: 3384366 - RNA, 14 nt, Human
cauucaagauuccc

SEQ ID NO: 3384367 - RNA, 18 nt, Human
cauucaaguguaaaauau

SEQ ID NO: 3384368 - RNA, 19 nt, Human
cauucaaguguaaaauauu

SEQ ID NO: 3384369 - RNA, 20 nt, Human
cauucaaguguaaaauauuu

SEQ ID NO: 3384370 - RNA, 22 nt, Human
cauucacaguucuuugggccag

SEQ ID NO: 3384371 - RNA, 15 nt, Human
cauucacauuuagaa

SEQ ID NO: 3384372 - RNA, 22 nt, Human
cauucacggagauaugaagagc

SEQ ID NO: 3384373 - RNA, 15 nt, Human
cauucacuagcuuug

SEQ ID NO: 3384374 - RNA, 20 nt, Human
cauucacucuuccagaaucc

SEQ ID NO: 3384375 - RNA, 14 nt, Human
cauucacuucacug

SEQ ID NO: 3384376 - RNA, 17 nt, Human
cauucacuucacugugc

SEQ ID NO: 3384377 - RNA, 15 nt, Human
cauucacuucauaau

SEQ ID NO: 3384378 - RNA, 17 nt, Human
cauucagaagaaaaaga

SEQ ID NO: 3384379 - RNA, 21 nt, Human
cauucagauaugauucaaaug

SEQ ID NO: 3384380 - RNA, 13 nt, Human
cauucaggaaaac

SEQ ID NO: 3384381 - RNA, 20 nt, Human
cauucaggaaaacugacaga

SEQ ID NO: 3384382 - RNA, 23 nt, Human
cauucaggaaaacugacagagga

SEQ ID NO: 3384383 - RNA, 19 nt, Human
cauucagugauuacuguca

SEQ ID NO: 3384384 - RNA, 20 nt, Human
cauucagugauuacugucaa

SEQ ID NO: 3384385 - RNA, 15 nt, Human
cauucauaacuuuca

SEQ ID NO: 3384386 - RNA, 19 nt, Human
cauucauauuacaauauuu

SEQ ID NO: 3384387 - RNA, 18 nt, Human
cauucaucuuguguuuua

SEQ ID NO: 3384388 - RNA, 14 nt, Human
cauucaugccuggc

SEQ ID NO: 3384389 - RNA, 16 nt, Human
cauucaugccuggcuu

SEQ ID NO: 3384390 - RNA, 15 nt, Human
cauucauuccauucu

SEQ ID NO: 3384391 - RNA, 20 nt, Human
cauucauuuagcuaaacgga

SEQ ID NO: 3384392 - RNA, 17 nt, Human
cauucauuuuauauuga

SEQ ID NO: 3384393 - RNA, 18 nt, Human
cauucauuuuauauugaa

SEQ ID NO: 3384394 - RNA, 19 nt, Human
cauucauuuucuggguguu

SEQ ID NO: 3384395 - RNA, 11 nt, Human
cauucauuuuu

SEQ ID NO: 3384396 - RNA, 17 nt, Human
cauuccaaagcuuuauu

SEQ ID NO: 3384397 - RNA, 22 nt, Human
cauuccaacuaucucauuucca

SEQ ID NO: 3384398 - RNA, 23 nt, Human
cauuccaagacaguauacagucc

SEQ ID NO: 3384399 - RNA, 14 nt, Human
cauuccaagacucu

SEQ ID NO: 3384400 - RNA, 19 nt, Human
cauuccaggcagccucugu

SEQ ID NO: 3384401 - RNA, 12 nt, Human
cauuccaggccc

SEQ ID NO: 3384402 - RNA, 12 nt, Human
cauuccaggcuc

SEQ ID NO: 3384403 - RNA, 13 nt, Human
cauuccaggcucc

SEQ ID NO: 3384404 - RNA, 17 nt, Human
cauuccaggcuccuccc

SEQ ID NO: 3384405 - RNA, 16 nt, Human
cauuccagucaggcuc

SEQ ID NO: 3384406 - RNA, 15 nt, Human
cauuccauaaauguc

SEQ ID NO: 3384407 - RNA, 17 nt, Human
cauuccaugugcccagu

SEQ ID NO: 3384408 - RNA, 18 nt, Human
cauuccaugugcccaguu

SEQ ID NO: 3384409 - RNA, 21 nt, Human
cauuccaugugcccaguuaau

SEQ ID NO: 3384410 - RNA, 11 nt, Human
cauucccaggu

SEQ ID NO: 3384411 - RNA, 13 nt, Human
cauuccccaggag

SEQ ID NO: 3384412 - RNA, 13 nt, Human
cauucccccagug

SEQ ID NO: 3384413 - RNA, 14 nt, Human
cauucccccagugc

SEQ ID NO: 3384414 - RNA, 17 nt, Human
cauuccccgucucuggu

SEQ ID NO: 3384415 - RNA, 19 nt, Human
cauucccgcagugggagca

SEQ ID NO: 3384416 - RNA, 18 nt, Human
cauucccucgucuuuccc

SEQ ID NO: 3384417 - RNA, 11 nt, Human
cauucccugag

SEQ ID NO: 3384418 - RNA, 17 nt, Human
cauucccugagucacca

SEQ ID NO: 3384419 - RNA, 20 nt, Human
cauucccugagucaccagga

SEQ ID NO: 3384420 - RNA, 21 nt, Human
cauucccugagucaccaggaa

SEQ ID NO: 3384421 - RNA, 15 nt, Human
cauucccugggaucu

SEQ ID NO: 3384422 - RNA, 22 nt, Human
cauuccuaaagaaaaauaucuu

SEQ ID NO: 3384423 - RNA, 21 nt, Human
cauuccuaacacagcaugugu

SEQ ID NO: 3384424 - RNA, 13 nt, Human
cauuccucaccuu

SEQ ID NO: 3384425 - RNA, 16 nt, Human
cauuccucagggacag

SEQ ID NO: 3384426 - RNA, 16 nt, Human
cauuccugaagaacca

SEQ ID NO: 3384427 - RNA, 21 nt, Human
cauuccugaagaaccaguccc

SEQ ID NO: 3384428 - RNA, 16 nt, Human
cauuccugaugcuucu

SEQ ID NO: 3384429 - RNA, 14 nt, Human
cauuccugccuguc

SEQ ID NO: 3384430 - RNA, 16 nt, Human
cauuccugccugucuc

SEQ ID NO: 3384431 - RNA, 21 nt, Human
cauuccuggaaaccacagucc

SEQ ID NO: 3384432 - RNA, 16 nt, Human
cauuccuggagcccga

SEQ ID NO: 3384433 - RNA, 15 nt, Human
cauuccugguaccca

SEQ ID NO: 3384434 - RNA, 17 nt, Human
cauuccugguacccagc

SEQ ID NO: 3384435 - RNA, 18 nt, Human
cauuccuguauucacccg

SEQ ID NO: 3384436 - RNA, 22 nt, Human
cauuccuucccagaggggccug

SEQ ID NO: 3384437 - RNA, 15 nt, Human
cauuccuucuuugau

SEQ ID NO: 3384438 - RNA, 13 nt, Human
cauuccuugccug

SEQ ID NO: 3384439 - RNA, 22 nt, Human
cauucgaagauccccagacuuc

SEQ ID NO: 3384440 - RNA, 22 nt, Human
cauucgcuacuaugauuuaauu

SEQ ID NO: 3384441 - RNA, 13 nt, Human
cauucggcucccu

SEQ ID NO: 3384442 - RNA, 18 nt, Human
cauucggcucccuggagc

SEQ ID NO: 3384443 - RNA, 19 nt, Human
cauucguacauaauacuga

SEQ ID NO: 3384444 - RNA, 13 nt, Human
cauucgugaaaac

SEQ ID NO: 3384445 - RNA, 16 nt, Human
cauucuaaccuggagg

SEQ ID NO: 3384446 - RNA, 16 nt, Human
cauucuacacagagca

SEQ ID NO: 3384447 - RNA, 13 nt, Human
cauucuacuugcu

SEQ ID NO: 3384448 - RNA, 15 nt, Human
cauucuacuugcucu

SEQ ID NO: 3384449 - RNA, 18 nt, Human
cauucuacuugcucugga

SEQ ID NO: 3384450 - RNA, 21 nt, Human
cauucuacuugcucuggaccu

SEQ ID NO: 3384451 - RNA, 21 nt, Human
cauucuagagugcauauauuu

SEQ ID NO: 3384452 - RNA, 23 nt, Human
cauucuaggccuccuggcccagg

SEQ ID NO: 3384453 - RNA, 17 nt, Human
cauucuaucaagcccag

SEQ ID NO: 3384454 - RNA, 16 nt, Human
cgcacaaggcugacca

SEQ ID NO: 3384455 - RNA, 20 nt, Human
cgcacacacacacacaggag

SEQ ID NO: 3384456 - RNA, 12 nt, Human
cgcacacagcuu

SEQ ID NO: 3384457 - RNA, 22 nt, Human
cgcacacccucacucugccagg

SEQ ID NO: 3384458 - RNA, 12 nt, Human
cgcacagacagg

SEQ ID NO: 3384459 - RNA, 13 nt, Human
cgcacagacaggu

SEQ ID NO: 3384460 - RNA, 20 nt, Human
cgcacagcagccugcuuccc

SEQ ID NO: 3384461 - RNA, 17 nt, Human
cgcaccagcccagaagu

SEQ ID NO: 3384462 - RNA, 13 nt, Human
cgcacccccaccc

SEQ ID NO: 3384463 - RNA, 22 nt, Human
cgcaccccgauguggaccucua

SEQ ID NO: 3384464 - RNA, 19 nt, Human
cgcaccuaccaucagggac

SEQ ID NO: 3384465 - RNA, 16 nt, Human
cgcaccugccucagga

SEQ ID NO: 3384466 - RNA, 14 nt, Human
cgcaccuguacagu

SEQ ID NO: 3384467 - RNA, 14 nt, Human
cgcacgcacacaca

SEQ ID NO: 3384468 - RNA, 18 nt, Human
cgcacgugggucuucagg

SEQ ID NO: 3384469 - RNA, 16 nt, Human
cgcacuccaugagcac

SEQ ID NO: 3384470 - RNA, 13 nt, Human
cgcacucuggcag

SEQ ID NO: 3384471 - RNA, 12 nt, Human
cgcacuguggau

SEQ ID NO: 3384472 - RNA, 17 nt, Human
cgcacuuuccuccuggc

SEQ ID NO: 3384473 - RNA, 19 nt, Human
cgcagaacgaaccuuggcc

SEQ ID NO: 3384474 - RNA, 13 nt, Human
cgcagaaggaagg

SEQ ID NO: 3384475 - RNA, 15 nt, Human
cgcagaccuccccag

SEQ ID NO: 3384476 - RNA, 19 nt, Human
cgcagaccuccccagcccc

SEQ ID NO: 3384477 - RNA, 13 nt, Human
cgcagaccucugg

SEQ ID NO: 3384478 - RNA, 14 nt, Human
cgcagagaggccag

SEQ ID NO: 3384479 - RNA, 19 nt, Human
cgcagagcgcgccccuagc

SEQ ID NO: 3384480 - RNA, 14 nt, Human
cgcagaugauccau

SEQ ID NO: 3384481 - RNA, 19 nt, Human
cgcagaugugcagcagauu

SEQ ID NO: 3384482 - RNA, 18 nt, Human
cgcagcaggaggccaggc

SEQ ID NO: 3384483 - RNA, 18 nt, Human
cgcagcauccgaccaggu

SEQ ID NO: 3384484 - RNA, 21 nt, Human
cgcagccaaggccgaagcucu

SEQ ID NO: 3384485 - RNA, 11 nt, Human
cgcagccaccc

SEQ ID NO: 3384486 - RNA, 13 nt, Human
cgcagccacccug

SEQ ID NO: 3384487 - RNA, 14 nt, Human
cgcagccacccuga

SEQ ID NO: 3384488 - RNA, 16 nt, Human
cgcagccacccugagg

SEQ ID NO: 3384489 - RNA, 22 nt, Human
cgcagccacccugaggagucug

SEQ ID NO: 3384490 - RNA, 15 nt, Human
cgcagccaggacacc

SEQ ID NO: 3384491 - RNA, 13 nt, Human
cgcagccccaucu

SEQ ID NO: 3384492 - RNA, 18 nt, Human
cgcagccccaucugugca

SEQ ID NO: 3384493 - RNA, 18 nt, Human
cgcagcccuagagccugc

SEQ ID NO: 3384494 - RNA, 19 nt, Human
cgcagcccuagagccugcc

SEQ ID NO: 3384495 - RNA, 17 nt, Human
cgcagcccugcagaggg

SEQ ID NO: 3384496 - RNA, 23 nt, Human
cgcagcccuggcagggggcaugc

SEQ ID NO: 3384497 - RNA, 23 nt, Human
cgcagccucucagugcccuccag

SEQ ID NO: 3384498 - RNA, 11 nt, Human
cgcagccugag

SEQ ID NO: 3384499 - RNA, 12 nt, Human
cgcagccugagu

SEQ ID NO: 3384500 - RNA, 19 nt, Human
cgcagcucuugcccuuccc

SEQ ID NO: 3384501 - RNA, 23 nt, Human
cgcagcucuugcccuucccuguc

SEQ ID NO: 3384502 - RNA, 17 nt, Human
cgcaggaacucccagca

SEQ ID NO: 3384503 - RNA, 18 nt, Human
cgcaggaacucccagcaa

SEQ ID NO: 3384504 - RNA, 15 nt, Human
cgcaggaagcugcuc

SEQ ID NO: 3384505 - RNA, 22 nt, Human
cgcaggauucuuccucccuccc

SEQ ID NO: 3384506 - RNA, 19 nt, Human
cgcaggccucccugccagu

SEQ ID NO: 3384507 - RNA, 17 nt, Human
cgcaggcuggcccugcc

SEQ ID NO: 3384508 - RNA, 18 nt, Human
cgcaggcuggcccugccc

SEQ ID NO: 3384509 - RNA, 20 nt, Human
cgcaggcuggcccugcccug

SEQ ID NO: 3384510 - RNA, 22 nt, Human
cgcaggcuggcccugcccuggu

SEQ ID NO: 3384511 - RNA, 13 nt, Human
cgcaggugggcug

SEQ ID NO: 3384512 - RNA, 23 nt, Human
cgcaguccacuucugacagccuc

SEQ ID NO: 3384513 - RNA, 22 nt, Human
cgcagucgucgcacagucucuc

SEQ ID NO: 3384514 - RNA, 19 nt, Human
cgcagugcuucucuacaga

SEQ ID NO: 3384515 - RNA, 23 nt, Human
cgcagugggagcaaacugcaugc

SEQ ID NO: 3384516 - RNA, 12 nt, Human
cgcaguuuuuuu

SEQ ID NO: 3384517 - RNA, 21 nt, Human
cgcaguuuuuuuuuucuuguc

SEQ ID NO: 3384518 - RNA, 15 nt, Human
cgcauaggaccuuuc

SEQ ID NO: 3384519 - RNA, 14 nt, Human
cgcauccccugccu

SEQ ID NO: 3384520 - RNA, 16 nt, Human
cgcauccccugccucc

SEQ ID NO: 3384521 - RNA, 15 nt, Human
cgcauccuagucucu

SEQ ID NO: 3384522 - RNA, 22 nt, Human
cgcaucuaguuccccuguuuau

SEQ ID NO: 3384523 - RNA, 13 nt, Human
cgcaucuucucca

SEQ ID NO: 3384524 - RNA, 16 nt, Human
cgcaucuugccuccag

SEQ ID NO: 3384525 - RNA, 17 nt, Human
cgcaucuugccuccagg

SEQ ID NO: 3384526 - RNA, 14 nt, Human
cgcaugcagcagcu

SEQ ID NO: 3384527 - RNA, 20 nt, Human
cgcaugcccccucgugccag

SEQ ID NO: 3384528 - RNA, 22 nt, Human
cgcauggaguguguauuguucc

SEQ ID NO: 3384529 - RNA, 16 nt, Human
ccuugagcccuggcug

SEQ ID NO: 3384530 - RNA, 17 nt, Human
ccuugagcuccccaaaa

SEQ ID NO: 3384531 - RNA, 14 nt, Human
ccuugagcugagau

SEQ ID NO: 3384532 - RNA, 16 nt, Human
ccuugaggagucuugu

SEQ ID NO: 3384533 - RNA, 18 nt, Human
ccuugaggagucuugugu

SEQ ID NO: 3384534 - RNA, 11 nt, Human
ccuugagggag

SEQ ID NO: 3384535 - RNA, 15 nt, Human
ccuugagggcugcag

SEQ ID NO: 3384536 - RNA, 16 nt, Human
ccuugagggcugcagu

SEQ ID NO: 3384537 - RNA, 19 nt, Human
ccuugaguaguuuuuaucu

SEQ ID NO: 3384538 - RNA, 14 nt, Human
ccuugagugggguu

SEQ ID NO: 3384539 - RNA, 23 nt, Human
ccuugagugggguuaucucugug

SEQ ID NO: 3384540 - RNA, 22 nt, Human
ccuugaguugauucagcucugc

SEQ ID NO: 3384541 - RNA, 23 nt, Human
ccuugauaauauauuguguugac

SEQ ID NO: 3384542 - RNA, 18 nt, Human
ccuugaucagccccaccc

SEQ ID NO: 3384543 - RNA, 20 nt, Human
ccuugaucagccccacccug

SEQ ID NO: 3384544 - RNA, 13 nt, Human
ccuugaucauuuu

SEQ ID NO: 3384545 - RNA, 14 nt, Human
ccuugaugaagaag

SEQ ID NO: 3384546 - RNA, 15 nt, Human
ccuugaugauuuaau

SEQ ID NO: 3384547 - RNA, 18 nt, Human
ccuugaugcacagagaag

SEQ ID NO: 3384548 - RNA, 13 nt, Human
ccuugauuggaag

SEQ ID NO: 3384549 - RNA, 19 nt, Human
ccuugauuuaaacacacag

SEQ ID NO: 3384550 - RNA, 16 nt, Human
ccuugcaacacacaga

SEQ ID NO: 3384551 - RNA, 18 nt, Human
ccuugcaacacacagaca

SEQ ID NO: 3384552 - RNA, 15 nt, Human
ccuugcaagaaucag

SEQ ID NO: 3384553 - RNA, 24 nt, Human
ccuugcacacaucaucuguaagcu

SEQ ID NO: 3384554 - RNA, 18 nt, Human
ccuugcacacucagaagc

SEQ ID NO: 3384555 - RNA, 19 nt, Human
ccuugcacacuccccugca

SEQ ID NO: 3384556 - RNA, 14 nt, Human
ccuugcacauagua

SEQ ID NO: 3384557 - RNA, 13 nt, Human
ccuugcaccccuc

SEQ ID NO: 3384558 - RNA, 14 nt, Human
ccuugcaccccuca

SEQ ID NO: 3384559 - RNA, 15 nt, Human
ccuugcagcuaguuu

SEQ ID NO: 3384560 - RNA, 21 nt, Human
ccuugcauuuuagcuaauuua

SEQ ID NO: 3384561 - RNA, 13 nt, Human
ccuugccacccca

SEQ ID NO: 3384562 - RNA, 23 nt, Human
ccuugccaccccacccucccugg

SEQ ID NO: 3384563 - RNA, 19 nt, Human
ccuugccagcugcugagcc

SEQ ID NO: 3384564 - RNA, 23 nt, Human
ccuugccauccuaaaagccaccc

SEQ ID NO: 3384565 - RNA, 15 nt, Human
ccuugcccaccccac

SEQ ID NO: 3384566 - RNA, 19 nt, Human
ccuugcccacuccugcucu

SEQ ID NO: 3384567 - RNA, 11 nt, Human
ccuugcccaga

SEQ ID NO: 3384568 - RNA, 13 nt, Human
ccuugcccagccu

SEQ ID NO: 3384569 - RNA, 16 nt, Human
ccuugcccagccugga

SEQ ID NO: 3384570 - RNA, 15 nt, Human
ccuugcccagggcuc

SEQ ID NO: 3384571 - RNA, 16 nt, Human
ccuugcccagggcuca

SEQ ID NO: 3384572 - RNA, 22 nt, Human
ccuugcccagggcucagccugg

SEQ ID NO: 3384573 - RNA, 21 nt, Human
ccuugccccccuggccucccc

SEQ ID NO: 3384574 - RNA, 12 nt, Human
ccuugcccugac

SEQ ID NO: 3384575 - RNA, 16 nt, Human
ccuugccgucuaccug

SEQ ID NO: 3384576 - RNA, 17 nt, Human
ccuugccgucuaccuga

SEQ ID NO: 3384577 - RNA, 19 nt, Human
ccuugccucaaugccagua

SEQ ID NO: 3384578 - RNA, 22 nt, Human
ccuugccuccccauuucccauc

SEQ ID NO: 3384579 - RNA, 12 nt, Human
ccuugccuccug

SEQ ID NO: 3384580 - RNA, 15 nt, Human
ccuugccuccugugu

SEQ ID NO: 3384581 - RNA, 21 nt, Human
ccuugccugaacauccuuccu

SEQ ID NO: 3384582 - RNA, 12 nt, Human
ccuugccuggua

SEQ ID NO: 3384583 - RNA, 18 nt, Human
ccuugccuuucgaggccu

SEQ ID NO: 3384584 - RNA, 19 nt, Human
ccuugccuuucgaggccug

SEQ ID NO: 3384585 - RNA, 17 nt, Human
ccuugcggcuccucagg

SEQ ID NO: 3384586 - RNA, 20 nt, Human
ccuugcggcuccucagggac

SEQ ID NO: 3384587 - RNA, 20 nt, Human
ccuugcgguauccgccccca

SEQ ID NO: 3384588 - RNA, 23 nt, Human
ccuugcuaccacggccuccuuuc

SEQ ID NO: 3384589 - RNA, 14 nt, Human
ccuugcuacccaga

SEQ ID NO: 3384590 - RNA, 18 nt, Human
ccuugcucgcuguaaaau

SEQ ID NO: 3384591 - RNA, 22 nt, Human
ccuugcucuccccugcccugcu

SEQ ID NO: 3384592 - RNA, 17 nt, Human
ccuugcucugcaggcac

SEQ ID NO: 3384593 - RNA, 14 nt, Human
ccuugcuggcccca

SEQ ID NO: 3384594 - RNA, 21 nt, Human
ccuugcugguuuucuggaugg

SEQ ID NO: 3384595 - RNA, 13 nt, Human
ccuugcuguccug

SEQ ID NO: 3384596 - RNA, 17 nt, Human
ccuugcuguccugaucu

SEQ ID NO: 3384597 - RNA, 12 nt, Human
ccuugcuuguua

SEQ ID NO: 3384598 - RNA, 15 nt, Human
ccuugcuuuucccuc

SEQ ID NO: 3384599 - RNA, 16 nt, Human
cauuuaggggcaagca

SEQ ID NO: 3384600 - RNA, 17 nt, Human
cauuuaggggccacuuu

SEQ ID NO: 3384601 - RNA, 14 nt, Human
cauuuaguaagaau

SEQ ID NO: 3384602 - RNA, 15 nt, Human
cauuuauaauugcau

SEQ ID NO: 3384603 - RNA, 17 nt, Human
cauuuauacaaauuaga

SEQ ID NO: 3384604 - RNA, 19 nt, Human
cauuuauacaaauuagaaa

SEQ ID NO: 3384605 - RNA, 13 nt, Human
cauuuauauagau

SEQ ID NO: 3384606 - RNA, 14 nt, Human
cauuuauauaugaa

SEQ ID NO: 3384607 - RNA, 16 nt, Human
cauuuauauaugaaaa

SEQ ID NO: 3384608 - RNA, 22 nt, Human
cauuuauauauugaauuaauau

SEQ ID NO: 3384609 - RNA, 13 nt, Human
cauuuauauguac

SEQ ID NO: 3384610 - RNA, 20 nt, Human
cauuuauauugauaagaucu

SEQ ID NO: 3384611 - RNA, 20 nt, Human
cauuuaucaaucaguauaau

SEQ ID NO: 3384612 - RNA, 18 nt, Human
cauuuauccacaggaaag

SEQ ID NO: 3384613 - RNA, 14 nt, Human
cauuuaucuugaag

SEQ ID NO: 3384614 - RNA, 16 nt, Human
cauuuaucuugaagga

SEQ ID NO: 3384615 - RNA, 17 nt, Human
cauuuaucuugaaggaa

SEQ ID NO: 3384616 - RNA, 23 nt, Human
cauuuaugagcucuucauguuuc

SEQ ID NO: 3384617 - RNA, 19 nt, Human
cauuuaugaguaacuauua

SEQ ID NO: 3384618 - RNA, 15 nt, Human
cauuuaugauuuaau

SEQ ID NO: 3384619 - RNA, 17 nt, Human
cauuuaugauuuaauaa

SEQ ID NO: 3384620 - RNA, 21 nt, Human
cauuuaugauuuaauaaaaua

SEQ ID NO: 3384621 - RNA, 14 nt, Human
cauuuaugcacauu

SEQ ID NO: 3384622 - RNA, 16 nt, Human
cauuuaugguaaucau

SEQ ID NO: 3384623 - RNA, 21 nt, Human
cauuuauggucaacacuuaag

SEQ ID NO: 3384624 - RNA, 15 nt, Human
cauuuauucugcuca

SEQ ID NO: 3384625 - RNA, 23 nt, Human
cauuuauuuauccagaaaacugu

SEQ ID NO: 3384626 - RNA, 13 nt, Human
cauuuauuuguga

SEQ ID NO: 3384627 - RNA, 23 nt, Human
cauuuauuuuaugagaaauguaa

SEQ ID NO: 3384628 - RNA, 22 nt, Human
cauuuauuuuuuuuaaagaaaa

SEQ ID NO: 3384629 - RNA, 14 nt, Human
cauuucaaaaugau

SEQ ID NO: 3384630 - RNA, 14 nt, Human
cauuucaaaaugcu

SEQ ID NO: 3384631 - RNA, 15 nt, Human
cauuucaacuguuug

SEQ ID NO: 3384632 - RNA, 20 nt, Human
cauuucaauguguauaaauu

SEQ ID NO: 3384633 - RNA, 23 nt, Human
cauuucaccccucccuuucuccc

SEQ ID NO: 3384634 - RNA, 15 nt, Human
cauuucacuuauuua

SEQ ID NO: 3384635 - RNA, 17 nt, Human
cauuucagaaagccuuu

SEQ ID NO: 3384636 - RNA, 16 nt, Human
cauuucaggagcagcc

SEQ ID NO: 3384637 - RNA, 13 nt, Human
cauuucaggaggg

SEQ ID NO: 3384638 - RNA, 21 nt, Human
cauuucaguaaaccugucuga

SEQ ID NO: 3384639 - RNA, 22 nt, Human
cauuucauaauuuguuuccagc

SEQ ID NO: 3384640 - RNA, 17 nt, Human
cauuucaucauuguuuc

SEQ ID NO: 3384641 - RNA, 14 nt, Human
cauuucaucuauuu

SEQ ID NO: 3384642 - RNA, 15 nt, Human
cauuucaucuauuuc

SEQ ID NO: 3384643 - RNA, 20 nt, Human
cauuucaucuauuucugaga

SEQ ID NO: 3384644 - RNA, 14 nt, Human
cauuucaucucauu

SEQ ID NO: 3384645 - RNA, 15 nt, Human
cauuucauguauagu

SEQ ID NO: 3384646 - RNA, 16 nt, Human
cauuucauguccugug

SEQ ID NO: 3384647 - RNA, 15 nt, Human
cauuucauuccauug

SEQ ID NO: 3384648 - RNA, 18 nt, Human
cauuucauuccauugccu

SEQ ID NO: 3384649 - RNA, 12 nt, Human
cauuucauugua

SEQ ID NO: 3384650 - RNA, 13 nt, Human
cauuucauuguau

SEQ ID NO: 3384651 - RNA, 17 nt, Human
cauuuccaaaugaauga

SEQ ID NO: 3384652 - RNA, 19 nt, Human
cauuuccaacaccacagac

SEQ ID NO: 3384653 - RNA, 22 nt, Human
cauuuccaacaccacagacaca

SEQ ID NO: 3384654 - RNA, 15 nt, Human
cauuuccauguaugc

SEQ ID NO: 3384655 - RNA, 21 nt, Human
cauuuccauguccccucccag

SEQ ID NO: 3384656 - RNA, 14 nt, Human
cauuuccauugcuu

SEQ ID NO: 3384657 - RNA, 16 nt, Human
cauuuccauugcuuau

SEQ ID NO: 3384658 - RNA, 15 nt, Human
cauuucccaucugca

SEQ ID NO: 3384659 - RNA, 13 nt, Human
cauuuccccagac

SEQ ID NO: 3384660 - RNA, 16 nt, Human
cauuuccccagaccug

SEQ ID NO: 3384661 - RNA, 20 nt, Human
cauuuccccagaccugagcu

SEQ ID NO: 3384662 - RNA, 16 nt, Human
cauuuccccagggcac

SEQ ID NO: 3384663 - RNA, 16 nt, Human
cauuuccguaauucuu

SEQ ID NO: 3384664 - RNA, 19 nt, Human
cauuuccguaauucuuauu

SEQ ID NO: 3384665 - RNA, 20 nt, Human
cauuuccucagcuuaucucu

SEQ ID NO: 3384666 - RNA, 22 nt, Human
cauuuccuggguggcuacucug

SEQ ID NO: 3384667 - RNA, 17 nt, Human
cauuucgccccucauuu

SEQ ID NO: 3384668 - RNA, 21 nt, Human
cauuucgccccucauuuaucc

SEQ ID NO: 3384669 - RNA, 20 nt, Human
cauuucgugagccccaucuu

SEQ ID NO: 3384670 - RNA, 17 nt, Human
cauuucuaaaggccucu

SEQ ID NO: 3384671 - RNA, 23 nt, Human
cauuucuaauuaaccuuacuaau

SEQ ID NO: 3384672 - RNA, 20 nt, Human
cauuucuaauuauguagcuc

SEQ ID NO: 3384673 - RNA, 21 nt, Human
cauuucuaauuauguagcucu

SEQ ID NO: 3384674 - RNA, 18 nt, Human
cauuucuaauuccuguuu

SEQ ID NO: 3384675 - RNA, 20 nt, Human
cauuucuacucucccauggc

SEQ ID NO: 3384676 - RNA, 20 nt, Human
cauuucuacucuuaaguuuc

SEQ ID NO: 3384677 - RNA, 21 nt, Human
cauuucuacucuuaaguuucu

SEQ ID NO: 3384678 - RNA, 13 nt, Human
cauuucuauuuau

SEQ ID NO: 3384679 - RNA, 19 nt, Human
cauuucuauuucuccucca

SEQ ID NO: 3384680 - RNA, 12 nt, Human
cauuucucaugu

SEQ ID NO: 3384681 - RNA, 18 nt, Human
cauuucuccagauuaucu

SEQ ID NO: 3384682 - RNA, 16 nt, Human
cauuucucugggguau

SEQ ID NO: 3384683 - RNA, 18 nt, Human
cauuucucuuacugcaaa

SEQ ID NO: 3384684 - RNA, 17 nt, Human
cauuucugaauagaaau

SEQ ID NO: 3384685 - RNA, 12 nt, Human
cauuucugauuu

SEQ ID NO: 3384686 - RNA, 14 nt, Human
cauuucuguaaaua

SEQ ID NO: 3384687 - RNA, 22 nt, Human
cauuucuucagucagaaaacuu

SEQ ID NO: 3384688 - RNA, 23 nt, Human
cauuucuucagucagaaaacuuu

SEQ ID NO: 3384689 - RNA, 16 nt, Human
ccuugugggccugggc

SEQ ID NO: 3384690 - RNA, 21 nt, Human
ccuugugggccugggcuccug

SEQ ID NO: 3384691 - RNA, 16 nt, Human
ccuugugguccaaaua

SEQ ID NO: 3384692 - RNA, 17 nt, Human
ccuugugguccaaauag

SEQ ID NO: 3384693 - RNA, 20 nt, Human
ccuuguggucccaccccaca

SEQ ID NO: 3384694 - RNA, 18 nt, Human
ccuuguguauauuuguau

SEQ ID NO: 3384695 - RNA, 15 nt, Human
ccuuguguguaugug

SEQ ID NO: 3384696 - RNA, 17 nt, Human
ccuuguguguaugugua

SEQ ID NO: 3384697 - RNA, 16 nt, Human
ccuuguuacccaugaa

SEQ ID NO: 3384698 - RNA, 18 nt, Human
ccuuguuacccaugaaaa

SEQ ID NO: 3384699 - RNA, 16 nt, Human
ccuuguuacuucugag

SEQ ID NO: 3384700 - RNA, 13 nt, Human
ccuuguugcauga

SEQ ID NO: 3384701 - RNA, 18 nt, Human
ccuuguuggagccugcag

SEQ ID NO: 3384702 - RNA, 19 nt, Human
ccuuguuuacacauacccu

SEQ ID NO: 3384703 - RNA, 20 nt, Human
ccuuguuucaaacacaaaug

SEQ ID NO: 3384704 - RNA, 22 nt, Human
ccuuguuucaaacacaaaugca

SEQ ID NO: 3384705 - RNA, 11 nt, Human
ccuuguuucag

SEQ ID NO: 3384706 - RNA, 21 nt, Human
ccuuguuucucuuccuuucuu

SEQ ID NO: 3384707 - RNA, 20 nt, Human
ccuuuaaaauuuuuuuagaa

SEQ ID NO: 3384708 - RNA, 21 nt, Human
ccuuuaaagaugaacucugaa

SEQ ID NO: 3384709 - RNA, 16 nt, Human
ccuuuaacaacauguu

SEQ ID NO: 3384710 - RNA, 22 nt, Human
ccuuuaacaacauguuuccagc

SEQ ID NO: 3384711 - RNA, 20 nt, Human
ccuuuaacugacaagccauc

SEQ ID NO: 3384712 - RNA, 12 nt, Human
ccuuuaagaaaa

SEQ ID NO: 3384713 - RNA, 13 nt, Human
ccuuuaagagaaa

SEQ ID NO: 3384714 - RNA, 14 nt, Human
ccuuuaagagaaau

SEQ ID NO: 3384715 - RNA, 19 nt, Human
ccuuuaaguagauaagcag

SEQ ID NO: 3384716 - RNA, 13 nt, Human
ccuuuaaugcauc

SEQ ID NO: 3384717 - RNA, 18 nt, Human
ccuuuaauuguaaaguaa

SEQ ID NO: 3384718 - RNA, 21 nt, Human
ccuuuacacauucggcucccu

SEQ ID NO: 3384719 - RNA, 23 nt, Human
ccuuuacacauucggcucccugg

SEQ ID NO: 3384720 - RNA, 12 nt, Human
ccuuuacaugag

SEQ ID NO: 3384721 - RNA, 18 nt, Human
ccuuuacaugaggacucu

SEQ ID NO: 3384722 - RNA, 16 nt, Human
ccuuuacccucaucug

SEQ ID NO: 3384723 - RNA, 18 nt, Human
ccuuuacccucaucuguc

SEQ ID NO: 3384724 - RNA, 21 nt, Human
ccuuuacccucuuugcugcag

SEQ ID NO: 3384725 - RNA, 19 nt, Human
ccuuuacguguuuaaaaaa

SEQ ID NO: 3384726 - RNA, 18 nt, Human
ccuuuacucauagcacuu

SEQ ID NO: 3384727 - RNA, 16 nt, Human
ccuuuacugacccugg

SEQ ID NO: 3384728 - RNA, 17 nt, Human
ccuuuacugacccuggg

SEQ ID NO: 3384729 - RNA, 14 nt, Human
ccuuuacuuucccu

SEQ ID NO: 3384730 - RNA, 20 nt, Human
ccuuuacuuucccuugcuuu

SEQ ID NO: 3384731 - RNA, 12 nt, Human
ccuuuagaaaau

SEQ ID NO: 3384732 - RNA, 20 nt, Human
ccuuuagaaacucaaaaacu

SEQ ID NO: 3384733 - RNA, 22 nt, Human
ccuuuagauagcagccuggcuc

SEQ ID NO: 3384734 - RNA, 16 nt, Human
ccuuuagccccuccca

SEQ ID NO: 3384735 - RNA, 14 nt, Human
ccuuuagcgcccag

SEQ ID NO: 3384736 - RNA, 15 nt, Human
ccuuuagggcagcuu

SEQ ID NO: 3384737 - RNA, 18 nt, Human
ccuuuaggguucugccuc

SEQ ID NO: 3384738 - RNA, 19 nt, Human
ccuuuaguaccugaaaagu

SEQ ID NO: 3384739 - RNA, 18 nt, Human
ccuuuaguaucaguguuu

SEQ ID NO: 3384740 - RNA, 20 nt, Human
ccuuuaucuaccaacuuuca

SEQ ID NO: 3384741 - RNA, 12 nt, Human
ccuuuaugugaa

SEQ ID NO: 3384742 - RNA, 13 nt, Human
ccuuuaugugaau

SEQ ID NO: 3384743 - RNA, 16 nt, Human
ccuuuauuaaaaucuu

SEQ ID NO: 3384744 - RNA, 19 nt, Human
cguauguggcaaaauguua

SEQ ID NO: 3384745 - RNA, 15 nt, Human
cguauugguccagcu

SEQ ID NO: 3384746 - RNA, 16 nt, Human
cgcagcccuggcaggg

SEQ ID NO: 3384747 - RNA, 13 nt, Human
cgcagcucuugcc

SEQ ID NO: 3384748 - RNA, 13 nt, Human
cgcagcuggacuc

SEQ ID NO: 3384749 - RNA, 17 nt, Human
cgcagcuggacucugca

SEQ ID NO: 3384750 - RNA, 13 nt, Human
cgcaggaagcugc

SEQ ID NO: 3384751 - RNA, 18 nt, Human
cgcaggccucccugccag

SEQ ID NO: 3384752 - RNA, 18 nt, Human
cgcaggcgggaaaagcag

SEQ ID NO: 3384753 - RNA, 19 nt, Human
cgcaguccacuucugacag

SEQ ID NO: 3384754 - RNA, 17 nt, Human
cgcagucgucgcacagu

SEQ ID NO: 3384755 - RNA, 19 nt, Human
cgcagucgucgcacagucu

SEQ ID NO: 3384756 - RNA, 15 nt, Human
cgcagugccucuggu

SEQ ID NO: 3384757 - RNA, 15 nt, Human
cgcaguggcccugag

SEQ ID NO: 3384758 - RNA, 16 nt, Human
cgcaguguggaggcca

SEQ ID NO: 3384759 - RNA, 16 nt, Human
cgcaguguuuugcaag

SEQ ID NO: 3384760 - RNA, 20 nt, Human
cgcaguuuuuuuuuucuugu

SEQ ID NO: 3384761 - RNA, 18 nt, Human
cgcaucaaaagacaauuc

SEQ ID NO: 3384762 - RNA, 19 nt, Human
cgcauccuagucucuauca

SEQ ID NO: 3384763 - RNA, 14 nt, Human
cgcaucuucuccau

SEQ ID NO: 3384764 - RNA, 21 nt, Human
cgcaucuucuccaucuggcag

SEQ ID NO: 3384765 - RNA, 16 nt, Human
cgcaugcagcagcuug

SEQ ID NO: 3384766 - RNA, 16 nt, Human
cgcaugcggcccagga

SEQ ID NO: 3384767 - RNA, 23 nt, Human
cgcauggaguguguauuguuccc

SEQ ID NO: 3384768 - RNA, 16 nt, Human
cgcauggucacacacu

SEQ ID NO: 3384769 - RNA, 19 nt, Human
cgcauggucacacacugau

SEQ ID NO: 3384770 - RNA, 13 nt, Human
cgcauucccugag

SEQ ID NO: 3384771 - RNA, 20 nt, Human
cgcauucucauggagaaguu

SEQ ID NO: 3384772 - RNA, 18 nt, Human
cgccaaagaaugccuuga

SEQ ID NO: 3384773 - RNA, 21 nt, Human
cgccaacaacuucuccauccu

SEQ ID NO: 3384774 - RNA, 13 nt, Human
cgccaaggcuggg

SEQ ID NO: 3384775 - RNA, 21 nt, Human
cgccacagcccuuuugucucu

SEQ ID NO: 3384776 - RNA, 19 nt, Human
cgccacauccccgcuggcu

SEQ ID NO: 3384777 - RNA, 18 nt, Human
cgccacauggcuuccucc

SEQ ID NO: 3384778 - RNA, 23 nt, Human
cgccacauggcuuccuccugcgc

SEQ ID NO: 3384779 - RNA, 15 nt, Human
cgccaccauuccugg

SEQ ID NO: 3384780 - RNA, 13 nt, Human
cgccacccgcagc

SEQ ID NO: 3384781 - RNA, 20 nt, Human
cgccaccuggcauuccuucu

SEQ ID NO: 3384782 - RNA, 22 nt, Human
cgccacuacacuccagccugag

SEQ ID NO: 3384783 - RNA, 14 nt, Human
cgccacucauuuca

SEQ ID NO: 3384784 - RNA, 17 nt, Human
cgccacucauuucaucu

SEQ ID NO: 3384785 - RNA, 19 nt, Human
cgccacucauuucaucuca

SEQ ID NO: 3384786 - RNA, 15 nt, Human
cgccacuccugaacc

SEQ ID NO: 3384787 - RNA, 23 nt, Human
cgccacucgcuucccccauagcc

SEQ ID NO: 3384788 - RNA, 23 nt, Human
cgccacugcacuccagccugggc

SEQ ID NO: 3384789 - RNA, 21 nt, Human
cgccacugcacucuagccgga

SEQ ID NO: 3384790 - RNA, 19 nt, Human
cgccacuggggcucagagc

SEQ ID NO: 3384791 - RNA, 23 nt, Human
cgccacuguuuugaaucucauaa

SEQ ID NO: 3384792 - RNA, 22 nt, Human
cgccagcacagaaacagaggag

SEQ ID NO: 3384793 - RNA, 15 nt, Human
cgccagccuccucug

SEQ ID NO: 3384794 - RNA, 17 nt, Human
cgccagccuccucugga

SEQ ID NO: 3384795 - RNA, 18 nt, Human
cgccagcugaugacucaa

SEQ ID NO: 3384796 - RNA, 21 nt, Human
cgccaggauggaacacggcca

SEQ ID NO: 3384797 - RNA, 23 nt, Human
cgccaggauggcgcaggaacuca

SEQ ID NO: 3384798 - RNA, 17 nt, Human
cgccaggcugaccacag

SEQ ID NO: 3384799 - RNA, 20 nt, Human
cgccaggcugaccacagcac

SEQ ID NO: 3384800 - RNA, 21 nt, Human
cgccaggcugaccacagcaca

SEQ ID NO: 3384801 - RNA, 19 nt, Human
cgccagggaccccagaauc

SEQ ID NO: 3384802 - RNA, 23 nt, Human
cgccaggggaaaaucagccugcu

SEQ ID NO: 3384803 - RNA, 13 nt, Human
cgccaucagccca

SEQ ID NO: 3384804 - RNA, 16 nt, Human
cgccaucccagcccca

SEQ ID NO: 3384805 - RNA, 17 nt, Human
cgccaucccagccccaa

SEQ ID NO: 3384806 - RNA, 20 nt, Human
cgccaucccagccccaauga

SEQ ID NO: 3384807 - RNA, 20 nt, Human
cgccauggcuuccaaggugg

SEQ ID NO: 3384808 - RNA, 16 nt, Human
cgccauugccaccagg

SEQ ID NO: 3384809 - RNA, 20 nt, Human
cgcccaaaccuuucccccau

SEQ ID NO: 3384810 - RNA, 17 nt, Human
cgcccaaaggacgcacu

SEQ ID NO: 3384811 - RNA, 22 nt, Human
cgcccaaaggacgcacugagca

SEQ ID NO: 3384812 - RNA, 15 nt, Human
cgcccaacccuuccc

SEQ ID NO: 3384813 - RNA, 13 nt, Human
cgcccaacuccac

SEQ ID NO: 3384814 - RNA, 12 nt, Human
cgcccaaggccu

SEQ ID NO: 3384815 - RNA, 23 nt, Human
cgcccaccgcaugcccccucgug

SEQ ID NO: 3384816 - RNA, 17 nt, Human
cgcccacuguccugggc

SEQ ID NO: 3384817 - RNA, 22 nt, Human
cgcccacuguccugggcgcccu

SEQ ID NO: 3384818 - RNA, 22 nt, Human
cgcccagagacccaagcugccu

SEQ ID NO: 3384819 - RNA, 16 nt, Human
cgcccagcuccugaca

SEQ ID NO: 3384820 - RNA, 15 nt, Human
cgcccagcugcaccu

SEQ ID NO: 3384821 - RNA, 15 nt, Human
cgcccaggagacauc

SEQ ID NO: 3384822 - RNA, 17 nt, Human
cgcccaggaucagauug

SEQ ID NO: 3384823 - RNA, 20 nt, Human
cgcccaggcuggagugcaau

SEQ ID NO: 3384824 - RNA, 17 nt, Human
cgcccaggcuggccagc

SEQ ID NO: 3384825 - RNA, 18 nt, Human
cgcccagucccagcagcc

SEQ ID NO: 3384826 - RNA, 21 nt, Human
cgcccagucccagcagccagc

SEQ ID NO: 3384827 - RNA, 14 nt, Human
cgcccaguccuucc

SEQ ID NO: 3384828 - RNA, 16 nt, Human
cgcccaguccuuccac

SEQ ID NO: 3384829 - RNA, 12 nt, Human
cgcccagucugg

SEQ ID NO: 3384830 - RNA, 14 nt, Human
cgcccaucucagga

SEQ ID NO: 3384831 - RNA, 20 nt, Human
cgcccaugagagcgcagccc

SEQ ID NO: 3384832 - RNA, 22 nt, Human
cgccccaacccguggaggcugc

SEQ ID NO: 3384833 - RNA, 13 nt, Human
cgccccacccaga

SEQ ID NO: 3384834 - RNA, 12 nt, Human
cgccccagccuc

SEQ ID NO: 3384835 - RNA, 16 nt, Human
cgccccaucugcccca

SEQ ID NO: 3384836 - RNA, 19 nt, Human
cgcccccacccugagcgcc

SEQ ID NO: 3384837 - RNA, 15 nt, Human
cgcccccacugguga

SEQ ID NO: 3384838 - RNA, 18 nt, Human
cgcccccaguccccaccc

SEQ ID NO: 3384839 - RNA, 17 nt, Human
cgccccccucccagagg

SEQ ID NO: 3384840 - RNA, 20 nt, Human
cgcccccuccgcccugccac

SEQ ID NO: 3384841 - RNA, 14 nt, Human
cgcccccuccucua

SEQ ID NO: 3384842 - RNA, 13 nt, Human
cgccccgccccac

SEQ ID NO: 3384843 - RNA, 14 nt, Human
cgccccgccccaca

SEQ ID NO: 3384844 - RNA, 17 nt, Human
cgccccgccccacauuc

SEQ ID NO: 3384845 - RNA, 21 nt, Human
cgccccuagccgguuccuguc

SEQ ID NO: 3384846 - RNA, 18 nt, Human
cgccccucccacagcgcu

SEQ ID NO: 3384847 - RNA, 12 nt, Human
cgccccugagcc

SEQ ID NO: 3384848 - RNA, 19 nt, Human
cgccccugcagcacggaca

SEQ ID NO: 3384849 - RNA, 12 nt, Human
cgccccugccug

SEQ ID NO: 3384850 - RNA, 18 nt, Human
cgccccugccugccaugu

SEQ ID NO: 3384851 - RNA, 18 nt, Human
cgcccgcccacuguccug

SEQ ID NO: 3384852 - RNA, 13 nt, Human
cgcccgcugggcu

SEQ ID NO: 3384853 - RNA, 18 nt, Human
cgcccggcuaauuuuugu

SEQ ID NO: 3384854 - RNA, 13 nt, Human
cgcccgggcccag

SEQ ID NO: 3384855 - RNA, 14 nt, Human
cgcccgggcccaga

SEQ ID NO: 3384856 - RNA, 17 nt, Human
cgcccgggcccagagga

SEQ ID NO: 3384857 - RNA, 17 nt, Human
cgcccgggguggccaca

SEQ ID NO: 3384858 - RNA, 12 nt, Human
cgcccguccugc

SEQ ID NO: 3384859 - RNA, 13 nt, Human
cgcccucccaggc

SEQ ID NO: 3384860 - RNA, 16 nt, Human
cgcccuccccuccccu

SEQ ID NO: 3384861 - RNA, 14 nt, Human
cgcccucuguccug

SEQ ID NO: 3384862 - RNA, 17 nt, Human
cgcccucuguccugacu

SEQ ID NO: 3384863 - RNA, 11 nt, Human
cgcccugcaga

SEQ ID NO: 3384864 - RNA, 14 nt, Human
cgcccugccacuca

SEQ ID NO: 3384865 - RNA, 18 nt, Human
cgcccugcuccucccugg

SEQ ID NO: 3384866 - RNA, 21 nt, Human
cgcccugcuccucccuggcug

SEQ ID NO: 3384867 - RNA, 16 nt, Human
cgcccuggaagccggc

SEQ ID NO: 3384868 - RNA, 16 nt, Human
cgcccuggacugugug

SEQ ID NO: 3384869 - RNA, 15 nt, Human
cgcccuuaccuuccc

SEQ ID NO: 3384870 - RNA, 19 nt, Human
cgcccuuagucccccaacu

SEQ ID NO: 3384871 - RNA, 11 nt, Human
cgcccuuggcu

SEQ ID NO: 3384872 - RNA, 20 nt, Human
cgcccuuggcuucugugaug

SEQ ID NO: 3384873 - RNA, 14 nt, Human
cgcccuuuccuccu

SEQ ID NO: 3384874 - RNA, 20 nt, Human
cgcccuuuccuccucaggca

SEQ ID NO: 3384875 - RNA, 18 nt, Human
cgccgacuuuguaccccc

SEQ ID NO: 3384876 - RNA, 23 nt, Human
cgccgcaaaccacacuggacucc

SEQ ID NO: 3384877 - RNA, 22 nt, Human
cgccgccggaguccacucccag

SEQ ID NO: 3384878 - RNA, 21 nt, Human
cgccgccuccgggacccccag

SEQ ID NO: 3384879 - RNA, 14 nt, Human
cgccgccugguacu

SEQ ID NO: 3384880 - RNA, 20 nt, Human
cgccgccugguacucaagcc

SEQ ID NO: 3384881 - RNA, 15 nt, Human
cgccggaucugaggg

SEQ ID NO: 3384882 - RNA, 22 nt, Human
cgccggcaaaacuuuggcacug

SEQ ID NO: 3384883 - RNA, 20 nt, Human
cgccggcaauaaaagcccag

SEQ ID NO: 3384884 - RNA, 20 nt, Human
cgccggggacagaggccugc

SEQ ID NO: 3384885 - RNA, 15 nt, Human
cgccgucuccagggg

SEQ ID NO: 3384886 - RNA, 17 nt, Human
cgccgugaguucucagg

SEQ ID NO: 3384887 - RNA, 13 nt, Human
cgccguggcugcg

SEQ ID NO: 3384888 - RNA, 14 nt, Human
cgccgugggcugcg

SEQ ID NO: 3384889 - RNA, 16 nt, Human
cgcugagccaccugcc

SEQ ID NO: 3384890 - RNA, 14 nt, Human
cgcugaguggcagg

SEQ ID NO: 3384891 - RNA, 18 nt, Human
cgcugauacauaacuaaa

SEQ ID NO: 3384892 - RNA, 14 nt, Human
cgcugauucucagg

SEQ ID NO: 3384893 - RNA, 14 nt, Human
cgcugccagccuug

SEQ ID NO: 3384894 - RNA, 18 nt, Human
cgcugcccaggggagccc

SEQ ID NO: 3384895 - RNA, 19 nt, Human
cgcugcccggcgcccucug

SEQ ID NO: 3384896 - RNA, 21 nt, Human
cgcugccgcaccccagagugu

SEQ ID NO: 3384897 - RNA, 15 nt, Human
cgcugccugcccaca

SEQ ID NO: 3384898 - RNA, 19 nt, Human
cgcugcuccacgcgcuucg

SEQ ID NO: 3384899 - RNA, 12 nt, Human
cgcugcucugcc

SEQ ID NO: 3384900 - RNA, 18 nt, Human
cgcugcugcgcccugggc

SEQ ID NO: 3384901 - RNA, 20 nt, Human
cgcugcugcugcugcgcccu

SEQ ID NO: 3384902 - RNA, 19 nt, Human
cgcuggaggaugugggcag

SEQ ID NO: 3384903 - RNA, 21 nt, Human
cgcuggaggaugugggcagcu

SEQ ID NO: 3384904 - RNA, 18 nt, Human
cgcuggagugcagugagc

SEQ ID NO: 3384905 - RNA, 12 nt, Human
cgcuggcccagc

SEQ ID NO: 3384906 - RNA, 14 nt, Human
cgcuggcccagccg

SEQ ID NO: 3384907 - RNA, 16 nt, Human
cgcuggcccagccggc

SEQ ID NO: 3384908 - RNA, 21 nt, Human
cgcuggcccccacuggcugug

SEQ ID NO: 3384909 - RNA, 20 nt, Human
cgcuggccccuuugggcccu

SEQ ID NO: 3384910 - RNA, 19 nt, Human
cgcuggccgggaccccgag

SEQ ID NO: 3384911 - RNA, 23 nt, Human
ccaagugccaaagaagcagacca

SEQ ID NO: 3384912 - RNA, 16 nt, Human
ccaagugccagucuug

SEQ ID NO: 3384913 - RNA, 22 nt, Human
ccaagugccagucuugugucug

SEQ ID NO: 3384914 - RNA, 16 nt, Human
ccaaguggcucccaca

SEQ ID NO: 3384915 - RNA, 22 nt, Human
ccaaguggggugcugggaggag

SEQ ID NO: 3384916 - RNA, 23 nt, Human
ccaagugguuuccacaugcucug

SEQ ID NO: 3384917 - RNA, 21 nt, Human
ccaagugugcauauuguacac

SEQ ID NO: 3384918 - RNA, 16 nt, Human
ccaaguuaaauguaga

SEQ ID NO: 3384919 - RNA, 22 nt, Human
ccaaguuauaaaucaaugucac

SEQ ID NO: 3384920 - RNA, 19 nt, Human
ccaaguuccgucaguccaa

SEQ ID NO: 3384921 - RNA, 17 nt, Human
ccaaguugugcuugagc

SEQ ID NO: 3384922 - RNA, 22 nt, Human
ccaaguuguggugcugacaaag

SEQ ID NO: 3384923 - RNA, 12 nt, Human
ccaaguuuugug

SEQ ID NO: 3384924 - RNA, 16 nt, Human
ccaauaacacacagcu

SEQ ID NO: 3384925 - RNA, 14 nt, Human
ccaauaacauucuu

SEQ ID NO: 3384926 - RNA, 14 nt, Human
ccaauaccccaugg

SEQ ID NO: 3384927 - RNA, 19 nt, Human
ccaauagcacuuucauugc

SEQ ID NO: 3384928 - RNA, 16 nt, Human
ccaauaggaaugcuaa

SEQ ID NO: 3384929 - RNA, 19 nt, Human
ccaauaggcaaauuaauca

SEQ ID NO: 3384930 - RNA, 13 nt, Human
ccaauauccuaau

SEQ ID NO: 3384931 - RNA, 15 nt, Human
ccaauauccuaauaa

SEQ ID NO: 3384932 - RNA, 17 nt, Human
ccaauauccuaauaaaa

SEQ ID NO: 3384933 - RNA, 16 nt, Human
ccaauauguauuguaa

SEQ ID NO: 3384934 - RNA, 13 nt, Human
ccaauauuauaau

SEQ ID NO: 3384935 - RNA, 16 nt, Human
ccaauauucauagcag

SEQ ID NO: 3384936 - RNA, 21 nt, Human
ccaauauuuaaucuuuuauga

SEQ ID NO: 3384937 - RNA, 18 nt, Human
ccaauauuucucagacau

SEQ ID NO: 3384938 - RNA, 12 nt, Human
ccaauauuucug

SEQ ID NO: 3384939 - RNA, 18 nt, Human
ccaauauuucugcuuucu

SEQ ID NO: 3384940 - RNA, 22 nt, Human
ccaaucaaucuugcauguaacg

SEQ ID NO: 3384941 - RNA, 22 nt, Human
ccaaucagagaccaggcccugg

SEQ ID NO: 3384942 - RNA, 15 nt, Human
ccaaucagcacugaa

SEQ ID NO: 3384943 - RNA, 17 nt, Human
ccaaucagcacugaaaa

SEQ ID NO: 3384944 - RNA, 14 nt, Human
ccaaucauuuuaau

SEQ ID NO: 3384945 - RNA, 22 nt, Human
ccaaucauuuuaauuauuauuc

SEQ ID NO: 3384946 - RNA, 21 nt, Human
ccaauccagguacgcacagac

SEQ ID NO: 3384947 - RNA, 22 nt, Human
ccaauccagguacgcacagaca

SEQ ID NO: 3384948 - RNA, 21 nt, Human
ccaauccccuccuugggcacu

SEQ ID NO: 3384949 - RNA, 15 nt, Human
ccaaucccugauccc

SEQ ID NO: 3384950 - RNA, 16 nt, Human
ccaaucgguguguagu

SEQ ID NO: 3384951 - RNA, 18 nt, Human
ccaaucuaaccacaucaa

SEQ ID NO: 3384952 - RNA, 12 nt, Human
ccaaugaaauga

SEQ ID NO: 3384953 - RNA, 23 nt, Human
ccaaugaauaauggaaaaugcca

SEQ ID NO: 3384954 - RNA, 17 nt, Human
ccaaugagacuugccuu

SEQ ID NO: 3384955 - RNA, 21 nt, Human
ccaaugagacuugccuuccua

SEQ ID NO: 3384956 - RNA, 14 nt, Human
ccaaugagcuuucu

SEQ ID NO: 3384957 - RNA, 20 nt, Human
ccaaugagcuuucugaacag

SEQ ID NO: 3384958 - RNA, 23 nt, Human
ccaaugagcuuucugaacagcug

SEQ ID NO: 3384959 - RNA, 14 nt, Human
ccaaugcacuuugu

SEQ ID NO: 3384960 - RNA, 23 nt, Human
ccaaugcaugcagccacugugcu

SEQ ID NO: 3384961 - RNA, 13 nt, Human
ccaaugccaaaaa

SEQ ID NO: 3384962 - RNA, 18 nt, Human
ccaaugcuuuuaucaaac

SEQ ID NO: 3384963 - RNA, 15 nt, Human
ccaauggaaaccuca

SEQ ID NO: 3384964 - RNA, 18 nt, Human
ccaauggaaccuccuuuc

SEQ ID NO: 3384965 - RNA, 20 nt, Human
ccaauggaguagaccccugg

SEQ ID NO: 3384966 - RNA, 14 nt, Human
ccaaugggagcuca

SEQ ID NO: 3384967 - RNA, 17 nt, Human
ccaaugggagcucaugg

SEQ ID NO: 3384968 - RNA, 21 nt, Human
ccaauguauugauaagagggc

SEQ ID NO: 3384969 - RNA, 22 nt, Human
ccaaugucuggagaccaccagg

SEQ ID NO: 3384970 - RNA, 20 nt, Human
ccaauguuagagacuuuuuu

SEQ ID NO: 3384971 - RNA, 20 nt, Human
ccaauguucucucuucucca

SEQ ID NO: 3384972 - RNA, 12 nt, Human
ccaauguuuucc

SEQ ID NO: 3384973 - RNA, 14 nt, Human
ccaauuaguuuccu

SEQ ID NO: 3384974 - RNA, 20 nt, Human
ccaauuaguuuccuuuuuaa

SEQ ID NO: 3384975 - RNA, 17 nt, Human
ccaauuauguuaaacua

SEQ ID NO: 3384976 - RNA, 22 nt, Human
ccaauuauugauauauauuaua

SEQ ID NO: 3384977 - RNA, 21 nt, Human
ccaauucaacccuuugcccca

SEQ ID NO: 3384978 - RNA, 16 nt, Human
ccaauucagacaggca

SEQ ID NO: 3384979 - RNA, 14 nt, Human
ccaauucuccuuua

SEQ ID NO: 3384980 - RNA, 17 nt, Human
ccaauucucgagcuugg

SEQ ID NO: 3384981 - RNA, 13 nt, Human
ccaauuggaggaa

SEQ ID NO: 3384982 - RNA, 13 nt, Human
ccaauugugcugc

SEQ ID NO: 3384983 - RNA, 16 nt, Human
ccaauuucagacuccc

SEQ ID NO: 3384984 - RNA, 21 nt, Human
ccaauuuuaacuuagagcuuu

SEQ ID NO: 3384985 - RNA, 16 nt, Human
ccaauuuuaauuuagu

SEQ ID NO: 3384986 - RNA, 23 nt, Human
ccaauuuuaauuuaguaaauguu

SEQ ID NO: 3384987 - RNA, 16 nt, Human
ccaauuuuuuuuuccu

SEQ ID NO: 3384988 - RNA, 13 nt, Human
ccacaaaaacagg

SEQ ID NO: 3384989 - RNA, 14 nt, Human
ccacaaacuguaau

SEQ ID NO: 3384990 - RNA, 20 nt, Human
ccacaaagcacaguuugaac

SEQ ID NO: 3384991 - RNA, 22 nt, Human
ccacaaagccuuaucaaguguc

SEQ ID NO: 3384992 - RNA, 13 nt, Human
ccacaaccucuuc

SEQ ID NO: 3384993 - RNA, 17 nt, Human
ccacaacuauuuucaga

SEQ ID NO: 3384994 - RNA, 17 nt, Human
ccacaacugacacagga

SEQ ID NO: 3384995 - RNA, 22 nt, Human
ccacaagaaaugaaagcaggga

SEQ ID NO: 3384996 - RNA, 15 nt, Human
ccacaagaaauuuga

SEQ ID NO: 3384997 - RNA, 16 nt, Human
ccacaagaaauuugau

SEQ ID NO: 3384998 - RNA, 21 nt, Human
ccacaagaaauuugauuucua

SEQ ID NO: 3384999 - RNA, 13 nt, Human
ccacaagagccca

SEQ ID NO: 3385000 - RNA, 18 nt, Human
ccacaagagcccaggccu

SEQ ID NO: 3385001 - RNA, 24 nt, Human
ccacaagauucccagagacaggaa

SEQ ID NO: 3385002 - RNA, 17 nt, Human
ccacaaggacuuccugu

SEQ ID NO: 3385003 - RNA, 16 nt, Human
ccacaagugcccucca

SEQ ID NO: 3385004 - RNA, 20 nt, Human
ccacaagugcccuccaggcu

SEQ ID NO: 3385005 - RNA, 20 nt, Human
ccacaagugccgcaaauugu

SEQ ID NO: 3385006 - RNA, 21 nt, Human
ccacaagugccgcaaauugua

SEQ ID NO: 3385007 - RNA, 15 nt, Human
ccacaagugguggua

SEQ ID NO: 3385008 - RNA, 21 nt, Human
ccacaauaaagaucgccccca

SEQ ID NO: 3385009 - RNA, 15 nt, Human
ccacaaucaccgaug

SEQ ID NO: 3385010 - RNA, 14 nt, Human
ccacacacaacagc

SEQ ID NO: 3385011 - RNA, 22 nt, Human
ccacacacaacagccaacagcu

SEQ ID NO: 3385012 - RNA, 12 nt, Human
ccacacacacaa

SEQ ID NO: 3385013 - RNA, 14 nt, Human
ccacacacacaaaa

SEQ ID NO: 3385014 - RNA, 17 nt, Human
ccacacacacacacaug

SEQ ID NO: 3385015 - RNA, 17 nt, Human
ccacacacacagaaaau

SEQ ID NO: 3385016 - RNA, 22 nt, Human
ccacacacacagaaaauauacu

SEQ ID NO: 3385017 - RNA, 12 nt, Human
ccacacacagag

SEQ ID NO: 3385018 - RNA, 16 nt, Human
ccacacacagaggaag

SEQ ID NO: 3385019 - RNA, 18 nt, Human
ccacacacagaggaagag

SEQ ID NO: 3385020 - RNA, 19 nt, Human
ccacacacagcugggcugu

SEQ ID NO: 3385021 - RNA, 11 nt, Human
ccacacacagg

SEQ ID NO: 3385022 - RNA, 18 nt, Human
ccacacacgcaggaacuc

SEQ ID NO: 3385023 - RNA, 14 nt, Human
ccacacacucgccc

SEQ ID NO: 3385024 - RNA, 14 nt, Human
ccacacaggcuggc

SEQ ID NO: 3385025 - RNA, 22 nt, Human
ccacacagugcucaaggccagc

SEQ ID NO: 3385026 - RNA, 14 nt, Human
ccacacaugcaagg

SEQ ID NO: 3385027 - RNA, 14 nt, Human
ccacaccaagcagc

SEQ ID NO: 3385028 - RNA, 12 nt, Human
ccacaccaagcu

SEQ ID NO: 3385029 - RNA, 13 nt, Human
ccacaccaagcug

SEQ ID NO: 3385030 - RNA, 23 nt, Human
ccacaccaagcugugccacccug

SEQ ID NO: 3385031 - RNA, 13 nt, Human
ccacaccagcccc

SEQ ID NO: 3385032 - RNA, 22 nt, Human
ccacacccaauuccacucugau

SEQ ID NO: 3385033 - RNA, 19 nt, Human
cuaauuugcauuaaauuca

SEQ ID NO: 3385034 - RNA, 20 nt, Human
cuaauuuuacauguuuauaa

SEQ ID NO: 3385035 - RNA, 15 nt, Human
cuaauuuuaguauuc

SEQ ID NO: 3385036 - RNA, 17 nt, Human
cuaauuuuaguauucau

SEQ ID NO: 3385037 - RNA, 13 nt, Human
cuaauuuucucaa

SEQ ID NO: 3385038 - RNA, 15 nt, Human
cuaauuuuggaugga

SEQ ID NO: 3385039 - RNA, 17 nt, Human
cuaauuuuuaagcaaaa

SEQ ID NO: 3385040 - RNA, 21 nt, Human
cuaauuuuuauuuuugcugag

SEQ ID NO: 3385041 - RNA, 12 nt, Human
cuaauuuuucca

SEQ ID NO: 3385042 - RNA, 20 nt, Human
cuaauuuuuguaauuuuagu

SEQ ID NO: 3385043 - RNA, 18 nt, Human
cuaauuuuuguauuauuu

SEQ ID NO: 3385044 - RNA, 14 nt, Human
cuaauuuuuuguug

SEQ ID NO: 3385045 - RNA, 16 nt, Human
cuaauuuuuuguuguu

SEQ ID NO: 3385046 - RNA, 16 nt, Human
cuaauuuuuuuguauu

SEQ ID NO: 3385047 - RNA, 20 nt, Human
cuaauuuuuuuguauuuuag

SEQ ID NO: 3385048 - RNA, 23 nt, Human
cuacaaaaaauuagaaauuggcu

SEQ ID NO: 3385049 - RNA, 20 nt, Human
cuacaaaaacacagcaaggg

SEQ ID NO: 3385050 - RNA, 13 nt, Human
cuacaaaacauua

SEQ ID NO: 3385051 - RNA, 17 nt, Human
cuacaaaauuugaaauu

SEQ ID NO: 3385052 - RNA, 15 nt, Human
cuacaaacaaaauuu

SEQ ID NO: 3385053 - RNA, 19 nt, Human
cuacaaagaagacauguuu

SEQ ID NO: 3385054 - RNA, 20 nt, Human
cuacaaagaagacauguuuu

SEQ ID NO: 3385055 - RNA, 20 nt, Human
cuacaaagcacuagagaaug

SEQ ID NO: 3385056 - RNA, 15 nt, Human
cuacaaagguuuaaa

SEQ ID NO: 3385057 - RNA, 10 nt, Human
cuacaaauca

SEQ ID NO: 3385058 - RNA, 14 nt, Human
cuacaaaucaguaa

SEQ ID NO: 3385059 - RNA, 12 nt, Human
cuacaaccaauu

SEQ ID NO: 3385060 - RNA, 14 nt, Human
cuacaacuucagca

SEQ ID NO: 3385061 - RNA, 16 nt, Human
cuacaacuucagcagu

SEQ ID NO: 3385062 - RNA, 15 nt, Human
cuacaagagcagccu

SEQ ID NO: 3385063 - RNA, 17 nt, Human
cuacaagagcagccugu

SEQ ID NO: 3385064 - RNA, 21 nt, Human
cuacaagagcagccuguggca

SEQ ID NO: 3385065 - RNA, 22 nt, Human
cuacaagagcagccuguggcau

SEQ ID NO: 3385066 - RNA, 17 nt, Human
cuacaagcuaaaauuag

SEQ ID NO: 3385067 - RNA, 19 nt, Human
cuacaagcuaaaauuagau

SEQ ID NO: 3385068 - RNA, 18 nt, Human
cuacaaguauucugccuu

SEQ ID NO: 3385069 - RNA, 22 nt, Human
cuacaauauguacauuucuaag

SEQ ID NO: 3385070 - RNA, 18 nt, Human
cuacaaugugaacuuuau

SEQ ID NO: 3385071 - RNA, 16 nt, Human
cuacaauucauugugu

SEQ ID NO: 3385072 - RNA, 16 nt, Human
cuacaauuuaaagcaa

SEQ ID NO: 3385073 - RNA, 15 nt, Human
cuacaauuuucuccc

SEQ ID NO: 3385074 - RNA, 20 nt, Human
cuacaauuuucucccaggaa

SEQ ID NO: 3385075 - RNA, 23 nt, Human
cuacaauuuucucccaggaagcu

SEQ ID NO: 3385076 - RNA, 13 nt, Human
cuacacaaagcag

SEQ ID NO: 3385077 - RNA, 15 nt, Human
cuacacacugcaugu

SEQ ID NO: 3385078 - RNA, 21 nt, Human
cuacacacugcauguuuguga

SEQ ID NO: 3385079 - RNA, 15 nt, Human
cuacacaggacaggg

SEQ ID NO: 3385080 - RNA, 14 nt, Human
cuacacagggaugu

SEQ ID NO: 3385081 - RNA, 19 nt, Human
cuacacagugggaacucug

SEQ ID NO: 3385082 - RNA, 21 nt, Human
cuacacauauaaauugucuua

SEQ ID NO: 3385083 - RNA, 19 nt, Human
cuacacauuuuuaaauugu

SEQ ID NO: 3385084 - RNA, 14 nt, Human
cuacaccacacaca

SEQ ID NO: 3385085 - RNA, 19 nt, Human
cuacaccacucuggcagcc

SEQ ID NO: 3385086 - RNA, 14 nt, Human
cuacacccagcaau

SEQ ID NO: 3385087 - RNA, 16 nt, Human
cuacacccuuggacuu

SEQ ID NO: 3385088 - RNA, 20 nt, Human
cuacacccuuggacuugagg

SEQ ID NO: 3385089 - RNA, 16 nt, Human
cuacaccuauuauccc

SEQ ID NO: 3385090 - RNA, 18 nt, Human
cuacaccuauuaucccag

SEQ ID NO: 3385091 - RNA, 15 nt, Human
cuacaccuggcugag

SEQ ID NO: 3385092 - RNA, 20 nt, Human
cuacaccuugcuuuuuuacu

SEQ ID NO: 3385093 - RNA, 15 nt, Human
cuacaccuuucuccu

SEQ ID NO: 3385094 - RNA, 23 nt, Human
cuacacgguucaaaccugugaag

SEQ ID NO: 3385095 - RNA, 16 nt, Human
cuacacuccagccuga

SEQ ID NO: 3385096 - RNA, 17 nt, Human
cuacacuccagccuggg

SEQ ID NO: 3385097 - RNA, 16 nt, Human
cuacacuccagugaga

SEQ ID NO: 3385098 - RNA, 12 nt, Human
cuacacucuccu

SEQ ID NO: 3385099 - RNA, 17 nt, Human
cuacacucuccugggcc

SEQ ID NO: 3385100 - RNA, 23 nt, Human
cuacacucuccugggccccuccc

SEQ ID NO: 3385101 - RNA, 23 nt, Human
cuacacuucgcaccggagugucu

SEQ ID NO: 3385102 - RNA, 16 nt, Human
cuacagaaaaaccuug

SEQ ID NO: 3385103 - RNA, 20 nt, Human
cuacagaaaaaccuuggguu

SEQ ID NO: 3385104 - RNA, 17 nt, Human
cuacagaacuucagaaa

SEQ ID NO: 3385105 - RNA, 14 nt, Human
cuacagacauuaaa

SEQ ID NO: 3385106 - RNA, 19 nt, Human
cuacagacauuaaauaauc

SEQ ID NO: 3385107 - RNA, 22 nt, Human
cuacagaccugcuuuuugaaau

SEQ ID NO: 3385108 - RNA, 20 nt, Human
cuacagagaaaccagcuucc

SEQ ID NO: 3385109 - RNA, 22 nt, Human
cuacagagaaccuggaguuccu

SEQ ID NO: 3385110 - RNA, 17 nt, Human
cuacagagaagccuuca

SEQ ID NO: 3385111 - RNA, 20 nt, Human
cuacagagcuucccugacuc

SEQ ID NO: 3385112 - RNA, 20 nt, Human
cuacagaggccaugggccuc

SEQ ID NO: 3385113 - RNA, 22 nt, Human
cuacagaggccaugggccuccu

SEQ ID NO: 3385114 - RNA, 15 nt, Human
cuacagauagucaaa

SEQ ID NO: 3385115 - RNA, 13 nt, Human
cuacagauguccc

SEQ ID NO: 3385116 - RNA, 13 nt, Human
cuacagcaaauuu

SEQ ID NO: 3385117 - RNA, 20 nt, Human
cgguuuccagggaggggccg

SEQ ID NO: 3385118 - RNA, 22 nt, Human
cgguuucgaagucauuaaacug

SEQ ID NO: 3385119 - RNA, 16 nt, Human
cgguuucuuuuuaagu

SEQ ID NO: 3385120 - RNA, 20 nt, Human
cgguuugccauguugccaga

SEQ ID NO: 3385121 - RNA, 18 nt, Human
cgguuuuuuauuauugug

SEQ ID NO: 3385122 - RNA, 16 nt, Human
cguaaaaaugauuuca

SEQ ID NO: 3385123 - RNA, 14 nt, Human
cguaaaauuaagaa

SEQ ID NO: 3385124 - RNA, 12 nt, Human
cguaaagauuug

SEQ ID NO: 3385125 - RNA, 16 nt, Human
cguaaagcuagaaaug

SEQ ID NO: 3385126 - RNA, 17 nt, Human
cguaaagcuagaaauga

SEQ ID NO: 3385127 - RNA, 16 nt, Human
cguaaaguacuuguag

SEQ ID NO: 3385128 - RNA, 18 nt, Human
cguaaaguacuuguaguu

SEQ ID NO: 3385129 - RNA, 20 nt, Human
cguaaauacacaacacacac

SEQ ID NO: 3385130 - RNA, 12 nt, Human
cguaaccagcca

SEQ ID NO: 3385131 - RNA, 13 nt, Human
cguaaccagccag

SEQ ID NO: 3385132 - RNA, 12 nt, Human
cguaacccaacu

SEQ ID NO: 3385133 - RNA, 19 nt, Human
cguaacccaacucuccugg

SEQ ID NO: 3385134 - RNA, 15 nt, Human
cguaacuggcugugu

SEQ ID NO: 3385135 - RNA, 14 nt, Human
cguaagauuuccuu

SEQ ID NO: 3385136 - RNA, 15 nt, Human
cguaaguacagagaa

SEQ ID NO: 3385137 - RNA, 19 nt, Human
cguaaguacagagaagcca

SEQ ID NO: 3385138 - RNA, 17 nt, Human
cguaaugacuuauugug

SEQ ID NO: 3385139 - RNA, 17 nt, Human
cguaaugcgccaauaaa

SEQ ID NO: 3385140 - RNA, 21 nt, Human
cguaaugcuuagagaauguuc

SEQ ID NO: 3385141 - RNA, 16 nt, Human
cguaauuuugccaaau

SEQ ID NO: 3385142 - RNA, 20 nt, Human
cguacauaauacugaaccac

SEQ ID NO: 3385143 - RNA, 17 nt, Human
cguacauucaauguuua

SEQ ID NO: 3385144 - RNA, 14 nt, Human
cguaccccacccuc

SEQ ID NO: 3385145 - RNA, 20 nt, Human
cguacguaauaagguuuuaa

SEQ ID NO: 3385146 - RNA, 22 nt, Human
cguacuuagcagcuaucucuca

SEQ ID NO: 3385147 - RNA, 23 nt, Human
cguagaaguuuuuguacuguaaa

SEQ ID NO: 3385148 - RNA, 16 nt, Human
cguagagggugcugcc

SEQ ID NO: 3385149 - RNA, 17 nt, Human
cguagagggugcugccc

SEQ ID NO: 3385150 - RNA, 23 nt, Human
cguagauauuggacaaagaaccu

SEQ ID NO: 3385151 - RNA, 19 nt, Human
cguagaucaccagaauaaa

SEQ ID NO: 3385152 - RNA, 21 nt, Human
cguagauucccaucauacacu

SEQ ID NO: 3385153 - RNA, 19 nt, Human
cguagccagcugcucccca

SEQ ID NO: 3385154 - RNA, 19 nt, Human
cguagcuauccggacagag

SEQ ID NO: 3385155 - RNA, 16 nt, Human
cguagcugcaaaggac

SEQ ID NO: 3385156 - RNA, 17 nt, Human
cguaggcuacagagaag

SEQ ID NO: 3385157 - RNA, 14 nt, Human
cguaggggaggggu

SEQ ID NO: 3385158 - RNA, 17 nt, Human
cguaggggagggguugc

SEQ ID NO: 3385159 - RNA, 23 nt, Human
cguaggggagggguugccacagg

SEQ ID NO: 3385160 - RNA, 19 nt, Human
cguagucggcacagccugg

SEQ ID NO: 3385161 - RNA, 15 nt, Human
cguagugcagcaggg

SEQ ID NO: 3385162 - RNA, 20 nt, Human
cguaguguagauuuguuuug

SEQ ID NO: 3385163 - RNA, 13 nt, Human
cguaguucccuga

SEQ ID NO: 3385164 - RNA, 16 nt, Human
cguauaaaagccuguu

SEQ ID NO: 3385165 - RNA, 21 nt, Human
cguauaaaagccuguuuaaga

SEQ ID NO: 3385166 - RNA, 16 nt, Human
cguauagaagucuuca

SEQ ID NO: 3385167 - RNA, 12 nt, Human
cguauagcugua

SEQ ID NO: 3385168 - RNA, 15 nt, Human
cguauaggcauguaa

SEQ ID NO: 3385169 - RNA, 22 nt, Human
cguauaugucucaggucccugc

SEQ ID NO: 3385170 - RNA, 15 nt, Human
cguaucuccggcucc

SEQ ID NO: 3385171 - RNA, 18 nt, Human
cguaucuccggcucccag

SEQ ID NO: 3385172 - RNA, 15 nt, Human
cguaugucugguucu

SEQ ID NO: 3385173 - RNA, 16 nt, Human
cguaugucuguuacca

SEQ ID NO: 3385174 - RNA, 20 nt, Human
cguaugucuguuaccauguc

SEQ ID NO: 3385175 - RNA, 15 nt, Human
cguauguuauacaac

SEQ ID NO: 3385176 - RNA, 15 nt, Human
cguauuuaauagcaa

SEQ ID NO: 3385177 - RNA, 22 nt, Human
cguauuuuaaaagccacauaga

SEQ ID NO: 3385178 - RNA, 14 nt, Human
cgugccuccaccac

SEQ ID NO: 3385179 - RNA, 22 nt, Human
cgugccuccaccaccacuggcc

SEQ ID NO: 3385180 - RNA, 19 nt, Human
cgugccuccuuccaccucc

SEQ ID NO: 3385181 - RNA, 20 nt, Human
cgugccuccuuccaccuccc

SEQ ID NO: 3385182 - RNA, 16 nt, Human
cgugccuggccacgcc

SEQ ID NO: 3385183 - RNA, 15 nt, Human
cgugccuucagcucu

SEQ ID NO: 3385184 - RNA, 18 nt, Human
cgugccuucagcucuaca

SEQ ID NO: 3385185 - RNA, 19 nt, Human
cgugccuuuugcaccccuc

SEQ ID NO: 3385186 - RNA, 21 nt, Human
cgugccuuuugcaccccuccc

SEQ ID NO: 3385187 - RNA, 23 nt, Human
cgugcgcugggcacuucccugcu

SEQ ID NO: 3385188 - RNA, 13 nt, Human
cgugcuaaggacu

SEQ ID NO: 3385189 - RNA, 14 nt, Human
cgugcuaaggacuu

SEQ ID NO: 3385190 - RNA, 16 nt, Human
cgugcuaaggacuugu

SEQ ID NO: 3385191 - RNA, 15 nt, Human
cgugcuacugcacuc

SEQ ID NO: 3385192 - RNA, 19 nt, Human
cgugcucgccccagcaggu

SEQ ID NO: 3385193 - RNA, 22 nt, Human
cgugcucuuuguuuugugucuc

SEQ ID NO: 3385194 - RNA, 23 nt, Human
cgugcucuuuguuuugugucucu

SEQ ID NO: 3385195 - RNA, 15 nt, Human
cgugcugacagcugc

SEQ ID NO: 3385196 - RNA, 20 nt, Human
cgugcuuagccuccugaccu

SEQ ID NO: 3385197 - RNA, 14 nt, Human
cgugcuuccucagu

SEQ ID NO: 3385198 - RNA, 17 nt, Human
cguggaaccucugucuc

SEQ ID NO: 3385199 - RNA, 17 nt, Human
cguggacaccugcccug

SEQ ID NO: 3385200 - RNA, 18 nt, Human
cguggacaccugcccugc

SEQ ID NO: 3385201 - RNA, 19 nt, Human
cguggacaccugcccugcc

SEQ ID NO: 3385202 - RNA, 15 nt, Human
cguggaccuuccugc

SEQ ID NO: 3385203 - RNA, 15 nt, Human
cguggacugaguggg

SEQ ID NO: 3385204 - RNA, 18 nt, Human
cguggagaaucacaggcu

SEQ ID NO: 3385205 - RNA, 15 nt, Human
cguggagagcuagga

SEQ ID NO: 3385206 - RNA, 17 nt, Human
cguggagagcuggugcc

SEQ ID NO: 3385207 - RNA, 22 nt, Human
cguggagcaggcgguggggaga

SEQ ID NO: 3385208 - RNA, 20 nt, Human
cguggagcgggguaugaaga

SEQ ID NO: 3385209 - RNA, 13 nt, Human
cguggagggaggc

SEQ ID NO: 3385210 - RNA, 18 nt, Human
cguggaugcgcagugccu

SEQ ID NO: 3385211 - RNA, 19 nt, Human
cguggauuaaacuuaugaa

SEQ ID NO: 3385212 - RNA, 14 nt, Human
cguggcaaauauaa

SEQ ID NO: 3385213 - RNA, 18 nt, Human
cguggcacucgcuguaug

SEQ ID NO: 3385214 - RNA, 20 nt, Human
cguggcagauaaucagccuc

SEQ ID NO: 3385215 - RNA, 13 nt, Human
cguggcaucaccu

SEQ ID NO: 3385216 - RNA, 16 nt, Human
cguggcaucuuaaaag

SEQ ID NO: 3385217 - RNA, 20 nt, Human
cguggcauguggccuguggc

SEQ ID NO: 3385218 - RNA, 21 nt, Human
cguggcauguggccuguggcc

SEQ ID NO: 3385219 - RNA, 15 nt, Human
cguggccagcccggc

SEQ ID NO: 3385220 - RNA, 19 nt, Human
cguggccagcccggcuggu

SEQ ID NO: 3385221 - RNA, 14 nt, Human
cguggcccaaggcu

SEQ ID NO: 3385222 - RNA, 13 nt, Human
cguggccccagcc

SEQ ID NO: 3385223 - RNA, 15 nt, Human
cguggccccagccug

SEQ ID NO: 3385224 - RNA, 18 nt, Human
cguggccccagccuggcc

SEQ ID NO: 3385225 - RNA, 15 nt, Human
cguggcccuuccugg

SEQ ID NO: 3385226 - RNA, 16 nt, Human
cguggcccuuccugga

SEQ ID NO: 3385227 - RNA, 18 nt, Human
cguggcccuuccuggaca

SEQ ID NO: 3385228 - RNA, 22 nt, Human
cguggcccuuccuggacagcug

SEQ ID NO: 3385229 - RNA, 21 nt, Human
cguggccucccaaagugcugg

SEQ ID NO: 3385230 - RNA, 15 nt, Human
cguggccucuugagc

SEQ ID NO: 3385231 - RNA, 23 nt, Human
cguggccucuugagcaguggcug

SEQ ID NO: 3385232 - RNA, 20 nt, Human
cguggccuuccccagccucu

SEQ ID NO: 3385233 - RNA, 22 nt, Human
cguggcuaagaguguccuagga

SEQ ID NO: 3385234 - RNA, 15 nt, Human
cguggcucagccagc

SEQ ID NO: 3385235 - RNA, 14 nt, Human
cguggcugaccccc

SEQ ID NO: 3385236 - RNA, 17 nt, Human
cguggcugaccccccuc

SEQ ID NO: 3385237 - RNA, 18 nt, Human
cguggcugaccccccuca

SEQ ID NO: 3385238 - RNA, 19 nt, Human
cguggcugaccccccucag

SEQ ID NO: 3385239 - RNA, 19 nt, Human
cguggcugcggcacccuug

SEQ ID NO: 3385240 - RNA, 22 nt, Human
cguggcugcgugccccugcugc

SEQ ID NO: 3385241 - RNA, 15 nt, Human
cguggcugcuucaag

SEQ ID NO: 3385242 - RNA, 18 nt, Human
cguggcuucccgcucagc

SEQ ID NO: 3385243 - RNA, 21 nt, Human
cguggcuucugaugaaucuug

SEQ ID NO: 3385244 - RNA, 19 nt, Human
cgugggacggugcccaagc

SEQ ID NO: 3385245 - RNA, 20 nt, Human
cgugggacggugcccaagcc

SEQ ID NO: 3385246 - RNA, 22 nt, Human
cgugggagacaagaaaucccug

SEQ ID NO: 3385247 - RNA, 17 nt, Human
cgugggagagagacgug

SEQ ID NO: 3385248 - RNA, 23 nt, Human
cgugggauucagagaaaggcaag

SEQ ID NO: 3385249 - RNA, 16 nt, Human
cgugggcuccccucuu

SEQ ID NO: 3385250 - RNA, 11 nt, Human
cguggggaggu

SEQ ID NO: 3385251 - RNA, 12 nt, Human
cguggggcagca

SEQ ID NO: 3385252 - RNA, 16 nt, Human
cguggggcagggagcu

SEQ ID NO: 3385253 - RNA, 23 nt, Human
cguggggcagggagcugggcccg

SEQ ID NO: 3385254 - RNA, 17 nt, Human
cguggggugugcuggga

SEQ ID NO: 3385255 - RNA, 18 nt, Human
cgugggucuguuuuccuu

SEQ ID NO: 3385256 - RNA, 14 nt, Human
cguggguugcuaac

SEQ ID NO: 3385257 - RNA, 19 nt, Human
cguggguugcuaacugaac

SEQ ID NO: 3385258 - RNA, 15 nt, Human
cguggugauuuagca

SEQ ID NO: 3385259 - RNA, 22 nt, Human
cguggugauuuagcaggaagcu

SEQ ID NO: 3385260 - RNA, 18 nt, Human
cguggugcgagugcguga

SEQ ID NO: 3385261 - RNA, 14 nt, Human
cgugguggcaggca

SEQ ID NO: 3385262 - RNA, 19 nt, Human
cgugguguuauuuaaagaa

SEQ ID NO: 3385263 - RNA, 20 nt, Human
cguguaaccauggacccaau

SEQ ID NO: 3385264 - RNA, 17 nt, Human
cguguaggaaccugcac

SEQ ID NO: 3385265 - RNA, 14 nt, Human
cgugucaagcugcu

SEQ ID NO: 3385266 - RNA, 17 nt, Human
cgugucaagcugcucug

SEQ ID NO: 3385267 - RNA, 16 nt, Human
cgugucaccugugcuu

SEQ ID NO: 3385268 - RNA, 13 nt, Human
cguguccaccccc

SEQ ID NO: 3385269 - RNA, 17 nt, Human
cguguccccggccucag

SEQ ID NO: 3385270 - RNA, 18 nt, Human
cguguccccggggcccag

SEQ ID NO: 3385271 - RNA, 15 nt, Human
cgugucccucucgga

SEQ ID NO: 3385272 - RNA, 22 nt, Human
cgugucuguauuuaugugugag

SEQ ID NO: 3385273 - RNA, 20 nt, Human
cgugucuuccacuuugcaua

SEQ ID NO: 3385274 - RNA, 20 nt, Human
cgugugagugugacagggcc

SEQ ID NO: 3385275 - RNA, 18 nt, Human
cgugugcacacacaccac

SEQ ID NO: 3385276 - RNA, 15 nt, Human
cgugugccugugugc

SEQ ID NO: 3385277 - RNA, 21 nt, Human
cguguggcaauagugggcccu

SEQ ID NO: 3385278 - RNA, 18 nt, Human
cguguguagaguuaagaa

SEQ ID NO: 3385279 - RNA, 22 nt, Human
cguguguagaguuaagaagcug

SEQ ID NO: 3385280 - RNA, 19 nt, Human
cguguguagauaguaugca

SEQ ID NO: 3385281 - RNA, 19 nt, Human
ccagaacacacuccaucag

SEQ ID NO: 3385282 - RNA, 22 nt, Human
ccagaacacacuccaucagcuu

SEQ ID NO: 3385283 - RNA, 16 nt, Human
ccagaaccaauuauuu

SEQ ID NO: 3385284 - RNA, 14 nt, Human
ccagaaccccgagc

SEQ ID NO: 3385285 - RNA, 16 nt, Human
ccagaacucugccugc

SEQ ID NO: 3385286 - RNA, 19 nt, Human
ccagaacucugccugcccu

SEQ ID NO: 3385287 - RNA, 24 nt, Human
ccagaacucuuccuccaaggacag

SEQ ID NO: 3385288 - RNA, 13 nt, Human
ccagaacuucccu

SEQ ID NO: 3385289 - RNA, 14 nt, Human
ccagaacuucccug

SEQ ID NO: 3385290 - RNA, 15 nt, Human
ccagaacuucccuga

SEQ ID NO: 3385291 - RNA, 20 nt, Human
ccagaacuugacccugagcu

SEQ ID NO: 3385292 - RNA, 22 nt, Human
ccagaagaaaauagugguguga

SEQ ID NO: 3385293 - RNA, 18 nt, Human
ccagaagaaaauucuccu

SEQ ID NO: 3385294 - RNA, 18 nt, Human
ccagaagaagagaagcug

SEQ ID NO: 3385295 - RNA, 22 nt, Human
ccagaagaagagaagcugcuga

SEQ ID NO: 3385296 - RNA, 17 nt, Human
ccagaagaagauggcug

SEQ ID NO: 3385297 - RNA, 22 nt, Human
ccagaagauccccucaggacug

SEQ ID NO: 3385298 - RNA, 23 nt, Human
ccagaagaugaacagacugaccu

SEQ ID NO: 3385299 - RNA, 21 nt, Human
ccagaagaugacugaggguga

SEQ ID NO: 3385300 - RNA, 13 nt, Human
ccagaagcccaga

SEQ ID NO: 3385301 - RNA, 14 nt, Human
ccagaagcccagaa

SEQ ID NO: 3385302 - RNA, 15 nt, Human
ccagaagcccagaau

SEQ ID NO: 3385303 - RNA, 15 nt, Human
ccagaagccucuggc

SEQ ID NO: 3385304 - RNA, 20 nt, Human
ccagaagccucuggcuagag

SEQ ID NO: 3385305 - RNA, 17 nt, Human
ccagaagcucccccagc

SEQ ID NO: 3385306 - RNA, 19 nt, Human
ccagaagcucccccagcaa

SEQ ID NO: 3385307 - RNA, 23 nt, Human
ccagaaggagggggugaccuccg

SEQ ID NO: 3385308 - RNA, 18 nt, Human
ccagaagucaaggcuuag

SEQ ID NO: 3385309 - RNA, 12 nt, Human
ccagaaguguga

SEQ ID NO: 3385310 - RNA, 16 nt, Human
ccagaagugugacugg

SEQ ID NO: 3385311 - RNA, 19 nt, Human
ccagaauaaguuauugcag

SEQ ID NO: 3385312 - RNA, 14 nt, Human
ccagaaucccagcc

SEQ ID NO: 3385313 - RNA, 16 nt, Human
ccagaaugcuguacau

SEQ ID NO: 3385314 - RNA, 17 nt, Human
ccagaaugcuguacauc

SEQ ID NO: 3385315 - RNA, 22 nt, Human
ccagaaugucagauuccuuucc

SEQ ID NO: 3385316 - RNA, 20 nt, Human
ccagaauugugcaaauggaa

SEQ ID NO: 3385317 - RNA, 13 nt, Human
ccagaauuucaaa

SEQ ID NO: 3385318 - RNA, 19 nt, Human
ccagaauuucccaaagcag

SEQ ID NO: 3385319 - RNA, 17 nt, Human
ccagaauuuggaaaucc

SEQ ID NO: 3385320 - RNA, 18 nt, Human
ccagaauuuggaaauccu

SEQ ID NO: 3385321 - RNA, 14 nt, Human
ccagacacaggccc

SEQ ID NO: 3385322 - RNA, 21 nt, Human
cuacacaggggaaaagaggag

SEQ ID NO: 3385323 - RNA, 20 nt, Human
cuacacagugggaacucuga

SEQ ID NO: 3385324 - RNA, 15 nt, Human
cuacaccacacacaa

SEQ ID NO: 3385325 - RNA, 21 nt, Human
cuacaccacacacaacagcca

SEQ ID NO: 3385326 - RNA, 13 nt, Human
cuacaccacucug

SEQ ID NO: 3385327 - RNA, 14 nt, Human
cuacaccacucugg

SEQ ID NO: 3385328 - RNA, 15 nt, Human
cuacaccacucuggc

SEQ ID NO: 3385329 - RNA, 20 nt, Human
cuacaccacucuggcagcca

SEQ ID NO: 3385330 - RNA, 21 nt, Human
cuacaccacucuggcagccac

SEQ ID NO: 3385331 - RNA, 22 nt, Human
cuacaccacucuggcagccaca

SEQ ID NO: 3385332 - RNA, 11 nt, Human
cuacacccagc

SEQ ID NO: 3385333 - RNA, 12 nt, Human
cuacacccagca

SEQ ID NO: 3385334 - RNA, 16 nt, Human
cuauacccacccagaa

SEQ ID NO: 3385335 - RNA, 19 nt, Human
cuauaccugugccucggcu

SEQ ID NO: 3385336 - RNA, 19 nt, Human
cuauacgcagcgugcuuua

SEQ ID NO: 3385337 - RNA, 17 nt, Human
cuauacugcauacuuuu

SEQ ID NO: 3385338 - RNA, 15 nt, Human
cuauacuugaacaaa

SEQ ID NO: 3385339 - RNA, 22 nt, Human
cuauacuugaacaaaaggguca

SEQ ID NO: 3385340 - RNA, 13 nt, Human
cuauagaaagugu

SEQ ID NO: 3385341 - RNA, 19 nt, Human
cuauagaaaguguucuguu

SEQ ID NO: 3385342 - RNA, 19 nt, Human
cuauagacccgaggaaacu

SEQ ID NO: 3385343 - RNA, 16 nt, Human
cuauagagccuaccug

SEQ ID NO: 3385344 - RNA, 17 nt, Human
cuauagcaucacuuaaa

SEQ ID NO: 3385345 - RNA, 13 nt, Human
cuauagccaaaaa

SEQ ID NO: 3385346 - RNA, 14 nt, Human
cuauagccaaaaau

SEQ ID NO: 3385347 - RNA, 19 nt, Human
cuauagccaaaaauagcua

SEQ ID NO: 3385348 - RNA, 17 nt, Human
cuauagccuaggugaca

SEQ ID NO: 3385349 - RNA, 21 nt, Human
cuauagccuggggugggguca

SEQ ID NO: 3385350 - RNA, 23 nt, Human
cuauagcucaggaccugggaccu

SEQ ID NO: 3385351 - RNA, 16 nt, Human
cuauaggcuggagaag

SEQ ID NO: 3385352 - RNA, 18 nt, Human
cuauaggcuggagaagcu

SEQ ID NO: 3385353 - RNA, 19 nt, Human
cuauaggucauacaaucca

SEQ ID NO: 3385354 - RNA, 14 nt, Human
cuauagguccagaa

SEQ ID NO: 3385355 - RNA, 22 nt, Human
cuauaggugcuacaaaaacaca

SEQ ID NO: 3385356 - RNA, 12 nt, Human
cuauaguauuug

SEQ ID NO: 3385357 - RNA, 21 nt, Human
cuauaguccagcuuuguucuu

SEQ ID NO: 3385358 - RNA, 13 nt, Human
cuauaguuacugu

SEQ ID NO: 3385359 - RNA, 16 nt, Human
cuauaguuacuguccu

SEQ ID NO: 3385360 - RNA, 15 nt, Human
cuauaguucuagaca

SEQ ID NO: 3385361 - RNA, 19 nt, Human
cuauaguuuaaaacacauu

SEQ ID NO: 3385362 - RNA, 14 nt, Human
cuauauaaaauaac

SEQ ID NO: 3385363 - RNA, 17 nt, Human
cuauauaaaauaacuaa

SEQ ID NO: 3385364 - RNA, 22 nt, Human
cuauauaaaauaacuaaaaugu

SEQ ID NO: 3385365 - RNA, 19 nt, Human
cuauauaagacaagaacuc

SEQ ID NO: 3385366 - RNA, 16 nt, Human
cuauauacaugugugu

SEQ ID NO: 3385367 - RNA, 19 nt, Human
cuauauacauguguguaua

SEQ ID NO: 3385368 - RNA, 14 nt, Human
cuauauaccaaagc

SEQ ID NO: 3385369 - RNA, 15 nt, Human
cuauauagagauguu

SEQ ID NO: 3385370 - RNA, 19 nt, Human
cuauauagcugaucaguuu

SEQ ID NO: 3385371 - RNA, 19 nt, Human
cuauauaguaccuuugcuc

SEQ ID NO: 3385372 - RNA, 20 nt, Human
cuauauaguaccuuugcucu

SEQ ID NO: 3385373 - RNA, 19 nt, Human
cuauauauaaaacggugcu

SEQ ID NO: 3385374 - RNA, 21 nt, Human
cuauauauaauucuguacaua

SEQ ID NO: 3385375 - RNA, 18 nt, Human
cuauauauauaaauguau

SEQ ID NO: 3385376 - RNA, 13 nt, Human
cuauauauauaau

SEQ ID NO: 3385377 - RNA, 14 nt, Human
cuauauauauaugc

SEQ ID NO: 3385378 - RNA, 23 nt, Human
cuauauaugugaugaucuaccag

SEQ ID NO: 3385379 - RNA, 12 nt, Human
cuauauauuucu

SEQ ID NO: 3385380 - RNA, 14 nt, Human
cuauauauuucuau

SEQ ID NO: 3385381 - RNA, 14 nt, Human
cuauaucaugcuuu

SEQ ID NO: 3385382 - RNA, 20 nt, Human
cuauaucaugcuuuaaagug

SEQ ID NO: 3385383 - RNA, 15 nt, Human
cuauaucauuaaaag

SEQ ID NO: 3385384 - RNA, 15 nt, Human
cuauauccauguacu

SEQ ID NO: 3385385 - RNA, 17 nt, Human
cuauauccugugacugu

SEQ ID NO: 3385386 - RNA, 17 nt, Human
cuauaucuauaaacacu

SEQ ID NO: 3385387 - RNA, 19 nt, Human
cuauaucuauaaacacugu

SEQ ID NO: 3385388 - RNA, 13 nt, Human
cuauaucuauaua

SEQ ID NO: 3385389 - RNA, 15 nt, Human
cuauaucuguauaua

SEQ ID NO: 3385390 - RNA, 20 nt, Human
cuauaucuguauauaaaaua

SEQ ID NO: 3385391 - RNA, 13 nt, Human
cuauaucuguuuu

SEQ ID NO: 3385392 - RNA, 22 nt, Human
cuauaucuguuuuacugcuuuu

SEQ ID NO: 3385393 - RNA, 15 nt, Human
cuauaugaaaaacaa

SEQ ID NO: 3385394 - RNA, 23 nt, Human
cuauaugaauuuaaauauaauuc

SEQ ID NO: 3385395 - RNA, 16 nt, Human
cuauaugagaagaaua

SEQ ID NO: 3385396 - RNA, 17 nt, Human
cuauaugagaagaauag

SEQ ID NO: 3385397 - RNA, 19 nt, Human
cuauaugauuuauaguuug

SEQ ID NO: 3385398 - RNA, 17 nt, Human
cuauauggaauugcuua

SEQ ID NO: 3385399 - RNA, 10 nt, Human
cuauauguau

SEQ ID NO: 3385400 - RNA, 18 nt, Human
cuauauugauuguccuuu

SEQ ID NO: 3385401 - RNA, 19 nt, Human
cuauauugcccaggcuggu

SEQ ID NO: 3385402 - RNA, 14 nt, Human
cuauauuuaaguau

SEQ ID NO: 3385403 - RNA, 23 nt, Human
cuauauuugcuagacucuagaca

SEQ ID NO: 3385404 - RNA, 22 nt, Human
cuauauuugggccugcuccaga

SEQ ID NO: 3385405 - RNA, 14 nt, Human
cuauauuuuccuga

SEQ ID NO: 3385406 - RNA, 14 nt, Human
cuauauuuugucau

SEQ ID NO: 3385407 - RNA, 15 nt, Human
cuauauuuugucaua

SEQ ID NO: 3385408 - RNA, 21 nt, Human
cuauauuuugucauaucaaau

SEQ ID NO: 3385409 - RNA, 19 nt, Human
cuaucaacaauaaaauuuu

SEQ ID NO: 3385410 - RNA, 19 nt, Human
cuaucaaccccagacacug

SEQ ID NO: 3385411 - RNA, 21 nt, Human
cuaucaaccccagacacuggu

SEQ ID NO: 3385412 - RNA, 15 nt, Human
cuaucaagucaauca

SEQ ID NO: 3385413 - RNA, 21 nt, Human
cuaucaauagucaagaaaaau

SEQ ID NO: 3385414 - RNA, 18 nt, Human
cuaucaauauauaaauuu

SEQ ID NO: 3385415 - RNA, 16 nt, Human
cuaucacccaacgcuc

SEQ ID NO: 3385416 - RNA, 14 nt, Human
cuaucaccuccccu

SEQ ID NO: 3385417 - RNA, 17 nt, Human
cuaucacugguuugguu

SEQ ID NO: 3385418 - RNA, 13 nt, Human
cuaucagaagacc

SEQ ID NO: 3385419 - RNA, 18 nt, Human
cuaucagaguauccacug

SEQ ID NO: 3385420 - RNA, 19 nt, Human
cuaucagaguugcugcaaa

SEQ ID NO: 3385421 - RNA, 17 nt, Human
cuaucagugugcccccc

SEQ ID NO: 3385422 - RNA, 23 nt, Human
cuaucaguuuuauagcuuuauuu

SEQ ID NO: 3385423 - RNA, 16 nt, Human
cuaucauaguuaacau

SEQ ID NO: 3385424 - RNA, 16 nt, Human
cuaucauuaaaguucu

SEQ ID NO: 3385425 - RNA, 18 nt, Human
cuaucauugcuuccuccu

SEQ ID NO: 3385426 - RNA, 17 nt, Human
cuaucauuuuuguacag

SEQ ID NO: 3385427 - RNA, 23 nt, Human
cuaucauuuuuguacaguuugcu

SEQ ID NO: 3385428 - RNA, 19 nt, Human
cuauccaaacauguauuua

SEQ ID NO: 3385429 - RNA, 20 nt, Human
cuauccaaacauguauuuau

SEQ ID NO: 3385430 - RNA, 23 nt, Human
cuauccaaucaaucuugcaugua

SEQ ID NO: 3385431 - RNA, 19 nt, Human
cuauccacccagcccauuc

SEQ ID NO: 3385432 - RNA, 21 nt, Human
cuauccacugggcacaacugc

SEQ ID NO: 3385433 - RNA, 22 nt, Human
cuauccaucaugaccagcaaau

SEQ ID NO: 3385434 - RNA, 16 nt, Human
cuauccaugcaccaaa

SEQ ID NO: 3385435 - RNA, 17 nt, Human
cuauccaugcaccaaac

SEQ ID NO: 3385436 - RNA, 13 nt, Human
cuaucccauccca

SEQ ID NO: 3385437 - RNA, 16 nt, Human
cuaucccggcugcccu

SEQ ID NO: 3385438 - RNA, 14 nt, Human
cuaucccucacaca

SEQ ID NO: 3385439 - RNA, 13 nt, Human
cuauccuacccca

SEQ ID NO: 3385440 - RNA, 14 nt, Human
cuauccucacugcc

SEQ ID NO: 3385441 - RNA, 13 nt, Human
cuauccuggcucu

SEQ ID NO: 3385442 - RNA, 22 nt, Human
cuauccuggcuuugcccaaccu

SEQ ID NO: 3385443 - RNA, 11 nt, Human
cuauccuuggc

SEQ ID NO: 3385444 - RNA, 15 nt, Human
cuaucuaaugacaug

SEQ ID NO: 3385445 - RNA, 17 nt, Human
cuaucuacucuccucau

SEQ ID NO: 3385446 - RNA, 13 nt, Human
cuaucuauuugag

SEQ ID NO: 3385447 - RNA, 20 nt, Human
cuaucucacagcacacucag

SEQ ID NO: 3385448 - RNA, 14 nt, Human
cuaucucagagaua

SEQ ID NO: 3385449 - RNA, 21 nt, Human
cuaucucaucuaucucaaucc

SEQ ID NO: 3385450 - RNA, 13 nt, Human
cuaucucccccag

SEQ ID NO: 3385451 - RNA, 14 nt, Human
cuaucucccccagc

SEQ ID NO: 3385452 - RNA, 16 nt, Human
cuaucucccccagccc

SEQ ID NO: 3385453 - RNA, 20 nt, Human
cuaucucccccagccccauc

SEQ ID NO: 3385454 - RNA, 15 nt, Human
cuaucuccuagggcu

SEQ ID NO: 3385455 - RNA, 19 nt, Human
cuaucucuauuauuggaaa

SEQ ID NO: 3385456 - RNA, 17 nt, Human
cuaucucugugugcaca

SEQ ID NO: 3385457 - RNA, 21 nt, Human
cuaucucugugugcacaaaua

SEQ ID NO: 3385458 - RNA, 23 nt, Human
cuaucuggaggccuuccagcugc

SEQ ID NO: 3385459 - RNA, 24 nt, Human
cuaucuggccauauuuacuaccuu

SEQ ID NO: 3385460 - RNA, 16 nt, Human
cuaucugggcuuccug

SEQ ID NO: 3385461 - RNA, 20 nt, Human
cuaucugggcuuccuggagc

SEQ ID NO: 3385462 - RNA, 17 nt, Human
cuaucugguauuaaaug

SEQ ID NO: 3385463 - RNA, 20 nt, Human
cuaucugguauuaaaugcca

SEQ ID NO: 3385464 - RNA, 21 nt, Human
cuaucuggucaaccuccugga

SEQ ID NO: 3385465 - RNA, 16 nt, Human
cuaucuggugauuucu

SEQ ID NO: 3385466 - RNA, 17 nt, Human
cuaucuggugauuucua

SEQ ID NO: 3385467 - RNA, 23 nt, Human
cuauucaaacagucucaggaaau

SEQ ID NO: 3385468 - RNA, 17 nt, Human
cuauucacaaaauauca

SEQ ID NO: 3385469 - RNA, 16 nt, Human
cuauucacaauuauuc

SEQ ID NO: 3385470 - RNA, 14 nt, Human
cuauucagacaagc

SEQ ID NO: 3385471 - RNA, 17 nt, Human
cuauucauuaaauguuu

SEQ ID NO: 3385472 - RNA, 15 nt, Human
cuauuccaaaaaggu

SEQ ID NO: 3385473 - RNA, 12 nt, Human
cuauuccagcuc

SEQ ID NO: 3385474 - RNA, 13 nt, Human
cuauuccagcuca

SEQ ID NO: 3385475 - RNA, 19 nt, Human
cuauuccagcugucccccc

SEQ ID NO: 3385476 - RNA, 14 nt, Human
cuauuccuccuggg

SEQ ID NO: 3385477 - RNA, 13 nt, Human
cuauuccugagag

SEQ ID NO: 3385478 - RNA, 17 nt, Human
cuauuccuucuggccuu

SEQ ID NO: 3385479 - RNA, 23 nt, Human
cuauuccuucuggccuuuccucu

SEQ ID NO: 3385480 - RNA, 15 nt, Human
cuauuccuuucccuu

SEQ ID NO: 3385481 - RNA, 18 nt, Human
cuauuccuuucccuuccu

SEQ ID NO: 3385482 - RNA, 19 nt, Human
cuauuccuuucccuuccuc

SEQ ID NO: 3385483 - RNA, 20 nt, Human
cuauuccuuucccuuccucu

SEQ ID NO: 3385484 - RNA, 15 nt, Human
cuauucuagccugca

SEQ ID NO: 3385485 - RNA, 14 nt, Human
cuauucuccagcug

SEQ ID NO: 3385486 - RNA, 18 nt, Human
cuauucucuccucagacu

SEQ ID NO: 3385487 - RNA, 14 nt, Human
cuauucuugaugua

SEQ ID NO: 3385488 - RNA, 16 nt, Human
cuauucuugauguaaa

SEQ ID NO: 3385489 - RNA, 22 nt, Human
cuauucuugauguaaaaucuug

SEQ ID NO: 3385490 - RNA, 21 nt, Human
cuauucuugauuuauuugcuu

SEQ ID NO: 3385491 - RNA, 23 nt, Human
cuauucuugauuuauuugcuucu

SEQ ID NO: 3385492 - RNA, 20 nt, Human
cuauugaauucggaacuguc

SEQ ID NO: 3385493 - RNA, 16 nt, Human
cuauugacaauaaaau

SEQ ID NO: 3385494 - RNA, 14 nt, Human
cuauugacuucaau

SEQ ID NO: 3385495 - RNA, 17 nt, Human
cuauugagucuucaugu

SEQ ID NO: 3385496 - RNA, 16 nt, Human
cuauugauaauuuaga

SEQ ID NO: 3385497 - RNA, 15 nt, Human
cuauugauguacagu

SEQ ID NO: 3385498 - RNA, 23 nt, Human
cuauugauguacagucugucaug

SEQ ID NO: 3385499 - RNA, 17 nt, Human
cuauugauuuaagcuuu

SEQ ID NO: 3385500 - RNA, 13 nt, Human
cuacgccugccuc

SEQ ID NO: 3385501 - RNA, 14 nt, Human
cuacgcucuccuuu

SEQ ID NO: 3385502 - RNA, 14 nt, Human
cuacggaccaggua

SEQ ID NO: 3385503 - RNA, 14 nt, Human
cuacguauuuaaua

SEQ ID NO: 3385504 - RNA, 13 nt, Human
cuacgugugauuu

SEQ ID NO: 3385505 - RNA, 14 nt, Human
cuacgugugauuuu

SEQ ID NO: 3385506 - RNA, 18 nt, Human
cuacgugugauuuuucug

SEQ ID NO: 3385507 - RNA, 20 nt, Human
cuacguuucuuuaaccuugu

SEQ ID NO: 3385508 - RNA, 14 nt, Human
cuacuaaaaaugca

SEQ ID NO: 3385509 - RNA, 23 nt, Human
cuacuaacaaucagcuccuuccu

SEQ ID NO: 3385510 - RNA, 23 nt, Human
cuacuaagaaaauagagaugagc

SEQ ID NO: 3385511 - RNA, 20 nt, Human
cuacuaaggcuuuccuaccu

SEQ ID NO: 3385512 - RNA, 17 nt, Human
cuacuaauagaauaaag

SEQ ID NO: 3385513 - RNA, 14 nt, Human
cuacuaaugauguu

SEQ ID NO: 3385514 - RNA, 15 nt, Human
cuacuaauuccacac

SEQ ID NO: 3385515 - RNA, 18 nt, Human
cuacuacaucgcccucca

SEQ ID NO: 3385516 - RNA, 16 nt, Human
cuacuagcaaaauaaa

SEQ ID NO: 3385517 - RNA, 14 nt, Human
cuacuauaaagaga

SEQ ID NO: 3385518 - RNA, 18 nt, Human
cuacuaugccagaugccu

SEQ ID NO: 3385519 - RNA, 12 nt, Human
cuacuauuuucu

SEQ ID NO: 3385520 - RNA, 21 nt, Human
cuacucaagcggguggcucug

SEQ ID NO: 3385521 - RNA, 13 nt, Human
cuacucacucaag

SEQ ID NO: 3385522 - RNA, 14 nt, Human
cuacucacucaagu

SEQ ID NO: 3385523 - RNA, 15 nt, Human
cuacucaggaggcug

SEQ ID NO: 3385524 - RNA, 16 nt, Human
cuacucauuuuaauga

SEQ ID NO: 3385525 - RNA, 17 nt, Human
cuacucccagacaccca

SEQ ID NO: 3385526 - RNA, 13 nt, Human
cuacucccugcag

SEQ ID NO: 3385527 - RNA, 18 nt, Human
cuacucccugcagaugcc

SEQ ID NO: 3385528 - RNA, 17 nt, Human
cuacuccuaccucagcc

SEQ ID NO: 3385529 - RNA, 14 nt, Human
cuacuccucugcag

SEQ ID NO: 3385530 - RNA, 20 nt, Human
cuacuccucugcagugccuu

SEQ ID NO: 3385531 - RNA, 13 nt, Human
cuacuccugucuu

SEQ ID NO: 3385532 - RNA, 17 nt, Human
cuacuccugucuucugc

SEQ ID NO: 3385533 - RNA, 19 nt, Human
cuacuccugucuucugcuu

SEQ ID NO: 3385534 - RNA, 16 nt, Human
cuacucgaguuacaga

SEQ ID NO: 3385535 - RNA, 22 nt, Human
cuacucuagagaaguggacugg

SEQ ID NO: 3385536 - RNA, 20 nt, Human
cuacucuagggaaaaaccag

SEQ ID NO: 3385537 - RNA, 22 nt, Human
cuacucucaggaucaagaaagu

SEQ ID NO: 3385538 - RNA, 18 nt, Human
cuacucucccauggcuua

SEQ ID NO: 3385539 - RNA, 12 nt, Human
cuacucuccuca

SEQ ID NO: 3385540 - RNA, 13 nt, Human
cuacucuccucau

SEQ ID NO: 3385541 - RNA, 17 nt, Human
cuacucuccucggcccc

SEQ ID NO: 3385542 - RNA, 14 nt, Human
cuacucugugccag

SEQ ID NO: 3385543 - RNA, 19 nt, Human
cuacucugugccagagccu

SEQ ID NO: 3385544 - RNA, 12 nt, Human
cuacucuguguc

SEQ ID NO: 3385545 - RNA, 21 nt, Human
cuacucugugucagguggggc

SEQ ID NO: 3385546 - RNA, 15 nt, Human
cuacucuguuccuuc

SEQ ID NO: 3385547 - RNA, 15 nt, Human
cuacucuuaagccau

SEQ ID NO: 3385548 - RNA, 18 nt, Human
cuacucuuaagccaucuu

SEQ ID NO: 3385549 - RNA, 22 nt, Human
cuacucuuaagccaucuuggua

SEQ ID NO: 3385550 - RNA, 22 nt, Human
cuacucuuaaguuucucagcuc

SEQ ID NO: 3385551 - RNA, 14 nt, Human
cuacucuucucucu

SEQ ID NO: 3385552 - RNA, 12 nt, Human
cuacugaaacag

SEQ ID NO: 3385553 - RNA, 13 nt, Human
cuacugaagcccu

SEQ ID NO: 3385554 - RNA, 14 nt, Human
cuacugaagcccuu

SEQ ID NO: 3385555 - RNA, 14 nt, Human
cuacugacaugugg

SEQ ID NO: 3385556 - RNA, 18 nt, Human
cuacugaccagacaagcu

SEQ ID NO: 3385557 - RNA, 18 nt, Human
cuacugcaccauuuaaaa

SEQ ID NO: 3385558 - RNA, 20 nt, Human
cuacugcacuccagccuggg

SEQ ID NO: 3385559 - RNA, 23 nt, Human
cuacugcacuccagccuggggga

SEQ ID NO: 3385560 - RNA, 20 nt, Human
cuacugcagcaccuccaggc

SEQ ID NO: 3385561 - RNA, 21 nt, Human
cuacugcagcaccuccaggcc

SEQ ID NO: 3385562 - RNA, 19 nt, Human
cuacugcauuuagggagua

SEQ ID NO: 3385563 - RNA, 22 nt, Human
cuacugccaaccucgcuccaac

SEQ ID NO: 3385564 - RNA, 15 nt, Human
cuacugccauccugg

SEQ ID NO: 3385565 - RNA, 17 nt, Human
cuacugccauccuggcc

SEQ ID NO: 3385566 - RNA, 23 nt, Human
cuacugccauccuggcccagggc

SEQ ID NO: 3385567 - RNA, 21 nt, Human
cuacugcccaggcacugcaaa

SEQ ID NO: 3385568 - RNA, 15 nt, Human
cuacuggauucuuau

SEQ ID NO: 3385569 - RNA, 16 nt, Human
cuacuggggaaacugg

SEQ ID NO: 3385570 - RNA, 17 nt, Human
cuacuggguguagacug

SEQ ID NO: 3385571 - RNA, 23 nt, Human
cuacugggugucauuucauucca

SEQ ID NO: 3385572 - RNA, 17 nt, Human
cuacuguaauuuuauau

SEQ ID NO: 3385573 - RNA, 19 nt, Human
cuacuguaauuuuauauga

SEQ ID NO: 3385574 - RNA, 20 nt, Human
cuacugucaaaugaugugca

SEQ ID NO: 3385575 - RNA, 21 nt, Human
cuacugucaaaugaugugcaa

SEQ ID NO: 3385576 - RNA, 20 nt, Human
cuacugucuuuggaaaaaug

SEQ ID NO: 3385577 - RNA, 13 nt, Human
cuacugugacuga

SEQ ID NO: 3385578 - RNA, 15 nt, Human
cuacuguggaaaaau

SEQ ID NO: 3385579 - RNA, 18 nt, Human
cuacuguggaaaaauauu

SEQ ID NO: 3385580 - RNA, 21 nt, Human
cuacugugguguuuuguuuau

SEQ ID NO: 3385581 - RNA, 11 nt, Human
cuacuguguaa

SEQ ID NO: 3385582 - RNA, 15 nt, Human
cuacuguguguguga

SEQ ID NO: 3385583 - RNA, 20 nt, Human
cuacugugugugugaaugaa

SEQ ID NO: 3385584 - RNA, 23 nt, Human
cuacuguguuaugcaaaagcaag

SEQ ID NO: 3385585 - RNA, 15 nt, Human
cuacuguucuaaagc

SEQ ID NO: 3385586 - RNA, 20 nt, Human
cuacuguucuaaagcucuga

SEQ ID NO: 3385587 - RNA, 23 nt, Human
cuacuguuuuaauuuauacuggc

SEQ ID NO: 3385588 - RNA, 13 nt, Human
cuacuuaagagaa

SEQ ID NO: 3385589 - RNA, 19 nt, Human
cuacuuaauuccuuucuca

SEQ ID NO: 3385590 - RNA, 13 nt, Human
cuacuuacacauc

SEQ ID NO: 3385591 - RNA, 21 nt, Human
cuacuuaccuaccacaugcca

SEQ ID NO: 3385592 - RNA, 16 nt, Human
cuacuuagcacuucag

SEQ ID NO: 3385593 - RNA, 19 nt, Human
cuacuuagcacuucagggc

SEQ ID NO: 3385594 - RNA, 22 nt, Human
cuacuuagcauccuaagaaaua

SEQ ID NO: 3385595 - RNA, 17 nt, Human
cuacuuagcaugucccu

SEQ ID NO: 3385596 - RNA, 20 nt, Human
cuacuuccccuuccuaauuc

SEQ ID NO: 3385597 - RNA, 16 nt, Human
cuacuucccucaccca

SEQ ID NO: 3385598 - RNA, 13 nt, Human
cuacuuccuccuc

SEQ ID NO: 3385599 - RNA, 20 nt, Human
cuacuuccugugacuucagc

SEQ ID NO: 3385600 - RNA, 22 nt, Human
cuacuucuuuugcucuuagcug

SEQ ID NO: 3385601 - RNA, 17 nt, Human
cuacuugauuuuauugu

SEQ ID NO: 3385602 - RNA, 15 nt, Human
cuacuugcucuggac

SEQ ID NO: 3385603 - RNA, 17 nt, Human
cuacuugcucuggaccu

SEQ ID NO: 3385604 - RNA, 18 nt, Human
cuacuugcucuggaccug

SEQ ID NO: 3385605 - RNA, 21 nt, Human
cuacuugcucuggaccugccc

SEQ ID NO: 3385606 - RNA, 12 nt, Human
cuacuugggagg

SEQ ID NO: 3385607 - RNA, 19 nt, Human
cuacuugggaggcugagau

SEQ ID NO: 3385608 - RNA, 13 nt, Human
cuacuugguuugu

SEQ ID NO: 3385609 - RNA, 17 nt, Human
cuacuugguuuguguuc

SEQ ID NO: 3385610 - RNA, 22 nt, Human
cuacuuucugugucuauggauu

SEQ ID NO: 3385611 - RNA, 20 nt, Human
cuacuuugguuucugucugu

SEQ ID NO: 3385612 - RNA, 17 nt, Human
cucuuugauuauuugca

SEQ ID NO: 3385613 - RNA, 19 nt, Human
cucuuugauuauuugcaug

SEQ ID NO: 3385614 - RNA, 20 nt, Human
cucuuugcuuugcuuucugc

SEQ ID NO: 3385615 - RNA, 21 nt, Human
cucuuuggcgaccuccuuuca

SEQ ID NO: 3385616 - RNA, 15 nt, Human
cucuuugggaauguu

SEQ ID NO: 3385617 - RNA, 17 nt, Human
cucuuugucuaaaacaa

SEQ ID NO: 3385618 - RNA, 23 nt, Human
cucuuugucuacaccauuaugug

SEQ ID NO: 3385619 - RNA, 18 nt, Human
cucuuuguuuugugucuc

SEQ ID NO: 3385620 - RNA, 19 nt, Human
cucuuuuacccaauaagau

SEQ ID NO: 3385621 - RNA, 21 nt, Human
cucuuuuacccuggccccucu

SEQ ID NO: 3385622 - RNA, 14 nt, Human
cucuuuuaccugcu

SEQ ID NO: 3385623 - RNA, 17 nt, Human
cucuuuuaccugcugcu

SEQ ID NO: 3385624 - RNA, 18 nt, Human
cucuuuuaccugcugcuu

SEQ ID NO: 3385625 - RNA, 15 nt, Human
cucuuuuagucauuu

SEQ ID NO: 3385626 - RNA, 15 nt, Human
cucuuuuauauuugu

SEQ ID NO: 3385627 - RNA, 19 nt, Human
cucuuuuccccuuuccugu

SEQ ID NO: 3385628 - RNA, 17 nt, Human
cucuuuucuaaaagacu

SEQ ID NO: 3385629 - RNA, 15 nt, Human
cucuuuucuguacuu

SEQ ID NO: 3385630 - RNA, 18 nt, Human
cucuuuucuuuagagcau

SEQ ID NO: 3385631 - RNA, 10 nt, Human
cucuuuugua

SEQ ID NO: 3385632 - RNA, 13 nt, Human
cucuuuuuaaagu

SEQ ID NO: 3385633 - RNA, 19 nt, Human
cucuuuuuauuuaguuccu

SEQ ID NO: 3385634 - RNA, 21 nt, Human
cucuuuuugggcuccuuuuuc

SEQ ID NO: 3385635 - RNA, 15 nt, Human
cucuuuuugugaagu

SEQ ID NO: 3385636 - RNA, 13 nt, Human
cucuuuuuguuug

SEQ ID NO: 3385637 - RNA, 18 nt, Human
cucuuuuuuacucauuga

SEQ ID NO: 3385638 - RNA, 20 nt, Human
cucuuuuuuguuuguuucuu

SEQ ID NO: 3385639 - RNA, 15 nt, Human
cugaaaaaaaguuua

SEQ ID NO: 3385640 - RNA, 13 nt, Human
cugaaaaaauaua

SEQ ID NO: 3385641 - RNA, 20 nt, Human
cugaaaacauaaaaaguuaa

SEQ ID NO: 3385642 - RNA, 14 nt, Human
cugaaaacaucugg

SEQ ID NO: 3385643 - RNA, 22 nt, Human
cugaaaaccaucuggccuggcc

SEQ ID NO: 3385644 - RNA, 14 nt, Human
cugaaaacccagag

SEQ ID NO: 3385645 - RNA, 17 nt, Human
cugaaaacccagagagg

SEQ ID NO: 3385646 - RNA, 15 nt, Human
cugaaaaccucuccu

SEQ ID NO: 3385647 - RNA, 20 nt, Human
cugaaaaccucuccucaugu

SEQ ID NO: 3385648 - RNA, 15 nt, Human
cugaaaacuggaaua

SEQ ID NO: 3385649 - RNA, 11 nt, Human
cugaaaagaaa

SEQ ID NO: 3385650 - RNA, 16 nt, Human
cugaaaagaaggaaag

SEQ ID NO: 3385651 - RNA, 19 nt, Human
cugaaaagagagcagagaa

SEQ ID NO: 3385652 - RNA, 13 nt, Human
cugaaaauauaac

SEQ ID NO: 3385653 - RNA, 22 nt, Human
cugaaaauauaaccagccauug

SEQ ID NO: 3385654 - RNA, 14 nt, Human
cugaaaauguccuu

SEQ ID NO: 3385655 - RNA, 16 nt, Human
cugaaaauguccuugu

SEQ ID NO: 3385656 - RNA, 19 nt, Human
cugaaaauguccuugugau

SEQ ID NO: 3385657 - RNA, 21 nt, Human
cugaaaaugugaauaaaauua

SEQ ID NO: 3385658 - RNA, 13 nt, Human
cugaaaauguuag

SEQ ID NO: 3385659 - RNA, 17 nt, Human
cugaaaauuaacacugc

SEQ ID NO: 3385660 - RNA, 22 nt, Human
cugaaaauuccagaaaggauau

SEQ ID NO: 3385661 - RNA, 21 nt, Human
cugaaaauuggacagauugcc

SEQ ID NO: 3385662 - RNA, 19 nt, Human
cugaaacacgaaacuuguu

SEQ ID NO: 3385663 - RNA, 17 nt, Human
cugaaacagauuucaua

SEQ ID NO: 3385664 - RNA, 14 nt, Human
cugaaacagcugcc

SEQ ID NO: 3385665 - RNA, 17 nt, Human
cugaaacagcugccuua

SEQ ID NO: 3385666 - RNA, 19 nt, Human
cugaaacagcugccuuagc

SEQ ID NO: 3385667 - RNA, 22 nt, Human
cugaaacagcugccuuagcuuc

SEQ ID NO: 3385668 - RNA, 22 nt, Human
cugaaacucacacaacuaggaa

SEQ ID NO: 3385669 - RNA, 23 nt, Human
cugaaacuuauuuuuuucugauu

SEQ ID NO: 3385670 - RNA, 20 nt, Human
cugaaagaaacaguuaacuu

SEQ ID NO: 3385671 - RNA, 19 nt, Human
cugaaagaacauggacuug

SEQ ID NO: 3385672 - RNA, 14 nt, Human
cugaaagagaaaca

SEQ ID NO: 3385673 - RNA, 14 nt, Human
cugaaagaggcuga

SEQ ID NO: 3385674 - RNA, 22 nt, Human
cugaaagaggcugaggccugga

SEQ ID NO: 3385675 - RNA, 12 nt, Human
cugaaagccacg

SEQ ID NO: 3385676 - RNA, 23 nt, Human
cugaaagcccugagcuuucugcu

SEQ ID NO: 3385677 - RNA, 20 nt, Human
cugaaagccuuagggaagcu

SEQ ID NO: 3385678 - RNA, 23 nt, Human
cugaaagggacgcuacccgggaa

SEQ ID NO: 3385679 - RNA, 18 nt, Human
cugaaaguguuuccuuca

SEQ ID NO: 3385680 - RNA, 23 nt, Human
cugaaaguuuuguaaaagaaauc

SEQ ID NO: 3385681 - RNA, 22 nt, Human
cugaaauagacccacaagaggc

SEQ ID NO: 3385682 - RNA, 16 nt, Human
cugaaauaggaaacaa

SEQ ID NO: 3385683 - RNA, 14 nt, Human
cugaaauauaaagu

SEQ ID NO: 3385684 - RNA, 21 nt, Human
cugaaauaucccggggguggg

SEQ ID NO: 3385685 - RNA, 18 nt, Human
cugaaaucaauuaaaagu

SEQ ID NO: 3385686 - RNA, 16 nt, Human
cugaaaucugaagacc

SEQ ID NO: 3385687 - RNA, 21 nt, Human
cugaaaucuucccaugcauuc

SEQ ID NO: 3385688 - RNA, 19 nt, Human
cugaaaugaaacaaauaau

SEQ ID NO: 3385689 - RNA, 18 nt, Human
cugaaaugccuuacuuug

SEQ ID NO: 3385690 - RNA, 16 nt, Human
cugaaaugcugcauuu

SEQ ID NO: 3385691 - RNA, 20 nt, Human
cugaaaugcugcauuuuaau

SEQ ID NO: 3385692 - RNA, 18 nt, Human
cugaaaugucaguucuga

SEQ ID NO: 3385693 - RNA, 17 nt, Human
cugaaaugugugugaug

SEQ ID NO: 3385694 - RNA, 12 nt, Human
cugaaauuccaa

SEQ ID NO: 3385695 - RNA, 13 nt, Human
cugaaauuccaaa

SEQ ID NO: 3385696 - RNA, 18 nt, Human
cugaaauuccaaagucuc

SEQ ID NO: 3385697 - RNA, 16 nt, Human
cugaaauucuccugga

SEQ ID NO: 3385698 - RNA, 18 nt, Human
cugaaauucuccuggagg

SEQ ID NO: 3385699 - RNA, 20 nt, Human
cugaaauucuccuggagguc

SEQ ID NO: 3385700 - RNA, 14 nt, Human
cugaaauugaaaag

SEQ ID NO: 3385701 - RNA, 20 nt, Human
cugaaauugaaaaguuauuu

SEQ ID NO: 3385702 - RNA, 21 nt, Human
cugaaauugaaaaguuauuuc

SEQ ID NO: 3385703 - RNA, 14 nt, Human
cugaaauuucacca

SEQ ID NO: 3385704 - RNA, 19 nt, Human
cugaaauuuuauaugcuua

SEQ ID NO: 3385705 - RNA, 20 nt, Human
cugaaauuuuucuucuugag

SEQ ID NO: 3385706 - RNA, 13 nt, Human
cugaacaagaauu

SEQ ID NO: 3385707 - RNA, 14 nt, Human
cugaacaagaauug

SEQ ID NO: 3385708 - RNA, 16 nt, Human
cugaacaagaauugga

SEQ ID NO: 3385709 - RNA, 19 nt, Human
cugaacaauaggcuguucc

SEQ ID NO: 3385710 - RNA, 19 nt, Human
cugaacacaggcagcuuuc

SEQ ID NO: 3385711 - RNA, 14 nt, Human
cugaacacauuucu

SEQ ID NO: 3385712 - RNA, 17 nt, Human
cugaacacauuucuuuu

SEQ ID NO: 3385713 - RNA, 22 nt, Human
cugaacacauuucuuuuuaaaa

SEQ ID NO: 3385714 - RNA, 22 nt, Human
cugaacaccauagguagaaugu

SEQ ID NO: 3385715 - RNA, 19 nt, Human
cugaacaccauugaaggcu

SEQ ID NO: 3385716 - RNA, 16 nt, Human
cugaacacuuauugcu

SEQ ID NO: 3385717 - RNA, 22 nt, Human
cugaacacuuauugcuuugaaa

SEQ ID NO: 3385718 - RNA, 19 nt, Human
cugaacacuuuuguuguaa

SEQ ID NO: 3385719 - RNA, 20 nt, Human
cugaacacuuuuguuguaaa

SEQ ID NO: 3385720 - RNA, 22 nt, Human
cugaacagaugaccccugccca

SEQ ID NO: 3385721 - RNA, 24 nt, Human
cugaacagaugaccccugcccaga

SEQ ID NO: 3385722 - RNA, 20 nt, Human
cugaacaucugaguccugga

SEQ ID NO: 3385723 - RNA, 23 nt, Human
cugaacaucugaguccuggauga

SEQ ID NO: 3385724 - RNA, 15 nt, Human
cugaacauuccagag

SEQ ID NO: 3385725 - RNA, 12 nt, Human
cugaacauugga

SEQ ID NO: 3385726 - RNA, 21 nt, Human
cugaacauuuacuacaguuuu

SEQ ID NO: 3385727 - RNA, 12 nt, Human
cugaaccaugug

SEQ ID NO: 3385728 - RNA, 14 nt, Human
cugaaccccagggc

SEQ ID NO: 3385729 - RNA, 21 nt, Human
cugaaccccgucgaggggcuc

SEQ ID NO: 3385730 - RNA, 16 nt, Human
cugaaccccucccucc

SEQ ID NO: 3385731 - RNA, 15 nt, Human
cugaacccugugcug

SEQ ID NO: 3385732 - RNA, 20 nt, Human
cugaacccugugcugguguc

SEQ ID NO: 3385733 - RNA, 17 nt, Human
cugaaccugaugcugac

SEQ ID NO: 3385734 - RNA, 19 nt, Human
cugaaccugggaaagagau

SEQ ID NO: 3385735 - RNA, 14 nt, Human
cugaaccugucuuu

SEQ ID NO: 3385736 - RNA, 16 nt, Human
cugaaccuuccaucuc

SEQ ID NO: 3385737 - RNA, 18 nt, Human
cugaacguuugguucaaa

SEQ ID NO: 3385738 - RNA, 17 nt, Human
cugaacucgcuucucug

SEQ ID NO: 3385739 - RNA, 16 nt, Human
cugaacucugacaaca

SEQ ID NO: 3385740 - RNA, 17 nt, Human
cugaacucugacaacag

SEQ ID NO: 3385741 - RNA, 16 nt, Human
cugaacugggaccuuu

SEQ ID NO: 3385742 - RNA, 18 nt, Human
cugaacuugcauugugau

SEQ ID NO: 3385743 - RNA, 14 nt, Human
cugaacuuugaaga

SEQ ID NO: 3385744 - RNA, 21 nt, Human
cugaacuuugggaagccuuua

SEQ ID NO: 3385745 - RNA, 14 nt, Human
cugaagaagauggu

SEQ ID NO: 3385746 - RNA, 23 nt, Human
cugaagaagcaccaaucaugaau

SEQ ID NO: 3385747 - RNA, 16 nt, Human
cugaagaccucgagca

SEQ ID NO: 3385748 - RNA, 20 nt, Human
cugaagagcuauuauauaaa

SEQ ID NO: 3385749 - RNA, 15 nt, Human
cugaagaggaggagg

SEQ ID NO: 3385750 - RNA, 22 nt, Human
cugagccccugucuagagaggg

SEQ ID NO: 3385751 - RNA, 13 nt, Human
cugagccccuucc

SEQ ID NO: 3385752 - RNA, 14 nt, Human
cugagccccuuccu

SEQ ID NO: 3385753 - RNA, 16 nt, Human
cugagcccgggcugcc

SEQ ID NO: 3385754 - RNA, 18 nt, Human
cugagcccgggcugccug

SEQ ID NO: 3385755 - RNA, 22 nt, Human
cugagcccgggcugccugggcu

SEQ ID NO: 3385756 - RNA, 21 nt, Human
cugaggcuuuggauuugacau

SEQ ID NO: 3385757 - RNA, 22 nt, Human
cugagggaaauguuuuguaaac

SEQ ID NO: 3385758 - RNA, 16 nt, Human
cugagggaccaacugg

SEQ ID NO: 3385759 - RNA, 21 nt, Human
cugagggaccaacugggccca

SEQ ID NO: 3385760 - RNA, 13 nt, Human
cugagggaccagc

SEQ ID NO: 3385761 - RNA, 17 nt, Human
cugagggagccuggccc

SEQ ID NO: 3385762 - RNA, 20 nt, Human
cugagggagcuccaacucag

SEQ ID NO: 3385763 - RNA, 16 nt, Human
cugagggaggaccugg

SEQ ID NO: 3385764 - RNA, 17 nt, Human
cugagggaggaccuggg

SEQ ID NO: 3385765 - RNA, 15 nt, Human
cugagggaggaggcc

SEQ ID NO: 3385766 - RNA, 17 nt, Human
cugagggaggaggccac

SEQ ID NO: 3385767 - RNA, 18 nt, Human
cugagggaggaggccacc

SEQ ID NO: 3385768 - RNA, 19 nt, Human
cugagggaggaggccaccu

SEQ ID NO: 3385769 - RNA, 20 nt, Human
cugagggaggaggccaccuc

SEQ ID NO: 3385770 - RNA, 23 nt, Human
cugagggaggaggccaccucucc

SEQ ID NO: 3385771 - RNA, 13 nt, Human
cugagggcaaauc

SEQ ID NO: 3385772 - RNA, 20 nt, Human
cugagggccccucugcccag

SEQ ID NO: 3385773 - RNA, 15 nt, Human
cugagggccugcugg

SEQ ID NO: 3385774 - RNA, 16 nt, Human
cugagggcgaggggag

SEQ ID NO: 3385775 - RNA, 14 nt, Human
cugagggcuuccuu

SEQ ID NO: 3385776 - RNA, 20 nt, Human
cugagggcuuguaguucuuu

SEQ ID NO: 3385777 - RNA, 19 nt, Human
cugaggggagacagagcaa

SEQ ID NO: 3385778 - RNA, 19 nt, Human
cugaggggcaacgaagaaa

SEQ ID NO: 3385779 - RNA, 15 nt, Human
cugaggggcagccug

SEQ ID NO: 3385780 - RNA, 23 nt, Human
cugaggggcagccugccuugccc

SEQ ID NO: 3385781 - RNA, 18 nt, Human
cugaggggcaucugcccc

SEQ ID NO: 3385782 - RNA, 16 nt, Human
cugaggggggauccag

SEQ ID NO: 3385783 - RNA, 16 nt, Human
cugaggggggccgugc

SEQ ID NO: 3385784 - RNA, 21 nt, Human
cugaggggggccgugcccagg

SEQ ID NO: 3385785 - RNA, 15 nt, Human
cugaggguccccacc

SEQ ID NO: 3385786 - RNA, 19 nt, Human
cugaggguccccaccuggg

SEQ ID NO: 3385787 - RNA, 20 nt, Human
cugaggguccccaccuggga

SEQ ID NO: 3385788 - RNA, 15 nt, Human
cugaggguggagacu

SEQ ID NO: 3385789 - RNA, 20 nt, Human
cugaggguguuucuuccugc

SEQ ID NO: 3385790 - RNA, 15 nt, Human
cugaggucagggagu

SEQ ID NO: 3385791 - RNA, 22 nt, Human
cugaggucaucggcguggccca

SEQ ID NO: 3385792 - RNA, 13 nt, Human
cugagguccugag

SEQ ID NO: 3385793 - RNA, 16 nt, Human
cugagguccugagcac

SEQ ID NO: 3385794 - RNA, 19 nt, Human
cugagguccugagcacugc

SEQ ID NO: 3385795 - RNA, 20 nt, Human
cugagguccugagcacugcc

SEQ ID NO: 3385796 - RNA, 24 nt, Human
cugagguccugagcacugccagga

SEQ ID NO: 3385797 - RNA, 16 nt, Human
cugaggucucuugagg

SEQ ID NO: 3385798 - RNA, 22 nt, Human
cugaggugaugaagacagcccg

SEQ ID NO: 3385799 - RNA, 17 nt, Human
cugaggugcacugggag

SEQ ID NO: 3385800 - RNA, 15 nt, Human
cugaggugcccagga

SEQ ID NO: 3385801 - RNA, 16 nt, Human
cugaggugcccaggag

SEQ ID NO: 3385802 - RNA, 18 nt, Human
cugaggugcccaggagaa

SEQ ID NO: 3385803 - RNA, 14 nt, Human
cccuggggccugac

SEQ ID NO: 3385804 - RNA, 13 nt, Human
cccuggggccugu

SEQ ID NO: 3385805 - RNA, 23 nt, Human
cccuggggccuguacugccugcu

SEQ ID NO: 3385806 - RNA, 21 nt, Human
cccuggggcuaggcuggagcc

SEQ ID NO: 3385807 - RNA, 18 nt, Human
cccuggggcuggcuuuuc

SEQ ID NO: 3385808 - RNA, 15 nt, Human
cccuggggcuucucc

SEQ ID NO: 3385809 - RNA, 17 nt, Human
cccugggggaagcccug

SEQ ID NO: 3385810 - RNA, 18 nt, Human
cccugggggaagcccugg

SEQ ID NO: 3385811 - RNA, 23 nt, Human
cccuggguagcgggggaggguag

SEQ ID NO: 3385812 - RNA, 22 nt, Human
cccugggugggugguggggagg

SEQ ID NO: 3385813 - RNA, 23 nt, Human
cccugggugggugguggggaggg

SEQ ID NO: 3385814 - RNA, 16 nt, Human
cccuggguuagacugc

SEQ ID NO: 3385815 - RNA, 22 nt, Human
cccuggguuagacugccagcuc

SEQ ID NO: 3385816 - RNA, 18 nt, Human
cccugguccagggaagcu

SEQ ID NO: 3385817 - RNA, 21 nt, Human
cccugguccccuccuucccaa

SEQ ID NO: 3385818 - RNA, 14 nt, Human
cccuggucccuugu

SEQ ID NO: 3385819 - RNA, 17 nt, Human
cccuggucucagcagcg

SEQ ID NO: 3385820 - RNA, 20 nt, Human
cccuggucucagcagcgacc

SEQ ID NO: 3385821 - RNA, 15 nt, Human
cccuggucucugguc

SEQ ID NO: 3385822 - RNA, 21 nt, Human
cccuggugaccagcaccaucu

SEQ ID NO: 3385823 - RNA, 22 nt, Human
cccuggugagagggccgggcag

SEQ ID NO: 3385824 - RNA, 21 nt, Human
cccuggugaggaagcuccagu

SEQ ID NO: 3385825 - RNA, 16 nt, Human
cccuggugccuggcuc

SEQ ID NO: 3385826 - RNA, 14 nt, Human
cccuggugcugcca

SEQ ID NO: 3385827 - RNA, 15 nt, Human
cccuggugcugccac

SEQ ID NO: 3385828 - RNA, 17 nt, Human
cccugguggacaguccu

SEQ ID NO: 3385829 - RNA, 21 nt, Human
cccugguggacaguccuggga

SEQ ID NO: 3385830 - RNA, 23 nt, Human
cccugguggacaguccugggaga

SEQ ID NO: 3385831 - RNA, 14 nt, Human
cccugguggcagcu

SEQ ID NO: 3385832 - RNA, 16 nt, Human
cccugguggcagcuca

SEQ ID NO: 3385833 - RNA, 17 nt, Human
cccugguggcagcucac

SEQ ID NO: 3385834 - RNA, 15 nt, Human
cccugguggcagugg

SEQ ID NO: 3385835 - RNA, 22 nt, Human
cccugguggcccucuccccugc

SEQ ID NO: 3385836 - RNA, 16 nt, Human
cccuggugggccaaca

SEQ ID NO: 3385837 - RNA, 18 nt, Human
cccugguuauauucucac

SEQ ID NO: 3385838 - RNA, 22 nt, Human
cccugguuauugauguggcccu

SEQ ID NO: 3385839 - RNA, 16 nt, Human
cccugguucucaucuu

SEQ ID NO: 3385840 - RNA, 17 nt, Human
cccugguucucaucuuu

SEQ ID NO: 3385841 - RNA, 22 nt, Human
cccugguucugaugaugugccu

SEQ ID NO: 3385842 - RNA, 15 nt, Human
cccugguuucacugg

SEQ ID NO: 3385843 - RNA, 23 nt, Human
cccugguuuccugcccugggagg

SEQ ID NO: 3385844 - RNA, 22 nt, Human
cccuguaccucaucccaugaga

SEQ ID NO: 3385845 - RNA, 15 nt, Human
cccuguaggccucag

SEQ ID NO: 3385846 - RNA, 23 nt, Human
cccuguauucccaccccuggacu

SEQ ID NO: 3385847 - RNA, 15 nt, Human
cccugucaaacauua

SEQ ID NO: 3385848 - RNA, 14 nt, Human
cccugucaccaagc

SEQ ID NO: 3385849 - RNA, 19 nt, Human
cccugucaccaagcucaca

SEQ ID NO: 3385850 - RNA, 21 nt, Human
cccugucagugcagcccgugu

SEQ ID NO: 3385851 - RNA, 21 nt, Human
cccuguccaaacugccuaagc

SEQ ID NO: 3385852 - RNA, 14 nt, Human
cccugucccaugca

SEQ ID NO: 3385853 - RNA, 19 nt, Human
cccugucccaugcaggccc

SEQ ID NO: 3385854 - RNA, 13 nt, Human
cccugucccccag

SEQ ID NO: 3385855 - RNA, 15 nt, Human
cccugucccccagcu

SEQ ID NO: 3385856 - RNA, 17 nt, Human
cccugucccccagcucu

SEQ ID NO: 3385857 - RNA, 10 nt, Human
cccugucccu

SEQ ID NO: 3385858 - RNA, 12 nt, Human
cccugucccucc

SEQ ID NO: 3385859 - RNA, 13 nt, Human
cccugucccucua

SEQ ID NO: 3385860 - RNA, 14 nt, Human
cccuguccuccucg

SEQ ID NO: 3385861 - RNA, 20 nt, Human
cccuguccucucuggcuggg

SEQ ID NO: 3385862 - RNA, 23 nt, Human
cccuguccugauggucagcuccc

SEQ ID NO: 3385863 - RNA, 13 nt, Human
cccuguccugcca

SEQ ID NO: 3385864 - RNA, 13 nt, Human
cccuguccuggug

SEQ ID NO: 3385865 - RNA, 17 nt, Human
cccuguccuuagccuag

SEQ ID NO: 3385866 - RNA, 16 nt, Human
cccugucgagacacuu

SEQ ID NO: 3385867 - RNA, 20 nt, Human
cccugucgagacacuugccu

SEQ ID NO: 3385868 - RNA, 16 nt, Human
cccugucuaaugaaac

SEQ ID NO: 3385869 - RNA, 20 nt, Human
cccugucuagagagggaggc

SEQ ID NO: 3385870 - RNA, 20 nt, Human
cccugucucaaaaaaagaaa

SEQ ID NO: 3385871 - RNA, 14 nt, Human
cccugucucuacua

SEQ ID NO: 3385872 - RNA, 21 nt, Human
cccugucuguagagggcccug

SEQ ID NO: 3385873 - RNA, 16 nt, Human
cccugucuugcuguca

SEQ ID NO: 3385874 - RNA, 14 nt, Human
cccugucuuuccua

SEQ ID NO: 3385875 - RNA, 14 nt, Human
cccugugacaaaau

SEQ ID NO: 3385876 - RNA, 17 nt, Human
cccugugacauggugcc

SEQ ID NO: 3385877 - RNA, 21 nt, Human
cccugugaguacuacaguccu

SEQ ID NO: 3385878 - RNA, 18 nt, Human
cccugugauggggcccug

SEQ ID NO: 3385879 - RNA, 21 nt, Human
cccugugauggggcccugccu

SEQ ID NO: 3385880 - RNA, 21 nt, Human
cccugugcagaagggagcugg

SEQ ID NO: 3385881 - RNA, 13 nt, Human
cccugugccccca

SEQ ID NO: 3385882 - RNA, 20 nt, Human
cccugugccuaacaccagcg

SEQ ID NO: 3385883 - RNA, 22 nt, Human
cccugugccuugucacgccaga

SEQ ID NO: 3385884 - RNA, 20 nt, Human
cccugugcuccgugccucca

SEQ ID NO: 3385885 - RNA, 23 nt, Human
cccugugcugguguccugaccac

SEQ ID NO: 3385886 - RNA, 14 nt, Human
cccuguggaaggga

SEQ ID NO: 3385887 - RNA, 16 nt, Human
cccuguggagacuggg

SEQ ID NO: 3385888 - RNA, 17 nt, Human
cccuguggagcccgcac

SEQ ID NO: 3385889 - RNA, 15 nt, Human
cccuguggcccuggc

SEQ ID NO: 3385890 - RNA, 16 nt, Human
cccugugggaccccag

SEQ ID NO: 3385891 - RNA, 17 nt, Human
cccugugggaccccagg

SEQ ID NO: 3385892 - RNA, 19 nt, Human
cccugugggaccccaggcc

SEQ ID NO: 3385893 - RNA, 15 nt, Human
cccugugggccccca

SEQ ID NO: 3385894 - RNA, 18 nt, Human
cccugugggcccccaaau

SEQ ID NO: 3385895 - RNA, 16 nt, Human
cccugugucauuucaa

SEQ ID NO: 3385896 - RNA, 21 nt, Human
cccuguguccaccugugggug

SEQ ID NO: 3385897 - RNA, 15 nt, Human
cccuguguugucucu

SEQ ID NO: 3385898 - RNA, 21 nt, Human
cccuguguugucucuagagca

SEQ ID NO: 3385899 - RNA, 20 nt, Human
aaauguaccuucagaauaag

SEQ ID NO: 3385900 - RNA, 17 nt, Human
aaauguaccuucuuuca

SEQ ID NO: 3385901 - RNA, 15 nt, Human
aaauguacugagauu

SEQ ID NO: 3385902 - RNA, 16 nt, Human
aaauguagaauauuca

SEQ ID NO: 3385903 - RNA, 20 nt, Human
aaauguagaauauucagaca

SEQ ID NO: 3385904 - RNA, 19 nt, Human
aaauguagcuucagucauu

SEQ ID NO: 3385905 - RNA, 22 nt, Human
aaauguagcuucagucauuaaa

SEQ ID NO: 3385906 - RNA, 15 nt, Human
aaauguauaaauaua

SEQ ID NO: 3385907 - RNA, 17 nt, Human
aaauguauaaauauaca

SEQ ID NO: 3385908 - RNA, 19 nt, Human
aaauguauaaauauacagu

SEQ ID NO: 3385909 - RNA, 18 nt, Human
aaauguauaccuguaacu

SEQ ID NO: 3385910 - RNA, 15 nt, Human
aaauguauauacaca

SEQ ID NO: 3385911 - RNA, 18 nt, Human
aaauguauauacacauau

SEQ ID NO: 3385912 - RNA, 13 nt, Human
aaauguauauauu

SEQ ID NO: 3385913 - RNA, 16 nt, Human
aaauguauauauuuag

SEQ ID NO: 3385914 - RNA, 17 nt, Human
aaauguauauauuuagu

SEQ ID NO: 3385915 - RNA, 18 nt, Human
aaauguauauauuuagug

SEQ ID NO: 3385916 - RNA, 20 nt, Human
aaauguaucuaagaauaaua

SEQ ID NO: 3385917 - RNA, 13 nt, Human
aaauguaugcaug

SEQ ID NO: 3385918 - RNA, 20 nt, Human
aaauguaugcauguugucua

SEQ ID NO: 3385919 - RNA, 13 nt, Human
aaaugucacuuuu

SEQ ID NO: 3385920 - RNA, 15 nt, Human
aaaugucacuuuuug

SEQ ID NO: 3385921 - RNA, 15 nt, Human
aaauguccuugugau

SEQ ID NO: 3385922 - RNA, 24 nt, Human
aaaugucuaguuguaacaccauga

SEQ ID NO: 3385923 - RNA, 17 nt, Human
aaaugucucacugagca

SEQ ID NO: 3385924 - RNA, 20 nt, Human
aaaugucuguaaauauguuu

SEQ ID NO: 3385925 - RNA, 15 nt, Human
aaaugucuuaauuuu

SEQ ID NO: 3385926 - RNA, 18 nt, Human
aaaugucuuaauuuuuga

SEQ ID NO: 3385927 - RNA, 18 nt, Human
aaaugucuuauauagcag

SEQ ID NO: 3385928 - RNA, 14 nt, Human
aaaugucuuccugg

SEQ ID NO: 3385929 - RNA, 12 nt, Human
aaaugucuugcu

SEQ ID NO: 3385930 - RNA, 12 nt, Human
aaaugucuugug

SEQ ID NO: 3385931 - RNA, 14 nt, Human
aaaugucuuuaaug

SEQ ID NO: 3385932 - RNA, 19 nt, Human
aaaugucuuuaaugcaaua

SEQ ID NO: 3385933 - RNA, 21 nt, Human
aaaugucuuuccaaauuauuu

SEQ ID NO: 3385934 - RNA, 22 nt, Human
aaaugucuuuccuuuugcucuu

SEQ ID NO: 3385935 - RNA, 14 nt, Human
aaaugucuuuguaa

SEQ ID NO: 3385936 - RNA, 15 nt, Human
aaaugucuuuguaag

SEQ ID NO: 3385937 - RNA, 16 nt, Human
aaaugucuuuguaagu

SEQ ID NO: 3385938 - RNA, 21 nt, Human
aaaugucuuuguaagucagug

SEQ ID NO: 3385939 - RNA, 15 nt, Human
aaaugugaagaugca

SEQ ID NO: 3385940 - RNA, 22 nt, Human
aaaugugaauuacuaacuucua

SEQ ID NO: 3385941 - RNA, 20 nt, Human
aaaugugaauuuuuauuguu

SEQ ID NO: 3385942 - RNA, 21 nt, Human
aaaugugaauuuuuauuguug

SEQ ID NO: 3385943 - RNA, 21 nt, Human
aaaugugaugaauacuguauu

SEQ ID NO: 3385944 - RNA, 15 nt, Human
aaaugugauguucua

SEQ ID NO: 3385945 - RNA, 19 nt, Human
aaaugugauguucuaaggc

SEQ ID NO: 3385946 - RNA, 22 nt, Human
aaaugugauguucuaaggcucu

SEQ ID NO: 3385947 - RNA, 17 nt, Human
aaaugugauuuuucuga

SEQ ID NO: 3385948 - RNA, 17 nt, Human
aaaugugcaaaacagcg

SEQ ID NO: 3385949 - RNA, 11 nt, Human
aaaugugcagu

SEQ ID NO: 3385950 - RNA, 22 nt, Human
aaaugugccuauugcuagagcu

SEQ ID NO: 3385951 - RNA, 16 nt, Human
aaaugugcuuugagaa

SEQ ID NO: 3385952 - RNA, 19 nt, Human
aaaugugggauuauggguc

SEQ ID NO: 3385953 - RNA, 22 nt, Human
aaaugugguuuuccugaaauca

SEQ ID NO: 3385954 - RNA, 14 nt, Human
aaauguguguaugu

SEQ ID NO: 3385955 - RNA, 18 nt, Human
aaaugugugugaugugac

SEQ ID NO: 3385956 - RNA, 12 nt, Human
aaauguguuguu

SEQ ID NO: 3385957 - RNA, 19 nt, Human
cugcagcagcgguggccuc

SEQ ID NO: 3385958 - RNA, 13 nt, Human
cugcagcaggagu

SEQ ID NO: 3385959 - RNA, 21 nt, Human
cugcagcaggaguggugcaga

SEQ ID NO: 3385960 - RNA, 17 nt, Human
cugcagcaugaccugug

SEQ ID NO: 3385961 - RNA, 21 nt, Human
cugcagcauguugcugaggag

SEQ ID NO: 3385962 - RNA, 14 nt, Human
cugcagccagccca

SEQ ID NO: 3385963 - RNA, 15 nt, Human
cugcagccagcccag

SEQ ID NO: 3385964 - RNA, 16 nt, Human
cugcagccagcccagc

SEQ ID NO: 3385965 - RNA, 18 nt, Human
cugcagccagcccagccc

SEQ ID NO: 3385966 - RNA, 22 nt, Human
cugcagccagcccagcccagcu

SEQ ID NO: 3385967 - RNA, 22 nt, Human
cugcagccagcucacguccagg

SEQ ID NO: 3385968 - RNA, 22 nt, Human
cugcagccaggccacuggcccc

SEQ ID NO: 3385969 - RNA, 23 nt, Human
cugcagccaggccacuggccccu

SEQ ID NO: 3385970 - RNA, 12 nt, Human
cugcagcccagg

SEQ ID NO: 3385971 - RNA, 21 nt, Human
cugcagccccacccagaugcc

SEQ ID NO: 3385972 - RNA, 24 nt, Human
cugcagcccggcgccaccauccug

SEQ ID NO: 3385973 - RNA, 13 nt, Human
cugcagcccuggc

SEQ ID NO: 3385974 - RNA, 19 nt, Human
cugcagccucaaccuccug

SEQ ID NO: 3385975 - RNA, 22 nt, Human
cugcagccucaaccuccugggc

SEQ ID NO: 3385976 - RNA, 23 nt, Human
cugcagccucaaccuccugggcu

SEQ ID NO: 3385977 - RNA, 12 nt, Human
cugcagccucag

SEQ ID NO: 3385978 - RNA, 13 nt, Human
cugcagccucagg

SEQ ID NO: 3385979 - RNA, 19 nt, Human
cugcagccucaggacuggg

SEQ ID NO: 3385980 - RNA, 22 nt, Human
cugcagccucaggacugggagc

SEQ ID NO: 3385981 - RNA, 13 nt, Human
cugcagccuccuc

SEQ ID NO: 3385982 - RNA, 21 nt, Human
cugcagccucgaacuccuggg

SEQ ID NO: 3385983 - RNA, 22 nt, Human
cugcagccucgaacuccugggc

SEQ ID NO: 3385984 - RNA, 14 nt, Human
cugcagccugcagg

SEQ ID NO: 3385985 - RNA, 14 nt, Human
cugcagccuggagc

SEQ ID NO: 3385986 - RNA, 22 nt, Human
cugcagccuugaacucugggcu

SEQ ID NO: 3385987 - RNA, 20 nt, Human
cugcagccuuugccuccccg

SEQ ID NO: 3385988 - RNA, 15 nt, Human
cugcagcuaguccua

SEQ ID NO: 3385989 - RNA, 11 nt, Human
cugcagcuccc

SEQ ID NO: 3385990 - RNA, 18 nt, Human
cugcagcucccuggcuuc

SEQ ID NO: 3385991 - RNA, 19 nt, Human
cugcagcucccuggcuucu

SEQ ID NO: 3385992 - RNA, 23 nt, Human
cugcagcucccuggcuucugugg

SEQ ID NO: 3385993 - RNA, 22 nt, Human
cugcagcugccgggccugauuu

SEQ ID NO: 3385994 - RNA, 16 nt, Human
cugcagcuggacagag

SEQ ID NO: 3385995 - RNA, 17 nt, Human
cugcagcuguuuuaguu

SEQ ID NO: 3385996 - RNA, 19 nt, Human
cugcagcuuccugucaaca

SEQ ID NO: 3385997 - RNA, 22 nt, Human
cugcagcuugggagagccccug

SEQ ID NO: 3385998 - RNA, 16 nt, Human
cugcagcuuguagcca

SEQ ID NO: 3385999 - RNA, 12 nt, Human
cugcagcuuuac

SEQ ID NO: 3386000 - RNA, 12 nt, Human
cugcagcuuugu

SEQ ID NO: 3386001 - RNA, 18 nt, Human
cugcaggaaauagucacu

SEQ ID NO: 3386002 - RNA, 14 nt, Human
cugcaggaaggagc

SEQ ID NO: 3386003 - RNA, 17 nt, Human
cugcaggaccugccugu

SEQ ID NO: 3386004 - RNA, 18 nt, Human
cugcaggaccugccugua

SEQ ID NO: 3386005 - RNA, 20 nt, Human
cugcaggaucucaccaggca

SEQ ID NO: 3386006 - RNA, 20 nt, Human
cugcaggcaccuuaguggcu

SEQ ID NO: 3386007 - RNA, 12 nt, Human
cugcaggcagac

SEQ ID NO: 3386008 - RNA, 16 nt, Human
cugcaggcagccaggc

SEQ ID NO: 3386009 - RNA, 18 nt, Human
cugcaggcagccaggcca

SEQ ID NO: 3386010 - RNA, 11 nt, Human
cugcaggcagg

SEQ ID NO: 3386011 - RNA, 15 nt, Human
cugcaggcaggaaca

SEQ ID NO: 3386012 - RNA, 12 nt, Human
cugcaggcaggg

SEQ ID NO: 3386013 - RNA, 23 nt, Human
cugcaggccccgcuuguccagcg

SEQ ID NO: 3386014 - RNA, 15 nt, Human
cugcaggcccuggcc

SEQ ID NO: 3386015 - RNA, 17 nt, Human
cugcaggcccuggccuc

SEQ ID NO: 3386016 - RNA, 18 nt, Human
cugcaggcccuggccucc

SEQ ID NO: 3386017 - RNA, 21 nt, Human
cugcaggcccuggccuccccu

SEQ ID NO: 3386018 - RNA, 15 nt, Human
cugcaggcuuugcca

SEQ ID NO: 3386019 - RNA, 15 nt, Human
cugcagggacacggg

SEQ ID NO: 3386020 - RNA, 20 nt, Human
cugcagggacacgggcagcc

SEQ ID NO: 3386021 - RNA, 16 nt, Human
cugcagggccaagcac

SEQ ID NO: 3386022 - RNA, 20 nt, Human
cugcagggccauggcucagg

SEQ ID NO: 3386023 - RNA, 23 nt, Human
cugcagggccauggcucagggug

SEQ ID NO: 3386024 - RNA, 18 nt, Human
cugcagggccgccaggga

SEQ ID NO: 3386025 - RNA, 18 nt, Human
cugcagggcuuuaaaauu

SEQ ID NO: 3386026 - RNA, 12 nt, Human
cugcaggggcuc

SEQ ID NO: 3386027 - RNA, 15 nt, Human
cugcaggggcucugg

SEQ ID NO: 3386028 - RNA, 18 nt, Human
cugcaggggcucuggaga

SEQ ID NO: 3386029 - RNA, 21 nt, Human
cugcaggggcucuggagagaa

SEQ ID NO: 3386030 - RNA, 23 nt, Human
cugcagggggugugucugcucag

SEQ ID NO: 3386031 - RNA, 16 nt, Human
cugcaggguggugcug

SEQ ID NO: 3386032 - RNA, 22 nt, Human
cugcaggguggugcugggacug

SEQ ID NO: 3386033 - RNA, 23 nt, Human
cugcaggguggugcugggacuga

SEQ ID NO: 3386034 - RNA, 14 nt, Human
cugcaggucccuaa

SEQ ID NO: 3386035 - RNA, 15 nt, Human
cugcaggucccuaau

SEQ ID NO: 3386036 - RNA, 23 nt, Human
cugcaggucccuaauaaagcugu

SEQ ID NO: 3386037 - RNA, 20 nt, Human
cugcagguucuucuuccuga

SEQ ID NO: 3386038 - RNA, 17 nt, Human
cugcagguugaagccau

SEQ ID NO: 3386039 - RNA, 19 nt, Human
cugcagguugaagccaugu

SEQ ID NO: 3386040 - RNA, 21 nt, Human
cugcagguugaagccaugucu

SEQ ID NO: 3386041 - RNA, 17 nt, Human
cugcagguuggacccca

SEQ ID NO: 3386042 - RNA, 21 nt, Human
cugcagguuggaccccagaga

SEQ ID NO: 3386043 - RNA, 16 nt, Human
cugauaaagcacagcu

SEQ ID NO: 3386044 - RNA, 19 nt, Human
cugauaacuagauggugcu

SEQ ID NO: 3386045 - RNA, 20 nt, Human
cugauaacuagauggugcug

SEQ ID NO: 3386046 - RNA, 24 nt, Human
cugauaacuagauggugcugagaa

SEQ ID NO: 3386047 - RNA, 14 nt, Human
cugauaauaauuga

SEQ ID NO: 3386048 - RNA, 18 nt, Human
cugauacauaacuaaauu

SEQ ID NO: 3386049 - RNA, 15 nt, Human
cugauacccagagca

SEQ ID NO: 3386050 - RNA, 22 nt, Human
cugauagcauaugacaaauguu

SEQ ID NO: 3386051 - RNA, 17 nt, Human
cugauagccccucuccc

SEQ ID NO: 3386052 - RNA, 21 nt, Human
cugauauauguguuuuucaca

SEQ ID NO: 3386053 - RNA, 18 nt, Human
cugauaugauuuaaaaca

SEQ ID NO: 3386054 - RNA, 19 nt, Human
cugauaugauuuaaaacau

SEQ ID NO: 3386055 - RNA, 23 nt, Human
cugauauuaauuuaucagauugc

SEQ ID NO: 3386056 - RNA, 17 nt, Human
cugauauucagaauuau

SEQ ID NO: 3386057 - RNA, 20 nt, Human
cugauauucagaauuaugau

SEQ ID NO: 3386058 - RNA, 23 nt, Human
cugauauuuuaccucuuauugca

SEQ ID NO: 3386059 - RNA, 17 nt, Human
cugaucaaugacagagc

SEQ ID NO: 3386060 - RNA, 15 nt, Human
cugaucaccugcccu

SEQ ID NO: 3386061 - RNA, 16 nt, Human
cugaucagaacaaaug

SEQ ID NO: 3386062 - RNA, 17 nt, Human
cugaucagaccacggcu

SEQ ID NO: 3386063 - RNA, 19 nt, Human
cugaucaucgccagaggug

SEQ ID NO: 3386064 - RNA, 17 nt, Human
cugaucaugcauuguug

SEQ ID NO: 3386065 - RNA, 13 nt, Human
cugauccagagca

SEQ ID NO: 3386066 - RNA, 18 nt, Human
cugauccagccucucccc

SEQ ID NO: 3386067 - RNA, 12 nt, Human
cugaucccacuc

SEQ ID NO: 3386068 - RNA, 20 nt, Human
cugaucccagagagcccgag

SEQ ID NO: 3386069 - RNA, 21 nt, Human
cugaucccagagagcccgagg

SEQ ID NO: 3386070 - RNA, 21 nt, Human
cugauccuaacugaagagaca

SEQ ID NO: 3386071 - RNA, 17 nt, Human
cugauccuggaggccca

SEQ ID NO: 3386072 - RNA, 15 nt, Human
cugaucgccuucccc

SEQ ID NO: 3386073 - RNA, 19 nt, Human
cugaucgugcuaaauuuuc

SEQ ID NO: 3386074 - RNA, 13 nt, Human
cugaucucaggga

SEQ ID NO: 3386075 - RNA, 22 nt, Human
cugaucucagggaagcccagcu

SEQ ID NO: 3386076 - RNA, 20 nt, Human
cugaucuccauggcuuccuc

SEQ ID NO: 3386077 - RNA, 22 nt, Human
cugaucuccauggcuuccuccu

SEQ ID NO: 3386078 - RNA, 13 nt, Human
cugaucucuuccu

SEQ ID NO: 3386079 - RNA, 21 nt, Human
cugaucucuuccuguuuugua

SEQ ID NO: 3386080 - RNA, 20 nt, Human
cugaucugaugcaagcaaga

SEQ ID NO: 3386081 - RNA, 19 nt, Human
cugaucugcggaucucagc

SEQ ID NO: 3386082 - RNA, 13 nt, Human
cugaucugguuug

SEQ ID NO: 3386083 - RNA, 18 nt, Human
cugaucugugcuuuccag

SEQ ID NO: 3386084 - RNA, 23 nt, Human
cugaucugugcuuuccagcucac

SEQ ID NO: 3386085 - RNA, 18 nt, Human
cugaucuuaagaggcuga

SEQ ID NO: 3386086 - RNA, 14 nt, Human
cugaugaaaauaaa

SEQ ID NO: 3386087 - RNA, 16 nt, Human
cugaugaaaauaaaga

SEQ ID NO: 3386088 - RNA, 17 nt, Human
cugaugaaaauaaagaa

SEQ ID NO: 3386089 - RNA, 14 nt, Human
cugaugaaucacug

SEQ ID NO: 3386090 - RNA, 18 nt, Human
cugaugaaucacuguuuu

SEQ ID NO: 3386091 - RNA, 16 nt, Human
cugaugacaauaaagc

SEQ ID NO: 3386092 - RNA, 15 nt, Human
cugaugacagagcga

SEQ ID NO: 3386093 - RNA, 16 nt, Human
cugaugacagagcgag

SEQ ID NO: 3386094 - RNA, 14 nt, Human
cugaugacccaggc

SEQ ID NO: 3386095 - RNA, 21 nt, Human
cugaugacccccccagcuuca

SEQ ID NO: 3386096 - RNA, 19 nt, Human
cugaugaccuaaccuaagc

SEQ ID NO: 3386097 - RNA, 14 nt, Human
cugaugacucaaga

SEQ ID NO: 3386098 - RNA, 17 nt, Human
cugaugagaauacugag

SEQ ID NO: 3386099 - RNA, 23 nt, Human
cugaugagaauuuauaaauuauu

SEQ ID NO: 3386100 - RNA, 17 nt, Human
cugaugagauuuuuaaa

SEQ ID NO: 3386101 - RNA, 21 nt, Human
cugaugcaucagaaagggagg

SEQ ID NO: 3386102 - RNA, 23 nt, Human
cugaugcaucagaaagggagggc

SEQ ID NO: 3386103 - RNA, 19 nt, Human
cugaugccaaguuguuuga

SEQ ID NO: 3386104 - RNA, 18 nt, Human
cugaugccaauacuaguc

SEQ ID NO: 3386105 - RNA, 19 nt, Human
cugaugcucccuccccugc

SEQ ID NO: 3386106 - RNA, 21 nt, Human
cugaugcucccuccccugccc

SEQ ID NO: 3386107 - RNA, 22 nt, Human
cugaugcucccuccccugcccu

SEQ ID NO: 3386108 - RNA, 23 nt, Human
cugaugcucccuccccugcccug

SEQ ID NO: 3386109 - RNA, 16 nt, Human
cugaugcugagauucu

SEQ ID NO: 3386110 - RNA, 16 nt, Human
cugaugcugggcuggg

SEQ ID NO: 3386111 - RNA, 15 nt, Human
cccuucaucuccagg

SEQ ID NO: 3386112 - RNA, 21 nt, Human
cccuucauugauuuccugugu

SEQ ID NO: 3386113 - RNA, 17 nt, Human
cccuuccaccugcucug

SEQ ID NO: 3386114 - RNA, 20 nt, Human
cccuuccagaucacugccac

SEQ ID NO: 3386115 - RNA, 16 nt, Human
cccuucccacuggagg

SEQ ID NO: 3386116 - RNA, 21 nt, Human
cccuucccaugacccaggcug

SEQ ID NO: 3386117 - RNA, 11 nt, Human
cccuuccccau

SEQ ID NO: 3386118 - RNA, 15 nt, Human
cccuuccccauggga

SEQ ID NO: 3386119 - RNA, 16 nt, Human
cccuucccccagccca

SEQ ID NO: 3386120 - RNA, 21 nt, Human
cccuucccccagcccauccau

SEQ ID NO: 3386121 - RNA, 21 nt, Human
cccuuccccuacccccuccuc

SEQ ID NO: 3386122 - RNA, 13 nt, Human
cccuuccccuccu

SEQ ID NO: 3386123 - RNA, 12 nt, Human
cccuucccuccu

SEQ ID NO: 3386124 - RNA, 14 nt, Human
cccuucccuguccc

SEQ ID NO: 3386125 - RNA, 16 nt, Human
cccuucccugucccuc

SEQ ID NO: 3386126 - RNA, 14 nt, Human
cccuucccuuccac

SEQ ID NO: 3386127 - RNA, 17 nt, Human
cccuucccuuccacugc

SEQ ID NO: 3386128 - RNA, 14 nt, Human
cccuuccgacccuc

SEQ ID NO: 3386129 - RNA, 17 nt, Human
cccuuccgacccucugg

SEQ ID NO: 3386130 - RNA, 21 nt, Human
cccuuccgacccucugggaac

SEQ ID NO: 3386131 - RNA, 23 nt, Human
cccuuccgcaguguggccaggcu

SEQ ID NO: 3386132 - RNA, 15 nt, Human
cccuuccgccacugg

SEQ ID NO: 3386133 - RNA, 13 nt, Human
cccuuccuaauuc

SEQ ID NO: 3386134 - RNA, 20 nt, Human
cccuuccuacagauagucaa

SEQ ID NO: 3386135 - RNA, 15 nt, Human
cccuuccuccauccu

SEQ ID NO: 3386136 - RNA, 19 nt, Human
cccuuccuccuccaccacc

SEQ ID NO: 3386137 - RNA, 10 nt, Human
cccuuccucu

SEQ ID NO: 3386138 - RNA, 17 nt, Human
cccuuccucuccacugc

SEQ ID NO: 3386139 - RNA, 14 nt, Human
cccuuccucugcuc

SEQ ID NO: 3386140 - RNA, 15 nt, Human
cccuuccucuuucca

SEQ ID NO: 3386141 - RNA, 14 nt, Human
cccuuccuggacag

SEQ ID NO: 3386142 - RNA, 19 nt, Human
cccuuccuggacagcugug

SEQ ID NO: 3386143 - RNA, 20 nt, Human
cccuuccuggacagcugugc

SEQ ID NO: 3386144 - RNA, 22 nt, Human
cccuuccugggcacacgcugcu

SEQ ID NO: 3386145 - RNA, 14 nt, Human
cccuucuacacucu

SEQ ID NO: 3386146 - RNA, 15 nt, Human
cccuucuacacucuc

SEQ ID NO: 3386147 - RNA, 18 nt, Human
cccuucuacacucuccug

SEQ ID NO: 3386148 - RNA, 16 nt, Human
cccuucuaccuuccug

SEQ ID NO: 3386149 - RNA, 16 nt, Human
cccuucuacugcuucu

SEQ ID NO: 3386150 - RNA, 18 nt, Human
cccuucuauacccaccca

SEQ ID NO: 3386151 - RNA, 16 nt, Human
cccuucucagaaucua

SEQ ID NO: 3386152 - RNA, 23 nt, Human
cccuucucauuccaacagugagu

SEQ ID NO: 3386153 - RNA, 18 nt, Human
cccuucuccaucucucug

SEQ ID NO: 3386154 - RNA, 21 nt, Human
cccuucuccaucucucuggcc

SEQ ID NO: 3386155 - RNA, 23 nt, Human
cccuucuccaucucucuggcccu

SEQ ID NO: 3386156 - RNA, 21 nt, Human
cccuucuccauggcccugcca

SEQ ID NO: 3386157 - RNA, 18 nt, Human
cccuucuccccugcacug

SEQ ID NO: 3386158 - RNA, 18 nt, Human
cccuucuccucuuguaaa

SEQ ID NO: 3386159 - RNA, 20 nt, Human
cccuucuccucuuguaaaua

SEQ ID NO: 3386160 - RNA, 15 nt, Human
cccuucucucaucuc

SEQ ID NO: 3386161 - RNA, 19 nt, Human
cccuucucuccagccccug

SEQ ID NO: 3386162 - RNA, 21 nt, Human
cccuucucuccagccccugga

SEQ ID NO: 3386163 - RNA, 16 nt, Human
cccuucucugcuccac

SEQ ID NO: 3386164 - RNA, 17 nt, Human
cccuucucugcuccacc

SEQ ID NO: 3386165 - RNA, 23 nt, Human
cccuucucuguagggaacucugg

SEQ ID NO: 3386166 - RNA, 13 nt, Human
cccuucucuguga

SEQ ID NO: 3386167 - RNA, 15 nt, Human
cccuucucuuccagg

SEQ ID NO: 3386168 - RNA, 19 nt, Human
cccuucucuuccaggcagc

SEQ ID NO: 3386169 - RNA, 16 nt, Human
cccuucugucccucac

SEQ ID NO: 3386170 - RNA, 15 nt, Human
cccuucugugcccag

SEQ ID NO: 3386171 - RNA, 16 nt, Human
cccuucugugcccagc

SEQ ID NO: 3386172 - RNA, 12 nt, Human
cccuucuuucca

SEQ ID NO: 3386173 - RNA, 13 nt, Human
cccuucuuuccuc

SEQ ID NO: 3386174 - RNA, 22 nt, Human
cccuugaaagucaugaacacau

SEQ ID NO: 3386175 - RNA, 12 nt, Human
cccuugaacucu

SEQ ID NO: 3386176 - RNA, 21 nt, Human
cccuugacaacuggcaggcag

SEQ ID NO: 3386177 - RNA, 18 nt, Human
cccuugacaucuggaaac

SEQ ID NO: 3386178 - RNA, 19 nt, Human
cccuugagaccucagccau

SEQ ID NO: 3386179 - RNA, 20 nt, Human
cccuugagaccucagccaug

SEQ ID NO: 3386180 - RNA, 13 nt, Human
cccuugagcccuc

SEQ ID NO: 3386181 - RNA, 18 nt, Human
cccuugaggucucagccc

SEQ ID NO: 3386182 - RNA, 15 nt, Human
cccuugaugaagaag

SEQ ID NO: 3386183 - RNA, 21 nt, Human
cccuugauuuaaacacacaga

SEQ ID NO: 3386184 - RNA, 12 nt, Human
cccuugcagccg

SEQ ID NO: 3386185 - RNA, 19 nt, Human
cccuugcaguucagcacca

SEQ ID NO: 3386186 - RNA, 13 nt, Human
cccuugccacccc

SEQ ID NO: 3386187 - RNA, 23 nt, Human
aaauguuguucauuauuggaggg

SEQ ID NO: 3386188 - RNA, 17 nt, Human
aaauguuuaaacauuuu

SEQ ID NO: 3386189 - RNA, 11 nt, Human
aaauguuuaau

SEQ ID NO: 3386190 - RNA, 14 nt, Human
aaauguuuaaucau

SEQ ID NO: 3386191 - RNA, 15 nt, Human
aaauguuuaaucaua

SEQ ID NO: 3386192 - RNA, 20 nt, Human
aaauguuuggcauguaaaug

SEQ ID NO: 3386193 - RNA, 16 nt, Human
aaauguuuuaaggcuu

SEQ ID NO: 3386194 - RNA, 18 nt, Human
aaauguuuuagcaauuua

SEQ ID NO: 3386195 - RNA, 22 nt, Human
aaauguuuugcucaauagauug

SEQ ID NO: 3386196 - RNA, 13 nt, Human
aaauguuuuguaa

SEQ ID NO: 3386197 - RNA, 20 nt, Human
aaauguuuuguaaacuuuga

SEQ ID NO: 3386198 - RNA, 21 nt, Human
aaauguuuuucugccagggag

SEQ ID NO: 3386199 - RNA, 21 nt, Human
aaauguuuuuggucuuuuaua

SEQ ID NO: 3386200 - RNA, 22 nt, Human
aaauguuuuuuuuuaaagacuu

SEQ ID NO: 3386201 - RNA, 12 nt, Human
aaauuaaaaaaa

SEQ ID NO: 3386202 - RNA, 19 nt, Human
aaauuaaaaaaaaaaaacu

SEQ ID NO: 3386203 - RNA, 21 nt, Human
aaauuaaaaaaaaaaaacuuu

SEQ ID NO: 3386204 - RNA, 15 nt, Human
aaauuaaaaaaaaau

SEQ ID NO: 3386205 - RNA, 14 nt, Human
aaauuaaaaaagau

SEQ ID NO: 3386206 - RNA, 20 nt, Human
aaauuaaaaaagauaaacac

SEQ ID NO: 3386207 - RNA, 13 nt, Human
aaauuaaaaagau

SEQ ID NO: 3386208 - RNA, 18 nt, Human
aaauuaaacauaaaacaa

SEQ ID NO: 3386209 - RNA, 13 nt, Human
aaauuaaagaaaa

SEQ ID NO: 3386210 - RNA, 23 nt, Human
aaauuaaagccuuuaguaucagu

SEQ ID NO: 3386211 - RNA, 19 nt, Human
aaauuaaauauauguaugu

SEQ ID NO: 3386212 - RNA, 20 nt, Human
aaauuaaauauauguaugua

SEQ ID NO: 3386213 - RNA, 14 nt, Human
aaauuaaaugaauu

SEQ ID NO: 3386214 - RNA, 13 nt, Human
aaauuaacacugc

SEQ ID NO: 3386215 - RNA, 18 nt, Human
aaauuaacaguccuaacu

SEQ ID NO: 3386216 - RNA, 20 nt, Human
aaauuaacuggguaaugaaa

SEQ ID NO: 3386217 - RNA, 17 nt, Human
aaauuaacuugaguuuu

SEQ ID NO: 3386218 - RNA, 15 nt, Human
aaauuaagaaggcaa

SEQ ID NO: 3386219 - RNA, 16 nt, Human
aaauuaagcaaauguu

SEQ ID NO: 3386220 - RNA, 21 nt, Human
aaauuaagguguuugaaaaua

SEQ ID NO: 3386221 - RNA, 13 nt, Human
aaauuaauaaucu

SEQ ID NO: 3386222 - RNA, 11 nt, Human
aaauuaauauc

SEQ ID NO: 3386223 - RNA, 17 nt, Human
aaauuaauaucuuucug

SEQ ID NO: 3386224 - RNA, 16 nt, Human
aaauuaaucauaguca

SEQ ID NO: 3386225 - RNA, 19 nt, Human
aaauuaauuggcagcagau

SEQ ID NO: 3386226 - RNA, 16 nt, Human
aaauuaauugugugaa

SEQ ID NO: 3386227 - RNA, 12 nt, Human
aaauuacaacua

SEQ ID NO: 3386228 - RNA, 14 nt, Human
aaauuacaauuuua

SEQ ID NO: 3386229 - RNA, 22 nt, Human
aaauuacacccaaagagguauu

SEQ ID NO: 3386230 - RNA, 13 nt, Human
aaauuacauuucg

SEQ ID NO: 3386231 - RNA, 12 nt, Human
aaauuacauuug

SEQ ID NO: 3386232 - RNA, 16 nt, Human
aaauuacauuuguaau

SEQ ID NO: 3386233 - RNA, 20 nt, Human
aaauuacauuuguaauuuaa

SEQ ID NO: 3386234 - RNA, 23 nt, Human
aaauuacauuuguaauuuaaggu

SEQ ID NO: 3386235 - RNA, 15 nt, Human
aaauuacuacaaaau

SEQ ID NO: 3386236 - RNA, 20 nt, Human
aaauuacucaggaagaacac

SEQ ID NO: 3386237 - RNA, 13 nt, Human
aaauuacuguuua

SEQ ID NO: 3386238 - RNA, 23 nt, Human
aaauuacuguuuauuaaaguaca

SEQ ID NO: 3386239 - RNA, 12 nt, Human
aaauuagaaaaa

SEQ ID NO: 3386240 - RNA, 15 nt, Human
aaauuagaaaauauu

SEQ ID NO: 3386241 - RNA, 23 nt, Human
aaauuagaaaccuuaauaugugg

SEQ ID NO: 3386242 - RNA, 20 nt, Human
aaauuagaaagcaacuuauc

SEQ ID NO: 3386243 - RNA, 19 nt, Human
aaauuagauccuaagaugu

SEQ ID NO: 3386244 - RNA, 19 nt, Human
aaauuagccuaagauauac

SEQ ID NO: 3386245 - RNA, 20 nt, Human
aaauuagccuaagauauacu

SEQ ID NO: 3386246 - RNA, 19 nt, Human
aaauuagcugugugaaaua

SEQ ID NO: 3386247 - RNA, 22 nt, Human
aaauuaggaggcucaacaauaa

SEQ ID NO: 3386248 - RNA, 23 nt, Human
aaauuaggaggcucaacaauaaa

SEQ ID NO: 3386249 - RNA, 14 nt, Human
aaauuagggcaauu

SEQ ID NO: 3386250 - RNA, 18 nt, Human
aaauuagggcucuaauuu

SEQ ID NO: 3386251 - RNA, 23 nt, Human
aaauuaggguugguuccuuucca

SEQ ID NO: 3386252 - RNA, 12 nt, Human
aaauuauaagga

SEQ ID NO: 3386253 - RNA, 18 nt, Human
aaauuauaaggacugcau

SEQ ID NO: 3386254 - RNA, 15 nt, Human
aaauuauaauguauu

SEQ ID NO: 3386255 - RNA, 17 nt, Human
aaauuauaauguauuca

SEQ ID NO: 3386256 - RNA, 19 nt, Human
aaauuauaauguauucaua

SEQ ID NO: 3386257 - RNA, 18 nt, Human
aaauuauaccuguugcuu

SEQ ID NO: 3386258 - RNA, 13 nt, Human
aaauuauagaagu

SEQ ID NO: 3386259 - RNA, 20 nt, Human
aaauuauagaugggaaugaa

SEQ ID NO: 3386260 - RNA, 18 nt, Human
aaauuauagcucuaaugu

SEQ ID NO: 3386261 - RNA, 19 nt, Human
aaauuaucaagcuaauaaa

SEQ ID NO: 3386262 - RNA, 14 nt, Human
aaauuaucuauuug

SEQ ID NO: 3386263 - RNA, 20 nt, Human
aaauuaucuauuuguauaua

SEQ ID NO: 3386264 - RNA, 13 nt, Human
aaauuaugacaau

SEQ ID NO: 3386265 - RNA, 14 nt, Human
aaauuauggaaaca

SEQ ID NO: 3386266 - RNA, 13 nt, Human
aaauuauguaaug

SEQ ID NO: 3386267 - RNA, 19 nt, Human
aaauuauguauguuuacau

SEQ ID NO: 3386268 - RNA, 17 nt, Human
aaauuaugugacauuuu

SEQ ID NO: 3386269 - RNA, 20 nt, Human
aaauuaugugacauuuuaca

SEQ ID NO: 3386270 - RNA, 19 nt, Human
aaauuauguuuuuauuaag

SEQ ID NO: 3386271 - RNA, 14 nt, Human
aaauuauuaaagga

SEQ ID NO: 3386272 - RNA, 15 nt, Human
aaauuauuaaaggaa

SEQ ID NO: 3386273 - RNA, 16 nt, Human
aaauuauuaugacacc

SEQ ID NO: 3386274 - RNA, 16 nt, Human
aaauuauucaguuaag

SEQ ID NO: 3386275 - RNA, 20 nt, Human
aaauuauucaguuaagaaaa

SEQ ID NO: 3386276 - RNA, 20 nt, Human
aaauuauucuauaauuucca

SEQ ID NO: 3386277 - RNA, 12 nt, Human
aaauuauuguuu

SEQ ID NO: 3386278 - RNA, 13 nt, Human
aaauuauuuaaac

SEQ ID NO: 3386279 - RNA, 13 nt, Human
aaauuauuucuua

SEQ ID NO: 3386280 - RNA, 20 nt, Human
aaauuauuucuuaauuauua

SEQ ID NO: 3386281 - RNA, 22 nt, Human
aaauuauuucuuaauuauuaua

SEQ ID NO: 3386282 - RNA, 13 nt, Human
aaauuauuugaaa

SEQ ID NO: 3386283 - RNA, 21 nt, Human
aaauuauuuguaagauauuug

SEQ ID NO: 3386284 - RNA, 13 nt, Human
aaauuauuugugu

SEQ ID NO: 3386285 - RNA, 23 nt, Human
aaauuauuuguguaauagaaaac

SEQ ID NO: 3386286 - RNA, 15 nt, Human
aaauuauuuuaaauu

SEQ ID NO: 3386287 - RNA, 20 nt, Human
aaauuauuuuguucauacau

SEQ ID NO: 3386288 - RNA, 14 nt, Human
aaauucaaaaagug

SEQ ID NO: 3386289 - RNA, 21 nt, Human
aaauucaaagcauggacauuu

SEQ ID NO: 3386290 - RNA, 16 nt, Human
aaauucaacaaacauu

SEQ ID NO: 3386291 - RNA, 15 nt, Human
aaauucaacuuugua

SEQ ID NO: 3386292 - RNA, 14 nt, Human
aaauucaauaguaa

SEQ ID NO: 3386293 - RNA, 17 nt, Human
aaauucaauaguaauau

SEQ ID NO: 3386294 - RNA, 20 nt, Human
aaauucaauuguaaauugaa

SEQ ID NO: 3386295 - RNA, 16 nt, Human
aaauucacaagcugcc

SEQ ID NO: 3386296 - RNA, 18 nt, Human
aaauucacaaguuguguu

SEQ ID NO: 3386297 - RNA, 16 nt, Human
aaauucacuauuggcu

SEQ ID NO: 3386298 - RNA, 18 nt, Human
aaauucacuauuggcugg

SEQ ID NO: 3386299 - RNA, 21 nt, Human
aaauucauggcaugcuuaaau

SEQ ID NO: 3386300 - RNA, 16 nt, Human
aaauucauuucacauu

SEQ ID NO: 3386301 - RNA, 12 nt, Human
aaauuccaaagu

SEQ ID NO: 3386302 - RNA, 21 nt, Human
aaauuccaaagucucuaauuc

SEQ ID NO: 3386303 - RNA, 17 nt, Human
aaauuccaagugauuga

SEQ ID NO: 3386304 - RNA, 21 nt, Human
aaauuccagaaaggauauuua

SEQ ID NO: 3386305 - RNA, 13 nt, Human
aaauuccagaaug

SEQ ID NO: 3386306 - RNA, 19 nt, Human
aaauucccaaccugcucau

SEQ ID NO: 3386307 - RNA, 17 nt, Human
aaauucccguuuuguca

SEQ ID NO: 3386308 - RNA, 14 nt, Human
aaauucccuaaagc

SEQ ID NO: 3386309 - RNA, 21 nt, Human
cugcccggugggggggcagag

SEQ ID NO: 3386310 - RNA, 18 nt, Human
cugcccguaaacacgccu

SEQ ID NO: 3386311 - RNA, 21 nt, Human
cugcccgucucucucccaugg

SEQ ID NO: 3386312 - RNA, 17 nt, Human
cugcccgucuucagccu

SEQ ID NO: 3386313 - RNA, 14 nt, Human
cugcccguguacau

SEQ ID NO: 3386314 - RNA, 20 nt, Human
cugcccuaaugcgcaggcug

SEQ ID NO: 3386315 - RNA, 21 nt, Human
cugcccuaaugcgcaggcugg

SEQ ID NO: 3386316 - RNA, 17 nt, Human
cugcccuaccugcccca

SEQ ID NO: 3386317 - RNA, 19 nt, Human
cugcccuagagcacacugu

SEQ ID NO: 3386318 - RNA, 21 nt, Human
cugcccuagagcacacuguag

SEQ ID NO: 3386319 - RNA, 15 nt, Human
cugcccuagcuccac

SEQ ID NO: 3386320 - RNA, 22 nt, Human
cugcccuagcuccacacccucu

SEQ ID NO: 3386321 - RNA, 23 nt, Human
cugcccuaguuuucuuuccuccu

SEQ ID NO: 3386322 - RNA, 12 nt, Human
cugcccucaggg

SEQ ID NO: 3386323 - RNA, 19 nt, Human
cugcccucauggccccucu

SEQ ID NO: 3386324 - RNA, 12 nt, Human
cugcccuccaag

SEQ ID NO: 3386325 - RNA, 21 nt, Human
cugcccuccccagagcacugg

SEQ ID NO: 3386326 - RNA, 20 nt, Human
cugcccuccccucucugcac

SEQ ID NO: 3386327 - RNA, 17 nt, Human
cugcccucccuccuucc

SEQ ID NO: 3386328 - RNA, 16 nt, Human
cugcccucccuggagc

SEQ ID NO: 3386329 - RNA, 23 nt, Human
cugcccuccugugcucagcccug

SEQ ID NO: 3386330 - RNA, 18 nt, Human
cugcccuccuuguccacc

SEQ ID NO: 3386331 - RNA, 20 nt, Human
cugcccuccuuguccaccca

SEQ ID NO: 3386332 - RNA, 16 nt, Human
cugccucucuuguaau

SEQ ID NO: 3386333 - RNA, 15 nt, Human
cugccucugacacac

SEQ ID NO: 3386334 - RNA, 17 nt, Human
cugccucugacacacag

SEQ ID NO: 3386335 - RNA, 22 nt, Human
cugccucugacacacagcucug

SEQ ID NO: 3386336 - RNA, 15 nt, Human
cugccucugagggaa

SEQ ID NO: 3386337 - RNA, 13 nt, Human
cugccucugccac

SEQ ID NO: 3386338 - RNA, 16 nt, Human
cugccucugccacacu

SEQ ID NO: 3386339 - RNA, 21 nt, Human
cugccucugccacacucugac

SEQ ID NO: 3386340 - RNA, 12 nt, Human
cugccucugccu

SEQ ID NO: 3386341 - RNA, 14 nt, Human
cugccucugccuua

SEQ ID NO: 3386342 - RNA, 14 nt, Human
cugccucuucucua

SEQ ID NO: 3386343 - RNA, 15 nt, Human
cugccucuucucuac

SEQ ID NO: 3386344 - RNA, 16 nt, Human
cugccucuucugggag

SEQ ID NO: 3386345 - RNA, 18 nt, Human
cugccucuuucccuagga

SEQ ID NO: 3386346 - RNA, 19 nt, Human
cugccugaagucacacagu

SEQ ID NO: 3386347 - RNA, 13 nt, Human
cugccugagcacc

SEQ ID NO: 3386348 - RNA, 20 nt, Human
cugccugagcaccucccagc

SEQ ID NO: 3386349 - RNA, 23 nt, Human
cugccugagggccccucugccca

SEQ ID NO: 3386350 - RNA, 19 nt, Human
cugccugagucgugaccug

SEQ ID NO: 3386351 - RNA, 16 nt, Human
cugccugauggaccug

SEQ ID NO: 3386352 - RNA, 15 nt, Human
cugccugcaccccug

SEQ ID NO: 3386353 - RNA, 21 nt, Human
cugccugcagaggucugugcu

SEQ ID NO: 3386354 - RNA, 23 nt, Human
cugccugcagaggucugugcuga

SEQ ID NO: 3386355 - RNA, 17 nt, Human
cugccugcauaggaguu

SEQ ID NO: 3386356 - RNA, 13 nt, Human
cugccugcccaca

SEQ ID NO: 3386357 - RNA, 13 nt, Human
cugccugcccacc

SEQ ID NO: 3386358 - RNA, 14 nt, Human
cugccugcccaccc

SEQ ID NO: 3386359 - RNA, 20 nt, Human
cugccugcccaggccccugc

SEQ ID NO: 3386360 - RNA, 21 nt, Human
cugccugcccaggccccugcc

SEQ ID NO: 3386361 - RNA, 22 nt, Human
cugccugcccaggccccugcca

SEQ ID NO: 3386362 - RNA, 14 nt, Human
cugccugccccgcc

SEQ ID NO: 3386363 - RNA, 17 nt, Human
cugccugcccgcacagc

SEQ ID NO: 3386364 - RNA, 15 nt, Human
cugccugcccuggug

SEQ ID NO: 3386365 - RNA, 23 nt, Human
cugccugcccuuuguccuccugc

SEQ ID NO: 3386366 - RNA, 23 nt, Human
cugccugccgguaaacacgccug

SEQ ID NO: 3386367 - RNA, 12 nt, Human
cugccugccugu

SEQ ID NO: 3386368 - RNA, 17 nt, Human
cugccugccuuaaguga

SEQ ID NO: 3386369 - RNA, 22 nt, Human
cugccugccuuaagugaggaaa

SEQ ID NO: 3386370 - RNA, 16 nt, Human
cugccugccuuggccu

SEQ ID NO: 3386371 - RNA, 15 nt, Human
cugccugcgucuucc

SEQ ID NO: 3386372 - RNA, 18 nt, Human
cugccugcucccauccug

SEQ ID NO: 3386373 - RNA, 23 nt, Human
cugccugcuuuucacugcugcaa

SEQ ID NO: 3386374 - RNA, 23 nt, Human
cugccuggacuuggccccugcca

SEQ ID NO: 3386375 - RNA, 11 nt, Human
cugccuggagc

SEQ ID NO: 3386376 - RNA, 15 nt, Human
cugccuggagcccca

SEQ ID NO: 3386377 - RNA, 14 nt, Human
cugccuggccacug

SEQ ID NO: 3386378 - RNA, 16 nt, Human
cugccuggccacugcu

SEQ ID NO: 3386379 - RNA, 21 nt, Human
cugccuggccacugcucccua

SEQ ID NO: 3386380 - RNA, 12 nt, Human
cugccuggccag

SEQ ID NO: 3386381 - RNA, 13 nt, Human
cugccuggccagg

SEQ ID NO: 3386382 - RNA, 15 nt, Human
cugccuggccaggca

SEQ ID NO: 3386383 - RNA, 20 nt, Human
cugccuggcccccagcugug

SEQ ID NO: 3386384 - RNA, 18 nt, Human
cugccuggcccccugucc

SEQ ID NO: 3386385 - RNA, 13 nt, Human
cugccuggccccu

SEQ ID NO: 3386386 - RNA, 12 nt, Human
cugccugggcug

SEQ ID NO: 3386387 - RNA, 20 nt, Human
cugccugggcuguuggcacu

SEQ ID NO: 3386388 - RNA, 19 nt, Human
cugccugguccucacacuc

SEQ ID NO: 3386389 - RNA, 22 nt, Human
cugccuggucuccugcccccac

SEQ ID NO: 3386390 - RNA, 19 nt, Human
cugccuguaacuugagagu

SEQ ID NO: 3386391 - RNA, 17 nt, Human
cugccuguaguuaggaa

SEQ ID NO: 3386392 - RNA, 13 nt, Human
cugccuguauacu

SEQ ID NO: 3386393 - RNA, 12 nt, Human
cugccugucccc

SEQ ID NO: 3386394 - RNA, 14 nt, Human
cugccuguccccau

SEQ ID NO: 3386395 - RNA, 20 nt, Human
cugccugucccucucaggca

SEQ ID NO: 3386396 - RNA, 23 nt, Human
cugccugucccucucaggcaugc

SEQ ID NO: 3386397 - RNA, 12 nt, Human
cugccugucucc

SEQ ID NO: 3386398 - RNA, 18 nt, Human
cugccugucugccccagc

SEQ ID NO: 3386399 - RNA, 17 nt, Human
cugccugugagccaguc

SEQ ID NO: 3386400 - RNA, 14 nt, Human
cugccugugcugug

SEQ ID NO: 3386401 - RNA, 14 nt, Human
cugccuguggccau

SEQ ID NO: 3386402 - RNA, 23 nt, Human
cugccuguggcgccgucuccagg

SEQ ID NO: 3386403 - RNA, 17 nt, Human
cugccuguuauaacucu

SEQ ID NO: 3386404 - RNA, 15 nt, Human
cugccuguucagcuc

SEQ ID NO: 3386405 - RNA, 19 nt, Human
cugccuguucagcuccagc

SEQ ID NO: 3386406 - RNA, 20 nt, Human
cugccuguucagcuccagcu

SEQ ID NO: 3386407 - RNA, 23 nt, Human
cugccuguucagcuccagcucac

SEQ ID NO: 3386408 - RNA, 15 nt, Human
cugccuguucccauu

SEQ ID NO: 3386409 - RNA, 18 nt, Human
cugccuguugggccagga

SEQ ID NO: 3386410 - RNA, 20 nt, Human
cugccuguugggccaggagc

SEQ ID NO: 3386411 - RNA, 13 nt, Human
cugccuuaaguga

SEQ ID NO: 3386412 - RNA, 15 nt, Human
cugccuuagagccag

SEQ ID NO: 3386413 - RNA, 17 nt, Human
cugccuuagagccaggc

SEQ ID NO: 3386414 - RNA, 18 nt, Human
cugccuuagcuucaggaa

SEQ ID NO: 3386415 - RNA, 15 nt, Human
cugccuucaccuuca

SEQ ID NO: 3386416 - RNA, 12 nt, Human
cugccuucccua

SEQ ID NO: 3386417 - RNA, 16 nt, Human
cugccuuccuccuggg

SEQ ID NO: 3386418 - RNA, 13 nt, Human
cugccuucgcuuc

SEQ ID NO: 3386419 - RNA, 15 nt, Human
cugccuucgcuucuu

SEQ ID NO: 3386420 - RNA, 23 nt, Human
cugccuucgcuucuugccucugu

SEQ ID NO: 3386421 - RNA, 18 nt, Human
cugccuucuggccuugua

SEQ ID NO: 3386422 - RNA, 17 nt, Human
cugccuucuguccuggu

SEQ ID NO: 3386423 - RNA, 17 nt, Human
cugccuugaaaaagaca

SEQ ID NO: 3386424 - RNA, 17 nt, Human
cugccuugaaccuguga

SEQ ID NO: 3386425 - RNA, 21 nt, Human
cugccuugaagccacugaagc

SEQ ID NO: 3386426 - RNA, 12 nt, Human
cugccuugccuu

SEQ ID NO: 3386427 - RNA, 13 nt, Human
cugccuugccuuu

SEQ ID NO: 3386428 - RNA, 16 nt, Human
cugccuugcuguuggu

SEQ ID NO: 3386429 - RNA, 12 nt, Human
cugccuuuauug

SEQ ID NO: 3386430 - RNA, 15 nt, Human
cugccuuuauugugu

SEQ ID NO: 3386431 - RNA, 17 nt, Human
cugccuuuauuguguuu

SEQ ID NO: 3386432 - RNA, 24 nt, Human
cugccuuuauuguguuugucauua

SEQ ID NO: 3386433 - RNA, 22 nt, Human
cugccuuuccauccauggccag

SEQ ID NO: 3386434 - RNA, 18 nt, Human
cugccuuugauguuacag

SEQ ID NO: 3386435 - RNA, 14 nt, Human
cugccuuugccucc

SEQ ID NO: 3386436 - RNA, 21 nt, Human
cugccuuugccuccagaagca

SEQ ID NO: 3386437 - RNA, 17 nt, Human
cugccuuuuaguuccug

SEQ ID NO: 3386438 - RNA, 23 nt, Human
cugccuuuuaguuccugugcaca

SEQ ID NO: 3386439 - RNA, 20 nt, Human
cugcgaagacccucuugccc

SEQ ID NO: 3386440 - RNA, 12 nt, Human
cugcgaaguccu

SEQ ID NO: 3386441 - RNA, 14 nt, Human
cugcgaaguccuau

SEQ ID NO: 3386442 - RNA, 14 nt, Human
cugcgacccugggg

SEQ ID NO: 3386443 - RNA, 21 nt, Human
cugcgacccugggggcacagg

SEQ ID NO: 3386444 - RNA, 22 nt, Human
cugcgacccugggggcacagga

SEQ ID NO: 3386445 - RNA, 15 nt, Human
cugcgacuaaacuua

SEQ ID NO: 3386446 - RNA, 18 nt, Human
cugcgacuuucugccugg

SEQ ID NO: 3386447 - RNA, 20 nt, Human
cugcgaucuucagagcaggg

SEQ ID NO: 3386448 - RNA, 22 nt, Human
cugcgcccaccccgcucugcau

SEQ ID NO: 3386449 - RNA, 13 nt, Human
cugcgcccugggc

SEQ ID NO: 3386450 - RNA, 18 nt, Human
cugcgcccuuaccuuccc

SEQ ID NO: 3386451 - RNA, 19 nt, Human
cugcgccgccgccggaguc

SEQ ID NO: 3386452 - RNA, 20 nt, Human
cugcgccugcugcaugcccu

SEQ ID NO: 3386453 - RNA, 21 nt, Human
cugcgccuuuccuuuucgccu

SEQ ID NO: 3386454 - RNA, 13 nt, Human
cugcggaccccag

SEQ ID NO: 3386455 - RNA, 23 nt, Human
cugcggaggaaggaggacccagg

SEQ ID NO: 3386456 - RNA, 19 nt, Human
cugcggagugaagaggggc

SEQ ID NO: 3386457 - RNA, 19 nt, Human
cugcgggaugguccugggg

SEQ ID NO: 3386458 - RNA, 22 nt, Human
cugcgggaugguccuggggcuc

SEQ ID NO: 3386459 - RNA, 19 nt, Human
cugcggggcgggcacaccu

SEQ ID NO: 3386460 - RNA, 22 nt, Human
cugcgguagaugggagggaggc

SEQ ID NO: 3386461 - RNA, 17 nt, Human
cugcggucaaggccagc

SEQ ID NO: 3386462 - RNA, 23 nt, Human
cugcgguccacccaggagccccg

SEQ ID NO: 3386463 - RNA, 16 nt, Human
cugccaaccuaaaacu

SEQ ID NO: 3386464 - RNA, 23 nt, Human
cugccaaccucgcuccaacucca

SEQ ID NO: 3386465 - RNA, 19 nt, Human
cugccaacugaucuguuau

SEQ ID NO: 3386466 - RNA, 22 nt, Human
cugccaacuucuucagagcuga

SEQ ID NO: 3386467 - RNA, 14 nt, Human
cugccaagccccau

SEQ ID NO: 3386468 - RNA, 15 nt, Human
cugccaagccccauc

SEQ ID NO: 3386469 - RNA, 22 nt, Human
cugccaaggccagaguggccug

SEQ ID NO: 3386470 - RNA, 23 nt, Human
cugccaaggccagaguggccugg

SEQ ID NO: 3386471 - RNA, 17 nt, Human
cugccaauauccuaaua

SEQ ID NO: 3386472 - RNA, 20 nt, Human
cugccaauauccuaauaaaa

SEQ ID NO: 3386473 - RNA, 15 nt, Human
cugccaaugggagcu

SEQ ID NO: 3386474 - RNA, 18 nt, Human
cugccaaugggagcucau

SEQ ID NO: 3386475 - RNA, 15 nt, Human
cugccacacaaacgu

SEQ ID NO: 3386476 - RNA, 15 nt, Human
ccgucuucagccuag

SEQ ID NO: 3386477 - RNA, 19 nt, Human
ccgucuuucuuuuauacug

SEQ ID NO: 3386478 - RNA, 17 nt, Human
ccgugaaaacggagcug

SEQ ID NO: 3386479 - RNA, 17 nt, Human
ccgugaagauacuuugu

SEQ ID NO: 3386480 - RNA, 18 nt, Human
ccgugaagauacuuugua

SEQ ID NO: 3386481 - RNA, 20 nt, Human
ccgugacagacuccugagga

SEQ ID NO: 3386482 - RNA, 22 nt, Human
ccgugagcaggaaggccugggu

SEQ ID NO: 3386483 - RNA, 22 nt, Human
ccgugagccaaucccucaccuu

SEQ ID NO: 3386484 - RNA, 13 nt, Human
ccgugaggccaga

SEQ ID NO: 3386485 - RNA, 16 nt, Human
ccgugaguucucaggg

SEQ ID NO: 3386486 - RNA, 18 nt, Human
ccgugaguucucagggcu

SEQ ID NO: 3386487 - RNA, 19 nt, Human
ccgugaguucucagggcuc

SEQ ID NO: 3386488 - RNA, 20 nt, Human
ccgugccaaagucucccuuc

SEQ ID NO: 3386489 - RNA, 15 nt, Human
ccgugccccgccucc

SEQ ID NO: 3386490 - RNA, 17 nt, Human
ccgugccuccaccacca

SEQ ID NO: 3386491 - RNA, 15 nt, Human
ccgugccuucagcuc

SEQ ID NO: 3386492 - RNA, 14 nt, Human
ccgugcuaaggacu

SEQ ID NO: 3386493 - RNA, 15 nt, Human
ccgugcuaaggacuu

SEQ ID NO: 3386494 - RNA, 20 nt, Human
ccgugcugacagcugcuccu

SEQ ID NO: 3386495 - RNA, 20 nt, Human
ccgugcuuguuugcucaccu

SEQ ID NO: 3386496 - RNA, 22 nt, Human
ccgugcuuguuugcucaccugg

SEQ ID NO: 3386497 - RNA, 23 nt, Human
ccgugcuuguuugcucaccuggg

SEQ ID NO: 3386498 - RNA, 23 nt, Human
ccguggagaugggaugcuugccu

SEQ ID NO: 3386499 - RNA, 16 nt, Human
ccguggaggaggaagg

SEQ ID NO: 3386500 - RNA, 14 nt, Human
ccguggaggcugcu

SEQ ID NO: 3386501 - RNA, 22 nt, Human
ccguggauugcacguggccucu

SEQ ID NO: 3386502 - RNA, 23 nt, Human
ccguggauugcacguggccucuu

SEQ ID NO: 3386503 - RNA, 15 nt, Human
ccguggcacugcaua

SEQ ID NO: 3386504 - RNA, 20 nt, Human
ccguggccaucccugugagg

SEQ ID NO: 3386505 - RNA, 15 nt, Human
ccguggccccagccu

SEQ ID NO: 3386506 - RNA, 17 nt, Human
ccguggccccagccugg

SEQ ID NO: 3386507 - RNA, 22 nt, Human
ccguggccccagccuggcccag

SEQ ID NO: 3386508 - RNA, 16 nt, Human
ccguggcccugcccuc

SEQ ID NO: 3386509 - RNA, 19 nt, Human
ccguggcccuuccuggaca

SEQ ID NO: 3386510 - RNA, 21 nt, Human
ccguggcgcuuucugcaguuu

SEQ ID NO: 3386511 - RNA, 23 nt, Human
ccguggcuguggcauccagaguc

SEQ ID NO: 3386512 - RNA, 15 nt, Human
ccguggcuucccgcu

SEQ ID NO: 3386513 - RNA, 19 nt, Human
ccgugggccccacccucgg

SEQ ID NO: 3386514 - RNA, 15 nt, Human
ccguggggcagggag

SEQ ID NO: 3386515 - RNA, 22 nt, Human
ccguggggcagggagcugggcc

SEQ ID NO: 3386516 - RNA, 20 nt, Human
ccguggggccggggcuucug

SEQ ID NO: 3386517 - RNA, 13 nt, Human
ccguggucccuga

SEQ ID NO: 3386518 - RNA, 14 nt, Human
ccguggucccugag

SEQ ID NO: 3386519 - RNA, 16 nt, Human
ccguggucccugagga

SEQ ID NO: 3386520 - RNA, 20 nt, Human
ccgugguguuauuuaaagaa

SEQ ID NO: 3386521 - RNA, 23 nt, Human
ccgugguuugaacacgaaagaaa

SEQ ID NO: 3386522 - RNA, 17 nt, Human
ccgugucaagcugcucu

SEQ ID NO: 3386523 - RNA, 17 nt, Human
ccgugucugucuggcac

SEQ ID NO: 3386524 - RNA, 16 nt, Human
ccguguggccccuuca

SEQ ID NO: 3386525 - RNA, 21 nt, Human
ccguguguucuccgucccugc

SEQ ID NO: 3386526 - RNA, 19 nt, Human
ccguguuggucuguacuga

SEQ ID NO: 3386527 - RNA, 18 nt, Human
ccguguuugucucuucug

SEQ ID NO: 3386528 - RNA, 17 nt, Human
ccguuagcuccuguggc

SEQ ID NO: 3386529 - RNA, 18 nt, Human
ccguuagcuccuguggcc

SEQ ID NO: 3386530 - RNA, 20 nt, Human
ccguuauuauaauuguauca

SEQ ID NO: 3386531 - RNA, 15 nt, Human
ccguucaugggggag

SEQ ID NO: 3386532 - RNA, 16 nt, Human
ccguucaugggggagg

SEQ ID NO: 3386533 - RNA, 23 nt, Human
ccguucaugggggagggggcaga

SEQ ID NO: 3386534 - RNA, 21 nt, Human
ccguuccaccccaagagaacu

SEQ ID NO: 3386535 - RNA, 22 nt, Human
ccguuccaccccaagagaacuc

SEQ ID NO: 3386536 - RNA, 18 nt, Human
ccguuccugacaucacag

SEQ ID NO: 3386537 - RNA, 20 nt, Human
ccguuggggauuggggaaga

SEQ ID NO: 3386538 - RNA, 14 nt, Human
ccguugucucccug

SEQ ID NO: 3386539 - RNA, 21 nt, Human
ccguugucucccuggcccuca

SEQ ID NO: 3386540 - RNA, 23 nt, Human
ccguuucauuuagucaugugacc

SEQ ID NO: 3386541 - RNA, 19 nt, Human
ccguuuccagguguuuaua

SEQ ID NO: 3386542 - RNA, 22 nt, Human
ccguuugagaagaaaacaucua

SEQ ID NO: 3386543 - RNA, 13 nt, Human
ccguuugcuuuug

SEQ ID NO: 3386544 - RNA, 14 nt, Human
ccguuuugucacuu

SEQ ID NO: 3386545 - RNA, 14 nt, Human
ccuaaaaaagauau

SEQ ID NO: 3386546 - RNA, 13 nt, Human
ccuaaaaauuggu

SEQ ID NO: 3386547 - RNA, 17 nt, Human
ccuaaaacauaagauca

SEQ ID NO: 3386548 - RNA, 15 nt, Human
ccuaaaacuggccug

SEQ ID NO: 3386549 - RNA, 19 nt, Human
ccuaaaagaaacccugcac

SEQ ID NO: 3386550 - RNA, 23 nt, Human
ccuaaaagcaaaauaaaaacuau

SEQ ID NO: 3386551 - RNA, 17 nt, Human
ccuaaaagcacacucau

SEQ ID NO: 3386552 - RNA, 18 nt, Human
ccuaaaagcacacucauc

SEQ ID NO: 3386553 - RNA, 17 nt, Human
ccuaaaaggcccagaga

SEQ ID NO: 3386554 - RNA, 23 nt, Human
ccuaaaaguucauaacagugcca

SEQ ID NO: 3386555 - RNA, 19 nt, Human
ccuaaaauaacaguaugug

SEQ ID NO: 3386556 - RNA, 12 nt, Human
ccuaaaaucuug

SEQ ID NO: 3386557 - RNA, 16 nt, Human
ccuaaaauuauggaaa

SEQ ID NO: 3386558 - RNA, 22 nt, Human
ccuaaaauuugcccucccaucc

SEQ ID NO: 3386559 - RNA, 13 nt, Human
ccuaaaccucagu

SEQ ID NO: 3386560 - RNA, 14 nt, Human
ccuaaacuccaggg

SEQ ID NO: 3386561 - RNA, 13 nt, Human
ccuaaagagagua

SEQ ID NO: 3386562 - RNA, 23 nt, Human
ccuaaagagaguauuuuuauaca

SEQ ID NO: 3386563 - RNA, 12 nt, Human
ccuaaagagaua

SEQ ID NO: 3386564 - RNA, 15 nt, Human
ccuaaagcagccagc

SEQ ID NO: 3386565 - RNA, 13 nt, Human
ccuaaagccucaa

SEQ ID NO: 3386566 - RNA, 16 nt, Human
ccuaaagugcugggau

SEQ ID NO: 3386567 - RNA, 19 nt, Human
ccuaaauaauaaaaauaaa

SEQ ID NO: 3386568 - RNA, 16 nt, Human
ccuaaauauauuuuaa

SEQ ID NO: 3386569 - RNA, 18 nt, Human
ccuaaauauauuuuaaga

SEQ ID NO: 3386570 - RNA, 17 nt, Human
ccuaaauccauuuggaa

SEQ ID NO: 3386571 - RNA, 16 nt, Human
ccuaaauuuaaugcug

SEQ ID NO: 3386572 - RNA, 18 nt, Human
ccuaaauuuaaugcugcc

SEQ ID NO: 3386573 - RNA, 23 nt, Human
ccuaacaugguuuaaaagaaaaa

SEQ ID NO: 3386574 - RNA, 11 nt, Human
ccuaaccaagu

SEQ ID NO: 3386575 - RNA, 15 nt, Human
ccuaaccccuuccag

SEQ ID NO: 3386576 - RNA, 12 nt, Human
ccuaacccuggc

SEQ ID NO: 3386577 - RNA, 12 nt, Human
ccuaaccugccg

SEQ ID NO: 3386578 - RNA, 14 nt, Human
ccuaaccugugucu

SEQ ID NO: 3386579 - RNA, 17 nt, Human
ccuaaccugugucugcg

SEQ ID NO: 3386580 - RNA, 18 nt, Human
ccuaaccugugucugcga

SEQ ID NO: 3386581 - RNA, 15 nt, Human
ccuaacgaaguaucc

SEQ ID NO: 3386582 - RNA, 18 nt, Human
ccuaacucauacugugcu

SEQ ID NO: 3386583 - RNA, 14 nt, Human
ccuaacucuucuuu

SEQ ID NO: 3386584 - RNA, 14 nt, Human
ccuaacuguaucuu

SEQ ID NO: 3386585 - RNA, 12 nt, Human
ccuaagacaugu

SEQ ID NO: 3386586 - RNA, 15 nt, Human
ccuaagaccuggggu

SEQ ID NO: 3386587 - RNA, 23 nt, Human
ccuaagaccugggguugucagcu

SEQ ID NO: 3386588 - RNA, 15 nt, Human
ccuaagagagcaccu

SEQ ID NO: 3386589 - RNA, 13 nt, Human
ccuaagaggcugc

SEQ ID NO: 3386590 - RNA, 16 nt, Human
ccuaagaggcugcccu

SEQ ID NO: 3386591 - RNA, 19 nt, Human
ccuaagaggcugcccuccu

SEQ ID NO: 3386592 - RNA, 16 nt, Human
ccuaagaguguuuaau

SEQ ID NO: 3386593 - RNA, 21 nt, Human
ccuaagaucucgguuugccaa

SEQ ID NO: 3386594 - RNA, 19 nt, Human
ccuaagauguguucuuauu

SEQ ID NO: 3386595 - RNA, 17 nt, Human
ccuaagcagaaagugcc

SEQ ID NO: 3386596 - RNA, 20 nt, Human
ccuaagcagaaagugccuuu

SEQ ID NO: 3386597 - RNA, 23 nt, Human
ccuaagcagaaagugccuuucag

SEQ ID NO: 3386598 - RNA, 12 nt, Human
ccuaagcaucua

SEQ ID NO: 3386599 - RNA, 16 nt, Human
ccuaagcauugccugg

SEQ ID NO: 3386600 - RNA, 16 nt, Human
ccuaagccacuugaaa

SEQ ID NO: 3386601 - RNA, 14 nt, Human
ccuaagccagcugc

SEQ ID NO: 3386602 - RNA, 17 nt, Human
ccuaagccagcugcccc

SEQ ID NO: 3386603 - RNA, 16 nt, Human
ccuaaggaaccuuccu

SEQ ID NO: 3386604 - RNA, 23 nt, Human
ccuaaggacuucuuuaauuuugg

SEQ ID NO: 3386605 - RNA, 19 nt, Human
ccuaaggaucucucaggag

SEQ ID NO: 3386606 - RNA, 23 nt, Human
ccuaaggaucucucaggagcaca

SEQ ID NO: 3386607 - RNA, 24 nt, Human
ccuaaggaucucucaggagcacag

SEQ ID NO: 3386608 - RNA, 23 nt, Human
ccuaaggcaucuaucugugcuag

SEQ ID NO: 3386609 - RNA, 19 nt, Human
ccuaagggucgaaagcucu

SEQ ID NO: 3386610 - RNA, 22 nt, Human
ccuaagggucgaaagcucuaga

SEQ ID NO: 3386611 - RNA, 23 nt, Human
ccuaagggucgaaagcucuagaa

SEQ ID NO: 3386612 - RNA, 16 nt, Human
ccuaaguacuguaaua

SEQ ID NO: 3386613 - RNA, 18 nt, Human
ccuaaguacuguaauaau

SEQ ID NO: 3386614 - RNA, 16 nt, Human
ccuaaguccuuuaugu

SEQ ID NO: 3386615 - RNA, 14 nt, Human
ccuaagucucugug

SEQ ID NO: 3386616 - RNA, 17 nt, Human
cugcguccuccucaccu

SEQ ID NO: 3386617 - RNA, 19 nt, Human
cugcguccuccucaccuca

SEQ ID NO: 3386618 - RNA, 23 nt, Human
cugcgucuuccgccccugccugc

SEQ ID NO: 3386619 - RNA, 22 nt, Human
cugcgugccagucaagaagaaa

SEQ ID NO: 3386620 - RNA, 18 nt, Human
cugcucugaugcaucaga

SEQ ID NO: 3386621 - RNA, 21 nt, Human
cugcccagaucagccagaagc

SEQ ID NO: 3386622 - RNA, 23 nt, Human
cugcccagcuugggcccagcugg

SEQ ID NO: 3386623 - RNA, 20 nt, Human
cugcccaggacggggccggc

SEQ ID NO: 3386624 - RNA, 13 nt, Human
cugcccaggcccc

SEQ ID NO: 3386625 - RNA, 14 nt, Human
cugcccaggccccu

SEQ ID NO: 3386626 - RNA, 15 nt, Human
cugcccaggccccug

SEQ ID NO: 3386627 - RNA, 18 nt, Human
cugcccaggccccugcca

SEQ ID NO: 3386628 - RNA, 19 nt, Human
cugcccaggccccugccac

SEQ ID NO: 3386629 - RNA, 18 nt, Human
cugcccaggcugugcagc

SEQ ID NO: 3386630 - RNA, 17 nt, Human
cugcccaggggagcccu

SEQ ID NO: 3386631 - RNA, 13 nt, Human
cugcccaggggug

SEQ ID NO: 3386632 - RNA, 16 nt, Human
cugcccaggggugccc

SEQ ID NO: 3386633 - RNA, 17 nt, Human
cugcccaggggugcccc

SEQ ID NO: 3386634 - RNA, 22 nt, Human
cugcccaggggugcccccuccu

SEQ ID NO: 3386635 - RNA, 13 nt, Human
cugcccagucccc

SEQ ID NO: 3386636 - RNA, 19 nt, Human
cugcccagucccccaaccc

SEQ ID NO: 3386637 - RNA, 21 nt, Human
cugcccaguguuguuuguaaa

SEQ ID NO: 3386638 - RNA, 22 nt, Human
cugcccaguguuguuuguaaau

SEQ ID NO: 3386639 - RNA, 23 nt, Human
cugcccaguguuguuuguaaaua

SEQ ID NO: 3386640 - RNA, 18 nt, Human
cugcccaucgugaagaag

SEQ ID NO: 3386641 - RNA, 18 nt, Human
cugcccaucugggaaaau

SEQ ID NO: 3386642 - RNA, 20 nt, Human
cugcccaucugggaaaauac

SEQ ID NO: 3386643 - RNA, 16 nt, Human
cugcccauggacaggc

SEQ ID NO: 3386644 - RNA, 21 nt, Human
cugcccaugucgcgcucagca

SEQ ID NO: 3386645 - RNA, 23 nt, Human
cugcccauucugcccugugggac

SEQ ID NO: 3386646 - RNA, 22 nt, Human
cugccccaaauaacuucagucc

SEQ ID NO: 3386647 - RNA, 23 nt, Human
cugccccaaauaacuucaguccu

SEQ ID NO: 3386648 - RNA, 16 nt, Human
cugccccaacuccugg

SEQ ID NO: 3386649 - RNA, 21 nt, Human
cugccccaacuccuggaagcu

SEQ ID NO: 3386650 - RNA, 24 nt, Human
cugccccaacuccuuccagcuagu

SEQ ID NO: 3386651 - RNA, 16 nt, Human
cugccccacaccuccu

SEQ ID NO: 3386652 - RNA, 18 nt, Human
cugccccacaccuccucu

SEQ ID NO: 3386653 - RNA, 22 nt, Human
cugccccacaccuccucucacu

SEQ ID NO: 3386654 - RNA, 23 nt, Human
cugccccaccccuccccauuagc

SEQ ID NO: 3386655 - RNA, 13 nt, Human
cugccccagaggc

SEQ ID NO: 3386656 - RNA, 14 nt, Human
cugccccagcccag

SEQ ID NO: 3386657 - RNA, 13 nt, Human
cugccccagcucu

SEQ ID NO: 3386658 - RNA, 14 nt, Human
cugccccagcucug

SEQ ID NO: 3386659 - RNA, 15 nt, Human
cugccccagcucugg

SEQ ID NO: 3386660 - RNA, 14 nt, Human
cugccccaggccug

SEQ ID NO: 3386661 - RNA, 15 nt, Human
cugccccaggccuga

SEQ ID NO: 3386662 - RNA, 17 nt, Human
cugccccaggcugcggc

SEQ ID NO: 3386663 - RNA, 18 nt, Human
cugccccauccuccagca

SEQ ID NO: 3386664 - RNA, 21 nt, Human
cugccccauccuccagcaggg

SEQ ID NO: 3386665 - RNA, 22 nt, Human
cugccccauccuccagcaggga

SEQ ID NO: 3386666 - RNA, 17 nt, Human
cugccccaucuccccuc

SEQ ID NO: 3386667 - RNA, 21 nt, Human
cugccccauuuauccaccucc

SEQ ID NO: 3386668 - RNA, 22 nt, Human
cugccccauuuauccaccucca

SEQ ID NO: 3386669 - RNA, 14 nt, Human
cugcccccacaccu

SEQ ID NO: 3386670 - RNA, 22 nt, Human
cugcccccaccacggccacugg

SEQ ID NO: 3386671 - RNA, 22 nt, Human
cugcccccaccccauucccgca

SEQ ID NO: 3386672 - RNA, 23 nt, Human
cugcccccaccccauucccgcag

SEQ ID NO: 3386673 - RNA, 12 nt, Human
cugcccccacga

SEQ ID NO: 3386674 - RNA, 21 nt, Human
cugcccccacgagggucagga

SEQ ID NO: 3386675 - RNA, 14 nt, Human
cugcccccagagcc

SEQ ID NO: 3386676 - RNA, 23 nt, Human
cugcccccagcucuucuccccag

SEQ ID NO: 3386677 - RNA, 14 nt, Human
cugcccccaggacu

SEQ ID NO: 3386678 - RNA, 18 nt, Human
cugcccccaggacugggc

SEQ ID NO: 3386679 - RNA, 16 nt, Human
cugccccccagccucu

SEQ ID NO: 3386680 - RNA, 19 nt, Human
cugccccccccccccaucu

SEQ ID NO: 3386681 - RNA, 15 nt, Human
cugcccccgcauccc

SEQ ID NO: 3386682 - RNA, 18 nt, Human
cugcccccgcauccccug

SEQ ID NO: 3386683 - RNA, 18 nt, Human
cugcccccggcccccugg

SEQ ID NO: 3386684 - RNA, 17 nt, Human
cugcccccuccccuuca

SEQ ID NO: 3386685 - RNA, 23 nt, Human
cugcccccuccccuucacaccau

SEQ ID NO: 3386686 - RNA, 15 nt, Human
cugcccccucugccc

SEQ ID NO: 3386687 - RNA, 12 nt, Human
cugcccccugca

SEQ ID NO: 3386688 - RNA, 14 nt, Human
cugcccccugcaga

SEQ ID NO: 3386689 - RNA, 13 nt, Human
cugcccccugcug

SEQ ID NO: 3386690 - RNA, 18 nt, Human
cugcccccugcugccaug

SEQ ID NO: 3386691 - RNA, 23 nt, Human
cugcccccuucucccacacugcu

SEQ ID NO: 3386692 - RNA, 17 nt, Human
cugccccgcccagcugc

SEQ ID NO: 3386693 - RNA, 22 nt, Human
cugccccggccccucccccuga

SEQ ID NO: 3386694 - RNA, 18 nt, Human
cugccccgucaccaucuc

SEQ ID NO: 3386695 - RNA, 19 nt, Human
cugccccgucaccaucuca

SEQ ID NO: 3386696 - RNA, 22 nt, Human
cugccccgucucaugaggggcc

SEQ ID NO: 3386697 - RNA, 15 nt, Human
cugccccgugcagac

SEQ ID NO: 3386698 - RNA, 17 nt, Human
cugccccgugcagacug

SEQ ID NO: 3386699 - RNA, 19 nt, Human
cugccccgugcagacugga

SEQ ID NO: 3386700 - RNA, 22 nt, Human
cugccccgugcagacuggaggg

SEQ ID NO: 3386701 - RNA, 15 nt, Human
cugccccucaugcca

SEQ ID NO: 3386702 - RNA, 11 nt, Human
cugccccuccc

SEQ ID NO: 3386703 - RNA, 16 nt, Human
cugccccucccugcca

SEQ ID NO: 3386704 - RNA, 20 nt, Human
cugccccuccucucugcccu

SEQ ID NO: 3386705 - RNA, 16 nt, Human
cugccccucucugggc

SEQ ID NO: 3386706 - RNA, 18 nt, Human
cugccccucucugggccu

SEQ ID NO: 3386707 - RNA, 23 nt, Human
cugccccucucugggccucagag

SEQ ID NO: 3386708 - RNA, 15 nt, Human
cugccccucuuucuc

SEQ ID NO: 3386709 - RNA, 10 nt, Human
cugccccugc

SEQ ID NO: 3386710 - RNA, 14 nt, Human
cugccccugcacag

SEQ ID NO: 3386711 - RNA, 15 nt, Human
cugccccugcacagc

SEQ ID NO: 3386712 - RNA, 23 nt, Human
cugccccugcuacugccaaccuc

SEQ ID NO: 3386713 - RNA, 14 nt, Human
cugccccuggcagc

SEQ ID NO: 3386714 - RNA, 15 nt, Human
cugccccuggcagcc

SEQ ID NO: 3386715 - RNA, 17 nt, Human
cugccccuggcagcccc

SEQ ID NO: 3386716 - RNA, 18 nt, Human
cugccccuguucucuucc

SEQ ID NO: 3386717 - RNA, 21 nt, Human
cugccccuucuacacucuccu

SEQ ID NO: 3386718 - RNA, 24 nt, Human
cugccccuucuacacucuccuggg

SEQ ID NO: 3386719 - RNA, 13 nt, Human
cugcccgagcugg

SEQ ID NO: 3386720 - RNA, 21 nt, Human
cugcccgagcuggugcauuac

SEQ ID NO: 3386721 - RNA, 17 nt, Human
cugcccgcacagcagcc

SEQ ID NO: 3386722 - RNA, 17 nt, Human
cugcccgcagaccucug

SEQ ID NO: 3386723 - RNA, 18 nt, Human
cugcccgcagaccucugg

SEQ ID NO: 3386724 - RNA, 17 nt, Human
cugcccgccugcccacc

SEQ ID NO: 3386725 - RNA, 20 nt, Human
cugcccgccugcccaccugc

SEQ ID NO: 3386726 - RNA, 19 nt, Human
cugcccgcucccagugucu

SEQ ID NO: 3386727 - RNA, 13 nt, Human
cugcccggcaggg

SEQ ID NO: 3386728 - RNA, 16 nt, Human
cugcccggcgcccucu

SEQ ID NO: 3386729 - RNA, 21 nt, Human
cugcccggcgcccucuguccu

SEQ ID NO: 3386730 - RNA, 18 nt, Human
cugcccgggagcucagga

SEQ ID NO: 3386731 - RNA, 19 nt, Human
cugcccgggcgcggccagc

SEQ ID NO: 3386732 - RNA, 19 nt, Human
cugcccggggcagcugcca

SEQ ID NO: 3386733 - RNA, 21 nt, Human
cugcccggggcagcugccaga

SEQ ID NO: 3386734 - RNA, 19 nt, Human
cugcccguaaacacgccug

SEQ ID NO: 3386735 - RNA, 18 nt, Human
cugcccgucucucuccca

SEQ ID NO: 3386736 - RNA, 22 nt, Human
cugcccgucucucucccaugga

SEQ ID NO: 3386737 - RNA, 18 nt, Human
cugcccgucuucagccua

SEQ ID NO: 3386738 - RNA, 16 nt, Human
cugcccuagcuccaca

SEQ ID NO: 3386739 - RNA, 16 nt, Human
cugcccuaugggccug

SEQ ID NO: 3386740 - RNA, 20 nt, Human
cugcccuaugggccugccgg

SEQ ID NO: 3386741 - RNA, 19 nt, Human
cugcccuccaagaccuucu

SEQ ID NO: 3386742 - RNA, 22 nt, Human
cugcccuccacacccgcgcccc

SEQ ID NO: 3386743 - RNA, 22 nt, Human
cugcccuccagcucuuuccucc

SEQ ID NO: 3386744 - RNA, 14 nt, Human
cugcccuccauccc

SEQ ID NO: 3386745 - RNA, 14 nt, Human
cugcccuccccucu

SEQ ID NO: 3386746 - RNA, 18 nt, Human
cugcccucccuccuuccu

SEQ ID NO: 3386747 - RNA, 12 nt, Human
cugcccuccugu

SEQ ID NO: 3386748 - RNA, 20 nt, Human
cugcccuccugugcucagcc

SEQ ID NO: 3386749 - RNA, 21 nt, Human
cugcccuccugugcucagccc

SEQ ID NO: 3386750 - RNA, 17 nt, Human
cugcccuccuuaauuug

SEQ ID NO: 3386751 - RNA, 22 nt, Human
cugcccucguggccagcccggc

SEQ ID NO: 3386752 - RNA, 12 nt, Human
cugcccucuaga

SEQ ID NO: 3386753 - RNA, 21 nt, Human
cugcccucuccugggcagcug

SEQ ID NO: 3386754 - RNA, 13 nt, Human
cugcccucuguuc

SEQ ID NO: 3386755 - RNA, 19 nt, Human
cugcccucuguucaguaac

SEQ ID NO: 3386756 - RNA, 20 nt, Human
cugcccugcacgucauggga

SEQ ID NO: 3386757 - RNA, 13 nt, Human
cugcccugccacc

SEQ ID NO: 3386758 - RNA, 16 nt, Human
cugcccugccaccugu

SEQ ID NO: 3386759 - RNA, 20 nt, Human
cugcccugccaccugucugu

SEQ ID NO: 3386760 - RNA, 16 nt, Human
cugcccugccacuuug

SEQ ID NO: 3386761 - RNA, 16 nt, Human
cugcccugcccaccug

SEQ ID NO: 3386762 - RNA, 20 nt, Human
cugcccugcccaccuggccu

SEQ ID NO: 3386763 - RNA, 20 nt, Human
ccuccacccugucccccagc

SEQ ID NO: 3386764 - RNA, 21 nt, Human
ccuccacccugucccccagcu

SEQ ID NO: 3386765 - RNA, 24 nt, Human
ccuccacccugucccccagcucug

SEQ ID NO: 3386766 - RNA, 19 nt, Human
ccuccaccuaccacucaca

SEQ ID NO: 3386767 - RNA, 13 nt, Human
ccuccaccuccug

SEQ ID NO: 3386768 - RNA, 13 nt, Human
ccuccaccuucca

SEQ ID NO: 3386769 - RNA, 14 nt, Human
ccuccaccuuccau

SEQ ID NO: 3386770 - RNA, 18 nt, Human
ccuccacguucugcucau

SEQ ID NO: 3386771 - RNA, 12 nt, Human
ccuccacuccca

SEQ ID NO: 3386772 - RNA, 15 nt, Human
ccuccacucccacuu

SEQ ID NO: 3386773 - RNA, 18 nt, Human
ccuccacucccacuuccc

SEQ ID NO: 3386774 - RNA, 11 nt, Human
ccuccacuccu

SEQ ID NO: 3386775 - RNA, 22 nt, Human
ccuccacucucccccacccccu

SEQ ID NO: 3386776 - RNA, 15 nt, Human
ccuccacucuuucuu

SEQ ID NO: 3386777 - RNA, 20 nt, Human
ccuccacucuuucuuucaau

SEQ ID NO: 3386778 - RNA, 17 nt, Human
ccuccagaacucuuccu

SEQ ID NO: 3386779 - RNA, 20 nt, Human
ccuccagaacucuuccucca

SEQ ID NO: 3386780 - RNA, 20 nt, Human
ccuccagaagccucuggcua

SEQ ID NO: 3386781 - RNA, 17 nt, Human
ccuccagagacaacagg

SEQ ID NO: 3386782 - RNA, 13 nt, Human
ccuccagagcccc

SEQ ID NO: 3386783 - RNA, 15 nt, Human
ccuccagagccccac

SEQ ID NO: 3386784 - RNA, 20 nt, Human
ccuccagagccccacagccc

SEQ ID NO: 3386785 - RNA, 13 nt, Human
ccuccagcaggga

SEQ ID NO: 3386786 - RNA, 17 nt, Human
ccuccagccccuguccc

SEQ ID NO: 3386787 - RNA, 20 nt, Human
ccuccagcccgggagccuag

SEQ ID NO: 3386788 - RNA, 22 nt, Human
ccuccagcccgggagccuagga

SEQ ID NO: 3386789 - RNA, 23 nt, Human
ccuccagccugcccaagcccagg

SEQ ID NO: 3386790 - RNA, 18 nt, Human
ccuccagcucagcaguga

SEQ ID NO: 3386791 - RNA, 15 nt, Human
ccuccagcucuuucc

SEQ ID NO: 3386792 - RNA, 19 nt, Human
ccuccagcucuuuccuccu

SEQ ID NO: 3386793 - RNA, 15 nt, Human
ccuccagcugcacca

SEQ ID NO: 3386794 - RNA, 19 nt, Human
ccuccagcugcaccagagc

SEQ ID NO: 3386795 - RNA, 11 nt, Human
ccuccagcugu

SEQ ID NO: 3386796 - RNA, 21 nt, Human
ccuccagcuuguggagcccca

SEQ ID NO: 3386797 - RNA, 13 nt, Human
ccuccaggaagcc

SEQ ID NO: 3386798 - RNA, 15 nt, Human
ccuccaggaagccuu

SEQ ID NO: 3386799 - RNA, 12 nt, Human
ccuccaggagcu

SEQ ID NO: 3386800 - RNA, 19 nt, Human
ccuccaggagcuucuuguu

SEQ ID NO: 3386801 - RNA, 20 nt, Human
ccuccaggcccgucugucca

SEQ ID NO: 3386802 - RNA, 21 nt, Human
ccuccaggcccgucuguccau

SEQ ID NO: 3386803 - RNA, 12 nt, Human
ccuccaggccug

SEQ ID NO: 3386804 - RNA, 16 nt, Human
ccuccaggccugccuc

SEQ ID NO: 3386805 - RNA, 21 nt, Human
ccuccaggccugccucccacu

SEQ ID NO: 3386806 - RNA, 13 nt, Human
ccuccaggccugu

SEQ ID NO: 3386807 - RNA, 17 nt, Human
ccuccaggccuguugcu

SEQ ID NO: 3386808 - RNA, 15 nt, Human
ccuccagggacagca

SEQ ID NO: 3386809 - RNA, 20 nt, Human
ccuccagggccacgugccag

SEQ ID NO: 3386810 - RNA, 22 nt, Human
ccuccagggccacgugccaggc

SEQ ID NO: 3386811 - RNA, 17 nt, Human
ccuccagggcuggacug

SEQ ID NO: 3386812 - RNA, 18 nt, Human
ccuccagggcuggacuga

SEQ ID NO: 3386813 - RNA, 23 nt, Human
ccuccagggcuggacugaggccu

SEQ ID NO: 3386814 - RNA, 12 nt, Human
ccuccaggugca

SEQ ID NO: 3386815 - RNA, 19 nt, Human
cugcgucaugcuuguguua

SEQ ID NO: 3386816 - RNA, 15 nt, Human
cugcguccuccucac

SEQ ID NO: 3386817 - RNA, 24 nt, Human
cugcguccuccucaccucaugccc

SEQ ID NO: 3386818 - RNA, 18 nt, Human
cugcgucgguccuggugc

SEQ ID NO: 3386819 - RNA, 16 nt, Human
cugcgucuauccugug

SEQ ID NO: 3386820 - RNA, 18 nt, Human
cugcgucuauccugugua

SEQ ID NO: 3386821 - RNA, 14 nt, Human
cugcgucuggaggg

SEQ ID NO: 3386822 - RNA, 15 nt, Human
cugcgucuggagggg

SEQ ID NO: 3386823 - RNA, 13 nt, Human
cugcgucuguguu

SEQ ID NO: 3386824 - RNA, 19 nt, Human
cugcgugacaauaaaacau

SEQ ID NO: 3386825 - RNA, 16 nt, Human
cugcgugccccugcug

SEQ ID NO: 3386826 - RNA, 13 nt, Human
cugcguggcugac

SEQ ID NO: 3386827 - RNA, 23 nt, Human
cugcguggcugaccccccucagg

SEQ ID NO: 3386828 - RNA, 22 nt, Human
cugcgugggugugugcguguuu

SEQ ID NO: 3386829 - RNA, 16 nt, Human
cugcguguucucagag

SEQ ID NO: 3386830 - RNA, 15 nt, Human
cugcguucugcaagc

SEQ ID NO: 3386831 - RNA, 16 nt, Human
cugcguugguccagag

SEQ ID NO: 3386832 - RNA, 19 nt, Human
cugcguugguccagagcgg

SEQ ID NO: 3386833 - RNA, 20 nt, Human
cugcguuuuggaagcucuga

SEQ ID NO: 3386834 - RNA, 12 nt, Human
cugcuaaaucuc

SEQ ID NO: 3386835 - RNA, 20 nt, Human
cugcuaaaucuccuauuuuu

SEQ ID NO: 3386836 - RNA, 14 nt, Human
cugcuaaauugaug

SEQ ID NO: 3386837 - RNA, 19 nt, Human
cugcuaacggugcucaggg

SEQ ID NO: 3386838 - RNA, 17 nt, Human
cugcuaaguauuuccca

SEQ ID NO: 3386839 - RNA, 23 nt, Human
cugcuaaguauuucccagcacau

SEQ ID NO: 3386840 - RNA, 16 nt, Human
cugcuaauaaaaccca

SEQ ID NO: 3386841 - RNA, 24 nt, Human
cugcuaauauuuuccuccugagug

SEQ ID NO: 3386842 - RNA, 18 nt, Human
cugcuacaaagaagacau

SEQ ID NO: 3386843 - RNA, 19 nt, Human
cugcuacaaagaagacaug

SEQ ID NO: 3386844 - RNA, 23 nt, Human
cugcuacaaauacucuuaggaag

SEQ ID NO: 3386845 - RNA, 15 nt, Human
cugcuacaauguccu

SEQ ID NO: 3386846 - RNA, 13 nt, Human
cugcuacccuccc

SEQ ID NO: 3386847 - RNA, 18 nt, Human
cugcuacccucccugcug

SEQ ID NO: 3386848 - RNA, 19 nt, Human
cugcuacccucccugcugu

SEQ ID NO: 3386849 - RNA, 18 nt, Human
cugcuaccucccuugccu

SEQ ID NO: 3386850 - RNA, 19 nt, Human
cugcuaccucccuugccuu

SEQ ID NO: 3386851 - RNA, 21 nt, Human
cugcuacguuccuauugucau

SEQ ID NO: 3386852 - RNA, 20 nt, Human
cugcuacucaaguagcauuu

SEQ ID NO: 3386853 - RNA, 18 nt, Human
cugcuacucuguuccuuc

SEQ ID NO: 3386854 - RNA, 17 nt, Human
cugcuagaacuuuuuua

SEQ ID NO: 3386855 - RNA, 22 nt, Human
cugcuagcacuuggagccaagg

SEQ ID NO: 3386856 - RNA, 15 nt, Human
cugcuaggccagagc

SEQ ID NO: 3386857 - RNA, 18 nt, Human
cugcuaggccagagccca

SEQ ID NO: 3386858 - RNA, 18 nt, Human
cugcuaggcgagugccag

SEQ ID NO: 3386859 - RNA, 20 nt, Human
cugcuaggcgagugccagga

SEQ ID NO: 3386860 - RNA, 21 nt, Human
cugcuaggugggccagccccu

SEQ ID NO: 3386861 - RNA, 17 nt, Human
cugcuauauuuucauga

SEQ ID NO: 3386862 - RNA, 23 nt, Human
cugcuauauuuucaugacuuuuc

SEQ ID NO: 3386863 - RNA, 16 nt, Human
cugcuauccugccaaa

SEQ ID NO: 3386864 - RNA, 14 nt, Human
cugcuaugcuugaa

SEQ ID NO: 3386865 - RNA, 19 nt, Human
cugcuauuuauuuuccuaa

SEQ ID NO: 3386866 - RNA, 20 nt, Human
cugcuauuuauuuuccuaaa

SEQ ID NO: 3386867 - RNA, 21 nt, Human
cugcuauuuauuuuccuaaag

SEQ ID NO: 3386868 - RNA, 13 nt, Human
cugcuauuuuacu

SEQ ID NO: 3386869 - RNA, 18 nt, Human
cugcucacgucaaaugca

SEQ ID NO: 3386870 - RNA, 16 nt, Human
cugcucacuaccuccu

SEQ ID NO: 3386871 - RNA, 21 nt, Human
cugcucacuaccuccucaggg

SEQ ID NO: 3386872 - RNA, 17 nt, Human
cugcucagaacuugcug

SEQ ID NO: 3386873 - RNA, 12 nt, Human
cugcucagaucc

SEQ ID NO: 3386874 - RNA, 13 nt, Human
cugcucagcagcu

SEQ ID NO: 3386875 - RNA, 16 nt, Human
cugcucagccaagcuu

SEQ ID NO: 3386876 - RNA, 13 nt, Human
cugcucagcccug

SEQ ID NO: 3386877 - RNA, 14 nt, Human
cugcucagcccugc

SEQ ID NO: 3386878 - RNA, 15 nt, Human
cugcucagcccugca

SEQ ID NO: 3386879 - RNA, 18 nt, Human
cugcucagcccugcacca

SEQ ID NO: 3386880 - RNA, 13 nt, Human
cugcucaggcugc

SEQ ID NO: 3386881 - RNA, 18 nt, Human
cugcucaggcugcagcug

SEQ ID NO: 3386882 - RNA, 19 nt, Human
cugcucaggcugcagcugg

SEQ ID NO: 3386883 - RNA, 23 nt, Human
cugcucaggcugcagcuggacag

SEQ ID NO: 3386884 - RNA, 12 nt, Human
cugcucaucauu

SEQ ID NO: 3386885 - RNA, 22 nt, Human
cugcucaucauucucugucuca

SEQ ID NO: 3386886 - RNA, 22 nt, Human
cugcucauucuaaugauggccc

SEQ ID NO: 3386887 - RNA, 23 nt, Human
cugcucauucuaaugauggccca

SEQ ID NO: 3386888 - RNA, 21 nt, Human
cugcuccacaguguuggcgag

SEQ ID NO: 3386889 - RNA, 12 nt, Human
cugcuccacccu

SEQ ID NO: 3386890 - RNA, 20 nt, Human
cugcuccacccuuggccugu

SEQ ID NO: 3386891 - RNA, 21 nt, Human
cugcuccacccuuggccuguc

SEQ ID NO: 3386892 - RNA, 12 nt, Human
cugcuccacgcg

SEQ ID NO: 3386893 - RNA, 14 nt, Human
cugcuccacgcgcu

SEQ ID NO: 3386894 - RNA, 23 nt, Human
cugcuccagaauuuggaaauccu

SEQ ID NO: 3386895 - RNA, 13 nt, Human
cugcuccagaccu

SEQ ID NO: 3386896 - RNA, 19 nt, Human
cugcuccagcucuggcaug

SEQ ID NO: 3386897 - RNA, 14 nt, Human
cugcuccagcuguu

SEQ ID NO: 3386898 - RNA, 12 nt, Human
cugcuccaggga

SEQ ID NO: 3386899 - RNA, 20 nt, Human
cugcucccaaggggccugag

SEQ ID NO: 3386900 - RNA, 10 nt, Human
cugcucccac

SEQ ID NO: 3386901 - RNA, 19 nt, Human
cugcucccaccuggcucug

SEQ ID NO: 3386902 - RNA, 14 nt, Human
cugcucccauccug

SEQ ID NO: 3386903 - RNA, 20 nt, Human
cugcuccccagcagcggaac

SEQ ID NO: 3386904 - RNA, 18 nt, Human
cugcuccccagcccuggc

SEQ ID NO: 3386905 - RNA, 20 nt, Human
cugcuccccagcccuggcuc

SEQ ID NO: 3386906 - RNA, 12 nt, Human
cugcucccccac

SEQ ID NO: 3386907 - RNA, 22 nt, Human
cugcucccccacccccucccca

SEQ ID NO: 3386908 - RNA, 16 nt, Human
cugcugcuucauguuu

SEQ ID NO: 3386909 - RNA, 13 nt, Human
cugcugcuucuua

SEQ ID NO: 3386910 - RNA, 15 nt, Human
cugcuggaaacagac

SEQ ID NO: 3386911 - RNA, 13 nt, Human
cugcuggaagccc

SEQ ID NO: 3386912 - RNA, 15 nt, Human
cugcuggacaguauc

SEQ ID NO: 3386913 - RNA, 21 nt, Human
cugcuggaggccucaggugcu

SEQ ID NO: 3386914 - RNA, 21 nt, Human
cugcuggaguuucauguacaa

SEQ ID NO: 3386915 - RNA, 23 nt, Human
cugcuggaucacagcugcuuucu

SEQ ID NO: 3386916 - RNA, 15 nt, Human
cugcuggcaucaaga

SEQ ID NO: 3386917 - RNA, 12 nt, Human
cugcuggccaaa

SEQ ID NO: 3386918 - RNA, 22 nt, Human
cugcuggcccagccaaacccug

SEQ ID NO: 3386919 - RNA, 11 nt, Human
cugcuggcccc

SEQ ID NO: 3386920 - RNA, 16 nt, Human
cugcuggccccucacc

SEQ ID NO: 3386921 - RNA, 13 nt, Human
cugcuggccgccu

SEQ ID NO: 3386922 - RNA, 18 nt, Human
cugcuggccgccucaccc

SEQ ID NO: 3386923 - RNA, 20 nt, Human
cugcuggccggacacccgac

SEQ ID NO: 3386924 - RNA, 15 nt, Human
cugcuggccggagca

SEQ ID NO: 3386925 - RNA, 20 nt, Human
cugcuggccgggcacagcug

SEQ ID NO: 3386926 - RNA, 13 nt, Human
cugcuggccugga

SEQ ID NO: 3386927 - RNA, 14 nt, Human
cugcuggccuggau

SEQ ID NO: 3386928 - RNA, 16 nt, Human
cugcuggccuggaucu

SEQ ID NO: 3386929 - RNA, 16 nt, Human
cugcuggccuggccgg

SEQ ID NO: 3386930 - RNA, 15 nt, Human
cugcuggcgccucug

SEQ ID NO: 3386931 - RNA, 12 nt, Human
cugcuggcucuu

SEQ ID NO: 3386932 - RNA, 19 nt, Human
cugcugggacuggccaggu

SEQ ID NO: 3386933 - RNA, 18 nt, Human
cugcugggagguuaaaaa

SEQ ID NO: 3386934 - RNA, 15 nt, Human
cugcugggcucagug

SEQ ID NO: 3386935 - RNA, 16 nt, Human
cugcugggcucaguga

SEQ ID NO: 3386936 - RNA, 18 nt, Human
cugcugggcucagugaag

SEQ ID NO: 3386937 - RNA, 18 nt, Human
cugcugggcucuccaccu

SEQ ID NO: 3386938 - RNA, 12 nt, Human
cugcugggcugg

SEQ ID NO: 3386939 - RNA, 14 nt, Human
cugcugggcugggg

SEQ ID NO: 3386940 - RNA, 17 nt, Human
cugcuggggaagacagu

SEQ ID NO: 3386941 - RNA, 14 nt, Human
cugcuggggccugg

SEQ ID NO: 3386942 - RNA, 16 nt, Human
cugcuggggccuggga

SEQ ID NO: 3386943 - RNA, 20 nt, Human
cugcugggggcaacuggcca

SEQ ID NO: 3386944 - RNA, 12 nt, Human
cugcuggguggc

SEQ ID NO: 3386945 - RNA, 17 nt, Human
cugcuggguggcccauc

SEQ ID NO: 3386946 - RNA, 21 nt, Human
cugcuggguggcccauccccc

SEQ ID NO: 3386947 - RNA, 19 nt, Human
cugcuggguuuuccuccgg

SEQ ID NO: 3386948 - RNA, 20 nt, Human
cugcugguaauuuguaucug

SEQ ID NO: 3386949 - RNA, 18 nt, Human
cugcuggucacuucuucu

SEQ ID NO: 3386950 - RNA, 17 nt, Human
cugcuggucagcacucc

SEQ ID NO: 3386951 - RNA, 21 nt, Human
cugcugguuuuaacaacugug

SEQ ID NO: 3386952 - RNA, 17 nt, Human
cugcuguaaauuuggcu

SEQ ID NO: 3386953 - RNA, 16 nt, Human
cugcugucaccucucc

SEQ ID NO: 3386954 - RNA, 16 nt, Human
cugcugucauugcuuc

SEQ ID NO: 3386955 - RNA, 19 nt, Human
cugcugucauugcuucuuc

SEQ ID NO: 3386956 - RNA, 18 nt, Human
cugcuguccagacagccu

SEQ ID NO: 3386957 - RNA, 20 nt, Human
cugcuguccagacagccugu

SEQ ID NO: 3386958 - RNA, 21 nt, Human
cugcuguccagacagccugua

SEQ ID NO: 3386959 - RNA, 20 nt, Human
cugcuguccccucuugcccc

SEQ ID NO: 3386960 - RNA, 20 nt, Human
cugcugucuaaccugugacc

SEQ ID NO: 3386961 - RNA, 15 nt, Human
cugcugucucagccu

SEQ ID NO: 3386962 - RNA, 21 nt, Human
cugcugucuggguggcucacu

SEQ ID NO: 3386963 - RNA, 15 nt, Human
cugcugugaacccug

SEQ ID NO: 3386964 - RNA, 22 nt, Human
cugcugugaacccuggggccug

SEQ ID NO: 3386965 - RNA, 23 nt, Human
cugcugugaacccuggggccuga

SEQ ID NO: 3386966 - RNA, 16 nt, Human
cugcugugauuccacu

SEQ ID NO: 3386967 - RNA, 22 nt, Human
cugcugugauuccacuacaccu

SEQ ID NO: 3386968 - RNA, 19 nt, Human
cugcugugcugugcccaag

SEQ ID NO: 3386969 - RNA, 12 nt, Human
cugcuguggcca

SEQ ID NO: 3386970 - RNA, 15 nt, Human
cugcuguggccagga

SEQ ID NO: 3386971 - RNA, 18 nt, Human
cugcuguggccaggaggu

SEQ ID NO: 3386972 - RNA, 20 nt, Human
cugcuguuauauuucaucau

SEQ ID NO: 3386973 - RNA, 15 nt, Human
cugcuuaacuucaca

SEQ ID NO: 3386974 - RNA, 22 nt, Human
cugcuuaaucuucaaagccuuc

SEQ ID NO: 3386975 - RNA, 17 nt, Human
ccuccaggugcacaagc

SEQ ID NO: 3386976 - RNA, 21 nt, Human
ccuccaggugcacaagcucca

SEQ ID NO: 3386977 - RNA, 22 nt, Human
ccuccaggugcacaagcuccaa

SEQ ID NO: 3386978 - RNA, 15 nt, Human
ccuccaggugcagag

SEQ ID NO: 3386979 - RNA, 18 nt, Human
ccuccaggugcagaggua

SEQ ID NO: 3386980 - RNA, 12 nt, Human
ccuccagguuuu

SEQ ID NO: 3386981 - RNA, 19 nt, Human
ccuccagguuuuucaauua

SEQ ID NO: 3386982 - RNA, 19 nt, Human
ccuccauauuuucuuuaaa

SEQ ID NO: 3386983 - RNA, 16 nt, Human
ccuccaucccuggccc

SEQ ID NO: 3386984 - RNA, 19 nt, Human
ccuccauccuccuccuucc

SEQ ID NO: 3386985 - RNA, 20 nt, Human
ccuccauccuccuccuuccu

SEQ ID NO: 3386986 - RNA, 12 nt, Human
ccuccauccuga

SEQ ID NO: 3386987 - RNA, 24 nt, Human
ccuccaucucauguaucaucugga

SEQ ID NO: 3386988 - RNA, 19 nt, Human
ccuccaucuccaagaaugc

SEQ ID NO: 3386989 - RNA, 21 nt, Human
ccuccaucuccaagaaugcug

SEQ ID NO: 3386990 - RNA, 23 nt, Human
ccuccaucuccaagaaugcugaa

SEQ ID NO: 3386991 - RNA, 16 nt, Human
ccuccaugacagcgcu

SEQ ID NO: 3386992 - RNA, 19 nt, Human
ccuccaugcugccuccaga

SEQ ID NO: 3386993 - RNA, 18 nt, Human
ccuccaugggccccaggg

SEQ ID NO: 3386994 - RNA, 21 nt, Human
ccuccauuaaagucugaauca

SEQ ID NO: 3386995 - RNA, 15 nt, Human
ccucccaacucaccc

SEQ ID NO: 3386996 - RNA, 20 nt, Human
ccucccaacucaccccagcc

SEQ ID NO: 3386997 - RNA, 20 nt, Human
ccucccaagcuggcuggggu

SEQ ID NO: 3386998 - RNA, 18 nt, Human
ccucccaaggagaacaaa

SEQ ID NO: 3386999 - RNA, 19 nt, Human
ccucccaauuucagacucc

SEQ ID NO: 3387000 - RNA, 20 nt, Human
ccucccaauuucagacuccc

SEQ ID NO: 3387001 - RNA, 19 nt, Human
ccucccacacccaaagcug

SEQ ID NO: 3387002 - RNA, 22 nt, Human
ccucccacacccaaagcugagc

SEQ ID NO: 3387003 - RNA, 16 nt, Human
ccucccacacucccaa

SEQ ID NO: 3387004 - RNA, 15 nt, Human
ccucccaccacagca

SEQ ID NO: 3387005 - RNA, 20 nt, Human
ccucccacccccuucucugc

SEQ ID NO: 3387006 - RNA, 14 nt, Human
ccucccaccuccag

SEQ ID NO: 3387007 - RNA, 14 nt, Human
ccucccaccucugu

SEQ ID NO: 3387008 - RNA, 13 nt, Human
ccucccacugggg

SEQ ID NO: 3387009 - RNA, 15 nt, Human
ccucccacugggguc

SEQ ID NO: 3387010 - RNA, 12 nt, Human
ccucccacuuug

SEQ ID NO: 3387011 - RNA, 18 nt, Human
ccucccagaacacacucc

SEQ ID NO: 3387012 - RNA, 17 nt, Human
ccucccagagcaccugc

SEQ ID NO: 3387013 - RNA, 23 nt, Human
ccucccagaggagccaccaguuc

SEQ ID NO: 3387014 - RNA, 18 nt, Human
ccucccagagguccagcc

SEQ ID NO: 3387015 - RNA, 21 nt, Human
ccucccagagguccagcccau

SEQ ID NO: 3387016 - RNA, 20 nt, Human
ccucccagcccuauggaugu

SEQ ID NO: 3387017 - RNA, 13 nt, Human
ccucccagcucug

SEQ ID NO: 3387018 - RNA, 11 nt, Human
ccucccagcug

SEQ ID NO: 3387019 - RNA, 19 nt, Human
ccucccagcugacaguccu

SEQ ID NO: 3387020 - RNA, 22 nt, Human
ccucccaggacucugaccccag

SEQ ID NO: 3387021 - RNA, 14 nt, Human
ccucccaggcgccc

SEQ ID NO: 3387022 - RNA, 15 nt, Human
ccucccaggcucuca

SEQ ID NO: 3387023 - RNA, 21 nt, Human
ccucccauagauacucucuuc

SEQ ID NO: 3387024 - RNA, 21 nt, Human
ccucccaucugggaguccccu

SEQ ID NO: 3387025 - RNA, 20 nt, Human
ccuccccaaggcccccugcc

SEQ ID NO: 3387026 - RNA, 22 nt, Human
ccuccccaaggcccccugccug

SEQ ID NO: 3387027 - RNA, 23 nt, Human
ccuccccaaggcccccugccugc

SEQ ID NO: 3387028 - RNA, 16 nt, Human
ccuccccagcaggugg

SEQ ID NO: 3387029 - RNA, 12 nt, Human
ccuccccagccc

SEQ ID NO: 3387030 - RNA, 15 nt, Human
ccuccccagccccua

SEQ ID NO: 3387031 - RNA, 12 nt, Human
ccuccccagccu

SEQ ID NO: 3387032 - RNA, 14 nt, Human
ccuccccagccugc

SEQ ID NO: 3387033 - RNA, 13 nt, Human
ccuccccaggccg

SEQ ID NO: 3387034 - RNA, 14 nt, Human
ccuccccaggggag

SEQ ID NO: 3387035 - RNA, 15 nt, Human
ccuccccauuuccca

SEQ ID NO: 3387036 - RNA, 20 nt, Human
ccuccccauuucccaucugc

SEQ ID NO: 3387037 - RNA, 22 nt, Human
ccuccccauuucccaucugcac

SEQ ID NO: 3387038 - RNA, 23 nt, Human
ccuccccauuucccaucugcacc

SEQ ID NO: 3387039 - RNA, 21 nt, Human
ccucccccagccaugccagcu

SEQ ID NO: 3387040 - RNA, 14 nt, Human
ccuccccccacugc

SEQ ID NO: 3387041 - RNA, 20 nt, Human
ccuccccccacugcaggccc

SEQ ID NO: 3387042 - RNA, 15 nt, Human
ccucccccccaugca

SEQ ID NO: 3387043 - RNA, 16 nt, Human
ccucccccgccacucc

SEQ ID NO: 3387044 - RNA, 17 nt, Human
ccucccccgccacuccu

SEQ ID NO: 3387045 - RNA, 16 nt, Human
ccucccccuccuuccc

SEQ ID NO: 3387046 - RNA, 12 nt, Human
ccucccccugcc

SEQ ID NO: 3387047 - RNA, 15 nt, Human
ccucccccugccagu

SEQ ID NO: 3387048 - RNA, 18 nt, Human
ccucccccugccagugcc

SEQ ID NO: 3387049 - RNA, 20 nt, Human
ccucccccugccagugccuu

SEQ ID NO: 3387050 - RNA, 14 nt, Human
ccucccccuguccc

SEQ ID NO: 3387051 - RNA, 15 nt, Human
ccucccccuucuccc

SEQ ID NO: 3387052 - RNA, 22 nt, Human
ccucccccuucucccaccccug

SEQ ID NO: 3387053 - RNA, 21 nt, Human
cuggcaucuaauucugauucu

SEQ ID NO: 3387054 - RNA, 19 nt, Human
cuggcaucugacacaaaaa

SEQ ID NO: 3387055 - RNA, 18 nt, Human
cuggcaucuuagaccucc

SEQ ID NO: 3387056 - RNA, 23 nt, Human
cuggcaucuuugcuauggggaca

SEQ ID NO: 3387057 - RNA, 17 nt, Human
cuggcaugauccaagca

SEQ ID NO: 3387058 - RNA, 19 nt, Human
cuggcaugggaaugaaugu

SEQ ID NO: 3387059 - RNA, 20 nt, Human
cuggcauguucaaagccaca

SEQ ID NO: 3387060 - RNA, 19 nt, Human
cuggcauuagaauuauuua

SEQ ID NO: 3387061 - RNA, 21 nt, Human
cuggcauuauguccacugugu

SEQ ID NO: 3387062 - RNA, 19 nt, Human
cuggcauugucccugugcc

SEQ ID NO: 3387063 - RNA, 13 nt, Human
cuggcauuuuaua

SEQ ID NO: 3387064 - RNA, 17 nt, Human
cuggccaagcugaggug

SEQ ID NO: 3387065 - RNA, 19 nt, Human
cuggccaagcugaggugcc

SEQ ID NO: 3387066 - RNA, 16 nt, Human
cuggccaccacccccc

SEQ ID NO: 3387067 - RNA, 17 nt, Human
cuggccaccaggcuggc

SEQ ID NO: 3387068 - RNA, 22 nt, Human
cuggccaccaggcuggcgcagc

SEQ ID NO: 3387069 - RNA, 16 nt, Human
cuggccaccucucucc

SEQ ID NO: 3387070 - RNA, 18 nt, Human
cuggccaccucucuccuu

SEQ ID NO: 3387071 - RNA, 15 nt, Human
cuggccaccugaggu

SEQ ID NO: 3387072 - RNA, 20 nt, Human
cuggccaccugaggugggcc

SEQ ID NO: 3387073 - RNA, 22 nt, Human
cuggccaccugaggugggccca

SEQ ID NO: 3387074 - RNA, 18 nt, Human
cuggccagacacaggccc

SEQ ID NO: 3387075 - RNA, 16 nt, Human
cuggccagaugcacca

SEQ ID NO: 3387076 - RNA, 19 nt, Human
cuggccagaugcaccagcc

SEQ ID NO: 3387077 - RNA, 18 nt, Human
cuggccagauggcccgga

SEQ ID NO: 3387078 - RNA, 13 nt, Human
cuggccagcccca

SEQ ID NO: 3387079 - RNA, 15 nt, Human
cuggccagccccaca

SEQ ID NO: 3387080 - RNA, 22 nt, Human
cuggccagccgcucuccugcca

SEQ ID NO: 3387081 - RNA, 14 nt, Human
cuggccagccuggg

SEQ ID NO: 3387082 - RNA, 17 nt, Human
cuggccagccuggggcc

SEQ ID NO: 3387083 - RNA, 22 nt, Human
cuggccagccuggggccuggca

SEQ ID NO: 3387084 - RNA, 23 nt, Human
cuggccagcgagcgcccagcucc

SEQ ID NO: 3387085 - RNA, 13 nt, Human
cuggccaggagca

SEQ ID NO: 3387086 - RNA, 12 nt, Human
cuggccaggaug

SEQ ID NO: 3387087 - RNA, 23 nt, Human
cuggccaggauggaggggugguc

SEQ ID NO: 3387088 - RNA, 11 nt, Human
cuggccaggca

SEQ ID NO: 3387089 - RNA, 13 nt, Human
cuggccaggcaga

SEQ ID NO: 3387090 - RNA, 14 nt, Human
cuggccaggcagau

SEQ ID NO: 3387091 - RNA, 21 nt, Human
cuggccaggcagaucugugcc

SEQ ID NO: 3387092 - RNA, 22 nt, Human
cuggccaggcagaucugugccc

SEQ ID NO: 3387093 - RNA, 18 nt, Human
cuggccagggccacgcuc

SEQ ID NO: 3387094 - RNA, 16 nt, Human
cuggccaguccaggcu

SEQ ID NO: 3387095 - RNA, 17 nt, Human
cuggccaguccaggcug

SEQ ID NO: 3387096 - RNA, 19 nt, Human
cuggccaguccaggcugcc

SEQ ID NO: 3387097 - RNA, 20 nt, Human
cuggccagugcccugauccc

SEQ ID NO: 3387098 - RNA, 15 nt, Human
cuggccaguguuuaa

SEQ ID NO: 3387099 - RNA, 16 nt, Human
cuggccaucuccaccc

SEQ ID NO: 3387100 - RNA, 13 nt, Human
cuggccaucucug

SEQ ID NO: 3387101 - RNA, 22 nt, Human
cuggccaucugguuaggauggc

SEQ ID NO: 3387102 - RNA, 12 nt, Human
cuggccauggag

SEQ ID NO: 3387103 - RNA, 15 nt, Human
cuggccauggagaaa

SEQ ID NO: 3387104 - RNA, 16 nt, Human
cuggccauggagaaag

SEQ ID NO: 3387105 - RNA, 17 nt, Human
cuggccauggagaaagc

SEQ ID NO: 3387106 - RNA, 23 nt, Human
cuggccauggagaaagcugacuu

SEQ ID NO: 3387107 - RNA, 14 nt, Human
cuggccauggccug

SEQ ID NO: 3387108 - RNA, 20 nt, Human
cuggccauggccugcaaacu

SEQ ID NO: 3387109 - RNA, 22 nt, Human
cuggccauggccugcaaacugg

SEQ ID NO: 3387110 - RNA, 22 nt, Human
cuggccauuugccaauuuuccu

SEQ ID NO: 3387111 - RNA, 12 nt, Human
cuggcccagccg

SEQ ID NO: 3387112 - RNA, 13 nt, Human
cuggcccagccgg

SEQ ID NO: 3387113 - RNA, 15 nt, Human
cuggcccagccggcc

SEQ ID NO: 3387114 - RNA, 16 nt, Human
cuggcccagccggccu

SEQ ID NO: 3387115 - RNA, 20 nt, Human
cuggcccagccggccucucu

SEQ ID NO: 3387116 - RNA, 14 nt, Human
cuggcccagcggcc

SEQ ID NO: 3387117 - RNA, 17 nt, Human
cuggcccagcggccccu

SEQ ID NO: 3387118 - RNA, 15 nt, Human
cuggcccagcucccc

SEQ ID NO: 3387119 - RNA, 22 nt, Human
cuggcccagcucccccgggagg

SEQ ID NO: 3387120 - RNA, 14 nt, Human
cuggcccagggcau

SEQ ID NO: 3387121 - RNA, 20 nt, Human
cuggcccagggcaucuggga

SEQ ID NO: 3387122 - RNA, 13 nt, Human
cuggcccagggcc

SEQ ID NO: 3387123 - RNA, 22 nt, Human
cuggcccaucaggguaggcugg

SEQ ID NO: 3387124 - RNA, 16 nt, Human
cuggcccaucagugua

SEQ ID NO: 3387125 - RNA, 19 nt, Human
cuggcccauguauggccag

SEQ ID NO: 3387126 - RNA, 17 nt, Human
cuggccccacaccagcc

SEQ ID NO: 3387127 - RNA, 15 nt, Human
cuggccccagcccug

SEQ ID NO: 3387128 - RNA, 17 nt, Human
cuggccccauggucagc

SEQ ID NO: 3387129 - RNA, 22 nt, Human
cuggcccccaaccucagggcuc

SEQ ID NO: 3387130 - RNA, 14 nt, Human
cugcuuaaugaaaa

SEQ ID NO: 3387131 - RNA, 12 nt, Human
cugcuuaauuca

SEQ ID NO: 3387132 - RNA, 22 nt, Human
cugcuuacaauucccugcuguc

SEQ ID NO: 3387133 - RNA, 20 nt, Human
cugcuuagaauccaaacuug

SEQ ID NO: 3387134 - RNA, 19 nt, Human
cugcuuagcuugcaccuug

SEQ ID NO: 3387135 - RNA, 16 nt, Human
cugcuuaggagagacc

SEQ ID NO: 3387136 - RNA, 20 nt, Human
cugcuuauccguuagccgug

SEQ ID NO: 3387137 - RNA, 12 nt, Human
cugcuucaagga

SEQ ID NO: 3387138 - RNA, 21 nt, Human
cugcuucagauguggagccag

SEQ ID NO: 3387139 - RNA, 23 nt, Human
cugcuucagauguggagccaggc

SEQ ID NO: 3387140 - RNA, 13 nt, Human
cugcuucagccuc

SEQ ID NO: 3387141 - RNA, 15 nt, Human
cugcuucagcuugcu

SEQ ID NO: 3387142 - RNA, 12 nt, Human
cugcuucagugg

SEQ ID NO: 3387143 - RNA, 19 nt, Human
cugcuucaguguauggaaa

SEQ ID NO: 3387144 - RNA, 18 nt, Human
cugcuuccaccucacccc

SEQ ID NO: 3387145 - RNA, 21 nt, Human
cugcuuccagugaggcucugc

SEQ ID NO: 3387146 - RNA, 16 nt, Human
cugcuucccaccuccc

SEQ ID NO: 3387147 - RNA, 22 nt, Human
cugcuucccaccucccugccca

SEQ ID NO: 3387148 - RNA, 24 nt, Human
cugcuucccaccucccugcccagg

SEQ ID NO: 3387149 - RNA, 11 nt, Human
cugcuucccau

SEQ ID NO: 3387150 - RNA, 13 nt, Human
cugcuucccaucc

SEQ ID NO: 3387151 - RNA, 24 nt, Human
cugcuucccauccuacccucgggc

SEQ ID NO: 3387152 - RNA, 21 nt, Human
cugcuucccucugccuguccc

SEQ ID NO: 3387153 - RNA, 19 nt, Human
cugcuuccgguagggaggc

SEQ ID NO: 3387154 - RNA, 14 nt, Human
cugcuuccucagag

SEQ ID NO: 3387155 - RNA, 18 nt, Human
cugcuuccuccuggaaau

SEQ ID NO: 3387156 - RNA, 14 nt, Human
cugcuuccugcuug

SEQ ID NO: 3387157 - RNA, 15 nt, Human
cugcuuccugcuugc

SEQ ID NO: 3387158 - RNA, 16 nt, Human
cugcuuccuuucuuga

SEQ ID NO: 3387159 - RNA, 19 nt, Human
cugcuucuaccaacuggaa

SEQ ID NO: 3387160 - RNA, 22 nt, Human
cugcuucuccaaaaaucugccu

SEQ ID NO: 3387161 - RNA, 16 nt, Human
cugcuucuccaaggaa

SEQ ID NO: 3387162 - RNA, 18 nt, Human
cugcuucucccacuuggc

SEQ ID NO: 3387163 - RNA, 20 nt, Human
cugcuucucccacuuggcca

SEQ ID NO: 3387164 - RNA, 13 nt, Human
cugcuucucccag

SEQ ID NO: 3387165 - RNA, 17 nt, Human
cugcuucucugacuucu

SEQ ID NO: 3387166 - RNA, 16 nt, Human
cugcuucuuaacccca

SEQ ID NO: 3387167 - RNA, 22 nt, Human
cugcuugaauaaacaccacugg

SEQ ID NO: 3387168 - RNA, 17 nt, Human
cugcuugacaacaucug

SEQ ID NO: 3387169 - RNA, 20 nt, Human
cugcuugagaauauugaagu

SEQ ID NO: 3387170 - RNA, 12 nt, Human
cugcuugaggaa

SEQ ID NO: 3387171 - RNA, 18 nt, Human
cugcuugaugaagcaagg

SEQ ID NO: 3387172 - RNA, 21 nt, Human
cugcuugaugggauucuggac

SEQ ID NO: 3387173 - RNA, 13 nt, Human
cugcuugauuuuu

SEQ ID NO: 3387174 - RNA, 20 nt, Human
cugcuugauuuuugccucuu

SEQ ID NO: 3387175 - RNA, 13 nt, Human
cugcuugcccuaa

SEQ ID NO: 3387176 - RNA, 15 nt, Human
cugcuugcccuaagc

SEQ ID NO: 3387177 - RNA, 20 nt, Human
cugcuugccgaaacuggaag

SEQ ID NO: 3387178 - RNA, 21 nt, Human
cugcuugccgaaacuggaagu

SEQ ID NO: 3387179 - RNA, 14 nt, Human
cugcuuggcccagg

SEQ ID NO: 3387180 - RNA, 13 nt, Human
cugcuugggcuuc

SEQ ID NO: 3387181 - RNA, 18 nt, Human
cugcuugggcuucauccu

SEQ ID NO: 3387182 - RNA, 19 nt, Human
cugcuugggcuucauccuc

SEQ ID NO: 3387183 - RNA, 22 nt, Human
cugcuuggggggugaugagggc

SEQ ID NO: 3387184 - RNA, 22 nt, Human
cugcuuggguggagaagccauu

SEQ ID NO: 3387185 - RNA, 17 nt, Human
cugcuugucccugccca

SEQ ID NO: 3387186 - RNA, 19 nt, Human
cugcuugugucccuccugg

SEQ ID NO: 3387187 - RNA, 17 nt, Human
cugcuuuaaagggccug

SEQ ID NO: 3387188 - RNA, 21 nt, Human
cugcuuuaaagggccugccug

SEQ ID NO: 3387189 - RNA, 22 nt, Human
cugcuuuaaagggccugccugg

SEQ ID NO: 3387190 - RNA, 17 nt, Human
cugcuuuagacuugaaa

SEQ ID NO: 3387191 - RNA, 21 nt, Human
cugcuuucagauacuggauug

SEQ ID NO: 3387192 - RNA, 12 nt, Human
cugcuuuccaca

SEQ ID NO: 3387193 - RNA, 13 nt, Human
cugcuuucucccc

SEQ ID NO: 3387194 - RNA, 16 nt, Human
cugcuuucuguuguca

SEQ ID NO: 3387195 - RNA, 15 nt, Human
cugcuuucuuugauu

SEQ ID NO: 3387196 - RNA, 20 nt, Human
cugcuuugacugagcagacu

SEQ ID NO: 3387197 - RNA, 19 nt, Human
cugggcaccuggggagugg

SEQ ID NO: 3387198 - RNA, 12 nt, Human
cugggcacuucc

SEQ ID NO: 3387199 - RNA, 17 nt, Human
cugggcacuucccugcu

SEQ ID NO: 3387200 - RNA, 20 nt, Human
ccugaagcuaucguaaaauu

SEQ ID NO: 3387201 - RNA, 23 nt, Human
ccugaagcuaucguaaaauuaag

SEQ ID NO: 3387202 - RNA, 14 nt, Human
ccugaaggccccgc

SEQ ID NO: 3387203 - RNA, 22 nt, Human
ccugaaggccccgcccaggcuu

SEQ ID NO: 3387204 - RNA, 16 nt, Human
ccugaagucacacagu

SEQ ID NO: 3387205 - RNA, 17 nt, Human
ccugaagucacacagug

SEQ ID NO: 3387206 - RNA, 17 nt, Human
ccugaaguucaccauua

SEQ ID NO: 3387207 - RNA, 15 nt, Human
ccugaauaaagagcc

SEQ ID NO: 3387208 - RNA, 22 nt, Human
ccugaauagcucccagauuuca

SEQ ID NO: 3387209 - RNA, 14 nt, Human
ccugaaucaugagc

SEQ ID NO: 3387210 - RNA, 20 nt, Human
ccugaauccaaacuaaucca

SEQ ID NO: 3387211 - RNA, 15 nt, Human
ccugaauucuuuuuc

SEQ ID NO: 3387212 - RNA, 19 nt, Human
ccugaauuuauuauuguuc

SEQ ID NO: 3387213 - RNA, 21 nt, Human
ccugaauuuuguugcuguuuu

SEQ ID NO: 3387214 - RNA, 13 nt, Human
ccugacaaauuuu

SEQ ID NO: 3387215 - RNA, 23 nt, Human
ccugacaacacucauugaccuga

SEQ ID NO: 3387216 - RNA, 18 nt, Human
ccugacaaccacuggucu

SEQ ID NO: 3387217 - RNA, 19 nt, Human
ccugacaaccacuggucug

SEQ ID NO: 3387218 - RNA, 18 nt, Human
ccugacacaccaggcgcu

SEQ ID NO: 3387219 - RNA, 18 nt, Human
ccugacacaccugcagcc

SEQ ID NO: 3387220 - RNA, 14 nt, Human
ccugacacacuaac

SEQ ID NO: 3387221 - RNA, 14 nt, Human
ccugacaccccacu

SEQ ID NO: 3387222 - RNA, 14 nt, Human
ccugacacccuucu

SEQ ID NO: 3387223 - RNA, 22 nt, Human
ccugacacugcggggcuuggcu

SEQ ID NO: 3387224 - RNA, 14 nt, Human
ccugacacuuuaau

SEQ ID NO: 3387225 - RNA, 16 nt, Human
ccugacagaaggacuc

SEQ ID NO: 3387226 - RNA, 14 nt, Human
ccugacagaaggug

SEQ ID NO: 3387227 - RNA, 21 nt, Human
ccugacagaugucagccgagc

SEQ ID NO: 3387228 - RNA, 13 nt, Human
ccugacagccaga

SEQ ID NO: 3387229 - RNA, 20 nt, Human
ccugacagccagaacucugu

SEQ ID NO: 3387230 - RNA, 18 nt, Human
ccugacaucaaaaaaggc

SEQ ID NO: 3387231 - RNA, 14 nt, Human
ccugacaucacagc

SEQ ID NO: 3387232 - RNA, 17 nt, Human
ccugacaucacagcagc

SEQ ID NO: 3387233 - RNA, 20 nt, Human
ccugacaucacagcagccuc

SEQ ID NO: 3387234 - RNA, 17 nt, Human
ccugacauguccuucug

SEQ ID NO: 3387235 - RNA, 14 nt, Human
ccugaccacccucc

SEQ ID NO: 3387236 - RNA, 14 nt, Human
ccugaccagcugcu

SEQ ID NO: 3387237 - RNA, 15 nt, Human
ccugaccagcugcuc

SEQ ID NO: 3387238 - RNA, 23 nt, Human
ccugaccaguugcagucacucua

SEQ ID NO: 3387239 - RNA, 14 nt, Human
ccugacccaggccg

SEQ ID NO: 3387240 - RNA, 15 nt, Human
ccugacccaggccgc

SEQ ID NO: 3387241 - RNA, 20 nt, Human
ccugacccauugcuguuguc

SEQ ID NO: 3387242 - RNA, 14 nt, Human
ccugaccccugcuc

SEQ ID NO: 3387243 - RNA, 16 nt, Human
ccugaccccugcucag

SEQ ID NO: 3387244 - RNA, 18 nt, Human
ccugacccucaucuuucu

SEQ ID NO: 3387245 - RNA, 22 nt, Human
ccugacccucaucuuucuucca

SEQ ID NO: 3387246 - RNA, 17 nt, Human
ccugacccuguauauag

SEQ ID NO: 3387247 - RNA, 19 nt, Human
ccugacccuguauauagcc

SEQ ID NO: 3387248 - RNA, 16 nt, Human
ccugaccucacuguga

SEQ ID NO: 3387249 - RNA, 13 nt, Human
ccugaccucaggc

SEQ ID NO: 3387250 - RNA, 17 nt, Human
ccugaccucccagcccu

SEQ ID NO: 3387251 - RNA, 18 nt, Human
ccugaccucccagcccua

SEQ ID NO: 3387252 - RNA, 16 nt, Human
ccugaccucccccucc

SEQ ID NO: 3387253 - RNA, 13 nt, Human
ccugaccucuugc

SEQ ID NO: 3387254 - RNA, 19 nt, Human
ccugaccucuugcugucuc

SEQ ID NO: 3387255 - RNA, 23 nt, Human
ccugaccucuugcugucucugcu

SEQ ID NO: 3387256 - RNA, 14 nt, Human
ccugaccugugagc

SEQ ID NO: 3387257 - RNA, 21 nt, Human
ccugaccugugagcccagcug

SEQ ID NO: 3387258 - RNA, 17 nt, Human
ccugaccuuccuuccug

SEQ ID NO: 3387259 - RNA, 16 nt, Human
ccugacgaaacuggcc

SEQ ID NO: 3387260 - RNA, 21 nt, Human
ccugacgaaacuggccccgga

SEQ ID NO: 3387261 - RNA, 23 nt, Human
ccugacuauuauguuguuagaga

SEQ ID NO: 3387262 - RNA, 16 nt, Human
ccugacucaggcauca

SEQ ID NO: 3387263 - RNA, 16 nt, Human
ccugacucucugugac

SEQ ID NO: 3387264 - RNA, 17 nt, Human
ccugacucucugugacc

SEQ ID NO: 3387265 - RNA, 18 nt, Human
ccugacucucugugaccu

SEQ ID NO: 3387266 - RNA, 18 nt, Human
ccugacucugaaaucuga

SEQ ID NO: 3387267 - RNA, 12 nt, Human
ccugacucugcc

SEQ ID NO: 3387268 - RNA, 13 nt, Human
ccugacucugccc

SEQ ID NO: 3387269 - RNA, 16 nt, Human
ccugacucugcccccu

SEQ ID NO: 3387270 - RNA, 14 nt, Human
ccugacugcccagc

SEQ ID NO: 3387271 - RNA, 19 nt, Human
ccugacugggggcagacau

SEQ ID NO: 3387272 - RNA, 21 nt, Human
ccugacuggugcuauaggcug

SEQ ID NO: 3387273 - RNA, 13 nt, Human
ccugacugucucc

SEQ ID NO: 3387274 - RNA, 22 nt, Human
ccugacuucaggggcugcccgc

SEQ ID NO: 3387275 - RNA, 23 nt, Human
ccugacuucaggggcugcccgcu

SEQ ID NO: 3387276 - RNA, 15 nt, Human
ccugacuucuguuua

SEQ ID NO: 3387277 - RNA, 13 nt, Human
ccugacuuuucug

SEQ ID NO: 3387278 - RNA, 15 nt, Human
ccugagaaagcccug

SEQ ID NO: 3387279 - RNA, 15 nt, Human
ccugagacaaaugga

SEQ ID NO: 3387280 - RNA, 12 nt, Human
ccugagaccaca

SEQ ID NO: 3387281 - RNA, 18 nt, Human
ccugagaccacagagaga

SEQ ID NO: 3387282 - RNA, 13 nt, Human
ccugagacccagg

SEQ ID NO: 3387283 - RNA, 19 nt, Human
ccugagaccccuggccucc

SEQ ID NO: 3387284 - RNA, 20 nt, Human
ccugagagaaacugagguca

SEQ ID NO: 3387285 - RNA, 13 nt, Human
ccugagaggcagg

SEQ ID NO: 3387286 - RNA, 14 nt, Human
ccugagaggcaggc

SEQ ID NO: 3387287 - RNA, 18 nt, Human
ccugagaggcaggcauag

SEQ ID NO: 3387288 - RNA, 15 nt, Human
ccugagaggggaagc

SEQ ID NO: 3387289 - RNA, 22 nt, Human
ccugagagucagcucucugccc

SEQ ID NO: 3387290 - RNA, 23 nt, Human
ccugagagucagcucucugcccu

SEQ ID NO: 3387291 - RNA, 17 nt, Human
ccugagaucucugcagg

SEQ ID NO: 3387292 - RNA, 19 nt, Human
ccugagauggcccucuggu

SEQ ID NO: 3387293 - RNA, 20 nt, Human
ccugagauggcccucuggua

SEQ ID NO: 3387294 - RNA, 21 nt, Human
ccugagaugggcuucccaagg

SEQ ID NO: 3387295 - RNA, 17 nt, Human
ccugagauucagauguc

SEQ ID NO: 3387296 - RNA, 21 nt, Human
ccugagauuuauuaaagaaaa

SEQ ID NO: 3387297 - RNA, 23 nt, Human
ccugagauuuauuaaagaaaaaa

SEQ ID NO: 3387298 - RNA, 23 nt, Human
ccugagauuucaucugcucuccu

SEQ ID NO: 3387299 - RNA, 21 nt, Human
ccugagcaacagagugagacc

SEQ ID NO: 3387300 - RNA, 14 nt, Human
ccugagcaacucuu

SEQ ID NO: 3387301 - RNA, 23 nt, Human
ccugagcaacucuugauuaucca

SEQ ID NO: 3387302 - RNA, 20 nt, Human
ccugagcaaugucugugcua

SEQ ID NO: 3387303 - RNA, 17 nt, Human
ccugagcaccucccagc

SEQ ID NO: 3387304 - RNA, 21 nt, Human
ccugagcaccucccagccccu

SEQ ID NO: 3387305 - RNA, 18 nt, Human
ccugagcaguccuuggcc

SEQ ID NO: 3387306 - RNA, 13 nt, Human
ccugagccaagga

SEQ ID NO: 3387307 - RNA, 15 nt, Human
ccugagccagauuuc

SEQ ID NO: 3387308 - RNA, 18 nt, Human
ccugagccagauuucacu

SEQ ID NO: 3387309 - RNA, 15 nt, Human
ccugagccagggucu

SEQ ID NO: 3387310 - RNA, 15 nt, Human
ccugagcccacugug

SEQ ID NO: 3387311 - RNA, 12 nt, Human
ccugagcccagg

SEQ ID NO: 3387312 - RNA, 19 nt, Human
ccugagcccagggaggccg

SEQ ID NO: 3387313 - RNA, 21 nt, Human
ccugagccccagggagagggg

SEQ ID NO: 3387314 - RNA, 23 nt, Human
ccugagccccagggugcccagaa

SEQ ID NO: 3387315 - RNA, 15 nt, Human
ccugagcccccagcu

SEQ ID NO: 3387316 - RNA, 18 nt, Human
ccugagccccgcccucuu

SEQ ID NO: 3387317 - RNA, 22 nt, Human
ccugagccccgcccucuuccug

SEQ ID NO: 3387318 - RNA, 13 nt, Human
ccugagccccuuc

SEQ ID NO: 3387319 - RNA, 14 nt, Human
ccugagccccuucc

SEQ ID NO: 3387320 - RNA, 20 nt, Human
ccugagccccuuccuugcuc

SEQ ID NO: 3387321 - RNA, 23 nt, Human
ccugagccccuuccuugcucugc

SEQ ID NO: 3387322 - RNA, 17 nt, Human
ccugagcccuacucccu

SEQ ID NO: 3387323 - RNA, 21 nt, Human
ccugagcccuacucccugcag

SEQ ID NO: 3387324 - RNA, 15 nt, Human
ccugagccugccgag

SEQ ID NO: 3387325 - RNA, 16 nt, Human
ccugagccugccgagc

SEQ ID NO: 3387326 - RNA, 17 nt, Human
ccugagccugccgagca

SEQ ID NO: 3387327 - RNA, 12 nt, Human
ccugagccuggc

SEQ ID NO: 3387328 - RNA, 13 nt, Human
ccugagccuggcc

SEQ ID NO: 3387329 - RNA, 14 nt, Human
ccugagccuggcca

SEQ ID NO: 3387330 - RNA, 22 nt, Human
ccugagcgaguggagucugcca

SEQ ID NO: 3387331 - RNA, 23 nt, Human
ccugagcgaguggagucugccac

SEQ ID NO: 3387332 - RNA, 17 nt, Human
ccugagcgccugggucc

SEQ ID NO: 3387333 - RNA, 23 nt, Human
ccugagcgcuccugccgcagagc

SEQ ID NO: 3387334 - RNA, 21 nt, Human
ccugagcuagaagcuggagga

SEQ ID NO: 3387335 - RNA, 18 nt, Human
ccugagcuaggaagaguc

SEQ ID NO: 3387336 - RNA, 13 nt, Human
ccugagcucacuc

SEQ ID NO: 3387337 - RNA, 14 nt, Human
ccugagcucacuga

SEQ ID NO: 3387338 - RNA, 22 nt, Human
ccugagcucgguggacccaggg

SEQ ID NO: 3387339 - RNA, 14 nt, Human
ccugagcuuuaugg

SEQ ID NO: 3387340 - RNA, 16 nt, Human
ccugagcuuucugcua

SEQ ID NO: 3387341 - RNA, 17 nt, Human
cuggugggcaccaagag

SEQ ID NO: 3387342 - RNA, 22 nt, Human
cugguggggauaggccagccgc

SEQ ID NO: 3387343 - RNA, 15 nt, Human
cugguggggcagcuc

SEQ ID NO: 3387344 - RNA, 16 nt, Human
cugguggggcagcucc

SEQ ID NO: 3387345 - RNA, 22 nt, Human
cuggugggugaaagaaaucaug

SEQ ID NO: 3387346 - RNA, 18 nt, Human
cuggugggugccuaggcc

SEQ ID NO: 3387347 - RNA, 19 nt, Human
cugguggucagcccuagga

SEQ ID NO: 3387348 - RNA, 14 nt, Human
cuggugguggcucg

SEQ ID NO: 3387349 - RNA, 22 nt, Human
cuggugguggcucgggaggcga

SEQ ID NO: 3387350 - RNA, 12 nt, Human
cuggugguucac

SEQ ID NO: 3387351 - RNA, 20 nt, Human
cuggugguugcuguuuuccu

SEQ ID NO: 3387352 - RNA, 18 nt, Human
cuggugguuucacggugc

SEQ ID NO: 3387353 - RNA, 20 nt, Human
cuggugguuucacggugcca

SEQ ID NO: 3387354 - RNA, 12 nt, Human
cugggcagaagg

SEQ ID NO: 3387355 - RNA, 15 nt, Human
cugggcagaaggaag

SEQ ID NO: 3387356 - RNA, 13 nt, Human
cugggcagaggaa

SEQ ID NO: 3387357 - RNA, 18 nt, Human
cugggcagcauagcaaga

SEQ ID NO: 3387358 - RNA, 16 nt, Human
cugggcagcugccucc

SEQ ID NO: 3387359 - RNA, 19 nt, Human
cugggcagcugccuccccu

SEQ ID NO: 3387360 - RNA, 22 nt, Human
cugggcagcugccuccccuccu

SEQ ID NO: 3387361 - RNA, 21 nt, Human
cugggcagcuguuagagucca

SEQ ID NO: 3387362 - RNA, 16 nt, Human
cugggcauagaugcag

SEQ ID NO: 3387363 - RNA, 23 nt, Human
cugggcauagaugcaggugagcc

SEQ ID NO: 3387364 - RNA, 14 nt, Human
cugggcaucuguuc

SEQ ID NO: 3387365 - RNA, 17 nt, Human
cugggcaucuguucugg

SEQ ID NO: 3387366 - RNA, 18 nt, Human
cugggcaucuguucuggu

SEQ ID NO: 3387367 - RNA, 21 nt, Human
cugggcaugguaccagcccug

SEQ ID NO: 3387368 - RNA, 22 nt, Human
cugggcaugguaccagcccugg

SEQ ID NO: 3387369 - RNA, 12 nt, Human
cugggcauuuuc

SEQ ID NO: 3387370 - RNA, 20 nt, Human
cugggccaaguuccucuagu

SEQ ID NO: 3387371 - RNA, 21 nt, Human
cugggccaaguuccucuagug

SEQ ID NO: 3387372 - RNA, 22 nt, Human
cugggccaauucaauacaaaca

SEQ ID NO: 3387373 - RNA, 14 nt, Human
cugggccagaauuu

SEQ ID NO: 3387374 - RNA, 13 nt, Human
cugggccagagua

SEQ ID NO: 3387375 - RNA, 20 nt, Human
cugggccaggggagguuaca

SEQ ID NO: 3387376 - RNA, 14 nt, Human
cugggccagggucu

SEQ ID NO: 3387377 - RNA, 15 nt, Human
cugggccagggucug

SEQ ID NO: 3387378 - RNA, 20 nt, Human
cugggccagggucuguguga

SEQ ID NO: 3387379 - RNA, 18 nt, Human
cugggccauguccaaaga

SEQ ID NO: 3387380 - RNA, 19 nt, Human
cugggccauguccaaagag

SEQ ID NO: 3387381 - RNA, 19 nt, Human
cugggccauguugugccuc

SEQ ID NO: 3387382 - RNA, 20 nt, Human
cugggccauguugugccucc

SEQ ID NO: 3387383 - RNA, 19 nt, Human
cugggccauucuccacagc

SEQ ID NO: 3387384 - RNA, 14 nt, Human
cugggcccaacccu

SEQ ID NO: 3387385 - RNA, 18 nt, Human
cugggcccaacccugucu

SEQ ID NO: 3387386 - RNA, 19 nt, Human
cugggcccaacccugucug

SEQ ID NO: 3387387 - RNA, 21 nt, Human
cugggcccacccaagcaggag

SEQ ID NO: 3387388 - RNA, 18 nt, Human
cugggcccagaggcacag

SEQ ID NO: 3387389 - RNA, 19 nt, Human
cugggcccagaggcacagc

SEQ ID NO: 3387390 - RNA, 20 nt, Human
cugggcccagaggcacagcc

SEQ ID NO: 3387391 - RNA, 21 nt, Human
cugggcccagaggcacagccg

SEQ ID NO: 3387392 - RNA, 22 nt, Human
cugggcccagaggcacagccgg

SEQ ID NO: 3387393 - RNA, 18 nt, Human
cugggccccagcccaccc

SEQ ID NO: 3387394 - RNA, 13 nt, Human
cugggccccagcu

SEQ ID NO: 3387395 - RNA, 15 nt, Human
cugggccccaguugu

SEQ ID NO: 3387396 - RNA, 19 nt, Human
cugggccccccagcucagg

SEQ ID NO: 3387397 - RNA, 20 nt, Human
cugggccccucccuaccuca

SEQ ID NO: 3387398 - RNA, 20 nt, Human
cugggccccugccucucugc

SEQ ID NO: 3387399 - RNA, 21 nt, Human
cugggcccgacauggcuccgg

SEQ ID NO: 3387400 - RNA, 13 nt, Human
cugggcccucucu

SEQ ID NO: 3387401 - RNA, 14 nt, Human
cugggcccucucuu

SEQ ID NO: 3387402 - RNA, 13 nt, Human
cugggcccugggc

SEQ ID NO: 3387403 - RNA, 15 nt, Human
cugggcccugggcug

SEQ ID NO: 3387404 - RNA, 17 nt, Human
cugggcccuggggccug

SEQ ID NO: 3387405 - RNA, 20 nt, Human
cugggcccuggggccuguac

SEQ ID NO: 3387406 - RNA, 21 nt, Human
cugggccguaucuccggcucc

SEQ ID NO: 3387407 - RNA, 12 nt, Human
cugggccuaugg

SEQ ID NO: 3387408 - RNA, 16 nt, Human
cugggccuauggagag

SEQ ID NO: 3387409 - RNA, 18 nt, Human
cugggccuauggagagcc

SEQ ID NO: 3387410 - RNA, 13 nt, Human
cugggccugcaga

SEQ ID NO: 3387411 - RNA, 16 nt, Human
cugggccugccucacc

SEQ ID NO: 3387412 - RNA, 17 nt, Human
cugggccugcugcugag

SEQ ID NO: 3387413 - RNA, 18 nt, Human
cugggccugcugcugaga

SEQ ID NO: 3387414 - RNA, 22 nt, Human
cugggccugcugcugagaaccu

SEQ ID NO: 3387415 - RNA, 12 nt, Human
cugggccuggcu

SEQ ID NO: 3387416 - RNA, 20 nt, Human
cugggccuggcucccucacu

SEQ ID NO: 3387417 - RNA, 22 nt, Human
cugggccuggcucccucacucu

SEQ ID NO: 3387418 - RNA, 12 nt, Human
cugggccugggc

SEQ ID NO: 3387419 - RNA, 13 nt, Human
cugggccugggcu

SEQ ID NO: 3387420 - RNA, 14 nt, Human
cugggccuuaggaa

SEQ ID NO: 3387421 - RNA, 18 nt, Human
cugggccuuaggaagagc

SEQ ID NO: 3387422 - RNA, 14 nt, Human
cugggcgcccugga

SEQ ID NO: 3387423 - RNA, 17 nt, Human
cugggcggcugugcuuc

SEQ ID NO: 3387424 - RNA, 14 nt, Human
cugggcuauggaca

SEQ ID NO: 3387425 - RNA, 15 nt, Human
cugggcuauggacac

SEQ ID NO: 3387426 - RNA, 20 nt, Human
cugggcuauggacacagggu

SEQ ID NO: 3387427 - RNA, 13 nt, Human
cugggcucaagca

SEQ ID NO: 3387428 - RNA, 19 nt, Human
cugggcucccuucccaccu

SEQ ID NO: 3387429 - RNA, 20 nt, Human
cugggcucccuucccaccuc

SEQ ID NO: 3387430 - RNA, 14 nt, Human
cugggcuccuccag

SEQ ID NO: 3387431 - RNA, 15 nt, Human
cugggcuccuccagg

SEQ ID NO: 3387432 - RNA, 13 nt, Human
cugggcuccugga

SEQ ID NO: 3387433 - RNA, 17 nt, Human
cugggcucggaggcugc

SEQ ID NO: 3387434 - RNA, 12 nt, Human
cugggcucucca

SEQ ID NO: 3387435 - RNA, 18 nt, Human
cugggcucuccaccucag

SEQ ID NO: 3387436 - RNA, 22 nt, Human
cugggcucugcaauuccccucu

SEQ ID NO: 3387437 - RNA, 14 nt, Human
cugggcucugccac

SEQ ID NO: 3387438 - RNA, 15 nt, Human
cugggcucugccacc

SEQ ID NO: 3387439 - RNA, 13 nt, Human
cugggcucugccc

SEQ ID NO: 3387440 - RNA, 18 nt, Human
cugggcucugccccagcu

SEQ ID NO: 3387441 - RNA, 18 nt, Human
cugggcucugggagcagc

SEQ ID NO: 3387442 - RNA, 16 nt, Human
cugggcucugugggcu

SEQ ID NO: 3387443 - RNA, 15 nt, Human
cugggcugacuggga

SEQ ID NO: 3387444 - RNA, 13 nt, Human
cugggcugagccc

SEQ ID NO: 3387445 - RNA, 23 nt, Human
cugggcugagggagccuggcccc

SEQ ID NO: 3387446 - RNA, 23 nt, Human
cugggcugccaugugaagaggga

SEQ ID NO: 3387447 - RNA, 17 nt, Human
cugggcugcucucacau

SEQ ID NO: 3387448 - RNA, 20 nt, Human
cugggcuggaugagcuccca

SEQ ID NO: 3387449 - RNA, 12 nt, Human
cugggcuggcuc

SEQ ID NO: 3387450 - RNA, 16 nt, Human
cugggcuggcucccuc

SEQ ID NO: 3387451 - RNA, 20 nt, Human
cugggcuggggccugauggg

SEQ ID NO: 3387452 - RNA, 12 nt, Human
cugggcugggug

SEQ ID NO: 3387453 - RNA, 22 nt, Human
cugggcugggugcgaccccauc

SEQ ID NO: 3387454 - RNA, 22 nt, Human
cugggcuuauaucuggccucug

SEQ ID NO: 3387455 - RNA, 18 nt, Human
cugggcuucaguggcagc

SEQ ID NO: 3387456 - RNA, 21 nt, Human
cugggcuucaguggcagcugc

SEQ ID NO: 3387457 - RNA, 24 nt, Human
cugggcuucaguggcagcugcuuu

SEQ ID NO: 3387458 - RNA, 19 nt, Human
cugggcuuccuggagcaga

SEQ ID NO: 3387459 - RNA, 15 nt, Human
cugggcuuggccugc

SEQ ID NO: 3387460 - RNA, 18 nt, Human
cugggcuuggccugcugu

SEQ ID NO: 3387461 - RNA, 21 nt, Human
cugggcuuggggaccagagcu

SEQ ID NO: 3387462 - RNA, 19 nt, Human
cugggcuuggggcuuccua

SEQ ID NO: 3387463 - RNA, 21 nt, Human
cugggcuuugauuccaucucc

SEQ ID NO: 3387464 - RNA, 18 nt, Human
cuggggaaagacacugcc

SEQ ID NO: 3387465 - RNA, 22 nt, Human
cuggggaaagacacugccuggg

SEQ ID NO: 3387466 - RNA, 22 nt, Human
cuggggaaauaacagcuguggc

SEQ ID NO: 3387467 - RNA, 15 nt, Human
cuggggaaccugacc

SEQ ID NO: 3387468 - RNA, 14 nt, Human
cuggggaagacagu

SEQ ID NO: 3387469 - RNA, 13 nt, Human
cuggggaagcaaa

SEQ ID NO: 3387470 - RNA, 13 nt, Human
cuggggaaggaag

SEQ ID NO: 3387471 - RNA, 12 nt, Human
cuggggaaggag

SEQ ID NO: 3387472 - RNA, 23 nt, Human
cuggggacggggggccccaguca

SEQ ID NO: 3387473 - RNA, 19 nt, Human
cuggggacuuggccucucu

SEQ ID NO: 3387474 - RNA, 11 nt, Human
cuggggagcag

SEQ ID NO: 3387475 - RNA, 16 nt, Human
cuggggagcaggcagc

SEQ ID NO: 3387476 - RNA, 17 nt, Human
cuggggagcaggcagcc

SEQ ID NO: 3387477 - RNA, 14 nt, Human
cuggggagcggguc

SEQ ID NO: 3387478 - RNA, 20 nt, Human
cuggggagugggacagaguc

SEQ ID NO: 3387479 - RNA, 14 nt, Human
cuggggauccccgc

SEQ ID NO: 3387480 - RNA, 16 nt, Human
cuggggaugugggagg

SEQ ID NO: 3387481 - RNA, 16 nt, Human
cuggggcacaguccag

SEQ ID NO: 3387482 - RNA, 19 nt, Human
cuggggcacaguccaggaa

SEQ ID NO: 3387483 - RNA, 21 nt, Human
cuggggcacuuggcagcgcgg

SEQ ID NO: 3387484 - RNA, 18 nt, Human
cuggggcagacaauaaac

SEQ ID NO: 3387485 - RNA, 14 nt, Human
cuggggcagccucu

SEQ ID NO: 3387486 - RNA, 14 nt, Human
cugucuguguuuuu

SEQ ID NO: 3387487 - RNA, 19 nt, Human
cugucuguuguauucauug

SEQ ID NO: 3387488 - RNA, 19 nt, Human
cugucuuaaacuaaaugug

SEQ ID NO: 3387489 - RNA, 23 nt, Human
cugucuuaauuaaguaaacuaau

SEQ ID NO: 3387490 - RNA, 14 nt, Human
cugucuucaagggc

SEQ ID NO: 3387491 - RNA, 22 nt, Human
cugucuucaccugauucaacua

SEQ ID NO: 3387492 - RNA, 18 nt, Human
cugucuucaguaagccgu

SEQ ID NO: 3387493 - RNA, 12 nt, Human
cugucuucccag

SEQ ID NO: 3387494 - RNA, 15 nt, Human
cugucuucccagggu

SEQ ID NO: 3387495 - RNA, 18 nt, Human
cugucuucccaggguagc

SEQ ID NO: 3387496 - RNA, 14 nt, Human
cugucuuccugcau

SEQ ID NO: 3387497 - RNA, 12 nt, Human
cugucuuccuuu

SEQ ID NO: 3387498 - RNA, 14 nt, Human
cugucuucuggacu

SEQ ID NO: 3387499 - RNA, 19 nt, Human
cugucuucuguauauaaau

SEQ ID NO: 3387500 - RNA, 21 nt, Human
cugucuucuucaggguccuga

SEQ ID NO: 3387501 - RNA, 23 nt, Human
cugucuugccuuuuucauuauuu

SEQ ID NO: 3387502 - RNA, 13 nt, Human
cugucuuguaaua

SEQ ID NO: 3387503 - RNA, 20 nt, Human
cugucuuguaauauuuugua

SEQ ID NO: 3387504 - RNA, 22 nt, Human
cugucuuguaauauuuuguauu

SEQ ID NO: 3387505 - RNA, 22 nt, Human
cugucuuguugcggauggaugg

SEQ ID NO: 3387506 - RNA, 16 nt, Human
cugucuuuaauucugu

SEQ ID NO: 3387507 - RNA, 11 nt, Human
cugucuuuccu

SEQ ID NO: 3387508 - RNA, 14 nt, Human
cugucuuuccuaga

SEQ ID NO: 3387509 - RNA, 15 nt, Human
cugucuuucuugcuc

SEQ ID NO: 3387510 - RNA, 17 nt, Human
cugucuuucuugcuccc

SEQ ID NO: 3387511 - RNA, 14 nt, Human
cugucuuuuaaacu

SEQ ID NO: 3387512 - RNA, 21 nt, Human
cugucuuuucagguuugucau

SEQ ID NO: 3387513 - RNA, 19 nt, Human
cugugaaaaaaaaaaugcu

SEQ ID NO: 3387514 - RNA, 23 nt, Human
cugugaaacuggcacugaauuaa

SEQ ID NO: 3387515 - RNA, 22 nt, Human
cugugaaaggaaagagggaggu

SEQ ID NO: 3387516 - RNA, 23 nt, Human
cugugaaauaucaucacguaugu

SEQ ID NO: 3387517 - RNA, 20 nt, Human
cugugaacaagcuucaguaa

SEQ ID NO: 3387518 - RNA, 17 nt, Human
cugugaacccaggacaa

SEQ ID NO: 3387519 - RNA, 22 nt, Human
cugugaacccaggacaagcaug

SEQ ID NO: 3387520 - RNA, 18 nt, Human
cugugaacgauuuagaaa

SEQ ID NO: 3387521 - RNA, 22 nt, Human
cugugaacgauuuagaaagaag

SEQ ID NO: 3387522 - RNA, 15 nt, Human
cugugaacugaacuc

SEQ ID NO: 3387523 - RNA, 18 nt, Human
cugugaacuugaaauuug

SEQ ID NO: 3387524 - RNA, 15 nt, Human
cugugaacuugggga

SEQ ID NO: 3387525 - RNA, 20 nt, Human
cugugaagaucucacucugc

SEQ ID NO: 3387526 - RNA, 17 nt, Human
cugugaagugagaccuu

SEQ ID NO: 3387527 - RNA, 15 nt, Human
cugugaaugccacug

SEQ ID NO: 3387528 - RNA, 13 nt, Human
cugugaauuaagc

SEQ ID NO: 3387529 - RNA, 14 nt, Human
cugugaauucagau

SEQ ID NO: 3387530 - RNA, 19 nt, Human
cugugaauugagcugcaga

SEQ ID NO: 3387531 - RNA, 22 nt, Human
cugugacacacuacaccacaca

SEQ ID NO: 3387532 - RNA, 17 nt, Human
cugugacaggcagcaga

SEQ ID NO: 3387533 - RNA, 13 nt, Human
cugugacauguaa

SEQ ID NO: 3387534 - RNA, 15 nt, Human
cugugaccaaugucu

SEQ ID NO: 3387535 - RNA, 16 nt, Human
cugugaccaaugucuu

SEQ ID NO: 3387536 - RNA, 14 nt, Human
cugugaccauuuau

SEQ ID NO: 3387537 - RNA, 17 nt, Human
cugugaccauuuauaau

SEQ ID NO: 3387538 - RNA, 12 nt, Human
cugugacccacu

SEQ ID NO: 3387539 - RNA, 21 nt, Human
cugugacccucaauucauauu

SEQ ID NO: 3387540 - RNA, 14 nt, Human
cugugaccucaggc

SEQ ID NO: 3387541 - RNA, 23 nt, Human
cugugaccucaggcacuagccuu

SEQ ID NO: 3387542 - RNA, 17 nt, Human
cugugaccucuccccug

SEQ ID NO: 3387543 - RNA, 15 nt, Human
cugugaccugcaucu

SEQ ID NO: 3387544 - RNA, 18 nt, Human
cugugaccugcugagcuc

SEQ ID NO: 3387545 - RNA, 22 nt, Human
cugugaccugcugagcucugag

SEQ ID NO: 3387546 - RNA, 17 nt, Human
cugugacuaggaaaaaa

SEQ ID NO: 3387547 - RNA, 14 nt, Human
cugugacucuuuuu

SEQ ID NO: 3387548 - RNA, 22 nt, Human
cugugacugauguuaggcuggg

SEQ ID NO: 3387549 - RNA, 16 nt, Human
cugugacuucuccagg

SEQ ID NO: 3387550 - RNA, 21 nt, Human
cugugacuucuccaggucuca

SEQ ID NO: 3387551 - RNA, 17 nt, Human
cugugagaagguuuauu

SEQ ID NO: 3387552 - RNA, 12 nt, Human
cugugagacagu

SEQ ID NO: 3387553 - RNA, 22 nt, Human
ccugcugccauguggacuggug

SEQ ID NO: 3387554 - RNA, 22 nt, Human
ccugcugcccaaucuccaucug

SEQ ID NO: 3387555 - RNA, 22 nt, Human
ccugcugcccaggcugugcagc

SEQ ID NO: 3387556 - RNA, 13 nt, Human
ccugcugcccucc

SEQ ID NO: 3387557 - RNA, 18 nt, Human
ccugcugcccucccccuc

SEQ ID NO: 3387558 - RNA, 18 nt, Human
ccugcugccgccucccag

SEQ ID NO: 3387559 - RNA, 22 nt, Human
ccugcugccgccucccagccug

SEQ ID NO: 3387560 - RNA, 23 nt, Human
ccugcugccgccucccagccugg

SEQ ID NO: 3387561 - RNA, 13 nt, Human
ccugcugccuccc

SEQ ID NO: 3387562 - RNA, 12 nt, Human
ccugcugcuccc

SEQ ID NO: 3387563 - RNA, 18 nt, Human
ccugcugcucccucagac

SEQ ID NO: 3387564 - RNA, 16 nt, Human
ccugcugcugagaacc

SEQ ID NO: 3387565 - RNA, 17 nt, Human
ccugcugcugagaaccu

SEQ ID NO: 3387566 - RNA, 18 nt, Human
ccugcugcugccugccug

SEQ ID NO: 3387567 - RNA, 19 nt, Human
ccugcugcuggugcacagc

SEQ ID NO: 3387568 - RNA, 20 nt, Human
ccugcugcugucaccucucc

SEQ ID NO: 3387569 - RNA, 23 nt, Human
ccugcugcugucugggugcuacu

SEQ ID NO: 3387570 - RNA, 14 nt, Human
ccugcugcuucucc

SEQ ID NO: 3387571 - RNA, 16 nt, Human
ccugcugcuucuccaa

SEQ ID NO: 3387572 - RNA, 14 nt, Human
ccugcuggaggccu

SEQ ID NO: 3387573 - RNA, 18 nt, Human
ccugcuggaggccucagg

SEQ ID NO: 3387574 - RNA, 16 nt, Human
ccugcuggaucuccca

SEQ ID NO: 3387575 - RNA, 9 nt, Human
ccugcuggc

SEQ ID NO: 3387576 - RNA, 15 nt, Human
ccugcuggcacccac

SEQ ID NO: 3387577 - RNA, 14 nt, Human
ccugcuggccccuc

SEQ ID NO: 3387578 - RNA, 16 nt, Human
ccugcuggccccucac

SEQ ID NO: 3387579 - RNA, 13 nt, Human
ccugcuggccgcc

SEQ ID NO: 3387580 - RNA, 19 nt, Human
ccugcuggccgccucaccc

SEQ ID NO: 3387581 - RNA, 21 nt, Human
ccugcuggccggacacccgac

SEQ ID NO: 3387582 - RNA, 17 nt, Human
ccugcugggcucuccac

SEQ ID NO: 3387583 - RNA, 18 nt, Human
ccugcugggcucuccacc

SEQ ID NO: 3387584 - RNA, 21 nt, Human
ccugcugggcucuccaccuca

SEQ ID NO: 3387585 - RNA, 13 nt, Human
ccugcuggggauc

SEQ ID NO: 3387586 - RNA, 21 nt, Human
ccugcuggggauccccgccug

SEQ ID NO: 3387587 - RNA, 17 nt, Human
ccugcuggguaaacugu

SEQ ID NO: 3387588 - RNA, 21 nt, Human
ccugcuggguguggcgcagca

SEQ ID NO: 3387589 - RNA, 12 nt, Human
ccugcuggucaa

SEQ ID NO: 3387590 - RNA, 17 nt, Human
ccugcuggucacagccu

SEQ ID NO: 3387591 - RNA, 18 nt, Human
ccugcuggucacagccuc

SEQ ID NO: 3387592 - RNA, 20 nt, Human
ccugcugucauugcuucuuc

SEQ ID NO: 3387593 - RNA, 19 nt, Human
ccugcugugaaagaaguaa

SEQ ID NO: 3387594 - RNA, 23 nt, Human
ccugcugugauuccacuacaccu

SEQ ID NO: 3387595 - RNA, 14 nt, Human
ccugcuucaaauau

SEQ ID NO: 3387596 - RNA, 22 nt, Human
ccugcuucagauguggagccag

SEQ ID NO: 3387597 - RNA, 24 nt, Human
ccugcuucagucccuuccccaugc

SEQ ID NO: 3387598 - RNA, 14 nt, Human
ccugcuucaugcuc

SEQ ID NO: 3387599 - RNA, 17 nt, Human
ccugcuucaugcucagc

SEQ ID NO: 3387600 - RNA, 14 nt, Human
ccugcuuccaggaa

SEQ ID NO: 3387601 - RNA, 21 nt, Human
ccugcuucccaccucccugcc

SEQ ID NO: 3387602 - RNA, 17 nt, Human
ccugcuucuccagccug

SEQ ID NO: 3387603 - RNA, 15 nt, Human
ccugcuucucugccc

SEQ ID NO: 3387604 - RNA, 22 nt, Human
ccugcuugaugggauucuggac

SEQ ID NO: 3387605 - RNA, 15 nt, Human
ccugcuugccaaggc

SEQ ID NO: 3387606 - RNA, 17 nt, Human
ccugcuugccaaggcag

SEQ ID NO: 3387607 - RNA, 18 nt, Human
ccugcuugccaaggcaga

SEQ ID NO: 3387608 - RNA, 14 nt, Human
ccugcuuggcccag

SEQ ID NO: 3387609 - RNA, 23 nt, Human
ccugcuuggguggagaagccauu

SEQ ID NO: 3387610 - RNA, 15 nt, Human
ccugcuugucccugc

SEQ ID NO: 3387611 - RNA, 23 nt, Human
ccugcuuuagaauguuuuccuuc

SEQ ID NO: 3387612 - RNA, 15 nt, Human
ccugcuuucagauac

SEQ ID NO: 3387613 - RNA, 21 nt, Human
ccugcuuucagauacuggauu

SEQ ID NO: 3387614 - RNA, 15 nt, Human
ccugcuuuggcgggc

SEQ ID NO: 3387615 - RNA, 23 nt, Human
ccugcuuugggcugcccuggugc

SEQ ID NO: 3387616 - RNA, 20 nt, Human
ccugcuuuuuauggccugug

SEQ ID NO: 3387617 - RNA, 16 nt, Human
ccugcuuuuugaaaug

SEQ ID NO: 3387618 - RNA, 17 nt, Human
ccugcuuuuugaaauga

SEQ ID NO: 3387619 - RNA, 23 nt, Human
ccugcuuuuugaaaugaaauuua

SEQ ID NO: 3387620 - RNA, 12 nt, Human
ccuggaaaccac

SEQ ID NO: 3387621 - RNA, 15 nt, Human
ccuggaaaccacagu

SEQ ID NO: 3387622 - RNA, 15 nt, Human
ccuggaaaggcucag

SEQ ID NO: 3387623 - RNA, 22 nt, Human
ccuggaaauaucaguuacucag

SEQ ID NO: 3387624 - RNA, 23 nt, Human
ccuggaaaucaggguuaguauug

SEQ ID NO: 3387625 - RNA, 19 nt, Human
ccuggaacaauauuuuaug

SEQ ID NO: 3387626 - RNA, 22 nt, Human
ccuggaacaucaucaaggcacu

SEQ ID NO: 3387627 - RNA, 24 nt, Human
ccuggaacauccuuugcagggcag

SEQ ID NO: 3387628 - RNA, 18 nt, Human
ccuggaaccuugcugucc

SEQ ID NO: 3387629 - RNA, 20 nt, Human
ccuggaaccuugcuguccug

SEQ ID NO: 3387630 - RNA, 23 nt, Human
cugugcccacccuccacucuccu

SEQ ID NO: 3387631 - RNA, 19 nt, Human
cugugcccagaauacugau

SEQ ID NO: 3387632 - RNA, 17 nt, Human
cugugcccagagauggg

SEQ ID NO: 3387633 - RNA, 11 nt, Human
cugugcccagc

SEQ ID NO: 3387634 - RNA, 14 nt, Human
cugugcccagcuca

SEQ ID NO: 3387635 - RNA, 13 nt, Human
cugugcccccagg

SEQ ID NO: 3387636 - RNA, 20 nt, Human
cugugcccccaggguccugg

SEQ ID NO: 3387637 - RNA, 22 nt, Human
cugugcccccaggguccuggga

SEQ ID NO: 3387638 - RNA, 23 nt, Human
cugugcccccaggguccugggag

SEQ ID NO: 3387639 - RNA, 20 nt, Human
cugugccccuuccgccacug

SEQ ID NO: 3387640 - RNA, 23 nt, Human
cugugccccuuccgccacugggg

SEQ ID NO: 3387641 - RNA, 20 nt, Human
cugugccccuugacaacugg

SEQ ID NO: 3387642 - RNA, 14 nt, Human
cugugcccuccuga

SEQ ID NO: 3387643 - RNA, 16 nt, Human
cugugcccuccugacc

SEQ ID NO: 3387644 - RNA, 12 nt, Human
cugugcccuggu

SEQ ID NO: 3387645 - RNA, 21 nt, Human
cugugccucccuccccagugc

SEQ ID NO: 3387646 - RNA, 15 nt, Human
cugugccuccucccu

SEQ ID NO: 3387647 - RNA, 17 nt, Human
cugugccuccucccucc

SEQ ID NO: 3387648 - RNA, 18 nt, Human
cugugccuccucccuccc

SEQ ID NO: 3387649 - RNA, 21 nt, Human
cugugccuccucccucccucu

SEQ ID NO: 3387650 - RNA, 24 nt, Human
cugugccucgcuccccacucugcu

SEQ ID NO: 3387651 - RNA, 11 nt, Human
cugugccucug

SEQ ID NO: 3387652 - RNA, 12 nt, Human
cugugccucugc

SEQ ID NO: 3387653 - RNA, 13 nt, Human
cugugccucugcc

SEQ ID NO: 3387654 - RNA, 16 nt, Human
cugugccucugccugu

SEQ ID NO: 3387655 - RNA, 16 nt, Human
cugugccucugggacu

SEQ ID NO: 3387656 - RNA, 17 nt, Human
cugugccucugggacug

SEQ ID NO: 3387657 - RNA, 18 nt, Human
cugugccucugggacugg

SEQ ID NO: 3387658 - RNA, 13 nt, Human
cugugccuggagc

SEQ ID NO: 3387659 - RNA, 20 nt, Human
cugugccuugucacgccaga

SEQ ID NO: 3387660 - RNA, 21 nt, Human
cugugcgucuugguguaauuu

SEQ ID NO: 3387661 - RNA, 22 nt, Human
cugugcgucuugguguaauuug

SEQ ID NO: 3387662 - RNA, 16 nt, Human
cugugcgugaaacaca

SEQ ID NO: 3387663 - RNA, 14 nt, Human
cugugcguggggcu

SEQ ID NO: 3387664 - RNA, 22 nt, Human
cugugcguguguguguguguau

SEQ ID NO: 3387665 - RNA, 18 nt, Human
cugugcuaauaacagugc

SEQ ID NO: 3387666 - RNA, 22 nt, Human
cugugcuacugucuuuggaaaa

SEQ ID NO: 3387667 - RNA, 17 nt, Human
cugugcuacuuugccuu

SEQ ID NO: 3387668 - RNA, 15 nt, Human
cugugcuaugaauuu

SEQ ID NO: 3387669 - RNA, 16 nt, Human
cugugcuaugaauuuu

SEQ ID NO: 3387670 - RNA, 19 nt, Human
cugugcuauggugcucugu

SEQ ID NO: 3387671 - RNA, 21 nt, Human
cugugcuauggugcucugucu

SEQ ID NO: 3387672 - RNA, 17 nt, Human
cugugcucagaagggcu

SEQ ID NO: 3387673 - RNA, 13 nt, Human
cugugcucagaga

SEQ ID NO: 3387674 - RNA, 16 nt, Human
cugugcucagcccuga

SEQ ID NO: 3387675 - RNA, 15 nt, Human
cugugcucaggacuc

SEQ ID NO: 3387676 - RNA, 16 nt, Human
cugugcucaggacuca

SEQ ID NO: 3387677 - RNA, 19 nt, Human
cugugcuccauggcugcca

SEQ ID NO: 3387678 - RNA, 15 nt, Human
cugugcuccgugccu

SEQ ID NO: 3387679 - RNA, 16 nt, Human
cugugcucucaccagc

SEQ ID NO: 3387680 - RNA, 14 nt, Human
cugugcucuggaca

SEQ ID NO: 3387681 - RNA, 15 nt, Human
cugugcucuggacag

SEQ ID NO: 3387682 - RNA, 13 nt, Human
cugugcugaggcc

SEQ ID NO: 3387683 - RNA, 16 nt, Human
cugugcugaggccuua

SEQ ID NO: 3387684 - RNA, 21 nt, Human
cugugcugaggccuuaucauu

SEQ ID NO: 3387685 - RNA, 12 nt, Human
cugugcugaguc

SEQ ID NO: 3387686 - RNA, 19 nt, Human
cugugcugagucugaaggc

SEQ ID NO: 3387687 - RNA, 12 nt, Human
cugugcugcccu

SEQ ID NO: 3387688 - RNA, 13 nt, Human
cugugcugcccug

SEQ ID NO: 3387689 - RNA, 13 nt, Human
cugugcuggagcc

SEQ ID NO: 3387690 - RNA, 15 nt, Human
cugugcuggagccac

SEQ ID NO: 3387691 - RNA, 21 nt, Human
cugugcuggagccacuaacua

SEQ ID NO: 3387692 - RNA, 12 nt, Human
cugugcuggcca

SEQ ID NO: 3387693 - RNA, 14 nt, Human
cugugcugggagaa

SEQ ID NO: 3387694 - RNA, 12 nt, Human
cugugcuggugu

SEQ ID NO: 3387695 - RNA, 21 nt, Human
cugugcuguggaagcaacagg

SEQ ID NO: 3387696 - RNA, 17 nt, Human
cugugcuguuguuauga

SEQ ID NO: 3387697 - RNA, 14 nt, Human
cugugcuguuucaa

SEQ ID NO: 3387698 - RNA, 17 nt, Human
cugugcuucaauuaaua

SEQ ID NO: 3387699 - RNA, 17 nt, Human
cugugcuucgggcccuu

SEQ ID NO: 3387700 - RNA, 21 nt, Human
cugugcuucgggcccuuccca

SEQ ID NO: 3387701 - RNA, 16 nt, Human
cugugcuugaaggccc

SEQ ID NO: 3387702 - RNA, 20 nt, Human
cugugcuugaaggcccugcu

SEQ ID NO: 3387703 - RNA, 17 nt, Human
cugugcuuuccagcuca

SEQ ID NO: 3387704 - RNA, 22 nt, Human
cugugcuuuccagcucaccccc

SEQ ID NO: 3387705 - RNA, 19 nt, Human
cugugcuuucccugaacug

SEQ ID NO: 3387706 - RNA, 20 nt, Human
cugugcuuucuauuguacag

SEQ ID NO: 3387707 - RNA, 20 nt, Human
cuguggaaaguguaaagcau

SEQ ID NO: 3387708 - RNA, 18 nt, Human
cuguggaacauaaaaagg

SEQ ID NO: 3387709 - RNA, 21 nt, Human
cuguggaacauaaaaaggaca

SEQ ID NO: 3387710 - RNA, 12 nt, Human
cuguggaagcaa

SEQ ID NO: 3387711 - RNA, 18 nt, Human
cuguggaaucuggaguga

SEQ ID NO: 3387712 - RNA, 14 nt, Human
cuguggagacugcu

SEQ ID NO: 3387713 - RNA, 17 nt, Human
cuguggagacugcuccu

SEQ ID NO: 3387714 - RNA, 22 nt, Human
cuguggagacugcuccugagcc

SEQ ID NO: 3387715 - RNA, 23 nt, Human
cuguggaggaaggauuguaaaaa

SEQ ID NO: 3387716 - RNA, 17 nt, Human
cuguggaggauugcuau

SEQ ID NO: 3387717 - RNA, 14 nt, Human
cuguggaucaaauc

SEQ ID NO: 3387718 - RNA, 19 nt, Human
cuguacuccucccaggcgc

SEQ ID NO: 3387719 - RNA, 17 nt, Human
cuguacucgcuugugca

SEQ ID NO: 3387720 - RNA, 23 nt, Human
cuguacucuggggugcugccuga

SEQ ID NO: 3387721 - RNA, 21 nt, Human
cuguacugauucaauuugaug

SEQ ID NO: 3387722 - RNA, 15 nt, Human
cuguacugccugcuu

SEQ ID NO: 3387723 - RNA, 13 nt, Human
cuguacuggagag

SEQ ID NO: 3387724 - RNA, 17 nt, Human
cuguacuggagagcaac

SEQ ID NO: 3387725 - RNA, 18 nt, Human
cuguacuggagagcaaca

SEQ ID NO: 3387726 - RNA, 17 nt, Human
cuguacugugucucaug

SEQ ID NO: 3387727 - RNA, 20 nt, Human
cuguacuguuacugggcccu

SEQ ID NO: 3387728 - RNA, 16 nt, Human
cuguacuuaauaaauu

SEQ ID NO: 3387729 - RNA, 20 nt, Human
cuguacuucaaguuaaagug

SEQ ID NO: 3387730 - RNA, 17 nt, Human
cuguacuucuugaauau

SEQ ID NO: 3387731 - RNA, 14 nt, Human
cuguacuuuuuggc

SEQ ID NO: 3387732 - RNA, 13 nt, Human
cuguagaaauggu

SEQ ID NO: 3387733 - RNA, 22 nt, Human
cuguagaccuagggaggaccuu

SEQ ID NO: 3387734 - RNA, 13 nt, Human
cuguagaguggga

SEQ ID NO: 3387735 - RNA, 16 nt, Human
cuguagaguugcugag

SEQ ID NO: 3387736 - RNA, 16 nt, Human
cuguagauaauuaacc

SEQ ID NO: 3387737 - RNA, 18 nt, Human
cuguagauauguauucuu

SEQ ID NO: 3387738 - RNA, 16 nt, Human
cuguagaugauguauu

SEQ ID NO: 3387739 - RNA, 20 nt, Human
cuguagauucuguggaacaa

SEQ ID NO: 3387740 - RNA, 21 nt, Human
cuguagauugcuucuguagua

SEQ ID NO: 3387741 - RNA, 16 nt, Human
cuguagcaucuucugg

SEQ ID NO: 3387742 - RNA, 17 nt, Human
cuguagcaucuucugga

SEQ ID NO: 3387743 - RNA, 18 nt, Human
cuguagcaucuucuggag

SEQ ID NO: 3387744 - RNA, 16 nt, Human
cuguagcccacucugc

SEQ ID NO: 3387745 - RNA, 20 nt, Human
cuguagcccacucugcucgc

SEQ ID NO: 3387746 - RNA, 17 nt, Human
cuguagccccagugaca

SEQ ID NO: 3387747 - RNA, 20 nt, Human
cuguagccccagugacagcu

SEQ ID NO: 3387748 - RNA, 22 nt, Human
cuguagccuaaacuccaaacau

SEQ ID NO: 3387749 - RNA, 21 nt, Human
cuguagcuauaaugagcaugu

SEQ ID NO: 3387750 - RNA, 18 nt, Human
cuguaggaagguuaaugu

SEQ ID NO: 3387751 - RNA, 19 nt, Human
cuguaggaucuaaggcugu

SEQ ID NO: 3387752 - RNA, 12 nt, Human
cuguaggccuca

SEQ ID NO: 3387753 - RNA, 22 nt, Human
cuguaggccucaggugaaacuc

SEQ ID NO: 3387754 - RNA, 15 nt, Human
cuguagggcuggacc

SEQ ID NO: 3387755 - RNA, 15 nt, Human
cuguagguugcacac

SEQ ID NO: 3387756 - RNA, 20 nt, Human
cuguagguugcacacuuugg

SEQ ID NO: 3387757 - RNA, 20 nt, Human
cuguaguaaauaaugcuuug

SEQ ID NO: 3387758 - RNA, 22 nt, Human
cuguaguaaauaaugcuuugaa

SEQ ID NO: 3387759 - RNA, 14 nt, Human
cuguagucccagcc

SEQ ID NO: 3387760 - RNA, 22 nt, Human
cuguagucccagcuacucggga

SEQ ID NO: 3387761 - RNA, 16 nt, Human
cuguagugcuacaggg

SEQ ID NO: 3387762 - RNA, 20 nt, Human
cuguagugucacucaaggcg

SEQ ID NO: 3387763 - RNA, 16 nt, Human
cuguaguucuaagacu

SEQ ID NO: 3387764 - RNA, 20 nt, Human
cuguaguugcguggacucug

SEQ ID NO: 3387765 - RNA, 19 nt, Human
cuguauaaaaucagccaau

SEQ ID NO: 3387766 - RNA, 19 nt, Human
cuguauaaaggugugcugu

SEQ ID NO: 3387767 - RNA, 14 nt, Human
cuguauaaaugucu

SEQ ID NO: 3387768 - RNA, 14 nt, Human
cuguauaagcacug

SEQ ID NO: 3387769 - RNA, 13 nt, Human
cuguauaaguaag

SEQ ID NO: 3387770 - RNA, 15 nt, Human
cuguauaaguaagaa

SEQ ID NO: 3387771 - RNA, 21 nt, Human
cuguauaaguggaggcacuuu

SEQ ID NO: 3387772 - RNA, 22 nt, Human
cuguauaaguggaggcacuuua

SEQ ID NO: 3387773 - RNA, 15 nt, Human
cuguauaaguuauuu

SEQ ID NO: 3387774 - RNA, 22 nt, Human
cuguauaaguuauuuuuguaca

SEQ ID NO: 3387775 - RNA, 13 nt, Human
ccugucccccagc

SEQ ID NO: 3387776 - RNA, 17 nt, Human
ccugucccccagcucug

SEQ ID NO: 3387777 - RNA, 14 nt, Human
ccugucccccugac

SEQ ID NO: 3387778 - RNA, 17 nt, Human
ccuguccccucagcucc

SEQ ID NO: 3387779 - RNA, 13 nt, Human
ccuguccccugcu

SEQ ID NO: 3387780 - RNA, 18 nt, Human
ccugucccucccaccucu

SEQ ID NO: 3387781 - RNA, 15 nt, Human
ccugucccuggccau

SEQ ID NO: 3387782 - RNA, 23 nt, Human
ccugucccuucucuuaauuuaau

SEQ ID NO: 3387783 - RNA, 15 nt, Human
ccugucccuugaccu

SEQ ID NO: 3387784 - RNA, 21 nt, Human
ccuguccuaaggaaccuuccu

SEQ ID NO: 3387785 - RNA, 15 nt, Human
ccuguccucacugcu

SEQ ID NO: 3387786 - RNA, 21 nt, Human
ccuguccucacugcucccuga

SEQ ID NO: 3387787 - RNA, 15 nt, Human
ccuguccucagcuuc

SEQ ID NO: 3387788 - RNA, 17 nt, Human
ccuguccucccaucccc

SEQ ID NO: 3387789 - RNA, 21 nt, Human
ccuguccucccauccccugga

SEQ ID NO: 3387790 - RNA, 15 nt, Human
ccuguccuccucgga

SEQ ID NO: 3387791 - RNA, 16 nt, Human
ccuguccuccuggugg

SEQ ID NO: 3387792 - RNA, 17 nt, Human
ccuguccuccugguggg

SEQ ID NO: 3387793 - RNA, 16 nt, Human
ccuguccucuuucagc

SEQ ID NO: 3387794 - RNA, 18 nt, Human
ccuguccucuuucagcuc

SEQ ID NO: 3387795 - RNA, 22 nt, Human
ccuguccugauggucagcuccc

SEQ ID NO: 3387796 - RNA, 23 nt, Human
ccuguccugauggucagcucccu

SEQ ID NO: 3387797 - RNA, 17 nt, Human
ccuguccugccuaaggc

SEQ ID NO: 3387798 - RNA, 14 nt, Human
ccuguccugccugu

SEQ ID NO: 3387799 - RNA, 15 nt, Human
ccuguccugggcugg

SEQ ID NO: 3387800 - RNA, 18 nt, Human
ccugucgagacacuugcc

SEQ ID NO: 3387801 - RNA, 21 nt, Human
ccugucgaguucggcucuggg

SEQ ID NO: 3387802 - RNA, 22 nt, Human
ccugucgauuagacuggacagc

SEQ ID NO: 3387803 - RNA, 16 nt, Human
ccugucggagcccugu

SEQ ID NO: 3387804 - RNA, 17 nt, Human
ccugucggagcccuguc

SEQ ID NO: 3387805 - RNA, 14 nt, Human
ccugucuagagagg

SEQ ID NO: 3387806 - RNA, 16 nt, Human
ccugucuagucucucc

SEQ ID NO: 3387807 - RNA, 13 nt, Human
ccugucucagccu

SEQ ID NO: 3387808 - RNA, 17 nt, Human
ccugucucauccccagg

SEQ ID NO: 3387809 - RNA, 20 nt, Human
ccugucucauccccaggggu

SEQ ID NO: 3387810 - RNA, 15 nt, Human
ccugucuccccucug

SEQ ID NO: 3387811 - RNA, 18 nt, Human
ccugucuccccucugcug

SEQ ID NO: 3387812 - RNA, 17 nt, Human
ccugucucuacuaaaaa

SEQ ID NO: 3387813 - RNA, 22 nt, Human
ccugucucuuccauaugaccuc

SEQ ID NO: 3387814 - RNA, 23 nt, Human
ccugucugagacucacaggaagg

SEQ ID NO: 3387815 - RNA, 15 nt, Human
ccugucugccagcca

SEQ ID NO: 3387816 - RNA, 17 nt, Human
ccugucugccagccagc

SEQ ID NO: 3387817 - RNA, 23 nt, Human
ccugucugccagccagcagccag

SEQ ID NO: 3387818 - RNA, 15 nt, Human
ccugucugccagggc

SEQ ID NO: 3387819 - RNA, 20 nt, Human
ccugucugccccagcccaga

SEQ ID NO: 3387820 - RNA, 20 nt, Human
ccugucuguagagggcccug

SEQ ID NO: 3387821 - RNA, 22 nt, Human
ccugucugugaccugcaucuaa

SEQ ID NO: 3387822 - RNA, 17 nt, Human
ccugucuguuacacugg

SEQ ID NO: 3387823 - RNA, 17 nt, Human
ccugucuuauccuccac

SEQ ID NO: 3387824 - RNA, 16 nt, Human
ccugucuucccagggu

SEQ ID NO: 3387825 - RNA, 15 nt, Human
ccugucuuccugcau

SEQ ID NO: 3387826 - RNA, 17 nt, Human
ccugucuucugcuuugu

SEQ ID NO: 3387827 - RNA, 19 nt, Human
ccugucuugccuuuuucau

SEQ ID NO: 3387828 - RNA, 20 nt, Human
ccugucuugccuuuuucauu

SEQ ID NO: 3387829 - RNA, 16 nt, Human
ccugugaaugccacug

SEQ ID NO: 3387830 - RNA, 21 nt, Human
ccugugaaugccacugccuuc

SEQ ID NO: 3387831 - RNA, 18 nt, Human
ccugugacuucagcucug

SEQ ID NO: 3387832 - RNA, 17 nt, Human
ccugugagcccagcugg

SEQ ID NO: 3387833 - RNA, 13 nt, Human
ccugugagcugca

SEQ ID NO: 3387834 - RNA, 14 nt, Human
ccugugagcugcac

SEQ ID NO: 3387835 - RNA, 13 nt, Human
ccugugaggcagg

SEQ ID NO: 3387836 - RNA, 15 nt, Human
ccugugaguaaauau

SEQ ID NO: 3387837 - RNA, 16 nt, Human
ccugugaguaaauauu

SEQ ID NO: 3387838 - RNA, 17 nt, Human
ccugugaguaaauauug

SEQ ID NO: 3387839 - RNA, 20 nt, Human
ccugugauccacccaacccu

SEQ ID NO: 3387840 - RNA, 19 nt, Human
ccugugaucuuauuuuucu

SEQ ID NO: 3387841 - RNA, 17 nt, Human
ccugugauggggcccug

SEQ ID NO: 3387842 - RNA, 18 nt, Human
ccugugauggggcccugc

SEQ ID NO: 3387843 - RNA, 19 nt, Human
ccugugauggggcccugcc

SEQ ID NO: 3387844 - RNA, 20 nt, Human
ccugugauggggcccugccu

SEQ ID NO: 3387845 - RNA, 17 nt, Human
ccugugcaaugcauuag

SEQ ID NO: 3387846 - RNA, 12 nt, Human
ccugugcacaca

SEQ ID NO: 3387847 - RNA, 13 nt, Human
ccugugcacacac

SEQ ID NO: 3387848 - RNA, 17 nt, Human
ccugugcacacacacac

SEQ ID NO: 3387849 - RNA, 18 nt, Human
ccugugcacaccccacuc

SEQ ID NO: 3387850 - RNA, 18 nt, Human
ccugugcagccgcugagc

SEQ ID NO: 3387851 - RNA, 20 nt, Human
ccugugcagccgcugagcga

SEQ ID NO: 3387852 - RNA, 21 nt, Human
ccugugcagccgcugagcgag

SEQ ID NO: 3387853 - RNA, 14 nt, Human
ccugugcauguaug

SEQ ID NO: 3387854 - RNA, 21 nt, Human
ccugugccacccaccagggcg

SEQ ID NO: 3387855 - RNA, 15 nt, Human
ccugugccagcccag

SEQ ID NO: 3387856 - RNA, 17 nt, Human
ccugugccagcccagag

SEQ ID NO: 3387857 - RNA, 12 nt, Human
ccugugccaggu

SEQ ID NO: 3387858 - RNA, 21 nt, Human
ccugugccaggugaaggaggc

SEQ ID NO: 3387859 - RNA, 15 nt, Human
ccugugcccuuauuc

SEQ ID NO: 3387860 - RNA, 16 nt, Human
ccugugccuccucccu

SEQ ID NO: 3387861 - RNA, 18 nt, Human
ccugugcuccgugccucc

SEQ ID NO: 3387862 - RNA, 21 nt, Human
ccugugcuccgugccuccacc

SEQ ID NO: 3387863 - RNA, 22 nt, Human
ccugugcuccgugccuccacca

SEQ ID NO: 3387864 - RNA, 18 nt, Human
ccugugcugacggaagcc

SEQ ID NO: 3387865 - RNA, 23 nt, Human
ccugugcugcccgucuucagccu

SEQ ID NO: 3387866 - RNA, 24 nt, Human
ccuguggaacauaaaaaggacauc

SEQ ID NO: 3387867 - RNA, 20 nt, Human
ccuguggaaggcagagaaau

SEQ ID NO: 3387868 - RNA, 15 nt, Human
ccuguggagcccgca

SEQ ID NO: 3387869 - RNA, 15 nt, Human
ccuguggagcucagc

SEQ ID NO: 3387870 - RNA, 20 nt, Human
ccuguggaugauaaaacaca

SEQ ID NO: 3387871 - RNA, 21 nt, Human
ccuguggaugaucaauccuuu

SEQ ID NO: 3387872 - RNA, 19 nt, Human
ccuguggaugcugcugccc

SEQ ID NO: 3387873 - RNA, 18 nt, Human
ccuguggauguaaaguga

SEQ ID NO: 3387874 - RNA, 14 nt, Human
ccuguggcaggcag

SEQ ID NO: 3387875 - RNA, 18 nt, Human
ccuguggcaggcagcgcc

SEQ ID NO: 3387876 - RNA, 22 nt, Human
ccuguggcaggcagcgccaagc

SEQ ID NO: 3387877 - RNA, 18 nt, Human
ccuguggcaucuuugccu

SEQ ID NO: 3387878 - RNA, 20 nt, Human
ccuguggccaaguucuuagu

SEQ ID NO: 3387879 - RNA, 16 nt, Human
ccuguggccccacccu

SEQ ID NO: 3387880 - RNA, 17 nt, Human
ccuguggccccacccug

SEQ ID NO: 3387881 - RNA, 14 nt, Human
ccuguggcccuggc

SEQ ID NO: 3387882 - RNA, 18 nt, Human
ccuguggcccuguccugc

SEQ ID NO: 3387883 - RNA, 15 nt, Human
ccuguggcggugccu

SEQ ID NO: 3387884 - RNA, 18 nt, Human
ccuguggcugcgcuuccu

SEQ ID NO: 3387885 - RNA, 16 nt, Human
ccuguggcuguggaga

SEQ ID NO: 3387886 - RNA, 14 nt, Human
ccugugggagccuc

SEQ ID NO: 3387887 - RNA, 20 nt, Human
ccuguggggauuucucccag

SEQ ID NO: 3387888 - RNA, 22 nt, Human
ccuguggggauuucucccagcu

SEQ ID NO: 3387889 - RNA, 20 nt, Human
ccugugggggaagagcacag

SEQ ID NO: 3387890 - RNA, 21 nt, Human
ccugugggggaagagcacagc

SEQ ID NO: 3387891 - RNA, 21 nt, Human
ccuguggggucaacccuucug

SEQ ID NO: 3387892 - RNA, 19 nt, Human
ccugugguucugagauggc

SEQ ID NO: 3387893 - RNA, 20 nt, Human
ccuguguaacagcuccuugg

SEQ ID NO: 3387894 - RNA, 21 nt, Human
ccuguguaacagcuccuuggg

SEQ ID NO: 3387895 - RNA, 13 nt, Human
ccuguguagcugg

SEQ ID NO: 3387896 - RNA, 17 nt, Human
ccugugucaguuuaugu

SEQ ID NO: 3387897 - RNA, 21 nt, Human
ccugugucuugcaauggcagc

SEQ ID NO: 3387898 - RNA, 10 nt, Human
ccugugugca

SEQ ID NO: 3387899 - RNA, 16 nt, Human
ccugugugcagguucc

SEQ ID NO: 3387900 - RNA, 15 nt, Human
ccuguguggacagga

SEQ ID NO: 3387901 - RNA, 14 nt, Human
ccuguguggagagg

SEQ ID NO: 3387902 - RNA, 23 nt, Human
ccuguguggagagggaaugugaa

SEQ ID NO: 3387903 - RNA, 12 nt, Human
ccuguguggcca

SEQ ID NO: 3387904 - RNA, 15 nt, Human
ccuguguggccacuu

SEQ ID NO: 3387905 - RNA, 23 nt, Human
ccuguguggccacuucuguccau

SEQ ID NO: 3387906 - RNA, 17 nt, Human
ccugugugguacucuga

SEQ ID NO: 3387907 - RNA, 22 nt, Human
ccugugugguuuaguguaaaaa

SEQ ID NO: 3387908 - RNA, 20 nt, Human
ccuguguguccaaaacugcc

SEQ ID NO: 3387909 - RNA, 20 nt, Human
ccugugugugcgccuacagg

SEQ ID NO: 3387910 - RNA, 17 nt, Human
ccuguguuaauuuaagu

SEQ ID NO: 3387911 - RNA, 16 nt, Human
ccuguguugucucuag

SEQ ID NO: 3387912 - RNA, 20 nt, Human
ccuguguugucucuagagca

SEQ ID NO: 3387913 - RNA, 22 nt, Human
ccuguguugucucuagagcagg

SEQ ID NO: 3387914 - RNA, 15 nt, Human
ccuguuacccagaga

SEQ ID NO: 3387915 - RNA, 19 nt, Human
ccuguuaccuacuuugacu

SEQ ID NO: 3387916 - RNA, 23 nt, Human
ccuguuagacguccuccguccau

SEQ ID NO: 3387917 - RNA, 15 nt, Human
ccuguuagcagacag

SEQ ID NO: 3387918 - RNA, 18 nt, Human
ccuguuagcuccucacug

SEQ ID NO: 3387919 - RNA, 22 nt, Human
cuuagcaggagaggagagccag

SEQ ID NO: 3387920 - RNA, 14 nt, Human
cuuagcagugauuu

SEQ ID NO: 3387921 - RNA, 19 nt, Human
cuuagcauagcuuauuauu

SEQ ID NO: 3387922 - RNA, 22 nt, Human
cuuagcauagcuuauuauugaa

SEQ ID NO: 3387923 - RNA, 19 nt, Human
cuuagcauuuucugcaucu

SEQ ID NO: 3387924 - RNA, 21 nt, Human
cuuagcauuuucugcaucucc

SEQ ID NO: 3387925 - RNA, 22 nt, Human
cuuagccauuuuucaaagcaau

SEQ ID NO: 3387926 - RNA, 13 nt, Human
cuuagcccccacc

SEQ ID NO: 3387927 - RNA, 17 nt, Human
cuuagcccccacccacu

SEQ ID NO: 3387928 - RNA, 18 nt, Human
cuuagcccccacccacuu

SEQ ID NO: 3387929 - RNA, 11 nt, Human
cuuagccuccc

SEQ ID NO: 3387930 - RNA, 14 nt, Human
cuuagccuccugac

SEQ ID NO: 3387931 - RNA, 21 nt, Human
cuuagccuggaccucugacag

SEQ ID NO: 3387932 - RNA, 15 nt, Human
cuuagccuggagcac

SEQ ID NO: 3387933 - RNA, 16 nt, Human
cuuagcucaaugagca

SEQ ID NO: 3387934 - RNA, 22 nt, Human
cuuagcucaaugagcauguuua

SEQ ID NO: 3387935 - RNA, 23 nt, Human
cuuagcucauucuccuuguguua

SEQ ID NO: 3387936 - RNA, 14 nt, Human
cuuagcugagugga

SEQ ID NO: 3387937 - RNA, 14 nt, Human
cuuagcugccaagu

SEQ ID NO: 3387938 - RNA, 17 nt, Human
cuuagcugccaaguaaa

SEQ ID NO: 3387939 - RNA, 17 nt, Human
cuuagcugucugcucag

SEQ ID NO: 3387940 - RNA, 16 nt, Human
ccuguuccccagagaa

SEQ ID NO: 3387941 - RNA, 18 nt, Human
ccuguuccccucacugga

SEQ ID NO: 3387942 - RNA, 19 nt, Human
ccuguuccccucucccuuc

SEQ ID NO: 3387943 - RNA, 16 nt, Human
ccuguucuaaggggga

SEQ ID NO: 3387944 - RNA, 21 nt, Human
ccuguucuaagggggagggga

SEQ ID NO: 3387945 - RNA, 21 nt, Human
ccuguucugaacuguggggug

SEQ ID NO: 3387946 - RNA, 12 nt, Human
ccuguucuuccu

SEQ ID NO: 3387947 - RNA, 13 nt, Human
ccuguucuuccuc

SEQ ID NO: 3387948 - RNA, 21 nt, Human
ccuguugaauuuuguucucug

SEQ ID NO: 3387949 - RNA, 23 nt, Human
ccuguugacgaagucucuuuucu

SEQ ID NO: 3387950 - RNA, 16 nt, Human
ccuguugcacccagcc

SEQ ID NO: 3387951 - RNA, 17 nt, Human
ccuguugcacccagccc

SEQ ID NO: 3387952 - RNA, 19 nt, Human
ccuguugcacccagcccug

SEQ ID NO: 3387953 - RNA, 20 nt, Human
ccuguugcacccagcccugg

SEQ ID NO: 3387954 - RNA, 22 nt, Human
ccuguugcuaagccccagcaag

SEQ ID NO: 3387955 - RNA, 19 nt, Human
ccuguugcuauagagccua

SEQ ID NO: 3387956 - RNA, 17 nt, Human
ccuguugcuguguuuaa

SEQ ID NO: 3387957 - RNA, 19 nt, Human
ccuguuggacccgcucugg

SEQ ID NO: 3387958 - RNA, 16 nt, Human
ccuguugggccaggag

SEQ ID NO: 3387959 - RNA, 17 nt, Human
ccuguugggccaggagc

SEQ ID NO: 3387960 - RNA, 23 nt, Human
ccuguugggccaggagccuccug

SEQ ID NO: 3387961 - RNA, 13 nt, Human
ccuguugguucca

SEQ ID NO: 3387962 - RNA, 17 nt, Human
ccuguugguuccaagcc

SEQ ID NO: 3387963 - RNA, 21 nt, Human
ccuguugguuccaagcccugg

SEQ ID NO: 3387964 - RNA, 14 nt, Human
ccuguugugccaca

SEQ ID NO: 3387965 - RNA, 14 nt, Human
ccuguuuaaaaaac

SEQ ID NO: 3387966 - RNA, 15 nt, Human
ccuguuuaauauuua

SEQ ID NO: 3387967 - RNA, 21 nt, Human
ccuguuuaauauuuaaacagc

SEQ ID NO: 3387968 - RNA, 16 nt, Human
ccuguuucaaucacug

SEQ ID NO: 3387969 - RNA, 17 nt, Human
ccuguuucaaucacugu

SEQ ID NO: 3387970 - RNA, 18 nt, Human
ccuguuucagaggcucag

SEQ ID NO: 3387971 - RNA, 19 nt, Human
ccuguuucagaggcucaga

SEQ ID NO: 3387972 - RNA, 18 nt, Human
ccuguuugaagccugccc

SEQ ID NO: 3387973 - RNA, 19 nt, Human
ccuguuugaggaaagcaag

SEQ ID NO: 3387974 - RNA, 16 nt, Human
ccuguuuggauuuuua

SEQ ID NO: 3387975 - RNA, 15 nt, Human
ccuguuuggccucuc

SEQ ID NO: 3387976 - RNA, 16 nt, Human
ccuguuuggccucucu

SEQ ID NO: 3387977 - RNA, 18 nt, Human
ccuguuuguuucugaaag

SEQ ID NO: 3387978 - RNA, 23 nt, Human
ccuguuuucccacgaggaaucug

SEQ ID NO: 3387979 - RNA, 18 nt, Human
ccuguuuuguuggaaggu

SEQ ID NO: 3387980 - RNA, 17 nt, Human
ccuguuuuuaagcuguu

SEQ ID NO: 3387981 - RNA, 16 nt, Human
ccuguuuuucacauuu

SEQ ID NO: 3387982 - RNA, 15 nt, Human
ccuguuuuucugggu

SEQ ID NO: 3387983 - RNA, 17 nt, Human
ccuguuuuucugggugg

SEQ ID NO: 3387984 - RNA, 20 nt, Human
ccuuaaaacaucauuccuuu

SEQ ID NO: 3387985 - RNA, 13 nt, Human
ccuuaaaauggaa

SEQ ID NO: 3387986 - RNA, 16 nt, Human
ccuuaaaauuugaaac

SEQ ID NO: 3387987 - RNA, 20 nt, Human
ccuuaaacaaaaauuaaaau

SEQ ID NO: 3387988 - RNA, 20 nt, Human
ccuuaaacaguugcacagca

SEQ ID NO: 3387989 - RNA, 15 nt, Human
ccuuaaacugugugg

SEQ ID NO: 3387990 - RNA, 22 nt, Human
ccuuaaaggcaccaucuaauag

SEQ ID NO: 3387991 - RNA, 12 nt, Human
ccuuaacacuga

SEQ ID NO: 3387992 - RNA, 18 nt, Human
ccuuaacccaaggagcac

SEQ ID NO: 3387993 - RNA, 16 nt, Human
ccuuaacugcauccag

SEQ ID NO: 3387994 - RNA, 12 nt, Human
ccuuaagaauga

SEQ ID NO: 3387995 - RNA, 20 nt, Human
ccuuaagaaugaguuucuua

SEQ ID NO: 3387996 - RNA, 15 nt, Human
ccuuaagaaugccaa

SEQ ID NO: 3387997 - RNA, 14 nt, Human
ccuuaagcugcagg

SEQ ID NO: 3387998 - RNA, 15 nt, Human
ccuuaauauuucuuc

SEQ ID NO: 3387999 - RNA, 15 nt, Human
ccuuaauuuccuuuu

SEQ ID NO: 3388000 - RNA, 19 nt, Human
ccuuaauuuuuuuuucaua

SEQ ID NO: 3388001 - RNA, 22 nt, Human
ccuuacaaguuagaaaacauaa

SEQ ID NO: 3388002 - RNA, 20 nt, Human
ccuuacacaaugguuuucuu

SEQ ID NO: 3388003 - RNA, 18 nt, Human
ccuuacaccucguuaggg

SEQ ID NO: 3388004 - RNA, 14 nt, Human
ccuuacagccucug

SEQ ID NO: 3388005 - RNA, 17 nt, Human
ccuuacaguaggagccc

SEQ ID NO: 3388006 - RNA, 17 nt, Human
ccuuaccaacuuucugu

SEQ ID NO: 3388007 - RNA, 19 nt, Human
ccuuaccaacuuucuguaa

SEQ ID NO: 3388008 - RNA, 15 nt, Human
ccuuaccagcagagc

SEQ ID NO: 3388009 - RNA, 17 nt, Human
ccuuaccagcagagcac

SEQ ID NO: 3388010 - RNA, 15 nt, Human
ccuuaccccuuagcc

SEQ ID NO: 3388011 - RNA, 16 nt, Human
ccuuaccccuuagccu

SEQ ID NO: 3388012 - RNA, 13 nt, Human
ccuuaccuccugc

SEQ ID NO: 3388013 - RNA, 16 nt, Human
ccuuaccuccugccca

SEQ ID NO: 3388014 - RNA, 17 nt, Human
ccuuaccuccugcccag

SEQ ID NO: 3388015 - RNA, 18 nt, Human
ccuuaccuccugcccagg

SEQ ID NO: 3388016 - RNA, 17 nt, Human
ccuuacgaucaggcaca

SEQ ID NO: 3388017 - RNA, 16 nt, Human
ccuuacucccaggcac

SEQ ID NO: 3388018 - RNA, 21 nt, Human
ccuuacuccugugggagccuc

SEQ ID NO: 3388019 - RNA, 22 nt, Human
ccuuacuccugugggagccucg

SEQ ID NO: 3388020 - RNA, 16 nt, Human
ccuuacucuucuugaa

SEQ ID NO: 3388021 - RNA, 22 nt, Human
ccuuacucuucuugaaauuuua

SEQ ID NO: 3388022 - RNA, 13 nt, Human
ccuuacuggcuua

SEQ ID NO: 3388023 - RNA, 20 nt, Human
ccuuacuuacagcauaaggg

SEQ ID NO: 3388024 - RNA, 13 nt, Human
ccuuacuucuugc

SEQ ID NO: 3388025 - RNA, 21 nt, Human
ccuuacuuuacugccugaaua

SEQ ID NO: 3388026 - RNA, 16 nt, Human
ccuuagaaaauguguc

SEQ ID NO: 3388027 - RNA, 18 nt, Human
ccuuagaaauguaaacug

SEQ ID NO: 3388028 - RNA, 15 nt, Human
ccuuagaaccuuucu

SEQ ID NO: 3388029 - RNA, 18 nt, Human
ccuuagaagguauuaaga

SEQ ID NO: 3388030 - RNA, 18 nt, Human
ccuuagaagucacacagu

SEQ ID NO: 3388031 - RNA, 15 nt, Human
ccuuagacagaggcc

SEQ ID NO: 3388032 - RNA, 17 nt, Human
ccuuagacagaggcccu

SEQ ID NO: 3388033 - RNA, 16 nt, Human
ccuuagacagucccug

SEQ ID NO: 3388034 - RNA, 17 nt, Human
ccuuagacagucccugc

SEQ ID NO: 3388035 - RNA, 21 nt, Human
ccuuagaccaccaagccuuga

SEQ ID NO: 3388036 - RNA, 17 nt, Human
ccuuagacucuuuuccu

SEQ ID NO: 3388037 - RNA, 15 nt, Human
ccuuagagccaggca

SEQ ID NO: 3388038 - RNA, 17 nt, Human
ccuuagagguccucugg

SEQ ID NO: 3388039 - RNA, 19 nt, Human
ccuuagagguccucuggag

SEQ ID NO: 3388040 - RNA, 23 nt, Human
ccuuagauugaaguaaacugcag

SEQ ID NO: 3388041 - RNA, 16 nt, Human
ccuuagcaaauucugu

SEQ ID NO: 3388042 - RNA, 21 nt, Human
ccuuagcccccacccacuucc

SEQ ID NO: 3388043 - RNA, 13 nt, Human
ccuuagccuggac

SEQ ID NO: 3388044 - RNA, 15 nt, Human
ccuuagcugccaagc

SEQ ID NO: 3388045 - RNA, 20 nt, Human
ccuuagcugccaagccccau

SEQ ID NO: 3388046 - RNA, 14 nt, Human
ccuuagcuucuggc

SEQ ID NO: 3388047 - RNA, 15 nt, Human
ccuuaggaagagccu

SEQ ID NO: 3388048 - RNA, 19 nt, Human
ccuuaggccuaccugaugg

SEQ ID NO: 3388049 - RNA, 13 nt, Human
ccuuaggccuucc

SEQ ID NO: 3388050 - RNA, 14 nt, Human
ccuuagucuucuca

SEQ ID NO: 3388051 - RNA, 16 nt, Human
ccuuaguggcuuuuuu

SEQ ID NO: 3388052 - RNA, 16 nt, Human
ccuuauaguuugggcu

SEQ ID NO: 3388053 - RNA, 20 nt, Human
ccuuauauaugcacuuaauu

SEQ ID NO: 3388054 - RNA, 14 nt, Human
ccuuaucaaaggac

SEQ ID NO: 3388055 - RNA, 14 nt, Human
ccuuaucagagcua

SEQ ID NO: 3388056 - RNA, 14 nt, Human
ccuuaucauaaauu

SEQ ID NO: 3388057 - RNA, 17 nt, Human
ccuuauccaggacucug

SEQ ID NO: 3388058 - RNA, 16 nt, Human
ccuuauccucccugua

SEQ ID NO: 3388059 - RNA, 20 nt, Human
ccuuauccuuccucuccuuc

SEQ ID NO: 3388060 - RNA, 19 nt, Human
ccuuaucuaguguuugauu

SEQ ID NO: 3388061 - RNA, 23 nt, Human
ccuuaucuccacaaccucuuccc

SEQ ID NO: 3388062 - RNA, 19 nt, Human
ccuuaugcuucuuucaaau

SEQ ID NO: 3388063 - RNA, 17 nt, Human
ccuuauggaacacucug

SEQ ID NO: 3388064 - RNA, 16 nt, Human
cuguuuuuuuuucauu

SEQ ID NO: 3388065 - RNA, 19 nt, Human
cuuaaaaaaaaaaaaaagc

SEQ ID NO: 3388066 - RNA, 15 nt, Human
cuuaaaaaaaacuca

SEQ ID NO: 3388067 - RNA, 15 nt, Human
cuuaaaaaaaugaca

SEQ ID NO: 3388068 - RNA, 17 nt, Human
cuuaaaaaauaaaaacu

SEQ ID NO: 3388069 - RNA, 13 nt, Human
cuuaaaaaauguc

SEQ ID NO: 3388070 - RNA, 14 nt, Human
cuuaaaaacaacga

SEQ ID NO: 3388071 - RNA, 11 nt, Human
cuuaaaaagua

SEQ ID NO: 3388072 - RNA, 18 nt, Human
cuuaaaaagucugcauua

SEQ ID NO: 3388073 - RNA, 13 nt, Human
cuuaaaaaugguu

SEQ ID NO: 3388074 - RNA, 20 nt, Human
cuuaaaaaugguuuaaaugg

SEQ ID NO: 3388075 - RNA, 16 nt, Human
cuuaaaaauguaaaua

SEQ ID NO: 3388076 - RNA, 22 nt, Human
cuuaaaaauguuuuuucaugug

SEQ ID NO: 3388077 - RNA, 17 nt, Human
cuuaaaacaucauuccu

SEQ ID NO: 3388078 - RNA, 21 nt, Human
cuuaaaacuaggcauuuguaa

SEQ ID NO: 3388079 - RNA, 23 nt, Human
cuuaaaacuaggcauuuguaaau

SEQ ID NO: 3388080 - RNA, 15 nt, Human
cuuaaaacuuuucaa

SEQ ID NO: 3388081 - RNA, 17 nt, Human
cuuaaaagccaucaugu

SEQ ID NO: 3388082 - RNA, 21 nt, Human
cuuaaaagccaucauguaaau

SEQ ID NO: 3388083 - RNA, 21 nt, Human
cuuaaaagcuaucuucaugua

SEQ ID NO: 3388084 - RNA, 23 nt, Human
cuuaaaauaaacaguugugaacc

SEQ ID NO: 3388085 - RNA, 13 nt, Human
cuuaaaauaagca

SEQ ID NO: 3388086 - RNA, 20 nt, Human
cuuaaaauacgguaccuggc

SEQ ID NO: 3388087 - RNA, 18 nt, Human
cuuaaaauagaaauaagu

SEQ ID NO: 3388088 - RNA, 11 nt, Human
cuuaaaaugga

SEQ ID NO: 3388089 - RNA, 14 nt, Human
cuuaaaauggaauu

SEQ ID NO: 3388090 - RNA, 18 nt, Human
cuuaaaauggaauugaaa

SEQ ID NO: 3388091 - RNA, 13 nt, Human
cuuaaaauuugaa

SEQ ID NO: 3388092 - RNA, 19 nt, Human
cuuaaaauuugaaacauug

SEQ ID NO: 3388093 - RNA, 13 nt, Human
cuuaaacaaaaau

SEQ ID NO: 3388094 - RNA, 14 nt, Human
cuuaaacagggcau

SEQ ID NO: 3388095 - RNA, 14 nt, Human
cuuagcuucaggaa

SEQ ID NO: 3388096 - RNA, 20 nt, Human
cuuagcuuuagaaacagugc

SEQ ID NO: 3388097 - RNA, 11 nt, Human
cuuaggaagga

SEQ ID NO: 3388098 - RNA, 15 nt, Human
cuuaggagagaccga

SEQ ID NO: 3388099 - RNA, 16 nt, Human
cuuaggagcagagcuc

SEQ ID NO: 3388100 - RNA, 14 nt, Human
cuuaggaugugugc

SEQ ID NO: 3388101 - RNA, 16 nt, Human
cuuaggaugugugcau

SEQ ID NO: 3388102 - RNA, 12 nt, Human
cuuaggccuucc

SEQ ID NO: 3388103 - RNA, 20 nt, Human
cuuagggacaggaccccagc

SEQ ID NO: 3388104 - RNA, 21 nt, Human
cuuagggacagucaaaaccaa

SEQ ID NO: 3388105 - RNA, 17 nt, Human
cuuagggcacugggcug

SEQ ID NO: 3388106 - RNA, 15 nt, Human
cuuaggggaaggaga

SEQ ID NO: 3388107 - RNA, 16 nt, Human
cuuagggugaaccacu

SEQ ID NO: 3388108 - RNA, 21 nt, Human
cuuaggguuaugauuaaguaa

SEQ ID NO: 3388109 - RNA, 20 nt, Human
cuuaguaaaauuuauuucau

SEQ ID NO: 3388110 - RNA, 21 nt, Human
cuuaguaaugcuacgugugau

SEQ ID NO: 3388111 - RNA, 22 nt, Human
cuuaguaaugcuacgugugauu

SEQ ID NO: 3388112 - RNA, 23 nt, Human
cuuaguaaugcuacgugugauuu

SEQ ID NO: 3388113 - RNA, 15 nt, Human
cuuaguacaaaguuu

SEQ ID NO: 3388114 - RNA, 21 nt, Human
cuuaguagauuaaaaauuaua

SEQ ID NO: 3388115 - RNA, 13 nt, Human
cuuaguauugcaa

SEQ ID NO: 3388116 - RNA, 17 nt, Human
cuuagucaaauguaaug

SEQ ID NO: 3388117 - RNA, 19 nt, Human
cuuagucacugagacagcc

SEQ ID NO: 3388118 - RNA, 21 nt, Human
cuuagucacugagacagcccg

SEQ ID NO: 3388119 - RNA, 15 nt, Human
cuuagucacugccug

SEQ ID NO: 3388120 - RNA, 16 nt, Human
cuuagucacugccugc

SEQ ID NO: 3388121 - RNA, 17 nt, Human
cuuagucacugccugca

SEQ ID NO: 3388122 - RNA, 22 nt, Human
cuuagucccccaacucugagcc

SEQ ID NO: 3388123 - RNA, 12 nt, Human
cuuagucucagu

SEQ ID NO: 3388124 - RNA, 13 nt, Human
cuuagucucaguu

SEQ ID NO: 3388125 - RNA, 18 nt, Human
cuuagucucaguuugugu

SEQ ID NO: 3388126 - RNA, 20 nt, Human
cuuagucucaguuugugugu

SEQ ID NO: 3388127 - RNA, 15 nt, Human
cuuagucuucucaua

SEQ ID NO: 3388128 - RNA, 16 nt, Human
cuuagucuucucauag

SEQ ID NO: 3388129 - RNA, 20 nt, Human
cuuagugcggacaaguuuua

SEQ ID NO: 3388130 - RNA, 14 nt, Human
cuuagugggccagg

SEQ ID NO: 3388131 - RNA, 18 nt, Human
cuuagugggccagggcug

SEQ ID NO: 3388132 - RNA, 21 nt, Human
cuuagugggccagggcugccc

SEQ ID NO: 3388133 - RNA, 23 nt, Human
cuuagugggccagggcugcccug

SEQ ID NO: 3388134 - RNA, 20 nt, Human
cuuagugggguuuuauaucc

SEQ ID NO: 3388135 - RNA, 11 nt, Human
cuuaguguaug

SEQ ID NO: 3388136 - RNA, 13 nt, Human
cuuaguguuucug

SEQ ID NO: 3388137 - RNA, 19 nt, Human
cuuaguguuucugugcaug

SEQ ID NO: 3388138 - RNA, 22 nt, Human
cuuaguuuggauucuuauguag

SEQ ID NO: 3388139 - RNA, 18 nt, Human
cuuauaaaucauauugau

SEQ ID NO: 3388140 - RNA, 17 nt, Human
cuuauaagguguuuucu

SEQ ID NO: 3388141 - RNA, 16 nt, Human
cuuauaauacucuguu

SEQ ID NO: 3388142 - RNA, 13 nt, Human
cuuauaauuuaaa

SEQ ID NO: 3388143 - RNA, 21 nt, Human
cuuauacaauuaugaagauuu

SEQ ID NO: 3388144 - RNA, 12 nt, Human
cuuauacacauu

SEQ ID NO: 3388145 - RNA, 17 nt, Human
cuuauacgaaauaauug

SEQ ID NO: 3388146 - RNA, 18 nt, Human
cuuauacgaaauaauugu

SEQ ID NO: 3388147 - RNA, 20 nt, Human
cuuauacgaaauaauuguug

SEQ ID NO: 3388148 - RNA, 22 nt, Human
cuuauacgaaauaauuguuguu

SEQ ID NO: 3388149 - RNA, 19 nt, Human
cuuauacgcuuuucuuugu

SEQ ID NO: 3388150 - RNA, 14 nt, Human
cuuauagaauauuu

SEQ ID NO: 3388151 - RNA, 14 nt, Human
cuuauagacaacau

SEQ ID NO: 3388152 - RNA, 16 nt, Human
cuuauagccucugucu

SEQ ID NO: 3388153 - RNA, 14 nt, Human
cuuauagguguugg

SEQ ID NO: 3388154 - RNA, 23 nt, Human
cuuauagucaauguuucuuuuau

SEQ ID NO: 3388155 - RNA, 16 nt, Human
cuuauagucuaagacu

SEQ ID NO: 3388156 - RNA, 14 nt, Human
cuuauaguuacugu

SEQ ID NO: 3388157 - RNA, 18 nt, Human
cuuauaguuacuguguaa

SEQ ID NO: 3388158 - RNA, 19 nt, Human
cuuauaguuacuguguaau

SEQ ID NO: 3388159 - RNA, 14 nt, Human
cuuauaguucuagg

SEQ ID NO: 3388160 - RNA, 15 nt, Human
cuuauaguucuaggc

SEQ ID NO: 3388161 - RNA, 16 nt, Human
cuuauaguuugggcuu

SEQ ID NO: 3388162 - RNA, 20 nt, Human
cuuauaguuugggcuucagc

SEQ ID NO: 3388163 - RNA, 23 nt, Human
cuuauaguuugggcuucagccua

SEQ ID NO: 3388164 - RNA, 21 nt, Human
cuuauauagcagcaaaaauau

SEQ ID NO: 3388165 - RNA, 23 nt, Human
cuuauauaugcacuuaauuuguu

SEQ ID NO: 3388166 - RNA, 14 nt, Human
cuuauauaugugaa

SEQ ID NO: 3388167 - RNA, 20 nt, Human
cuuauaucuaaaucugucca

SEQ ID NO: 3388168 - RNA, 19 nt, Human
cuuauaucuauauuuuaca

SEQ ID NO: 3388169 - RNA, 16 nt, Human
cuuauaucuggccucu

SEQ ID NO: 3388170 - RNA, 22 nt, Human
cuuauaucuggccucugcuuuc

SEQ ID NO: 3388171 - RNA, 20 nt, Human
cuuauauuaauaguaauuug

SEQ ID NO: 3388172 - RNA, 18 nt, Human
cuuauauugaagacaauu

SEQ ID NO: 3388173 - RNA, 18 nt, Human
cuuauauuguaagaaaua

SEQ ID NO: 3388174 - RNA, 14 nt, Human
cuuauauuucccua

SEQ ID NO: 3388175 - RNA, 14 nt, Human
cuuaucaaaggaca

SEQ ID NO: 3388176 - RNA, 16 nt, Human
cuuaucaaaggacacc

SEQ ID NO: 3388177 - RNA, 16 nt, Human
cuuaucaagugucuuc

SEQ ID NO: 3388178 - RNA, 19 nt, Human
cuuaucaagugucuuccau

SEQ ID NO: 3388179 - RNA, 21 nt, Human
cuuaucaauuugucauuuuga

SEQ ID NO: 3388180 - RNA, 17 nt, Human
cuuaucaccagcugccu

SEQ ID NO: 3388181 - RNA, 18 nt, Human
cuuaucacugacacaaaa

SEQ ID NO: 3388182 - RNA, 22 nt, Human
cuuaucagcuacuuaagagaaa

SEQ ID NO: 3388183 - RNA, 21 nt, Human
cuuaucauccacauuguuuua

SEQ ID NO: 3388184 - RNA, 20 nt, Human
cuuaucaugcugucuuuaca

SEQ ID NO: 3388185 - RNA, 15 nt, Human
cuuauccagcuggug

SEQ ID NO: 3388186 - RNA, 16 nt, Human
cuuaucccugcccauu

SEQ ID NO: 3388187 - RNA, 22 nt, Human
cuuaucccugcccauuucauau

SEQ ID NO: 3388188 - RNA, 21 nt, Human
cuuauccuaaaacaaauaguu

SEQ ID NO: 3388189 - RNA, 21 nt, Human
cuuauccuagcacaugcuuca

SEQ ID NO: 3388190 - RNA, 15 nt, Human
cuuauccucccugua

SEQ ID NO: 3388191 - RNA, 19 nt, Human
cuuauccucccuguaacuu

SEQ ID NO: 3388192 - RNA, 20 nt, Human
cuuauccucccuguaacuug

SEQ ID NO: 3388193 - RNA, 15 nt, Human
cuuauccucugaucu

SEQ ID NO: 3388194 - RNA, 17 nt, Human
cuuauccugcauuguua

SEQ ID NO: 3388195 - RNA, 15 nt, Human
cuuaucuagcugcau

SEQ ID NO: 3388196 - RNA, 15 nt, Human
cuuaucucagauauu

SEQ ID NO: 3388197 - RNA, 20 nt, Human
cuuaucucagauauuugcac

SEQ ID NO: 3388198 - RNA, 20 nt, Human
cuuaucucagucaugcauaa

SEQ ID NO: 3388199 - RNA, 22 nt, Human
cuuaucucagucaugcauaaau

SEQ ID NO: 3388200 - RNA, 23 nt, Human
cuuaucucagucaugcauaaaua

SEQ ID NO: 3388201 - RNA, 12 nt, Human
cuuaucucucug

SEQ ID NO: 3388202 - RNA, 15 nt, Human
cuuaucucucugugc

SEQ ID NO: 3388203 - RNA, 21 nt, Human
cuuaucucucugugcugugga

SEQ ID NO: 3388204 - RNA, 18 nt, Human
cuuaucugagcugagcca

SEQ ID NO: 3388205 - RNA, 20 nt, Human
cuuaucugugcgugaaacac

SEQ ID NO: 3388206 - RNA, 14 nt, Human
cuuaucugugcuca

SEQ ID NO: 3388207 - RNA, 11 nt, Human
cuuaugaaaag

SEQ ID NO: 3388208 - RNA, 14 nt, Human
cuuccccugggccc

SEQ ID NO: 3388209 - RNA, 15 nt, Human
cuuccccugggcccu

SEQ ID NO: 3388210 - RNA, 13 nt, Human
cuuccccuucccu

SEQ ID NO: 3388211 - RNA, 23 nt, Human
cuuccccuugcccuugcccugac

SEQ ID NO: 3388212 - RNA, 15 nt, Human
cuucccgcucagccc

SEQ ID NO: 3388213 - RNA, 18 nt, Human
cuucccgggccagggcug

SEQ ID NO: 3388214 - RNA, 19 nt, Human
cuucccgucccauauccug

SEQ ID NO: 3388215 - RNA, 20 nt, Human
cuucccgucccauauccugc

SEQ ID NO: 3388216 - RNA, 22 nt, Human
cuucccgucccauauccugccu

SEQ ID NO: 3388217 - RNA, 17 nt, Human
cuucccuacaguugaaa

SEQ ID NO: 3388218 - RNA, 21 nt, Human
cuucccuagcuuuagacccug

SEQ ID NO: 3388219 - RNA, 19 nt, Human
cuucccuagggcugggugu

SEQ ID NO: 3388220 - RNA, 22 nt, Human
cuucccuaucuuugccacccuc

SEQ ID NO: 3388221 - RNA, 23 nt, Human
cuucccuaucuuugccacccuca

SEQ ID NO: 3388222 - RNA, 13 nt, Human
cuucccuauuuau

SEQ ID NO: 3388223 - RNA, 21 nt, Human
cuucccucaaagcuuccauuc

SEQ ID NO: 3388224 - RNA, 17 nt, Human
cuucccucaccuuggca

SEQ ID NO: 3388225 - RNA, 15 nt, Human
cuucccucaguccca

SEQ ID NO: 3388226 - RNA, 20 nt, Human
cuucccuccccucuaguuuu

SEQ ID NO: 3388227 - RNA, 16 nt, Human
cuucccucccugcugu

SEQ ID NO: 3388228 - RNA, 14 nt, Human
cuucccuccuccca

SEQ ID NO: 3388229 - RNA, 19 nt, Human
cuucccuccucccauguca

SEQ ID NO: 3388230 - RNA, 13 nt, Human
cuucccuccugcu

SEQ ID NO: 3388231 - RNA, 19 nt, Human
cuucccucugccugucccu

SEQ ID NO: 3388232 - RNA, 17 nt, Human
cuucccucuguuucucu

SEQ ID NO: 3388233 - RNA, 14 nt, Human
cuucccucuucccu

SEQ ID NO: 3388234 - RNA, 23 nt, Human
cuucccugaacuuccugcuuccu

SEQ ID NO: 3388235 - RNA, 14 nt, Human
cuucccugacucau

SEQ ID NO: 3388236 - RNA, 19 nt, Human
cuucccugauugaccugcu

SEQ ID NO: 3388237 - RNA, 21 nt, Human
cuucccugauugaccugcucc

SEQ ID NO: 3388238 - RNA, 22 nt, Human
cuucccugauugaccugcuccg

SEQ ID NO: 3388239 - RNA, 13 nt, Human
cuucccugcacua

SEQ ID NO: 3388240 - RNA, 23 nt, Human
cuucccuggaaaccuuccaccca

SEQ ID NO: 3388241 - RNA, 21 nt, Human
cuucccuggcggccccaacuc

SEQ ID NO: 3388242 - RNA, 12 nt, Human
cuucccugguuc

SEQ ID NO: 3388243 - RNA, 16 nt, Human
cuucccugucccucua

SEQ ID NO: 3388244 - RNA, 14 nt, Human
cuucccugugccuc

SEQ ID NO: 3388245 - RNA, 15 nt, Human
cuucccugugccucc

SEQ ID NO: 3388246 - RNA, 22 nt, Human
cuucccuguguaguuugugcug

SEQ ID NO: 3388247 - RNA, 20 nt, Human
cuucccuuaaaauuuauaug

SEQ ID NO: 3388248 - RNA, 22 nt, Human
cuucccuuccacugccucugcc

SEQ ID NO: 3388249 - RNA, 16 nt, Human
cuucccuucuccaucu

SEQ ID NO: 3388250 - RNA, 22 nt, Human
cuucccuucucucucucucaaa

SEQ ID NO: 3388251 - RNA, 12 nt, Human
cuucccuugcca

SEQ ID NO: 3388252 - RNA, 18 nt, Human
cuucccuugccacuuugc

SEQ ID NO: 3388253 - RNA, 19 nt, Human
cuucccuugccacuuugca

SEQ ID NO: 3388254 - RNA, 14 nt, Human
cuucccuuuccuga

SEQ ID NO: 3388255 - RNA, 13 nt, Human
cuucccuuucugc

SEQ ID NO: 3388256 - RNA, 20 nt, Human
cuucccuuuuaaacacauuu

SEQ ID NO: 3388257 - RNA, 14 nt, Human
cuucccuuuuacau

SEQ ID NO: 3388258 - RNA, 20 nt, Human
cuuccgaaaaauccucuucc

SEQ ID NO: 3388259 - RNA, 21 nt, Human
cuuccgaaaaauccucuuccu

SEQ ID NO: 3388260 - RNA, 22 nt, Human
cuuccgacccucugggaaccuc

SEQ ID NO: 3388261 - RNA, 17 nt, Human
cuuccgcaguguggcca

SEQ ID NO: 3388262 - RNA, 14 nt, Human
cuuccgccacuggg

SEQ ID NO: 3388263 - RNA, 22 nt, Human
cuuccgccacuggggcucagag

SEQ ID NO: 3388264 - RNA, 16 nt, Human
cuuccgccccugccug

SEQ ID NO: 3388265 - RNA, 17 nt, Human
cuuccgccccugccugc

SEQ ID NO: 3388266 - RNA, 20 nt, Human
cuuccgccccugccugccau

SEQ ID NO: 3388267 - RNA, 17 nt, Human
cuuccggccccuccccu

SEQ ID NO: 3388268 - RNA, 16 nt, Human
cuuccgguagggaggc

SEQ ID NO: 3388269 - RNA, 21 nt, Human
cuuccgguagggaggcagccu

SEQ ID NO: 3388270 - RNA, 23 nt, Human
cuuccgguagggaggcagccucc

SEQ ID NO: 3388271 - RNA, 14 nt, Human
cuuccgucuccccc

SEQ ID NO: 3388272 - RNA, 20 nt, Human
cuuccuaaauuuuccugucc

SEQ ID NO: 3388273 - RNA, 19 nt, Human
cuuccuaauuccacagcug

SEQ ID NO: 3388274 - RNA, 21 nt, Human
cuuccuacaagagcagccugu

SEQ ID NO: 3388275 - RNA, 23 nt, Human
cuuccuacacccuuggacuugag

SEQ ID NO: 3388276 - RNA, 19 nt, Human
cuuccuaccaagucaaacu

SEQ ID NO: 3388277 - RNA, 22 nt, Human
cuuccuacccacaccucugcca

SEQ ID NO: 3388278 - RNA, 15 nt, Human
cuuccuaccuauccc

SEQ ID NO: 3388279 - RNA, 22 nt, Human
cuuccuacucuucucucugcuc

SEQ ID NO: 3388280 - RNA, 14 nt, Human
cuuccuagccuugc

SEQ ID NO: 3388281 - RNA, 23 nt, Human
cuuccuaguuuucuccucccagg

SEQ ID NO: 3388282 - RNA, 20 nt, Human
cuuccuauaacuugaugcau

SEQ ID NO: 3388283 - RNA, 18 nt, Human
cuuccuauaugcacuuau

SEQ ID NO: 3388284 - RNA, 15 nt, Human
cuuccucacccugau

SEQ ID NO: 3388285 - RNA, 12 nt, Human
cuuccucagcca

SEQ ID NO: 3388286 - RNA, 15 nt, Human
cuuccuccacauccu

SEQ ID NO: 3388287 - RNA, 13 nt, Human
cuuauuuagagau

SEQ ID NO: 3388288 - RNA, 13 nt, Human
cuuauuuauuauu

SEQ ID NO: 3388289 - RNA, 17 nt, Human
cuuauuuauuguauucu

SEQ ID NO: 3388290 - RNA, 19 nt, Human
cuuauuuauuguauucugg

SEQ ID NO: 3388291 - RNA, 15 nt, Human
cuuauuuccucauuu

SEQ ID NO: 3388292 - RNA, 11 nt, Human
cuuauuugagu

SEQ ID NO: 3388293 - RNA, 13 nt, Human
cuuauuugaguga

SEQ ID NO: 3388294 - RNA, 16 nt, Human
cuuauuuguauauggu

SEQ ID NO: 3388295 - RNA, 18 nt, Human
cuuauuuguauuuuuccu

SEQ ID NO: 3388296 - RNA, 23 nt, Human
cuuauuuuaaaauuuuaucucuu

SEQ ID NO: 3388297 - RNA, 20 nt, Human
cuuauuuuaagcauugugag

SEQ ID NO: 3388298 - RNA, 20 nt, Human
cuuauuuuauuuccaucaug

SEQ ID NO: 3388299 - RNA, 12 nt, Human
cuuauuuucaag

SEQ ID NO: 3388300 - RNA, 16 nt, Human
cuuauuuucauguaua

SEQ ID NO: 3388301 - RNA, 18 nt, Human
cuuauuuuggagagauag

SEQ ID NO: 3388302 - RNA, 13 nt, Human
cuuauuuuuccua

SEQ ID NO: 3388303 - RNA, 16 nt, Human
cuuauuuuucuaaacg

SEQ ID NO: 3388304 - RNA, 17 nt, Human
cuuauuuuugacagugu

SEQ ID NO: 3388305 - RNA, 18 nt, Human
cuuauuuuuuucugauug

SEQ ID NO: 3388306 - RNA, 20 nt, Human
cuuauuuuuuucugauugua

SEQ ID NO: 3388307 - RNA, 17 nt, Human
cuucaaaaguauuuucc

SEQ ID NO: 3388308 - RNA, 19 nt, Human
cuucaaaauguauauauuu

SEQ ID NO: 3388309 - RNA, 20 nt, Human
cuucaaaauguauauauuua

SEQ ID NO: 3388310 - RNA, 22 nt, Human
cuucaaacagaacugcagucag

SEQ ID NO: 3388311 - RNA, 17 nt, Human
cuucaaagcaaaugucu

SEQ ID NO: 3388312 - RNA, 11 nt, Human
cuucaaagcug

SEQ ID NO: 3388313 - RNA, 18 nt, Human
cuucaaagcuugaagauc

SEQ ID NO: 3388314 - RNA, 16 nt, Human
cuucaaagucucaaug

SEQ ID NO: 3388315 - RNA, 16 nt, Human
cuucaaaguuuaauaa

SEQ ID NO: 3388316 - RNA, 15 nt, Human
cuucaaauauuuccc

SEQ ID NO: 3388317 - RNA, 16 nt, Human
cuucaaauccuuccaa

SEQ ID NO: 3388318 - RNA, 18 nt, Human
cuucaaauccuuccaaaa

SEQ ID NO: 3388319 - RNA, 17 nt, Human
cuucaaauccuugaaga

SEQ ID NO: 3388320 - RNA, 14 nt, Human
cuucaaaugaaaau

SEQ ID NO: 3388321 - RNA, 18 nt, Human
cuucaaauuaaaacagcu

SEQ ID NO: 3388322 - RNA, 19 nt, Human
cuucaaauuagaagacauu

SEQ ID NO: 3388323 - RNA, 24 nt, Human
cuucaacagacccccucuagaaau

SEQ ID NO: 3388324 - RNA, 20 nt, Human
cuucaacaucaauguucauu

SEQ ID NO: 3388325 - RNA, 13 nt, Human
cuucaacauccug

SEQ ID NO: 3388326 - RNA, 20 nt, Human
cuucaacauccugccagccc

SEQ ID NO: 3388327 - RNA, 16 nt, Human
cuucaaccccaugaga

SEQ ID NO: 3388328 - RNA, 22 nt, Human
cuucaacguuucuucacuuuug

SEQ ID NO: 3388329 - RNA, 17 nt, Human
cuucaacugaccagccu

SEQ ID NO: 3388330 - RNA, 22 nt, Human
cuucaagcauggcuauuuuaua

SEQ ID NO: 3388331 - RNA, 20 nt, Human
cuucaagcucugagggaaag

SEQ ID NO: 3388332 - RNA, 21 nt, Human
cuucaaggauccugagccaga

SEQ ID NO: 3388333 - RNA, 13 nt, Human
cuucaaggcuuca

SEQ ID NO: 3388334 - RNA, 17 nt, Human
cuucaagggcugcuuca

SEQ ID NO: 3388335 - RNA, 15 nt, Human
cuucaaggugacaga

SEQ ID NO: 3388336 - RNA, 17 nt, Human
cuucaagucugugccug

SEQ ID NO: 3388337 - RNA, 22 nt, Human
cuucaagucugugccuggagcu

SEQ ID NO: 3388338 - RNA, 23 nt, Human
cuucaagucugugccuggagcuc

SEQ ID NO: 3388339 - RNA, 17 nt, Human
cuucaaguuagcucagg

SEQ ID NO: 3388340 - RNA, 12 nt, Human
cuucaauaaagu

SEQ ID NO: 3388341 - RNA, 14 nt, Human
cuucaauaaaguau

SEQ ID NO: 3388342 - RNA, 15 nt, Human
cuucaauaaaucuuu

SEQ ID NO: 3388343 - RNA, 21 nt, Human
cuucaauaaaugguauagcaa

SEQ ID NO: 3388344 - RNA, 20 nt, Human
cuucaaucaauaacagccgc

SEQ ID NO: 3388345 - RNA, 14 nt, Human
cuucaaucccagcc

SEQ ID NO: 3388346 - RNA, 15 nt, Human
cuucaauuccugggc

SEQ ID NO: 3388347 - RNA, 19 nt, Human
cuucaauuuauugcacaaa

SEQ ID NO: 3388348 - RNA, 10 nt, Human
cuucaauuug

SEQ ID NO: 3388349 - RNA, 14 nt, Human
cuucacaaagccca

SEQ ID NO: 3388350 - RNA, 23 nt, Human
cuucacaaagcccaagggaucug

SEQ ID NO: 3388351 - RNA, 14 nt, Human
cuucacaacagauu

SEQ ID NO: 3388352 - RNA, 21 nt, Human
ccuuuguccuccugcugccag

SEQ ID NO: 3388353 - RNA, 18 nt, Human
ccuuuguccuuuuucagg

SEQ ID NO: 3388354 - RNA, 12 nt, Human
ccuuugucuuuc

SEQ ID NO: 3388355 - RNA, 15 nt, Human
ccuuugugaggaagc

SEQ ID NO: 3388356 - RNA, 13 nt, Human
ccuuugugaguca

SEQ ID NO: 3388357 - RNA, 14 nt, Human
ccuuugugugcucu

SEQ ID NO: 3388358 - RNA, 18 nt, Human
ccuuuguuacuucucuaa

SEQ ID NO: 3388359 - RNA, 14 nt, Human
ccuuuuaacauuuu

SEQ ID NO: 3388360 - RNA, 18 nt, Human
ccuuuuacauacugcugu

SEQ ID NO: 3388361 - RNA, 20 nt, Human
ccuuuuacugguugcaugga

SEQ ID NO: 3388362 - RNA, 12 nt, Human
ccuuuuacugug

SEQ ID NO: 3388363 - RNA, 22 nt, Human
ccuuuuaguuccugugcacagc

SEQ ID NO: 3388364 - RNA, 22 nt, Human
ccuuuuauguaguaauugacau

SEQ ID NO: 3388365 - RNA, 19 nt, Human
ccuuuuauuuuuuucuaau

SEQ ID NO: 3388366 - RNA, 16 nt, Human
ccuuuucacccuucua

SEQ ID NO: 3388367 - RNA, 23 nt, Human
ccuuuucagcgauguaugcagcu

SEQ ID NO: 3388368 - RNA, 11 nt, Human
ccuuuucauag

SEQ ID NO: 3388369 - RNA, 20 nt, Human
ccuuuuccagagcauuccag

SEQ ID NO: 3388370 - RNA, 18 nt, Human
ccuuuuccauuugaaaga

SEQ ID NO: 3388371 - RNA, 21 nt, Human
ccuuuuccauuugaaagaaag

SEQ ID NO: 3388372 - RNA, 12 nt, Human
ccuuuucccaac

SEQ ID NO: 3388373 - RNA, 13 nt, Human
ccuuuucccugcu

SEQ ID NO: 3388374 - RNA, 19 nt, Human
ccuuuucgccuuuccucuc

SEQ ID NO: 3388375 - RNA, 21 nt, Human
ccuuuucuauuccuucuggcc

SEQ ID NO: 3388376 - RNA, 22 nt, Human
ccuuuucuauuccuucuggccu

SEQ ID NO: 3388377 - RNA, 13 nt, Human
ccuuuucucuuca

SEQ ID NO: 3388378 - RNA, 14 nt, Human
ccuuuucugcauuu

SEQ ID NO: 3388379 - RNA, 14 nt, Human
ccuuuucuguguuu

SEQ ID NO: 3388380 - RNA, 14 nt, Human
ccuuuucuguucua

SEQ ID NO: 3388381 - RNA, 9 nt, Human
ccuuuucuu

SEQ ID NO: 3388382 - RNA, 16 nt, Human
ccuuuucuuguaucug

SEQ ID NO: 3388383 - RNA, 17 nt, Human
ccuuuucuuguuuauca

SEQ ID NO: 3388384 - RNA, 18 nt, Human
ccuuuucuuuucuacccu

SEQ ID NO: 3388385 - RNA, 22 nt, Human
ccuuuucuuuucuacccuagcc

SEQ ID NO: 3388386 - RNA, 19 nt, Human
ccuuuucuuuuguuacugu

SEQ ID NO: 3388387 - RNA, 23 nt, Human
ccuuuucuuuuguuacuguucuu

SEQ ID NO: 3388388 - RNA, 23 nt, Human
ccuuuugaacgcccccccccacc

SEQ ID NO: 3388389 - RNA, 13 nt, Human
ccuuuugacacug

SEQ ID NO: 3388390 - RNA, 18 nt, Human
ccuuuugacacugcucua

SEQ ID NO: 3388391 - RNA, 14 nt, Human
ccuuuugcaccccu

SEQ ID NO: 3388392 - RNA, 18 nt, Human
ccuuuugcaccccuccca

SEQ ID NO: 3388393 - RNA, 20 nt, Human
ccuuuugcaccccucccauu

SEQ ID NO: 3388394 - RNA, 15 nt, Human
ccuuuugcagaagag

SEQ ID NO: 3388395 - RNA, 14 nt, Human
ccuuuugcaucauu

SEQ ID NO: 3388396 - RNA, 19 nt, Human
ccuuuuggcccccgagcug

SEQ ID NO: 3388397 - RNA, 20 nt, Human
ccuuuuggcccccgagcugg

SEQ ID NO: 3388398 - RNA, 17 nt, Human
ccuuuuguagaaugaac

SEQ ID NO: 3388399 - RNA, 11 nt, Human
ccuuuuguguu

SEQ ID NO: 3388400 - RNA, 19 nt, Human
ccuuuuguugagccaggcc

SEQ ID NO: 3388401 - RNA, 19 nt, Human
ccuuuuuaauaugcuuaaa

SEQ ID NO: 3388402 - RNA, 23 nt, Human
ccuuuuuacuccccuugagcuga

SEQ ID NO: 3388403 - RNA, 12 nt, Human
ccuuuuuauaac

SEQ ID NO: 3388404 - RNA, 12 nt, Human
ccuuuuucaaug

SEQ ID NO: 3388405 - RNA, 19 nt, Human
ccuuuuucauaaauuauuu

SEQ ID NO: 3388406 - RNA, 16 nt, Human
ccuuuuuccuagccug

SEQ ID NO: 3388407 - RNA, 17 nt, Human
ccuuuuuccucuccaca

SEQ ID NO: 3388408 - RNA, 14 nt, Human
ccuuuuuccuuguc

SEQ ID NO: 3388409 - RNA, 16 nt, Human
ccuuuuucuccagcug

SEQ ID NO: 3388410 - RNA, 21 nt, Human
ccuuuuucucccucuggauca

SEQ ID NO: 3388411 - RNA, 13 nt, Human
ccuuuuucugauu

SEQ ID NO: 3388412 - RNA, 18 nt, Human
ccuuuuucugcacuauau

SEQ ID NO: 3388413 - RNA, 16 nt, Human
ccuuuuucuuuauaaa

SEQ ID NO: 3388414 - RNA, 15 nt, Human
ccuuuuugacacuga

SEQ ID NO: 3388415 - RNA, 17 nt, Human
ccuuuuuuaaaaaugca

SEQ ID NO: 3388416 - RNA, 16 nt, Human
ccuuuuuuaaauaaau

SEQ ID NO: 3388417 - RNA, 21 nt, Human
ccuuuuuuaagauuuuucuca

SEQ ID NO: 3388418 - RNA, 22 nt, Human
ccuuuuuuaggaagcaagcuua

SEQ ID NO: 3388419 - RNA, 19 nt, Human
ccuuuuuuauacauaaaca

SEQ ID NO: 3388420 - RNA, 22 nt, Human
ccuuuuuuauuuuuuuaagcug

SEQ ID NO: 3388421 - RNA, 21 nt, Human
ccuuuuuucccauaagacaau

SEQ ID NO: 3388422 - RNA, 14 nt, Human
ccuuuuuuccccag

SEQ ID NO: 3388423 - RNA, 18 nt, Human
ccuuuuuuccccagacuu

SEQ ID NO: 3388424 - RNA, 16 nt, Human
ccuuuuuuccuuucca

SEQ ID NO: 3388425 - RNA, 20 nt, Human
ccuuuuuuggcugcugaagg

SEQ ID NO: 3388426 - RNA, 17 nt, Human
ccuuuuuugucccccaa

SEQ ID NO: 3388427 - RNA, 18 nt, Human
ccuuuuuuuccaucuuua

SEQ ID NO: 3388428 - RNA, 12 nt, Human
ccuuuuuuuuga

SEQ ID NO: 3388429 - RNA, 16 nt, Human
ccuuuuuuuuuucuug

SEQ ID NO: 3388430 - RNA, 19 nt, Human
cgaaaaaauaauuauuuau

SEQ ID NO: 3388431 - RNA, 13 nt, Human
cgaaaaccaggcc

SEQ ID NO: 3388432 - RNA, 19 nt, Human
cgaaaacccccaaaccaga

SEQ ID NO: 3388433 - RNA, 13 nt, Human
cgaaaaucaaaug

SEQ ID NO: 3388434 - RNA, 12 nt, Human
cgaaaaucauug

SEQ ID NO: 3388435 - RNA, 16 nt, Human
cgaaaccaaagaagaa

SEQ ID NO: 3388436 - RNA, 18 nt, Human
cgaaaccugggauucagg

SEQ ID NO: 3388437 - RNA, 15 nt, Human
cgaaacuggaaguua

SEQ ID NO: 3388438 - RNA, 18 nt, Human
cgaaacuggaaguuauuu

SEQ ID NO: 3388439 - RNA, 19 nt, Human
cgaaacuuguuauugugaa

SEQ ID NO: 3388440 - RNA, 21 nt, Human
cgaaacuuguuauugugaaug

SEQ ID NO: 3388441 - RNA, 18 nt, Human
cgaaagaaaacucuauuu

SEQ ID NO: 3388442 - RNA, 12 nt, Human
cgaaagaaggca

SEQ ID NO: 3388443 - RNA, 19 nt, Human
cgaaagaaggcauggacuu

SEQ ID NO: 3388444 - RNA, 23 nt, Human
cgaaagaaggcauggacuucugg

SEQ ID NO: 3388445 - RNA, 23 nt, Human
cgaaagaggcacccuuccaucug

SEQ ID NO: 3388446 - RNA, 11 nt, Human
cgaaagcacac

SEQ ID NO: 3388447 - RNA, 13 nt, Human
cgaaagcucuaga

SEQ ID NO: 3388448 - RNA, 15 nt, Human
cuucagcuccaggga

SEQ ID NO: 3388449 - RNA, 19 nt, Human
cuucagcugacuuuucugu

SEQ ID NO: 3388450 - RNA, 18 nt, Human
cuucagcuucuucaucuu

SEQ ID NO: 3388451 - RNA, 22 nt, Human
cuucaggaaccucgaguacugu

SEQ ID NO: 3388452 - RNA, 16 nt, Human
cuucaggagggagcau

SEQ ID NO: 3388453 - RNA, 21 nt, Human
cuucaggcauggggggugggg

SEQ ID NO: 3388454 - RNA, 20 nt, Human
cuucaggccucccucucucu

SEQ ID NO: 3388455 - RNA, 14 nt, Human
cuucaggcucuucu

SEQ ID NO: 3388456 - RNA, 16 nt, Human
cuucaggcucuucucc

SEQ ID NO: 3388457 - RNA, 18 nt, Human
cuucaggcucuucuccuu

SEQ ID NO: 3388458 - RNA, 19 nt, Human
cuucaggcucuucuccuuu

SEQ ID NO: 3388459 - RNA, 15 nt, Human
cuucaggcugccuaa

SEQ ID NO: 3388460 - RNA, 21 nt, Human
cuucaggcuuccugcaauuuu

SEQ ID NO: 3388461 - RNA, 18 nt, Human
cuucagggagucagcugu

SEQ ID NO: 3388462 - RNA, 15 nt, Human
cuucagggagugagg

SEQ ID NO: 3388463 - RNA, 9 nt, Human
cuucagggc

SEQ ID NO: 3388464 - RNA, 22 nt, Human
cuucagggcagauuuuaguuuu

SEQ ID NO: 3388465 - RNA, 17 nt, Human
cuucagggcagggcucu

SEQ ID NO: 3388466 - RNA, 18 nt, Human
cuucagggcagggcucug

SEQ ID NO: 3388467 - RNA, 20 nt, Human
cuucagggcagggcucugau

SEQ ID NO: 3388468 - RNA, 16 nt, Human
cuucagggcagguggg

SEQ ID NO: 3388469 - RNA, 23 nt, Human
cuucaggggagucccgucaggac

SEQ ID NO: 3388470 - RNA, 17 nt, Human
cuucaggggcacuucau

SEQ ID NO: 3388471 - RNA, 14 nt, Human
cuucaggggcugcc

SEQ ID NO: 3388472 - RNA, 17 nt, Human
cuucaggggcugcccgc

SEQ ID NO: 3388473 - RNA, 23 nt, Human
cuucaggggcugcccgcucccag

SEQ ID NO: 3388474 - RNA, 15 nt, Human
cuucagggggccagg

SEQ ID NO: 3388475 - RNA, 18 nt, Human
cuucagggugaugccagg

SEQ ID NO: 3388476 - RNA, 20 nt, Human
cuucaggguucuccucuccc

SEQ ID NO: 3388477 - RNA, 21 nt, Human
cuucaggguucuccucucccc

SEQ ID NO: 3388478 - RNA, 23 nt, Human
cuucagguaaagggcaaauaaug

SEQ ID NO: 3388479 - RNA, 21 nt, Human
cuucagguuaucgaaauaaca

SEQ ID NO: 3388480 - RNA, 22 nt, Human
cuucaguaaaugugauucaccu

SEQ ID NO: 3388481 - RNA, 14 nt, Human
cuucaguaagccgu

SEQ ID NO: 3388482 - RNA, 15 nt, Human
cuucaguaagccgug

SEQ ID NO: 3388483 - RNA, 16 nt, Human
cuucagucagaaaacu

SEQ ID NO: 3388484 - RNA, 16 nt, Human
cuucagucauuaaauu

SEQ ID NO: 3388485 - RNA, 17 nt, Human
cuucagucccuucccca

SEQ ID NO: 3388486 - RNA, 23 nt, Human
cuucagucucuauaccaauaaag

SEQ ID NO: 3388487 - RNA, 11 nt, Human
cuucagugccc

SEQ ID NO: 3388488 - RNA, 17 nt, Human
cuucagugcccaccaac

SEQ ID NO: 3388489 - RNA, 13 nt, Human
cuucagugccuua

SEQ ID NO: 3388490 - RNA, 14 nt, Human
cuucagugccuuau

SEQ ID NO: 3388491 - RNA, 18 nt, Human
cuucagugccuuauggaa

SEQ ID NO: 3388492 - RNA, 18 nt, Human
cuucaguggcagcugcuu

SEQ ID NO: 3388493 - RNA, 15 nt, Human
cuucagugggagaaa

SEQ ID NO: 3388494 - RNA, 17 nt, Human
cuucaguguauggaaau

SEQ ID NO: 3388495 - RNA, 17 nt, Human
cuucaguuaugauuuuu

SEQ ID NO: 3388496 - RNA, 17 nt, Human
cuucaguuauuggugga

SEQ ID NO: 3388497 - RNA, 12 nt, Human
cgaauauugcug

SEQ ID NO: 3388498 - RNA, 18 nt, Human
cgaaucagcuauuuacug

SEQ ID NO: 3388499 - RNA, 14 nt, Human
cgaaucauuuguuc

SEQ ID NO: 3388500 - RNA, 16 nt, Human
cgaauccaagcucccu

SEQ ID NO: 3388501 - RNA, 18 nt, Human
cgaauccaagcucccugc

SEQ ID NO: 3388502 - RNA, 22 nt, Human
cgaauccaagcucccugcccca

SEQ ID NO: 3388503 - RNA, 22 nt, Human
cgaaugacaaaaucaucuuugu

SEQ ID NO: 3388504 - RNA, 15 nt, Human
cgaaugaucuuucuu

SEQ ID NO: 3388505 - RNA, 16 nt, Human
cgaaugguagucuaac

SEQ ID NO: 3388506 - RNA, 15 nt, Human
cgaaugugucuuuag

SEQ ID NO: 3388507 - RNA, 16 nt, Human
cgaauuaauagcuuuu

SEQ ID NO: 3388508 - RNA, 16 nt, Human
cgaauuucugugcccu

SEQ ID NO: 3388509 - RNA, 16 nt, Human
cgaauuuuaaaagaug

SEQ ID NO: 3388510 - RNA, 17 nt, Human
cgacaaagcugcuaaau

SEQ ID NO: 3388511 - RNA, 16 nt, Human
cgacaaaucugucugc

SEQ ID NO: 3388512 - RNA, 16 nt, Human
cgacaagcacagucag

SEQ ID NO: 3388513 - RNA, 12 nt, Human
cgacaagugcug

SEQ ID NO: 3388514 - RNA, 20 nt, Human
cgacacgugggcuccccucu

SEQ ID NO: 3388515 - RNA, 22 nt, Human
cgacagagggaagaaaagagcu

SEQ ID NO: 3388516 - RNA, 22 nt, Human
cgacaggcgagagaggagccag

SEQ ID NO: 3388517 - RNA, 16 nt, Human
cgacagugagacucug

SEQ ID NO: 3388518 - RNA, 13 nt, Human
cgacaucacuguu

SEQ ID NO: 3388519 - RNA, 14 nt, Human
cgacauugucuccc

SEQ ID NO: 3388520 - RNA, 16 nt, Human
cgaccaccccugccuc

SEQ ID NO: 3388521 - RNA, 14 nt, Human
cgaccccaucugcc

SEQ ID NO: 3388522 - RNA, 17 nt, Human
cgaccccaucugcccag

SEQ ID NO: 3388523 - RNA, 18 nt, Human
cgaccccaucugcccagg

SEQ ID NO: 3388524 - RNA, 19 nt, Human
cgaccccaucugcccagga

SEQ ID NO: 3388525 - RNA, 15 nt, Human
cgacccucugggaac

SEQ ID NO: 3388526 - RNA, 19 nt, Human
cgacccuugccgucuaccu

SEQ ID NO: 3388527 - RNA, 20 nt, Human
cgacccuugccgucuaccug

SEQ ID NO: 3388528 - RNA, 13 nt, Human
cgaccgcccccuc

SEQ ID NO: 3388529 - RNA, 13 nt, Human
cgaccucagccuu

SEQ ID NO: 3388530 - RNA, 14 nt, Human
cgaccucagccuuc

SEQ ID NO: 3388531 - RNA, 23 nt, Human
cgaccucguccucccccugccag

SEQ ID NO: 3388532 - RNA, 23 nt, Human
cgaccugauuuacaguuucaaaa

SEQ ID NO: 3388533 - RNA, 18 nt, Human
cgaccugguuuuuaaaua

SEQ ID NO: 3388534 - RNA, 11 nt, Human
cgaccuuggcc

SEQ ID NO: 3388535 - RNA, 16 nt, Human
cgaccuuggccgcacc

SEQ ID NO: 3388536 - RNA, 23 nt, Human
cgacgccacagcccagccacgga

SEQ ID NO: 3388537 - RNA, 12 nt, Human
cgacgcccaccc

SEQ ID NO: 3388538 - RNA, 14 nt, Human
cgacgcccacccaa

SEQ ID NO: 3388539 - RNA, 16 nt, Human
cgacgcuugcucuguu

SEQ ID NO: 3388540 - RNA, 17 nt, Human
cgacuagacacacaaag

SEQ ID NO: 3388541 - RNA, 21 nt, Human
cgacucacaccacuagccuca

SEQ ID NO: 3388542 - RNA, 13 nt, Human
cgacucagccuca

SEQ ID NO: 3388543 - RNA, 15 nt, Human
cgacuccagccagcg

SEQ ID NO: 3388544 - RNA, 17 nt, Human
cgacuccagccagcgcc

SEQ ID NO: 3388545 - RNA, 16 nt, Human
cgacucuggcccuggc

SEQ ID NO: 3388546 - RNA, 18 nt, Human
cgacucuggcccuggccc

SEQ ID NO: 3388547 - RNA, 16 nt, Human
cgacucugugcuggcc

SEQ ID NO: 3388548 - RNA, 22 nt, Human
cgacucugugcuggccagcgag

SEQ ID NO: 3388549 - RNA, 17 nt, Human
cgacugaaaauauuguu

SEQ ID NO: 3388550 - RNA, 14 nt, Human
cgacugcaacagga

SEQ ID NO: 3388551 - RNA, 20 nt, Human
cgacugcacagcggccccug

SEQ ID NO: 3388552 - RNA, 14 nt, Human
cgacuggccagggc

SEQ ID NO: 3388553 - RNA, 20 nt, Human
cgacuggccagggccacgcu

SEQ ID NO: 3388554 - RNA, 15 nt, Human
cgacuggguuuaugu

SEQ ID NO: 3388555 - RNA, 19 nt, Human
cgacugugaccugugggga

SEQ ID NO: 3388556 - RNA, 22 nt, Human
cgacuugaauuuucccacugca

SEQ ID NO: 3388557 - RNA, 16 nt, Human
cgacuugccaaauuua

SEQ ID NO: 3388558 - RNA, 21 nt, Human
cgacuugcuguuuuguucugu

SEQ ID NO: 3388559 - RNA, 18 nt, Human
cgacuugugcacaggcag

SEQ ID NO: 3388560 - RNA, 14 nt, Human
cgacuuucugccug

SEQ ID NO: 3388561 - RNA, 15 nt, Human
cgacuuucugccugg

SEQ ID NO: 3388562 - RNA, 17 nt, Human
cgagaaacagccugugu

SEQ ID NO: 3388563 - RNA, 19 nt, Human
cgagaaagaggcaccagga

SEQ ID NO: 3388564 - RNA, 17 nt, Human
cgagaccagccuggcca

SEQ ID NO: 3388565 - RNA, 13 nt, Human
cgagaccauccug

SEQ ID NO: 3388566 - RNA, 18 nt, Human
cgagacuugguuucaaaa

SEQ ID NO: 3388567 - RNA, 14 nt, Human
cgagagccugcucc

SEQ ID NO: 3388568 - RNA, 19 nt, Human
cgagagccugcucccccac

SEQ ID NO: 3388569 - RNA, 20 nt, Human
cgagagccugcucccccacc

SEQ ID NO: 3388570 - RNA, 21 nt, Human
cgagagccugcucccccaccc

SEQ ID NO: 3388571 - RNA, 15 nt, Human
cgagaggcagagaaa

SEQ ID NO: 3388572 - RNA, 13 nt, Human
cgagagggagaga

SEQ ID NO: 3388573 - RNA, 20 nt, Human
cgagaggggaagaguguacu

SEQ ID NO: 3388574 - RNA, 15 nt, Human
cgagaggugggccag

SEQ ID NO: 3388575 - RNA, 15 nt, Human
cgagagucuggcccu

SEQ ID NO: 3388576 - RNA, 17 nt, Human
cgagagucuggcccuag

SEQ ID NO: 3388577 - RNA, 14 nt, Human
cgagagucugucuc

SEQ ID NO: 3388578 - RNA, 16 nt, Human
cgagaucacgccacug

SEQ ID NO: 3388579 - RNA, 14 nt, Human
cgagcaaagaucaa

SEQ ID NO: 3388580 - RNA, 16 nt, Human
cgagcaaccguggccc

SEQ ID NO: 3388581 - RNA, 23 nt, Human
cgagcaaccguggcccuuccugg

SEQ ID NO: 3388582 - RNA, 20 nt, Human
cgagcaauauuuauggaugc

SEQ ID NO: 3388583 - RNA, 21 nt, Human
cgagcagacacccuuggagcu

SEQ ID NO: 3388584 - RNA, 12 nt, Human
cgagcagcugag

SEQ ID NO: 3388585 - RNA, 13 nt, Human
cgagcagcugagc

SEQ ID NO: 3388586 - RNA, 16 nt, Human
cgagcagcugagcagg

SEQ ID NO: 3388587 - RNA, 19 nt, Human
cgagcagcugagcagggcc

SEQ ID NO: 3388588 - RNA, 14 nt, Human
cgagcaggaggccu

SEQ ID NO: 3388589 - RNA, 18 nt, Human
cgagcaggcuacugucag

SEQ ID NO: 3388590 - RNA, 14 nt, Human
cgagcaucccccaa

SEQ ID NO: 3388591 - RNA, 15 nt, Human
cgagcauccuggcca

SEQ ID NO: 3388592 - RNA, 18 nt, Human
cgagccaugauguggagu

SEQ ID NO: 3388593 - RNA, 19 nt, Human
cgagccaugauguggagug

SEQ ID NO: 3388594 - RNA, 16 nt, Human
cgagcccuacuuccag

SEQ ID NO: 3388595 - RNA, 23 nt, Human
cgagcccuguggaugagcccuca

SEQ ID NO: 3388596 - RNA, 22 nt, Human
cgagcccuugcccaugcugggc

SEQ ID NO: 3388597 - RNA, 15 nt, Human
cgagccgggccuggg

SEQ ID NO: 3388598 - RNA, 18 nt, Human
cgagccggggaguuucuu

SEQ ID NO: 3388599 - RNA, 23 nt, Human
cgagccucugucacugcaggcac

SEQ ID NO: 3388600 - RNA, 19 nt, Human
cgagcgcccagcuccugac

SEQ ID NO: 3388601 - RNA, 14 nt, Human
cgagcgcccugcag

SEQ ID NO: 3388602 - RNA, 18 nt, Human
cgagcucguguauccugg

SEQ ID NO: 3388603 - RNA, 21 nt, Human
cgagcucguguauccuggggc

SEQ ID NO: 3388604 - RNA, 24 nt, Human
cgagcugggaccaguaccuggguc

SEQ ID NO: 3388605 - RNA, 16 nt, Human
cgagcugggggccaug

SEQ ID NO: 3388606 - RNA, 21 nt, Human
cgagcuggugcauuacagaga

SEQ ID NO: 3388607 - RNA, 12 nt, Human
cgagcugucccc

SEQ ID NO: 3388608 - RNA, 16 nt, Human
cuuccagaaaacaaaa

SEQ ID NO: 3388609 - RNA, 16 nt, Human
cuuccagaagugugau

SEQ ID NO: 3388610 - RNA, 15 nt, Human
cuuccagaucacugc

SEQ ID NO: 3388611 - RNA, 17 nt, Human
cuuccagaucacugcca

SEQ ID NO: 3388612 - RNA, 12 nt, Human
cuuccagauccu

SEQ ID NO: 3388613 - RNA, 22 nt, Human
cuuccagauccucucuggggcu

SEQ ID NO: 3388614 - RNA, 19 nt, Human
cuuccagauggucauccag

SEQ ID NO: 3388615 - RNA, 18 nt, Human
cuuccagcuagugaccca

SEQ ID NO: 3388616 - RNA, 12 nt, Human
cuuccagcugcu

SEQ ID NO: 3388617 - RNA, 16 nt, Human
cuuccaggaaaaagga

SEQ ID NO: 3388618 - RNA, 18 nt, Human
cuuccaggaaacuccaca

SEQ ID NO: 3388619 - RNA, 19 nt, Human
cuuccaggaaacuccacau

SEQ ID NO: 3388620 - RNA, 21 nt, Human
cuuccaggaaacuccacaucu

SEQ ID NO: 3388621 - RNA, 22 nt, Human
cuuccaggaaacuccacaucug

SEQ ID NO: 3388622 - RNA, 11 nt, Human
cuuccaggcag

SEQ ID NO: 3388623 - RNA, 16 nt, Human
cuuccaggcugggaga

SEQ ID NO: 3388624 - RNA, 24 nt, Human
cuuccaggggugggacacccugug

SEQ ID NO: 3388625 - RNA, 18 nt, Human
cuuccagguaucuccagg

SEQ ID NO: 3388626 - RNA, 19 nt, Human
cuuccagguguuacuguaa

SEQ ID NO: 3388627 - RNA, 23 nt, Human
cuuccagguucugguuagcucag

SEQ ID NO: 3388628 - RNA, 20 nt, Human
cuuccaguccaaucucaugg

SEQ ID NO: 3388629 - RNA, 20 nt, Human
cuuccagucuuccugacacu

SEQ ID NO: 3388630 - RNA, 14 nt, Human
cuuccaguuugcuu

SEQ ID NO: 3388631 - RNA, 17 nt, Human
cuuccaguuugcuuugc

SEQ ID NO: 3388632 - RNA, 16 nt, Human
cuuccauacagcucua

SEQ ID NO: 3388633 - RNA, 12 nt, Human
cuuccauaguga

SEQ ID NO: 3388634 - RNA, 22 nt, Human
cuuccaucccaaccagugccaa

SEQ ID NO: 3388635 - RNA, 14 nt, Human
cuuccaucccagga

SEQ ID NO: 3388636 - RNA, 22 nt, Human
cuuccaucccaggacaccacac

SEQ ID NO: 3388637 - RNA, 14 nt, Human
cuuccaucccuacc

SEQ ID NO: 3388638 - RNA, 15 nt, Human
cuuccaucccuaccc

SEQ ID NO: 3388639 - RNA, 16 nt, Human
cuuccaucucugacuu

SEQ ID NO: 3388640 - RNA, 13 nt, Human
cuuccaugaauuu

SEQ ID NO: 3388641 - RNA, 19 nt, Human
cuuccaugaauuuuaaaau

SEQ ID NO: 3388642 - RNA, 20 nt, Human
aacagauguuucuuuuguau

SEQ ID NO: 3388643 - RNA, 22 nt, Human
aacagauuauuuuggaaaguuu

SEQ ID NO: 3388644 - RNA, 16 nt, Human
aacagauuggauuuua

SEQ ID NO: 3388645 - RNA, 15 nt, Human
aacagauuuggaaag

SEQ ID NO: 3388646 - RNA, 13 nt, Human
aacagauuuguga

SEQ ID NO: 3388647 - RNA, 15 nt, Human
aacagauuugugaac

SEQ ID NO: 3388648 - RNA, 23 nt, Human
cuugauguugcuuagucacuuau

SEQ ID NO: 3388649 - RNA, 13 nt, Human
cuugauuaaauca

SEQ ID NO: 3388650 - RNA, 18 nt, Human
cuugauuaagauuuuaca

SEQ ID NO: 3388651 - RNA, 18 nt, Human
cuugauucacaaugaaau

SEQ ID NO: 3388652 - RNA, 15 nt, Human
cuugauucagucaca

SEQ ID NO: 3388653 - RNA, 19 nt, Human
cuugauucauaaugacuua

SEQ ID NO: 3388654 - RNA, 16 nt, Human
cuugauuugagauuuu

SEQ ID NO: 3388655 - RNA, 24 nt, Human
cuugauuugaguugauugagaaga

SEQ ID NO: 3388656 - RNA, 12 nt, Human
cuugauuuuugc

SEQ ID NO: 3388657 - RNA, 16 nt, Human
cuugcaaaauuccuga

SEQ ID NO: 3388658 - RNA, 17 nt, Human
cuugcaaaauuccugac

SEQ ID NO: 3388659 - RNA, 19 nt, Human
cuugcaacacacagacaca

SEQ ID NO: 3388660 - RNA, 20 nt, Human
cuugcaacuucaugucaacu

SEQ ID NO: 3388661 - RNA, 22 nt, Human
cuugcaagaaucagugcaaaga

SEQ ID NO: 3388662 - RNA, 17 nt, Human
cuugcaauggcagccuu

SEQ ID NO: 3388663 - RNA, 19 nt, Human
cuugcacacaucaucugua

SEQ ID NO: 3388664 - RNA, 22 nt, Human
cuugcacacuccccugcacugg

SEQ ID NO: 3388665 - RNA, 23 nt, Human
cuugcacacuccccugcacugga

SEQ ID NO: 3388666 - RNA, 14 nt, Human
cuugcacagggauu

SEQ ID NO: 3388667 - RNA, 20 nt, Human
cuugcacagggauucucaca

SEQ ID NO: 3388668 - RNA, 18 nt, Human
cuugcaccaaauuaucuu

SEQ ID NO: 3388669 - RNA, 23 nt, Human
cuugcaccccaaagcuuuccugc

SEQ ID NO: 3388670 - RNA, 16 nt, Human
cuugcaccccucacuc

SEQ ID NO: 3388671 - RNA, 12 nt, Human
cuugcaccugca

SEQ ID NO: 3388672 - RNA, 19 nt, Human
cuugcacgaccgccccagu

SEQ ID NO: 3388673 - RNA, 19 nt, Human
cuugcacgcccauguguga

SEQ ID NO: 3388674 - RNA, 17 nt, Human
cuugcacucuucuacca

SEQ ID NO: 3388675 - RNA, 18 nt, Human
cuugcacuggccuucuga

SEQ ID NO: 3388676 - RNA, 16 nt, Human
cuugcagaacugccau

SEQ ID NO: 3388677 - RNA, 17 nt, Human
cuugcagaacugccauu

SEQ ID NO: 3388678 - RNA, 18 nt, Human
cuugcagaacugccauua

SEQ ID NO: 3388679 - RNA, 13 nt, Human
cuugcagaagcug

SEQ ID NO: 3388680 - RNA, 18 nt, Human
cuugcagacucuacagag

SEQ ID NO: 3388681 - RNA, 21 nt, Human
cuugcagacucuacagaggcc

SEQ ID NO: 3388682 - RNA, 15 nt, Human
cuugcagagaagccu

SEQ ID NO: 3388683 - RNA, 19 nt, Human
cuugcagcacucacacagg

SEQ ID NO: 3388684 - RNA, 22 nt, Human
cuugcagcucuccccuucucug

SEQ ID NO: 3388685 - RNA, 14 nt, Human
cuugcaguagauuu

SEQ ID NO: 3388686 - RNA, 22 nt, Human
cuugcaguagauuuucuuuaaa

SEQ ID NO: 3388687 - RNA, 19 nt, Human
cuugcaguaucggcacugu

SEQ ID NO: 3388688 - RNA, 16 nt, Human
cuugcaguucuugagu

SEQ ID NO: 3388689 - RNA, 14 nt, Human
cuugcauacaaaca

SEQ ID NO: 3388690 - RNA, 21 nt, Human
cuugcauaguaaauguaguuc

SEQ ID NO: 3388691 - RNA, 13 nt, Human
cuugcauauuuug

SEQ ID NO: 3388692 - RNA, 23 nt, Human
cuugcaucaauuuuucuuauuuc

SEQ ID NO: 3388693 - RNA, 19 nt, Human
cuugcauccaacuccagga

SEQ ID NO: 3388694 - RNA, 18 nt, Human
cuugcaucucauugcucu

SEQ ID NO: 3388695 - RNA, 17 nt, Human
cuugcaugaggcuagug

SEQ ID NO: 3388696 - RNA, 18 nt, Human
cuugcaugguuuggagcu

SEQ ID NO: 3388697 - RNA, 22 nt, Human
cuugcaugguuuggagcugauc

SEQ ID NO: 3388698 - RNA, 10 nt, Human
cuugcauuga

SEQ ID NO: 3388699 - RNA, 18 nt, Human
cuugcauugaauauauua

SEQ ID NO: 3388700 - RNA, 14 nt, Human
cuugcauugacauu

SEQ ID NO: 3388701 - RNA, 14 nt, Human
cuugcauugcagag

SEQ ID NO: 3388702 - RNA, 20 nt, Human
cuugcauuuuagcuaauuua

SEQ ID NO: 3388703 - RNA, 20 nt, Human
cuugccaaaguacagaauuu

SEQ ID NO: 3388704 - RNA, 13 nt, Human
cuugccaaauuua

SEQ ID NO: 3388705 - RNA, 21 nt, Human
cuugccaaccuguaauaaaua

SEQ ID NO: 3388706 - RNA, 22 nt, Human
cuugccaaccuguaauaaauau

SEQ ID NO: 3388707 - RNA, 19 nt, Human
cuugccacaccccccaccc

SEQ ID NO: 3388708 - RNA, 20 nt, Human
cuugccacagcucuugagga

SEQ ID NO: 3388709 - RNA, 13 nt, Human
cuugccaccccac

SEQ ID NO: 3388710 - RNA, 18 nt, Human
cuugccaccccacccucc

SEQ ID NO: 3388711 - RNA, 17 nt, Human
cuugccacuagggcucu

SEQ ID NO: 3388712 - RNA, 17 nt, Human
cuugccacugcacucca

SEQ ID NO: 3388713 - RNA, 19 nt, Human
cuugccagaaccaaauuaa

SEQ ID NO: 3388714 - RNA, 12 nt, Human
cuugccagagau

SEQ ID NO: 3388715 - RNA, 16 nt, Human
cuugccagagauccaa

SEQ ID NO: 3388716 - RNA, 13 nt, Human
cuugccagagccg

SEQ ID NO: 3388717 - RNA, 17 nt, Human
cuugccagaugcugcag

SEQ ID NO: 3388718 - RNA, 12 nt, Human
cuugccagcugc

SEQ ID NO: 3388719 - RNA, 21 nt, Human
cuugccaucccucccuccacc

SEQ ID NO: 3388720 - RNA, 22 nt, Human
cuugcccaccccacccccaccc

SEQ ID NO: 3388721 - RNA, 23 nt, Human
cuugcccagagaugccuccaccg

SEQ ID NO: 3388722 - RNA, 20 nt, Human
cuugcccaguuucagggcua

SEQ ID NO: 3388723 - RNA, 14 nt, Human
cuugcccauccuga

SEQ ID NO: 3388724 - RNA, 17 nt, Human
cuugcccaugcugggcu

SEQ ID NO: 3388725 - RNA, 18 nt, Human
cuugccccaacccccagc

SEQ ID NO: 3388726 - RNA, 16 nt, Human
cuugccccaucacugc

SEQ ID NO: 3388727 - RNA, 14 nt, Human
cuugccccccaccc

SEQ ID NO: 3388728 - RNA, 19 nt, Human
cuugccccccaccccagcc

SEQ ID NO: 3388729 - RNA, 22 nt, Human
cuugccccccuggccuccccca

SEQ ID NO: 3388730 - RNA, 20 nt, Human
cuugcccggauucugggagg

SEQ ID NO: 3388731 - RNA, 15 nt, Human
cuugcccuagaugag

SEQ ID NO: 3388732 - RNA, 12 nt, Human
cuugcccugacc

SEQ ID NO: 3388733 - RNA, 15 nt, Human
cuugcccugaccucc

SEQ ID NO: 3388734 - RNA, 11 nt, Human
cuugcccugcu

SEQ ID NO: 3388735 - RNA, 17 nt, Human
cuugcccuucccugucc

SEQ ID NO: 3388736 - RNA, 23 nt, Human
cuugcccuucccugucccucuaa

SEQ ID NO: 3388737 - RNA, 15 nt, Human
cuugcccuugcccug

SEQ ID NO: 3388738 - RNA, 17 nt, Human
cuugcccuuucccccca

SEQ ID NO: 3388739 - RNA, 22 nt, Human
cuugcccuuuccccccauguug

SEQ ID NO: 3388740 - RNA, 17 nt, Human
cuugccgaaacuggaag

SEQ ID NO: 3388741 - RNA, 21 nt, Human
cuugccgcgucgcccucccag

SEQ ID NO: 3388742 - RNA, 18 nt, Human
cuugccgucuaccugagg

SEQ ID NO: 3388743 - RNA, 17 nt, Human
cuugccuaaauuuaaug

SEQ ID NO: 3388744 - RNA, 19 nt, Human
cuugccuagggccuggucc

SEQ ID NO: 3388745 - RNA, 18 nt, Human
cuugccucaaugccagua

SEQ ID NO: 3388746 - RNA, 13 nt, Human
cuugccucauuuu

SEQ ID NO: 3388747 - RNA, 13 nt, Human
cuugccuccaggu

SEQ ID NO: 3388748 - RNA, 19 nt, Human
cuugccuccaggugcagag

SEQ ID NO: 3388749 - RNA, 21 nt, Human
cuugccuccaggugcagaggu

SEQ ID NO: 3388750 - RNA, 17 nt, Human
cuugccuccauggugcc

SEQ ID NO: 3388751 - RNA, 22 nt, Human
cuugccuccauggugccucugg

SEQ ID NO: 3388752 - RNA, 12 nt, Human
cuugccuccugg

SEQ ID NO: 3388753 - RNA, 15 nt, Human
cuugccuccugugua

SEQ ID NO: 3388754 - RNA, 23 nt, Human
cuugccucggcuccugcugcacc

SEQ ID NO: 3388755 - RNA, 13 nt, Human
cuugccucucugu

SEQ ID NO: 3388756 - RNA, 14 nt, Human
cuugccucucuguu

SEQ ID NO: 3388757 - RNA, 14 nt, Human
cuugccucugcaca

SEQ ID NO: 3388758 - RNA, 23 nt, Human
cuugccucuguccccuucucuca

SEQ ID NO: 3388759 - RNA, 13 nt, Human
cuugccucugugc

SEQ ID NO: 3388760 - RNA, 16 nt, Human
cuugccucugugcugu

SEQ ID NO: 3388761 - RNA, 20 nt, Human
cuugccucugugcugugugu

SEQ ID NO: 3388762 - RNA, 20 nt, Human
cuugccucuuuuaccugcug

SEQ ID NO: 3388763 - RNA, 22 nt, Human
cuugccucuuuuaccugcugcu

SEQ ID NO: 3388764 - RNA, 18 nt, Human
cuugccugaacauccuuc

SEQ ID NO: 3388765 - RNA, 22 nt, Human
cuugccugaacauccuuccuuc

SEQ ID NO: 3388766 - RNA, 20 nt, Human
cuugccuggagacguggaac

SEQ ID NO: 3388767 - RNA, 11 nt, Human
cuugccugugc

SEQ ID NO: 3388768 - RNA, 18 nt, Human
cuugccugugccagguga

SEQ ID NO: 3388769 - RNA, 17 nt, Human
cuugccuuucgaggccu

SEQ ID NO: 3388770 - RNA, 18 nt, Human
cuugccuuucgaggccug

SEQ ID NO: 3388771 - RNA, 14 nt, Human
cuugcgaauaacag

SEQ ID NO: 3388772 - RNA, 16 nt, Human
cuugcgaauccaagcu

SEQ ID NO: 3388773 - RNA, 19 nt, Human
cuugcgaauccaagcuccc

SEQ ID NO: 3388774 - RNA, 20 nt, Human
cuugcgaauccaagcucccu

SEQ ID NO: 3388775 - RNA, 14 nt, Human
cuugcgcauucuca

SEQ ID NO: 3388776 - RNA, 19 nt, Human
cuugcgcuuuugcugguca

SEQ ID NO: 3388777 - RNA, 20 nt, Human
cuugcggaaucacucugucc

SEQ ID NO: 3388778 - RNA, 17 nt, Human
cuugcggcaaaaggaaa

SEQ ID NO: 3388779 - RNA, 15 nt, Human
cuugcggcuccucag

SEQ ID NO: 3388780 - RNA, 15 nt, Human
cuugcguaugucugu

SEQ ID NO: 3388781 - RNA, 16 nt, Human
cuugcuaaucaguguc

SEQ ID NO: 3388782 - RNA, 18 nt, Human
cuugcuaaucagugucuc

SEQ ID NO: 3388783 - RNA, 20 nt, Human
cuugcuaccaguauuuagaa

SEQ ID NO: 3388784 - RNA, 16 nt, Human
cuugcuaccucaaggg

SEQ ID NO: 3388785 - RNA, 17 nt, Human
cuugcuauauugcccag

SEQ ID NO: 3388786 - RNA, 13 nt, Human
cuugcuauucugu

SEQ ID NO: 3388787 - RNA, 15 nt, Human
cuugcuauucugucc

SEQ ID NO: 3388788 - RNA, 20 nt, Human
cuugcuauucugucccuagg

SEQ ID NO: 3388789 - RNA, 15 nt, Human
cuugcucccugacug

SEQ ID NO: 3388790 - RNA, 17 nt, Human
cuugcucccuucagccc

SEQ ID NO: 3388791 - RNA, 18 nt, Human
cuugcucccuucagcccc

SEQ ID NO: 3388792 - RNA, 18 nt, Human
cuugcuccuccuucugcu

SEQ ID NO: 3388793 - RNA, 16 nt, Human
cuugcucuaucucaca

SEQ ID NO: 3388794 - RNA, 18 nt, Human
cuugcucuaucucacagc

SEQ ID NO: 3388795 - RNA, 17 nt, Human
cuugcucucccucuucu

SEQ ID NO: 3388796 - RNA, 20 nt, Human
cuugcucucccucuucucaa

SEQ ID NO: 3388797 - RNA, 16 nt, Human
cuucugccuucucaug

SEQ ID NO: 3388798 - RNA, 13 nt, Human
cuucugccuuuuu

SEQ ID NO: 3388799 - RNA, 16 nt, Human
cuucugcgccucaggc

SEQ ID NO: 3388800 - RNA, 10 nt, Human
cuucugcucc

SEQ ID NO: 3388801 - RNA, 14 nt, Human
cuucugcuccaccc

SEQ ID NO: 3388802 - RNA, 23 nt, Human
cuucugcuccacccuuggccugu

SEQ ID NO: 3388803 - RNA, 11 nt, Human
cuucugcuggg

SEQ ID NO: 3388804 - RNA, 19 nt, Human
cuucugcugggcuggggcc

SEQ ID NO: 3388805 - RNA, 18 nt, Human
cuucugcuggggccuggg

SEQ ID NO: 3388806 - RNA, 18 nt, Human
cuucugcuuaggagagac

SEQ ID NO: 3388807 - RNA, 15 nt, Human
cuucugcuuuguugu

SEQ ID NO: 3388808 - RNA, 20 nt, Human
cuucugcuuuucugcccugg

SEQ ID NO: 3388809 - RNA, 23 nt, Human
cuucugcuuuucugcccuggcug

SEQ ID NO: 3388810 - RNA, 16 nt, Human
cuucuggaauuuguuc

SEQ ID NO: 3388811 - RNA, 15 nt, Human
cuucuggacaggcuc

SEQ ID NO: 3388812 - RNA, 14 nt, Human
cuucuggagcccuu

SEQ ID NO: 3388813 - RNA, 18 nt, Human
cuucuggagucuccagug

SEQ ID NO: 3388814 - RNA, 17 nt, Human
cuucuggccaggaagcu

SEQ ID NO: 3388815 - RNA, 22 nt, Human
cuucuggccaggaagcuuuggu

SEQ ID NO: 3388816 - RNA, 11 nt, Human
cuucuggccuu

SEQ ID NO: 3388817 - RNA, 21 nt, Human
cuucuggccuuuccucucucc

SEQ ID NO: 3388818 - RNA, 22 nt, Human
cuucugggaagggguuucuaac

SEQ ID NO: 3388819 - RNA, 17 nt, Human
cuucugggagcaggaac

SEQ ID NO: 3388820 - RNA, 15 nt, Human
cuucugggagggcag

SEQ ID NO: 3388821 - RNA, 22 nt, Human
cuucugggagggcagcagggcu

SEQ ID NO: 3388822 - RNA, 19 nt, Human
cuucugggcaucuguucug

SEQ ID NO: 3388823 - RNA, 20 nt, Human
cuucugggcaucuguucugg

SEQ ID NO: 3388824 - RNA, 16 nt, Human
cuucugggccugacca

SEQ ID NO: 3388825 - RNA, 21 nt, Human
cuucugggcuucaucuggcaa

SEQ ID NO: 3388826 - RNA, 22 nt, Human
cuucugggcuucaucuggcaac

SEQ ID NO: 3388827 - RNA, 19 nt, Human
cuucugggguccccagggc

SEQ ID NO: 3388828 - RNA, 16 nt, Human
cuucuggguuccuucc

SEQ ID NO: 3388829 - RNA, 15 nt, Human
cuucugguacucucc

SEQ ID NO: 3388830 - RNA, 16 nt, Human
cuucugguacucuccu

SEQ ID NO: 3388831 - RNA, 19 nt, Human
cuucugguacucuccuaga

SEQ ID NO: 3388832 - RNA, 20 nt, Human
cuucuguaauuguguggauu

SEQ ID NO: 3388833 - RNA, 21 nt, Human
cuucuguaguuuuaucacaug

SEQ ID NO: 3388834 - RNA, 16 nt, Human
cuucuguauauaaaug

SEQ ID NO: 3388835 - RNA, 16 nt, Human
cuucugucaucuaccu

SEQ ID NO: 3388836 - RNA, 15 nt, Human
cuucuguccaagcag

SEQ ID NO: 3388837 - RNA, 16 nt, Human
cuucuguccuacucug

SEQ ID NO: 3388838 - RNA, 21 nt, Human
cuucuguccuacucuguguca

SEQ ID NO: 3388839 - RNA, 16 nt, Human
cuucuguccugugagg

SEQ ID NO: 3388840 - RNA, 11 nt, Human
cuucugucucc

SEQ ID NO: 3388841 - RNA, 16 nt, Human
cuucugugaugagcug

SEQ ID NO: 3388842 - RNA, 19 nt, Human
cuucugugaugagcugauc

SEQ ID NO: 3388843 - RNA, 14 nt, Human
cuucugugcaccug

SEQ ID NO: 3388844 - RNA, 15 nt, Human
cuucugugcaccugg

SEQ ID NO: 3388845 - RNA, 18 nt, Human
cuucugugcaccugggcu

SEQ ID NO: 3388846 - RNA, 19 nt, Human
cuucugugcccagaauacu

SEQ ID NO: 3388847 - RNA, 20 nt, Human
cuucugugcccagaauacug

SEQ ID NO: 3388848 - RNA, 15 nt, Human
cuucugugcccagcu

SEQ ID NO: 3388849 - RNA, 13 nt, Human
cuucuguggcuca

SEQ ID NO: 3388850 - RNA, 21 nt, Human
cuucuguggguuucuaaagcu

SEQ ID NO: 3388851 - RNA, 17 nt, Human
cuucuguguuugaacug

SEQ ID NO: 3388852 - RNA, 15 nt, Human
cuucuguugcugccu

SEQ ID NO: 3388853 - RNA, 20 nt, Human
cuucuguugcugccucaugc

SEQ ID NO: 3388854 - RNA, 15 nt, Human
cuucuguugucaccu

SEQ ID NO: 3388855 - RNA, 16 nt, Human
cuucuguuuagucucc

SEQ ID NO: 3388856 - RNA, 14 nt, Human
cuucuguuucuagu

SEQ ID NO: 3388857 - RNA, 15 nt, Human
cuucuguuuuauaau

SEQ ID NO: 3388858 - RNA, 20 nt, Human
cuucuguuuuauaauuuugu

SEQ ID NO: 3388859 - RNA, 16 nt, Human
cuucuguuuucaaucu

SEQ ID NO: 3388860 - RNA, 19 nt, Human
cuucuguuuucaaucucgu

SEQ ID NO: 3388861 - RNA, 14 nt, Human
cuucuguuuucugu

SEQ ID NO: 3388862 - RNA, 13 nt, Human
cuucuuaaagagu

SEQ ID NO: 3388863 - RNA, 13 nt, Human
cuucuuaaauauc

SEQ ID NO: 3388864 - RNA, 20 nt, Human
cuucuuaaucuuuucacaaa

SEQ ID NO: 3388865 - RNA, 21 nt, Human
cuucuuaaucuuuucacaaau

SEQ ID NO: 3388866 - RNA, 15 nt, Human
cuucuuaauguacau

SEQ ID NO: 3388867 - RNA, 17 nt, Human
cuucuuaauuaauuuga

SEQ ID NO: 3388868 - RNA, 21 nt, Human
cuucuuacaauaauucuauga

SEQ ID NO: 3388869 - RNA, 14 nt, Human
cuucuuacaugcau

SEQ ID NO: 3388870 - RNA, 15 nt, Human
cuucuuacaugcauu

SEQ ID NO: 3388871 - RNA, 17 nt, Human
cuucuuauucucacucc

SEQ ID NO: 3388872 - RNA, 15 nt, Human
cuucuucacccagcu

SEQ ID NO: 3388873 - RNA, 16 nt, Human
cuucuucacccagcua

SEQ ID NO: 3388874 - RNA, 18 nt, Human
cuucuucagagacuccug

SEQ ID NO: 3388875 - RNA, 21 nt, Human
cuucuucagagacuccugcag

SEQ ID NO: 3388876 - RNA, 21 nt, Human
cuucuucagccaccucucuuu

SEQ ID NO: 3388877 - RNA, 16 nt, Human
cuucuucauauucuaa

SEQ ID NO: 3388878 - RNA, 16 nt, Human
cuucuucauucuauca

SEQ ID NO: 3388879 - RNA, 18 nt, Human
cuucuuccaucccaggac

SEQ ID NO: 3388880 - RNA, 21 nt, Human
cuucuuccccuucccugacug

SEQ ID NO: 3388881 - RNA, 14 nt, Human
cuucuucccucccu

SEQ ID NO: 3388882 - RNA, 15 nt, Human
cuucuucucaaagca

SEQ ID NO: 3388883 - RNA, 19 nt, Human
cuucuucugucaucuaccu

SEQ ID NO: 3388884 - RNA, 13 nt, Human
cuucuucugucca

SEQ ID NO: 3388885 - RNA, 14 nt, Human
cuucuucuucagaa

SEQ ID NO: 3388886 - RNA, 13 nt, Human
cuucuugaauaua

SEQ ID NO: 3388887 - RNA, 20 nt, Human
cuucuugcauccuuccuaua

SEQ ID NO: 3388888 - RNA, 13 nt, Human
cuucuugccucug

SEQ ID NO: 3388889 - RNA, 16 nt, Human
cuucuugccucugugc

SEQ ID NO: 3388890 - RNA, 17 nt, Human
cuucuugccucugugcu

SEQ ID NO: 3388891 - RNA, 23 nt, Human
cuucuugcugcccugccccaagu

SEQ ID NO: 3388892 - RNA, 21 nt, Human
cuucuugcuucuuucuagaaa

SEQ ID NO: 3388893 - RNA, 18 nt, Human
cuucuuggggcccagugc

SEQ ID NO: 3388894 - RNA, 23 nt, Human
cuucuuggggcccagugcauggu

SEQ ID NO: 3388895 - RNA, 23 nt, Human
cuucuuggugcuuacacaucuca

SEQ ID NO: 3388896 - RNA, 16 nt, Human
cuucuugucagacaua

SEQ ID NO: 3388897 - RNA, 18 nt, Human
cuucuugucagacauaaa

SEQ ID NO: 3388898 - RNA, 13 nt, Human
cuucuugugaagg

SEQ ID NO: 3388899 - RNA, 15 nt, Human
cuucuugugaucuug

SEQ ID NO: 3388900 - RNA, 19 nt, Human
cuucuugugaucuugcucu

SEQ ID NO: 3388901 - RNA, 16 nt, Human
cuucuuguucugagau

SEQ ID NO: 3388902 - RNA, 22 nt, Human
cuucuuguucugagauucaaua

SEQ ID NO: 3388903 - RNA, 12 nt, Human
cuucuuuaaaca

SEQ ID NO: 3388904 - RNA, 20 nt, Human
cuucuuuaaucacuuaacau

SEQ ID NO: 3388905 - RNA, 20 nt, Human
cuucuuuauacuguaauuua

SEQ ID NO: 3388906 - RNA, 17 nt, Human
cuucuuucauuucuucu

SEQ ID NO: 3388907 - RNA, 13 nt, Human
cuucuuucccuuc

SEQ ID NO: 3388908 - RNA, 18 nt, Human
cuucuuucccuuccucca

SEQ ID NO: 3388909 - RNA, 19 nt, Human
cuucuuucccuuccuccau

SEQ ID NO: 3388910 - RNA, 15 nt, Human
cuucuuuccucuucc

SEQ ID NO: 3388911 - RNA, 16 nt, Human
cuucuuucuagaaaga

SEQ ID NO: 3388912 - RNA, 23 nt, Human
cuucuuucucucagccuuacauu

SEQ ID NO: 3388913 - RNA, 14 nt, Human
cuucuuugauaaug

SEQ ID NO: 3388914 - RNA, 19 nt, Human
cuucuuugauaauguuaaa

SEQ ID NO: 3388915 - RNA, 18 nt, Human
cuucuuugcagccugggu

SEQ ID NO: 3388916 - RNA, 15 nt, Human
cuucuuugcuugccu

SEQ ID NO: 3388917 - RNA, 12 nt, Human
cuucuuuuagca

SEQ ID NO: 3388918 - RNA, 16 nt, Human
cuucuuuucacauucu

SEQ ID NO: 3388919 - RNA, 13 nt, Human
cuucuuuugauua

SEQ ID NO: 3388920 - RNA, 16 nt, Human
cuucuuuugauuaugu

SEQ ID NO: 3388921 - RNA, 13 nt, Human
cuucuuuugcucu

SEQ ID NO: 3388922 - RNA, 15 nt, Human
cuucuuuuggcuucc

SEQ ID NO: 3388923 - RNA, 22 nt, Human
cuucuuuuucuggacucuggac

SEQ ID NO: 3388924 - RNA, 16 nt, Human
cuucuuuuuuuucauu

SEQ ID NO: 3388925 - RNA, 21 nt, Human
cuugaaaaaugugcaaaacag

SEQ ID NO: 3388926 - RNA, 23 nt, Human
cuugaaaacacuguucucugccc

SEQ ID NO: 3388927 - RNA, 12 nt, Human
cuugaaaauuaa

SEQ ID NO: 3388928 - RNA, 20 nt, Human
cuugaaaauuuuauuaaaaa

SEQ ID NO: 3388929 - RNA, 16 nt, Human
cuugaaacuuugggaa

SEQ ID NO: 3388930 - RNA, 13 nt, Human
cuugaaagaaaau

SEQ ID NO: 3388931 - RNA, 19 nt, Human
cuugaaagaagaaaagguu

SEQ ID NO: 3388932 - RNA, 19 nt, Human
cuugaaauauaggaacuua

SEQ ID NO: 3388933 - RNA, 18 nt, Human
cuugaaauauccugcuug

SEQ ID NO: 3388934 - RNA, 21 nt, Human
cuugaaauuaagaaggcaaaa

SEQ ID NO: 3388935 - RNA, 19 nt, Human
cuugaaauuugaauuuugu

SEQ ID NO: 3388936 - RNA, 14 nt, Human
cuugaaauuuuaac

SEQ ID NO: 3388937 - RNA, 19 nt, Human
cuugaacaaaagggucaga

SEQ ID NO: 3388938 - RNA, 22 nt, Human
cuugaacaaaagggucagagga

SEQ ID NO: 3388939 - RNA, 23 nt, Human
cuugaacacucaugcugaaagcc

SEQ ID NO: 3388940 - RNA, 23 nt, Human
cuugaacauuaauccacauguuu

SEQ ID NO: 3388941 - RNA, 14 nt, Human
cuugaacccgggag

SEQ ID NO: 3388942 - RNA, 19 nt, Human
cuugaacguuuucuaauug

SEQ ID NO: 3388943 - RNA, 21 nt, Human
cuugaacguuuucuaauugcu

SEQ ID NO: 3388944 - RNA, 13 nt, Human
cuugaacuccuga

SEQ ID NO: 3388945 - RNA, 14 nt, Human
cuugaacuccuggc

SEQ ID NO: 3388946 - RNA, 18 nt, Human
cuugaacuccuggccuca

SEQ ID NO: 3388947 - RNA, 13 nt, Human
cgccuccaggcca

SEQ ID NO: 3388948 - RNA, 16 nt, Human
cgccuccauccaaggc

SEQ ID NO: 3388949 - RNA, 13 nt, Human
cgccucccacugg

SEQ ID NO: 3388950 - RNA, 15 nt, Human
cgccucccacugggg

SEQ ID NO: 3388951 - RNA, 14 nt, Human
cgccucccagccug

SEQ ID NO: 3388952 - RNA, 15 nt, Human
cgccucccagccugg

SEQ ID NO: 3388953 - RNA, 17 nt, Human
cgccuccccaccuccag

SEQ ID NO: 3388954 - RNA, 19 nt, Human
cgccuccccaccuccaggc

SEQ ID NO: 3388955 - RNA, 16 nt, Human
cgccuccccugcccca

SEQ ID NO: 3388956 - RNA, 14 nt, Human
cgccuccgagggac

SEQ ID NO: 3388957 - RNA, 17 nt, Human
cgccuccgggaccccca

SEQ ID NO: 3388958 - RNA, 15 nt, Human
cgccucgcccaccgc

SEQ ID NO: 3388959 - RNA, 22 nt, Human
cgccucgcccaccgcaugcccc

SEQ ID NO: 3388960 - RNA, 13 nt, Human
cgccucugcauuc

SEQ ID NO: 3388961 - RNA, 15 nt, Human
cgccucuuucaagca

SEQ ID NO: 3388962 - RNA, 16 nt, Human
cgccugacagaaacca

SEQ ID NO: 3388963 - RNA, 16 nt, Human
cgccugagcccaggga

SEQ ID NO: 3388964 - RNA, 20 nt, Human
cgccugagcccagggaggcc

SEQ ID NO: 3388965 - RNA, 16 nt, Human
cgccugagcucacucg

SEQ ID NO: 3388966 - RNA, 18 nt, Human
cgccugcaaacgcugccu

SEQ ID NO: 3388967 - RNA, 19 nt, Human
cgccugcaaacgcugccug

SEQ ID NO: 3388968 - RNA, 20 nt, Human
cgccugcaaacgcugccugc

SEQ ID NO: 3388969 - RNA, 22 nt, Human
cgccugcaaacgcugccugccg

SEQ ID NO: 3388970 - RNA, 22 nt, Human
cgccugcacuccucagggcagc

SEQ ID NO: 3388971 - RNA, 15 nt, Human
cgccugcccaccugc

SEQ ID NO: 3388972 - RNA, 20 nt, Human
cgccugcccgucucucuccc

SEQ ID NO: 3388973 - RNA, 17 nt, Human
cgccugcccucauggcc

SEQ ID NO: 3388974 - RNA, 22 nt, Human
cgccugcccucauggccccucu

SEQ ID NO: 3388975 - RNA, 13 nt, Human
cgccugcccuccc

SEQ ID NO: 3388976 - RNA, 17 nt, Human
cgccugcuugucccugc

SEQ ID NO: 3388977 - RNA, 13 nt, Human
cgccuggagcccu

SEQ ID NO: 3388978 - RNA, 15 nt, Human
cgccuggauuucugg

SEQ ID NO: 3388979 - RNA, 20 nt, Human
cgccuggauuucugguucug

SEQ ID NO: 3388980 - RNA, 11 nt, Human
cgccuggcaga

SEQ ID NO: 3388981 - RNA, 14 nt, Human
cgccuggccaggag

SEQ ID NO: 3388982 - RNA, 20 nt, Human
cgccuggguccaaugcucag

SEQ ID NO: 3388983 - RNA, 23 nt, Human
cgccuggugaugcgcaguugcug

SEQ ID NO: 3388984 - RNA, 20 nt, Human
cgccuguaaucccagcacuu

SEQ ID NO: 3388985 - RNA, 15 nt, Human
cgccuguagucccag

SEQ ID NO: 3388986 - RNA, 20 nt, Human
cgccuguaguccuagccacu

SEQ ID NO: 3388987 - RNA, 17 nt, Human
cgccugugaugcugggc

SEQ ID NO: 3388988 - RNA, 16 nt, Human
cgccugugcacacaca

SEQ ID NO: 3388989 - RNA, 15 nt, Human
cgccuguucccccgc

SEQ ID NO: 3388990 - RNA, 14 nt, Human
cgccuuaagcugau

SEQ ID NO: 3388991 - RNA, 13 nt, Human
cgccuucacagca

SEQ ID NO: 3388992 - RNA, 14 nt, Human
cgccuucacagcag

SEQ ID NO: 3388993 - RNA, 22 nt, Human
cgccuucacuccggugugccug

SEQ ID NO: 3388994 - RNA, 19 nt, Human
cgccuucccuccugcuuug

SEQ ID NO: 3388995 - RNA, 19 nt, Human
cgccuuccuugaccuuccu

SEQ ID NO: 3388996 - RNA, 15 nt, Human
cgcgacaaugcaaac

SEQ ID NO: 3388997 - RNA, 16 nt, Human
cgcgacaaugcaaacc

SEQ ID NO: 3388998 - RNA, 14 nt, Human
cgcgaccuuggccg

SEQ ID NO: 3388999 - RNA, 16 nt, Human
cgcgaucccacacagg

SEQ ID NO: 3389000 - RNA, 15 nt, Human
cgcgaucucagcuca

SEQ ID NO: 3389001 - RNA, 14 nt, Human
cgcgaugggucagg

SEQ ID NO: 3389002 - RNA, 18 nt, Human
cgcgauguggaacugcug

SEQ ID NO: 3389003 - RNA, 16 nt, Human
cgcgccacaggacccu

SEQ ID NO: 3389004 - RNA, 22 nt, Human
cgcgccacuacacuccagccug

SEQ ID NO: 3389005 - RNA, 18 nt, Human
cgcgccacucgcuucccc

SEQ ID NO: 3389006 - RNA, 22 nt, Human
cgcgccacucgcuucccccaua

SEQ ID NO: 3389007 - RNA, 16 nt, Human
cgcgccccccucccag

SEQ ID NO: 3389008 - RNA, 21 nt, Human
cgcgccccccucccagaggcg

SEQ ID NO: 3389009 - RNA, 20 nt, Human
cgcgccccgaaaggucaccu

SEQ ID NO: 3389010 - RNA, 13 nt, Human
cgcgcgcgcacac

SEQ ID NO: 3389011 - RNA, 16 nt, Human
cgcgcuugcuggccag

SEQ ID NO: 3389012 - RNA, 16 nt, Human
cgcggagccugcauuu

SEQ ID NO: 3389013 - RNA, 12 nt, Human
cgcggccagccc

SEQ ID NO: 3389014 - RNA, 14 nt, Human
cgcggccagccccg

SEQ ID NO: 3389015 - RNA, 22 nt, Human
cgcggccagccccggcccuggg

SEQ ID NO: 3389016 - RNA, 21 nt, Human
cgcggcccucaguagucccug

SEQ ID NO: 3389017 - RNA, 18 nt, Human
cgcggcggagcuggcccc

SEQ ID NO: 3389018 - RNA, 22 nt, Human
cgcggcucccggggcagggcag

SEQ ID NO: 3389019 - RNA, 11 nt, Human
cgcgugcacac

SEQ ID NO: 3389020 - RNA, 19 nt, Human
cgcgugcacacaccagagc

SEQ ID NO: 3389021 - RNA, 17 nt, Human
cgcguugaaauuguaau

SEQ ID NO: 3389022 - RNA, 17 nt, Human
cgcguuguaaaauauag

SEQ ID NO: 3389023 - RNA, 15 nt, Human
cgcuaaagagcccuu

SEQ ID NO: 3389024 - RNA, 21 nt, Human
cgcuaaagagcccuugccucc

SEQ ID NO: 3389025 - RNA, 12 nt, Human
cgcuaaggaaga

SEQ ID NO: 3389026 - RNA, 21 nt, Human
cgcuaaucccgauucacccug

SEQ ID NO: 3389027 - RNA, 23 nt, Human
cgcuacaaaacgcgcagaugugc

SEQ ID NO: 3389028 - RNA, 16 nt, Human
cgcuacaccacucugg

SEQ ID NO: 3389029 - RNA, 23 nt, Human
cgcuacaccacucuggcagccac

SEQ ID NO: 3389030 - RNA, 22 nt, Human
cgcuacauuuccgccacauccc

SEQ ID NO: 3389031 - RNA, 16 nt, Human
cgcuacccgggaaggg

SEQ ID NO: 3389032 - RNA, 17 nt, Human
cgcuacccgggaagggg

SEQ ID NO: 3389033 - RNA, 12 nt, Human
cgcuaccucccu

SEQ ID NO: 3389034 - RNA, 15 nt, Human
cgcuaccucccuccc

SEQ ID NO: 3389035 - RNA, 20 nt, Human
cgcuacuaugauuuaauuug

SEQ ID NO: 3389036 - RNA, 13 nt, Human
cgcuagaggccug

SEQ ID NO: 3389037 - RNA, 14 nt, Human
cgcuagaggccuga

SEQ ID NO: 3389038 - RNA, 17 nt, Human
cgcuagaggccugagga

SEQ ID NO: 3389039 - RNA, 15 nt, Human
cgcuagcacagcucc

SEQ ID NO: 3389040 - RNA, 20 nt, Human
cgcuauaguuacuguccugu

SEQ ID NO: 3389041 - RNA, 18 nt, Human
cgcuaucugggaagcuau

SEQ ID NO: 3389042 - RNA, 14 nt, Human
cgcuaucuucacau

SEQ ID NO: 3389043 - RNA, 14 nt, Human
cgcuauuacaaaua

SEQ ID NO: 3389044 - RNA, 23 nt, Human
cgcucagcucauccaugccucag

SEQ ID NO: 3389045 - RNA, 22 nt, Human
cgcucaugggccccucugacuc

SEQ ID NO: 3389046 - RNA, 15 nt, Human
cgcuccaacuccaac

SEQ ID NO: 3389047 - RNA, 16 nt, Human
cgcuccaacuccaaca

SEQ ID NO: 3389048 - RNA, 15 nt, Human
cgcuccagcugcccc

SEQ ID NO: 3389049 - RNA, 18 nt, Human
cgcuccagcugccccggc

SEQ ID NO: 3389050 - RNA, 11 nt, Human
cgcuccaggua

SEQ ID NO: 3389051 - RNA, 19 nt, Human
cgcucccaacacaaggugg

SEQ ID NO: 3389052 - RNA, 19 nt, Human
cgcuccccacucugcucug

SEQ ID NO: 3389053 - RNA, 16 nt, Human
cgcuccccgccuguuc

SEQ ID NO: 3389054 - RNA, 18 nt, Human
cgcuccccgccuguuccc

SEQ ID NO: 3389055 - RNA, 15 nt, Human
cgcuccuggcccagc

SEQ ID NO: 3389056 - RNA, 21 nt, Human
cgcuccugucugccagccagc

SEQ ID NO: 3389057 - RNA, 20 nt, Human
cgcuccuuuguguguguguc

SEQ ID NO: 3389058 - RNA, 22 nt, Human
cgcucgaaguugaucuccccag

SEQ ID NO: 3389059 - RNA, 20 nt, Human
cgcucggaggccccaaagga

SEQ ID NO: 3389060 - RNA, 23 nt, Human
cgcucguguguucuauccaaaca

SEQ ID NO: 3389061 - RNA, 14 nt, Human
cgcucucaguucuc

SEQ ID NO: 3389062 - RNA, 13 nt, Human
cgcucuccugcca

SEQ ID NO: 3389063 - RNA, 17 nt, Human
cgcucuccuuucuuucu

SEQ ID NO: 3389064 - RNA, 13 nt, Human
cgcucucuggccu

SEQ ID NO: 3389065 - RNA, 15 nt, Human
cgcucucuuccugcc

SEQ ID NO: 3389066 - RNA, 13 nt, Human
cgcucucuuuucu

SEQ ID NO: 3389067 - RNA, 20 nt, Human
cgcucugcaugcggcccagc

SEQ ID NO: 3389068 - RNA, 17 nt, Human
cgcucugcuggccuggc

SEQ ID NO: 3389069 - RNA, 13 nt, Human
cgcucugcugugg

SEQ ID NO: 3389070 - RNA, 22 nt, Human
cgcucuguugcccaggcuggag

SEQ ID NO: 3389071 - RNA, 13 nt, Human
cgcucuuugagaa

SEQ ID NO: 3389072 - RNA, 13 nt, Human
cgcugaauaaaug

SEQ ID NO: 3389073 - RNA, 23 nt, Human
cgcugacaaccaccgcuccccag

SEQ ID NO: 3389074 - RNA, 16 nt, Human
cgcugacuacagggcc

SEQ ID NO: 3389075 - RNA, 17 nt, Human
cgcugacuacagggccg

SEQ ID NO: 3389076 - RNA, 22 nt, Human
cuuggcccaggaguuuggccag

SEQ ID NO: 3389077 - RNA, 15 nt, Human
cuuggcccagggggc

SEQ ID NO: 3389078 - RNA, 18 nt, Human
cuuggcccagggggcuuc

SEQ ID NO: 3389079 - RNA, 22 nt, Human
cuuggccgcaccuaaagcagcc

SEQ ID NO: 3389080 - RNA, 20 nt, Human
cuuggccggcugugcucaga

SEQ ID NO: 3389081 - RNA, 22 nt, Human
cuuggccggcugugcucagaga

SEQ ID NO: 3389082 - RNA, 12 nt, Human
cuuggccucaga

SEQ ID NO: 3389083 - RNA, 13 nt, Human
cuuggccucagag

SEQ ID NO: 3389084 - RNA, 14 nt, Human
cuuggccucccaag

SEQ ID NO: 3389085 - RNA, 14 nt, Human
cuuggccucucucu

SEQ ID NO: 3389086 - RNA, 16 nt, Human
cuuggccucucucuag

SEQ ID NO: 3389087 - RNA, 16 nt, Human
cuuggccugcugugau

SEQ ID NO: 3389088 - RNA, 12 nt, Human
cuuggccugggc

SEQ ID NO: 3389089 - RNA, 17 nt, Human
cuuggccugucucaucc

SEQ ID NO: 3389090 - RNA, 14 nt, Human
cuuggcgaugccag

SEQ ID NO: 3389091 - RNA, 18 nt, Human
cuuggcgaugccagccaa

SEQ ID NO: 3389092 - RNA, 20 nt, Human
cuuggcgaugccagccaagc

SEQ ID NO: 3389093 - RNA, 12 nt, Human
cuuggcgcugcc

SEQ ID NO: 3389094 - RNA, 17 nt, Human
cuuggcgcugccccugg

SEQ ID NO: 3389095 - RNA, 23 nt, Human
cuuggcgcugccccuggcagccc

SEQ ID NO: 3389096 - RNA, 15 nt, Human
cuuggcggcagcagc

SEQ ID NO: 3389097 - RNA, 18 nt, Human
cuuggcguggagcaggcg

SEQ ID NO: 3389098 - RNA, 14 nt, Human
cuuggcucagacau

SEQ ID NO: 3389099 - RNA, 22 nt, Human
cuuggcuccaugcuccucacug

SEQ ID NO: 3389100 - RNA, 21 nt, Human
cuuggcucgaaucucugugcc

SEQ ID NO: 3389101 - RNA, 22 nt, Human
cuuggcucgaaucucugugccu

SEQ ID NO: 3389102 - RNA, 22 nt, Human
cuuggcucucaaugcuguuugg

SEQ ID NO: 3389103 - RNA, 17 nt, Human
cuugaacugagcuugga

SEQ ID NO: 3389104 - RNA, 20 nt, Human
cuugaacuggguacuugugg

SEQ ID NO: 3389105 - RNA, 14 nt, Human
cuugaacuugccuc

SEQ ID NO: 3389106 - RNA, 15 nt, Human
cuugaacuugccucu

SEQ ID NO: 3389107 - RNA, 19 nt, Human
cuugaacuuuccuggaugu

SEQ ID NO: 3389108 - RNA, 20 nt, Human
cuugaagaucguuaguaucu

SEQ ID NO: 3389109 - RNA, 19 nt, Human
cuugaagccaaagaaaaau

SEQ ID NO: 3389110 - RNA, 18 nt, Human
cuugaagccacugaagcu

SEQ ID NO: 3389111 - RNA, 19 nt, Human
cuugaagccacugaagcug

SEQ ID NO: 3389112 - RNA, 15 nt, Human
cuugaagccugcucc

SEQ ID NO: 3389113 - RNA, 15 nt, Human
cuugaaggaaaaauu

SEQ ID NO: 3389114 - RNA, 23 nt, Human
cuugaaggaucuguuuuuaaaaa

SEQ ID NO: 3389115 - RNA, 17 nt, Human
cuugaaggcccugcuga

SEQ ID NO: 3389116 - RNA, 15 nt, Human
cuugaagggcccagg

SEQ ID NO: 3389117 - RNA, 11 nt, Human
cuugaagucag

SEQ ID NO: 3389118 - RNA, 15 nt, Human
cuugaaguccuggcu

SEQ ID NO: 3389119 - RNA, 17 nt, Human
cuugaaguccuggcuuc

SEQ ID NO: 3389120 - RNA, 19 nt, Human
cuugaauaaccaucugaaa

SEQ ID NO: 3389121 - RNA, 19 nt, Human
cuugaauacucugcccucu

SEQ ID NO: 3389122 - RNA, 13 nt, Human
cuugaauaguauu

SEQ ID NO: 3389123 - RNA, 15 nt, Human
cuugaauaguauugu

SEQ ID NO: 3389124 - RNA, 17 nt, Human
cuugaauaguauugugu

SEQ ID NO: 3389125 - RNA, 18 nt, Human
cuugaauaguauuguguu

SEQ ID NO: 3389126 - RNA, 23 nt, Human
cuugaauccuuccauuccacaca

SEQ ID NO: 3389127 - RNA, 20 nt, Human
cuugaaugaugccaugagga

SEQ ID NO: 3389128 - RNA, 14 nt, Human
cuugaaugcugcca

SEQ ID NO: 3389129 - RNA, 15 nt, Human
cuugaaugcugccag

SEQ ID NO: 3389130 - RNA, 16 nt, Human
cuugaaugcugccagu

SEQ ID NO: 3389131 - RNA, 21 nt, Human
cuugaauggcaauguuuugcu

SEQ ID NO: 3389132 - RNA, 23 nt, Human
cuugaauggcaauguuuugcuuu

SEQ ID NO: 3389133 - RNA, 21 nt, Human
cuugaauguagcagccccggg

SEQ ID NO: 3389134 - RNA, 19 nt, Human
cuugaauguggcuugagaa

SEQ ID NO: 3389135 - RNA, 20 nt, Human
cuugaauguggcuugagaaa

SEQ ID NO: 3389136 - RNA, 18 nt, Human
cuugaauguggucucagg

SEQ ID NO: 3389137 - RNA, 15 nt, Human
cuugaaugugucagg

SEQ ID NO: 3389138 - RNA, 20 nt, Human
cuugaauuguaacuguucuu

SEQ ID NO: 3389139 - RNA, 22 nt, Human
cuugaauuuucccacugcaccc

SEQ ID NO: 3389140 - RNA, 20 nt, Human
cuugacaaaaccuaacuugc

SEQ ID NO: 3389141 - RNA, 18 nt, Human
cuugacaaacuucuuuca

SEQ ID NO: 3389142 - RNA, 16 nt, Human
cuugacaaagucaagc

SEQ ID NO: 3389143 - RNA, 19 nt, Human
cuugacaaagucaagccac

SEQ ID NO: 3389144 - RNA, 23 nt, Human
cuugacacauaguuuuucagucu

SEQ ID NO: 3389145 - RNA, 12 nt, Human
cuugacagcuca

SEQ ID NO: 3389146 - RNA, 20 nt, Human
cuugacaguggaacuacauu

SEQ ID NO: 3389147 - RNA, 19 nt, Human
cuugacauaauuucacuga

SEQ ID NO: 3389148 - RNA, 16 nt, Human
cuugacaucaacugca

SEQ ID NO: 3389149 - RNA, 19 nt, Human
cuugacaucuggaaaccuc

SEQ ID NO: 3389150 - RNA, 18 nt, Human
cuugaccaagcaggaagc

SEQ ID NO: 3389151 - RNA, 20 nt, Human
cuugaccagcagaucccagc

SEQ ID NO: 3389152 - RNA, 13 nt, Human
cuugaccaggcug

SEQ ID NO: 3389153 - RNA, 21 nt, Human
cuugaccauucuccaccugcc

SEQ ID NO: 3389154 - RNA, 16 nt, Human
cuugacccaucucccc

SEQ ID NO: 3389155 - RNA, 16 nt, Human
cuugacccugcacccu

SEQ ID NO: 3389156 - RNA, 17 nt, Human
cuugaccgugaggccag

SEQ ID NO: 3389157 - RNA, 20 nt, Human
cuugaccgugaggccagaga

SEQ ID NO: 3389158 - RNA, 22 nt, Human
cuugaccgugaggccagagaca

SEQ ID NO: 3389159 - RNA, 13 nt, Human
cuugaccucaggu

SEQ ID NO: 3389160 - RNA, 17 nt, Human
cuugaccugaggcugug

SEQ ID NO: 3389161 - RNA, 20 nt, Human
cuugaccugaggcugugguc

SEQ ID NO: 3389162 - RNA, 19 nt, Human
cuugaccugcauuguaaau

SEQ ID NO: 3389163 - RNA, 20 nt, Human
cuugaccugcauuguaaaua

SEQ ID NO: 3389164 - RNA, 13 nt, Human
cuugaccuuccuc

SEQ ID NO: 3389165 - RNA, 14 nt, Human
cuugaccuuccucu

SEQ ID NO: 3389166 - RNA, 17 nt, Human
cuugaccuuccucuggg

SEQ ID NO: 3389167 - RNA, 21 nt, Human
cuugaccuuccucuggggcuc

SEQ ID NO: 3389168 - RNA, 13 nt, Human
cuugaccuuugua

SEQ ID NO: 3389169 - RNA, 22 nt, Human
cuugaccuuuguacagcccaga

SEQ ID NO: 3389170 - RNA, 16 nt, Human
cuugacuauuggagga

SEQ ID NO: 3389171 - RNA, 13 nt, Human
cuugacuccuugu

SEQ ID NO: 3389172 - RNA, 22 nt, Human
cuugacuugcaauuucuaccua

SEQ ID NO: 3389173 - RNA, 20 nt, Human
cuugacuuuagucugcaaaa

SEQ ID NO: 3389174 - RNA, 19 nt, Human
cuugacuuugaacuaauga

SEQ ID NO: 3389175 - RNA, 19 nt, Human
cuugacuuugcuccucaca

SEQ ID NO: 3389176 - RNA, 13 nt, Human
cuugagaaaccuu

SEQ ID NO: 3389177 - RNA, 19 nt, Human
cuugagaacuuuauuucca

SEQ ID NO: 3389178 - RNA, 17 nt, Human
cuugagacuguuuugaa

SEQ ID NO: 3389179 - RNA, 22 nt, Human
cuugagacuguuuugaauuugg

SEQ ID NO: 3389180 - RNA, 14 nt, Human
cuugagagggugga

SEQ ID NO: 3389181 - RNA, 20 nt, Human
cuugagaguagaugguuuga

SEQ ID NO: 3389182 - RNA, 22 nt, Human
cuugagcauguuacugacagag

SEQ ID NO: 3389183 - RNA, 12 nt, Human
cuugagcccagg

SEQ ID NO: 3389184 - RNA, 21 nt, Human
cuugagcccuccccaggaauu

SEQ ID NO: 3389185 - RNA, 12 nt, Human
cuugagcccugg

SEQ ID NO: 3389186 - RNA, 20 nt, Human
cuugagccuugaacuuugac

SEQ ID NO: 3389187 - RNA, 13 nt, Human
cuugagcucagga

SEQ ID NO: 3389188 - RNA, 12 nt, Human
cuugagcucuau

SEQ ID NO: 3389189 - RNA, 13 nt, Human
cuugagcugagau

SEQ ID NO: 3389190 - RNA, 16 nt, Human
cuugagcugagaugga

SEQ ID NO: 3389191 - RNA, 17 nt, Human
cuugagcuggccucucu

SEQ ID NO: 3389192 - RNA, 18 nt, Human
cuugaggacacaugucca

SEQ ID NO: 3389193 - RNA, 14 nt, Human
cuugaggaguguga

SEQ ID NO: 3389194 - RNA, 24 nt, Human
cuugaggcuuagcuuugcucugcc

SEQ ID NO: 3389195 - RNA, 18 nt, Human
cuugagggcaagagccac

SEQ ID NO: 3389196 - RNA, 17 nt, Human
cuugagggcccagagca

SEQ ID NO: 3389197 - RNA, 18 nt, Human
cuugagggcccagagcag

SEQ ID NO: 3389198 - RNA, 15 nt, Human
cuugagggcugcagu

SEQ ID NO: 3389199 - RNA, 19 nt, Human
cuugaggggaagcuagucu

SEQ ID NO: 3389200 - RNA, 23 nt, Human
cuugaggggaagcuagucuuuug

SEQ ID NO: 3389201 - RNA, 13 nt, Human
cuugagggggaag

SEQ ID NO: 3389202 - RNA, 15 nt, Human
cuugaggucucagcc

SEQ ID NO: 3389203 - RNA, 12 nt, Human
cuugaguaaaau

SEQ ID NO: 3389204 - RNA, 21 nt, Human
cuugaguaaaauacucuuuuu

SEQ ID NO: 3389205 - RNA, 21 nt, Human
cuugagugggguuaucucugu

SEQ ID NO: 3389206 - RNA, 17 nt, Human
cuugaguucccagaugg

SEQ ID NO: 3389207 - RNA, 23 nt, Human
cuugaguuguuuuuguauauugg

SEQ ID NO: 3389208 - RNA, 16 nt, Human
cuugaguuugucgcuc

SEQ ID NO: 3389209 - RNA, 16 nt, Human
cuugauaaagggccaa

SEQ ID NO: 3389210 - RNA, 22 nt, Human
cuugauaauuuuccuuuaauau

SEQ ID NO: 3389211 - RNA, 15 nt, Human
cuugauacauucaaa

SEQ ID NO: 3389212 - RNA, 19 nt, Human
cuugauaccccccucuguc

SEQ ID NO: 3389213 - RNA, 12 nt, Human
cuugauagaaau

SEQ ID NO: 3389214 - RNA, 17 nt, Human
cuugauagaaaugccaa

SEQ ID NO: 3389215 - RNA, 23 nt, Human
cuugauagccucauuaaagcauu

SEQ ID NO: 3389216 - RNA, 17 nt, Human
cuugauauccucuuuga

SEQ ID NO: 3389217 - RNA, 23 nt, Human
cuugauauuuguauuuauucuuu

SEQ ID NO: 3389218 - RNA, 14 nt, Human
cuugauauuuucua

SEQ ID NO: 3389219 - RNA, 17 nt, Human
cuugaucaacaucuuuu

SEQ ID NO: 3389220 - RNA, 23 nt, Human
cuuguaaagacugguuuucugcc

SEQ ID NO: 3389221 - RNA, 12 nt, Human
cuuguaaauaca

SEQ ID NO: 3389222 - RNA, 15 nt, Human
cuuguaaauacacca

SEQ ID NO: 3389223 - RNA, 16 nt, Human
cuuguaaauagcucag

SEQ ID NO: 3389224 - RNA, 17 nt, Human
cuuguaacaagaaaaca

SEQ ID NO: 3389225 - RNA, 17 nt, Human
cuuguaacuaaaauaau

SEQ ID NO: 3389226 - RNA, 22 nt, Human
cuuguaacuaaaauaauuuugu

SEQ ID NO: 3389227 - RNA, 20 nt, Human
cuuguaagagcuauacaguu

SEQ ID NO: 3389228 - RNA, 16 nt, Human
cuuguaauauuuugua

SEQ ID NO: 3389229 - RNA, 22 nt, Human
cuuguaaugauauagccagaaa

SEQ ID NO: 3389230 - RNA, 13 nt, Human
cuuguaauguaac

SEQ ID NO: 3389231 - RNA, 13 nt, Human
cuuguaauucuaa

SEQ ID NO: 3389232 - RNA, 16 nt, Human
cuuguaauucuaaaug

SEQ ID NO: 3389233 - RNA, 22 nt, Human
cuuguaauuuaaacaggcccag

SEQ ID NO: 3389234 - RNA, 22 nt, Human
cuuguaauuuuuuuaauuuaca

SEQ ID NO: 3389235 - RNA, 16 nt, Human
cuuguacacucauuca

SEQ ID NO: 3389236 - RNA, 12 nt, Human
cuuguacauaau

SEQ ID NO: 3389237 - RNA, 13 nt, Human
cuuguacaugugu

SEQ ID NO: 3389238 - RNA, 23 nt, Human
cuuguaccucuggcugacuaaau

SEQ ID NO: 3389239 - RNA, 21 nt, Human
cuuguagaacucacucugggc

SEQ ID NO: 3389240 - RNA, 23 nt, Human
cuuguagaacucacucugggcug

SEQ ID NO: 3389241 - RNA, 15 nt, Human
cuuguagaauuguua

SEQ ID NO: 3389242 - RNA, 15 nt, Human
cuuguagccagccgg

SEQ ID NO: 3389243 - RNA, 18 nt, Human
cuuguagcccaggcugga

SEQ ID NO: 3389244 - RNA, 21 nt, Human
cuuguagcccuuuccaagcuu

SEQ ID NO: 3389245 - RNA, 12 nt, Human
cuuguagccuuu

SEQ ID NO: 3389246 - RNA, 23 nt, Human
cuuguagcggaugauucuucaag

SEQ ID NO: 3389247 - RNA, 14 nt, Human
cuuguagcuccucc

SEQ ID NO: 3389248 - RNA, 16 nt, Human
cuuguagcuccucccc

SEQ ID NO: 3389249 - RNA, 21 nt, Human
cuuguaggagcugagguuuca

SEQ ID NO: 3389250 - RNA, 17 nt, Human
cuuguagggaugccuuu

SEQ ID NO: 3389251 - RNA, 22 nt, Human
cuuguaggggaggggcuccuuu

SEQ ID NO: 3389252 - RNA, 23 nt, Human
cuuguaggggaggggcuccuuuc

SEQ ID NO: 3389253 - RNA, 17 nt, Human
cuuguauaaauguauau

SEQ ID NO: 3389254 - RNA, 18 nt, Human
cuuguauaaauguauaua

SEQ ID NO: 3389255 - RNA, 19 nt, Human
cuuguauaaauguauauac

SEQ ID NO: 3389256 - RNA, 21 nt, Human
cuuguauagcaugaaauaaaa

SEQ ID NO: 3389257 - RNA, 19 nt, Human
cgcuggaccuugaacuggg

SEQ ID NO: 3389258 - RNA, 20 nt, Human
cgcuggaggaugugggcagc

SEQ ID NO: 3389259 - RNA, 17 nt, Human
cgcuggagugcagugag

SEQ ID NO: 3389260 - RNA, 11 nt, Human
cgcuggcccag

SEQ ID NO: 3389261 - RNA, 23 nt, Human
cgcuggcccagccggccucucug

SEQ ID NO: 3389262 - RNA, 16 nt, Human
cgcuggcccccacugg

SEQ ID NO: 3389263 - RNA, 18 nt, Human
cgcugggcacuucccugc

SEQ ID NO: 3389264 - RNA, 19 nt, Human
cgcugggcacuucccugcu

SEQ ID NO: 3389265 - RNA, 14 nt, Human
cgcugggcugagcc

SEQ ID NO: 3389266 - RNA, 15 nt, Human
cgcugggcugagccc

SEQ ID NO: 3389267 - RNA, 17 nt, Human
cgcugggcugagccccu

SEQ ID NO: 3389268 - RNA, 20 nt, Human
cgcuggggccaguugguccc

SEQ ID NO: 3389269 - RNA, 22 nt, Human
cgcuggguccuaauuaccaguc

SEQ ID NO: 3389270 - RNA, 14 nt, Human
cgcugggugguacc

SEQ ID NO: 3389271 - RNA, 23 nt, Human
cgcugguagagauggaggaggag

SEQ ID NO: 3389272 - RNA, 17 nt, Human
cgcuguaugucuuaaaa

SEQ ID NO: 3389273 - RNA, 22 nt, Human
cgcugucagccauuccuguucc

SEQ ID NO: 3389274 - RNA, 23 nt, Human
cgcugucccuaguaaaaauacaa

SEQ ID NO: 3389275 - RNA, 15 nt, Human
cgcugucuccagacc

SEQ ID NO: 3389276 - RNA, 16 nt, Human
cgcugucuccagaccc

SEQ ID NO: 3389277 - RNA, 20 nt, Human
cgcugucuccagacccccac

SEQ ID NO: 3389278 - RNA, 16 nt, Human
cgcugugagccccugg

SEQ ID NO: 3389279 - RNA, 11 nt, Human
cgcugugcugc

SEQ ID NO: 3389280 - RNA, 14 nt, Human
cgcugugcugcccu

SEQ ID NO: 3389281 - RNA, 17 nt, Human
cgcugugcugcccugcc

SEQ ID NO: 3389282 - RNA, 18 nt, Human
cgcugugcugcccugccc

SEQ ID NO: 3389283 - RNA, 14 nt, Human
cgcugugggcaggu

SEQ ID NO: 3389284 - RNA, 20 nt, Human
cgcuuaucaacuaaugauuu

SEQ ID NO: 3389285 - RNA, 18 nt, Human
cgcuucccccauagccac

SEQ ID NO: 3389286 - RNA, 16 nt, Human
cgcuucccuccugccc

SEQ ID NO: 3389287 - RNA, 20 nt, Human
cgcuuccggcuccugugcuu

SEQ ID NO: 3389288 - RNA, 17 nt, Human
cgcuucugaaugcugcu

SEQ ID NO: 3389289 - RNA, 15 nt, Human
cgcuucugccuuuuc

SEQ ID NO: 3389290 - RNA, 11 nt, Human
cgcuugccucg

SEQ ID NO: 3389291 - RNA, 13 nt, Human
cgcuugccucggc

SEQ ID NO: 3389292 - RNA, 14 nt, Human
cgcuugccucggcu

SEQ ID NO: 3389293 - RNA, 15 nt, Human
cgcuugccucggcuc

SEQ ID NO: 3389294 - RNA, 22 nt, Human
cgcuugccucggcuccugcugc

SEQ ID NO: 3389295 - RNA, 12 nt, Human
cgcuugcucugu

SEQ ID NO: 3389296 - RNA, 18 nt, Human
cgcuugcuuuucuguauu

SEQ ID NO: 3389297 - RNA, 12 nt, Human
cgcuuggcucca

SEQ ID NO: 3389298 - RNA, 17 nt, Human
cgcuugugcagaaaaca

SEQ ID NO: 3389299 - RNA, 21 nt, Human
cgcuuguggggacccaggcuc

SEQ ID NO: 3389300 - RNA, 13 nt, Human
cgcuuuauuuucu

SEQ ID NO: 3389301 - RNA, 16 nt, Human
cgcuuucuacccagcg

SEQ ID NO: 3389302 - RNA, 22 nt, Human
cgcuuucuagcuguugagcugu

SEQ ID NO: 3389303 - RNA, 22 nt, Human
cgcuuucuggaaaagaggaguu

SEQ ID NO: 3389304 - RNA, 16 nt, Human
cgcuuugauucauagu

SEQ ID NO: 3389305 - RNA, 11 nt, Human
cgcuuuggccu

SEQ ID NO: 3389306 - RNA, 16 nt, Human
cgcuuuuccuuggcau

SEQ ID NO: 3389307 - RNA, 22 nt, Human
cgcuuuuccuuggcauuccgca

SEQ ID NO: 3389308 - RNA, 15 nt, Human
cggaaaacaugcuac

SEQ ID NO: 3389309 - RNA, 19 nt, Human
cggaaacuaguguacauuu

SEQ ID NO: 3389310 - RNA, 20 nt, Human
cggaaagcagcucaaaggca

SEQ ID NO: 3389311 - RNA, 17 nt, Human
cggaaagcccugugcuc

SEQ ID NO: 3389312 - RNA, 21 nt, Human
cggaaagguauuugggaaacu

SEQ ID NO: 3389313 - RNA, 14 nt, Human
cggaaauuaaaguu

SEQ ID NO: 3389314 - RNA, 15 nt, Human
cggaacaagccuaaa

SEQ ID NO: 3389315 - RNA, 21 nt, Human
cggaaccgcucaccuagagcc

SEQ ID NO: 3389316 - RNA, 18 nt, Human
cggaacugcaugcugcug

SEQ ID NO: 3389317 - RNA, 20 nt, Human
cggaagcagugccuuccaua

SEQ ID NO: 3389318 - RNA, 23 nt, Human
cggaagcagugccuuccauaauu

SEQ ID NO: 3389319 - RNA, 17 nt, Human
cggaagggguuccucaa

SEQ ID NO: 3389320 - RNA, 15 nt, Human
cggaaggguaaacaa

SEQ ID NO: 3389321 - RNA, 19 nt, Human
cggaaggguaaacaauaua

SEQ ID NO: 3389322 - RNA, 13 nt, Human
cggaaguuuucaa

SEQ ID NO: 3389323 - RNA, 17 nt, Human
cggaauaagagaccugu

SEQ ID NO: 3389324 - RNA, 21 nt, Human
cggaauaagagaccuguuuua

SEQ ID NO: 3389325 - RNA, 17 nt, Human
cggaauaguuggcuagg

SEQ ID NO: 3389326 - RNA, 21 nt, Human
cggaaucacucuguccuugga

SEQ ID NO: 3389327 - RNA, 21 nt, Human
cggaauccuguccucagcuuc

SEQ ID NO: 3389328 - RNA, 19 nt, Human
cggaauuuaccugauuucu

SEQ ID NO: 3389329 - RNA, 12 nt, Human
cggacaaaauau

SEQ ID NO: 3389330 - RNA, 18 nt, Human
cggacaagacccccagca

SEQ ID NO: 3389331 - RNA, 13 nt, Human
cggacaaguuuua

SEQ ID NO: 3389332 - RNA, 13 nt, Human
cggacaauaaacc

SEQ ID NO: 3389333 - RNA, 20 nt, Human
cggacaauaaaccuccgcca

SEQ ID NO: 3389334 - RNA, 12 nt, Human
cggacacccccu

SEQ ID NO: 3389335 - RNA, 15 nt, Human
cggacagccacggcc

SEQ ID NO: 3389336 - RNA, 20 nt, Human
cggacagccacggccaggcc

SEQ ID NO: 3389337 - RNA, 15 nt, Human
cggacaguggcagga

SEQ ID NO: 3389338 - RNA, 23 nt, Human
cggaccaaagggagucugccagg

SEQ ID NO: 3389339 - RNA, 13 nt, Human
cggaccagccugg

SEQ ID NO: 3389340 - RNA, 17 nt, Human
cggaccagccuggccca

SEQ ID NO: 3389341 - RNA, 21 nt, Human
cggaccuuggcagcccaggcc

SEQ ID NO: 3389342 - RNA, 16 nt, Human
cggacguuuccaucag

SEQ ID NO: 3389343 - RNA, 18 nt, Human
cggacguuuccaucaggu

SEQ ID NO: 3389344 - RNA, 17 nt, Human
cggacuuagcugggaga

SEQ ID NO: 3389345 - RNA, 20 nt, Human
cggagacggagucccaccuu

SEQ ID NO: 3389346 - RNA, 14 nt, Human
cggagacgggaccg

SEQ ID NO: 3389347 - RNA, 21 nt, Human
cggagacgugaugaagggagg

SEQ ID NO: 3389348 - RNA, 13 nt, Human
cggagagaaaaaa

SEQ ID NO: 3389349 - RNA, 16 nt, Human
cggagagaaaaaagaa

SEQ ID NO: 3389350 - RNA, 23 nt, Human
cggagagcgccugccccucccag

SEQ ID NO: 3389351 - RNA, 11 nt, Human
cggagaggaag

SEQ ID NO: 3389352 - RNA, 17 nt, Human
cggagaguacagugagc

SEQ ID NO: 3389353 - RNA, 17 nt, Human
cggagcaaacucugcug

SEQ ID NO: 3389354 - RNA, 17 nt, Human
cggagcacacuggcuca

SEQ ID NO: 3389355 - RNA, 15 nt, Human
cggagcaucccggag

SEQ ID NO: 3389356 - RNA, 22 nt, Human
cggagcaucccggaggaaaucu

SEQ ID NO: 3389357 - RNA, 18 nt, Human
cggagccacuccucugac

SEQ ID NO: 3389358 - RNA, 20 nt, Human
cggagccucauccgaggcag

SEQ ID NO: 3389359 - RNA, 17 nt, Human
cggagcuaacacuggcc

SEQ ID NO: 3389360 - RNA, 18 nt, Human
cggagcuaacacuggccc

SEQ ID NO: 3389361 - RNA, 17 nt, Human
cggagcugccccucucu

SEQ ID NO: 3389362 - RNA, 20 nt, Human
cggagcugccccucucuggg

SEQ ID NO: 3389363 - RNA, 13 nt, Human
cggagcuggcccc

SEQ ID NO: 3389364 - RNA, 14 nt, Human
cuuguguauccauu

SEQ ID NO: 3389365 - RNA, 16 nt, Human
cuuguguauccauuau

SEQ ID NO: 3389366 - RNA, 22 nt, Human
cuugugucccuccugggaucug

SEQ ID NO: 3389367 - RNA, 15 nt, Human
cuugugucuacagag

SEQ ID NO: 3389368 - RNA, 12 nt, Human
cuugugucugua

SEQ ID NO: 3389369 - RNA, 22 nt, Human
cuugugucuuuggaggugcugc

SEQ ID NO: 3389370 - RNA, 20 nt, Human
cuuguguguaugcacaugaa

SEQ ID NO: 3389371 - RNA, 21 nt, Human
cuuguguguaugcacaugaac

SEQ ID NO: 3389372 - RNA, 19 nt, Human
cuugugugugggcugugag

SEQ ID NO: 3389373 - RNA, 11 nt, Human
cuuguguguuu

SEQ ID NO: 3389374 - RNA, 20 nt, Human
cuuguguguuuauugucaaa

SEQ ID NO: 3389375 - RNA, 18 nt, Human
cuuguguguuucacuuuu

SEQ ID NO: 3389376 - RNA, 19 nt, Human
cuuguguguuucacuuuua

SEQ ID NO: 3389377 - RNA, 19 nt, Human
cuuguguguuuugagagua

SEQ ID NO: 3389378 - RNA, 19 nt, Human
cuuguguuaaguaugugua

SEQ ID NO: 3389379 - RNA, 22 nt, Human
cuuguguuuuuaacucaauauu

SEQ ID NO: 3389380 - RNA, 16 nt, Human
cuuguuaauauucuuu

SEQ ID NO: 3389381 - RNA, 14 nt, Human
cuuguuacuucuga

SEQ ID NO: 3389382 - RNA, 19 nt, Human
cuuguuaugguagaaaaau

SEQ ID NO: 3389383 - RNA, 14 nt, Human
cuuguucaggaaaa

SEQ ID NO: 3389384 - RNA, 15 nt, Human
cuuguuccaaggcca

SEQ ID NO: 3389385 - RNA, 20 nt, Human
cuuguuccagcccuauucug

SEQ ID NO: 3389386 - RNA, 13 nt, Human
cuuguuccagcuc

SEQ ID NO: 3389387 - RNA, 21 nt, Human
cuuguuccccacugacagccu

SEQ ID NO: 3389388 - RNA, 20 nt, Human
cuuguucugugaugagggga

SEQ ID NO: 3389389 - RNA, 21 nt, Human
cuuguucugugaugaggggag

SEQ ID NO: 3389390 - RNA, 12 nt, Human
cuuguucuucca

SEQ ID NO: 3389391 - RNA, 13 nt, Human
cuuguugagccgu

SEQ ID NO: 3389392 - RNA, 20 nt, Human
cuuguugccuauaagccaaa

SEQ ID NO: 3389393 - RNA, 22 nt, Human
cuuguugcuguugauguuuugu

SEQ ID NO: 3389394 - RNA, 12 nt, Human
cuuguugcuuug

SEQ ID NO: 3389395 - RNA, 15 nt, Human
cuuguugcuuuguug

SEQ ID NO: 3389396 - RNA, 18 nt, Human
cuuguuggagccugcagg

SEQ ID NO: 3389397 - RNA, 23 nt, Human
cuuguuggauuuuugucuugugu

SEQ ID NO: 3389398 - RNA, 18 nt, Human
cuuguugggauuccugac

SEQ ID NO: 3389399 - RNA, 22 nt, Human
cuuguugggauuccugacccag

SEQ ID NO: 3389400 - RNA, 22 nt, Human
cuuguugguucaccauugagac

SEQ ID NO: 3389401 - RNA, 20 nt, Human
cuuguuguugguuguuuuuu

SEQ ID NO: 3389402 - RNA, 16 nt, Human
cuuguuguuucuugcc

SEQ ID NO: 3389403 - RNA, 22 nt, Human
cuuguuuacagcacuacucugu

SEQ ID NO: 3389404 - RNA, 19 nt, Human
cuuguuuaccuuucucucu

SEQ ID NO: 3389405 - RNA, 18 nt, Human
cuuguuuaucagauacau

SEQ ID NO: 3389406 - RNA, 22 nt, Human
cuuguuuaucagauacaucacu

SEQ ID NO: 3389407 - RNA, 14 nt, Human
cuuguuuauuaaau

SEQ ID NO: 3389408 - RNA, 12 nt, Human
cuuguuuauuga

SEQ ID NO: 3389409 - RNA, 23 nt, Human
cuuguuuauugaguuuguaggua

SEQ ID NO: 3389410 - RNA, 16 nt, Human
cuuguuuauuuugugg

SEQ ID NO: 3389411 - RNA, 22 nt, Human
cuuguuucaauuccaccugcaa

SEQ ID NO: 3389412 - RNA, 15 nt, Human
cuuguuucacugaaa

SEQ ID NO: 3389413 - RNA, 13 nt, Human
cuuguuuccuugu

SEQ ID NO: 3389414 - RNA, 12 nt, Human
cuuguuucuccc

SEQ ID NO: 3389415 - RNA, 22 nt, Human
cuuguuugauuuuagcugcaga

SEQ ID NO: 3389416 - RNA, 16 nt, Human
cuuguuugcucaccug

SEQ ID NO: 3389417 - RNA, 20 nt, Human
cuuguuugcucaccuggggu

SEQ ID NO: 3389418 - RNA, 15 nt, Human
cuuguuugucuucca

SEQ ID NO: 3389419 - RNA, 22 nt, Human
cuuguuuuccagucucuuguac

SEQ ID NO: 3389420 - RNA, 14 nt, Human
cuuguuuucuugcc

SEQ ID NO: 3389421 - RNA, 22 nt, Human
cuuguuuucuuucuuuaaaugu

SEQ ID NO: 3389422 - RNA, 23 nt, Human
cuuguuuucuuucuuuaaauguu

SEQ ID NO: 3389423 - RNA, 14 nt, Human
cuuguuuugcuucc

SEQ ID NO: 3389424 - RNA, 23 nt, Human
cuuguuuugcuuccccucccccc

SEQ ID NO: 3389425 - RNA, 19 nt, Human
cuuguuuuggacuuuguua

SEQ ID NO: 3389426 - RNA, 15 nt, Human
cuuguuuuguuuguc

SEQ ID NO: 3389427 - RNA, 18 nt, Human
cuuguuuuguuugucucu

SEQ ID NO: 3389428 - RNA, 12 nt, Human
cuuguuuuuaag

SEQ ID NO: 3389429 - RNA, 14 nt, Human
cuuguuuuuguaaa

SEQ ID NO: 3389430 - RNA, 15 nt, Human
cuuguuuuuguaaag

SEQ ID NO: 3389431 - RNA, 20 nt, Human
cuuguuuuuguaaagaaaaa

SEQ ID NO: 3389432 - RNA, 23 nt, Human
cuuguuuuuguaaagaaaaauau

SEQ ID NO: 3389433 - RNA, 23 nt, Human
cuuguuuuuuguuuguuuguugc

SEQ ID NO: 3389434 - RNA, 17 nt, Human
cuuuaaaaaaaaaauug

SEQ ID NO: 3389435 - RNA, 17 nt, Human
cuuuaaaaaaauuuaag

SEQ ID NO: 3389436 - RNA, 22 nt, Human
cuuuaaaaaauuaaucugggcc

SEQ ID NO: 3389437 - RNA, 14 nt, Human
cuuuaaaaacuauu

SEQ ID NO: 3389438 - RNA, 13 nt, Human
cuuuaaaaacugu

SEQ ID NO: 3389439 - RNA, 14 nt, Human
cuuuaaaacaaaac

SEQ ID NO: 3389440 - RNA, 18 nt, Human
cuuuaaaagaugcuuuua

SEQ ID NO: 3389441 - RNA, 14 nt, Human
cuuuaaaagugauc

SEQ ID NO: 3389442 - RNA, 14 nt, Human
cuuuaaaauauugu

SEQ ID NO: 3389443 - RNA, 21 nt, Human
cuuuaaaauguaaagccaugc

SEQ ID NO: 3389444 - RNA, 12 nt, Human
cuuuaaaauucu

SEQ ID NO: 3389445 - RNA, 18 nt, Human
cuuuaaaauuuuuuuaga

SEQ ID NO: 3389446 - RNA, 22 nt, Human
cuuuaaaccuguuuuuuuuuca

SEQ ID NO: 3389447 - RNA, 19 nt, Human
cuuuaaacuacauuagguu

SEQ ID NO: 3389448 - RNA, 16 nt, Human
cuuuaaacucagggac

SEQ ID NO: 3389449 - RNA, 20 nt, Human
cuuuaaaggcccagccccua

SEQ ID NO: 3389450 - RNA, 17 nt, Human
cuuuaaaguguaauaau

SEQ ID NO: 3389451 - RNA, 14 nt, Human
cuuuaaauaauuua

SEQ ID NO: 3389452 - RNA, 15 nt, Human
cuuuaaaucugugau

SEQ ID NO: 3389453 - RNA, 18 nt, Human
cuuuccaaaccuuaucuc

SEQ ID NO: 3389454 - RNA, 16 nt, Human
cuuuccaaaguacacu

SEQ ID NO: 3389455 - RNA, 18 nt, Human
cuuuccaaaugcccagcu

SEQ ID NO: 3389456 - RNA, 20 nt, Human
cuuuccaaauuauuucuuaa

SEQ ID NO: 3389457 - RNA, 17 nt, Human
cuuuccaacguuuggaa

SEQ ID NO: 3389458 - RNA, 17 nt, Human
cuuuccaccacagccag

SEQ ID NO: 3389459 - RNA, 21 nt, Human
cuuuccaccacagccagcacc

SEQ ID NO: 3389460 - RNA, 20 nt, Human
cuuuccacccccucccuggc

SEQ ID NO: 3389461 - RNA, 23 nt, Human
cuuuccacccccucccuggccug

SEQ ID NO: 3389462 - RNA, 15 nt, Human
cuuuccaccuucuca

SEQ ID NO: 3389463 - RNA, 21 nt, Human
cuuuccacggagccacuccuc

SEQ ID NO: 3389464 - RNA, 13 nt, Human
cuuuccacucugg

SEQ ID NO: 3389465 - RNA, 15 nt, Human
cuuuccacucuggau

SEQ ID NO: 3389466 - RNA, 23 nt, Human
cuuuccacucuggauucagccuu

SEQ ID NO: 3389467 - RNA, 14 nt, Human
cuuuccacuucuuc

SEQ ID NO: 3389468 - RNA, 20 nt, Human
cuuuccacuucuuccuuucu

SEQ ID NO: 3389469 - RNA, 15 nt, Human
cuuuccaggaaggcu

SEQ ID NO: 3389470 - RNA, 13 nt, Human
cuuuccaguuaag

SEQ ID NO: 3389471 - RNA, 20 nt, Human
cuuuccauaaauccuugaug

SEQ ID NO: 3389472 - RNA, 18 nt, Human
cuuuccauccauggccag

SEQ ID NO: 3389473 - RNA, 18 nt, Human
cuuuccauguugcugcca

SEQ ID NO: 3389474 - RNA, 15 nt, Human
cuuuccauguuguug

SEQ ID NO: 3389475 - RNA, 22 nt, Human
cuuuccauuugguuuagaacau

SEQ ID NO: 3389476 - RNA, 16 nt, Human
cuuucccauggggagg

SEQ ID NO: 3389477 - RNA, 17 nt, Human
cuuucccauggggaggg

SEQ ID NO: 3389478 - RNA, 22 nt, Human
cuuuccccaccagaugcugaaa

SEQ ID NO: 3389479 - RNA, 18 nt, Human
cuuuccccauacucuguc

SEQ ID NO: 3389480 - RNA, 15 nt, Human
cuuuccccaugucuc

SEQ ID NO: 3389481 - RNA, 21 nt, Human
cuuuccccaugucucgacuca

SEQ ID NO: 3389482 - RNA, 17 nt, Human
cuuucccccuucucuua

SEQ ID NO: 3389483 - RNA, 18 nt, Human
cuuuccccuuccuuuuaa

SEQ ID NO: 3389484 - RNA, 19 nt, Human
cuuucccgggcuguccacu

SEQ ID NO: 3389485 - RNA, 17 nt, Human
cuuucccuaaagacccu

SEQ ID NO: 3389486 - RNA, 12 nt, Human
cuuucccuaagc

SEQ ID NO: 3389487 - RNA, 18 nt, Human
cuuucccuacccucuaga

SEQ ID NO: 3389488 - RNA, 11 nt, Human
cuuucccucac

SEQ ID NO: 3389489 - RNA, 18 nt, Human
cuuucccucacccccucc

SEQ ID NO: 3389490 - RNA, 19 nt, Human
cuuucccucacccccuccc

SEQ ID NO: 3389491 - RNA, 13 nt, Human
cuuucccuccuug

SEQ ID NO: 3389492 - RNA, 15 nt, Human
cuuucccuccuuggu

SEQ ID NO: 3389493 - RNA, 14 nt, Human
cuuucccuuccucc

SEQ ID NO: 3389494 - RNA, 15 nt, Human
cuuucccuuccucca

SEQ ID NO: 3389495 - RNA, 16 nt, Human
cuuucccuugcuuuuc

SEQ ID NO: 3389496 - RNA, 12 nt, Human
cuuucccuuggu

SEQ ID NO: 3389497 - RNA, 21 nt, Human
cuuuccgguguuuaagacauu

SEQ ID NO: 3389498 - RNA, 17 nt, Human
cuuuccuaaggcugcaa

SEQ ID NO: 3389499 - RNA, 20 nt, Human
cuuuccuagauggcagucac

SEQ ID NO: 3389500 - RNA, 17 nt, Human
cuuuccuccucugacuu

SEQ ID NO: 3389501 - RNA, 12 nt, Human
cuuuccuccuuu

SEQ ID NO: 3389502 - RNA, 17 nt, Human
cuuuccucucuauauuu

SEQ ID NO: 3389503 - RNA, 16 nt, Human
cuuuccucuuuggucu

SEQ ID NO: 3389504 - RNA, 16 nt, Human
cuuuccugaggcuggg

SEQ ID NO: 3389505 - RNA, 20 nt, Human
cuuuccugaggcugggcucc

SEQ ID NO: 3389506 - RNA, 22 nt, Human
cuuuccugaggcugggcucccu

SEQ ID NO: 3389507 - RNA, 22 nt, Human
cuuuccugagucccaucccugc

SEQ ID NO: 3389508 - RNA, 15 nt, Human
cuuuacgcccaucuc

SEQ ID NO: 3389509 - RNA, 18 nt, Human
cuuuacggacacccccuc

SEQ ID NO: 3389510 - RNA, 14 nt, Human
cuuuacguagugua

SEQ ID NO: 3389511 - RNA, 22 nt, Human
cuuuacuaagaugacauugcua

SEQ ID NO: 3389512 - RNA, 13 nt, Human
cuuuacuauggcc

SEQ ID NO: 3389513 - RNA, 22 nt, Human
cuuuacucccaagacuucauug

SEQ ID NO: 3389514 - RNA, 19 nt, Human
cuuuacuccucacacuuac

SEQ ID NO: 3389515 - RNA, 13 nt, Human
cuuuacugccuga

SEQ ID NO: 3389516 - RNA, 23 nt, Human
cuuuacugccugaauaaagagcc

SEQ ID NO: 3389517 - RNA, 19 nt, Human
cuuuacugucaaaauaauu

SEQ ID NO: 3389518 - RNA, 14 nt, Human
cuuuacuguuuguu

SEQ ID NO: 3389519 - RNA, 15 nt, Human
cuuuacuuagcuuau

SEQ ID NO: 3389520 - RNA, 17 nt, Human
cuuuacuuuagaagcac

SEQ ID NO: 3389521 - RNA, 15 nt, Human
cuuuagaaaaggcau

SEQ ID NO: 3389522 - RNA, 20 nt, Human
cuuuagaaacacauaauuaa

SEQ ID NO: 3389523 - RNA, 23 nt, Human
cuuuagaaacagugcaacacugg

SEQ ID NO: 3389524 - RNA, 19 nt, Human
cuuuagaaagguuuugagc

SEQ ID NO: 3389525 - RNA, 15 nt, Human
cuuuagaaauaaaug

SEQ ID NO: 3389526 - RNA, 16 nt, Human
cuuuagaaauaaaugu

SEQ ID NO: 3389527 - RNA, 14 nt, Human
cuuuagaagccugc

SEQ ID NO: 3389528 - RNA, 15 nt, Human
cuuuagaagccugca

SEQ ID NO: 3389529 - RNA, 17 nt, Human
cuuuagaagugcauuuc

SEQ ID NO: 3389530 - RNA, 15 nt, Human
cuuuagaaucccagc

SEQ ID NO: 3389531 - RNA, 18 nt, Human
cuuuagaaugagagugug

SEQ ID NO: 3389532 - RNA, 23 nt, Human
cuuuagaauguuuuccuucuacu

SEQ ID NO: 3389533 - RNA, 14 nt, Human
cuuuagacccuggg

SEQ ID NO: 3389534 - RNA, 14 nt, Human
cuuuagacuugaaa

SEQ ID NO: 3389535 - RNA, 15 nt, Human
cuuuagacuugaaaa

SEQ ID NO: 3389536 - RNA, 14 nt, Human
cuuuagagaagaug

SEQ ID NO: 3389537 - RNA, 20 nt, Human
cuuuagagaagauggauaug

SEQ ID NO: 3389538 - RNA, 22 nt, Human
cuuuagagaaguauacauaagu

SEQ ID NO: 3389539 - RNA, 19 nt, Human
cuuuagagcauugccauuc

SEQ ID NO: 3389540 - RNA, 13 nt, Human
cuuuagaguagca

SEQ ID NO: 3389541 - RNA, 13 nt, Human
cuuuagaugcuga

SEQ ID NO: 3389542 - RNA, 22 nt, Human
cuuuagccccucccaagcuggc

SEQ ID NO: 3389543 - RNA, 14 nt, Human
cuuuagcugacaga

SEQ ID NO: 3389544 - RNA, 14 nt, Human
cuuuagcuguguua

SEQ ID NO: 3389545 - RNA, 21 nt, Human
cuuuaggagggaguuaucuaa

SEQ ID NO: 3389546 - RNA, 13 nt, Human
cuuuaggcuuuca

SEQ ID NO: 3389547 - RNA, 18 nt, Human
cuuuaggcuuucagcuua

SEQ ID NO: 3389548 - RNA, 13 nt, Human
cuuuagggcagcu

SEQ ID NO: 3389549 - RNA, 14 nt, Human
cuuuagggcagcuu

SEQ ID NO: 3389550 - RNA, 15 nt, Human
cuuuagggcagcuug

SEQ ID NO: 3389551 - RNA, 15 nt, Human
cuuuaggucuuugua

SEQ ID NO: 3389552 - RNA, 13 nt, Human
cuuuagguuuuuu

SEQ ID NO: 3389553 - RNA, 19 nt, Human
cuuuaguaccugaaaagua

SEQ ID NO: 3389554 - RNA, 21 nt, Human
cuuuaguaugacgcugauaca

SEQ ID NO: 3389555 - RNA, 14 nt, Human
cuuuagucugcaaa

SEQ ID NO: 3389556 - RNA, 13 nt, Human
cuuuaguuuuugg

SEQ ID NO: 3389557 - RNA, 21 nt, Human
cuuuaguuuuugguugggaau

SEQ ID NO: 3389558 - RNA, 13 nt, Human
cuuuauaaaucca

SEQ ID NO: 3389559 - RNA, 18 nt, Human
cuuuauaaauccagugac

SEQ ID NO: 3389560 - RNA, 15 nt, Human
cuuuauaagaaagcc

SEQ ID NO: 3389561 - RNA, 16 nt, Human
cuuuauaagaaagccu

SEQ ID NO: 3389562 - RNA, 18 nt, Human
cuuuauaagaaagccuga

SEQ ID NO: 3389563 - RNA, 20 nt, Human
cuuuauacaacagugcuaaa

SEQ ID NO: 3389564 - RNA, 23 nt, Human
cuuuauacaacagugcuaaaaau

SEQ ID NO: 3389565 - RNA, 19 nt, Human
cuuuauacauuaguaaaug

SEQ ID NO: 3389566 - RNA, 20 nt, Human
cuuuauacauuaguaaaugu

SEQ ID NO: 3389567 - RNA, 22 nt, Human
cuuuauacauuaguaaaugucu

SEQ ID NO: 3389568 - RNA, 21 nt, Human
cuuuauauacaauaauggaaa

SEQ ID NO: 3389569 - RNA, 14 nt, Human
cuuuaucaaugugu

SEQ ID NO: 3389570 - RNA, 19 nt, Human
cuuuaucacauuauuugca

SEQ ID NO: 3389571 - RNA, 16 nt, Human
cuuuauccucuuuaga

SEQ ID NO: 3389572 - RNA, 18 nt, Human
cuuuaucuguucuugcua

SEQ ID NO: 3389573 - RNA, 18 nt, Human
cuuuaucuugaauaaugu

SEQ ID NO: 3389574 - RNA, 19 nt, Human
cuuuaugauaauagauucu

SEQ ID NO: 3389575 - RNA, 21 nt, Human
cuuuaugauuuucauaacuua

SEQ ID NO: 3389576 - RNA, 20 nt, Human
cuuuaugccggaugugcuuu

SEQ ID NO: 3389577 - RNA, 23 nt, Human
cuuuauguacaggaugcuuuggu

SEQ ID NO: 3389578 - RNA, 19 nt, Human
cuuuauguaguuuuuauau

SEQ ID NO: 3389579 - RNA, 12 nt, Human
cuuuaugugaau

SEQ ID NO: 3389580 - RNA, 15 nt, Human
cuuuaugugaauuuu

SEQ ID NO: 3389581 - RNA, 20 nt, Human
cuuuauguuacuacaugcac

SEQ ID NO: 3389582 - RNA, 20 nt, Human
cuuuauuaaucacuauuguu

SEQ ID NO: 3389583 - RNA, 13 nt, Human
cuuuauuaccagu

SEQ ID NO: 3389584 - RNA, 22 nt, Human
cuuuauuacccccuccuucaga

SEQ ID NO: 3389585 - RNA, 16 nt, Human
cuuuauucaaguaaaa

SEQ ID NO: 3389586 - RNA, 12 nt, Human
cuuuauuccuag

SEQ ID NO: 3389587 - RNA, 18 nt, Human
cuuuauucuugaaagaag

SEQ ID NO: 3389588 - RNA, 14 nt, Human
cuuuauugaaauuc

SEQ ID NO: 3389589 - RNA, 17 nt, Human
cuuuauugauaucucca

SEQ ID NO: 3389590 - RNA, 19 nt, Human
cuuuauugccaaaacccag

SEQ ID NO: 3389591 - RNA, 19 nt, Human
cuuuauugcuuuuuuguau

SEQ ID NO: 3389592 - RNA, 12 nt, Human
cuuuauuggaaa

SEQ ID NO: 3389593 - RNA, 20 nt, Human
cuuuauuggguaucaagaca

SEQ ID NO: 3389594 - RNA, 13 nt, Human
cuuuauugucugu

SEQ ID NO: 3389595 - RNA, 14 nt, Human
cuuuauugucugua

SEQ ID NO: 3389596 - RNA, 22 nt, Human
cuuuauuuuauauaauaaagua

SEQ ID NO: 3389597 - RNA, 13 nt, Human
cuuuauuuugugu

SEQ ID NO: 3389598 - RNA, 18 nt, Human
cuuuauuuuguguaaaaa

SEQ ID NO: 3389599 - RNA, 21 nt, Human
cuuuauuuuuuaaguauuuau

SEQ ID NO: 3389600 - RNA, 20 nt, Human
cuuuauuuuuuugaacucuu

SEQ ID NO: 3389601 - RNA, 14 nt, Human
cuuucaaaaacaug

SEQ ID NO: 3389602 - RNA, 15 nt, Human
cuuucaaaccagcuu

SEQ ID NO: 3389603 - RNA, 18 nt, Human
cuuucaaaccagcuucau

SEQ ID NO: 3389604 - RNA, 15 nt, Human
cuuucaaagaaggaa

SEQ ID NO: 3389605 - RNA, 17 nt, Human
cuuucaaagccauuuua

SEQ ID NO: 3389606 - RNA, 20 nt, Human
cuuucaaaggagaaugaauc

SEQ ID NO: 3389607 - RNA, 11 nt, Human
cuuucaaauuu

SEQ ID NO: 3389608 - RNA, 22 nt, Human
cuuucuguuccaaauucaguuu

SEQ ID NO: 3389609 - RNA, 15 nt, Human
cuuucuguuggugua

SEQ ID NO: 3389610 - RNA, 15 nt, Human
cuuucuguugucauu

SEQ ID NO: 3389611 - RNA, 21 nt, Human
cuuucuuaauauuuuuacaug

SEQ ID NO: 3389612 - RNA, 15 nt, Human
cuuucuucaaaauau

SEQ ID NO: 3389613 - RNA, 13 nt, Human
cuuucuuccaaac

SEQ ID NO: 3389614 - RNA, 22 nt, Human
cuuucuuccaaacaggcucaga

SEQ ID NO: 3389615 - RNA, 12 nt, Human
cuuucuuccucu

SEQ ID NO: 3389616 - RNA, 16 nt, Human
cuuucuuccucugcug

SEQ ID NO: 3389617 - RNA, 14 nt, Human
cuuucuucuuccca

SEQ ID NO: 3389618 - RNA, 12 nt, Human
cuuucuugacaa

SEQ ID NO: 3389619 - RNA, 22 nt, Human
cuuucuugacaaaaccuaacuu

SEQ ID NO: 3389620 - RNA, 13 nt, Human
cuuucuugcuccc

SEQ ID NO: 3389621 - RNA, 15 nt, Human
cuuucuugcucccug

SEQ ID NO: 3389622 - RNA, 17 nt, Human
cuuucuugcucccuuca

SEQ ID NO: 3389623 - RNA, 20 nt, Human
cuuucuugcucccuucagcc

SEQ ID NO: 3389624 - RNA, 16 nt, Human
cuuucuugcugguugu

SEQ ID NO: 3389625 - RNA, 14 nt, Human
cuuucuuggccagu

SEQ ID NO: 3389626 - RNA, 22 nt, Human
cuuucuugguucauaaaugaau

SEQ ID NO: 3389627 - RNA, 16 nt, Human
cuuucuuuaaauguuu

SEQ ID NO: 3389628 - RNA, 16 nt, Human
cuuucuuucuuagaaa

SEQ ID NO: 3389629 - RNA, 22 nt, Human
cuuucuuuucuggaauguaauc

SEQ ID NO: 3389630 - RNA, 16 nt, Human
cuuucuuuuucuucuu

SEQ ID NO: 3389631 - RNA, 22 nt, Human
cuuucuuuuuguagcuggggcu

SEQ ID NO: 3389632 - RNA, 23 nt, Human
cuuucuuuuuuggccaucugcuc

SEQ ID NO: 3389633 - RNA, 15 nt, Human
cuuugaaaaaaaaua

SEQ ID NO: 3389634 - RNA, 16 nt, Human
cuuugaaaauauauac

SEQ ID NO: 3389635 - RNA, 22 nt, Human
cuuugaaacaagauaacugaga

SEQ ID NO: 3389636 - RNA, 17 nt, Human
cuuugaaaccugcucug

SEQ ID NO: 3389637 - RNA, 20 nt, Human
cuuugaaaccugcucuguag

SEQ ID NO: 3389638 - RNA, 15 nt, Human
cuuugaaacuagacu

SEQ ID NO: 3389639 - RNA, 20 nt, Human
cuuugaaagguuagagaaua

SEQ ID NO: 3389640 - RNA, 15 nt, Human
cuuugaaauaccuca

SEQ ID NO: 3389641 - RNA, 18 nt, Human
cuuugaaauaccucaugu

SEQ ID NO: 3389642 - RNA, 21 nt, Human
cuuugaaauaccucauguuua

SEQ ID NO: 3389643 - RNA, 22 nt, Human
cuuugaaauguguuucuguaua

SEQ ID NO: 3389644 - RNA, 16 nt, Human
cuuugaagaaggugga

SEQ ID NO: 3389645 - RNA, 18 nt, Human
cuuugaagaggaaaauga

SEQ ID NO: 3389646 - RNA, 22 nt, Human
cuuugaagaggaaaaugaauaa

SEQ ID NO: 3389647 - RNA, 14 nt, Human
cuuugaagcaguug

SEQ ID NO: 3389648 - RNA, 17 nt, Human
cuuugaaguagcucuuu

SEQ ID NO: 3389649 - RNA, 18 nt, Human
cuuugaauaaaaaugcac

SEQ ID NO: 3389650 - RNA, 22 nt, Human
cuuugaauaaagaauacuugaa

SEQ ID NO: 3389651 - RNA, 18 nt, Human
cuuugaauaaaugucacu

SEQ ID NO: 3389652 - RNA, 19 nt, Human
cuuugaauaaaugucacuu

SEQ ID NO: 3389653 - RNA, 22 nt, Human
cguaucuccggcucccagccuc

SEQ ID NO: 3389654 - RNA, 11 nt, Human
cguaugaaaau

SEQ ID NO: 3389655 - RNA, 13 nt, Human
cguaugcauguga

SEQ ID NO: 3389656 - RNA, 15 nt, Human
cguauguaaauguau

SEQ ID NO: 3389657 - RNA, 18 nt, Human
cguaugucugguucucaa

SEQ ID NO: 3389658 - RNA, 19 nt, Human
cguaugucugguucucaau

SEQ ID NO: 3389659 - RNA, 14 nt, Human
cguauuccccuucc

SEQ ID NO: 3389660 - RNA, 18 nt, Human
cguauuccccuucccacu

SEQ ID NO: 3389661 - RNA, 21 nt, Human
cgucaaaacagauuguuugca

SEQ ID NO: 3389662 - RNA, 22 nt, Human
cgucaaaacagauuguuugcaa

SEQ ID NO: 3389663 - RNA, 11 nt, Human
cgucaacaaau

SEQ ID NO: 3389664 - RNA, 16 nt, Human
cgucaacguuguacug

SEQ ID NO: 3389665 - RNA, 20 nt, Human
cgucaacucauauuuucaug

SEQ ID NO: 3389666 - RNA, 23 nt, Human
cgucaagagugaauucccucacu

SEQ ID NO: 3389667 - RNA, 12 nt, Human
cgucaccaccac

SEQ ID NO: 3389668 - RNA, 15 nt, Human
cgucaccaccacccc

SEQ ID NO: 3389669 - RNA, 21 nt, Human
cgucaccaccaccccuaccac

SEQ ID NO: 3389670 - RNA, 14 nt, Human
cgucaccaccucuc

SEQ ID NO: 3389671 - RNA, 16 nt, Human
cgucacuaccuggcug

SEQ ID NO: 3389672 - RNA, 18 nt, Human
cgucagccuccagccucu

SEQ ID NO: 3389673 - RNA, 19 nt, Human
cgucagcuggcacugucuc

SEQ ID NO: 3389674 - RNA, 20 nt, Human
cgucagggcccaagucccug

SEQ ID NO: 3389675 - RNA, 15 nt, Human
cgucagugccuaccc

SEQ ID NO: 3389676 - RNA, 14 nt, Human
cgucagugcugugc

SEQ ID NO: 3389677 - RNA, 16 nt, Human
cgucauaacuagaacu

SEQ ID NO: 3389678 - RNA, 19 nt, Human
cgucaucacuuuucaguga

SEQ ID NO: 3389679 - RNA, 16 nt, Human
cgucaucugguccugg

SEQ ID NO: 3389680 - RNA, 14 nt, Human
cguccacagcuucc

SEQ ID NO: 3389681 - RNA, 21 nt, Human
cguccagccgccauugccacc

SEQ ID NO: 3389682 - RNA, 17 nt, Human
cguccagcugcccuucc

SEQ ID NO: 3389683 - RNA, 15 nt, Human
cgucccauauccugc

SEQ ID NO: 3389684 - RNA, 22 nt, Human
cguccccccccaaccuuucccu

SEQ ID NO: 3389685 - RNA, 22 nt, Human
cgucccccucuggcuccagcug

SEQ ID NO: 3389686 - RNA, 13 nt, Human
cgucccccugggg

SEQ ID NO: 3389687 - RNA, 13 nt, Human
cguccccuccccc

SEQ ID NO: 3389688 - RNA, 12 nt, Human
cguccgcccugc

SEQ ID NO: 3389689 - RNA, 16 nt, Human
cguccucccgggcccu

SEQ ID NO: 3389690 - RNA, 17 nt, Human
cguccuccucaccucau

SEQ ID NO: 3389691 - RNA, 21 nt, Human
cguccuccucaccucaugccc

SEQ ID NO: 3389692 - RNA, 12 nt, Human
cguccuccucug

SEQ ID NO: 3389693 - RNA, 13 nt, Human
cguccuccucugu

SEQ ID NO: 3389694 - RNA, 15 nt, Human
cguccuccucuguga

SEQ ID NO: 3389695 - RNA, 13 nt, Human
cguccugagaaag

SEQ ID NO: 3389696 - RNA, 13 nt, Human
cguccugccaccu

SEQ ID NO: 3389697 - RNA, 16 nt, Human
cguccugccaccuggg

SEQ ID NO: 3389698 - RNA, 16 nt, Human
cguccugccuguggcg

SEQ ID NO: 3389699 - RNA, 18 nt, Human
cguccugcuuuggcagug

SEQ ID NO: 3389700 - RNA, 20 nt, Human
cguccuggagguuccccagc

SEQ ID NO: 3389701 - RNA, 16 nt, Human
cguccugucagugccg

SEQ ID NO: 3389702 - RNA, 16 nt, Human
cguccuuacuccugug

SEQ ID NO: 3389703 - RNA, 22 nt, Human
cguccuuacuccugugggagcc

SEQ ID NO: 3389704 - RNA, 16 nt, Human
cgucgacguagaaccu

SEQ ID NO: 3389705 - RNA, 13 nt, Human
cgucgcacagucu

SEQ ID NO: 3389706 - RNA, 16 nt, Human
cgucgcccucccaggc

SEQ ID NO: 3389707 - RNA, 21 nt, Human
cgucggggaggcuccugccug

SEQ ID NO: 3389708 - RNA, 17 nt, Human
cgucuacagcuccccca

SEQ ID NO: 3389709 - RNA, 14 nt, Human
cgucuccaggggcu

SEQ ID NO: 3389710 - RNA, 19 nt, Human
cgucuccaggggcugcuuc

SEQ ID NO: 3389711 - RNA, 17 nt, Human
cgucucccaucuuaacu

SEQ ID NO: 3389712 - RNA, 14 nt, Human
cgucucccccgugu

SEQ ID NO: 3389713 - RNA, 14 nt, Human
cgucucucucccau

SEQ ID NO: 3389714 - RNA, 18 nt, Human
cgucucucucccauggag

SEQ ID NO: 3389715 - RNA, 20 nt, Human
cgucucuuuuacccuggccc

SEQ ID NO: 3389716 - RNA, 15 nt, Human
cgucugaagcuugac

SEQ ID NO: 3389717 - RNA, 14 nt, Human
cgucugacaggcaa

SEQ ID NO: 3389718 - RNA, 20 nt, Human
cgucugacaggcaaugcugg

SEQ ID NO: 3389719 - RNA, 21 nt, Human
cgucugacaggcaaugcuggc

SEQ ID NO: 3389720 - RNA, 15 nt, Human
cgucugacccucucc

SEQ ID NO: 3389721 - RNA, 23 nt, Human
cgucugcuaacuuggagccccag

SEQ ID NO: 3389722 - RNA, 18 nt, Human
cgucuggaggggccccug

SEQ ID NO: 3389723 - RNA, 20 nt, Human
cgucuggaggggccccugcu

SEQ ID NO: 3389724 - RNA, 15 nt, Human
cgucuguauauuuug

SEQ ID NO: 3389725 - RNA, 14 nt, Human
cgucuguccaucug

SEQ ID NO: 3389726 - RNA, 20 nt, Human
cgucugugugugaccccucc

SEQ ID NO: 3389727 - RNA, 20 nt, Human
cgucuuagcaagaaguaaaa

SEQ ID NO: 3389728 - RNA, 12 nt, Human
cgucuucauuaa

SEQ ID NO: 3389729 - RNA, 23 nt, Human
cgucuucauuaagcccucuucca

SEQ ID NO: 3389730 - RNA, 17 nt, Human
cgucuuccgccccugcc

SEQ ID NO: 3389731 - RNA, 18 nt, Human
cgucuuccgccccugccu

SEQ ID NO: 3389732 - RNA, 13 nt, Human
cgucuucuccaac

SEQ ID NO: 3389733 - RNA, 14 nt, Human
cgucuugcuuggga

SEQ ID NO: 3389734 - RNA, 18 nt, Human
cgucuuucccaaaggcau

SEQ ID NO: 3389735 - RNA, 13 nt, Human
cgucuuucuuuuu

SEQ ID NO: 3389736 - RNA, 10 nt, Human
cgucuuugca

SEQ ID NO: 3389737 - RNA, 15 nt, Human
cgugaaaacggagcu

SEQ ID NO: 3389738 - RNA, 17 nt, Human
cgugaaaacggagcuga

SEQ ID NO: 3389739 - RNA, 12 nt, Human
cgugaaacacac

SEQ ID NO: 3389740 - RNA, 20 nt, Human
cgugaaacacaccaggcugu

SEQ ID NO: 3389741 - RNA, 24 nt, Human
cgugaaacacaccaggcugugggc

SEQ ID NO: 3389742 - RNA, 22 nt, Human
cgugaaagugcauuuuuguaaa

SEQ ID NO: 3389743 - RNA, 14 nt, Human
cgugaagaagccug

SEQ ID NO: 3389744 - RNA, 19 nt, Human
cgugaagauacuuuguauu

SEQ ID NO: 3389745 - RNA, 21 nt, Human
cgugaagauacuuuguauugu

SEQ ID NO: 3389746 - RNA, 19 nt, Human
cgugaaggccgagaagcaa

SEQ ID NO: 3389747 - RNA, 14 nt, Human
cgugacaacacuug

SEQ ID NO: 3389748 - RNA, 16 nt, Human
cgugacaauguuuaca

SEQ ID NO: 3389749 - RNA, 15 nt, Human
cgugacagacuccug

SEQ ID NO: 3389750 - RNA, 16 nt, Human
cgugacagugccuggg

SEQ ID NO: 3389751 - RNA, 20 nt, Human
cgugacgcugaauaaauguc

SEQ ID NO: 3389752 - RNA, 15 nt, Human
cgugacgucugggug

SEQ ID NO: 3389753 - RNA, 13 nt, Human
cgugacucaccca

SEQ ID NO: 3389754 - RNA, 16 nt, Human
cgugacucacccaagc

SEQ ID NO: 3389755 - RNA, 17 nt, Human
cgugacucacccaagca

SEQ ID NO: 3389756 - RNA, 18 nt, Human
cgugacucacccaagcau

SEQ ID NO: 3389757 - RNA, 13 nt, Human
cgugacugcccca

SEQ ID NO: 3389758 - RNA, 17 nt, Human
cgugacugccccaacuc

SEQ ID NO: 3389759 - RNA, 23 nt, Human
cgugacugccccaacuccuggaa

SEQ ID NO: 3389760 - RNA, 14 nt, Human
cgugagaccugccc

SEQ ID NO: 3389761 - RNA, 21 nt, Human
cgugagcaggaaggccugggu

SEQ ID NO: 3389762 - RNA, 19 nt, Human
cgugagcagugugucuccu

SEQ ID NO: 3389763 - RNA, 14 nt, Human
cuuucaaauuuaga

SEQ ID NO: 3389764 - RNA, 14 nt, Human
cuuucaacucauug

SEQ ID NO: 3389765 - RNA, 14 nt, Human
cuuucaacuugcau

SEQ ID NO: 3389766 - RNA, 22 nt, Human
cuuucaagcagucgugccugug

SEQ ID NO: 3389767 - RNA, 23 nt, Human
cuuucaagcagucgugccugugu

SEQ ID NO: 3389768 - RNA, 20 nt, Human
cuuucaagucaguucuguga

SEQ ID NO: 3389769 - RNA, 14 nt, Human
cuuucaagugccuu

SEQ ID NO: 3389770 - RNA, 22 nt, Human
cuuucaauaggaaaaacugauu

SEQ ID NO: 3389771 - RNA, 20 nt, Human
cuuucaaugguuugcaagga

SEQ ID NO: 3389772 - RNA, 15 nt, Human
cuuucacaaaaaaga

SEQ ID NO: 3389773 - RNA, 14 nt, Human
cuuucacaaccuuc

SEQ ID NO: 3389774 - RNA, 16 nt, Human
cuuucacaaccuucug

SEQ ID NO: 3389775 - RNA, 14 nt, Human
cuuucacacuucca

SEQ ID NO: 3389776 - RNA, 19 nt, Human
cuuucacacuuccaccagc

SEQ ID NO: 3389777 - RNA, 15 nt, Human
cuuucacagcuccuc

SEQ ID NO: 3389778 - RNA, 13 nt, Human
cuuucacaggcag

SEQ ID NO: 3389779 - RNA, 19 nt, Human
cuuucacaggcagccagug

SEQ ID NO: 3389780 - RNA, 17 nt, Human
cuuucacaguaccaucu

SEQ ID NO: 3389781 - RNA, 22 nt, Human
cuuucacauuguuugcugcuau

SEQ ID NO: 3389782 - RNA, 24 nt, Human
cuuucacauuguuugcugcuauug

SEQ ID NO: 3389783 - RNA, 16 nt, Human
cuuucaccuuugugua

SEQ ID NO: 3389784 - RNA, 19 nt, Human
cuuucacggaaacucccga

SEQ ID NO: 3389785 - RNA, 20 nt, Human
cuuucacuaaaacacacagg

SEQ ID NO: 3389786 - RNA, 15 nt, Human
cuuucacuauaaugu

SEQ ID NO: 3389787 - RNA, 16 nt, Human
cuuucacuauuuccuu

SEQ ID NO: 3389788 - RNA, 21 nt, Human
cuuucacuauuuccuuuauaa

SEQ ID NO: 3389789 - RNA, 14 nt, Human
cuuucacuucuuuc

SEQ ID NO: 3389790 - RNA, 18 nt, Human
cuuucacuucuuucccuu

SEQ ID NO: 3389791 - RNA, 21 nt, Human
cuuucacuucuuucccuuccu

SEQ ID NO: 3389792 - RNA, 13 nt, Human
cuuucagaaaaca

SEQ ID NO: 3389793 - RNA, 23 nt, Human
cuuucagaaaacagaaaaaaaac

SEQ ID NO: 3389794 - RNA, 14 nt, Human
cuuucagaaagcuu

SEQ ID NO: 3389795 - RNA, 21 nt, Human
cuuucagaaauauaacacauu

SEQ ID NO: 3389796 - RNA, 21 nt, Human
cuuucagaagugcccuuccug

SEQ ID NO: 3389797 - RNA, 16 nt, Human
cuuucagaauauguca

SEQ ID NO: 3389798 - RNA, 15 nt, Human
cuuucagauacugga

SEQ ID NO: 3389799 - RNA, 13 nt, Human
cuuugggcccagg

SEQ ID NO: 3389800 - RNA, 14 nt, Human
cuuugggcccugca

SEQ ID NO: 3389801 - RNA, 18 nt, Human
cuuugggccucugcuucu

SEQ ID NO: 3389802 - RNA, 14 nt, Human
cuuugggcugcccu

SEQ ID NO: 3389803 - RNA, 19 nt, Human
cuuugggcugcccuggugc

SEQ ID NO: 3389804 - RNA, 16 nt, Human
cuuugggcuucagcug

SEQ ID NO: 3389805 - RNA, 18 nt, Human
cuuuggggcuaauuuaac

SEQ ID NO: 3389806 - RNA, 21 nt, Human
cuuuggggcuuuuacaccagu

SEQ ID NO: 3389807 - RNA, 23 nt, Human
cuuuggggucuacacugcaauca

SEQ ID NO: 3389808 - RNA, 21 nt, Human
cuuuggguaccuauuuucauu

SEQ ID NO: 3389809 - RNA, 21 nt, Human
cuuugguacuaauaaucuugu

SEQ ID NO: 3389810 - RNA, 15 nt, Human
cuuuggucacuuuua

SEQ ID NO: 3389811 - RNA, 18 nt, Human
cuuuggucacuuuuagau

SEQ ID NO: 3389812 - RNA, 23 nt, Human
cuuugguccuaagucccugcccc

SEQ ID NO: 3389813 - RNA, 20 nt, Human
cuuuggucuacacugugcug

SEQ ID NO: 3389814 - RNA, 15 nt, Human
cuuuggucucuugcu

SEQ ID NO: 3389815 - RNA, 19 nt, Human
cuuuggugagaaccugggu

SEQ ID NO: 3389816 - RNA, 19 nt, Human
cuuuggugccuuuccuguu

SEQ ID NO: 3389817 - RNA, 19 nt, Human
cuuugguuauauuuagcuc

SEQ ID NO: 3389818 - RNA, 19 nt, Human
cuuugguuauuuuacuuuu

SEQ ID NO: 3389819 - RNA, 14 nt, Human
cuuugguucagcua

SEQ ID NO: 3389820 - RNA, 16 nt, Human
cuuugguucuaaggac

SEQ ID NO: 3389821 - RNA, 14 nt, Human
cuuugguucuggcc

SEQ ID NO: 3389822 - RNA, 21 nt, Human
cuuugguucuggguuguuucc

SEQ ID NO: 3389823 - RNA, 19 nt, Human
cuuugguuggcagcauucc

SEQ ID NO: 3389824 - RNA, 11 nt, Human
cuuugguuuuu

SEQ ID NO: 3389825 - RNA, 17 nt, Human
cuuugguuuuuuucuuc

SEQ ID NO: 3389826 - RNA, 16 nt, Human
cuuuguaaaaaucuuu

SEQ ID NO: 3389827 - RNA, 12 nt, Human
cuuuguaaauag

SEQ ID NO: 3389828 - RNA, 17 nt, Human
cuuuguaaauucugauu

SEQ ID NO: 3389829 - RNA, 15 nt, Human
cuuuguaaauuguca

SEQ ID NO: 3389830 - RNA, 21 nt, Human
cuuuguaagaguguagaagca

SEQ ID NO: 3389831 - RNA, 21 nt, Human
cuuuguaagucaguguugaga

SEQ ID NO: 3389832 - RNA, 17 nt, Human
cuuuguaagugaaaaac

SEQ ID NO: 3389833 - RNA, 13 nt, Human
cuuuguaauggga

SEQ ID NO: 3389834 - RNA, 22 nt, Human
cuuuguacacccaugaaagaaa

SEQ ID NO: 3389835 - RNA, 19 nt, Human
cuuuguacagagugcuuuu

SEQ ID NO: 3389836 - RNA, 17 nt, Human
cuuuguacagcccagag

SEQ ID NO: 3389837 - RNA, 15 nt, Human
cuuuguaccaaaauu

SEQ ID NO: 3389838 - RNA, 12 nt, Human
cuuuguaccccc

SEQ ID NO: 3389839 - RNA, 14 nt, Human
cuuuguacccccca

SEQ ID NO: 3389840 - RNA, 21 nt, Human
cuuuguagauccuuagagguc

SEQ ID NO: 3389841 - RNA, 16 nt, Human
cuuuguagcauuuggu

SEQ ID NO: 3389842 - RNA, 20 nt, Human
cuuuguaguguuuggugcuc

SEQ ID NO: 3389843 - RNA, 11 nt, Human
cuuuguauaga

SEQ ID NO: 3389844 - RNA, 18 nt, Human
cuuuguauauuauuucua

SEQ ID NO: 3389845 - RNA, 20 nt, Human
cuuuguaugauauuccauag

SEQ ID NO: 3389846 - RNA, 16 nt, Human
cuuuguauucugucuu

SEQ ID NO: 3389847 - RNA, 16 nt, Human
cuuugucaaaaggaag

SEQ ID NO: 3389848 - RNA, 16 nt, Human
cuuugucacuguuuca

SEQ ID NO: 3389849 - RNA, 16 nt, Human
cuuuguccuccugcug

SEQ ID NO: 3389850 - RNA, 20 nt, Human
cuuugucuaacucagaauua

SEQ ID NO: 3389851 - RNA, 20 nt, Human
cuuugucuacaccauuaugu

SEQ ID NO: 3389852 - RNA, 19 nt, Human
cuuugucuccucuauccug

SEQ ID NO: 3389853 - RNA, 13 nt, Human
cuuugugagucaa

SEQ ID NO: 3389854 - RNA, 19 nt, Human
cuuugugagucaauacaua

SEQ ID NO: 3389855 - RNA, 17 nt, Human
cuuugugauuauuucac

SEQ ID NO: 3389856 - RNA, 12 nt, Human
cuuugugauuuu

SEQ ID NO: 3389857 - RNA, 19 nt, Human
cuuugugauuuuuguaauu

SEQ ID NO: 3389858 - RNA, 14 nt, Human
cuuugugcauucug

SEQ ID NO: 3389859 - RNA, 20 nt, Human
cuuuguggauucugaggccc

SEQ ID NO: 3389860 - RNA, 15 nt, Human
cuuuguggccaagga

SEQ ID NO: 3389861 - RNA, 20 nt, Human
cuuuguggccaaggagcugc

SEQ ID NO: 3389862 - RNA, 13 nt, Human
cuuuguggggcuu

SEQ ID NO: 3389863 - RNA, 16 nt, Human
cuuugugguuuuaugg

SEQ ID NO: 3389864 - RNA, 16 nt, Human
cuuuguguagcuuugc

SEQ ID NO: 3389865 - RNA, 17 nt, Human
cuuuguguagcuuugcu

SEQ ID NO: 3389866 - RNA, 15 nt, Human
cuuugugugauugaa

SEQ ID NO: 3389867 - RNA, 18 nt, Human
cuuuguguguacucacug

SEQ ID NO: 3389868 - RNA, 14 nt, Human
cuuuguguuguaau

SEQ ID NO: 3389869 - RNA, 17 nt, Human
cuuuguguuguaauucu

SEQ ID NO: 3389870 - RNA, 22 nt, Human
cuuuguguuugguuuacauuua

SEQ ID NO: 3389871 - RNA, 16 nt, Human
cuuuguuaagguccug

SEQ ID NO: 3389872 - RNA, 17 nt, Human
cuuuguuaaguucuauu

SEQ ID NO: 3389873 - RNA, 21 nt, Human
cuuuguuacacuguuauuuuc

SEQ ID NO: 3389874 - RNA, 19 nt, Human
cuuuguuacuucucuaauu

SEQ ID NO: 3389875 - RNA, 18 nt, Human
cuuuguucauagcccagu

SEQ ID NO: 3389876 - RNA, 22 nt, Human
cuuuguuccccacuggagcaga

SEQ ID NO: 3389877 - RNA, 18 nt, Human
cuuuguucuaaagaugga

SEQ ID NO: 3389878 - RNA, 23 nt, Human
cuuuguucucagcucccccuguc

SEQ ID NO: 3389879 - RNA, 14 nt, Human
cuuuguucuggcuc

SEQ ID NO: 3389880 - RNA, 18 nt, Human
cuuuguugcaagauguga

SEQ ID NO: 3389881 - RNA, 11 nt, Human
cuuuguugcac

SEQ ID NO: 3389882 - RNA, 18 nt, Human
cuuuguugugugccucua

SEQ ID NO: 3389883 - RNA, 18 nt, Human
cuuuguuucguggggagg

SEQ ID NO: 3389884 - RNA, 15 nt, Human
cuuuguuucuccccc

SEQ ID NO: 3389885 - RNA, 13 nt, Human
cuuuguuucuugu

SEQ ID NO: 3389886 - RNA, 17 nt, Human
cuuuguuucuuguuuau

SEQ ID NO: 3389887 - RNA, 20 nt, Human
cuuuguuuggauguaauuua

SEQ ID NO: 3389888 - RNA, 14 nt, Human
cuuuguuuguucuu

SEQ ID NO: 3389889 - RNA, 21 nt, Human
cuuuguuuguugucagcugaa

SEQ ID NO: 3389890 - RNA, 20 nt, Human
cuuuguuuucugacuaauua

SEQ ID NO: 3389891 - RNA, 23 nt, Human
cuuuguuuugauguuuguggccu

SEQ ID NO: 3389892 - RNA, 19 nt, Human
cuuuguuuuguuuuaagga

SEQ ID NO: 3389893 - RNA, 18 nt, Human
cuuuguuuuuuguuggag

SEQ ID NO: 3389894 - RNA, 21 nt, Human
cuuuguuuuuuuuuccugucc

SEQ ID NO: 3389895 - RNA, 19 nt, Human
cuuuuaaaaaguauugcca

SEQ ID NO: 3389896 - RNA, 13 nt, Human
cuuuuaaaaugca

SEQ ID NO: 3389897 - RNA, 19 nt, Human
cuuuuaaaaugcaauguaa

SEQ ID NO: 3389898 - RNA, 12 nt, Human
cuuuuaaacaca

SEQ ID NO: 3389899 - RNA, 13 nt, Human
cuuuuaaacacau

SEQ ID NO: 3389900 - RNA, 13 nt, Human
cuuuuaaacugug

SEQ ID NO: 3389901 - RNA, 21 nt, Human
cuuuuaaagaaaaaaauugaa

SEQ ID NO: 3389902 - RNA, 18 nt, Human
cuuuuaaagacccuccua

SEQ ID NO: 3389903 - RNA, 22 nt, Human
cuuuuaaaggggcagaaaaacu

SEQ ID NO: 3389904 - RNA, 11 nt, Human
cuuuuaaagug

SEQ ID NO: 3389905 - RNA, 16 nt, Human
cuuuuaaaguguuuca

SEQ ID NO: 3389906 - RNA, 17 nt, Human
cuuuuaaaguguuucag

SEQ ID NO: 3389907 - RNA, 16 nt, Human
cuuuuaaaguugauau

SEQ ID NO: 3389908 - RNA, 12 nt, Human
cuuuuaaauccu

SEQ ID NO: 3389909 - RNA, 19 nt, Human
cuuuuaaauccuguugaaa

SEQ ID NO: 3389910 - RNA, 20 nt, Human
cuuuuaaauccuguugaaaa

SEQ ID NO: 3389911 - RNA, 22 nt, Human
cuuuuaaaugauugaauuauau

SEQ ID NO: 3389912 - RNA, 16 nt, Human
cuuuuaaauuagaaaa

SEQ ID NO: 3389913 - RNA, 21 nt, Human
cuuuuaacaccugauguguac

SEQ ID NO: 3389914 - RNA, 18 nt, Human
cuuuuaacauuuuguucu

SEQ ID NO: 3389915 - RNA, 21 nt, Human
cuuuuaacauuuuguucuuac

SEQ ID NO: 3389916 - RNA, 15 nt, Human
cuuuuaaccaucuga

SEQ ID NO: 3389917 - RNA, 14 nt, Human
cgugagccaccucg

SEQ ID NO: 3389918 - RNA, 12 nt, Human
cgugagccaggu

SEQ ID NO: 3389919 - RNA, 16 nt, Human
cgugagccccaucuuc

SEQ ID NO: 3389920 - RNA, 14 nt, Human
cgugaggccagaga

SEQ ID NO: 3389921 - RNA, 16 nt, Human
cgugaguccuggcaug

SEQ ID NO: 3389922 - RNA, 18 nt, Human
cgugaguccuggcauggg

SEQ ID NO: 3389923 - RNA, 16 nt, Human
cgugaguucucagggc

SEQ ID NO: 3389924 - RNA, 19 nt, Human
cgugaguucucagggcucc

SEQ ID NO: 3389925 - RNA, 14 nt, Human
cgugaucaaagcca

SEQ ID NO: 3389926 - RNA, 17 nt, Human
cgugauccacccgccuc

SEQ ID NO: 3389927 - RNA, 14 nt, Human
cgugaucucagcuc

SEQ ID NO: 3389928 - RNA, 18 nt, Human
cgugauuuugcuguagaa

SEQ ID NO: 3389929 - RNA, 18 nt, Human
cgugcacacaccagagcc

SEQ ID NO: 3389930 - RNA, 19 nt, Human
cgugcacacaccagagccc

SEQ ID NO: 3389931 - RNA, 21 nt, Human
cgugcacacaccagagcccac

SEQ ID NO: 3389932 - RNA, 22 nt, Human
cgugcacacaccagagcccacc

SEQ ID NO: 3389933 - RNA, 16 nt, Human
cgugcagacuggaggg

SEQ ID NO: 3389934 - RNA, 18 nt, Human
cgugcauaccacuuuugu

SEQ ID NO: 3389935 - RNA, 13 nt, Human
cgugcaugugcac

SEQ ID NO: 3389936 - RNA, 19 nt, Human
cgugcauuagcacagauuu

SEQ ID NO: 3389937 - RNA, 22 nt, Human
cgugcauuagcacagauuuuaa

SEQ ID NO: 3389938 - RNA, 12 nt, Human
cgugcauugugc

SEQ ID NO: 3389939 - RNA, 15 nt, Human
cgugcauugugcuuc

SEQ ID NO: 3389940 - RNA, 23 nt, Human
cgugccaaguccagguccuggug

SEQ ID NO: 3389941 - RNA, 22 nt, Human
cgugccaccccgagggcugagc

SEQ ID NO: 3389942 - RNA, 13 nt, Human
cgugccaggcccg

SEQ ID NO: 3389943 - RNA, 20 nt, Human
cgugccagucgcgcugccug

SEQ ID NO: 3389944 - RNA, 15 nt, Human
cuuuuauacugacac

SEQ ID NO: 3389945 - RNA, 19 nt, Human
cuuuuauagcuauuacugu

SEQ ID NO: 3389946 - RNA, 21 nt, Human
cuuuuauaggugagaaaaaaa

SEQ ID NO: 3389947 - RNA, 20 nt, Human
cuuuuauaguggaaaaacac

SEQ ID NO: 3389948 - RNA, 21 nt, Human
cuuuuauaguggaaaaacaca

SEQ ID NO: 3389949 - RNA, 14 nt, Human
cuuuuauaucccau

SEQ ID NO: 3389950 - RNA, 14 nt, Human
cuuuuauaucugua

SEQ ID NO: 3389951 - RNA, 23 nt, Human
cuuuuauaucuguauguauuagu

SEQ ID NO: 3389952 - RNA, 14 nt, Human
cuuuuauauuugua

SEQ ID NO: 3389953 - RNA, 24 nt, Human
cuuuuaucuauucugagaaaacaa

SEQ ID NO: 3389954 - RNA, 22 nt, Human
cuuuuaucuguuuaaagcauau

SEQ ID NO: 3389955 - RNA, 16 nt, Human
cuuuuaugagcagaag

SEQ ID NO: 3389956 - RNA, 17 nt, Human
cuuuuaugauguauauu

SEQ ID NO: 3389957 - RNA, 18 nt, Human
cuuuuaugcaaaagguuu

SEQ ID NO: 3389958 - RNA, 18 nt, Human
cuuuuauguuauuuauau

SEQ ID NO: 3389959 - RNA, 16 nt, Human
cuuuuauguuugaaua

SEQ ID NO: 3389960 - RNA, 18 nt, Human
cuuuuauguuugaauaug

SEQ ID NO: 3389961 - RNA, 22 nt, Human
cuuuuauguuugaauauggaca

SEQ ID NO: 3389962 - RNA, 18 nt, Human
cuaagauucugauuuuag

SEQ ID NO: 3389963 - RNA, 19 nt, Human
cuaagauucugauuuuagg

SEQ ID NO: 3389964 - RNA, 21 nt, Human
cuaagauucuuuuaaauuaga

SEQ ID NO: 3389965 - RNA, 15 nt, Human
cuaagcaaaauguga

SEQ ID NO: 3389966 - RNA, 12 nt, Human
cuaagcaauuuc

SEQ ID NO: 3389967 - RNA, 15 nt, Human
cuaagcagaaagugc

SEQ ID NO: 3389968 - RNA, 18 nt, Human
cuaagcagaaagugccuu

SEQ ID NO: 3389969 - RNA, 16 nt, Human
cuaagcagaggagggg

SEQ ID NO: 3389970 - RNA, 23 nt, Human
cuaagcagaggaggggccgcugc

SEQ ID NO: 3389971 - RNA, 14 nt, Human
cuaagcaggcgcaa

SEQ ID NO: 3389972 - RNA, 13 nt, Human
cuaagcaucuaag

SEQ ID NO: 3389973 - RNA, 15 nt, Human
cuaagcaucuaaguu

SEQ ID NO: 3389974 - RNA, 16 nt, Human
cuaagcauugccuggc

SEQ ID NO: 3389975 - RNA, 14 nt, Human
cuaagcauuuaaaa

SEQ ID NO: 3389976 - RNA, 13 nt, Human
cuaagccagccug

SEQ ID NO: 3389977 - RNA, 18 nt, Human
cuaagccagccuggucca

SEQ ID NO: 3389978 - RNA, 15 nt, Human
cuaagccagcugccc

SEQ ID NO: 3389979 - RNA, 17 nt, Human
cuaagccccagcaagca

SEQ ID NO: 3389980 - RNA, 20 nt, Human
cuaagcccugucgagacacu

SEQ ID NO: 3389981 - RNA, 21 nt, Human
cuaagcccugucgagacacuu

SEQ ID NO: 3389982 - RNA, 14 nt, Human
cuaagccuaccugc

SEQ ID NO: 3389983 - RNA, 16 nt, Human
cuaagccuaccugcuc

SEQ ID NO: 3389984 - RNA, 17 nt, Human
cuaagccuaccugcucu

SEQ ID NO: 3389985 - RNA, 22 nt, Human
cuaagcgcacauucaugugggc

SEQ ID NO: 3389986 - RNA, 17 nt, Human
cuaagcuaggaaugaaa

SEQ ID NO: 3389987 - RNA, 22 nt, Human
cuaagcucaaggcgugaggaug

SEQ ID NO: 3389988 - RNA, 16 nt, Human
cuaagcucacguccug

SEQ ID NO: 3389989 - RNA, 19 nt, Human
cuaagcugcagcuuccugu

SEQ ID NO: 3389990 - RNA, 14 nt, Human
cuaaggaaccaaca

SEQ ID NO: 3389991 - RNA, 14 nt, Human
cuaaggaaccuucc

SEQ ID NO: 3389992 - RNA, 11 nt, Human
cuaaggacaca

SEQ ID NO: 3389993 - RNA, 14 nt, Human
cuaaggacacacua

SEQ ID NO: 3389994 - RNA, 16 nt, Human
cuaaggacacacuaau

SEQ ID NO: 3389995 - RNA, 16 nt, Human
cuaaggacauuuccca

SEQ ID NO: 3389996 - RNA, 17 nt, Human
cuaaggacauuucccag

SEQ ID NO: 3389997 - RNA, 15 nt, Human
cuaaggacuucuuua

SEQ ID NO: 3389998 - RNA, 17 nt, Human
cuaaggaggggaaaaaa

SEQ ID NO: 3389999 - RNA, 21 nt, Human
cuaaggaggggaaaaaaaugu

SEQ ID NO: 3390000 - RNA, 22 nt, Human
cuaaggaggggaaaaaaauguu

SEQ ID NO: 3390001 - RNA, 23 nt, Human
cuaaggaggggaaaaaaauguug

SEQ ID NO: 3390002 - RNA, 15 nt, Human
cuaaggaucucucag

SEQ ID NO: 3390003 - RNA, 19 nt, Human
cuaaggaugucacagggcc

SEQ ID NO: 3390004 - RNA, 20 nt, Human
cuaaggcaugugugaaacau

SEQ ID NO: 3390005 - RNA, 13 nt, Human
cuaaggccuacuu

SEQ ID NO: 3390006 - RNA, 19 nt, Human
cuaaggccuaggauucuaa

SEQ ID NO: 3390007 - RNA, 19 nt, Human
cuaaggcguggagcugccu

SEQ ID NO: 3390008 - RNA, 18 nt, Human
cuaaggcucuaugagucu

SEQ ID NO: 3390009 - RNA, 11 nt, Human
cuaaggcucug

SEQ ID NO: 3390010 - RNA, 14 nt, Human
cuaaggcucugaga

SEQ ID NO: 3390011 - RNA, 19 nt, Human
cuaaggcucugagagucua

SEQ ID NO: 3390012 - RNA, 21 nt, Human
cuaaggcucugagagucuaga

SEQ ID NO: 3390013 - RNA, 22 nt, Human
cuaaggcucugagagucuagau

SEQ ID NO: 3390014 - RNA, 16 nt, Human
cuaagggaagacauuu

SEQ ID NO: 3390015 - RNA, 19 nt, Human
cuaagggaagacauuucuu

SEQ ID NO: 3390016 - RNA, 23 nt, Human
cuaagggagagugguauuugcag

SEQ ID NO: 3390017 - RNA, 17 nt, Human
cuaagggucgaaagcuc

SEQ ID NO: 3390018 - RNA, 19 nt, Human
cuaagggucgaaagcucua

SEQ ID NO: 3390019 - RNA, 20 nt, Human
cuaagggugggugcucagaa

SEQ ID NO: 3390020 - RNA, 20 nt, Human
cuaagguccgguguucuaag

SEQ ID NO: 3390021 - RNA, 22 nt, Human
cuaagguccgguguucuaagau

SEQ ID NO: 3390022 - RNA, 12 nt, Human
cuaagguccuaa

SEQ ID NO: 3390023 - RNA, 16 nt, Human
cuaaggugugcucuga

SEQ ID NO: 3390024 - RNA, 13 nt, Human
cuaagguucuaag

SEQ ID NO: 3390025 - RNA, 17 nt, Human
cuaagguucuaaggccu

SEQ ID NO: 3390026 - RNA, 22 nt, Human
cuaaguaaaaccacagcaguug

SEQ ID NO: 3390027 - RNA, 11 nt, Human
cuaaguauuaa

SEQ ID NO: 3390028 - RNA, 13 nt, Human
cuaaguauuaaaa

SEQ ID NO: 3390029 - RNA, 20 nt, Human
cuaaguauuaaaacauugga

SEQ ID NO: 3390030 - RNA, 18 nt, Human
cuaagucccugcccccuc

SEQ ID NO: 3390031 - RNA, 14 nt, Human
cuaagucucuguga

SEQ ID NO: 3390032 - RNA, 20 nt, Human
cuaagucucuuuuuuacaaa

SEQ ID NO: 3390033 - RNA, 16 nt, Human
cuaagucuuuccauug

SEQ ID NO: 3390034 - RNA, 16 nt, Human
cuaagugaaauuucua

SEQ ID NO: 3390035 - RNA, 17 nt, Human
cuaagugacauuuguag

SEQ ID NO: 3390036 - RNA, 22 nt, Human
cuaagugauccucccaccucag

SEQ ID NO: 3390037 - RNA, 21 nt, Human
cuaagugcuuauuacauuuua

SEQ ID NO: 3390038 - RNA, 21 nt, Human
cuaagugguacuaacuuuccu

SEQ ID NO: 3390039 - RNA, 21 nt, Human
cuaaguuaauuuaaaguuguu

SEQ ID NO: 3390040 - RNA, 20 nt, Human
cuaaguuccacugagcucca

SEQ ID NO: 3390041 - RNA, 17 nt, Human
cuaaguucuuagauauc

SEQ ID NO: 3390042 - RNA, 24 nt, Human
cuaaguugggaucuaggagaggag

SEQ ID NO: 3390043 - RNA, 19 nt, Human
cuaaguuucaguugauuuu

SEQ ID NO: 3390044 - RNA, 17 nt, Human
cuaauaaaaagcuuuug

SEQ ID NO: 3390045 - RNA, 15 nt, Human
cuaauaaaaagguga

SEQ ID NO: 3390046 - RNA, 13 nt, Human
cuaauaaaacuga

SEQ ID NO: 3390047 - RNA, 15 nt, Human
cuaauaaaacugaug

SEQ ID NO: 3390048 - RNA, 16 nt, Human
cuaauaaaacugaugu

SEQ ID NO: 3390049 - RNA, 12 nt, Human
cuaauaaaauau

SEQ ID NO: 3390050 - RNA, 20 nt, Human
cuaauaaaauaucauucagc

SEQ ID NO: 3390051 - RNA, 17 nt, Human
cuaauaaaauauuuucu

SEQ ID NO: 3390052 - RNA, 18 nt, Human
cuaauaaaauauuuucug

SEQ ID NO: 3390053 - RNA, 21 nt, Human
cuaauaaaauauuuucugugu

SEQ ID NO: 3390054 - RNA, 22 nt, Human
cuaauaaaauauuuucugugug

SEQ ID NO: 3390055 - RNA, 20 nt, Human
cuaauaaaauuuaaaagucu

SEQ ID NO: 3390056 - RNA, 21 nt, Human
cuaauaaaauuuaaaagucuu

SEQ ID NO: 3390057 - RNA, 19 nt, Human
cuaauaaacuaauaauugc

SEQ ID NO: 3390058 - RNA, 13 nt, Human
cuaauaaagcugu

SEQ ID NO: 3390059 - RNA, 14 nt, Human
cuaauaaagcugug

SEQ ID NO: 3390060 - RNA, 13 nt, Human
cuaauaaauacau

SEQ ID NO: 3390061 - RNA, 15 nt, Human
cuaauaaauacauac

SEQ ID NO: 3390062 - RNA, 22 nt, Human
cuaauaagcuaguugaauacuu

SEQ ID NO: 3390063 - RNA, 12 nt, Human
cuaauaauaaau

SEQ ID NO: 3390064 - RNA, 15 nt, Human
cuaauaauaaauagu

SEQ ID NO: 3390065 - RNA, 20 nt, Human
cuaauaauaaauaguucuuc

SEQ ID NO: 3390066 - RNA, 19 nt, Human
cuaauaaugagcuauuaaa

SEQ ID NO: 3390067 - RNA, 12 nt, Human
cuaauacaccag

SEQ ID NO: 3390068 - RNA, 17 nt, Human
cuaauacauuaaagcag

SEQ ID NO: 3390069 - RNA, 13 nt, Human
cuaauaccucugu

SEQ ID NO: 3390070 - RNA, 17 nt, Human
cuaauagacuaaaugaa

SEQ ID NO: 3390071 - RNA, 20 nt, Human
cuaauagacuaaaugaaauc

SEQ ID NO: 3390072 - RNA, 23 nt, Human
cuaauagcggguuacuuucacau

SEQ ID NO: 3390073 - RNA, 15 nt, Human
cuaauauauuuuuau

SEQ ID NO: 3390074 - RNA, 23 nt, Human
cuaauaucaaaugcaguauauuu

SEQ ID NO: 3390075 - RNA, 12 nt, Human
cuaauaucagca

SEQ ID NO: 3390076 - RNA, 17 nt, Human
cuaauauccccaaauua

SEQ ID NO: 3390077 - RNA, 22 nt, Human
cuaauauccccaaauuagggca

SEQ ID NO: 3390078 - RNA, 23 nt, Human
cuaauaugauagcgggaaaagga

SEQ ID NO: 3390079 - RNA, 20 nt, Human
cuaauauggccacaguaguc

SEQ ID NO: 3390080 - RNA, 18 nt, Human
cuaauauguaacaagcca

SEQ ID NO: 3390081 - RNA, 14 nt, Human
cuaauauuaaaaau

SEQ ID NO: 3390082 - RNA, 16 nt, Human
cuaauauuaaaaauau

SEQ ID NO: 3390083 - RNA, 22 nt, Human
cuaaucacaguuuuuccuggaa

SEQ ID NO: 3390084 - RNA, 19 nt, Human
cuaaucaccauguaagcac

SEQ ID NO: 3390085 - RNA, 22 nt, Human
cuaaucagaaauuuuuaucagu

SEQ ID NO: 3390086 - RNA, 20 nt, Human
cuaaucagcauucucacucc

SEQ ID NO: 3390087 - RNA, 19 nt, Human
cuaaucagggaggucauuu

SEQ ID NO: 3390088 - RNA, 14 nt, Human
cuaaucaugaaacu

SEQ ID NO: 3390089 - RNA, 17 nt, Human
cuaauccaggcagaucc

SEQ ID NO: 3390090 - RNA, 18 nt, Human
cuaauccaggcagaucca

SEQ ID NO: 3390091 - RNA, 19 nt, Human
cuaauccaggcagauccag

SEQ ID NO: 3390092 - RNA, 15 nt, Human
cuaauccccuucucc

SEQ ID NO: 3390093 - RNA, 16 nt, Human
cuaauccccuucuccc

SEQ ID NO: 3390094 - RNA, 18 nt, Human
cuaauccccuucuccccu

SEQ ID NO: 3390095 - RNA, 22 nt, Human
cuaaucccugggcauugcuuuc

SEQ ID NO: 3390096 - RNA, 22 nt, Human
cuaauccggaaaucagcaaacu

SEQ ID NO: 3390097 - RNA, 17 nt, Human
cuaaucuaacaauggaa

SEQ ID NO: 3390098 - RNA, 14 nt, Human
cuaaucucuguaaa

SEQ ID NO: 3390099 - RNA, 20 nt, Human
cuaaucucuguaaagcuaaa

SEQ ID NO: 3390100 - RNA, 20 nt, Human
cuaaucugcuaugcuugaau

SEQ ID NO: 3390101 - RNA, 14 nt, Human
cuaaucuguagggc

SEQ ID NO: 3390102 - RNA, 18 nt, Human
cuaaucuguagggcugga

SEQ ID NO: 3390103 - RNA, 21 nt, Human
cuaaucugugcuguuucaaag

SEQ ID NO: 3390104 - RNA, 17 nt, Human
cuaaucuuauucauuuu

SEQ ID NO: 3390105 - RNA, 19 nt, Human
cuaaucuuauucauuuucu

SEQ ID NO: 3390106 - RNA, 15 nt, Human
cuaaucuucagggca

SEQ ID NO: 3390107 - RNA, 14 nt, Human
cuaaucuugugaaa

SEQ ID NO: 3390108 - RNA, 21 nt, Human
cuaaucuugugaaaauaauug

SEQ ID NO: 3390109 - RNA, 13 nt, Human
cuaaugaaaguga

SEQ ID NO: 3390110 - RNA, 18 nt, Human
cuaaugaaagugaugaca

SEQ ID NO: 3390111 - RNA, 20 nt, Human
gaaaagauacgacuuuauuu

SEQ ID NO: 3390112 - RNA, 11 nt, Human
gaaaagaugca

SEQ ID NO: 3390113 - RNA, 23 nt, Human
gaaaagauucuucuguguuuaua

SEQ ID NO: 3390114 - RNA, 17 nt, Human
gaaaagauuuuaaucaa

SEQ ID NO: 3390115 - RNA, 17 nt, Human
gaaaagcagcucucccc

SEQ ID NO: 3390116 - RNA, 10 nt, Human
gaaaagcaua

SEQ ID NO: 3390117 - RNA, 16 nt, Human
gaaaagcauuuuucaa

SEQ ID NO: 3390118 - RNA, 15 nt, Human
gaaaagccauguuua

SEQ ID NO: 3390119 - RNA, 18 nt, Human
gaaaagccauguuuaaga

SEQ ID NO: 3390120 - RNA, 19 nt, Human
gaaaagccauguuuaagau

SEQ ID NO: 3390121 - RNA, 21 nt, Human
gaaaagccuaaucacaguuuu

SEQ ID NO: 3390122 - RNA, 13 nt, Human
gaaaagccucugu

SEQ ID NO: 3390123 - RNA, 14 nt, Human
gaaaagccucugug

SEQ ID NO: 3390124 - RNA, 20 nt, Human
gaaaagccuggguuuggugu

SEQ ID NO: 3390125 - RNA, 22 nt, Human
gaaaagccuggguuugguguau

SEQ ID NO: 3390126 - RNA, 18 nt, Human
gaaaagcggacaucagcu

SEQ ID NO: 3390127 - RNA, 16 nt, Human
gaaaagcuaagagaag

SEQ ID NO: 3390128 - RNA, 19 nt, Human
gaaaagcuauuagccagga

SEQ ID NO: 3390129 - RNA, 19 nt, Human
gaaaagcugcugacagugu

SEQ ID NO: 3390130 - RNA, 14 nt, Human
gaaaagcuucuuaa

SEQ ID NO: 3390131 - RNA, 18 nt, Human
gaaaagcuucuuaauuaa

SEQ ID NO: 3390132 - RNA, 22 nt, Human
gaaaaggcacccccgucaagag

SEQ ID NO: 3390133 - RNA, 16 nt, Human
gaaaaggccaagaggu

SEQ ID NO: 3390134 - RNA, 13 nt, Human
gaaaaggccuggg

SEQ ID NO: 3390135 - RNA, 14 nt, Human
gaaaaggccugggg

SEQ ID NO: 3390136 - RNA, 18 nt, Human
gaaaagggaacaggaaaa

SEQ ID NO: 3390137 - RNA, 19 nt, Human
gaaaagggaaguugugccu

SEQ ID NO: 3390138 - RNA, 17 nt, Human
gaaaagguuuaugaaaa

SEQ ID NO: 3390139 - RNA, 18 nt, Human
gaaaagguuuuauuuugu

SEQ ID NO: 3390140 - RNA, 16 nt, Human
gaaaaguaauauuuau

SEQ ID NO: 3390141 - RNA, 23 nt, Human
gaaaaguagacaaucauuguuuu

SEQ ID NO: 3390142 - RNA, 20 nt, Human
gaaaaguauauugauaaccu

SEQ ID NO: 3390143 - RNA, 20 nt, Human
gaaaaguauguuagugcaaa

SEQ ID NO: 3390144 - RNA, 15 nt, Human
gaaaaguauguucua

SEQ ID NO: 3390145 - RNA, 14 nt, Human
gaaaaguauuuuga

SEQ ID NO: 3390146 - RNA, 17 nt, Human
gaaaaguauuuugaagu

SEQ ID NO: 3390147 - RNA, 19 nt, Human
gaaaagugcauauuuaucc

SEQ ID NO: 3390148 - RNA, 19 nt, Human
gaaaaguggcaagaccaaa

SEQ ID NO: 3390149 - RNA, 14 nt, Human
gaaaaguugaauuu

SEQ ID NO: 3390150 - RNA, 22 nt, Human
gaaaaguuuaauauuaaagcca

SEQ ID NO: 3390151 - RNA, 23 nt, Human
gaaaaguuuaauauuaaagccau

SEQ ID NO: 3390152 - RNA, 14 nt, Human
gaaaaguuuauaaa

SEQ ID NO: 3390153 - RNA, 18 nt, Human
gaaaauaaaaaaaagaaa

SEQ ID NO: 3390154 - RNA, 19 nt, Human
gaaaauaaaaaaaagaaaa

SEQ ID NO: 3390155 - RNA, 19 nt, Human
gaaaauaaaaaaagaaaaa

SEQ ID NO: 3390156 - RNA, 14 nt, Human
gaaaauaaaaaguu

SEQ ID NO: 3390157 - RNA, 17 nt, Human
gaaaauaaaaaguuaaa

SEQ ID NO: 3390158 - RNA, 12 nt, Human
gaaaauaaaauu

SEQ ID NO: 3390159 - RNA, 12 nt, Human
gaaaauaaagaa

SEQ ID NO: 3390160 - RNA, 17 nt, Human
gaaaauaacugaauuug

SEQ ID NO: 3390161 - RNA, 19 nt, Human
gaaaauaagccaugagaau

SEQ ID NO: 3390162 - RNA, 19 nt, Human
gaaaauaagugaauaauaa

SEQ ID NO: 3390163 - RNA, 18 nt, Human
gaaaauaauguaauugua

SEQ ID NO: 3390164 - RNA, 21 nt, Human
gaaaauacuuaaauguuaugu

SEQ ID NO: 3390165 - RNA, 17 nt, Human
gaaaauagaauugacau

SEQ ID NO: 3390166 - RNA, 17 nt, Human
gaaaauaggcaggaagc

SEQ ID NO: 3390167 - RNA, 13 nt, Human
gaaaauaggcuuu

SEQ ID NO: 3390168 - RNA, 19 nt, Human
gaaaauaguuuauuuuaaa

SEQ ID NO: 3390169 - RNA, 23 nt, Human
gaaaauaguuuauuuuaaaacaa

SEQ ID NO: 3390170 - RNA, 16 nt, Human
gaaaauauaaccagcc

SEQ ID NO: 3390171 - RNA, 17 nt, Human
gaaaauauacuguaaag

SEQ ID NO: 3390172 - RNA, 22 nt, Human
gaaaauaucugcucaaaacuuu

SEQ ID NO: 3390173 - RNA, 12 nt, Human
gaaaauaugcau

SEQ ID NO: 3390174 - RNA, 13 nt, Human
gaaaauauguauu

SEQ ID NO: 3390175 - RNA, 18 nt, Human
gaaaauauguauuaacac

SEQ ID NO: 3390176 - RNA, 22 nt, Human
gaaaauauuguuuuacaauagu

SEQ ID NO: 3390177 - RNA, 19 nt, Human
gaaaauauuuugaucuuca

SEQ ID NO: 3390178 - RNA, 20 nt, Human
gaaaauauuuugaucuucaa

SEQ ID NO: 3390179 - RNA, 23 nt, Human
gaaaauauuuugaucuucaacaa

SEQ ID NO: 3390180 - RNA, 17 nt, Human
gaaaauauuuugucuaa

SEQ ID NO: 3390181 - RNA, 18 nt, Human
gaaaauauuuuuuauaua

SEQ ID NO: 3390182 - RNA, 15 nt, Human
gaaaaucaaauacau

SEQ ID NO: 3390183 - RNA, 17 nt, Human
gaaaaucacuuugucua

SEQ ID NO: 3390184 - RNA, 18 nt, Human
gaaaaucacuuugucuaa

SEQ ID NO: 3390185 - RNA, 18 nt, Human
gaaaaucagccugcucca

SEQ ID NO: 3390186 - RNA, 21 nt, Human
gaaaaucaucaagaagggcug

SEQ ID NO: 3390187 - RNA, 22 nt, Human
gaaaaucaucaagaagggcugc

SEQ ID NO: 3390188 - RNA, 13 nt, Human
gaaaauccucugg

SEQ ID NO: 3390189 - RNA, 14 nt, Human
gaaaaugaaaaaca

SEQ ID NO: 3390190 - RNA, 15 nt, Human
gaaaaugaaaauuag

SEQ ID NO: 3390191 - RNA, 18 nt, Human
gaaaaugaaaauuaggau

SEQ ID NO: 3390192 - RNA, 20 nt, Human
gaaaaugaauaucuauuaau

SEQ ID NO: 3390193 - RNA, 21 nt, Human
gaaaaugaguugugaaaguuu

SEQ ID NO: 3390194 - RNA, 23 nt, Human
gaaaaugaguuuuuauggggcug

SEQ ID NO: 3390195 - RNA, 23 nt, Human
gaaaaugauguguacccaaacgu

SEQ ID NO: 3390196 - RNA, 15 nt, Human
gaaaaugcgguuaua

SEQ ID NO: 3390197 - RNA, 22 nt, Human
gaaaauggucgagaaagaggca

SEQ ID NO: 3390198 - RNA, 15 nt, Human
gaaaauguaugugua

SEQ ID NO: 3390199 - RNA, 22 nt, Human
gaaaaugucagaaaccaguuau

SEQ ID NO: 3390200 - RNA, 14 nt, Human
gaaaauguccagga

SEQ ID NO: 3390201 - RNA, 22 nt, Human
gaaaaugucuguaauaauagac

SEQ ID NO: 3390202 - RNA, 15 nt, Human
gaaaauguucuguuu

SEQ ID NO: 3390203 - RNA, 15 nt, Human
gaaaauguugagaau

SEQ ID NO: 3390204 - RNA, 20 nt, Human
gaaaauguugagaaucccaa

SEQ ID NO: 3390205 - RNA, 20 nt, Human
gaaaauuaagggccgauuua

SEQ ID NO: 3390206 - RNA, 23 nt, Human
gaaaauuaagggccgauuuaauu

SEQ ID NO: 3390207 - RNA, 16 nt, Human
gaaaauuagacuguga

SEQ ID NO: 3390208 - RNA, 23 nt, Human
gaaaauuauuuaaaccgcuaaaa

SEQ ID NO: 3390209 - RNA, 17 nt, Human
gaaaauuauuuuaaaca

SEQ ID NO: 3390210 - RNA, 20 nt, Human
gaaaauuauuuuguucauac

SEQ ID NO: 3390211 - RNA, 21 nt, Human
gaaaauuauuuuguucauaca

SEQ ID NO: 3390212 - RNA, 23 nt, Human
gaaaauuauuuuguucauacaua

SEQ ID NO: 3390213 - RNA, 17 nt, Human
gaaaauucaaaaagugu

SEQ ID NO: 3390214 - RNA, 20 nt, Human
gaaaauuccagaaaggauau

SEQ ID NO: 3390215 - RNA, 21 nt, Human
gaaaauuccuauugauuuucu

SEQ ID NO: 3390216 - RNA, 13 nt, Human
gaaaauucugugc

SEQ ID NO: 3390217 - RNA, 21 nt, Human
gaaaauugccuuucuguguuu

SEQ ID NO: 3390218 - RNA, 16 nt, Human
gaaaauugcugugccu

SEQ ID NO: 3390219 - RNA, 22 nt, Human
gaaaauugcugugccucccaaa

SEQ ID NO: 3390220 - RNA, 23 nt, Human
gaaacaaaaacacuaaaaauaaa

SEQ ID NO: 3390221 - RNA, 21 nt, Human
gaaacaaaguggaaggaaaga

SEQ ID NO: 3390222 - RNA, 23 nt, Human
gaaacaaaguggaaggaaagaug

SEQ ID NO: 3390223 - RNA, 16 nt, Human
gaaacaacauuuauau

SEQ ID NO: 3390224 - RNA, 16 nt, Human
gaaacaaccaugucau

SEQ ID NO: 3390225 - RNA, 17 nt, Human
gaaacaacucuuugaga

SEQ ID NO: 3390226 - RNA, 20 nt, Human
gaaacaacucuuugagaaac

SEQ ID NO: 3390227 - RNA, 15 nt, Human
gaaacaauaaagaga

SEQ ID NO: 3390228 - RNA, 21 nt, Human
gaaacaauacucauaauguga

SEQ ID NO: 3390229 - RNA, 17 nt, Human
gaaacacaccaggcugu

SEQ ID NO: 3390230 - RNA, 16 nt, Human
gaaacacacugaggca

SEQ ID NO: 3390231 - RNA, 16 nt, Human
cuuuugaauuguuaca

SEQ ID NO: 3390232 - RNA, 18 nt, Human
cuuuugacuuaaagcaga

SEQ ID NO: 3390233 - RNA, 18 nt, Human
cuuuugagacuuuuuggu

SEQ ID NO: 3390234 - RNA, 20 nt, Human
cuuuugagacuuuuuggugg

SEQ ID NO: 3390235 - RNA, 23 nt, Human
cuuuugagugugugugugcaugu

SEQ ID NO: 3390236 - RNA, 23 nt, Human
cuuuugauaaucaacugggcuga

SEQ ID NO: 3390237 - RNA, 13 nt, Human
cuuuugauauuaa

SEQ ID NO: 3390238 - RNA, 20 nt, Human
cuuuugcaaagaaagaaaaa

SEQ ID NO: 3390239 - RNA, 18 nt, Human
cuuuugcaacuuaauacu

SEQ ID NO: 3390240 - RNA, 18 nt, Human
cuuuugcaagguuccaca

SEQ ID NO: 3390241 - RNA, 18 nt, Human
cuuuugcaccccucccau

SEQ ID NO: 3390242 - RNA, 20 nt, Human
cuuuugcaccccucccauua

SEQ ID NO: 3390243 - RNA, 19 nt, Human
cuuuugcaccugcucucuu

SEQ ID NO: 3390244 - RNA, 13 nt, Human
cuuuugccauuga

SEQ ID NO: 3390245 - RNA, 17 nt, Human
cuuuugcccauuuugaa

SEQ ID NO: 3390246 - RNA, 22 nt, Human
cuuuugcucgaugcagacaggg

SEQ ID NO: 3390247 - RNA, 22 nt, Human
cuuuugcucuuagcugucugcu

SEQ ID NO: 3390248 - RNA, 14 nt, Human
cuuuugcuuuaauu

SEQ ID NO: 3390249 - RNA, 23 nt, Human
cuuuugcuuuuccuuuguuuuua

SEQ ID NO: 3390250 - RNA, 16 nt, Human
cuuuugcuuuugccca

SEQ ID NO: 3390251 - RNA, 18 nt, Human
cuuuuggaagguauuuaa

SEQ ID NO: 3390252 - RNA, 18 nt, Human
cuuuuggaaucuagaaga

SEQ ID NO: 3390253 - RNA, 19 nt, Human
cuuuuggauuggacaaaau

SEQ ID NO: 3390254 - RNA, 23 nt, Human
cuuuuggauuggacaaaaugacu

SEQ ID NO: 3390255 - RNA, 23 nt, Human
cuuuuggcaaugacucaaagucu

SEQ ID NO: 3390256 - RNA, 15 nt, Human
cuuuugguguguugg

SEQ ID NO: 3390257 - RNA, 17 nt, Human
cuuuugguguguuggac

SEQ ID NO: 3390258 - RNA, 19 nt, Human
cuuuugguucauuuucaga

SEQ ID NO: 3390259 - RNA, 21 nt, Human
cuuuuguaaagaaauuuacua

SEQ ID NO: 3390260 - RNA, 12 nt, Human
cuuuuguaaagu

SEQ ID NO: 3390261 - RNA, 19 nt, Human
cuuuuguaaagugaagaau

SEQ ID NO: 3390262 - RNA, 14 nt, Human
cuuuuguaaauuaa

SEQ ID NO: 3390263 - RNA, 20 nt, Human
gaaacagcuuucaagugccu

SEQ ID NO: 3390264 - RNA, 21 nt, Human
gaaacagcuuucaagugccuu

SEQ ID NO: 3390265 - RNA, 17 nt, Human
gaaacaguugcauguag

SEQ ID NO: 3390266 - RNA, 20 nt, Human
gaaacaguugcauguaguaa

SEQ ID NO: 3390267 - RNA, 17 nt, Human
gaaacauaaauaaaaug

SEQ ID NO: 3390268 - RNA, 22 nt, Human
gaaacauaaauaaaaugaccag

SEQ ID NO: 3390269 - RNA, 16 nt, Human
gaaacauugcuuuuaa

SEQ ID NO: 3390270 - RNA, 17 nt, Human
gaaacauugcuuuuaaa

SEQ ID NO: 3390271 - RNA, 14 nt, Human
gaaacauuuauauu

SEQ ID NO: 3390272 - RNA, 13 nt, Human
gaaacauuuucau

SEQ ID NO: 3390273 - RNA, 15 nt, Human
gaaaccaaagaagaa

SEQ ID NO: 3390274 - RNA, 22 nt, Human
gaaaccaauuccucauccucag

SEQ ID NO: 3390275 - RNA, 14 nt, Human
gaaaccacagcugc

SEQ ID NO: 3390276 - RNA, 15 nt, Human
gaaaccacagcugcu

SEQ ID NO: 3390277 - RNA, 19 nt, Human
gaaaccagcuuccuucaga

SEQ ID NO: 3390278 - RNA, 21 nt, Human
gaaaccagcuuccuucagaga

SEQ ID NO: 3390279 - RNA, 19 nt, Human
gaaaccaguguagccuugc

SEQ ID NO: 3390280 - RNA, 23 nt, Human
gaaaccauguagcagugagucau

SEQ ID NO: 3390281 - RNA, 14 nt, Human
gaaacccaagcucc

SEQ ID NO: 3390282 - RNA, 17 nt, Human
gaaacccaagcuccucc

SEQ ID NO: 3390283 - RNA, 15 nt, Human
gaaacccagcucugg

SEQ ID NO: 3390284 - RNA, 16 nt, Human
gaaacccauaggccca

SEQ ID NO: 3390285 - RNA, 15 nt, Human
gaaacccccacacac

SEQ ID NO: 3390286 - RNA, 23 nt, Human
gaaacccccacacacacacacau

SEQ ID NO: 3390287 - RNA, 16 nt, Human
gaaacccgacagaggg

SEQ ID NO: 3390288 - RNA, 15 nt, Human
gaaacccgaggguug

SEQ ID NO: 3390289 - RNA, 18 nt, Human
gaaacccgaggguugauu

SEQ ID NO: 3390290 - RNA, 22 nt, Human
gaaacccgucucuacuaaaaau

SEQ ID NO: 3390291 - RNA, 15 nt, Human
gaaacccuauuuccc

SEQ ID NO: 3390292 - RNA, 15 nt, Human
gaaacccugagcaga

SEQ ID NO: 3390293 - RNA, 14 nt, Human
gaaacccuggacca

SEQ ID NO: 3390294 - RNA, 21 nt, Human
gaaaccgaguagaaaauguga

SEQ ID NO: 3390295 - RNA, 21 nt, Human
gaaaccgccuaguuuacuguu

SEQ ID NO: 3390296 - RNA, 19 nt, Human
gaaaccuacugcccaggca

SEQ ID NO: 3390297 - RNA, 17 nt, Human
gaaaccuaguacugccc

SEQ ID NO: 3390298 - RNA, 17 nt, Human
gaaaccugcccugccug

SEQ ID NO: 3390299 - RNA, 20 nt, Human
gaaaccuguauaacccuguu

SEQ ID NO: 3390300 - RNA, 15 nt, Human
gaaaccuguaucuuu

SEQ ID NO: 3390301 - RNA, 13 nt, Human
gaaaccuuaauau

SEQ ID NO: 3390302 - RNA, 17 nt, Human
gaaaccuuauuguaccu

SEQ ID NO: 3390303 - RNA, 22 nt, Human
gaaaccuuauuuuuucccaaag

SEQ ID NO: 3390304 - RNA, 15 nt, Human
gaaaccuuccaccca

SEQ ID NO: 3390305 - RNA, 16 nt, Human
gaaaccuuuaagaaaa

SEQ ID NO: 3390306 - RNA, 17 nt, Human
gaaaccuuuagggcagc

SEQ ID NO: 3390307 - RNA, 21 nt, Human
gaaaccuuuagggcagcuugc

SEQ ID NO: 3390308 - RNA, 20 nt, Human
gaaaccuuuucuuguaucug

SEQ ID NO: 3390309 - RNA, 18 nt, Human
gaaaccuuuuuuaagauu

SEQ ID NO: 3390310 - RNA, 19 nt, Human
gaaaccuuuuuuaagauuu

SEQ ID NO: 3390311 - RNA, 20 nt, Human
gaaaccuuuuuuaagauuuu

SEQ ID NO: 3390312 - RNA, 21 nt, Human
gaaaccuuuuuuaagauuuuu

SEQ ID NO: 3390313 - RNA, 22 nt, Human
gaaaccuuuuuuaagauuuuuc

SEQ ID NO: 3390314 - RNA, 21 nt, Human
gaaacgagacuuuccauuaca

SEQ ID NO: 3390315 - RNA, 16 nt, Human
gaaacggaugauuucu

SEQ ID NO: 3390316 - RNA, 18 nt, Human
gaaacggaugauuucuau

SEQ ID NO: 3390317 - RNA, 19 nt, Human
gaaacuaaagcaauagaaa

SEQ ID NO: 3390318 - RNA, 22 nt, Human
gaaacuaaagcaauagaaacaa

SEQ ID NO: 3390319 - RNA, 15 nt, Human
gaaacuaacagauaa

SEQ ID NO: 3390320 - RNA, 12 nt, Human
gaaacuaauaaa

SEQ ID NO: 3390321 - RNA, 15 nt, Human
gaaacuaauaaaaua

SEQ ID NO: 3390322 - RNA, 17 nt, Human
gaaacuaauaaaauauu

SEQ ID NO: 3390323 - RNA, 18 nt, Human
gaaacuaauaaaauauuu

SEQ ID NO: 3390324 - RNA, 19 nt, Human
gaaacuaauaaaauauuuu

SEQ ID NO: 3390325 - RNA, 20 nt, Human
gaaacuaauaaaauauuuuc

SEQ ID NO: 3390326 - RNA, 23 nt, Human
gaaacuaauaaaauauuuucugu

SEQ ID NO: 3390327 - RNA, 19 nt, Human
gaaacuacugccuuuagaa

SEQ ID NO: 3390328 - RNA, 24 nt, Human
gaaacuagcuuacaugagaacaga

SEQ ID NO: 3390329 - RNA, 20 nt, Human
gaaacuaggugcauauuuau

SEQ ID NO: 3390330 - RNA, 19 nt, Human
gaaacuauauuuugucaua

SEQ ID NO: 3390331 - RNA, 20 nt, Human
gaaacuauguguuuuucuca

SEQ ID NO: 3390332 - RNA, 21 nt, Human
gaaacucacacuccccuaggg

SEQ ID NO: 3390333 - RNA, 19 nt, Human
gaaacucaccugcuggccc

SEQ ID NO: 3390334 - RNA, 23 nt, Human
gaaacucaccugcuggccccuca

SEQ ID NO: 3390335 - RNA, 22 nt, Human
gaaacucagagucggaacggag

SEQ ID NO: 3390336 - RNA, 21 nt, Human
gaaacuccaccuugcggggau

SEQ ID NO: 3390337 - RNA, 15 nt, Human
gaaacuccagaugcc

SEQ ID NO: 3390338 - RNA, 17 nt, Human
gaaacucuauggucuua

SEQ ID NO: 3390339 - RNA, 14 nt, Human
gaaacucuuaucuc

SEQ ID NO: 3390340 - RNA, 19 nt, Human
gaaacucuuuuugggcucc

SEQ ID NO: 3390341 - RNA, 14 nt, Human
gaaacugaaugcuc

SEQ ID NO: 3390342 - RNA, 16 nt, Human
gaaacugacacaugcu

SEQ ID NO: 3390343 - RNA, 18 nt, Human
gaaacugaggaauuuucu

SEQ ID NO: 3390344 - RNA, 15 nt, Human
gaaacugcagggaaa

SEQ ID NO: 3390345 - RNA, 22 nt, Human
gaaacuggaaauacuagauuug

SEQ ID NO: 3390346 - RNA, 17 nt, Human
gaaacuggcaaagcaga

SEQ ID NO: 3390347 - RNA, 21 nt, Human
gaaacuguucccaccugcugg

SEQ ID NO: 3390348 - RNA, 17 nt, Human
gaaacuguugccagaga

SEQ ID NO: 3390349 - RNA, 14 nt, Human
gaaacuuacacaca

SEQ ID NO: 3390350 - RNA, 21 nt, Human
gaaacuuauuuuuuucugauu

SEQ ID NO: 3390351 - RNA, 17 nt, Human
gaaacuucaagcaccag

SEQ ID NO: 3390352 - RNA, 23 nt, Human
gaaacuucagcgguuuauauaag

SEQ ID NO: 3390353 - RNA, 12 nt, Human
gaaacuuggcuc

SEQ ID NO: 3390354 - RNA, 21 nt, Human
gaaacuugucacuugcauguc

SEQ ID NO: 3390355 - RNA, 16 nt, Human
gaaacuuguguaaaua

SEQ ID NO: 3390356 - RNA, 20 nt, Human
gaaacuuguuauugugaaug

SEQ ID NO: 3390357 - RNA, 17 nt, Human
gaaacuuguuucacuga

SEQ ID NO: 3390358 - RNA, 19 nt, Human
gaaacuuugagaucuaaaa

SEQ ID NO: 3390359 - RNA, 11 nt, Human
gaaacuuuucu

SEQ ID NO: 3390360 - RNA, 21 nt, Human
gaaacuuuucuuaaaaaguua

SEQ ID NO: 3390361 - RNA, 16 nt, Human
gaaacuuuuguaaaga

SEQ ID NO: 3390362 - RNA, 17 nt, Human
gaaagaaaauaugcauc

SEQ ID NO: 3390363 - RNA, 15 nt, Human
gaaagaaagaaggaa

SEQ ID NO: 3390364 - RNA, 15 nt, Human
gaaagaaagaggaaa

SEQ ID NO: 3390365 - RNA, 14 nt, Human
gaaagaaaucaugu

SEQ ID NO: 3390366 - RNA, 23 nt, Human
gaaagaacauggacuuguauauu

SEQ ID NO: 3390367 - RNA, 20 nt, Human
gaaagaacuaucuucaucug

SEQ ID NO: 3390368 - RNA, 16 nt, Human
gaaagaagaaaagguu

SEQ ID NO: 3390369 - RNA, 15 nt, Human
gaaagaagagacagg

SEQ ID NO: 3390370 - RNA, 13 nt, Human
gaaagaaggaaga

SEQ ID NO: 3390371 - RNA, 16 nt, Human
gaaagaaggcaaaguc

SEQ ID NO: 3390372 - RNA, 12 nt, Human
gaaagaauagaa

SEQ ID NO: 3390373 - RNA, 14 nt, Human
gaaagaauagaaag

SEQ ID NO: 3390374 - RNA, 12 nt, Human
cuacagaaaaac

SEQ ID NO: 3390375 - RNA, 13 nt, Human
cuacagaaaaacc

SEQ ID NO: 3390376 - RNA, 23 nt, Human
cuacagaaaaaccagaggcagcu

SEQ ID NO: 3390377 - RNA, 14 nt, Human
cuacagaaaaaccu

SEQ ID NO: 3390378 - RNA, 22 nt, Human
cuacagaaaugaggaggaugcu

SEQ ID NO: 3390379 - RNA, 20 nt, Human
cuacagaacuucagaaagac

SEQ ID NO: 3390380 - RNA, 22 nt, Human
cuacagaauacuagccagagcu

SEQ ID NO: 3390381 - RNA, 17 nt, Human
cuacagacauuaaauaa

SEQ ID NO: 3390382 - RNA, 14 nt, Human
cuacagagaaacca

SEQ ID NO: 3390383 - RNA, 13 nt, Human
cuacagagaagcc

SEQ ID NO: 3390384 - RNA, 15 nt, Human
cuacagagaagccuu

SEQ ID NO: 3390385 - RNA, 22 nt, Human
cuacagagaggaaauucuccac

SEQ ID NO: 3390386 - RNA, 12 nt, Human
cuacagagcugu

SEQ ID NO: 3390387 - RNA, 13 nt, Human
cuacagagcugug

SEQ ID NO: 3390388 - RNA, 14 nt, Human
cuacagagcugugg

SEQ ID NO: 3390389 - RNA, 16 nt, Human
cuacagagcuucccug

SEQ ID NO: 3390390 - RNA, 18 nt, Human
cuacagagcuucccugac

SEQ ID NO: 3390391 - RNA, 21 nt, Human
cuacagaggaaacaauauuua

SEQ ID NO: 3390392 - RNA, 21 nt, Human
cuacagcuaaucagcauucuc

SEQ ID NO: 3390393 - RNA, 14 nt, Human
cuacagcuaugaag

SEQ ID NO: 3390394 - RNA, 16 nt, Human
cuacagcuaugaagaa

SEQ ID NO: 3390395 - RNA, 17 nt, Human
cuacagcuaugaagaaa

SEQ ID NO: 3390396 - RNA, 14 nt, Human
cuacagcuccccca

SEQ ID NO: 3390397 - RNA, 17 nt, Human
cuacagcuuucuugcuc

SEQ ID NO: 3390398 - RNA, 19 nt, Human
cuacagcuuucuugcuccc

SEQ ID NO: 3390399 - RNA, 20 nt, Human
cuacaggaagcaccccaugc

SEQ ID NO: 3390400 - RNA, 14 nt, Human
cuacaggagugagc

SEQ ID NO: 3390401 - RNA, 16 nt, Human
cuacaggagugagcac

SEQ ID NO: 3390402 - RNA, 17 nt, Human
cuacaggcagucucucu

SEQ ID NO: 3390403 - RNA, 14 nt, Human
cuacaggggccaga

SEQ ID NO: 3390404 - RNA, 11 nt, Human
cuacagguuac

SEQ ID NO: 3390405 - RNA, 14 nt, Human
cuacagguuacaac

SEQ ID NO: 3390406 - RNA, 22 nt, Human
cuacaguauuacucuuacaaga

SEQ ID NO: 3390407 - RNA, 18 nt, Human
cuacagucaggaaaggaa

SEQ ID NO: 3390408 - RNA, 13 nt, Human
cuacaguccuccc

SEQ ID NO: 3390409 - RNA, 16 nt, Human
cuacaguccucccauc

SEQ ID NO: 3390410 - RNA, 17 nt, Human
cuacaguccucccaucu

SEQ ID NO: 3390411 - RNA, 19 nt, Human
cuacaguccucccaucuca

SEQ ID NO: 3390412 - RNA, 20 nt, Human
cuacaguccucccaucucac

SEQ ID NO: 3390413 - RNA, 16 nt, Human
cuacagugguuuuaua

SEQ ID NO: 3390414 - RNA, 13 nt, Human
cuacaguguacag

SEQ ID NO: 3390415 - RNA, 20 nt, Human
cuacaguguacagucuugua

SEQ ID NO: 3390416 - RNA, 21 nt, Human
cuacaguuauguucagucaca

SEQ ID NO: 3390417 - RNA, 22 nt, Human
cuacaguugaaaaacagcugag

SEQ ID NO: 3390418 - RNA, 13 nt, Human
cuuuuguaagaca

SEQ ID NO: 3390419 - RNA, 12 nt, Human
cuuuuguacuga

SEQ ID NO: 3390420 - RNA, 23 nt, Human
cuuuuguacugaauuuuuuugua

SEQ ID NO: 3390421 - RNA, 12 nt, Human
cuuuuguauaca

SEQ ID NO: 3390422 - RNA, 19 nt, Human
cuuuuguauacauccuggg

SEQ ID NO: 3390423 - RNA, 15 nt, Human
cuuuuguauguaaau

SEQ ID NO: 3390424 - RNA, 20 nt, Human
cuuuuguauguaaaugugca

SEQ ID NO: 3390425 - RNA, 21 nt, Human
cuuuuguauguaaaugugcau

SEQ ID NO: 3390426 - RNA, 23 nt, Human
cuuuuguauguaaaugugcauuc

SEQ ID NO: 3390427 - RNA, 14 nt, Human
cuuuuguauuaaga

SEQ ID NO: 3390428 - RNA, 17 nt, Human
cuuuuguauuaagaaag

SEQ ID NO: 3390429 - RNA, 19 nt, Human
cuuuugucuacacacccug

SEQ ID NO: 3390430 - RNA, 17 nt, Human
cuuuugucuaugggacu

SEQ ID NO: 3390431 - RNA, 15 nt, Human
cuuuugucucugcaa

SEQ ID NO: 3390432 - RNA, 12 nt, Human
cuuuugugcauu

SEQ ID NO: 3390433 - RNA, 18 nt, Human
cuuuugugcauuaucuag

SEQ ID NO: 3390434 - RNA, 21 nt, Human
cuuuugugggggacuguaagu

SEQ ID NO: 3390435 - RNA, 13 nt, Human
cuuuugugucuua

SEQ ID NO: 3390436 - RNA, 14 nt, Human
cuuuuguguuccaa

SEQ ID NO: 3390437 - RNA, 18 nt, Human
cuuuuguuaaauaauaug

SEQ ID NO: 3390438 - RNA, 12 nt, Human
cuuuuguuacug

SEQ ID NO: 3390439 - RNA, 15 nt, Human
cuuuuguuacuguuc

SEQ ID NO: 3390440 - RNA, 16 nt, Human
cuuuuguuacuguucu

SEQ ID NO: 3390441 - RNA, 16 nt, Human
cuuuuguucauuucau

SEQ ID NO: 3390442 - RNA, 22 nt, Human
cuuuuguucuugguuuguaaau

SEQ ID NO: 3390443 - RNA, 12 nt, Human
cuuuuguuguug

SEQ ID NO: 3390444 - RNA, 15 nt, Human
cuuuuguuguuucuu

SEQ ID NO: 3390445 - RNA, 17 nt, Human
cuuuuguuguuucuuaa

SEQ ID NO: 3390446 - RNA, 16 nt, Human
cuuuuguuuccuuuuu

SEQ ID NO: 3390447 - RNA, 19 nt, Human
cuuuuguuuccuuuuuucc

SEQ ID NO: 3390448 - RNA, 17 nt, Human
cuuuuguuuuuugaagu

SEQ ID NO: 3390449 - RNA, 19 nt, Human
cuuuuguuuuuugaagugu

SEQ ID NO: 3390450 - RNA, 21 nt, Human
cuuuuuaaaaauuguuauuua

SEQ ID NO: 3390451 - RNA, 17 nt, Human
cuuuuuaaaacacaugu

SEQ ID NO: 3390452 - RNA, 22 nt, Human
cuuuuuaaaagguauuuugaau

SEQ ID NO: 3390453 - RNA, 17 nt, Human
cuuuuuaagcuuauuua

SEQ ID NO: 3390454 - RNA, 15 nt, Human
cuuuuuaaguaaugu

SEQ ID NO: 3390455 - RNA, 17 nt, Human
cuuuuuaauucaccaaa

SEQ ID NO: 3390456 - RNA, 23 nt, Human
cuuuuuaauuguuguuucuuucu

SEQ ID NO: 3390457 - RNA, 18 nt, Human
cuuuuuacauaacugccu

SEQ ID NO: 3390458 - RNA, 20 nt, Human
cuuuuuaccaaguuucaggu

SEQ ID NO: 3390459 - RNA, 21 nt, Human
cuuuuuaguuuacccgguuuc

SEQ ID NO: 3390460 - RNA, 11 nt, Human
cuuuuuauaaa

SEQ ID NO: 3390461 - RNA, 18 nt, Human
cuuuuuauaaaaagauaa

SEQ ID NO: 3390462 - RNA, 22 nt, Human
cuuuuuauguugccaguuuaau

SEQ ID NO: 3390463 - RNA, 14 nt, Human
cuuuuuauugaauc

SEQ ID NO: 3390464 - RNA, 19 nt, Human
cuuuuuauugaaucuauuu

SEQ ID NO: 3390465 - RNA, 11 nt, Human
cuuuuuauugc

SEQ ID NO: 3390466 - RNA, 18 nt, Human
cuuuuuauuuauauguau

SEQ ID NO: 3390467 - RNA, 13 nt, Human
cuuuuuauuucug

SEQ ID NO: 3390468 - RNA, 18 nt, Human
cuuuuuauuuuuuaauua

SEQ ID NO: 3390469 - RNA, 20 nt, Human
cuuuuucaaugaauuuuaua

SEQ ID NO: 3390470 - RNA, 15 nt, Human
cuuuuucauccccuu

SEQ ID NO: 3390471 - RNA, 16 nt, Human
cuuuuucauccccuua

SEQ ID NO: 3390472 - RNA, 12 nt, Human
cuuuuucauuau

SEQ ID NO: 3390473 - RNA, 14 nt, Human
cuuuuucauuauuu

SEQ ID NO: 3390474 - RNA, 21 nt, Human
cuuuuucauuauuuuauuaug

SEQ ID NO: 3390475 - RNA, 12 nt, Human
cuuuuucauuua

SEQ ID NO: 3390476 - RNA, 18 nt, Human
cuuuuucauuugccuauu

SEQ ID NO: 3390477 - RNA, 22 nt, Human
cuuuuuccaacucagaaauuca

SEQ ID NO: 3390478 - RNA, 23 nt, Human
cuuuuuccaacuuggcugcagga

SEQ ID NO: 3390479 - RNA, 17 nt, Human
cuuuuuccccuuucugu

SEQ ID NO: 3390480 - RNA, 18 nt, Human
cuuuuuccuagccuguuu

SEQ ID NO: 3390481 - RNA, 12 nt, Human
cuuuuucuaaug

SEQ ID NO: 3390482 - RNA, 20 nt, Human
cuuuuucuaaugaggagaga

SEQ ID NO: 3390483 - RNA, 17 nt, Human
cuuuuucucccucugga

SEQ ID NO: 3390484 - RNA, 18 nt, Human
cuuuuucugauuagcuuu

SEQ ID NO: 3390485 - RNA, 21 nt, Human
cuuuuucugauuagcuuugug

SEQ ID NO: 3390486 - RNA, 13 nt, Human
cuuuuucugcacu

SEQ ID NO: 3390487 - RNA, 12 nt, Human
cuuuuucuggac

SEQ ID NO: 3390488 - RNA, 16 nt, Human
cuuuuucuggacucug

SEQ ID NO: 3390489 - RNA, 15 nt, Human
cuuuuucuguuguaa

SEQ ID NO: 3390490 - RNA, 16 nt, Human
cuuuuucuguuguaac

SEQ ID NO: 3390491 - RNA, 17 nt, Human
cuuuuucuguuguaacu

SEQ ID NO: 3390492 - RNA, 15 nt, Human
cuuuuucuucuuccc

SEQ ID NO: 3390493 - RNA, 16 nt, Human
cuuuuucuuuauaaac

SEQ ID NO: 3390494 - RNA, 18 nt, Human
cuuuuucuuuauaaacuu

SEQ ID NO: 3390495 - RNA, 15 nt, Human
cuuuuucuuuuguaa

SEQ ID NO: 3390496 - RNA, 21 nt, Human
cuuuuucuuuuuuucuuuggu

SEQ ID NO: 3390497 - RNA, 14 nt, Human
cuuuuugaaauguc

SEQ ID NO: 3390498 - RNA, 16 nt, Human
cuuuuugaaguauuua

SEQ ID NO: 3390499 - RNA, 13 nt, Human
cuuuuugaaucuu

SEQ ID NO: 3390500 - RNA, 22 nt, Human
cuuuuugauuacaguguagcuu

SEQ ID NO: 3390501 - RNA, 12 nt, Human
cuuuuugcagcu

SEQ ID NO: 3390502 - RNA, 14 nt, Human
cuuuuugcagcuuu

SEQ ID NO: 3390503 - RNA, 16 nt, Human
cuuuuugcucuaaaau

SEQ ID NO: 3390504 - RNA, 12 nt, Human
cuuuuuggaauc

SEQ ID NO: 3390505 - RNA, 18 nt, Human
cuuuuuggaaucuuugua

SEQ ID NO: 3390506 - RNA, 20 nt, Human
cuuuuuggcauaacauaaau

SEQ ID NO: 3390507 - RNA, 22 nt, Human
cuuuuuggcauaacauaaaucu

SEQ ID NO: 3390508 - RNA, 17 nt, Human
cuuuuugguggauguaa

SEQ ID NO: 3390509 - RNA, 19 nt, Human
cuuuuugguggauguaaau

SEQ ID NO: 3390510 - RNA, 18 nt, Human
cuuuuuguaagugagugu

SEQ ID NO: 3390511 - RNA, 13 nt, Human
cuuuuuguauaaa

SEQ ID NO: 3390512 - RNA, 17 nt, Human
cuuuuuguuguaaaaca

SEQ ID NO: 3390513 - RNA, 13 nt, Human
cuuuuuuaaauaa

SEQ ID NO: 3390514 - RNA, 17 nt, Human
cuuuuuuaaauaaacuu

SEQ ID NO: 3390515 - RNA, 15 nt, Human
cuuuuuuaaauaaau

SEQ ID NO: 3390516 - RNA, 17 nt, Human
cuuuuuuaaauauuuuc

SEQ ID NO: 3390517 - RNA, 15 nt, Human
cuuuuuuaaauuaau

SEQ ID NO: 3390518 - RNA, 21 nt, Human
cuuuuuuaaauuuucuucagu

SEQ ID NO: 3390519 - RNA, 15 nt, Human
cuuuuuuauacauaa

SEQ ID NO: 3390520 - RNA, 14 nt, Human
gaaagucuguccuu

SEQ ID NO: 3390521 - RNA, 16 nt, Human
gaaagucuguccuuga

SEQ ID NO: 3390522 - RNA, 21 nt, Human
gaaagucuugugacuagugcu

SEQ ID NO: 3390523 - RNA, 19 nt, Human
gaaagugaagcaaaucaga

SEQ ID NO: 3390524 - RNA, 16 nt, Human
gaaagugaauaaaaau

SEQ ID NO: 3390525 - RNA, 17 nt, Human
gaaagugaauaaaaauu

SEQ ID NO: 3390526 - RNA, 15 nt, Human
gaaagugaauaaacu

SEQ ID NO: 3390527 - RNA, 22 nt, Human
gaaagugagcaguguuagcuua

SEQ ID NO: 3390528 - RNA, 13 nt, Human
gaaagugaggaaa

SEQ ID NO: 3390529 - RNA, 17 nt, Human
gaaagugccuuucagga

SEQ ID NO: 3390530 - RNA, 22 nt, Human
gaaagugccuuucaggaucuau

SEQ ID NO: 3390531 - RNA, 21 nt, Human
gaaagugggaggucaggaaac

SEQ ID NO: 3390532 - RNA, 17 nt, Human
gaaagugggcaaaagcu

SEQ ID NO: 3390533 - RNA, 21 nt, Human
gaaagugggugagaugcugga

SEQ ID NO: 3390534 - RNA, 23 nt, Human
gaaagugggugagaugcuggaga

SEQ ID NO: 3390535 - RNA, 19 nt, Human
gaaaguggucuuaagaaau

SEQ ID NO: 3390536 - RNA, 12 nt, Human
gaaaguguaaag

SEQ ID NO: 3390537 - RNA, 13 nt, Human
gaaaguguaaagc

SEQ ID NO: 3390538 - RNA, 14 nt, Human
gaaaguguaaagca

SEQ ID NO: 3390539 - RNA, 23 nt, Human
gaaaguguaaagcauuccaacaa

SEQ ID NO: 3390540 - RNA, 15 nt, Human
gaaaguguaaauguu

SEQ ID NO: 3390541 - RNA, 23 nt, Human
gaaaguguauuuggaaauaaagu

SEQ ID NO: 3390542 - RNA, 23 nt, Human
gaaaguguguguaguuuuacuuu

SEQ ID NO: 3390543 - RNA, 17 nt, Human
gaaaguguuauuuuuca

SEQ ID NO: 3390544 - RNA, 13 nt, Human
gaaaguguucugu

SEQ ID NO: 3390545 - RNA, 17 nt, Human
gaaaguguucuguuaca

SEQ ID NO: 3390546 - RNA, 19 nt, Human
gaaaguguucuguuacaaa

SEQ ID NO: 3390547 - RNA, 14 nt, Human
gaaaguguuuccuu

SEQ ID NO: 3390548 - RNA, 18 nt, Human
gaaaguugcacggcugcu

SEQ ID NO: 3390549 - RNA, 17 nt, Human
gaaaguuguacaugaaa

SEQ ID NO: 3390550 - RNA, 14 nt, Human
gaaaguuuacagga

SEQ ID NO: 3390551 - RNA, 16 nt, Human
gaaaguuuacaggaaa

SEQ ID NO: 3390552 - RNA, 15 nt, Human
gaaaguuuuguaaaa

SEQ ID NO: 3390553 - RNA, 17 nt, Human
gaaaguuuuguaaaaga

SEQ ID NO: 3390554 - RNA, 11 nt, Human
gaaaguuuuuu

SEQ ID NO: 3390555 - RNA, 19 nt, Human
gaaaguuuuuuuuuauuau

SEQ ID NO: 3390556 - RNA, 14 nt, Human
gaaauaaaaaaguc

SEQ ID NO: 3390557 - RNA, 17 nt, Human
gaaauaaaaaagucucu

SEQ ID NO: 3390558 - RNA, 19 nt, Human
gaaauaaaaaagucucuau

SEQ ID NO: 3390559 - RNA, 20 nt, Human
gaaauaaaaaagucucuauu

SEQ ID NO: 3390560 - RNA, 22 nt, Human
gaaauaaaaaagucucuauuua

SEQ ID NO: 3390561 - RNA, 12 nt, Human
gaaauaaaagcu

SEQ ID NO: 3390562 - RNA, 18 nt, Human
gaaauaaaaggaagccaa

SEQ ID NO: 3390563 - RNA, 19 nt, Human
gaaauaaaaggaagccaaa

SEQ ID NO: 3390564 - RNA, 21 nt, Human
gaaauaaaagugaaugaaaga

SEQ ID NO: 3390565 - RNA, 23 nt, Human
gaaauaaaagugaaugaaagauu

SEQ ID NO: 3390566 - RNA, 16 nt, Human
gaaauaaaauauaucu

SEQ ID NO: 3390567 - RNA, 21 nt, Human
gaaauaaacgucuuaaauauu

SEQ ID NO: 3390568 - RNA, 17 nt, Human
gaaauaaaggaugugau

SEQ ID NO: 3390569 - RNA, 19 nt, Human
gaaauaaagucagauggaa

SEQ ID NO: 3390570 - RNA, 14 nt, Human
gaaauaaauagcua

SEQ ID NO: 3390571 - RNA, 21 nt, Human
gaaauaaauagcuauauccau

SEQ ID NO: 3390572 - RNA, 16 nt, Human
gaaauaacaaaaugga

SEQ ID NO: 3390573 - RNA, 16 nt, Human
gaaauaacaauguuaa

SEQ ID NO: 3390574 - RNA, 14 nt, Human
gaaaaaaagcaugu

SEQ ID NO: 3390575 - RNA, 19 nt, Human
gaaaaaaauaauuuuauga

SEQ ID NO: 3390576 - RNA, 14 nt, Human
gaaaaaaauacuau

SEQ ID NO: 3390577 - RNA, 13 nt, Human
gaaaaaaauguug

SEQ ID NO: 3390578 - RNA, 21 nt, Human
gaaaaaaauguuguuuccuaa

SEQ ID NO: 3390579 - RNA, 14 nt, Human
gaaaaaaauugaaa

SEQ ID NO: 3390580 - RNA, 19 nt, Human
gaaaaaaauugaaauguaa

SEQ ID NO: 3390581 - RNA, 19 nt, Human
gaaaaaacaccuagcuuua

SEQ ID NO: 3390582 - RNA, 21 nt, Human
gaaaaaagaaguguccgagaa

SEQ ID NO: 3390583 - RNA, 13 nt, Human
gaaaaaagaaugu

SEQ ID NO: 3390584 - RNA, 16 nt, Human
gaaaaaagagaaaaga

SEQ ID NO: 3390585 - RNA, 12 nt, Human
gaaaaaagcuuu

SEQ ID NO: 3390586 - RNA, 17 nt, Human
gaaaaaaguuccuuccu

SEQ ID NO: 3390587 - RNA, 14 nt, Human
gaaaaaaguuguag

SEQ ID NO: 3390588 - RNA, 12 nt, Human
gaaaaaauauau

SEQ ID NO: 3390589 - RNA, 19 nt, Human
gaaaaaaugauguucauuu

SEQ ID NO: 3390590 - RNA, 17 nt, Human
gaaaaaaugguagcauu

SEQ ID NO: 3390591 - RNA, 19 nt, Human
gaaaaaaugguagcauuuu

SEQ ID NO: 3390592 - RNA, 15 nt, Human
gaaaaacaauaagag

SEQ ID NO: 3390593 - RNA, 20 nt, Human
gaaaaacacauggggaaaaa

SEQ ID NO: 3390594 - RNA, 13 nt, Human
gaaaaacaggcac

SEQ ID NO: 3390595 - RNA, 18 nt, Human
gaaaaacaggcacuuggc

SEQ ID NO: 3390596 - RNA, 18 nt, Human
gaaaaaccagaggcagcu

SEQ ID NO: 3390597 - RNA, 23 nt, Human
gaaaaacucugggaaauaagaga

SEQ ID NO: 3390598 - RNA, 11 nt, Human
gaaaaagaaaa

SEQ ID NO: 3390599 - RNA, 23 nt, Human
gaaaaagaacaugcaguuugaaa

SEQ ID NO: 3390600 - RNA, 14 nt, Human
gaaaaagauguaca

SEQ ID NO: 3390601 - RNA, 17 nt, Human
gaaaaagcacaagaagc

SEQ ID NO: 3390602 - RNA, 14 nt, Human
gaaaaagcauguac

SEQ ID NO: 3390603 - RNA, 22 nt, Human
gaaaaagcauguacaguguucu

SEQ ID NO: 3390604 - RNA, 21 nt, Human
gaaaaaggacaggcagaaaga

SEQ ID NO: 3390605 - RNA, 21 nt, Human
gaaaaaggagcuuaccuccca

SEQ ID NO: 3390606 - RNA, 23 nt, Human
gaaaaagugauggagcagagcaa

SEQ ID NO: 3390607 - RNA, 14 nt, Human
gaaaaaguuuguuu

SEQ ID NO: 3390608 - RNA, 17 nt, Human
gaaaaauaaacacuaca

SEQ ID NO: 3390609 - RNA, 18 nt, Human
gaaaaauaaaucuguucu

SEQ ID NO: 3390610 - RNA, 20 nt, Human
gaaaaauagugucuuuguga

SEQ ID NO: 3390611 - RNA, 16 nt, Human
gaaaaauauaaaauua

SEQ ID NO: 3390612 - RNA, 17 nt, Human
gaaaaauauaaaauuau

SEQ ID NO: 3390613 - RNA, 19 nt, Human
gaaaaauauauacuaaaca

SEQ ID NO: 3390614 - RNA, 16 nt, Human
gaaaaauauuuaaugu

SEQ ID NO: 3390615 - RNA, 20 nt, Human
gaaaaauauuuaauguugaa

SEQ ID NO: 3390616 - RNA, 18 nt, Human
gaaaaauauuuauucauu

SEQ ID NO: 3390617 - RNA, 19 nt, Human
gaaaaaucacaauuuuuaa

SEQ ID NO: 3390618 - RNA, 16 nt, Human
gaaaaaucuaagugau

SEQ ID NO: 3390619 - RNA, 11 nt, Human
gaaaaaucuug

SEQ ID NO: 3390620 - RNA, 15 nt, Human
gaaaaaugaaagaug

SEQ ID NO: 3390621 - RNA, 16 nt, Human
gaaaaaugaaagauga

SEQ ID NO: 3390622 - RNA, 18 nt, Human
gaaaaaugaaagaugauu

SEQ ID NO: 3390623 - RNA, 16 nt, Human
gaaaaaugcuuugcuu

SEQ ID NO: 3390624 - RNA, 14 nt, Human
gaaaaauguaggag

SEQ ID NO: 3390625 - RNA, 14 nt, Human
gaaaaauguuagga

SEQ ID NO: 3390626 - RNA, 11 nt, Human
gaaaaauguuu

SEQ ID NO: 3390627 - RNA, 13 nt, Human
gaaaaauguuugu

SEQ ID NO: 3390628 - RNA, 17 nt, Human
gaaaaauuauugagcca

SEQ ID NO: 3390629 - RNA, 22 nt, Human
gaaaaauucaauaguaauauaa

SEQ ID NO: 3390630 - RNA, 16 nt, Human
gaaaaauuccacucaa

SEQ ID NO: 3390631 - RNA, 19 nt, Human
gaaaaauuggggaggaggg

SEQ ID NO: 3390632 - RNA, 20 nt, Human
gaaaaauuuaagcauuguuu

SEQ ID NO: 3390633 - RNA, 22 nt, Human
gaaaaauuuaagcauuguuugc

SEQ ID NO: 3390634 - RNA, 14 nt, Human
gaaaacaacaaaaa

SEQ ID NO: 3390635 - RNA, 22 nt, Human
gaaaacaauaacgauaaaagac

SEQ ID NO: 3390636 - RNA, 18 nt, Human
gaaaacacauuuuucuua

SEQ ID NO: 3390637 - RNA, 21 nt, Human
gaaaacacuguucucugcccu

SEQ ID NO: 3390638 - RNA, 24 nt, Human
gaaaacacuguucucugcccucca

SEQ ID NO: 3390639 - RNA, 11 nt, Human
gaaaacagaaa

SEQ ID NO: 3390640 - RNA, 16 nt, Human
gaaaacagaacacuua

SEQ ID NO: 3390641 - RNA, 21 nt, Human
gaaaacagaacaucauuagaa

SEQ ID NO: 3390642 - RNA, 19 nt, Human
gaaaacaggaaaaaaacuu

SEQ ID NO: 3390643 - RNA, 22 nt, Human
gaaaacaggacuuaaaaugaca

SEQ ID NO: 3390644 - RNA, 18 nt, Human
gaaaacaggcacugcccu

SEQ ID NO: 3390645 - RNA, 19 nt, Human
gaaaacaucuccuuagaaa

SEQ ID NO: 3390646 - RNA, 14 nt, Human
gaaaacaugcuaca

SEQ ID NO: 3390647 - RNA, 19 nt, Human
gaaaacaugcuacacacug

SEQ ID NO: 3390648 - RNA, 16 nt, Human
gaaaacauguuaauga

SEQ ID NO: 3390649 - RNA, 20 nt, Human
gaaaacauguuaaugacaau

SEQ ID NO: 3390650 - RNA, 11 nt, Human
gaaaacauugu

SEQ ID NO: 3390651 - RNA, 18 nt, Human
gaaaaccaaaaugacauc

SEQ ID NO: 3390652 - RNA, 15 nt, Human
gaaaaccagcucagc

SEQ ID NO: 3390653 - RNA, 22 nt, Human
gaaaaccagcuugcgaauaaca

SEQ ID NO: 3390654 - RNA, 13 nt, Human
gaaaacccagaga

SEQ ID NO: 3390655 - RNA, 14 nt, Human
gaaaacccagagag

SEQ ID NO: 3390656 - RNA, 20 nt, Human
gaaaacccccaaaccagaua

SEQ ID NO: 3390657 - RNA, 13 nt, Human
gaaaaccucuccu

SEQ ID NO: 3390658 - RNA, 11 nt, Human
gaaaaccuuuc

SEQ ID NO: 3390659 - RNA, 17 nt, Human
gaaaacgauuuaauuua

SEQ ID NO: 3390660 - RNA, 18 nt, Human
gaaaacgauuuaauuuau

SEQ ID NO: 3390661 - RNA, 22 nt, Human
gaaaacgcucucuacucugcuu

SEQ ID NO: 3390662 - RNA, 19 nt, Human
gaaaacgucuugcuuggga

SEQ ID NO: 3390663 - RNA, 14 nt, Human
gaaaacguggcugc

SEQ ID NO: 3390664 - RNA, 22 nt, Human
gaaaacguggcugcuucaagga

SEQ ID NO: 3390665 - RNA, 15 nt, Human
gaacuggccaagcug

SEQ ID NO: 3390666 - RNA, 18 nt, Human
gaacuggccaagcugagg

SEQ ID NO: 3390667 - RNA, 12 nt, Human
gaacuggguaaa

SEQ ID NO: 3390668 - RNA, 19 nt, Human
gaacuggguaaaugcaaag

SEQ ID NO: 3390669 - RNA, 18 nt, Human
gaacuguccagagagcaa

SEQ ID NO: 3390670 - RNA, 22 nt, Human
gaacuguccagagagcaacucu

SEQ ID NO: 3390671 - RNA, 20 nt, Human
gaacugucggaggaaagaca

SEQ ID NO: 3390672 - RNA, 17 nt, Human
gaacugugccuuugagu

SEQ ID NO: 3390673 - RNA, 20 nt, Human
gaacuguuguauaaauuuau

SEQ ID NO: 3390674 - RNA, 13 nt, Human
gaacuuaaaauga

SEQ ID NO: 3390675 - RNA, 14 nt, Human
gaacuuaaauaaug

SEQ ID NO: 3390676 - RNA, 17 nt, Human
gaacuuaaauaauguga

SEQ ID NO: 3390677 - RNA, 17 nt, Human
gaacuuacauuguucaa

SEQ ID NO: 3390678 - RNA, 19 nt, Human
gaacuucaccugcaaagcu

SEQ ID NO: 3390679 - RNA, 13 nt, Human
gaacuucagaaag

SEQ ID NO: 3390680 - RNA, 17 nt, Human
gaacuucucucagacuu

SEQ ID NO: 3390681 - RNA, 15 nt, Human
gaacuugaaauuuga

SEQ ID NO: 3390682 - RNA, 15 nt, Human
gaacuugaacugauu

SEQ ID NO: 3390683 - RNA, 16 nt, Human
gaacuugaacugauuc

SEQ ID NO: 3390684 - RNA, 15 nt, Human
gaacuugacccugag

SEQ ID NO: 3390685 - RNA, 19 nt, Human
gaacuugagccugucaaga

SEQ ID NO: 3390686 - RNA, 14 nt, Human
gaacuugaggacac

SEQ ID NO: 3390687 - RNA, 18 nt, Human
gaacuugaggacacaugu

SEQ ID NO: 3390688 - RNA, 11 nt, Human
gaacuugccug

SEQ ID NO: 3390689 - RNA, 18 nt, Human
gaacuugcugcugucuug

SEQ ID NO: 3390690 - RNA, 15 nt, Human
gaacuuggaagcaca

SEQ ID NO: 3390691 - RNA, 17 nt, Human
gaacuuggaggcaccau

SEQ ID NO: 3390692 - RNA, 18 nt, Human
gaacuuggcgcugccccu

SEQ ID NO: 3390693 - RNA, 12 nt, Human
gaacuugguucc

SEQ ID NO: 3390694 - RNA, 20 nt, Human
gaacuugugucccuaaugug

SEQ ID NO: 3390695 - RNA, 23 nt, Human
gaacuuucucuucauacuuuuuu

SEQ ID NO: 3390696 - RNA, 23 nt, Human
gaacuuugaccucugcagcaaua

SEQ ID NO: 3390697 - RNA, 19 nt, Human
gaacuuugcugagccugua

SEQ ID NO: 3390698 - RNA, 14 nt, Human
gaacuuuuuguagg

SEQ ID NO: 3390699 - RNA, 15 nt, Human
gaacuuuuuuaaaua

SEQ ID NO: 3390700 - RNA, 20 nt, Human
gaacuuuuuuaaauaaacuu

SEQ ID NO: 3390701 - RNA, 14 nt, Human
gaagaaaaaaaucu

SEQ ID NO: 3390702 - RNA, 21 nt, Human
gaagaaaaaaaucuucuccag

SEQ ID NO: 3390703 - RNA, 14 nt, Human
gaagaaaaagaagc

SEQ ID NO: 3390704 - RNA, 18 nt, Human
gaagaaaacacuguuauc

SEQ ID NO: 3390705 - RNA, 14 nt, Human
gaagaaaacaucua

SEQ ID NO: 3390706 - RNA, 11 nt, Human
gaagaaaagag

SEQ ID NO: 3390707 - RNA, 14 nt, Human
gaagaaaauaauua

SEQ ID NO: 3390708 - RNA, 13 nt, Human
gaagaaaauacuu

SEQ ID NO: 3390709 - RNA, 23 nt, Human
gaagaaaauggaaccaggcuugg

SEQ ID NO: 3390710 - RNA, 16 nt, Human
gaagaaaaugguuuau

SEQ ID NO: 3390711 - RNA, 18 nt, Human
gaagaaaauugcugugcc

SEQ ID NO: 3390712 - RNA, 14 nt, Human
gaagaaacagaaga

SEQ ID NO: 3390713 - RNA, 20 nt, Human
gaagaaacagcuaugagagg

SEQ ID NO: 3390714 - RNA, 19 nt, Human
gaagaaagaacggaagaag

SEQ ID NO: 3390715 - RNA, 20 nt, Human
gaagaaagaacggaagaaga

SEQ ID NO: 3390716 - RNA, 20 nt, Human
gaagaaagaacuaucuucau

SEQ ID NO: 3390717 - RNA, 17 nt, Human
gaagaaagaggugaccc

SEQ ID NO: 3390718 - RNA, 12 nt, Human
gaagaaagaugu

SEQ ID NO: 3390719 - RNA, 12 nt, Human
gaagaaagccug

SEQ ID NO: 3390720 - RNA, 21 nt, Human
gaagaaaggccaucagagcaa

SEQ ID NO: 3390721 - RNA, 21 nt, Human
gaagaaaggguguuuuucugu

SEQ ID NO: 3390722 - RNA, 15 nt, Human
gaagaaaucacagaa

SEQ ID NO: 3390723 - RNA, 16 nt, Human
gaagaaaugaaauuuu

SEQ ID NO: 3390724 - RNA, 18 nt, Human
gaagaaauuauaaagaua

SEQ ID NO: 3390725 - RNA, 22 nt, Human
gaagaaauuauaaagauaaagc

SEQ ID NO: 3390726 - RNA, 22 nt, Human
gaagaaauuccuguagcaucuu

SEQ ID NO: 3390727 - RNA, 18 nt, Human
gaagaacacccucuaaau

SEQ ID NO: 3390728 - RNA, 17 nt, Human
gaagaacauccaaggag

SEQ ID NO: 3390729 - RNA, 22 nt, Human
gaagaacaucuuuaugguaaag

SEQ ID NO: 3390730 - RNA, 13 nt, Human
gaagaacugcagg

SEQ ID NO: 3390731 - RNA, 15 nt, Human
gaagaacugcaggcc

SEQ ID NO: 3390732 - RNA, 16 nt, Human
gaagaacuugcaugga

SEQ ID NO: 3390733 - RNA, 13 nt, Human
gaagaagaaaaaa

SEQ ID NO: 3390734 - RNA, 14 nt, Human
gaagaagaaaaaaa

SEQ ID NO: 3390735 - RNA, 14 nt, Human
gaagaagaagaaaa

SEQ ID NO: 3390736 - RNA, 16 nt, Human
gaagaagagaagcugc

SEQ ID NO: 3390737 - RNA, 22 nt, Human
gaagaagagggagagguggagc

SEQ ID NO: 3390738 - RNA, 13 nt, Human
gaagaagaugcuc

SEQ ID NO: 3390739 - RNA, 18 nt, Human
gaagaagggagaagaaag

SEQ ID NO: 3390740 - RNA, 18 nt, Human
gaagaaggggacaauggc

SEQ ID NO: 3390741 - RNA, 13 nt, Human
gaagaaguguguc

SEQ ID NO: 3390742 - RNA, 19 nt, Human
gaagaauacaaacauauuu

SEQ ID NO: 3390743 - RNA, 23 nt, Human
gaagaauacuucucauuuuuuaa

SEQ ID NO: 3390744 - RNA, 15 nt, Human
gaagaauagggccca

SEQ ID NO: 3390745 - RNA, 17 nt, Human
gaagaauauucaggacu

SEQ ID NO: 3390746 - RNA, 14 nt, Human
gaagaauauuguau

SEQ ID NO: 3390747 - RNA, 14 nt, Human
gaagaaugaacaaa

SEQ ID NO: 3390748 - RNA, 17 nt, Human
gaagaauggagaggaac

SEQ ID NO: 3390749 - RNA, 18 nt, Human
gaagaauggagaggaaca

SEQ ID NO: 3390750 - RNA, 22 nt, Human
gaagaauguuaagacuugacag

SEQ ID NO: 3390751 - RNA, 18 nt, Human
gaagaauugaaaaguuuu

SEQ ID NO: 3390752 - RNA, 22 nt, Human
gaagaauugaaaaguuuuuguu

SEQ ID NO: 3390753 - RNA, 18 nt, Human
gaagaauugaacccagga

SEQ ID NO: 3390754 - RNA, 19 nt, Human
gaagaauugaacccaggag

SEQ ID NO: 3390755 - RNA, 23 nt, Human
gaagaauugaacccaggaggugg

SEQ ID NO: 3390756 - RNA, 12 nt, Human
gaagaauuuaaa

SEQ ID NO: 3390757 - RNA, 13 nt, Human
gaagaauuugaag

SEQ ID NO: 3390758 - RNA, 14 nt, Human
gaagaauuugaaga

SEQ ID NO: 3390759 - RNA, 14 nt, Human
gaagaauuuguuau

SEQ ID NO: 3390760 - RNA, 15 nt, Human
gaagaauuuuaaaaa

SEQ ID NO: 3390761 - RNA, 20 nt, Human
gaagaauuuucagaccccag

SEQ ID NO: 3390762 - RNA, 15 nt, Human
gaagacaaaaagaca

SEQ ID NO: 3390763 - RNA, 14 nt, Human
gaagacaaaaauac

SEQ ID NO: 3390764 - RNA, 20 nt, Human
gaagacaaaaauacucuaau

SEQ ID NO: 3390765 - RNA, 12 nt, Human
gaagacaaacuu

SEQ ID NO: 3390766 - RNA, 23 nt, Human
gaagacaaugugaaaagaaaaau

SEQ ID NO: 3390767 - RNA, 14 nt, Human
gaagacaauugaca

SEQ ID NO: 3390768 - RNA, 19 nt, Human
gaagacaauuugauacaua

SEQ ID NO: 3390769 - RNA, 13 nt, Human
gaaauaguucugu

SEQ ID NO: 3390770 - RNA, 23 nt, Human
gaaauaguucugugacuaggaaa

SEQ ID NO: 3390771 - RNA, 15 nt, Human
gaaauauaaugcaaa

SEQ ID NO: 3390772 - RNA, 21 nt, Human
gaaauauacuuuuacaaguaa

SEQ ID NO: 3390773 - RNA, 18 nt, Human
gaaauauauauacauaug

SEQ ID NO: 3390774 - RNA, 19 nt, Human
gaaauauauauacauaugu

SEQ ID NO: 3390775 - RNA, 23 nt, Human
gaaauauauauguguguguaugu

SEQ ID NO: 3390776 - RNA, 13 nt, Human
gaaauauauauua

SEQ ID NO: 3390777 - RNA, 24 nt, Human
gaaauauauggucuaauguuuaag

SEQ ID NO: 3390778 - RNA, 23 nt, Human
gaaauauauuuuaccauacauuu

SEQ ID NO: 3390779 - RNA, 16 nt, Human
gaaauaucaaagucau

SEQ ID NO: 3390780 - RNA, 20 nt, Human
gaaauaucaguuacucagcc

SEQ ID NO: 3390781 - RNA, 21 nt, Human
gaaauaucaguuacucagccc

SEQ ID NO: 3390782 - RNA, 21 nt, Human
gaaauaucaucacguauguua

SEQ ID NO: 3390783 - RNA, 13 nt, Human
gaaauaucauuua

SEQ ID NO: 3390784 - RNA, 15 nt, Human
gaaauauccugcuug

SEQ ID NO: 3390785 - RNA, 16 nt, Human
gaaauaucugugaaau

SEQ ID NO: 3390786 - RNA, 20 nt, Human
gaaauaucugugaaauauca

SEQ ID NO: 3390787 - RNA, 21 nt, Human
gaaauaugugagauuuuuuau

SEQ ID NO: 3390788 - RNA, 11 nt, Human
gaaauauuaaa

SEQ ID NO: 3390789 - RNA, 13 nt, Human
gaaauauuaugca

SEQ ID NO: 3390790 - RNA, 16 nt, Human
gaaauauuauguuaaa

SEQ ID NO: 3390791 - RNA, 15 nt, Human
gaaauauuuagcaaa

SEQ ID NO: 3390792 - RNA, 15 nt, Human
gaaauauuuauuuua

SEQ ID NO: 3390793 - RNA, 16 nt, Human
gaaauauuuauuuuaa

SEQ ID NO: 3390794 - RNA, 19 nt, Human
gaaauauuuauuuuuuuaa

SEQ ID NO: 3390795 - RNA, 19 nt, Human
gaaauauuugugacaaaaa

SEQ ID NO: 3390796 - RNA, 20 nt, Human
gaaauauuuuaaaaucagcu

SEQ ID NO: 3390797 - RNA, 22 nt, Human
gaaauauuuugauaauaaauug

SEQ ID NO: 3390798 - RNA, 19 nt, Human
gaaaucaaagagagaaaau

SEQ ID NO: 3390799 - RNA, 14 nt, Human
gaaaucaaagugcu

SEQ ID NO: 3390800 - RNA, 19 nt, Human
gaaaucaaauaugcaaagc

SEQ ID NO: 3390801 - RNA, 23 nt, Human
gaaaucaaauaugcaaagcacug

SEQ ID NO: 3390802 - RNA, 23 nt, Human
gaaaucaauaauuuguggugauu

SEQ ID NO: 3390803 - RNA, 19 nt, Human
gaaaucaauaguugaauua

SEQ ID NO: 3390804 - RNA, 17 nt, Human
gaaaucaccgaaaacgu

SEQ ID NO: 3390805 - RNA, 14 nt, Human
gaaaucagccaagu

SEQ ID NO: 3390806 - RNA, 21 nt, Human
gaaaucaucggagucagccag

SEQ ID NO: 3390807 - RNA, 17 nt, Human
gaaaucauguccauaca

SEQ ID NO: 3390808 - RNA, 11 nt, Human
gaaaucauguu

SEQ ID NO: 3390809 - RNA, 15 nt, Human
gaaaucccugcucac

SEQ ID NO: 3390810 - RNA, 24 nt, Human
cuagagugacucacuaauucauua

SEQ ID NO: 3390811 - RNA, 18 nt, Human
cuagaguuuagcuggaaa

SEQ ID NO: 3390812 - RNA, 14 nt, Human
cuagauacaauaaa

SEQ ID NO: 3390813 - RNA, 15 nt, Human
cuagauacaauaaau

SEQ ID NO: 3390814 - RNA, 17 nt, Human
cuagauaccuaaaacau

SEQ ID NO: 3390815 - RNA, 15 nt, Human
cuagauacucuuauu

SEQ ID NO: 3390816 - RNA, 13 nt, Human
cuagauacuguau

SEQ ID NO: 3390817 - RNA, 12 nt, Human
cuagauaguuua

SEQ ID NO: 3390818 - RNA, 14 nt, Human
cuagauaucgacuu

SEQ ID NO: 3390819 - RNA, 21 nt, Human
cuagauaucgacuuguuuuug

SEQ ID NO: 3390820 - RNA, 17 nt, Human
cuagaucauaaggcuuc

SEQ ID NO: 3390821 - RNA, 18 nt, Human
cuagauccacacacagag

SEQ ID NO: 3390822 - RNA, 21 nt, Human
cuagauccacacacagaggaa

SEQ ID NO: 3390823 - RNA, 12 nt, Human
cuagaugaccuc

SEQ ID NO: 3390824 - RNA, 21 nt, Human
cuagaugagaauucagcugcc

SEQ ID NO: 3390825 - RNA, 22 nt, Human
cuagaugauuaaauaagauucu

SEQ ID NO: 3390826 - RNA, 20 nt, Human
cuagaugggcaugggguggg

SEQ ID NO: 3390827 - RNA, 13 nt, Human
cuagauggugcug

SEQ ID NO: 3390828 - RNA, 14 nt, Human
cuagauggugcuga

SEQ ID NO: 3390829 - RNA, 16 nt, Human
cuagauggugcugaga

SEQ ID NO: 3390830 - RNA, 14 nt, Human
cuagauguaaauuu

SEQ ID NO: 3390831 - RNA, 22 nt, Human
cuagauguuuauucuucuagag

SEQ ID NO: 3390832 - RNA, 23 nt, Human
cuagauguuuauucuucuagagu

SEQ ID NO: 3390833 - RNA, 13 nt, Human
cuagauuaccaug

SEQ ID NO: 3390834 - RNA, 14 nt, Human
cuagauucaaaggu

SEQ ID NO: 3390835 - RNA, 16 nt, Human
cuagauucaaagguuc

SEQ ID NO: 3390836 - RNA, 18 nt, Human
cuagauucaaagguucua

SEQ ID NO: 3390837 - RNA, 21 nt, Human
cuagauucaaagguucuaggu

SEQ ID NO: 3390838 - RNA, 14 nt, Human
cuagauucagggaa

SEQ ID NO: 3390839 - RNA, 21 nt, Human
cuagauugcuaaggagcugau

SEQ ID NO: 3390840 - RNA, 13 nt, Human
cuagauuuaugaa

SEQ ID NO: 3390841 - RNA, 13 nt, Human
cuagauuuucacu

SEQ ID NO: 3390842 - RNA, 13 nt, Human
cuagauuuuguuu

SEQ ID NO: 3390843 - RNA, 17 nt, Human
cuagauuuuguuuugcu

SEQ ID NO: 3390844 - RNA, 19 nt, Human
cuagcaaaagaaguaacaa

SEQ ID NO: 3390845 - RNA, 19 nt, Human
cuagcaaaauaaaacauag

SEQ ID NO: 3390846 - RNA, 15 nt, Human
cuagcacagcagcuu

SEQ ID NO: 3390847 - RNA, 14 nt, Human
cuagcacagcuccc

SEQ ID NO: 3390848 - RNA, 15 nt, Human
cuagcacaugcuuca

SEQ ID NO: 3390849 - RNA, 18 nt, Human
cuagcacaugcuucaaua

SEQ ID NO: 3390850 - RNA, 16 nt, Human
cuagcacucacaugcu

SEQ ID NO: 3390851 - RNA, 21 nt, Human
cuagcacucacaugcuggaca

SEQ ID NO: 3390852 - RNA, 13 nt, Human
cuagcacuuccuu

SEQ ID NO: 3390853 - RNA, 14 nt, Human
cuagcacuuccuug

SEQ ID NO: 3390854 - RNA, 17 nt, Human
cuagcagaaaucuagaa

SEQ ID NO: 3390855 - RNA, 23 nt, Human
cuagcagcagggagggcuucugc

SEQ ID NO: 3390856 - RNA, 17 nt, Human
cuagcaguaaaagauga

SEQ ID NO: 3390857 - RNA, 15 nt, Human
cuagcaguggcaggc

SEQ ID NO: 3390858 - RNA, 20 nt, Human
cuagcaguggcaggcagagg

SEQ ID NO: 3390859 - RNA, 21 nt, Human
cuagcaguggcaggcagaggc

SEQ ID NO: 3390860 - RNA, 19 nt, Human
cuagcauacguacacauuu

SEQ ID NO: 3390861 - RNA, 21 nt, Human
cuagcauacguacacauuuua

SEQ ID NO: 3390862 - RNA, 15 nt, Human
cuagcauauaugugu

SEQ ID NO: 3390863 - RNA, 14 nt, Human
cuagcauaucugcc

SEQ ID NO: 3390864 - RNA, 13 nt, Human
cuagcaucccuga

SEQ ID NO: 3390865 - RNA, 15 nt, Human
cuagcaugccaacaa

SEQ ID NO: 3390866 - RNA, 22 nt, Human
cuagcauuguaaaauuauuuca

SEQ ID NO: 3390867 - RNA, 17 nt, Human
cuagccaaaccucacca

SEQ ID NO: 3390868 - RNA, 21 nt, Human
cuagccaaaccucaccaacuc

SEQ ID NO: 3390869 - RNA, 15 nt, Human
cuagccaccaacucu

SEQ ID NO: 3390870 - RNA, 22 nt, Human
cuagccagacacucugcucugc

SEQ ID NO: 3390871 - RNA, 23 nt, Human
cuagccagacacucugcucugcc

SEQ ID NO: 3390872 - RNA, 12 nt, Human
cuagccagagga

SEQ ID NO: 3390873 - RNA, 13 nt, Human
cuagccagaggag

SEQ ID NO: 3390874 - RNA, 17 nt, Human
cuagccagaggagagag

SEQ ID NO: 3390875 - RNA, 20 nt, Human
cuagccagcacuuguauaua

SEQ ID NO: 3390876 - RNA, 20 nt, Human
cuagccauuccugguaccca

SEQ ID NO: 3390877 - RNA, 21 nt, Human
cuagccauuccugguacccag

SEQ ID NO: 3390878 - RNA, 13 nt, Human
cuagcccaggaga

SEQ ID NO: 3390879 - RNA, 17 nt, Human
cuagcccaggagagaga

SEQ ID NO: 3390880 - RNA, 23 nt, Human
cuagcccaggagagagaaagcca

SEQ ID NO: 3390881 - RNA, 17 nt, Human
cuagcccuccuuuuucc

SEQ ID NO: 3390882 - RNA, 18 nt, Human
cuagcccucucacauuua

SEQ ID NO: 3390883 - RNA, 13 nt, Human
cuagccgaccuca

SEQ ID NO: 3390884 - RNA, 15 nt, Human
cuagccgaccucagc

SEQ ID NO: 3390885 - RNA, 17 nt, Human
cuagccgaccucagccu

SEQ ID NO: 3390886 - RNA, 15 nt, Human
cuagccgguuccugu

SEQ ID NO: 3390887 - RNA, 22 nt, Human
cuagccuauuuaccugcaggcu

SEQ ID NO: 3390888 - RNA, 23 nt, Human
cuagccuauuuaccugcaggcug

SEQ ID NO: 3390889 - RNA, 13 nt, Human
cuagccucacgcu

SEQ ID NO: 3390890 - RNA, 20 nt, Human
cuagccucaggggucugagc

SEQ ID NO: 3390891 - RNA, 15 nt, Human
cuagccugcacuuug

SEQ ID NO: 3390892 - RNA, 19 nt, Human
cuagccugcacuuugaugu

SEQ ID NO: 3390893 - RNA, 19 nt, Human
cuagccugcauugagcuug

SEQ ID NO: 3390894 - RNA, 22 nt, Human
cuagccugugccucugggacug

SEQ ID NO: 3390895 - RNA, 22 nt, Human
cuagccuuaaucagguccucag

SEQ ID NO: 3390896 - RNA, 23 nt, Human
cuagccuuagaagucacacagua

SEQ ID NO: 3390897 - RNA, 17 nt, Human
cuagccuuauccucuga

SEQ ID NO: 3390898 - RNA, 21 nt, Human
cuagccuuauccucugaucuc

SEQ ID NO: 3390899 - RNA, 13 nt, Human
cuagccuugcuug

SEQ ID NO: 3390900 - RNA, 22 nt, Human
cuagccuuggccucuuuccuca

SEQ ID NO: 3390901 - RNA, 18 nt, Human
cuagcgaucucuccuggc

SEQ ID NO: 3390902 - RNA, 22 nt, Human
cuagcgcaguuuuuuuuuucuu

SEQ ID NO: 3390903 - RNA, 20 nt, Human
cuagcgcuaucucccugccu

SEQ ID NO: 3390904 - RNA, 16 nt, Human
cuagcguagugcagca

SEQ ID NO: 3390905 - RNA, 20 nt, Human
cuagcguagugcagcagggc

SEQ ID NO: 3390906 - RNA, 17 nt, Human
cuagcuagaaauaugau

SEQ ID NO: 3390907 - RNA, 12 nt, Human
cuagcuagcuca

SEQ ID NO: 3390908 - RNA, 18 nt, Human
cuagcuaugcuguaucug

SEQ ID NO: 3390909 - RNA, 15 nt, Human
cuagcuaugugaccu

SEQ ID NO: 3390910 - RNA, 22 nt, Human
cuagcuccacacccucucccag

SEQ ID NO: 3390911 - RNA, 14 nt, Human
cuagcucgugauug

SEQ ID NO: 3390912 - RNA, 21 nt, Human
cuagcucucuaggccucucca

SEQ ID NO: 3390913 - RNA, 20 nt, Human
cuagcucugagccaguucag

SEQ ID NO: 3390914 - RNA, 21 nt, Human
cuagcucuuguugagccgugg

SEQ ID NO: 3390915 - RNA, 18 nt, Human
cuagcugaauguuuuucu

SEQ ID NO: 3390916 - RNA, 21 nt, Human
cuagcugccuagcaagcuggc

SEQ ID NO: 3390917 - RNA, 16 nt, Human
cuagcugcuacaaaga

SEQ ID NO: 3390918 - RNA, 18 nt, Human
cuagcugcuacaaagaag

SEQ ID NO: 3390919 - RNA, 21 nt, Human
cuagcuggaauuuuuuauucu

SEQ ID NO: 3390920 - RNA, 24 nt, Human
cuagcuggaauuuuuuauucuugu

SEQ ID NO: 3390921 - RNA, 21 nt, Human
cuagcuggagaggagcccugc

SEQ ID NO: 3390922 - RNA, 13 nt, Human
cuagcuggagccu

SEQ ID NO: 3390923 - RNA, 14 nt, Human
gaagacaccagagc

SEQ ID NO: 3390924 - RNA, 17 nt, Human
gaagacaccagagcaga

SEQ ID NO: 3390925 - RNA, 23 nt, Human
gaagacaccagagcagaugcaga

SEQ ID NO: 3390926 - RNA, 16 nt, Human
gaagacagaaccacag

SEQ ID NO: 3390927 - RNA, 18 nt, Human
gaagacagaaccacaggg

SEQ ID NO: 3390928 - RNA, 21 nt, Human
gaagacagagaccuccugccu

SEQ ID NO: 3390929 - RNA, 15 nt, Human
gaagacaguggcccc

SEQ ID NO: 3390930 - RNA, 15 nt, Human
gaagacauggagacu

SEQ ID NO: 3390931 - RNA, 21 nt, Human
gaagacauggagacuccugcc

SEQ ID NO: 3390932 - RNA, 17 nt, Human
gaagacauuucuuuucu

SEQ ID NO: 3390933 - RNA, 23 nt, Human
gaagacauuucuuuucuuuuuac

SEQ ID NO: 3390934 - RNA, 14 nt, Human
gaagaccacaucca

SEQ ID NO: 3390935 - RNA, 21 nt, Human
gaagaccacauccacacacgc

SEQ ID NO: 3390936 - RNA, 14 nt, Human
gaagaccccaccca

SEQ ID NO: 3390937 - RNA, 15 nt, Human
gaagaccccacccaa

SEQ ID NO: 3390938 - RNA, 16 nt, Human
gaagaccccacccaag

SEQ ID NO: 3390939 - RNA, 22 nt, Human
gaagaccguuuaccuagaagaa

SEQ ID NO: 3390940 - RNA, 23 nt, Human
gaagaccuaaccagggccagaag

SEQ ID NO: 3390941 - RNA, 14 nt, Human
gaagaccugagaau

SEQ ID NO: 3390942 - RNA, 21 nt, Human
gaagaccuuuuucugcacuau

SEQ ID NO: 3390943 - RNA, 15 nt, Human
gaagacuccuagcug

SEQ ID NO: 3390944 - RNA, 13 nt, Human
gaagacucuacca

SEQ ID NO: 3390945 - RNA, 15 nt, Human
gaagacuggaagcua

SEQ ID NO: 3390946 - RNA, 20 nt, Human
gaagacugucagcuuccaaa

SEQ ID NO: 3390947 - RNA, 21 nt, Human
gaagacuuacagcaaauccuu

SEQ ID NO: 3390948 - RNA, 15 nt, Human
gaagacuucaucccu

SEQ ID NO: 3390949 - RNA, 15 nt, Human
gaagacuucccagcu

SEQ ID NO: 3390950 - RNA, 11 nt, Human
gaagacuuugg

SEQ ID NO: 3390951 - RNA, 13 nt, Human
gaagacuuuggaa

SEQ ID NO: 3390952 - RNA, 15 nt, Human
gaagagagagcugag

SEQ ID NO: 3390953 - RNA, 18 nt, Human
gaagagagauauaucuga

SEQ ID NO: 3390954 - RNA, 19 nt, Human
gaacagaaaacaacaaaaa

SEQ ID NO: 3390955 - RNA, 12 nt, Human
gaacagaaggau

SEQ ID NO: 3390956 - RNA, 12 nt, Human
gaacagaauguu

SEQ ID NO: 3390957 - RNA, 14 nt, Human
gaacagaauguuuu

SEQ ID NO: 3390958 - RNA, 17 nt, Human
gaacagacaacagaagu

SEQ ID NO: 3390959 - RNA, 18 nt, Human
gaacagacaacagaaguc

SEQ ID NO: 3390960 - RNA, 16 nt, Human
gaacagacuggaagca

SEQ ID NO: 3390961 - RNA, 20 nt, Human
gaacagacuggaagcacagc

SEQ ID NO: 3390962 - RNA, 20 nt, Human
gaacagagagacccuugugg

SEQ ID NO: 3390963 - RNA, 18 nt, Human
gaacagaucuccaaagcu

SEQ ID NO: 3390964 - RNA, 22 nt, Human
gaacagaucuuuuacuuuggcc

SEQ ID NO: 3390965 - RNA, 21 nt, Human
gaacagauguuucuuuuguau

SEQ ID NO: 3390966 - RNA, 17 nt, Human
gaacagauucacacugu

SEQ ID NO: 3390967 - RNA, 20 nt, Human
gaacagcauggcacucccuc

SEQ ID NO: 3390968 - RNA, 22 nt, Human
gaacagccaaaugcauggugca

SEQ ID NO: 3390969 - RNA, 23 nt, Human
gaacagccaaaugcauggugcag

SEQ ID NO: 3390970 - RNA, 21 nt, Human
gaacagcggcuggacuuggag

SEQ ID NO: 3390971 - RNA, 22 nt, Human
gaacagcuaugggagccccagg

SEQ ID NO: 3390972 - RNA, 23 nt, Human
gaacagcuaugggagccccaggg

SEQ ID NO: 3390973 - RNA, 22 nt, Human
gaacagcugguguagcuacaga

SEQ ID NO: 3390974 - RNA, 23 nt, Human
gaacagcugguguagcuacagag

SEQ ID NO: 3390975 - RNA, 24 nt, Human
gaacagcugguguagcuacagaga

SEQ ID NO: 3390976 - RNA, 15 nt, Human
gaacagcuucagguu

SEQ ID NO: 3390977 - RNA, 19 nt, Human
gaacaggcaagugaagaaa

SEQ ID NO: 3390978 - RNA, 16 nt, Human
gaacagguucacguga

SEQ ID NO: 3390979 - RNA, 21 nt, Human
gaacagguuuuuuuguuuguu

SEQ ID NO: 3390980 - RNA, 14 nt, Human
gaacaguaacugcc

SEQ ID NO: 3390981 - RNA, 18 nt, Human
gaacagugaggugcccag

SEQ ID NO: 3390982 - RNA, 16 nt, Human
gaacagugauuaccag

SEQ ID NO: 3390983 - RNA, 18 nt, Human
gaacagugcaccugggac

SEQ ID NO: 3390984 - RNA, 17 nt, Human
gaacagugugcaaggca

SEQ ID NO: 3390985 - RNA, 21 nt, Human
gaacagugugcaaggcagccg

SEQ ID NO: 3390986 - RNA, 24 nt, Human
gaacagugugcaaggcagccgugg

SEQ ID NO: 3390987 - RNA, 21 nt, Human
gaacaguguggccucuucuga

SEQ ID NO: 3390988 - RNA, 16 nt, Human
gaacaguguuucccau

SEQ ID NO: 3390989 - RNA, 20 nt, Human
gaacaguuguguuugaagca

SEQ ID NO: 3390990 - RNA, 15 nt, Human
gaacauaaaauacaa

SEQ ID NO: 3390991 - RNA, 14 nt, Human
gaacauaauucuua

SEQ ID NO: 3390992 - RNA, 15 nt, Human
gaacauacaaaugca

SEQ ID NO: 3390993 - RNA, 16 nt, Human
gaacauacuguucacu

SEQ ID NO: 3390994 - RNA, 13 nt, Human
gaacauacuucag

SEQ ID NO: 3390995 - RNA, 18 nt, Human
gaacauagacuagagaaa

SEQ ID NO: 3390996 - RNA, 21 nt, Human
gaacauagacuagagaaaccg

SEQ ID NO: 3390997 - RNA, 18 nt, Human
gaacauauuguugaaagg

SEQ ID NO: 3390998 - RNA, 19 nt, Human
gaacauccaaaaucuugau

SEQ ID NO: 3390999 - RNA, 17 nt, Human
gaacauccaaccuuccc

SEQ ID NO: 3391000 - RNA, 15 nt, Human
gaacaucccugccag

SEQ ID NO: 3391001 - RNA, 19 nt, Human
gaacauccuuugcagggca

SEQ ID NO: 3391002 - RNA, 22 nt, Human
gaacauccuuugcagggcagcc

SEQ ID NO: 3391003 - RNA, 21 nt, Human
gaacaucugaguccuggauga

SEQ ID NO: 3391004 - RNA, 22 nt, Human
gaacaucuuugacacucugcag

SEQ ID NO: 3391005 - RNA, 23 nt, Human
gaacaugaaaacagaaaacgguu

SEQ ID NO: 3391006 - RNA, 20 nt, Human
gaacaugcaguuugaaauuc

SEQ ID NO: 3391007 - RNA, 22 nt, Human
gaacaugcaguuugaaauucug

SEQ ID NO: 3391008 - RNA, 23 nt, Human
gaacaugcaguuugaaauucuga

SEQ ID NO: 3391009 - RNA, 13 nt, Human
gaacaugcccccu

SEQ ID NO: 3391010 - RNA, 17 nt, Human
gaacauggacuuguaua

SEQ ID NO: 3391011 - RNA, 19 nt, Human
gaacauggccuaagggcca

SEQ ID NO: 3391012 - RNA, 16 nt, Human
gaacauugauugcugu

SEQ ID NO: 3391013 - RNA, 15 nt, Human
gaacauugguucuuu

SEQ ID NO: 3391014 - RNA, 15 nt, Human
gaaccaaaacauucc

SEQ ID NO: 3391015 - RNA, 16 nt, Human
gaaccaaaacauuccg

SEQ ID NO: 3391016 - RNA, 21 nt, Human
gaaccaaacccacccuuucua

SEQ ID NO: 3391017 - RNA, 22 nt, Human
gaaccaaacccacccuuucuac

SEQ ID NO: 3391018 - RNA, 17 nt, Human
gaaccaaaucuggaagc

SEQ ID NO: 3391019 - RNA, 16 nt, Human
gaaccaagcuauuccu

SEQ ID NO: 3391020 - RNA, 24 nt, Human
gaaccaaguggaccuugagaccac

SEQ ID NO: 3391021 - RNA, 18 nt, Human
gaaccacaucuugcucug

SEQ ID NO: 3391022 - RNA, 21 nt, Human
gaaccaccugccuauauuuuu

SEQ ID NO: 3391023 - RNA, 15 nt, Human
gaaccacuuucuuau

SEQ ID NO: 3391024 - RNA, 13 nt, Human
gaaccaggagcug

SEQ ID NO: 3391025 - RNA, 21 nt, Human
gaaccauaguuacuguaaaau

SEQ ID NO: 3391026 - RNA, 12 nt, Human
gaaccaucagaa

SEQ ID NO: 3391027 - RNA, 20 nt, Human
gaaccaucauuauaaacgug

SEQ ID NO: 3391028 - RNA, 18 nt, Human
gaaccauggugaagugcu

SEQ ID NO: 3391029 - RNA, 21 nt, Human
gaaccaugucagcaaaaagca

SEQ ID NO: 3391030 - RNA, 23 nt, Human
gaaccaugucagcaaaaagcaaa

SEQ ID NO: 3391031 - RNA, 13 nt, Human
gaacccaaaccca

SEQ ID NO: 3391032 - RNA, 14 nt, Human
gaacccaccugcug

SEQ ID NO: 3391033 - RNA, 19 nt, Human
gaacccaccugcugagaga

SEQ ID NO: 3391034 - RNA, 19 nt, Human
gaacccagacucagacauu

SEQ ID NO: 3391035 - RNA, 12 nt, Human
gaacccaggaca

SEQ ID NO: 3391036 - RNA, 16 nt, Human
gaacccaggacaagca

SEQ ID NO: 3391037 - RNA, 17 nt, Human
gaacccagggcucugcc

SEQ ID NO: 3391038 - RNA, 18 nt, Human
gaacccagggcucugccc

SEQ ID NO: 3391039 - RNA, 20 nt, Human
gaacccagggcucugcccca

SEQ ID NO: 3391040 - RNA, 17 nt, Human
gaaccccaaggagggag

SEQ ID NO: 3391041 - RNA, 14 nt, Human
gaaccccccuccca

SEQ ID NO: 3391042 - RNA, 20 nt, Human
gaacccuaaauaauaaaaau

SEQ ID NO: 3391043 - RNA, 19 nt, Human
gaacccucuguuccuuccc

SEQ ID NO: 3391044 - RNA, 14 nt, Human
gaacccugccaugg

SEQ ID NO: 3391045 - RNA, 23 nt, Human
gaacccuggugaggaagcuccag

SEQ ID NO: 3391046 - RNA, 14 nt, Human
gaacccugugcugg

SEQ ID NO: 3391047 - RNA, 17 nt, Human
gaacccugugcuggugu

SEQ ID NO: 3391048 - RNA, 12 nt, Human
gaacccuuuguu

SEQ ID NO: 3391049 - RNA, 18 nt, Human
gaacccuuuuaaaguuga

SEQ ID NO: 3391050 - RNA, 21 nt, Human
gaaccgagcaaagaucaaaau

SEQ ID NO: 3391051 - RNA, 23 nt, Human
gaaccgagcaaagaucaaaauaa

SEQ ID NO: 3391052 - RNA, 18 nt, Human
gaaccgaggggcucagga

SEQ ID NO: 3391053 - RNA, 21 nt, Human
gaaccgaggggcucaggaaaa

SEQ ID NO: 3391054 - RNA, 20 nt, Human
gaaccgcagaagccucccca

SEQ ID NO: 3391055 - RNA, 13 nt, Human
gaaccgcaggaag

SEQ ID NO: 3391056 - RNA, 22 nt, Human
gaaccgcucaccuagagccaga

SEQ ID NO: 3391057 - RNA, 15 nt, Human
gaaccgcugaauaug

SEQ ID NO: 3391058 - RNA, 19 nt, Human
gaaccgugguaugucugcc

SEQ ID NO: 3391059 - RNA, 18 nt, Human
gaaccguuuugaagcuac

SEQ ID NO: 3391060 - RNA, 19 nt, Human
gaaccguuuugaagcuacu

SEQ ID NO: 3391061 - RNA, 12 nt, Human
gaaccuaacugu

SEQ ID NO: 3391062 - RNA, 14 nt, Human
gaaccuaauacccu

SEQ ID NO: 3391063 - RNA, 19 nt, Human
gaaccuaauucaauucaaa

SEQ ID NO: 3391064 - RNA, 18 nt, Human
gaaccuacaguuuuaacu

SEQ ID NO: 3391065 - RNA, 19 nt, Human
gaaccuacaguuuuaacug

SEQ ID NO: 3391066 - RNA, 21 nt, Human
gaaccuacaguuuuaacugug

SEQ ID NO: 3391067 - RNA, 15 nt, Human
gaaccuaccuucauu

SEQ ID NO: 3391068 - RNA, 17 nt, Human
gaaccuauuucucuuuc

SEQ ID NO: 3391069 - RNA, 17 nt, Human
gaaccucacgcaccucc

SEQ ID NO: 3391070 - RNA, 20 nt, Human
gaaccucacgcaccucccau

SEQ ID NO: 3391071 - RNA, 11 nt, Human
gaaccucacuc

SEQ ID NO: 3391072 - RNA, 16 nt, Human
gaaccucacucuugcc

SEQ ID NO: 3391073 - RNA, 20 nt, Human
gaaccucacucuugccaacc

SEQ ID NO: 3391074 - RNA, 21 nt, Human
gaaccucacucuugccaaccu

SEQ ID NO: 3391075 - RNA, 12 nt, Human
gaaccucagccu

SEQ ID NO: 3391076 - RNA, 14 nt, Human
cuagcuggcucugu

SEQ ID NO: 3391077 - RNA, 12 nt, Human
cuagcugggggu

SEQ ID NO: 3391078 - RNA, 18 nt, Human
cuagcugggggugggcca

SEQ ID NO: 3391079 - RNA, 17 nt, Human
cuagcuggugguuucac

SEQ ID NO: 3391080 - RNA, 14 nt, Human
cuagcugugcaaga

SEQ ID NO: 3391081 - RNA, 12 nt, Human
cuagcugugugc

SEQ ID NO: 3391082 - RNA, 18 nt, Human
cuagcuguugagcuguuu

SEQ ID NO: 3391083 - RNA, 15 nt, Human
cuagcuuagagccuc

SEQ ID NO: 3391084 - RNA, 19 nt, Human
cuagcuuagagccucccuc

SEQ ID NO: 3391085 - RNA, 20 nt, Human
cuagcuuagagccucccuca

SEQ ID NO: 3391086 - RNA, 22 nt, Human
cuagcuucugcuuuucugcccu

SEQ ID NO: 3391087 - RNA, 23 nt, Human
cuagcuucugcuuuucugcccug

SEQ ID NO: 3391088 - RNA, 15 nt, Human
cuagcuuuagacccu

SEQ ID NO: 3391089 - RNA, 18 nt, Human
cuagcuuuagacccuggg

SEQ ID NO: 3391090 - RNA, 23 nt, Human
cuagcuuuauauauggacauggc

SEQ ID NO: 3391091 - RNA, 15 nt, Human
cuaggaaaauaaaac

SEQ ID NO: 3391092 - RNA, 17 nt, Human
cuaggaaaauauuuuga

SEQ ID NO: 3391093 - RNA, 14 nt, Human
cuaggaaauauuua

SEQ ID NO: 3391094 - RNA, 15 nt, Human
cuaggaaauauuuau

SEQ ID NO: 3391095 - RNA, 16 nt, Human
cuaggaaauccagggu

SEQ ID NO: 3391096 - RNA, 13 nt, Human
cuaggaacacucc

SEQ ID NO: 3391097 - RNA, 23 nt, Human
gaaccugggaaagagauuuaaac

SEQ ID NO: 3391098 - RNA, 17 nt, Human
gaaccugugaguaaaua

SEQ ID NO: 3391099 - RNA, 12 nt, Human
gaaccugugucc

SEQ ID NO: 3391100 - RNA, 19 nt, Human
gaaccuuccuuccugcuug

SEQ ID NO: 3391101 - RNA, 14 nt, Human
gaaccuugcugucc

SEQ ID NO: 3391102 - RNA, 17 nt, Human
gaaccuugcuguccuga

SEQ ID NO: 3391103 - RNA, 13 nt, Human
gaaccuuggccug

SEQ ID NO: 3391104 - RNA, 17 nt, Human
gaaccuugugccuggcu

SEQ ID NO: 3391105 - RNA, 19 nt, Human
gaaccuuugugcccuauca

SEQ ID NO: 3391106 - RNA, 20 nt, Human
gaaccuuugugcccuaucac

SEQ ID NO: 3391107 - RNA, 18 nt, Human
gaacgauauguagcagaa

SEQ ID NO: 3391108 - RNA, 16 nt, Human
gaacgauccuucaaag

SEQ ID NO: 3391109 - RNA, 17 nt, Human
gaacgcagcccuagagc

SEQ ID NO: 3391110 - RNA, 12 nt, Human
gaacgcccacuu

SEQ ID NO: 3391111 - RNA, 18 nt, Human
gaacgcccccccccaccc

SEQ ID NO: 3391112 - RNA, 19 nt, Human
gaacgcccccccccacccc

SEQ ID NO: 3391113 - RNA, 20 nt, Human
gaacgcccccccccaccccu

SEQ ID NO: 3391114 - RNA, 14 nt, Human
gaacggggagaaaa

SEQ ID NO: 3391115 - RNA, 15 nt, Human
gaacgguaaauuucu

SEQ ID NO: 3391116 - RNA, 22 nt, Human
gaacgugauuagugaaaggaag

SEQ ID NO: 3391117 - RNA, 23 nt, Human
gaacguuuagcugacaaaauacu

SEQ ID NO: 3391118 - RNA, 15 nt, Human
gaacguuuucuaauu

SEQ ID NO: 3391119 - RNA, 20 nt, Human
gaacguuuucuaauugcuua

SEQ ID NO: 3391120 - RNA, 22 nt, Human
gaacuaaacuaguuuuuccuau

SEQ ID NO: 3391121 - RNA, 18 nt, Human
gaacuaagaaacuuuugu

SEQ ID NO: 3391122 - RNA, 22 nt, Human
gaacuaagaaacuuuuguaaag

SEQ ID NO: 3391123 - RNA, 23 nt, Human
gaacuaagaaacuuuuguaaaga

SEQ ID NO: 3391124 - RNA, 23 nt, Human
gaacuacaaacaaaauuucuauu

SEQ ID NO: 3391125 - RNA, 14 nt, Human
gaacuacugaggau

SEQ ID NO: 3391126 - RNA, 16 nt, Human
gaacuagagaugugca

SEQ ID NO: 3391127 - RNA, 18 nt, Human
gaacuagagguuuuauga

SEQ ID NO: 3391128 - RNA, 18 nt, Human
gaacuagccaaaccagga

SEQ ID NO: 3391129 - RNA, 13 nt, Human
gaacuagcuggaa

SEQ ID NO: 3391130 - RNA, 20 nt, Human
gaacuaggaaggcacuucug

SEQ ID NO: 3391131 - RNA, 15 nt, Human
gaacuaggcugagca

SEQ ID NO: 3391132 - RNA, 15 nt, Human
gaacuauaaagaagu

SEQ ID NO: 3391133 - RNA, 19 nt, Human
gaacuauaacaccugccac

SEQ ID NO: 3391134 - RNA, 12 nt, Human
gaacuaucuuca

SEQ ID NO: 3391135 - RNA, 16 nt, Human
gaacuaucuucaucug

SEQ ID NO: 3391136 - RNA, 15 nt, Human
gaacuaugaacuaca

SEQ ID NO: 3391137 - RNA, 17 nt, Human
gaacuauggacggugcu

SEQ ID NO: 3391138 - RNA, 13 nt, Human
gaacuauuagagc

SEQ ID NO: 3391139 - RNA, 20 nt, Human
gaacuauuccccagcagggu

SEQ ID NO: 3391140 - RNA, 15 nt, Human
gaacuauuggagggu

SEQ ID NO: 3391141 - RNA, 22 nt, Human
gaacuauuuucaaagacuuaag

SEQ ID NO: 3391142 - RNA, 19 nt, Human
gaacucaaauggggccaga

SEQ ID NO: 3391143 - RNA, 23 nt, Human
gaacucaaauggggccagaucca

SEQ ID NO: 3391144 - RNA, 16 nt, Human
gaacucaccuggggcu

SEQ ID NO: 3391145 - RNA, 15 nt, Human
gaacucacucugggc

SEQ ID NO: 3391146 - RNA, 14 nt, Human
gaacucacuggggc

SEQ ID NO: 3391147 - RNA, 13 nt, Human
gaacucagaucca

SEQ ID NO: 3391148 - RNA, 15 nt, Human
gaacucagauccagg

SEQ ID NO: 3391149 - RNA, 16 nt, Human
gaacucagauccaggg

SEQ ID NO: 3391150 - RNA, 19 nt, Human
gaacucagauccagggaca

SEQ ID NO: 3391151 - RNA, 18 nt, Human
gaacucagaucugucuga

SEQ ID NO: 3391152 - RNA, 14 nt, Human
gaacucagccaagc

SEQ ID NO: 3391153 - RNA, 16 nt, Human
gaacucagccaagcac

SEQ ID NO: 3391154 - RNA, 16 nt, Human
gaacucaucacugugg

SEQ ID NO: 3391155 - RNA, 17 nt, Human
gaacucaucacuguggc

SEQ ID NO: 3391156 - RNA, 21 nt, Human
gaacucaucuagguaaauuac

SEQ ID NO: 3391157 - RNA, 22 nt, Human
gaacucaucuagguaaauuaca

SEQ ID NO: 3391158 - RNA, 13 nt, Human
gaacucauuccug

SEQ ID NO: 3391159 - RNA, 17 nt, Human
gaacuccaggcccuccu

SEQ ID NO: 3391160 - RNA, 23 nt, Human
gaacuccaggcccuccucuccca

SEQ ID NO: 3391161 - RNA, 20 nt, Human
gaacucccaagaacagcagg

SEQ ID NO: 3391162 - RNA, 21 nt, Human
gaacucccaagaacagcaggc

SEQ ID NO: 3391163 - RNA, 19 nt, Human
gaacucccagcaacacaag

SEQ ID NO: 3391164 - RNA, 15 nt, Human
gaacuccugaccuca

SEQ ID NO: 3391165 - RNA, 17 nt, Human
gaacuccugccauaguc

SEQ ID NO: 3391166 - RNA, 11 nt, Human
gaacuccuggg

SEQ ID NO: 3391167 - RNA, 13 nt, Human
gaacuccuuggcc

SEQ ID NO: 3391168 - RNA, 21 nt, Human
gaacuccuuggccuagcccac

SEQ ID NO: 3391169 - RNA, 18 nt, Human
gaacucgcgcucaguaaa

SEQ ID NO: 3391170 - RNA, 19 nt, Human
gaacucuaucugggccugg

SEQ ID NO: 3391171 - RNA, 17 nt, Human
gaacucucuccacccua

SEQ ID NO: 3391172 - RNA, 15 nt, Human
gaacucuuagaaaug

SEQ ID NO: 3391173 - RNA, 22 nt, Human
gaacucuuccuccaaggacaga

SEQ ID NO: 3391174 - RNA, 18 nt, Human
gaacucuuucuggccugc

SEQ ID NO: 3391175 - RNA, 16 nt, Human
gaacugaaaacauaaa

SEQ ID NO: 3391176 - RNA, 19 nt, Human
gaacugaaaacauaaaaag

SEQ ID NO: 3391177 - RNA, 17 nt, Human
gaacugaaaagagagca

SEQ ID NO: 3391178 - RNA, 18 nt, Human
gaacugaaaagagagcag

SEQ ID NO: 3391179 - RNA, 21 nt, Human
gaacugaaaagagagcagaga

SEQ ID NO: 3391180 - RNA, 13 nt, Human
gaacugaaaucau

SEQ ID NO: 3391181 - RNA, 17 nt, Human
gaacugaaguuucacau

SEQ ID NO: 3391182 - RNA, 17 nt, Human
gaacugagcuccucugg

SEQ ID NO: 3391183 - RNA, 21 nt, Human
gaacugagcuccucugggcag

SEQ ID NO: 3391184 - RNA, 15 nt, Human
gaacugagcuuggaa

SEQ ID NO: 3391185 - RNA, 21 nt, Human
gaacugagcuuggaagcuucu

SEQ ID NO: 3391186 - RNA, 22 nt, Human
gaacugagcuuggaagcuucug

SEQ ID NO: 3391187 - RNA, 16 nt, Human
gaacugaugacacuga

SEQ ID NO: 3391188 - RNA, 23 nt, Human
gaacugauucacaucucauuuuu

SEQ ID NO: 3391189 - RNA, 18 nt, Human
gaacugcagaccuguccu

SEQ ID NO: 3391190 - RNA, 21 nt, Human
gaacugcagcaaucuuugaaa

SEQ ID NO: 3391191 - RNA, 16 nt, Human
gaacugcaggcccugg

SEQ ID NO: 3391192 - RNA, 21 nt, Human
gaacugcaggcccuggccucc

SEQ ID NO: 3391193 - RNA, 15 nt, Human
gaacugcauauguuu

SEQ ID NO: 3391194 - RNA, 23 nt, Human
gaacugcauggaccuaacauucg

SEQ ID NO: 3391195 - RNA, 17 nt, Human
gaacugcauguauaaau

SEQ ID NO: 3391196 - RNA, 18 nt, Human
gaacugccauuauuuucu

SEQ ID NO: 3391197 - RNA, 20 nt, Human
gaacugccauuauuuucugu

SEQ ID NO: 3391198 - RNA, 22 nt, Human
gaacugcuagucaagugcgucc

SEQ ID NO: 3391199 - RNA, 14 nt, Human
gaacugcugccacu

SEQ ID NO: 3391200 - RNA, 15 nt, Human
gaacugcugccacug

SEQ ID NO: 3391201 - RNA, 16 nt, Human
gaacugcugccacuga

SEQ ID NO: 3391202 - RNA, 20 nt, Human
gaacuggacccuguugcuaa

SEQ ID NO: 3391203 - RNA, 21 nt, Human
gaacuggacucaggaugccca

SEQ ID NO: 3391204 - RNA, 23 nt, Human
gaacuggacucaggaugcccagg

SEQ ID NO: 3391205 - RNA, 14 nt, Human
gaacuggccaagcu

SEQ ID NO: 3391206 - RNA, 16 nt, Human
gaacuggccaagcuga

SEQ ID NO: 3391207 - RNA, 16 nt, Human
gaacuggguaaaugca

SEQ ID NO: 3391208 - RNA, 20 nt, Human
gaacuggucaccaugaaacu

SEQ ID NO: 3391209 - RNA, 17 nt, Human
gaacuguccagagagca

SEQ ID NO: 3391210 - RNA, 21 nt, Human
gaacugucucucaugaaccuc

SEQ ID NO: 3391211 - RNA, 22 nt, Human
gaacugugaggguaaaggcuau

SEQ ID NO: 3391212 - RNA, 22 nt, Human
gaacugugcauagugcugggau

SEQ ID NO: 3391213 - RNA, 20 nt, Human
gaacuguguuucaaguucaa

SEQ ID NO: 3391214 - RNA, 15 nt, Human
gaacuuaaauaaaug

SEQ ID NO: 3391215 - RNA, 20 nt, Human
gaacuuaacaugcuguguaa

SEQ ID NO: 3391216 - RNA, 22 nt, Human
gaacuuaacaugcuguguaagc

SEQ ID NO: 3391217 - RNA, 20 nt, Human
gaacuucaccugcaaagcuc

SEQ ID NO: 3391218 - RNA, 23 nt, Human
gaacuucgcaucaaaagacaauu

SEQ ID NO: 3391219 - RNA, 19 nt, Human
gaacuugaagccugcuccu

SEQ ID NO: 3391220 - RNA, 12 nt, Human
gaacuugacaau

SEQ ID NO: 3391221 - RNA, 23 nt, Human
gaacuugcauugugauuggccug

SEQ ID NO: 3391222 - RNA, 12 nt, Human
gaacuugccucu

SEQ ID NO: 3391223 - RNA, 24 nt, Human
gaacuugcgagaaauucguguguu

SEQ ID NO: 3391224 - RNA, 13 nt, Human
gaacuugcugccu

SEQ ID NO: 3391225 - RNA, 14 nt, Human
gaacuugcugccuc

SEQ ID NO: 3391226 - RNA, 14 nt, Human
gaacuugcugcugu

SEQ ID NO: 3391227 - RNA, 16 nt, Human
gaacuuggcgcugccc

SEQ ID NO: 3391228 - RNA, 17 nt, Human
gaacuugggccacugug

SEQ ID NO: 3391229 - RNA, 22 nt, Human
gaacuuggggaguuaagaccug

SEQ ID NO: 3391230 - RNA, 24 nt, Human
gaagccaggaauuucccaggaccc

SEQ ID NO: 3391231 - RNA, 15 nt, Human
gaagccaggagcaaa

SEQ ID NO: 3391232 - RNA, 17 nt, Human
gaagccaucaccucaga

SEQ ID NO: 3391233 - RNA, 23 nt, Human
gaagccaugaguuccagaaagua

SEQ ID NO: 3391234 - RNA, 12 nt, Human
gaagccaugucu

SEQ ID NO: 3391235 - RNA, 16 nt, Human
gaagccauugucuucg

SEQ ID NO: 3391236 - RNA, 14 nt, Human
gaagcccaauaaac

SEQ ID NO: 3391237 - RNA, 18 nt, Human
gaagcccaauaaaccucu

SEQ ID NO: 3391238 - RNA, 19 nt, Human
gaagcccagccccuacugc

SEQ ID NO: 3391239 - RNA, 20 nt, Human
gaagcccagccccuacugcu

SEQ ID NO: 3391240 - RNA, 18 nt, Human
ucagaccgucuuccucca

SEQ ID NO: 3391241 - RNA, 21 nt, Human
ucagaccuuggaucagaugaa

SEQ ID NO: 3391242 - RNA, 18 nt, Human
ucagaccuuuuaacuccu

SEQ ID NO: 3391243 - RNA, 17 nt, Human
ucagacgccugaggaac

SEQ ID NO: 3391244 - RNA, 19 nt, Human
ucagacuaagaaauauucc

SEQ ID NO: 3391245 - RNA, 22 nt, Human
ucagacucccauuccugaagaa

SEQ ID NO: 3391246 - RNA, 18 nt, Human
ucagacucuaagaaagaa

SEQ ID NO: 3391247 - RNA, 17 nt, Human
ucagacucucagcccag

SEQ ID NO: 3391248 - RNA, 19 nt, Human
ucagacucucagcccagaa

SEQ ID NO: 3391249 - RNA, 19 nt, Human
ucagacugaacauguacac

SEQ ID NO: 3391250 - RNA, 18 nt, Human
ucagacugacaguuuaca

SEQ ID NO: 3391251 - RNA, 14 nt, Human
ucagacugcaccca

SEQ ID NO: 3391252 - RNA, 16 nt, Human
ucagacugcacccagg

SEQ ID NO: 3391253 - RNA, 14 nt, Human
ucagacugcaugua

SEQ ID NO: 3391254 - RNA, 15 nt, Human
ucagacugcugggac

SEQ ID NO: 3391255 - RNA, 21 nt, Human
ucagacugcugggacuggcca

SEQ ID NO: 3391256 - RNA, 14 nt, Human
ucagacuggcuggc

SEQ ID NO: 3391257 - RNA, 13 nt, Human
ucagacuggggca

SEQ ID NO: 3391258 - RNA, 13 nt, Human
ucagacuugucaa

SEQ ID NO: 3391259 - RNA, 13 nt, Human
ucagacuuugcuu

SEQ ID NO: 3391260 - RNA, 21 nt, Human
ucagacuuuggaaaaugcauu

SEQ ID NO: 3391261 - RNA, 15 nt, Human
ucagacuuuuguaca

SEQ ID NO: 3391262 - RNA, 16 nt, Human
ucagagaaaugucugu

SEQ ID NO: 3391263 - RNA, 12 nt, Human
ucagagaauuuc

SEQ ID NO: 3391264 - RNA, 14 nt, Human
ucagagacaaaaua

SEQ ID NO: 3391265 - RNA, 22 nt, Human
ucagagacaaaauauuucccau

SEQ ID NO: 3391266 - RNA, 15 nt, Human
ucagagacagcugau

SEQ ID NO: 3391267 - RNA, 20 nt, Human
ucagagacaggaagucuuca

SEQ ID NO: 3391268 - RNA, 16 nt, Human
ucagagaccagggcuc

SEQ ID NO: 3391269 - RNA, 17 nt, Human
ucagagacucagggccc

SEQ ID NO: 3391270 - RNA, 20 nt, Human
ucagagacucagggccccag

SEQ ID NO: 3391271 - RNA, 17 nt, Human
ucagagacuccugcagg

SEQ ID NO: 3391272 - RNA, 14 nt, Human
ucagagagaguguu

SEQ ID NO: 3391273 - RNA, 20 nt, Human
ucagagagcagugcuuuugg

SEQ ID NO: 3391274 - RNA, 22 nt, Human
ucagagaggccuuuuggaaugu

SEQ ID NO: 3391275 - RNA, 16 nt, Human
ucagagagggugggag

SEQ ID NO: 3391276 - RNA, 23 nt, Human
ucagagauguccauuuuuacaag

SEQ ID NO: 3391277 - RNA, 20 nt, Human
ucagagcagcagugaaaaca

SEQ ID NO: 3391278 - RNA, 14 nt, Human
ucagagcagggguc

SEQ ID NO: 3391279 - RNA, 21 nt, Human
ucagagcccauggcuucccug

SEQ ID NO: 3391280 - RNA, 18 nt, Human
ucagagccccuacagcau

SEQ ID NO: 3391281 - RNA, 16 nt, Human
ucagagccgugguccu

SEQ ID NO: 3391282 - RNA, 20 nt, Human
ucagagccgugguccuuugg

SEQ ID NO: 3391283 - RNA, 21 nt, Human
ucagagccuccuuucuggcuu

SEQ ID NO: 3391284 - RNA, 18 nt, Human
ucagagccugcaguuauu

SEQ ID NO: 3391285 - RNA, 17 nt, Human
ucagagccuuuccucaa

SEQ ID NO: 3391286 - RNA, 22 nt, Human
ucagagcuaaacuccuuccugg

SEQ ID NO: 3391287 - RNA, 23 nt, Human
ucagagcuaagggugggugcuca

SEQ ID NO: 3391288 - RNA, 18 nt, Human
ucagagcuacuugggcca

SEQ ID NO: 3391289 - RNA, 14 nt, Human
ucagagcugacaca

SEQ ID NO: 3391290 - RNA, 18 nt, Human
ucagagcugacacaggau

SEQ ID NO: 3391291 - RNA, 15 nt, Human
ucagagcugcccucu

SEQ ID NO: 3391292 - RNA, 18 nt, Human
ucagagcugcccucuccu

SEQ ID NO: 3391293 - RNA, 19 nt, Human
ucagagcugcccucuccug

SEQ ID NO: 3391294 - RNA, 23 nt, Human
ucagagcugcccucuccugggca

SEQ ID NO: 3391295 - RNA, 15 nt, Human
ucagagcugggaggg

SEQ ID NO: 3391296 - RNA, 18 nt, Human
ucagaggaccuguauuua

SEQ ID NO: 3391297 - RNA, 22 nt, Human
ucagaggaccuguauuuaagca

SEQ ID NO: 3391298 - RNA, 18 nt, Human
ucagaggauggccagugu

SEQ ID NO: 3391299 - RNA, 20 nt, Human
ucagaggauggccagugucu

SEQ ID NO: 3391300 - RNA, 22 nt, Human
ucagaggccccaauaccccaug

SEQ ID NO: 3391301 - RNA, 18 nt, Human
ucagaggcccucgcugcc

SEQ ID NO: 3391302 - RNA, 20 nt, Human
ucagagggcccaaauggcag

SEQ ID NO: 3391303 - RNA, 18 nt, Human
ucagagggggacugcugc

SEQ ID NO: 3391304 - RNA, 18 nt, Human
ucagagguagggcugcca

SEQ ID NO: 3391305 - RNA, 17 nt, Human
ucagagguucuuugagg

SEQ ID NO: 3391306 - RNA, 23 nt, Human
ucagagguuuaccuagagaacag

SEQ ID NO: 3391307 - RNA, 23 nt, Human
ucagagugcaagccccugcucca

SEQ ID NO: 3391308 - RNA, 19 nt, Human
ucagaguucuuuuugaagu

SEQ ID NO: 3391309 - RNA, 13 nt, Human
ucagauaacuguu

SEQ ID NO: 3391310 - RNA, 20 nt, Human
ucagauaagguaaaaugcca

SEQ ID NO: 3391311 - RNA, 23 nt, Human
ucagauaagguaaaaugccauga

SEQ ID NO: 3391312 - RNA, 14 nt, Human
ucagauacaaugua

SEQ ID NO: 3391313 - RNA, 15 nt, Human
ucagauacuggauug

SEQ ID NO: 3391314 - RNA, 16 nt, Human
ucagauacuggauugu

SEQ ID NO: 3391315 - RNA, 19 nt, Human
ucagauacuggauuguacu

SEQ ID NO: 3391316 - RNA, 20 nt, Human
ucagauauaaaagacugacc

SEQ ID NO: 3391317 - RNA, 18 nt, Human
ucagauauauaucauauu

SEQ ID NO: 3391318 - RNA, 22 nt, Human
ucagauauuuuuucagaaauau

SEQ ID NO: 3391319 - RNA, 19 nt, Human
ucagaucacugaauuuaua

SEQ ID NO: 3391320 - RNA, 16 nt, Human
ucagaucauggcaucc

SEQ ID NO: 3391321 - RNA, 20 nt, Human
ucagaucauuaucagccugu

SEQ ID NO: 3391322 - RNA, 14 nt, Human
ucagauccaggagc

SEQ ID NO: 3391323 - RNA, 15 nt, Human
ucagauccaggagcu

SEQ ID NO: 3391324 - RNA, 18 nt, Human
ucagauccaggagcucca

SEQ ID NO: 3391325 - RNA, 17 nt, Human
ucagauccuuguuucaa

SEQ ID NO: 3391326 - RNA, 20 nt, Human
ucagaucugccuaaggacuu

SEQ ID NO: 3391327 - RNA, 20 nt, Human
ucagaucuuaauauaaauuc

SEQ ID NO: 3391328 - RNA, 13 nt, Human
ucagaucuucugu

SEQ ID NO: 3391329 - RNA, 19 nt, Human
ucagaucuuucuccuugaa

SEQ ID NO: 3391330 - RNA, 15 nt, Human
ucagaugacuagaaa

SEQ ID NO: 3391331 - RNA, 13 nt, Human
ucagaugagaaca

SEQ ID NO: 3391332 - RNA, 15 nt, Human
ucagaugagaacaaa

SEQ ID NO: 3391333 - RNA, 17 nt, Human
ucagaugagaacaaagc

SEQ ID NO: 3391334 - RNA, 20 nt, Human
ucagaugagaacaaagcugu

SEQ ID NO: 3391335 - RNA, 18 nt, Human
ucagaugcacaugagcug

SEQ ID NO: 3391336 - RNA, 22 nt, Human
ucagaugcauccuuucauaaga

SEQ ID NO: 3391337 - RNA, 16 nt, Human
ucagaugccacuucua

SEQ ID NO: 3391338 - RNA, 20 nt, Human
ucagaugccacuucuaagaa

SEQ ID NO: 3391339 - RNA, 12 nt, Human
ucagaugcucaa

SEQ ID NO: 3391340 - RNA, 15 nt, Human
ucagaugcuccaaga

SEQ ID NO: 3391341 - RNA, 22 nt, Human
ucagaugcuccaagauucuaga

SEQ ID NO: 3391342 - RNA, 14 nt, Human
ucagaugcuucugg

SEQ ID NO: 3391343 - RNA, 18 nt, Human
ucagaugcuucugggaga

SEQ ID NO: 3391344 - RNA, 19 nt, Human
ucagauggaaauauuuuga

SEQ ID NO: 3391345 - RNA, 22 nt, Human
ucagauggaaccgcaggaagcu

SEQ ID NO: 3391346 - RNA, 23 nt, Human
ucagauggaaccgcaggaagcug

SEQ ID NO: 3391347 - RNA, 15 nt, Human
ucagauggcagcuuu

SEQ ID NO: 3391348 - RNA, 16 nt, Human
ucagauggcagcuuuu

SEQ ID NO: 3391349 - RNA, 17 nt, Human
ucagauggcagcuuuua

SEQ ID NO: 3391350 - RNA, 15 nt, Human
ucagaugggaagaca

SEQ ID NO: 3391351 - RNA, 13 nt, Human
ucagauguaaugu

SEQ ID NO: 3391352 - RNA, 23 nt, Human
ucagaugucccuugaugcacaga

SEQ ID NO: 3391353 - RNA, 13 nt, Human
ucagaugucuucu

SEQ ID NO: 3391354 - RNA, 17 nt, Human
ucagaugucuucugccu

SEQ ID NO: 3391355 - RNA, 19 nt, Human
ucagaugucuucugccugu

SEQ ID NO: 3391356 - RNA, 21 nt, Human
ucagaugucuucugccuguua

SEQ ID NO: 3391357 - RNA, 22 nt, Human
ucagaugucuucugccuguuau

SEQ ID NO: 3391358 - RNA, 17 nt, Human
ucagauguggagccagg

SEQ ID NO: 3391359 - RNA, 14 nt, Human
uuucaaauuguauc

SEQ ID NO: 3391360 - RNA, 20 nt, Human
uuucaaauuuagaaacuaau

SEQ ID NO: 3391361 - RNA, 23 nt, Human
uuucaaauuuagaaacuaauuga

SEQ ID NO: 3391362 - RNA, 14 nt, Human
uuucaaauuucaca

SEQ ID NO: 3391363 - RNA, 23 nt, Human
uuucaacaaguagcuaaagucug

SEQ ID NO: 3391364 - RNA, 23 nt, Human
uuucaaccccacccuguuuggau

SEQ ID NO: 3391365 - RNA, 16 nt, Human
uuucaacgcagcccug

SEQ ID NO: 3391366 - RNA, 23 nt, Human
uuucaacggaaagugcugucuua

SEQ ID NO: 3391367 - RNA, 16 nt, Human
uuucaacucauugcau

SEQ ID NO: 3391368 - RNA, 17 nt, Human
uuucaagaaacugagga

SEQ ID NO: 3391369 - RNA, 19 nt, Human
uuucaagaaacugaggaau

SEQ ID NO: 3391370 - RNA, 14 nt, Human
uuucaagaaccugg

SEQ ID NO: 3391371 - RNA, 16 nt, Human
uuucaagaaccuggaa

SEQ ID NO: 3391372 - RNA, 13 nt, Human
uuucaagaacuug

SEQ ID NO: 3391373 - RNA, 20 nt, Human
uuucaagacauuaaaucuau

SEQ ID NO: 3391374 - RNA, 18 nt, Human
uuucaagaccccugucuu

SEQ ID NO: 3391375 - RNA, 22 nt, Human
uuucaagcagucgugccugugu

SEQ ID NO: 3391376 - RNA, 20 nt, Human
uuucaaggaagguucaugua

SEQ ID NO: 3391377 - RNA, 19 nt, Human
uuucaaggaaguagaaaca

SEQ ID NO: 3391378 - RNA, 17 nt, Human
uuucaaggcacucuaga

SEQ ID NO: 3391379 - RNA, 20 nt, Human
uuucaaggcacucuagauuc

SEQ ID NO: 3391380 - RNA, 22 nt, Human
uuucaaggcacucuagauucca

SEQ ID NO: 3391381 - RNA, 19 nt, Human
uuucaagggcuuuccugug

SEQ ID NO: 3391382 - RNA, 18 nt, Human
uuucaaguacacugaauu

SEQ ID NO: 3391383 - RNA, 18 nt, Human
uuuuaacuuuguuuuauu

SEQ ID NO: 3391384 - RNA, 18 nt, Human
uuuuaagaaagaaauacu

SEQ ID NO: 3391385 - RNA, 22 nt, Human
uuuuaagaaagaaauacuguau

SEQ ID NO: 3391386 - RNA, 16 nt, Human
uuuuaagaaauguagu

SEQ ID NO: 3391387 - RNA, 13 nt, Human
uuuuaagaauauc

SEQ ID NO: 3391388 - RNA, 13 nt, Human
uuuuaagauagug

SEQ ID NO: 3391389 - RNA, 16 nt, Human
uuuuaagauaguguaa

SEQ ID NO: 3391390 - RNA, 12 nt, Human
uuuuaagauuuu

SEQ ID NO: 3391391 - RNA, 22 nt, Human
uuuuaagcauuacucuuguaag

SEQ ID NO: 3391392 - RNA, 19 nt, Human
uuuuaagccuuuguugaac

SEQ ID NO: 3391393 - RNA, 20 nt, Human
uuuuaagccuuuguugaacu

SEQ ID NO: 3391394 - RNA, 21 nt, Human
uuuuaagcugcaaaucugaug

SEQ ID NO: 3391395 - RNA, 15 nt, Human
uuuuaaggacugacu

SEQ ID NO: 3391396 - RNA, 23 nt, Human
uuuuaaggauaaaucauaaaguc

SEQ ID NO: 3391397 - RNA, 23 nt, Human
uuuuaaggguuuguggaaaauga

SEQ ID NO: 3391398 - RNA, 23 nt, Human
uuuuaaggucuuucaguacuuuu

SEQ ID NO: 3391399 - RNA, 15 nt, Human
uuuuaaguauuuagg

SEQ ID NO: 3391400 - RNA, 17 nt, Human
uuuuaaguauuuauaua

SEQ ID NO: 3391401 - RNA, 15 nt, Human
uuuuaagugcugcau

SEQ ID NO: 3391402 - RNA, 19 nt, Human
uuuuaagugcuuuguaaug

SEQ ID NO: 3391403 - RNA, 23 nt, Human
uuuuaaguuaauagauuuuuuca

SEQ ID NO: 3391404 - RNA, 22 nt, Human
uuuuaaguuacacauuuuucag

SEQ ID NO: 3391405 - RNA, 15 nt, Human
uuuuaaguucuuaug

SEQ ID NO: 3391406 - RNA, 16 nt, Human
uuuuaaguuguuugca

SEQ ID NO: 3391407 - RNA, 15 nt, Human
uuuuaaguuugcacu

SEQ ID NO: 3391408 - RNA, 14 nt, Human
uuuuaauaaacacu

SEQ ID NO: 3391409 - RNA, 15 nt, Human
uuuuaauaaacuacu

SEQ ID NO: 3391410 - RNA, 21 nt, Human
uuuuaauaaacuacucuuuga

SEQ ID NO: 3391411 - RNA, 14 nt, Human
uuuuaauauaaauu

SEQ ID NO: 3391412 - RNA, 22 nt, Human
uuuuaauauuauuacuguugau

SEQ ID NO: 3391413 - RNA, 22 nt, Human
uuuuaaucagacaaaguaauuc

SEQ ID NO: 3391414 - RNA, 12 nt, Human
uuuuaaucauga

SEQ ID NO: 3391415 - RNA, 14 nt, Human
uuuuaaucaugaaa

SEQ ID NO: 3391416 - RNA, 20 nt, Human
uuuuaauccgccaauauuag

SEQ ID NO: 3391417 - RNA, 17 nt, Human
uuuuaaucugaaauucu

SEQ ID NO: 3391418 - RNA, 15 nt, Human
uuuuaaugaaaagga

SEQ ID NO: 3391419 - RNA, 19 nt, Human
uuuuaaugaaaaggaauca

SEQ ID NO: 3391420 - RNA, 17 nt, Human
uuuuaaugauuguuuaa

SEQ ID NO: 3391421 - RNA, 18 nt, Human
uuuuaauggauuguuaau

SEQ ID NO: 3391422 - RNA, 21 nt, Human
uuuuaauggcagcagaaaacu

SEQ ID NO: 3391423 - RNA, 22 nt, Human
uuuuaauggggguagcagcugg

SEQ ID NO: 3391424 - RNA, 13 nt, Human
uuuuaaugugcug

SEQ ID NO: 3391425 - RNA, 18 nt, Human
uuuuaaugugcuguguaa

SEQ ID NO: 3391426 - RNA, 23 nt, Human
uuuuaauuauuauuuauauaugu

SEQ ID NO: 3391427 - RNA, 12 nt, Human
uuuuaauuguau

SEQ ID NO: 3391428 - RNA, 13 nt, Human
uuuuaauuguauu

SEQ ID NO: 3391429 - RNA, 22 nt, Human
uuuuaauuguauuuuuguuguu

SEQ ID NO: 3391430 - RNA, 12 nt, Human
uuuuaauuguca

SEQ ID NO: 3391431 - RNA, 14 nt, Human
uuuuaauugucaug

SEQ ID NO: 3391432 - RNA, 10 nt, Human
uuuuaauuua

SEQ ID NO: 3391433 - RNA, 14 nt, Human
uuuuaauuuaguaa

SEQ ID NO: 3391434 - RNA, 13 nt, Human
uuuuaauuugaua

SEQ ID NO: 3391435 - RNA, 21 nt, Human
uuuuaauuugguuuucacauu

SEQ ID NO: 3391436 - RNA, 23 nt, Human
uuuuacaaaggcuguauucagca

SEQ ID NO: 3391437 - RNA, 14 nt, Human
uuuuacaaauguua

SEQ ID NO: 3391438 - RNA, 22 nt, Human
uuuuacaaauguuaaaaugugu

SEQ ID NO: 3391439 - RNA, 12 nt, Human
uuuuacaaguaa

SEQ ID NO: 3391440 - RNA, 12 nt, Human
uuuuacaauaaa

SEQ ID NO: 3391441 - RNA, 15 nt, Human
uccacauuguuuuaa

SEQ ID NO: 3391442 - RNA, 16 nt, Human
uccacauuguuuuaaa

SEQ ID NO: 3391443 - RNA, 18 nt, Human
uccacauuucccccuagc

SEQ ID NO: 3391444 - RNA, 15 nt, Human
uccacauuucuaaaa

SEQ ID NO: 3391445 - RNA, 18 nt, Human
uccaccaacccaucagaa

SEQ ID NO: 3391446 - RNA, 17 nt, Human
uccaccaagaaagcagg

SEQ ID NO: 3391447 - RNA, 18 nt, Human
uccaccaagccuggucag

SEQ ID NO: 3391448 - RNA, 22 nt, Human
uccaccaagccuggucagccca

SEQ ID NO: 3391449 - RNA, 22 nt, Human
uccaccaccacuggccaccagg

SEQ ID NO: 3391450 - RNA, 16 nt, Human
uccaccaccucccuca

SEQ ID NO: 3391451 - RNA, 12 nt, Human
uccaccagcauc

SEQ ID NO: 3391452 - RNA, 15 nt, Human
uccaccaggaaccuc

SEQ ID NO: 3391453 - RNA, 19 nt, Human
uccaccaggaaccucuuca

SEQ ID NO: 3391454 - RNA, 15 nt, Human
uccaccaucaagcca

SEQ ID NO: 3391455 - RNA, 22 nt, Human
uccacccauaauccuuucugcc

SEQ ID NO: 3391456 - RNA, 18 nt, Human
uccaccccaagagaacuc

SEQ ID NO: 3391457 - RNA, 19 nt, Human
uccaccccaagagaacucg

SEQ ID NO: 3391458 - RNA, 12 nt, Human
uccaccccacuc

SEQ ID NO: 3391459 - RNA, 20 nt, Human
uccaccccagugcacccacu

SEQ ID NO: 3391460 - RNA, 12 nt, Human
uccaccccaucc

SEQ ID NO: 3391461 - RNA, 16 nt, Human
uccacccccagcugcu

SEQ ID NO: 3391462 - RNA, 22 nt, Human
uccaccccccagaaccuguccu

SEQ ID NO: 3391463 - RNA, 13 nt, Human
uccacccccuccc

SEQ ID NO: 3391464 - RNA, 19 nt, Human
uccacccccucccuggccu

SEQ ID NO: 3391465 - RNA, 21 nt, Human
uccaccccuuucuagaccaau

SEQ ID NO: 3391466 - RNA, 13 nt, Human
uccacccuccacc

SEQ ID NO: 3391467 - RNA, 18 nt, Human
uccacccuccaccuucca

SEQ ID NO: 3391468 - RNA, 14 nt, Human
uccacccugccugc

SEQ ID NO: 3391469 - RNA, 12 nt, Human
uccacccugucc

SEQ ID NO: 3391470 - RNA, 20 nt, Human
uccacccugucccccagcuc

SEQ ID NO: 3391471 - RNA, 21 nt, Human
uccacccugucccccagcucu

SEQ ID NO: 3391472 - RNA, 14 nt, Human
uccacccuuggccu

SEQ ID NO: 3391473 - RNA, 14 nt, Human
uccaccgcugccua

SEQ ID NO: 3391474 - RNA, 19 nt, Human
uccaccgcugccuaagugg

SEQ ID NO: 3391475 - RNA, 14 nt, Human
uccaccuacaugag

SEQ ID NO: 3391476 - RNA, 20 nt, Human
uccaccuaguggcuguccag

SEQ ID NO: 3391477 - RNA, 14 nt, Human
uccaccucacccca

SEQ ID NO: 3391478 - RNA, 13 nt, Human
uccaccucagccu

SEQ ID NO: 3391479 - RNA, 14 nt, Human
uccaccuccaucuu

SEQ ID NO: 3391480 - RNA, 17 nt, Human
uccaccucccugcaaua

SEQ ID NO: 3391481 - RNA, 13 nt, Human
uccaccuccuucu

SEQ ID NO: 3391482 - RNA, 15 nt, Human
uccaccugccaggga

SEQ ID NO: 3391483 - RNA, 21 nt, Human
uccaccugccagggacagagg

SEQ ID NO: 3391484 - RNA, 13 nt, Human
uccaccugcuccc

SEQ ID NO: 3391485 - RNA, 18 nt, Human
uccaccugcucccaggcc

SEQ ID NO: 3391486 - RNA, 17 nt, Human
uccaccugcucugcuga

SEQ ID NO: 3391487 - RNA, 13 nt, Human
uccaccuggcccc

SEQ ID NO: 3391488 - RNA, 20 nt, Human
uccaccugguacucccucuc

SEQ ID NO: 3391489 - RNA, 23 nt, Human
uccaccugguacucccucucagg

SEQ ID NO: 3391490 - RNA, 16 nt, Human
uccaccugucucagcc

SEQ ID NO: 3391491 - RNA, 17 nt, Human
uccaccugucucagccu

SEQ ID NO: 3391492 - RNA, 12 nt, Human
uccaccuguggg

SEQ ID NO: 3391493 - RNA, 12 nt, Human
uccaccuuccca

SEQ ID NO: 3391494 - RNA, 18 nt, Human
uccaccuucccaugcccu

SEQ ID NO: 3391495 - RNA, 19 nt, Human
uccaccuucccaugcccug

SEQ ID NO: 3391496 - RNA, 14 nt, Human
uccacgacugucuc

SEQ ID NO: 3391497 - RNA, 15 nt, Human
uccacgacugucucc

SEQ ID NO: 3391498 - RNA, 18 nt, Human
uccacgacugucuccaug

SEQ ID NO: 3391499 - RNA, 18 nt, Human
uccacgauccugccaccc

SEQ ID NO: 3391500 - RNA, 17 nt, Human
uccacgcgcuucgacuu

SEQ ID NO: 3391501 - RNA, 21 nt, Human
uccacgcgugccguggcacca

SEQ ID NO: 3391502 - RNA, 17 nt, Human
uccacgcugucuccaga

SEQ ID NO: 3391503 - RNA, 18 nt, Human
uccacgcugucuccagac

SEQ ID NO: 3391504 - RNA, 21 nt, Human
uccacgcugucuccagacccc

SEQ ID NO: 3391505 - RNA, 22 nt, Human
uccacgcugucuccagaccccc

SEQ ID NO: 3391506 - RNA, 23 nt, Human
uccacgcugucuccagaccccca

SEQ ID NO: 3391507 - RNA, 14 nt, Human
uccacggagccacu

SEQ ID NO: 3391508 - RNA, 22 nt, Human
uccacggagccacuccucugac

SEQ ID NO: 3391509 - RNA, 14 nt, Human
uccacggcucuagg

SEQ ID NO: 3391510 - RNA, 17 nt, Human
uccacguucaccccucc

SEQ ID NO: 3391511 - RNA, 19 nt, Human
uccacuaaccccgggcggg

SEQ ID NO: 3391512 - RNA, 15 nt, Human
uccacuacaccuggc

SEQ ID NO: 3391513 - RNA, 17 nt, Human
uccacuagugcaaauca

SEQ ID NO: 3391514 - RNA, 21 nt, Human
uccacucagcuguccugcagc

SEQ ID NO: 3391515 - RNA, 15 nt, Human
uccacucaguugcaa

SEQ ID NO: 3391516 - RNA, 21 nt, Human
uccacucaugugacucuuucc

SEQ ID NO: 3391517 - RNA, 15 nt, Human
uccacuccauugucg

SEQ ID NO: 3391518 - RNA, 13 nt, Human
uccacucccagug

SEQ ID NO: 3391519 - RNA, 15 nt, Human
uccacucccagugcu

SEQ ID NO: 3391520 - RNA, 18 nt, Human
uccacuccuccuagccac

SEQ ID NO: 3391521 - RNA, 14 nt, Human
uccacuccuuccug

SEQ ID NO: 3391522 - RNA, 12 nt, Human
uccacucucccc

SEQ ID NO: 3391523 - RNA, 13 nt, Human
uccacucuccccc

SEQ ID NO: 3391524 - RNA, 17 nt, Human
uccacucuccuugcuac

SEQ ID NO: 3391525 - RNA, 22 nt, Human
uccacucucucuuguucuuacu

SEQ ID NO: 3391526 - RNA, 17 nt, Human
uccacucugauagaauu

SEQ ID NO: 3391527 - RNA, 12 nt, Human
uccacucugcuu

SEQ ID NO: 3391528 - RNA, 15 nt, Human
uccacucugcuucuc

SEQ ID NO: 3391529 - RNA, 19 nt, Human
uccacucugcuucucugac

SEQ ID NO: 3391530 - RNA, 20 nt, Human
uccacucugcuucucugacu

SEQ ID NO: 3391531 - RNA, 16 nt, Human
uccacucuuucuuuca

SEQ ID NO: 3391532 - RNA, 15 nt, Human
uccacugagggcagu

SEQ ID NO: 3391533 - RNA, 15 nt, Human
uccacugcccucugu

SEQ ID NO: 3391534 - RNA, 15 nt, Human
uccacugccuucgau

SEQ ID NO: 3391535 - RNA, 17 nt, Human
uccacugggguggccug

SEQ ID NO: 3391536 - RNA, 19 nt, Human
uccacugucacccuccacc

SEQ ID NO: 3391537 - RNA, 21 nt, Human
uccacugugccaugugccagg

SEQ ID NO: 3391538 - RNA, 22 nt, Human
uccacugugccaugugccaggu

SEQ ID NO: 3391539 - RNA, 20 nt, Human
uccacuguguauagaaguag

SEQ ID NO: 3391540 - RNA, 22 nt, Human
uccacuguuuauucaacaacua

SEQ ID NO: 3391541 - RNA, 14 nt, Human
uccacuucaaugca

SEQ ID NO: 3391542 - RNA, 14 nt, Human
uccacuucugacag

SEQ ID NO: 3391543 - RNA, 15 nt, Human
uccacuucugacagc

SEQ ID NO: 3391544 - RNA, 19 nt, Human
uccacuucugacagccuca

SEQ ID NO: 3391545 - RNA, 20 nt, Human
uccacuucuuucagcagacu

SEQ ID NO: 3391546 - RNA, 14 nt, Human
uccacuuggucugu

SEQ ID NO: 3391547 - RNA, 12 nt, Human
uccacuuucagc

SEQ ID NO: 3391548 - RNA, 15 nt, Human
uccacuuucagcugu

SEQ ID NO: 3391549 - RNA, 18 nt, Human
uccacuuucagcugucuu

SEQ ID NO: 3391550 - RNA, 18 nt, Human
uccacuuucagugaaagc

SEQ ID NO: 3391551 - RNA, 21 nt, Human
uccacuuucuagccagaggag

SEQ ID NO: 3391552 - RNA, 20 nt, Human
uccacuuuguuggaaagcag

SEQ ID NO: 3391553 - RNA, 19 nt, Human
uccacuuuguuucgugggg

SEQ ID NO: 3391554 - RNA, 22 nt, Human
uccacuuuguuucguggggagg

SEQ ID NO: 3391555 - RNA, 18 nt, Human
uccacuuuuccaguauuu

SEQ ID NO: 3391556 - RNA, 24 nt, Human
uccacuuuuuaacucguuugcuga

SEQ ID NO: 3391557 - RNA, 15 nt, Human
uccagaaaacuguga

SEQ ID NO: 3391558 - RNA, 17 nt, Human
uccagaaacuuguucuu

SEQ ID NO: 3391559 - RNA, 20 nt, Human
uccagaaacuuguucuucca

SEQ ID NO: 3391560 - RNA, 23 nt, Human
uccagaaagaaaacuuguauuau

SEQ ID NO: 3391561 - RNA, 14 nt, Human
uccagaaagcccca

SEQ ID NO: 3391562 - RNA, 16 nt, Human
uccagaaagccccacc

SEQ ID NO: 3391563 - RNA, 18 nt, Human
uccagaaaggauauuuaa

SEQ ID NO: 3391564 - RNA, 20 nt, Human
uccagaaaugucccuuucuu

SEQ ID NO: 3391565 - RNA, 17 nt, Human
uccagaagaagagaagc

SEQ ID NO: 3391566 - RNA, 17 nt, Human
uccagaagccucuggcu

SEQ ID NO: 3391567 - RNA, 18 nt, Human
uccagaagccucuggcua

SEQ ID NO: 3391568 - RNA, 14 nt, Human
uccagaaggagaca

SEQ ID NO: 3391569 - RNA, 19 nt, Human
uccagaaggagacaggcag

SEQ ID NO: 3391570 - RNA, 19 nt, Human
uccagaagugugacuggcu

SEQ ID NO: 3391571 - RNA, 12 nt, Human
uccagaauaucu

SEQ ID NO: 3391572 - RNA, 12 nt, Human
uccagaaugaag

SEQ ID NO: 3391573 - RNA, 22 nt, Human
uccagaauguauagacaggaaa

SEQ ID NO: 3391574 - RNA, 16 nt, Human
uccagaauugaccuuu

SEQ ID NO: 3391575 - RNA, 22 nt, Human
uccagaauuucccaaagcagug

SEQ ID NO: 3391576 - RNA, 18 nt, Human
uccagaauuuggaaaucc

SEQ ID NO: 3391577 - RNA, 15 nt, Human
uccagacagccugua

SEQ ID NO: 3391578 - RNA, 19 nt, Human
uccagacagggaauuaggc

SEQ ID NO: 3391579 - RNA, 20 nt, Human
uccagacauacgaaacacaa

SEQ ID NO: 3391580 - RNA, 13 nt, Human
uccagacaucaug

SEQ ID NO: 3391581 - RNA, 21 nt, Human
uccagacaucaugaauuuuac

SEQ ID NO: 3391582 - RNA, 19 nt, Human
uccagacauucucgcuucc

SEQ ID NO: 3391583 - RNA, 13 nt, Human
uccagacccccac

SEQ ID NO: 3391584 - RNA, 16 nt, Human
uccagacccccagcaa

SEQ ID NO: 3391585 - RNA, 16 nt, Human
uccagaccccuggcuu

SEQ ID NO: 3391586 - RNA, 23 nt, Human
uuuuaucuccccuucacaugcau

SEQ ID NO: 3391587 - RNA, 19 nt, Human
uuuuaucugaaaucaauua

SEQ ID NO: 3391588 - RNA, 23 nt, Human
uuuuaucugaauuuuuaaacaag

SEQ ID NO: 3391589 - RNA, 13 nt, Human
uuuuaucuucuau

SEQ ID NO: 3391590 - RNA, 19 nt, Human
uuuuaucuuucgugauaaa

SEQ ID NO: 3391591 - RNA, 17 nt, Human
uuuuaucuuuucuacag

SEQ ID NO: 3391592 - RNA, 23 nt, Human
uuuuaugaagaaaaaauacauuu

SEQ ID NO: 3391593 - RNA, 13 nt, Human
uuuuaugagaaau

SEQ ID NO: 3391594 - RNA, 14 nt, Human
uuuuaugagaaaug

SEQ ID NO: 3391595 - RNA, 12 nt, Human
uuuuaugagaug

SEQ ID NO: 3391596 - RNA, 20 nt, Human
uuuuaugauacuugaaaauu

SEQ ID NO: 3391597 - RNA, 15 nt, Human
uuuuaugauccagca

SEQ ID NO: 3391598 - RNA, 13 nt, Human
uuuuaugaugacg

SEQ ID NO: 3391599 - RNA, 15 nt, Human
uuuuaugaugaugaa

SEQ ID NO: 3391600 - RNA, 13 nt, Human
uuuuaugcauguu

SEQ ID NO: 3391601 - RNA, 19 nt, Human
uuuuaugccuuuuauuucu

SEQ ID NO: 3391602 - RNA, 13 nt, Human
uuuuaugcucuuu

SEQ ID NO: 3391603 - RNA, 17 nt, Human
uuuuaugguuacuucuu

SEQ ID NO: 3391604 - RNA, 15 nt, Human
uuuuaugguuauguu

SEQ ID NO: 3391605 - RNA, 19 nt, Human
uuuuaugugaaacauguuu

SEQ ID NO: 3391606 - RNA, 15 nt, Human
uuuuauguugacauu

SEQ ID NO: 3391607 - RNA, 23 nt, Human
uuuuauguugacauuuguuuggu

SEQ ID NO: 3391608 - RNA, 14 nt, Human
uuuuauguuugaau

SEQ ID NO: 3391609 - RNA, 14 nt, Human
uuuuauuaaaacau

SEQ ID NO: 3391610 - RNA, 19 nt, Human
uuuuauuaaaauauuucag

SEQ ID NO: 3391611 - RNA, 12 nt, Human
uuuuauuaauaa

SEQ ID NO: 3391612 - RNA, 19 nt, Human
uuuuauuaauaaacauucu

SEQ ID NO: 3391613 - RNA, 22 nt, Human
uuuuauuaauaaacauucuauc

SEQ ID NO: 3391614 - RNA, 14 nt, Human
uuuuauuaaucacu

SEQ ID NO: 3391615 - RNA, 18 nt, Human
uuuuauuaaucacugugu

SEQ ID NO: 3391616 - RNA, 22 nt, Human
uuuuauuaaucacuguguauau

SEQ ID NO: 3391617 - RNA, 19 nt, Human
uuuuauuaauuuuaguuuu

SEQ ID NO: 3391618 - RNA, 12 nt, Human
uuuuauuaugaa

SEQ ID NO: 3391619 - RNA, 21 nt, Human
uuuuauuaugaaacuugugua

SEQ ID NO: 3391620 - RNA, 12 nt, Human
uuuuauuaugca

SEQ ID NO: 3391621 - RNA, 23 nt, Human
uuuuauuaugcauaacugacaaa

SEQ ID NO: 3391622 - RNA, 14 nt, Human
uuuuauuaugcauu

SEQ ID NO: 3391623 - RNA, 21 nt, Human
uuuuauuaugcuguauuuucu

SEQ ID NO: 3391624 - RNA, 12 nt, Human
uuuuauuaugua

SEQ ID NO: 3391625 - RNA, 19 nt, Human
uuuuauuauuaaugcuuug

SEQ ID NO: 3391626 - RNA, 15 nt, Human
uuuuauuauuucuau

SEQ ID NO: 3391627 - RNA, 13 nt, Human
uuuuauuauuugu

SEQ ID NO: 3391628 - RNA, 14 nt, Human
uuuuauucaaguua

SEQ ID NO: 3391629 - RNA, 18 nt, Human
uuuuauucauaagccaau

SEQ ID NO: 3391630 - RNA, 22 nt, Human
ucccaugauuucauguacugca

SEQ ID NO: 3391631 - RNA, 16 nt, Human
ucccauggagccccag

SEQ ID NO: 3391632 - RNA, 18 nt, Human
ucccauggcuuaaugcuu

SEQ ID NO: 3391633 - RNA, 15 nt, Human
ucccauguaacagaa

SEQ ID NO: 3391634 - RNA, 18 nt, Human
ucccauguaacagaaagg

SEQ ID NO: 3391635 - RNA, 21 nt, Human
ucccauguagcccccuggccu

SEQ ID NO: 3391636 - RNA, 22 nt, Human
ucccauguagcccccuggccuc

SEQ ID NO: 3391637 - RNA, 13 nt, Human
ucccauguaugga

SEQ ID NO: 3391638 - RNA, 22 nt, Human
ucccauguauuuaucucuauuu

SEQ ID NO: 3391639 - RNA, 10 nt, Human
ucccaugugg

SEQ ID NO: 3391640 - RNA, 23 nt, Human
ucccauuaggacaaucagucccc

SEQ ID NO: 3391641 - RNA, 17 nt, Human
ucccauucacucuucca

SEQ ID NO: 3391642 - RNA, 11 nt, Human
ucccauuccag

SEQ ID NO: 3391643 - RNA, 14 nt, Human
ucccauuccaggca

SEQ ID NO: 3391644 - RNA, 14 nt, Human
ucccauucccuggg

SEQ ID NO: 3391645 - RNA, 15 nt, Human
ucccauucccuggga

SEQ ID NO: 3391646 - RNA, 15 nt, Human
ucccauucuaugugu

SEQ ID NO: 3391647 - RNA, 16 nt, Human
ucccauucuccauuug

SEQ ID NO: 3391648 - RNA, 16 nt, Human
ucccauucuuggccca

SEQ ID NO: 3391649 - RNA, 19 nt, Human
ucccauugucccucugccc

SEQ ID NO: 3391650 - RNA, 21 nt, Human
ucccauugucccucugcccca

SEQ ID NO: 3391651 - RNA, 19 nt, Human
ucccauugucuucugaccu

SEQ ID NO: 3391652 - RNA, 15 nt, Human
ucccauuuagaaugg

SEQ ID NO: 3391653 - RNA, 15 nt, Human
ucccauuucucacug

SEQ ID NO: 3391654 - RNA, 14 nt, Human
ucccauuuguaauu

SEQ ID NO: 3391655 - RNA, 16 nt, Human
ucccauuugugccaga

SEQ ID NO: 3391656 - RNA, 17 nt, Human
ucccauuugugccagag

SEQ ID NO: 3391657 - RNA, 19 nt, Human
ucccauuugugccagagga

SEQ ID NO: 3391658 - RNA, 23 nt, Human
ucccauuuucagacugcuuuaaa

SEQ ID NO: 3391659 - RNA, 13 nt, Human
ucccauuuugcaa

SEQ ID NO: 3391660 - RNA, 21 nt, Human
ucccauuuugcaaaauuucca

SEQ ID NO: 3391661 - RNA, 22 nt, Human
ucccauuuugcaaaauuuccag

SEQ ID NO: 3391662 - RNA, 19 nt, Human
ucccauuuuggaaguuuuc

SEQ ID NO: 3391663 - RNA, 20 nt, Human
ucccauuuuggaaguuuuca

SEQ ID NO: 3391664 - RNA, 14 nt, Human
uccccaaaggcuuu

SEQ ID NO: 3391665 - RNA, 22 nt, Human
uccccaaaggcuuugcccugcu

SEQ ID NO: 3391666 - RNA, 19 nt, Human
uccccaaauccgaaccucc

SEQ ID NO: 3391667 - RNA, 14 nt, Human
uccccaacagugug

SEQ ID NO: 3391668 - RNA, 16 nt, Human
uccccaacagugugaa

SEQ ID NO: 3391669 - RNA, 20 nt, Human
uccccaacagugugaaguua

SEQ ID NO: 3391670 - RNA, 21 nt, Human
uccccaacagugugaaguuag

SEQ ID NO: 3391671 - RNA, 23 nt, Human
uccccaacagugugaaguuagaa

SEQ ID NO: 3391672 - RNA, 16 nt, Human
uccccaacccccaacu

SEQ ID NO: 3391673 - RNA, 22 nt, Human
uccccaacccuagguucccugu

SEQ ID NO: 3391674 - RNA, 20 nt, Human
uccccaacccugccccugcc

SEQ ID NO: 3391675 - RNA, 23 nt, Human
uccccaagauucacaccugacuc

SEQ ID NO: 3391676 - RNA, 15 nt, Human
uccccaagccuggca

SEQ ID NO: 3391677 - RNA, 19 nt, Human
uccccacagcgucccuggc

SEQ ID NO: 3391678 - RNA, 20 nt, Human
uccccacagcgucccuggcg

SEQ ID NO: 3391679 - RNA, 15 nt, Human
uccccaccaccccag

SEQ ID NO: 3391680 - RNA, 16 nt, Human
uccccaccagaugcug

SEQ ID NO: 3391681 - RNA, 21 nt, Human
uccccaccagugaaugaaagu

SEQ ID NO: 3391682 - RNA, 15 nt, Human
uccccaccaucugcu

SEQ ID NO: 3391683 - RNA, 18 nt, Human
uccccaccaucugcuguc

SEQ ID NO: 3391684 - RNA, 19 nt, Human
uccccaccaucugcugucu

SEQ ID NO: 3391685 - RNA, 13 nt, Human
uccccaccccugc

SEQ ID NO: 3391686 - RNA, 16 nt, Human
uccccaccccugcccc

SEQ ID NO: 3391687 - RNA, 18 nt, Human
uccccaccccugccccca

SEQ ID NO: 3391688 - RNA, 16 nt, Human
uccccacccuccacuc

SEQ ID NO: 3391689 - RNA, 23 nt, Human
uccccacccugaaagcccugagc

SEQ ID NO: 3391690 - RNA, 16 nt, Human
uccccaccgcagacag

SEQ ID NO: 3391691 - RNA, 22 nt, Human
uccccaccgcagacaggaccag

SEQ ID NO: 3391692 - RNA, 24 nt, Human
uccccaccgcagacaggaccaggg

SEQ ID NO: 3391693 - RNA, 20 nt, Human
uccccaccuucaauuccugg

SEQ ID NO: 3391694 - RNA, 15 nt, Human
uccccacgccacagc

SEQ ID NO: 3391695 - RNA, 16 nt, Human
uccccacgccacagcc

SEQ ID NO: 3391696 - RNA, 19 nt, Human
uccccacgcccuccccucc

SEQ ID NO: 3391697 - RNA, 19 nt, Human
uccccacugacagccuccc

SEQ ID NO: 3391698 - RNA, 18 nt, Human
uccccacugccuacugca

SEQ ID NO: 3391699 - RNA, 20 nt, Human
uccccacugccugcccaccc

SEQ ID NO: 3391700 - RNA, 15 nt, Human
uccccacuguaucua

SEQ ID NO: 3391701 - RNA, 22 nt, Human
uccccacuugagaauuacccuu

SEQ ID NO: 3391702 - RNA, 16 nt, Human
uccccagaccugagcu

SEQ ID NO: 3391703 - RNA, 12 nt, Human
uccccagagcac

SEQ ID NO: 3391704 - RNA, 19 nt, Human
uccccagauugcaacaggc

SEQ ID NO: 3391705 - RNA, 21 nt, Human
uccccagcagggucuuuucau

SEQ ID NO: 3391706 - RNA, 23 nt, Human
uccccagcagggucuuuucaucu

SEQ ID NO: 3391707 - RNA, 19 nt, Human
uccccagcagguggggagg

SEQ ID NO: 3391708 - RNA, 19 nt, Human
uccccagcaugcaccacgg

SEQ ID NO: 3391709 - RNA, 20 nt, Human
uccccagcauuccagccccu

SEQ ID NO: 3391710 - RNA, 13 nt, Human
uccccagccagcc

SEQ ID NO: 3391711 - RNA, 19 nt, Human
uccccagccagccuggcug

SEQ ID NO: 3391712 - RNA, 21 nt, Human
uccccagccagccuggcuggg

SEQ ID NO: 3391713 - RNA, 10 nt, Human
uccccagccc

SEQ ID NO: 3391714 - RNA, 13 nt, Human
uccccagcccacu

SEQ ID NO: 3391715 - RNA, 19 nt, Human
uccccagcccacuggauca

SEQ ID NO: 3391716 - RNA, 17 nt, Human
uccccagcccagagaca

SEQ ID NO: 3391717 - RNA, 23 nt, Human
uccccagcccaggguucccccag

SEQ ID NO: 3391718 - RNA, 19 nt, Human
uccuccaggccugccuccc

SEQ ID NO: 3391719 - RNA, 21 nt, Human
uccuccaggguggcagcaaca

SEQ ID NO: 3391720 - RNA, 10 nt, Human
uccuccaggu

SEQ ID NO: 3391721 - RNA, 12 nt, Human
uccuccaggugc

SEQ ID NO: 3391722 - RNA, 13 nt, Human
uccuccaggugca

SEQ ID NO: 3391723 - RNA, 18 nt, Human
uccuccaggugcacaagc

SEQ ID NO: 3391724 - RNA, 14 nt, Human
uccuccagguuuuu

SEQ ID NO: 3391725 - RNA, 20 nt, Human
uccuccagguuuuucaauua

SEQ ID NO: 3391726 - RNA, 22 nt, Human
uccuccagguuuuucaauuaaa

SEQ ID NO: 3391727 - RNA, 18 nt, Human
uccuccaguaccuugcuu

SEQ ID NO: 3391728 - RNA, 12 nt, Human
uccucccaccuc

SEQ ID NO: 3391729 - RNA, 15 nt, Human
uccucccaccucagc

SEQ ID NO: 3391730 - RNA, 22 nt, Human
uccucccagcuuguaggagcug

SEQ ID NO: 3391731 - RNA, 12 nt, Human
uccucccagggu

SEQ ID NO: 3391732 - RNA, 22 nt, Human
uccucccaggguuuuaacuuug

SEQ ID NO: 3391733 - RNA, 13 nt, Human
uccucccauguca

SEQ ID NO: 3391734 - RNA, 20 nt, Human
uccucccaugucacugcaga

SEQ ID NO: 3391735 - RNA, 14 nt, Human
uccuccccacccuc

SEQ ID NO: 3391736 - RNA, 18 nt, Human
uccuccccacccuccugg

SEQ ID NO: 3391737 - RNA, 19 nt, Human
uccuccccacccuccuggc

SEQ ID NO: 3391738 - RNA, 21 nt, Human
uccuccccacuuguccgcugg

SEQ ID NO: 3391739 - RNA, 10 nt, Human
uccuccccag

SEQ ID NO: 3391740 - RNA, 13 nt, Human
uccuccccagcag

SEQ ID NO: 3391741 - RNA, 22 nt, Human
uccuccccauuagagucagccu

SEQ ID NO: 3391742 - RNA, 14 nt, Human
uccuccccucaagg

SEQ ID NO: 3391743 - RNA, 14 nt, Human
uccuccccucacag

SEQ ID NO: 3391744 - RNA, 19 nt, Human
uccuccccucacagccucu

SEQ ID NO: 3391745 - RNA, 23 nt, Human
uccuccccucacagccucugacc

SEQ ID NO: 3391746 - RNA, 16 nt, Human
uccuccccuccuccug

SEQ ID NO: 3391747 - RNA, 14 nt, Human
uccuccccucucuu

SEQ ID NO: 3391748 - RNA, 14 nt, Human
uccuccccuggacu

SEQ ID NO: 3391749 - RNA, 15 nt, Human
uccuccccuggacuc

SEQ ID NO: 3391750 - RNA, 15 nt, Human
uccuccccuggaggg

SEQ ID NO: 3391751 - RNA, 13 nt, Human
uccuccccuuccc

SEQ ID NO: 3391752 - RNA, 15 nt, Human
uccuccccuucccug

SEQ ID NO: 3391753 - RNA, 17 nt, Human
uccuccccuucccugca

SEQ ID NO: 3391754 - RNA, 14 nt, Human
uccucccgggcccu

SEQ ID NO: 3391755 - RNA, 17 nt, Human
uccucccgggcccuccc

SEQ ID NO: 3391756 - RNA, 12 nt, Human
uccucccuccac

SEQ ID NO: 3391757 - RNA, 13 nt, Human
uccucccuccugc

SEQ ID NO: 3391758 - RNA, 19 nt, Human
uccucccucugaggcugua

SEQ ID NO: 3391759 - RNA, 20 nt, Human
uccucccugacuuuucugug

SEQ ID NO: 3391760 - RNA, 15 nt, Human
uccucccugauguac

SEQ ID NO: 3391761 - RNA, 17 nt, Human
uccucccugauguacag

SEQ ID NO: 3391762 - RNA, 22 nt, Human
uccucccugcaucugaccagca

SEQ ID NO: 3391763 - RNA, 22 nt, Human
uccucccuggcugcccuggccc

SEQ ID NO: 3391764 - RNA, 22 nt, Human
uccucccuuccuuuucccugcu

SEQ ID NO: 3391765 - RNA, 13 nt, Human
uccucccuucugc

SEQ ID NO: 3391766 - RNA, 16 nt, Human
uccucccuucugcuac

SEQ ID NO: 3391767 - RNA, 19 nt, Human
uccucccuuuccuuccuaa

SEQ ID NO: 3391768 - RNA, 19 nt, Human
uccucccuuuuuccuuguc

SEQ ID NO: 3391769 - RNA, 23 nt, Human
uccuccgagccggggaguuucuu

SEQ ID NO: 3391770 - RNA, 23 nt, Human
uccuccgguugcauacuggacuc

SEQ ID NO: 3391771 - RNA, 14 nt, Human
uccuccguccagcc

SEQ ID NO: 3391772 - RNA, 18 nt, Human
uccuccgugcuuccucag

SEQ ID NO: 3391773 - RNA, 14 nt, Human
uccuccuccaccac

SEQ ID NO: 3391774 - RNA, 15 nt, Human
uccuccuccaccacc

SEQ ID NO: 3391775 - RNA, 13 nt, Human
uccuccuccaggg

SEQ ID NO: 3391776 - RNA, 20 nt, Human
uccuccucccacccggcugc

SEQ ID NO: 3391777 - RNA, 13 nt, Human
uccuccucccugc

SEQ ID NO: 3391778 - RNA, 18 nt, Human
uccuccuccuuccuaguu

SEQ ID NO: 3391779 - RNA, 14 nt, Human
uccuccucugacuu

SEQ ID NO: 3391780 - RNA, 11 nt, Human
uccuccucugu

SEQ ID NO: 3391781 - RNA, 12 nt, Human
uccuccucugug

SEQ ID NO: 3391782 - RNA, 12 nt, Human
uccuccugcaga

SEQ ID NO: 3391783 - RNA, 20 nt, Human
uccuccugcagaccacgccc

SEQ ID NO: 3391784 - RNA, 17 nt, Human
uccuccugcccaccugu

SEQ ID NO: 3391785 - RNA, 18 nt, Human
uccuccuggaaccuugcu

SEQ ID NO: 3391786 - RNA, 21 nt, Human
uccuccuggaaccuugcuguc

SEQ ID NO: 3391787 - RNA, 14 nt, Human
uccuccugggcccu

SEQ ID NO: 3391788 - RNA, 22 nt, Human
uccuccugguggguccaggggc

SEQ ID NO: 3391789 - RNA, 13 nt, Human
uccuccuuccaug

SEQ ID NO: 3391790 - RNA, 21 nt, Human
uccuccuuuucacaguucucu

SEQ ID NO: 3391791 - RNA, 14 nt, Human
uccuccuuuuucca

SEQ ID NO: 3391792 - RNA, 20 nt, Human
uccucgaugggagggauggc

SEQ ID NO: 3391793 - RNA, 14 nt, Human
uccucgcagagagg

SEQ ID NO: 3391794 - RNA, 17 nt, Human
uccucgcagagaggcca

SEQ ID NO: 3391795 - RNA, 21 nt, Human
uccucgcagccucucagugcc

SEQ ID NO: 3391796 - RNA, 24 nt, Human
uccucgccugacaaccacuggucu

SEQ ID NO: 3391797 - RNA, 14 nt, Human
uccucggaaccgcu

SEQ ID NO: 3391798 - RNA, 19 nt, Human
uccucggaucaccgagagu

SEQ ID NO: 3391799 - RNA, 14 nt, Human
uccucggcccccuc

SEQ ID NO: 3391800 - RNA, 16 nt, Human
uccucgguacucccau

SEQ ID NO: 3391801 - RNA, 21 nt, Human
uccucguucucccugggaggc

SEQ ID NO: 3391802 - RNA, 15 nt, Human
uccucguuuguguuc

SEQ ID NO: 3391803 - RNA, 16 nt, Human
uccucuaacuuggcuc

SEQ ID NO: 3391804 - RNA, 19 nt, Human
uccucuacuaacaaucagc

SEQ ID NO: 3391805 - RNA, 19 nt, Human
uccucuacuuaaugagaua

SEQ ID NO: 3391806 - RNA, 16 nt, Human
uccucuagaagccaag

SEQ ID NO: 3391807 - RNA, 17 nt, Human
uccucuagaagccaagg

SEQ ID NO: 3391808 - RNA, 21 nt, Human
uccucuaggaggucucuaaga

SEQ ID NO: 3391809 - RNA, 20 nt, Human
uccucuauacaucucucccc

SEQ ID NO: 3391810 - RNA, 14 nt, Human
uccucuauccuggg

SEQ ID NO: 3391811 - RNA, 17 nt, Human
uccucucaccucagccu

SEQ ID NO: 3391812 - RNA, 20 nt, Human
uccucucauccuuuucuccu

SEQ ID NO: 3391813 - RNA, 13 nt, Human
uccucuccaccua

SEQ ID NO: 3391814 - RNA, 17 nt, Human
uccucuccacugccuuc

SEQ ID NO: 3391815 - RNA, 11 nt, Human
uccucuccagg

SEQ ID NO: 3391816 - RNA, 12 nt, Human
uccucuccaggc

SEQ ID NO: 3391817 - RNA, 14 nt, Human
uccucucccauccc

SEQ ID NO: 3391818 - RNA, 22 nt, Human
uccucucccaucccccugcccu

SEQ ID NO: 3391819 - RNA, 18 nt, Human
uccucucccauugucccu

SEQ ID NO: 3391820 - RNA, 20 nt, Human
uccucucccauugucccucu

SEQ ID NO: 3391821 - RNA, 12 nt, Human
uccucuccccag

SEQ ID NO: 3391822 - RNA, 23 nt, Human
uccucuccccagcccagagacau

SEQ ID NO: 3391823 - RNA, 16 nt, Human
uccucuccccuccagc

SEQ ID NO: 3391824 - RNA, 17 nt, Human
uccucuccccucuaagg

SEQ ID NO: 3391825 - RNA, 19 nt, Human
uccucuccccucuaaggcc

SEQ ID NO: 3391826 - RNA, 15 nt, Human
uccucuccuggagga

SEQ ID NO: 3391827 - RNA, 13 nt, Human
uccucuccugucu

SEQ ID NO: 3391828 - RNA, 23 nt, Human
uccucuccuuugaaaccugcucu

SEQ ID NO: 3391829 - RNA, 15 nt, Human
uccucucgcggcccu

SEQ ID NO: 3391830 - RNA, 16 nt, Human
uccucucuaaccuccu

SEQ ID NO: 3391831 - RNA, 19 nt, Human
uccucucuaaccuccuuua

SEQ ID NO: 3391832 - RNA, 21 nt, Human
uccucucuaaccuccuuuacc

SEQ ID NO: 3391833 - RNA, 14 nt, Human
uccucucuauauuu

SEQ ID NO: 3391834 - RNA, 13 nt, Human
uccucucugcccu

SEQ ID NO: 3391835 - RNA, 19 nt, Human
uccucucuggggcuguguu

SEQ ID NO: 3391836 - RNA, 17 nt, Human
uccucucuuccucuucc

SEQ ID NO: 3391837 - RNA, 17 nt, Human
uccucucuuuguucuca

SEQ ID NO: 3391838 - RNA, 20 nt, Human
uccucucuuuguucucagcu

SEQ ID NO: 3391839 - RNA, 21 nt, Human
uccucucuuuguucucagcuc

SEQ ID NO: 3391840 - RNA, 10 nt, Human
uccucugaaa

SEQ ID NO: 3391841 - RNA, 11 nt, Human
uccucugaaac

SEQ ID NO: 3391842 - RNA, 15 nt, Human
uccucugaaacagcu

SEQ ID NO: 3391843 - RNA, 21 nt, Human
uccucugaaacagcugccuua

SEQ ID NO: 3391844 - RNA, 16 nt, Human
uccucugacucagggc

SEQ ID NO: 3391845 - RNA, 17 nt, Human
uccucugacucagggcu

SEQ ID NO: 3391846 - RNA, 13 nt, Human
uccucugagccuu

SEQ ID NO: 3391847 - RNA, 15 nt, Human
uccucugauacccag

SEQ ID NO: 3391848 - RNA, 16 nt, Human
uccucugcagcugacc

SEQ ID NO: 3391849 - RNA, 17 nt, Human
uccucugcagcugaccu

SEQ ID NO: 3391850 - RNA, 20 nt, Human
uccucugcagcugaccucug

SEQ ID NO: 3391851 - RNA, 13 nt, Human
uccucugcagugc

SEQ ID NO: 3391852 - RNA, 15 nt, Human
uccucugcagugccu

SEQ ID NO: 3391853 - RNA, 15 nt, Human
uccucugccaccucc

SEQ ID NO: 3391854 - RNA, 12 nt, Human
uccucugccuca

SEQ ID NO: 3391855 - RNA, 13 nt, Human
uccucugccugcc

SEQ ID NO: 3391856 - RNA, 20 nt, Human
uccucugcucccccuuuucc

SEQ ID NO: 3391857 - RNA, 21 nt, Human
uccucugcugaccugcugacc

SEQ ID NO: 3391858 - RNA, 14 nt, Human
uccucugcugcugg

SEQ ID NO: 3391859 - RNA, 15 nt, Human
uccucugcuugccau

SEQ ID NO: 3391860 - RNA, 16 nt, Human
uccucugcuugccauc

SEQ ID NO: 3391861 - RNA, 19 nt, Human
uccucugcuugccaucccu

SEQ ID NO: 3391862 - RNA, 18 nt, Human
uccucuggacggcaggcu

SEQ ID NO: 3391863 - RNA, 20 nt, Human
uccucuggacggcaggcuca

SEQ ID NO: 3391864 - RNA, 17 nt, Human
uccucuggagccagccg

SEQ ID NO: 3391865 - RNA, 15 nt, Human
uccucuggccugugu

SEQ ID NO: 3391866 - RNA, 23 nt, Human
uccucuggcuggcuaacuggaag

SEQ ID NO: 3391867 - RNA, 22 nt, Human
uccucuggcuuggccacagcca

SEQ ID NO: 3391868 - RNA, 20 nt, Human
uccucugggcaggaccucag

SEQ ID NO: 3391869 - RNA, 17 nt, Human
uccucauguucugcuuu

SEQ ID NO: 3391870 - RNA, 15 nt, Human
uccucauucaaaggg

SEQ ID NO: 3391871 - RNA, 22 nt, Human
uccucauucccucgucuuuccc

SEQ ID NO: 3391872 - RNA, 23 nt, Human
uccucauucccucgucuuuccca

SEQ ID NO: 3391873 - RNA, 15 nt, Human
uccucauuucuccag

SEQ ID NO: 3391874 - RNA, 23 nt, Human
uccucauuugggguagcuagagg

SEQ ID NO: 3391875 - RNA, 17 nt, Human
uccuccaacaccaagca

SEQ ID NO: 3391876 - RNA, 21 nt, Human
uccuccaagacacuguggacu

SEQ ID NO: 3391877 - RNA, 12 nt, Human
uccuccaagcca

SEQ ID NO: 3391878 - RNA, 23 nt, Human
uccuccacauccuuucuaaacaa

SEQ ID NO: 3391879 - RNA, 13 nt, Human
uccuccacauuug

SEQ ID NO: 3391880 - RNA, 18 nt, Human
uccuccaccgccauggcu

SEQ ID NO: 3391881 - RNA, 20 nt, Human
uccuccaccugccguggacu

SEQ ID NO: 3391882 - RNA, 12 nt, Human
uccuccacgccu

SEQ ID NO: 3391883 - RNA, 21 nt, Human
uccuccacguucugcucauca

SEQ ID NO: 3391884 - RNA, 23 nt, Human
uccuccacucucccccacccccu

SEQ ID NO: 3391885 - RNA, 11 nt, Human
uccuccagaac

SEQ ID NO: 3391886 - RNA, 13 nt, Human
uccuccagaacuc

SEQ ID NO: 3391887 - RNA, 16 nt, Human
uccuccagaacucuuc

SEQ ID NO: 3391888 - RNA, 12 nt, Human
uccuccagcagg

SEQ ID NO: 3391889 - RNA, 18 nt, Human
uccuccagccccuguccc

SEQ ID NO: 3391890 - RNA, 15 nt, Human
uccuccaggaagccu

SEQ ID NO: 3391891 - RNA, 17 nt, Human
uccuccaggagcuucuu

SEQ ID NO: 3391892 - RNA, 19 nt, Human
uccuccaggagcuucuugu

SEQ ID NO: 3391893 - RNA, 13 nt, Human
uccuccaggccug

SEQ ID NO: 3391894 - RNA, 15 nt, Human
uccuuuucuucuaug

SEQ ID NO: 3391895 - RNA, 14 nt, Human
uccuuuucuugcuu

SEQ ID NO: 3391896 - RNA, 18 nt, Human
uccuuuucuuguuuauca

SEQ ID NO: 3391897 - RNA, 23 nt, Human
uccuuuucuuguuuaucagcagu

SEQ ID NO: 3391898 - RNA, 23 nt, Human
uccuuuucuuuuguuacuguucu

SEQ ID NO: 3391899 - RNA, 13 nt, Human
uccuuuugacacu

SEQ ID NO: 3391900 - RNA, 14 nt, Human
uccuuuugacacug

SEQ ID NO: 3391901 - RNA, 18 nt, Human
uccuuuugaccuucauuu

SEQ ID NO: 3391902 - RNA, 20 nt, Human
uccuuuugaccuucauuuca

SEQ ID NO: 3391903 - RNA, 13 nt, Human
uccuuuugcuuga

SEQ ID NO: 3391904 - RNA, 23 nt, Human
uccuuuuggagucagacagaugu

SEQ ID NO: 3391905 - RNA, 12 nt, Human
uccuuuuguaaa

SEQ ID NO: 3391906 - RNA, 13 nt, Human
uccuuuuguaaag

SEQ ID NO: 3391907 - RNA, 14 nt, Human
uccuuuuguaaagu

SEQ ID NO: 3391908 - RNA, 12 nt, Human
uccuuuuguaga

SEQ ID NO: 3391909 - RNA, 12 nt, Human
uccuuuuguguu

SEQ ID NO: 3391910 - RNA, 19 nt, Human
uccuuuuuaaccauuccaa

SEQ ID NO: 3391911 - RNA, 12 nt, Human
uccuuuuuaaua

SEQ ID NO: 3391912 - RNA, 14 nt, Human
uccuuuuuauuuau

SEQ ID NO: 3391913 - RNA, 23 nt, Human
uccuuuuuauuuauauguaugug

SEQ ID NO: 3391914 - RNA, 14 nt, Human
uccuuuuucucccu

SEQ ID NO: 3391915 - RNA, 20 nt, Human
uccuuuuucugauuagcuuu

SEQ ID NO: 3391916 - RNA, 19 nt, Human
uccuuuuucuuuauaaacu

SEQ ID NO: 3391917 - RNA, 16 nt, Human
uccuuuuugguuuuua

SEQ ID NO: 3391918 - RNA, 13 nt, Human
uccuuuuuguuau

SEQ ID NO: 3391919 - RNA, 12 nt, Human
ucgaaaaaauaa

SEQ ID NO: 3391920 - RNA, 21 nt, Human
ucgaaaagagucuuccaauua

SEQ ID NO: 3391921 - RNA, 19 nt, Human
ucgaaaauucauuucacau

SEQ ID NO: 3391922 - RNA, 19 nt, Human
ucgaaaccugggauucagg

SEQ ID NO: 3391923 - RNA, 14 nt, Human
ucgaaagcucuaga

SEQ ID NO: 3391924 - RNA, 16 nt, Human
ucgaaauaacaauguu

SEQ ID NO: 3391925 - RNA, 20 nt, Human
ucgaaauaacaauguuaagg

SEQ ID NO: 3391926 - RNA, 18 nt, Human
ucgaaccguuuugaagcu

SEQ ID NO: 3391927 - RNA, 18 nt, Human
ucgaacuucacaacuagg

SEQ ID NO: 3391928 - RNA, 23 nt, Human
ucgaagcgcgccacucgcuuccc

SEQ ID NO: 3391929 - RNA, 15 nt, Human
ucgaagcucagccca

SEQ ID NO: 3391930 - RNA, 15 nt, Human
ucgaaugaaaagaca

SEQ ID NO: 3391931 - RNA, 17 nt, Human
ucgaaugaaauuaacug

SEQ ID NO: 3391932 - RNA, 15 nt, Human
ucgaaugacacuguu

SEQ ID NO: 3391933 - RNA, 22 nt, Human
ucgaauuuuguuuucuugauuu

SEQ ID NO: 3391934 - RNA, 21 nt, Human
ucgacacgugggcuccccucu

SEQ ID NO: 3391935 - RNA, 17 nt, Human
ucgacagugaauauuca

SEQ ID NO: 3391936 - RNA, 17 nt, Human
ucgaccaauucaacccu

SEQ ID NO: 3391937 - RNA, 18 nt, Human
ucgaccugauuuacaguu

SEQ ID NO: 3391938 - RNA, 19 nt, Human
ucgaccugauuuacaguuu

SEQ ID NO: 3391939 - RNA, 22 nt, Human
ucgaccugcggcugcugugugc

SEQ ID NO: 3391940 - RNA, 22 nt, Human
ucgacgcccgaguuagccucac

SEQ ID NO: 3391941 - RNA, 17 nt, Human
ucgacugugaccugugg

SEQ ID NO: 3391942 - RNA, 14 nt, Human
ucgacuugcauuuu

SEQ ID NO: 3391943 - RNA, 12 nt, Human
ucgacuuuucuu

SEQ ID NO: 3391944 - RNA, 18 nt, Human
ucgagaaacagccugugu

SEQ ID NO: 3391945 - RNA, 21 nt, Human
ucgagaagcugcucuggaauu

SEQ ID NO: 3391946 - RNA, 16 nt, Human
ucgagaccagccuggc

SEQ ID NO: 3391947 - RNA, 18 nt, Human
ucgagaccagccuggcca

SEQ ID NO: 3391948 - RNA, 23 nt, Human
ucgagaucccaacacugccagca

SEQ ID NO: 3391949 - RNA, 20 nt, Human
ucgagauuaucguuuucuua

SEQ ID NO: 3391950 - RNA, 17 nt, Human
ucgagcagcauuuuauu

SEQ ID NO: 3391951 - RNA, 20 nt, Human
ucgagcagggugcugugggu

SEQ ID NO: 3391952 - RNA, 15 nt, Human
ucgagcaugccugga

SEQ ID NO: 3391953 - RNA, 18 nt, Human
ucgagcgcccugcagacc

SEQ ID NO: 3391954 - RNA, 18 nt, Human
ucucaugugauccuuuua

SEQ ID NO: 3391955 - RNA, 15 nt, Human
ucucauguguuugca

SEQ ID NO: 3391956 - RNA, 22 nt, Human
ucucauguugaagccacugccu

SEQ ID NO: 3391957 - RNA, 16 nt, Human
ucucauuaaaagaaua

SEQ ID NO: 3391958 - RNA, 19 nt, Human
ucucauuaauacucuuuau

SEQ ID NO: 3391959 - RNA, 14 nt, Human
ucucauuacuuguu

SEQ ID NO: 3391960 - RNA, 17 nt, Human
ucucauuccaacaguga

SEQ ID NO: 3391961 - RNA, 14 nt, Human
ucucauuccccagg

SEQ ID NO: 3391962 - RNA, 16 nt, Human
ucucauuccccaggug

SEQ ID NO: 3391963 - RNA, 13 nt, Human
ucucauucuuguu

SEQ ID NO: 3391964 - RNA, 15 nt, Human
ucucauugcuuacaa

SEQ ID NO: 3391965 - RNA, 19 nt, Human
ucucauuggacccuuccau

SEQ ID NO: 3391966 - RNA, 15 nt, Human
ucucauuuaagggaa

SEQ ID NO: 3391967 - RNA, 18 nt, Human
ucucauuuaagggaaaaa

SEQ ID NO: 3391968 - RNA, 18 nt, Human
ucucauuuagccuguccu

SEQ ID NO: 3391969 - RNA, 22 nt, Human
ucucauuuagccuguccuguca

SEQ ID NO: 3391970 - RNA, 17 nt, Human
ucucauuucaccccucc

SEQ ID NO: 3391971 - RNA, 22 nt, Human
ucucauuucaccccucccuuuc

SEQ ID NO: 3391972 - RNA, 23 nt, Human
ucucauuugguuugauuuucccu

SEQ ID NO: 3391973 - RNA, 14 nt, Human
ucucauuugucaca

SEQ ID NO: 3391974 - RNA, 16 nt, Human
ucucauuugucacaca

SEQ ID NO: 3391975 - RNA, 16 nt, Human
ucucauuuuaauguaa

SEQ ID NO: 3391976 - RNA, 19 nt, Human
ucucauuuuaauguaaaga

SEQ ID NO: 3391977 - RNA, 20 nt, Human
ucucauuuuaauguaaagau

SEQ ID NO: 3391978 - RNA, 17 nt, Human
ucucauuuuuccguaaa

SEQ ID NO: 3391979 - RNA, 23 nt, Human
ucuccaaaaaaaaaaaaaauaca

SEQ ID NO: 3391980 - RNA, 19 nt, Human
ucuccaaaaaucugccugg

SEQ ID NO: 3391981 - RNA, 12 nt, Human
ucuccaaagcuu

SEQ ID NO: 3391982 - RNA, 12 nt, Human
ucuccaaaugag

SEQ ID NO: 3391983 - RNA, 24 nt, Human
ucuccaaaugagaucuaagccuuu

SEQ ID NO: 3391984 - RNA, 17 nt, Human
ucuccaaccccccagca

SEQ ID NO: 3391985 - RNA, 18 nt, Human
ucuccaaccccccagcac

SEQ ID NO: 3391986 - RNA, 23 nt, Human
ucuccaaccccccagcacugagg

SEQ ID NO: 3391987 - RNA, 18 nt, Human
ucuccaagaaugcugaaa

SEQ ID NO: 3391988 - RNA, 19 nt, Human
ucuccaagcaggacaugga

SEQ ID NO: 3391989 - RNA, 16 nt, Human
ucuccaaggaccaggu

SEQ ID NO: 3391990 - RNA, 22 nt, Human
ucuccaagggcuucugcacccu

SEQ ID NO: 3391991 - RNA, 17 nt, Human
ucuccaagucucagugg

SEQ ID NO: 3391992 - RNA, 18 nt, Human
ucuccaauaucagugcuc

SEQ ID NO: 3391993 - RNA, 19 nt, Human
ucuccacagcaaccccagg

SEQ ID NO: 3391994 - RNA, 18 nt, Human
ucuccaccaggaaccucu

SEQ ID NO: 3391995 - RNA, 19 nt, Human
ucuccacccccagcugcuu

SEQ ID NO: 3391996 - RNA, 14 nt, Human
ucuccacccuccca

SEQ ID NO: 3391997 - RNA, 12 nt, Human
ucuccacccugc

SEQ ID NO: 3391998 - RNA, 15 nt, Human
ucuccaccuaguggc

SEQ ID NO: 3391999 - RNA, 21 nt, Human
ucuccaccuaguggcugucca

SEQ ID NO: 3392000 - RNA, 17 nt, Human
ucuccaccugccaggga

SEQ ID NO: 3392001 - RNA, 20 nt, Human
ucucggagcaucccggagga

SEQ ID NO: 3392002 - RNA, 19 nt, Human
ucucggaguaucugggaac

SEQ ID NO: 3392003 - RNA, 14 nt, Human
ucucggcucagugc

SEQ ID NO: 3392004 - RNA, 14 nt, Human
ucucggugguacca

SEQ ID NO: 3392005 - RNA, 19 nt, Human
ucucgguugaaaccuguau

SEQ ID NO: 3392006 - RNA, 24 nt, Human
ucucguauagaagucuucaugaaa

SEQ ID NO: 3392007 - RNA, 21 nt, Human
ucucguccucguuuguguucu

SEQ ID NO: 3392008 - RNA, 14 nt, Human
ucucgucucuuuua

SEQ ID NO: 3392009 - RNA, 17 nt, Human
ucucgucuuccgucucc

SEQ ID NO: 3392010 - RNA, 18 nt, Human
ucucgucuuccgucuccc

SEQ ID NO: 3392011 - RNA, 19 nt, Human
ucucgucuuccgucucccc

SEQ ID NO: 3392012 - RNA, 20 nt, Human
ucucgugagucauuuaaaug

SEQ ID NO: 3392013 - RNA, 22 nt, Human
ucucgugauugauaagaaccuu

SEQ ID NO: 3392014 - RNA, 15 nt, Human
ucucguuucaaaaac

SEQ ID NO: 3392015 - RNA, 17 nt, Human
ucucguuugugauucuu

SEQ ID NO: 3392016 - RNA, 12 nt, Human
ucucguuuuucu

SEQ ID NO: 3392017 - RNA, 13 nt, Human
ucucuaaagcacu

SEQ ID NO: 3392018 - RNA, 23 nt, Human
ucucuaaagcacuaccgauucuu

SEQ ID NO: 3392019 - RNA, 13 nt, Human
ucucuaacaaugu

SEQ ID NO: 3392020 - RNA, 17 nt, Human
ucucuaacagcucagga

SEQ ID NO: 3392021 - RNA, 18 nt, Human
ucucuaacagcucaggau

SEQ ID NO: 3392022 - RNA, 14 nt, Human
ucucuaacagugga

SEQ ID NO: 3392023 - RNA, 18 nt, Human
ucucuaacucagaaacau

SEQ ID NO: 3392024 - RNA, 20 nt, Human
ucucuaacucagaaacauca

SEQ ID NO: 3392025 - RNA, 21 nt, Human
ucucuaacucagaaacaucag

SEQ ID NO: 3392026 - RNA, 13 nt, Human
ucucuaacuuauu

SEQ ID NO: 3392027 - RNA, 15 nt, Human
ucucuaauaagaaaa

SEQ ID NO: 3392028 - RNA, 23 nt, Human
ucucuaauauccacuuguccaug

SEQ ID NO: 3392029 - RNA, 18 nt, Human
ucucuacagguuugggua

SEQ ID NO: 3392030 - RNA, 14 nt, Human
ucucuacagugcca

SEQ ID NO: 3392031 - RNA, 13 nt, Human
ucucuaccagaua

SEQ ID NO: 3392032 - RNA, 23 nt, Human
ucucuacccaucuuaaaaacaac

SEQ ID NO: 3392033 - RNA, 14 nt, Human
ucucuaccuucucc

SEQ ID NO: 3392034 - RNA, 22 nt, Human
ucucuacuaaaaauacaaacaa

SEQ ID NO: 3392035 - RNA, 21 nt, Human
ucucuacugucucaguuuaca

SEQ ID NO: 3392036 - RNA, 12 nt, Human
ucucuagccacu

SEQ ID NO: 3392037 - RNA, 16 nt, Human
ucucuagggaaggcca

SEQ ID NO: 3392038 - RNA, 21 nt, Human
ucucuagggaaggccaccugc

SEQ ID NO: 3392039 - RNA, 22 nt, Human
ucucuagggaaggccaccugca

SEQ ID NO: 3392040 - RNA, 11 nt, Human
ucucuaguagu

SEQ ID NO: 3392041 - RNA, 12 nt, Human
ucucuaguaguu

SEQ ID NO: 3392042 - RNA, 16 nt, Human
ucucuauaccaauaaa

SEQ ID NO: 3392043 - RNA, 17 nt, Human
ucucuauaccaauaaag

SEQ ID NO: 3392044 - RNA, 18 nt, Human
ucucuaucauuaaaguuc

SEQ ID NO: 3392045 - RNA, 12 nt, Human
ucucuaucauuu

SEQ ID NO: 3392046 - RNA, 14 nt, Human
ucucuaucauuuaa

SEQ ID NO: 3392047 - RNA, 18 nt, Human
ucucuauccucucuuccu

SEQ ID NO: 3392048 - RNA, 14 nt, Human
ucucuauguaucaa

SEQ ID NO: 3392049 - RNA, 16 nt, Human
ucucuauguaucaaau

SEQ ID NO: 3392050 - RNA, 17 nt, Human
ucucuauuuaauauuua

SEQ ID NO: 3392051 - RNA, 18 nt, Human
ucucuauuugaauuauuu

SEQ ID NO: 3392052 - RNA, 15 nt, Human
ucucucaaauuguca

SEQ ID NO: 3392053 - RNA, 19 nt, Human
ucucucaacaccaugauuc

SEQ ID NO: 3392054 - RNA, 22 nt, Human
ucucucaacaccaugauuccuu

SEQ ID NO: 3392055 - RNA, 16 nt, Human
ucucucaauaugcuua

SEQ ID NO: 3392056 - RNA, 15 nt, Human
ucucucacuccuuga

SEQ ID NO: 3392057 - RNA, 21 nt, Human
ucucucacuuguuuuauuuaa

SEQ ID NO: 3392058 - RNA, 17 nt, Human
ucucucagaagggaggc

SEQ ID NO: 3392059 - RNA, 17 nt, Human
ucucucagccuuacauu

SEQ ID NO: 3392060 - RNA, 15 nt, Human
ucucucaggagcaca

SEQ ID NO: 3392061 - RNA, 21 nt, Human
ucucucaggagcacaggcagc

SEQ ID NO: 3392062 - RNA, 12 nt, Human
ucucucaggcca

SEQ ID NO: 3392063 - RNA, 16 nt, Human
ucucucagggccaggc

SEQ ID NO: 3392064 - RNA, 12 nt, Human
ucucucagguga

SEQ ID NO: 3392065 - RNA, 13 nt, Human
ucucucaggugaa

SEQ ID NO: 3392066 - RNA, 15 nt, Human
ucucucauacccucc

SEQ ID NO: 3392067 - RNA, 23 nt, Human
ucucucauccuccaguaccuugc

SEQ ID NO: 3392068 - RNA, 18 nt, Human
ucucucaucuguuacaca

SEQ ID NO: 3392069 - RNA, 15 nt, Human
ucucucaugaaccuc

SEQ ID NO: 3392070 - RNA, 17 nt, Human
ucucucaugaaccucaa

SEQ ID NO: 3392071 - RNA, 22 nt, Human
ucucucaugaaccucaagcugc

SEQ ID NO: 3392072 - RNA, 16 nt, Human
ucucucauugucugug

SEQ ID NO: 3392073 - RNA, 18 nt, Human
ucucuccacuuucagcug

SEQ ID NO: 3392074 - RNA, 14 nt, Human
ucucuccagccccu

SEQ ID NO: 3392075 - RNA, 17 nt, Human
ucucuccagccccugga

SEQ ID NO: 3392076 - RNA, 19 nt, Human
ucucuccaucagaggacac

SEQ ID NO: 3392077 - RNA, 11 nt, Human
ucucuccaucu

SEQ ID NO: 3392078 - RNA, 17 nt, Human
ucucuccaucuaccuuc

SEQ ID NO: 3392079 - RNA, 19 nt, Human
ucucuccauuucacuggcu

SEQ ID NO: 3392080 - RNA, 20 nt, Human
ucucucccaggggcuggcuu

SEQ ID NO: 3392081 - RNA, 23 nt, Human
ucucucccagucuacccagagaa

SEQ ID NO: 3392082 - RNA, 15 nt, Human
ucucucccauggagc

SEQ ID NO: 3392083 - RNA, 15 nt, Human
ucucucccugccaga

SEQ ID NO: 3392084 - RNA, 22 nt, Human
ucucucccugccagaggggaag

SEQ ID NO: 3392085 - RNA, 16 nt, Human
ucucuccucagacugc

SEQ ID NO: 3392086 - RNA, 11 nt, Human
ucucuccuccu

SEQ ID NO: 3392087 - RNA, 16 nt, Human
ucucuccuggccuauc

SEQ ID NO: 3392088 - RNA, 20 nt, Human
ucucuccuguaagccaaaga

SEQ ID NO: 3392089 - RNA, 14 nt, Human
ucucuccuguaccu

SEQ ID NO: 3392090 - RNA, 17 nt, Human
ucucuccuguaccucuu

SEQ ID NO: 3392091 - RNA, 22 nt, Human
ucucuccuguaccucuugagcc

SEQ ID NO: 3392092 - RNA, 14 nt, Human
ucucuccuguccaa

SEQ ID NO: 3392093 - RNA, 13 nt, Human
ucucuccuguccu

SEQ ID NO: 3392094 - RNA, 23 nt, Human
ucucucggcuccccauguguccu

SEQ ID NO: 3392095 - RNA, 15 nt, Human
ucucucgguuccacg

SEQ ID NO: 3392096 - RNA, 23 nt, Human
ucucucgguuccacgucccccug

SEQ ID NO: 3392097 - RNA, 19 nt, Human
ucucucuacuccuaccuca

SEQ ID NO: 3392098 - RNA, 12 nt, Human
ucucucuccugu

SEQ ID NO: 3392099 - RNA, 13 nt, Human
ucucucuccuguc

SEQ ID NO: 3392100 - RNA, 14 nt, Human
ucucucucucucuc

SEQ ID NO: 3392101 - RNA, 15 nt, Human
ucucucugcagcugc

SEQ ID NO: 3392102 - RNA, 17 nt, Human
ucucucugccugugagc

SEQ ID NO: 3392103 - RNA, 12 nt, Human
ucucucuggaaa

SEQ ID NO: 3392104 - RNA, 12 nt, Human
ucucucuggccc

SEQ ID NO: 3392105 - RNA, 20 nt, Human
ucucucuggggccacacaga

SEQ ID NO: 3392106 - RNA, 17 nt, Human
ucucucugugcugugga

SEQ ID NO: 3392107 - RNA, 11 nt, Human
ucucucugugg

SEQ ID NO: 3392108 - RNA, 14 nt, Human
ucucucuuaaaguu

SEQ ID NO: 3392109 - RNA, 18 nt, Human
ucucucuucagacucuca

SEQ ID NO: 3392110 - RNA, 20 nt, Human
ucucucuucagacucucagc

SEQ ID NO: 3392111 - RNA, 15 nt, Human
ucucucuucucagag

SEQ ID NO: 3392112 - RNA, 11 nt, Human
ucucucuuucc

SEQ ID NO: 3392113 - RNA, 13 nt, Human
ucucucuuuggac

SEQ ID NO: 3392114 - RNA, 16 nt, Human
ucucucuuuggacucu

SEQ ID NO: 3392115 - RNA, 15 nt, Human
ucucugaacacaggc

SEQ ID NO: 3392116 - RNA, 17 nt, Human
ucucugaacacaggcag

SEQ ID NO: 3392117 - RNA, 18 nt, Human
ucucugaacacaggcagc

SEQ ID NO: 3392118 - RNA, 19 nt, Human
ucucugaacacaggcagcu

SEQ ID NO: 3392119 - RNA, 21 nt, Human
ucucugaacacaggcagcuuu

SEQ ID NO: 3392120 - RNA, 13 nt, Human
ucucugaagauga

SEQ ID NO: 3392121 - RNA, 22 nt, Human
ucucugaagcauguuucauguu

SEQ ID NO: 3392122 - RNA, 13 nt, Human
ucucugaagccac

SEQ ID NO: 3392123 - RNA, 15 nt, Human
ucucugaaggaggcc

SEQ ID NO: 3392124 - RNA, 18 nt, Human
ucucugaaggaggccacc

SEQ ID NO: 3392125 - RNA, 18 nt, Human
ucucugacuucugccugg

SEQ ID NO: 3392126 - RNA, 13 nt, Human
ucucugaggacac

SEQ ID NO: 3392127 - RNA, 15 nt, Human
ucucugauacagaaa

SEQ ID NO: 3392128 - RNA, 23 nt, Human
ucucugauacuuuuuugaaauca

SEQ ID NO: 3392129 - RNA, 16 nt, Human
ucucugaugcagcuua

SEQ ID NO: 3392130 - RNA, 20 nt, Human
ucucugaugugauauccacu

SEQ ID NO: 3392131 - RNA, 19 nt, Human
ucucugauuuucaaagcuu

SEQ ID NO: 3392132 - RNA, 17 nt, Human
ucucugcaaacugccuu

SEQ ID NO: 3392133 - RNA, 19 nt, Human
ucucugcaaucuucucaga

SEQ ID NO: 3392134 - RNA, 15 nt, Human
aagcauuuaucauuc

SEQ ID NO: 3392135 - RNA, 19 nt, Human
aagcauuuaucauucuugu

SEQ ID NO: 3392136 - RNA, 15 nt, Human
aagcauuugaaugca

SEQ ID NO: 3392137 - RNA, 17 nt, Human
aagcauuuuauaaaucg

SEQ ID NO: 3392138 - RNA, 19 nt, Human
aagcauuuuauaaaucgcu

SEQ ID NO: 3392139 - RNA, 18 nt, Human
aagcauuuuucaauauau

SEQ ID NO: 3392140 - RNA, 19 nt, Human
aagcauuuuucaauauauu

SEQ ID NO: 3392141 - RNA, 17 nt, Human
aagccaaaaaccuuagc

SEQ ID NO: 3392142 - RNA, 21 nt, Human
aagccaaaaaccuuagcuccc

SEQ ID NO: 3392143 - RNA, 20 nt, Human
aagccaaaauuaagguguuu

SEQ ID NO: 3392144 - RNA, 22 nt, Human
aagccaaaauuaagguguuuga

SEQ ID NO: 3392145 - RNA, 17 nt, Human
aagccaaaccucuguga

SEQ ID NO: 3392146 - RNA, 15 nt, Human
aagccaaacucugcc

SEQ ID NO: 3392147 - RNA, 12 nt, Human
aagccaaagaaa

SEQ ID NO: 3392148 - RNA, 20 nt, Human
aagccaaagaaaugaacauu

SEQ ID NO: 3392149 - RNA, 12 nt, Human
aagccaaagagu

SEQ ID NO: 3392150 - RNA, 17 nt, Human
ucuggcaaugccacagc

SEQ ID NO: 3392151 - RNA, 22 nt, Human
ucuggcacacaguaggugcuca

SEQ ID NO: 3392152 - RNA, 14 nt, Human
ucuggcacagccug

SEQ ID NO: 3392153 - RNA, 16 nt, Human
ucuggcacagccugca

SEQ ID NO: 3392154 - RNA, 15 nt, Human
ucuggcagccacacu

SEQ ID NO: 3392155 - RNA, 16 nt, Human
ucuggcagccucccau

SEQ ID NO: 3392156 - RNA, 20 nt, Human
ucuggcagggugggauggag

SEQ ID NO: 3392157 - RNA, 11 nt, Human
ucuggccaggc

SEQ ID NO: 3392158 - RNA, 14 nt, Human
ucuggcccaccagg

SEQ ID NO: 3392159 - RNA, 21 nt, Human
ucuggccccacaccagcccca

SEQ ID NO: 3392160 - RNA, 13 nt, Human
ucuggcccuagac

SEQ ID NO: 3392161 - RNA, 16 nt, Human
ucuggcccugccuucu

SEQ ID NO: 3392162 - RNA, 17 nt, Human
ucuggccuaaaaucuug

SEQ ID NO: 3392163 - RNA, 13 nt, Human
ucuggccuagucc

SEQ ID NO: 3392164 - RNA, 18 nt, Human
ucuggccucaggugggcc

SEQ ID NO: 3392165 - RNA, 17 nt, Human
ucuggccucccacagac

SEQ ID NO: 3392166 - RNA, 14 nt, Human
ucuggccucccacc

SEQ ID NO: 3392167 - RNA, 15 nt, Human
ucuggccucccaccc

SEQ ID NO: 3392168 - RNA, 13 nt, Human
ucuggccuggcca

SEQ ID NO: 3392169 - RNA, 19 nt, Human
ucuggccuggccagugccc

SEQ ID NO: 3392170 - RNA, 16 nt, Human
ucuggccuggccuggc

SEQ ID NO: 3392171 - RNA, 17 nt, Human
ucuggccuggccuggcc

SEQ ID NO: 3392172 - RNA, 18 nt, Human
ucuggccuggccuggccc

SEQ ID NO: 3392173 - RNA, 20 nt, Human
ucuggccuggccuggcccug

SEQ ID NO: 3392174 - RNA, 10 nt, Human
ucuggccuuc

SEQ ID NO: 3392175 - RNA, 23 nt, Human
ucuggccuucggccuccauccug

SEQ ID NO: 3392176 - RNA, 21 nt, Human
ucuggccuuuccucucuccug

SEQ ID NO: 3392177 - RNA, 18 nt, Human
ucuggcgacaguuuuccu

SEQ ID NO: 3392178 - RNA, 16 nt, Human
ucuggcuaaggacagg

SEQ ID NO: 3392179 - RNA, 17 nt, Human
ucuggcuaugcauuuga

SEQ ID NO: 3392180 - RNA, 19 nt, Human
ucuggcuccucaaacagua

SEQ ID NO: 3392181 - RNA, 22 nt, Human
ucuggcucuaauucacagugcu

SEQ ID NO: 3392182 - RNA, 16 nt, Human
ucuggcucuacacaua

SEQ ID NO: 3392183 - RNA, 13 nt, Human
ucuggcucugucu

SEQ ID NO: 3392184 - RNA, 17 nt, Human
ucuggcucuuccaggcu

SEQ ID NO: 3392185 - RNA, 18 nt, Human
ucuggcucuuccaggcug

SEQ ID NO: 3392186 - RNA, 15 nt, Human
ucuggcugagcccug

SEQ ID NO: 3392187 - RNA, 14 nt, Human
ucuggcugagcuga

SEQ ID NO: 3392188 - RNA, 15 nt, Human
ucuggcugagcugaa

SEQ ID NO: 3392189 - RNA, 18 nt, Human
ucuggcuuauuuuaaugu

SEQ ID NO: 3392190 - RNA, 19 nt, Human
ucuggcuucaaauauuaug

SEQ ID NO: 3392191 - RNA, 23 nt, Human
ucuggcuuccagaaaaccccagc

SEQ ID NO: 3392192 - RNA, 13 nt, Human
ucuggcuuccagg

SEQ ID NO: 3392193 - RNA, 19 nt, Human
ucuggcuucuggccaggaa

SEQ ID NO: 3392194 - RNA, 17 nt, Human
ucugggaaaauacccca

SEQ ID NO: 3392195 - RNA, 18 nt, Human
ucugggaaauaagagaga

SEQ ID NO: 3392196 - RNA, 22 nt, Human
ucugggaaaugagaaggcagcc

SEQ ID NO: 3392197 - RNA, 22 nt, Human
ucugggaaauggcuugaagcca

SEQ ID NO: 3392198 - RNA, 15 nt, Human
ucugggaaccuccca

SEQ ID NO: 3392199 - RNA, 18 nt, Human
ucugggaaccucccagag

SEQ ID NO: 3392200 - RNA, 16 nt, Human
ucugggaccucaguuu

SEQ ID NO: 3392201 - RNA, 22 nt, Human
ucugggaccugccaggcagggg

SEQ ID NO: 3392202 - RNA, 21 nt, Human
ucugggacuugguuuccccaa

SEQ ID NO: 3392203 - RNA, 22 nt, Human
ucugggagaaaaucaucaagaa

SEQ ID NO: 3392204 - RNA, 23 nt, Human
ucugggagaaaaucaucaagaag

SEQ ID NO: 3392205 - RNA, 19 nt, Human
ucugggaggaauggacaga

SEQ ID NO: 3392206 - RNA, 13 nt, Human
ucugggagggcag

SEQ ID NO: 3392207 - RNA, 19 nt, Human
ucugggagggcagcagggc

SEQ ID NO: 3392208 - RNA, 15 nt, Human
ucugggauucuacuu

SEQ ID NO: 3392209 - RNA, 18 nt, Human
ucugggcacacucugcca

SEQ ID NO: 3392210 - RNA, 18 nt, Human
ucugggcaccacaaaaua

SEQ ID NO: 3392211 - RNA, 20 nt, Human
ucugggcaccacaaaauaua

SEQ ID NO: 3392212 - RNA, 21 nt, Human
ucugggcaccacaaaauauac

SEQ ID NO: 3392213 - RNA, 20 nt, Human
ucugggcaggacucagcucc

SEQ ID NO: 3392214 - RNA, 21 nt, Human
ucugggcaggacucagcuccc

SEQ ID NO: 3392215 - RNA, 12 nt, Human
ucugggccaagu

SEQ ID NO: 3392216 - RNA, 19 nt, Human
ucugggccaaguuccucua

SEQ ID NO: 3392217 - RNA, 21 nt, Human
ucugggccauucuccacagca

SEQ ID NO: 3392218 - RNA, 19 nt, Human
ucugggccuuggccuggag

SEQ ID NO: 3392219 - RNA, 20 nt, Human
ucugggccuuggccuggagc

SEQ ID NO: 3392220 - RNA, 17 nt, Human
ucugggcuagguagaaa

SEQ ID NO: 3392221 - RNA, 21 nt, Human
ucugggcuauggacacagggu

SEQ ID NO: 3392222 - RNA, 12 nt, Human
ucugggcucuga

SEQ ID NO: 3392223 - RNA, 17 nt, Human
ucugggcugcuacccag

SEQ ID NO: 3392224 - RNA, 22 nt, Human
ucugggcugcuacccagaaauc

SEQ ID NO: 3392225 - RNA, 19 nt, Human
ucugggcuggaugagcucc

SEQ ID NO: 3392226 - RNA, 20 nt, Human
ucugggcuggaugagcuccc

SEQ ID NO: 3392227 - RNA, 22 nt, Human
ucugggcuguaacguggcacug

SEQ ID NO: 3392228 - RNA, 13 nt, Human
ucugggcuuccug

SEQ ID NO: 3392229 - RNA, 14 nt, Human
ucugggcuuccugg

SEQ ID NO: 3392230 - RNA, 22 nt, Human
ucugggcuuugauuccaucucc

SEQ ID NO: 3392231 - RNA, 23 nt, Human
ucuggggaaagacacugccuggg

SEQ ID NO: 3392232 - RNA, 13 nt, Human
ucuggggaccagc

SEQ ID NO: 3392233 - RNA, 23 nt, Human
ucuggggaccagcuuggcucagg

SEQ ID NO: 3392234 - RNA, 17 nt, Human
ucuggggagcaggcagc

SEQ ID NO: 3392235 - RNA, 22 nt, Human
ucuggggagcaggcagccagca

SEQ ID NO: 3392236 - RNA, 19 nt, Human
ucuggggagcgggucugcu

SEQ ID NO: 3392237 - RNA, 21 nt, Human
ucuggggcaggcugggccaug

SEQ ID NO: 3392238 - RNA, 16 nt, Human
ucuggggccacacaga

SEQ ID NO: 3392239 - RNA, 23 nt, Human
ucuggggccuaauaaaacugaug

SEQ ID NO: 3392240 - RNA, 15 nt, Human
ucuggggcucuggga

SEQ ID NO: 3392241 - RNA, 16 nt, Human
ucuggggcucugggau

SEQ ID NO: 3392242 - RNA, 15 nt, Human
ucugggggaguggaa

SEQ ID NO: 3392243 - RNA, 15 nt, Human
ucuuuuaccugcugc

SEQ ID NO: 3392244 - RNA, 19 nt, Human
ucuuuuauaacuaguccuu

SEQ ID NO: 3392245 - RNA, 16 nt, Human
ucuuuuauauuuguau

SEQ ID NO: 3392246 - RNA, 18 nt, Human
ucuuuuauauuuguaucg

SEQ ID NO: 3392247 - RNA, 15 nt, Human
ucuuuuaucuguuua

SEQ ID NO: 3392248 - RNA, 21 nt, Human
ucuuuuaucuguuuaaagcau

SEQ ID NO: 3392249 - RNA, 13 nt, Human
ucuuuuauguuug

SEQ ID NO: 3392250 - RNA, 21 nt, Human
ucuuuuauguuugaauaugga

SEQ ID NO: 3392251 - RNA, 12 nt, Human
ucuuuucacaaa

SEQ ID NO: 3392252 - RNA, 14 nt, Human
ucuuuucacaaaua

SEQ ID NO: 3392253 - RNA, 16 nt, Human
ucuuuucacaaauaaa

SEQ ID NO: 3392254 - RNA, 22 nt, Human
ucuuuucacauagcugucuaga

SEQ ID NO: 3392255 - RNA, 19 nt, Human
ucuuuucacauucuuauaa

SEQ ID NO: 3392256 - RNA, 23 nt, Human
ucuuuucauacauuuucuaagaa

SEQ ID NO: 3392257 - RNA, 16 nt, Human
ucuuuucauucucauu

SEQ ID NO: 3392258 - RNA, 22 nt, Human
ucuuuuccaaaauaaaacaaag

SEQ ID NO: 3392259 - RNA, 19 nt, Human
ucuuuucccacuguuuaag

SEQ ID NO: 3392260 - RNA, 19 nt, Human
ucuuuuccccuuuccuguc

SEQ ID NO: 3392261 - RNA, 13 nt, Human
ucuuuuccucgcu

SEQ ID NO: 3392262 - RNA, 16 nt, Human
ucuuuucuaaaagacu

SEQ ID NO: 3392263 - RNA, 17 nt, Human
ucuuuucuacccuagcc

SEQ ID NO: 3392264 - RNA, 14 nt, Human
ucuuuucuaguuug

SEQ ID NO: 3392265 - RNA, 15 nt, Human
ucuuuucugaaucuu

SEQ ID NO: 3392266 - RNA, 20 nt, Human
ucuuuucugaaucuucugaa

SEQ ID NO: 3392267 - RNA, 19 nt, Human
ucuuuucuggaauguaauc

SEQ ID NO: 3392268 - RNA, 17 nt, Human
ucuuuucuuacuccucc

SEQ ID NO: 3392269 - RNA, 16 nt, Human
ucuuuucuuuagagca

SEQ ID NO: 3392270 - RNA, 13 nt, Human
ucuuuucuuugua

SEQ ID NO: 3392271 - RNA, 15 nt, Human
ucuuuugaaacaaua

SEQ ID NO: 3392272 - RNA, 14 nt, Human
ucuuuugaauuguu

SEQ ID NO: 3392273 - RNA, 15 nt, Human
ucuuuugaauuguuu

SEQ ID NO: 3392274 - RNA, 20 nt, Human
ucuuuugacauguggaaagu

SEQ ID NO: 3392275 - RNA, 22 nt, Human
ucuuuugacuuaaucucauuug

SEQ ID NO: 3392276 - RNA, 17 nt, Human
ucuuuugcaugaugauc

SEQ ID NO: 3392277 - RNA, 17 nt, Human
ucuuuugcuacuaaguu

SEQ ID NO: 3392278 - RNA, 14 nt, Human
ucuuuuguaaauua

SEQ ID NO: 3392279 - RNA, 11 nt, Human
ucuuuuguaag

SEQ ID NO: 3392280 - RNA, 11 nt, Human
ucuuuuguaug

SEQ ID NO: 3392281 - RNA, 12 nt, Human
ucuuuuguauua

SEQ ID NO: 3392282 - RNA, 22 nt, Human
ucuuuuguuaaauaauauggcu

SEQ ID NO: 3392283 - RNA, 11 nt, Human
ucuuuuguuac

SEQ ID NO: 3392284 - RNA, 12 nt, Human
ucuuuuguuacu

SEQ ID NO: 3392285 - RNA, 18 nt, Human
ucuuuuguuacuguucuu

SEQ ID NO: 3392286 - RNA, 23 nt, Human
ucuuuuguuacuguucuugcugc

SEQ ID NO: 3392287 - RNA, 18 nt, Human
ucuuuuguuguuucuuaa

SEQ ID NO: 3392288 - RNA, 14 nt, Human
ucuuuuuaagcuua

SEQ ID NO: 3392289 - RNA, 15 nt, Human
ucuuuuuaaguaaug

SEQ ID NO: 3392290 - RNA, 15 nt, Human
ucuuuuuaauaaaaa

SEQ ID NO: 3392291 - RNA, 12 nt, Human
ucuuuuuauuga

SEQ ID NO: 3392292 - RNA, 13 nt, Human
ucuuuuuauugaa

SEQ ID NO: 3392293 - RNA, 14 nt, Human
ucuuuuugaaaugu

SEQ ID NO: 3392294 - RNA, 14 nt, Human
ucuuuuugaaguau

SEQ ID NO: 3392295 - RNA, 14 nt, Human
ucuuuuugaaucuu

SEQ ID NO: 3392296 - RNA, 17 nt, Human
ucuuuuugcucuaaaau

SEQ ID NO: 3392297 - RNA, 13 nt, Human
ucuuuuugcuguu

SEQ ID NO: 3392298 - RNA, 19 nt, Human
ucuuuuuuaaaugaagaaa

SEQ ID NO: 3392299 - RNA, 22 nt, Human
ucuuuuuuaaauuuucuucagu

SEQ ID NO: 3392300 - RNA, 12 nt, Human
ucuuuuuuaacc

SEQ ID NO: 3392301 - RNA, 21 nt, Human
ucuuuuuuaaccgguaagagu

SEQ ID NO: 3392302 - RNA, 17 nt, Human
ucuuuuuuaauaaacua

SEQ ID NO: 3392303 - RNA, 18 nt, Human
ucuuuuuuacaaaggcug

SEQ ID NO: 3392304 - RNA, 19 nt, Human
ucuuuuuuacucauugaaa

SEQ ID NO: 3392305 - RNA, 16 nt, Human
ucuuuuuuagcauaaa

SEQ ID NO: 3392306 - RNA, 22 nt, Human
ucuuuuuucuaaaguaaaaaca

SEQ ID NO: 3392307 - RNA, 22 nt, Human
ucuuuuuuggccaucugcuccu

SEQ ID NO: 3392308 - RNA, 15 nt, Human
ucuuuuuuucuuggc

SEQ ID NO: 3392309 - RNA, 15 nt, Human
ucuuuuuuuguauag

SEQ ID NO: 3392310 - RNA, 16 nt, Human
ucuuuuuuugugaugu

SEQ ID NO: 3392311 - RNA, 19 nt, Human
ucuuuuuuuuaaugugcug

SEQ ID NO: 3392312 - RNA, 15 nt, Human
ucuuuuuuuuuaagu

SEQ ID NO: 3392313 - RNA, 21 nt, Human
ugaaaaaaaaccugagauuua

SEQ ID NO: 3392314 - RNA, 22 nt, Human
ugaaaaaaaaccugagauuuau

SEQ ID NO: 3392315 - RNA, 16 nt, Human
ugaaaaaaaaguuuca

SEQ ID NO: 3392316 - RNA, 17 nt, Human
ugaaaaaaaguuuacaa

SEQ ID NO: 3392317 - RNA, 20 nt, Human
ugaaaaaaauuggcauuaaa

SEQ ID NO: 3392318 - RNA, 17 nt, Human
ugaaaaaagcuuuuaug

SEQ ID NO: 3392319 - RNA, 21 nt, Human
ugaaaaaaggacaauuucaaa

SEQ ID NO: 3392320 - RNA, 13 nt, Human
ugaaaaaauauau

SEQ ID NO: 3392321 - RNA, 18 nt, Human
ugaaaaaauguauaugca

SEQ ID NO: 3392322 - RNA, 17 nt, Human
ugaaaaacaacaacaca

SEQ ID NO: 3392323 - RNA, 13 nt, Human
ugaaaaacaacca

SEQ ID NO: 3392324 - RNA, 13 nt, Human
ugaaaaacugagu

SEQ ID NO: 3392325 - RNA, 23 nt, Human
ugaaaaacuggcaacauuccaag

SEQ ID NO: 3392326 - RNA, 13 nt, Human
ugaaaaagaagaa

SEQ ID NO: 3392327 - RNA, 15 nt, Human
ugaaaaagaugccaa

SEQ ID NO: 3392328 - RNA, 13 nt, Human
ugaaaaagcaugu

SEQ ID NO: 3392329 - RNA, 15 nt, Human
ugaaaaagcauguac

SEQ ID NO: 3392330 - RNA, 20 nt, Human
ugaaaaagcauguacagugu

SEQ ID NO: 3392331 - RNA, 20 nt, Human
ugaaaaagcuggauuuucuu

SEQ ID NO: 3392332 - RNA, 20 nt, Human
ugaaaaaggaggaagagaaa

SEQ ID NO: 3392333 - RNA, 22 nt, Human
ugaaaaaggaggaagagaaaaa

SEQ ID NO: 3392334 - RNA, 16 nt, Human
ugaaaaaguaaagugu

SEQ ID NO: 3392335 - RNA, 19 nt, Human
ugaaaaaguuaaugcuuaa

SEQ ID NO: 3392336 - RNA, 15 nt, Human
ugaaaaaguuuguuu

SEQ ID NO: 3392337 - RNA, 12 nt, Human
ugaaaaauauaa

SEQ ID NO: 3392338 - RNA, 17 nt, Human
ugaaaaauauaaaauua

SEQ ID NO: 3392339 - RNA, 13 nt, Human
ugaaaaaugaaag

SEQ ID NO: 3392340 - RNA, 17 nt, Human
ugaaaaaugaaagauga

SEQ ID NO: 3392341 - RNA, 18 nt, Human
ugaaaaaugaaagaugau

SEQ ID NO: 3392342 - RNA, 19 nt, Human
ugaaaaauuuaagcauugu

SEQ ID NO: 3392343 - RNA, 16 nt, Human
ugaaaacaagugcugg

SEQ ID NO: 3392344 - RNA, 18 nt, Human
ugaaaacaagugcuggca

SEQ ID NO: 3392345 - RNA, 21 nt, Human
ugaaaacaagugcuggcacca

SEQ ID NO: 3392346 - RNA, 17 nt, Human
ugaaaacacauuugcuu

SEQ ID NO: 3392347 - RNA, 14 nt, Human
ugaaaacacauuuu

SEQ ID NO: 3392348 - RNA, 19 nt, Human
ugaaaacacauuuuucuua

SEQ ID NO: 3392349 - RNA, 20 nt, Human
ugaaaacacauuuuucuuag

SEQ ID NO: 3392350 - RNA, 22 nt, Human
ugaaaacacuguucucugcccu

SEQ ID NO: 3392351 - RNA, 22 nt, Human
ugaaaacagaaauugguaccuu

SEQ ID NO: 3392352 - RNA, 14 nt, Human
ugaaaacagaaugu

SEQ ID NO: 3392353 - RNA, 17 nt, Human
ugaaaacaucuggaagg

SEQ ID NO: 3392354 - RNA, 15 nt, Human
ugaaaaccaaaauga

SEQ ID NO: 3392355 - RNA, 17 nt, Human
ugaaaaccaaaaugaca

SEQ ID NO: 3392356 - RNA, 22 nt, Human
ugaaaaccaucuggccuggccu

SEQ ID NO: 3392357 - RNA, 15 nt, Human
ugaaaaccuacauau

SEQ ID NO: 3392358 - RNA, 17 nt, Human
ugaaaacguuuuauugu

SEQ ID NO: 3392359 - RNA, 18 nt, Human
ugaaaacguuuuauugug

SEQ ID NO: 3392360 - RNA, 16 nt, Human
ugaaaacuaaguucuc

SEQ ID NO: 3392361 - RNA, 19 nt, Human
ugaaaacuacauuuuaaca

SEQ ID NO: 3392362 - RNA, 21 nt, Human
ugaaaacuacauuuuaacaug

SEQ ID NO: 3392363 - RNA, 14 nt, Human
ugaaaacuauacaa

SEQ ID NO: 3392364 - RNA, 14 nt, Human
ugaaaacuggaaua

SEQ ID NO: 3392365 - RNA, 23 nt, Human
ugaaaacuggaauaagaagcaaa

SEQ ID NO: 3392366 - RNA, 15 nt, Human
ugaaaacuucagaag

SEQ ID NO: 3392367 - RNA, 17 nt, Human
ugaaaacuuuucucaga

SEQ ID NO: 3392368 - RNA, 20 nt, Human
ugaaaagaaaaaugagccug

SEQ ID NO: 3392369 - RNA, 16 nt, Human
ugaaaagaaauaauaa

SEQ ID NO: 3392370 - RNA, 13 nt, Human
ugaaaagaauugu

SEQ ID NO: 3392371 - RNA, 16 nt, Human
ugaaaagacaagaaaa

SEQ ID NO: 3392372 - RNA, 19 nt, Human
ugaaaagacuccaaagaaa

SEQ ID NO: 3392373 - RNA, 21 nt, Human
ugaaaagagaaugaugcucaa

SEQ ID NO: 3392374 - RNA, 16 nt, Human
ugaaaagagacaggca

SEQ ID NO: 3392375 - RNA, 19 nt, Human
ugaaaagagagcagagaau

SEQ ID NO: 3392376 - RNA, 15 nt, Human
ugaagaucuaaauaa

SEQ ID NO: 3392377 - RNA, 18 nt, Human
ugaagaugcuuuuugauc

SEQ ID NO: 3392378 - RNA, 17 nt, Human
ugaagauggcauccugu

SEQ ID NO: 3392379 - RNA, 18 nt, Human
ugaagauggcauccugug

SEQ ID NO: 3392380 - RNA, 19 nt, Human
ugaagauggcauccuguga

SEQ ID NO: 3392381 - RNA, 15 nt, Human
ugaagaugggagccu

SEQ ID NO: 3392382 - RNA, 18 nt, Human
ugaagaugggggccucuu

SEQ ID NO: 3392383 - RNA, 13 nt, Human
ugaagauguuugc

SEQ ID NO: 3392384 - RNA, 15 nt, Human
ugaagauucuccugu

SEQ ID NO: 3392385 - RNA, 16 nt, Human
ugaagauuguuuaucu

SEQ ID NO: 3392386 - RNA, 17 nt, Human
ugaagauuuaccacuug

SEQ ID NO: 3392387 - RNA, 14 nt, Human
ugaagcaaacacau

SEQ ID NO: 3392388 - RNA, 15 nt, Human
ugaagcaaacaguug

SEQ ID NO: 3392389 - RNA, 20 nt, Human
ugaagcaaacaguugacaau

SEQ ID NO: 3392390 - RNA, 22 nt, Human
ugaagcaaacucuaaaauuaua

SEQ ID NO: 3392391 - RNA, 14 nt, Human
ugaagcaaaucaga

SEQ ID NO: 3392392 - RNA, 20 nt, Human
ugaagcaaaucgaaugaaau

SEQ ID NO: 3392393 - RNA, 21 nt, Human
ugaagcaaaugucaugcugcc

SEQ ID NO: 3392394 - RNA, 13 nt, Human
ugaagcaaggaag

SEQ ID NO: 3392395 - RNA, 21 nt, Human
ugaagcaaggaagauauacau

SEQ ID NO: 3392396 - RNA, 18 nt, Human
ugaagcaauggauauuug

SEQ ID NO: 3392397 - RNA, 17 nt, Human
ugaagcacagaccccuu

SEQ ID NO: 3392398 - RNA, 22 nt, Human
ugaagcacagugaucaaguuau

SEQ ID NO: 3392399 - RNA, 13 nt, Human
ugaagcagagugg

SEQ ID NO: 3392400 - RNA, 23 nt, Human
ugaagcagaugcaaagaggcaag

SEQ ID NO: 3392401 - RNA, 13 nt, Human
ugaagcagccucu

SEQ ID NO: 3392402 - RNA, 20 nt, Human
ugaagcagccucuccccagg

SEQ ID NO: 3392403 - RNA, 21 nt, Human
ugaagcaggguuucuuuucuu

SEQ ID NO: 3392404 - RNA, 14 nt, Human
ugaagcaguugugu

SEQ ID NO: 3392405 - RNA, 17 nt, Human
ugaagcauagauaauau

SEQ ID NO: 3392406 - RNA, 22 nt, Human
ugaagcauagauaauauuguuu

SEQ ID NO: 3392407 - RNA, 18 nt, Human
ugaagcauucuccccagu

SEQ ID NO: 3392408 - RNA, 15 nt, Human
ugaagcauuuuauaa

SEQ ID NO: 3392409 - RNA, 22 nt, Human
ugaagcauuuuauaaaucgcuu

SEQ ID NO: 3392410 - RNA, 14 nt, Human
ugaagccaaagaaa

SEQ ID NO: 3392411 - RNA, 14 nt, Human
ugaagccaaguggg

SEQ ID NO: 3392412 - RNA, 22 nt, Human
ugaagccacagcccaggccucc

SEQ ID NO: 3392413 - RNA, 16 nt, Human
ugaagccacugaagcu

SEQ ID NO: 3392414 - RNA, 14 nt, Human
ugaagccagccuuc

SEQ ID NO: 3392415 - RNA, 14 nt, Human
ugaagccaucuaaa

SEQ ID NO: 3392416 - RNA, 13 nt, Human
ugaagccaugucu

SEQ ID NO: 3392417 - RNA, 15 nt, Human
ugaagcccucccagg

SEQ ID NO: 3392418 - RNA, 15 nt, Human
ugaagccgacucugg

SEQ ID NO: 3392419 - RNA, 17 nt, Human
ugaagccgccaggaccg

SEQ ID NO: 3392420 - RNA, 13 nt, Human
ugaagccugcccu

SEQ ID NO: 3392421 - RNA, 21 nt, Human
ugaagcgaaacacagagaagc

SEQ ID NO: 3392422 - RNA, 15 nt, Human
ugaagcuaagauuua

SEQ ID NO: 3392423 - RNA, 13 nt, Human
ugaagcuaauuau

SEQ ID NO: 3392424 - RNA, 18 nt, Human
ugaagcuaauuauuuuaa

SEQ ID NO: 3392425 - RNA, 23 nt, Human
ugaagcuaauuauuuuaauuagg

SEQ ID NO: 3392426 - RNA, 20 nt, Human
ugaagcuaucguaaaauuaa

SEQ ID NO: 3392427 - RNA, 19 nt, Human
ugaagcuauuuaucuguag

SEQ ID NO: 3392428 - RNA, 18 nt, Human
ugaagcucaccuguugcu

SEQ ID NO: 3392429 - RNA, 13 nt, Human
ugaagcugaaaau

SEQ ID NO: 3392430 - RNA, 15 nt, Human
ugaagcugccugcuu

SEQ ID NO: 3392431 - RNA, 18 nt, Human
ugaagcuuauuaaugcua

SEQ ID NO: 3392432 - RNA, 22 nt, Human
ugaagcuuauuaaugcuaaggg

SEQ ID NO: 3392433 - RNA, 13 nt, Human
ugaagcuugugua

SEQ ID NO: 3392434 - RNA, 12 nt, Human
ugaagcuuuaua

SEQ ID NO: 3392435 - RNA, 21 nt, Human
ugaagcuuuuaugugaaacau

SEQ ID NO: 3392436 - RNA, 21 nt, Human
ugaaggaaaaacacaagcaaa

SEQ ID NO: 3392437 - RNA, 14 nt, Human
ugaaggaaaaauuc

SEQ ID NO: 3392438 - RNA, 15 nt, Human
ugaaggaaaaugaua

SEQ ID NO: 3392439 - RNA, 13 nt, Human
ugaaggaaagauu

SEQ ID NO: 3392440 - RNA, 20 nt, Human
ugaaggaacuugucucuuca

SEQ ID NO: 3392441 - RNA, 20 nt, Human
ugaaggaauaaauugcuccu

SEQ ID NO: 3392442 - RNA, 16 nt, Human
ugaaggaauacaauau

SEQ ID NO: 3392443 - RNA, 15 nt, Human
ugaaggaauauaugg

SEQ ID NO: 3392444 - RNA, 19 nt, Human
ugaaggacacuuccugccu

SEQ ID NO: 3392445 - RNA, 20 nt, Human
ugaaggacacuuccugccua

SEQ ID NO: 3392446 - RNA, 21 nt, Human
ugaaggaccuucacucuaaga

SEQ ID NO: 3392447 - RNA, 22 nt, Human
ugaaggacuaauagaaaaguau

SEQ ID NO: 3392448 - RNA, 12 nt, Human
ugaaggacugug

SEQ ID NO: 3392449 - RNA, 23 nt, Human
ugaaggacugugacaggcagcag

SEQ ID NO: 3392450 - RNA, 18 nt, Human
ugaaggacuuuggcccua

SEQ ID NO: 3392451 - RNA, 22 nt, Human
ugaaggagaggcaacauccaaa

SEQ ID NO: 3392452 - RNA, 11 nt, Human
ugaaggagccc

SEQ ID NO: 3392453 - RNA, 13 nt, Human
ugaaggaggugag

SEQ ID NO: 3392454 - RNA, 16 nt, Human
ugaaggcaaaauugca

SEQ ID NO: 3392455 - RNA, 12 nt, Human
ugaccaacugug

SEQ ID NO: 3392456 - RNA, 13 nt, Human
ugaccaacugugu

SEQ ID NO: 3392457 - RNA, 18 nt, Human
ugaccaacuguguuguau

SEQ ID NO: 3392458 - RNA, 15 nt, Human
ugaccaagaacugca

SEQ ID NO: 3392459 - RNA, 16 nt, Human
ugaccaagaacugcau

SEQ ID NO: 3392460 - RNA, 14 nt, Human
ugaccaaguauaaa

SEQ ID NO: 3392461 - RNA, 16 nt, Human
ugaccaaguuauaaau

SEQ ID NO: 3392462 - RNA, 17 nt, Human
ugaccaauauuguacag

SEQ ID NO: 3392463 - RNA, 21 nt, Human
ugaccaauauuguacaguuuu

SEQ ID NO: 3392464 - RNA, 13 nt, Human
ugaccaaugucuu

SEQ ID NO: 3392465 - RNA, 14 nt, Human
ugaccaaugucuug

SEQ ID NO: 3392466 - RNA, 15 nt, Human
ugaccaaugucuuga

SEQ ID NO: 3392467 - RNA, 15 nt, Human
ugaccaauugugcug

SEQ ID NO: 3392468 - RNA, 17 nt, Human
ugaccaauugugcugcc

SEQ ID NO: 3392469 - RNA, 19 nt, Human
ugaccaauugugcugccau

SEQ ID NO: 3392470 - RNA, 12 nt, Human
ugaccacacucc

SEQ ID NO: 3392471 - RNA, 16 nt, Human
ugaccacagcacagcc

SEQ ID NO: 3392472 - RNA, 23 nt, Human
ugaccaccaccccaacaaaccau

SEQ ID NO: 3392473 - RNA, 15 nt, Human
ugaccacccuccccu

SEQ ID NO: 3392474 - RNA, 18 nt, Human
ugaccacccuccccucuc

SEQ ID NO: 3392475 - RNA, 19 nt, Human
ugaccacccuccccucucu

SEQ ID NO: 3392476 - RNA, 20 nt, Human
ugaccacggacguuuccauc

SEQ ID NO: 3392477 - RNA, 23 nt, Human
ugaccacggacguuuccaucagg

SEQ ID NO: 3392478 - RNA, 15 nt, Human
ugaccacucugucuu

SEQ ID NO: 3392479 - RNA, 16 nt, Human
ugaccacucugucuug

SEQ ID NO: 3392480 - RNA, 16 nt, Human
ugaccacugcagaaga

SEQ ID NO: 3392481 - RNA, 16 nt, Human
ugaccacuugaggccu

SEQ ID NO: 3392482 - RNA, 14 nt, Human
ugaccagaaauggu

SEQ ID NO: 3392483 - RNA, 18 nt, Human
ugaccagcacugucucag

SEQ ID NO: 3392484 - RNA, 17 nt, Human
ugaccagcagaucccag

SEQ ID NO: 3392485 - RNA, 20 nt, Human
ugaccagcagaucccagcuc

SEQ ID NO: 3392486 - RNA, 21 nt, Human
ugaccagcagaucccagcuca

SEQ ID NO: 3392487 - RNA, 14 nt, Human
ugaccagcagcgcc

SEQ ID NO: 3392488 - RNA, 15 nt, Human
ugaccagcagcgccu

SEQ ID NO: 3392489 - RNA, 17 nt, Human
ugaccagccgugagcau

SEQ ID NO: 3392490 - RNA, 23 nt, Human
ugaccagccuccaugcugccucc

SEQ ID NO: 3392491 - RNA, 18 nt, Human
ugaccaguauaaaauuac

SEQ ID NO: 3392492 - RNA, 15 nt, Human
ugaccagucugaccc

SEQ ID NO: 3392493 - RNA, 19 nt, Human
ugaccaguggcuauggccu

SEQ ID NO: 3392494 - RNA, 17 nt, Human
ugaccaguugcagucac

SEQ ID NO: 3392495 - RNA, 18 nt, Human
ugaccaguugcagucacu

SEQ ID NO: 3392496 - RNA, 21 nt, Human
ugaccaguuuaaccugaugca

SEQ ID NO: 3392497 - RNA, 15 nt, Human
ugaccaucauuucac

SEQ ID NO: 3392498 - RNA, 15 nt, Human
ugaccaucugcuuuu

SEQ ID NO: 3392499 - RNA, 16 nt, Human
ugaccaugaaagacuu

SEQ ID NO: 3392500 - RNA, 12 nt, Human
ugaccaugcuca

SEQ ID NO: 3392501 - RNA, 19 nt, Human
ugaccaugcucaucugcug

SEQ ID NO: 3392502 - RNA, 21 nt, Human
ugaccauucuccaccugccag

SEQ ID NO: 3392503 - RNA, 14 nt, Human
ugaccauuuauaau

SEQ ID NO: 3392504 - RNA, 16 nt, Human
ugacccaaagaccaau

SEQ ID NO: 3392505 - RNA, 21 nt, Human
ugacccaaaucucuuccacaa

SEQ ID NO: 3392506 - RNA, 17 nt, Human
ugacccacaagaaauga

SEQ ID NO: 3392507 - RNA, 15 nt, Human
ugacccacagccucu

SEQ ID NO: 3392508 - RNA, 20 nt, Human
ugacccacagccucugccug

SEQ ID NO: 3392509 - RNA, 15 nt, Human
ugacccaccccugug

SEQ ID NO: 3392510 - RNA, 16 nt, Human
ugacccaccccugugc

SEQ ID NO: 3392511 - RNA, 23 nt, Human
ugacccaccccugugcuccgugc

SEQ ID NO: 3392512 - RNA, 19 nt, Human
ugacccacuucucaucaca

SEQ ID NO: 3392513 - RNA, 16 nt, Human
ugacccaggccgcagc

SEQ ID NO: 3392514 - RNA, 22 nt, Human
ugacccaggccgcagcucuugc

SEQ ID NO: 3392515 - RNA, 16 nt, Human
ugacccaggcugccug

SEQ ID NO: 3392516 - RNA, 13 nt, Human
ugacccaggcugg

SEQ ID NO: 3392517 - RNA, 14 nt, Human
ugacccagucccug

SEQ ID NO: 3392518 - RNA, 20 nt, Human
ugacccagucccugggggaa

SEQ ID NO: 3392519 - RNA, 23 nt, Human
ugacccagugcccccacugacca

SEQ ID NO: 3392520 - RNA, 12 nt, Human
ugacccaugcug

SEQ ID NO: 3392521 - RNA, 15 nt, Human
ugacccaugcugccc

SEQ ID NO: 3392522 - RNA, 16 nt, Human
ugacccaugcugcccu

SEQ ID NO: 3392523 - RNA, 20 nt, Human
ugacccaugcugcccuguga

SEQ ID NO: 3392524 - RNA, 15 nt, Human
ugacccauugcuguu

SEQ ID NO: 3392525 - RNA, 22 nt, Human
ugaccccaaacaccuuccagcu

SEQ ID NO: 3392526 - RNA, 22 nt, Human
ugaccccaaagagccuggagaa

SEQ ID NO: 3392527 - RNA, 22 nt, Human
ugaccccagcauucucaggcac

SEQ ID NO: 3392528 - RNA, 13 nt, Human
ugaccccagggca

SEQ ID NO: 3392529 - RNA, 19 nt, Human
ugaccccagggcacaggag

SEQ ID NO: 3392530 - RNA, 15 nt, Human
ugacccccccagcuu

SEQ ID NO: 3392531 - RNA, 15 nt, Human
ugaccccccucagga

SEQ ID NO: 3392532 - RNA, 20 nt, Human
ugaccccucauagcccucac

SEQ ID NO: 3392533 - RNA, 13 nt, Human
ugaccccuccuca

SEQ ID NO: 3392534 - RNA, 22 nt, Human
ugaccccuccuggggccaggcc

SEQ ID NO: 3392535 - RNA, 20 nt, Human
ugacccggaggccacaugag

SEQ ID NO: 3392536 - RNA, 21 nt, Human
ugacccggaggccacaugagu

SEQ ID NO: 3392537 - RNA, 18 nt, Human
ugacccggcacccccugc

SEQ ID NO: 3392538 - RNA, 19 nt, Human
ugacccggcacccccugca

SEQ ID NO: 3392539 - RNA, 18 nt, Human
ugacccuagcucuuuccu

SEQ ID NO: 3392540 - RNA, 21 nt, Human
ugacccuaugggucuaggaca

SEQ ID NO: 3392541 - RNA, 11 nt, Human
ugacccuccaa

SEQ ID NO: 3392542 - RNA, 12 nt, Human
ugacccucccuu

SEQ ID NO: 3392543 - RNA, 15 nt, Human
ugacccucuccaccc

SEQ ID NO: 3392544 - RNA, 18 nt, Human
ugacccucuccaccccau

SEQ ID NO: 3392545 - RNA, 21 nt, Human
ugacccugcgaaggggcccug

SEQ ID NO: 3392546 - RNA, 23 nt, Human
ugacccugcgaaggggcccuggu

SEQ ID NO: 3392547 - RNA, 17 nt, Human
ugacccuguauauagcc

SEQ ID NO: 3392548 - RNA, 19 nt, Human
ugacccuguauauagccca

SEQ ID NO: 3392549 - RNA, 20 nt, Human
ugacccuguauauagcccag

SEQ ID NO: 3392550 - RNA, 20 nt, Human
ugacccuuacagccucugac

SEQ ID NO: 3392551 - RNA, 19 nt, Human
ugacccuucccaaucagca

SEQ ID NO: 3392552 - RNA, 18 nt, Human
ugaccgacagcuuuccag

SEQ ID NO: 3392553 - RNA, 16 nt, Human
ugaccggacuuuucug

SEQ ID NO: 3392554 - RNA, 19 nt, Human
ugaccggacuuuucugcaa

SEQ ID NO: 3392555 - RNA, 13 nt, Human
ugaccgugaggcc

SEQ ID NO: 3392556 - RNA, 16 nt, Human
ugaccgugaggccaga

SEQ ID NO: 3392557 - RNA, 20 nt, Human
ugaccgugaggccagagaca

SEQ ID NO: 3392558 - RNA, 16 nt, Human
ugaccgugggcggggc

SEQ ID NO: 3392559 - RNA, 22 nt, Human
ugaccuaguuuuccaugcgugu

SEQ ID NO: 3392560 - RNA, 21 nt, Human
ugaccucaaaugaugugccug

SEQ ID NO: 3392561 - RNA, 17 nt, Human
ugaccucaaccugugau

SEQ ID NO: 3392562 - RNA, 15 nt, Human
ugaccucacagugac

SEQ ID NO: 3392563 - RNA, 18 nt, Human
ugaccucacagugacccu

SEQ ID NO: 3392564 - RNA, 18 nt, Human
ugaccucaccuaggaagu

SEQ ID NO: 3392565 - RNA, 16 nt, Human
ugaccucacucagaag

SEQ ID NO: 3392566 - RNA, 14 nt, Human
ugaccucacuguga

SEQ ID NO: 3392567 - RNA, 22 nt, Human
ugaccucagcuuugauauuuca

SEQ ID NO: 3392568 - RNA, 18 nt, Human
ugaccucaggcacuagcc

SEQ ID NO: 3392569 - RNA, 18 nt, Human
ugaccuccagcuuuccug

SEQ ID NO: 3392570 - RNA, 11 nt, Human
ugaccucccag

SEQ ID NO: 3392571 - RNA, 15 nt, Human
ugaccucccagcccu

SEQ ID NO: 3392572 - RNA, 22 nt, Human
ugaccucccagcccuauggaug

SEQ ID NO: 3392573 - RNA, 23 nt, Human
ugaccucccagcccuauggaugu

SEQ ID NO: 3392574 - RNA, 18 nt, Human
ugaccucccccuccuucc

SEQ ID NO: 3392575 - RNA, 20 nt, Human
ugaccucuagcccugcccgg

SEQ ID NO: 3392576 - RNA, 12 nt, Human
ugaccucugccu

SEQ ID NO: 3392577 - RNA, 13 nt, Human
ugaccucugccug

SEQ ID NO: 3392578 - RNA, 17 nt, Human
ugaccucuguuguccuc

SEQ ID NO: 3392579 - RNA, 18 nt, Human
ugaccucuguuguccucc

SEQ ID NO: 3392580 - RNA, 21 nt, Human
ugagacuaaucuuauucauuu

SEQ ID NO: 3392581 - RNA, 19 nt, Human
ugagacuacaagugugugc

SEQ ID NO: 3392582 - RNA, 17 nt, Human
ugagacucagugcagau

SEQ ID NO: 3392583 - RNA, 15 nt, Human
ugagacucgagaacu

SEQ ID NO: 3392584 - RNA, 22 nt, Human
ugagacucgcgacaaugcaaac

SEQ ID NO: 3392585 - RNA, 22 nt, Human
ugagacucuaggguccagugga

SEQ ID NO: 3392586 - RNA, 14 nt, Human
ugagacucugucuc

SEQ ID NO: 3392587 - RNA, 22 nt, Human
ugagacugcgggaugguccugg

SEQ ID NO: 3392588 - RNA, 13 nt, Human
ugagacugugcug

SEQ ID NO: 3392589 - RNA, 12 nt, Human
ugagacuuccaa

SEQ ID NO: 3392590 - RNA, 14 nt, Human
ugagacuugcucuc

SEQ ID NO: 3392591 - RNA, 12 nt, Human
ugagacuuuaaa

SEQ ID NO: 3392592 - RNA, 20 nt, Human
ugagacuuuaaaagcauuuu

SEQ ID NO: 3392593 - RNA, 17 nt, Human
agccuucuuuuucugga

SEQ ID NO: 3392594 - RNA, 20 nt, Human
agccuucuuuuucuggacuc

SEQ ID NO: 3392595 - RNA, 23 nt, Human
agccuucuuuuucuggacucugg

SEQ ID NO: 3392596 - RNA, 18 nt, Human
agccuugaccauucucca

SEQ ID NO: 3392597 - RNA, 21 nt, Human
agccuugaccauucuccaccu

SEQ ID NO: 3392598 - RNA, 13 nt, Human
agccuugccagag

SEQ ID NO: 3392599 - RNA, 14 nt, Human
agccuugccagaga

SEQ ID NO: 3392600 - RNA, 17 nt, Human
agccuugccagagaucc

SEQ ID NO: 3392601 - RNA, 23 nt, Human
agccuugccuaaauuuaaugcug

SEQ ID NO: 3392602 - RNA, 19 nt, Human
agccuugcggaagguucua

SEQ ID NO: 3392603 - RNA, 12 nt, Human
agccuugcuugu

SEQ ID NO: 3392604 - RNA, 19 nt, Human
agccuuggauaaugcuguu

SEQ ID NO: 3392605 - RNA, 23 nt, Human
agccuuggauaaugcuguugccu

SEQ ID NO: 3392606 - RNA, 23 nt, Human
agccuuggggauucuuccaucug

SEQ ID NO: 3392607 - RNA, 16 nt, Human
agccuugguguccacc

SEQ ID NO: 3392608 - RNA, 18 nt, Human
agccuugguguccaccug

SEQ ID NO: 3392609 - RNA, 10 nt, Human
agccuugugu

SEQ ID NO: 3392610 - RNA, 20 nt, Human
agccuuguguauauuuguau

SEQ ID NO: 3392611 - RNA, 20 nt, Human
agccuuuaguaucaguguuu

SEQ ID NO: 3392612 - RNA, 18 nt, Human
agccuuucauuuugcuuu

SEQ ID NO: 3392613 - RNA, 19 nt, Human
agccuuucauuuugcuuua

SEQ ID NO: 3392614 - RNA, 21 nt, Human
agccuuucauuuugcuuuaau

SEQ ID NO: 3392615 - RNA, 23 nt, Human
agccuuucauuuugcuuuaauuu

SEQ ID NO: 3392616 - RNA, 23 nt, Human
agccuuuccucaaaacuggaguc

SEQ ID NO: 3392617 - RNA, 23 nt, Human
agccuuucucucuuuauacagcu

SEQ ID NO: 3392618 - RNA, 15 nt, Human
agccuuucuuuugga

SEQ ID NO: 3392619 - RNA, 11 nt, Human
agccuuugaau

SEQ ID NO: 3392620 - RNA, 15 nt, Human
agccuuugccucccc

SEQ ID NO: 3392621 - RNA, 17 nt, Human
agccuuugggaaaugcu

SEQ ID NO: 3392622 - RNA, 21 nt, Human
agccuuuguuccccacuggag

SEQ ID NO: 3392623 - RNA, 23 nt, Human
agccuuuguuccccacuggagca

SEQ ID NO: 3392624 - RNA, 14 nt, Human
agcgaaacacagag

SEQ ID NO: 3392625 - RNA, 13 nt, Human
agcgaacugacau

SEQ ID NO: 3392626 - RNA, 16 nt, Human
agcgaacuugacaauu

SEQ ID NO: 3392627 - RNA, 13 nt, Human
agcgaaguagcuu

SEQ ID NO: 3392628 - RNA, 13 nt, Human
agcgaauuuuaaa

SEQ ID NO: 3392629 - RNA, 15 nt, Human
agcgaauuuuaaaag

SEQ ID NO: 3392630 - RNA, 17 nt, Human
agcgaccaccccugccu

SEQ ID NO: 3392631 - RNA, 19 nt, Human
agcgaccaccccugccucc

SEQ ID NO: 3392632 - RNA, 17 nt, Human
agcgacccauucagaga

SEQ ID NO: 3392633 - RNA, 15 nt, Human
agcgaccgcccccuc

SEQ ID NO: 3392634 - RNA, 16 nt, Human
agcgaccgcccccucc

SEQ ID NO: 3392635 - RNA, 12 nt, Human
agcgacuaaacu

SEQ ID NO: 3392636 - RNA, 16 nt, Human
agcgagagucugucuc

SEQ ID NO: 3392637 - RNA, 19 nt, Human
agcgagcaucccccaaagu

SEQ ID NO: 3392638 - RNA, 19 nt, Human
agcgagcccugguggcagu

SEQ ID NO: 3392639 - RNA, 20 nt, Human
agcgaggagaugcuccuugg

SEQ ID NO: 3392640 - RNA, 24 nt, Human
agcgaggcugagccuacagaugaa

SEQ ID NO: 3392641 - RNA, 16 nt, Human
agcgagggcagcugcu

SEQ ID NO: 3392642 - RNA, 22 nt, Human
agcgagggccccagcgugaagc

SEQ ID NO: 3392643 - RNA, 22 nt, Human
agcgaggucaacagagaaggca

SEQ ID NO: 3392644 - RNA, 22 nt, Human
agcgaguggagucugccaccca

SEQ ID NO: 3392645 - RNA, 21 nt, Human
agcgaguuguggaaagccucu

SEQ ID NO: 3392646 - RNA, 18 nt, Human
agcgauguaugcagcuau

SEQ ID NO: 3392647 - RNA, 24 nt, Human
agcgauucuccugccucagccucc

SEQ ID NO: 3392648 - RNA, 17 nt, Human
agcgauucuucugcuuc

SEQ ID NO: 3392649 - RNA, 15 nt, Human
agcgcacagcugcuc

SEQ ID NO: 3392650 - RNA, 12 nt, Human
agcgcaccugcc

SEQ ID NO: 3392651 - RNA, 14 nt, Human
agcgcaccugcccc

SEQ ID NO: 3392652 - RNA, 21 nt, Human
agcgcagcuggacucugcauc

SEQ ID NO: 3392653 - RNA, 23 nt, Human
agcgcaguuuuuuuuuucuuguc

SEQ ID NO: 3392654 - RNA, 19 nt, Human
agcgccagccucagacugg

SEQ ID NO: 3392655 - RNA, 22 nt, Human
agcgccaguguaaucccccagg

SEQ ID NO: 3392656 - RNA, 14 nt, Human
agcgcccagcuccu

SEQ ID NO: 3392657 - RNA, 16 nt, Human
agcgcccagcuccuga

SEQ ID NO: 3392658 - RNA, 22 nt, Human
agcgcccaguuggguggaugcc

SEQ ID NO: 3392659 - RNA, 16 nt, Human
agcgcccuggccccca

SEQ ID NO: 3392660 - RNA, 17 nt, Human
agcgcccuuccucucca

SEQ ID NO: 3392661 - RNA, 23 nt, Human
agcgccgugaguucucagggcuc

SEQ ID NO: 3392662 - RNA, 22 nt, Human
agcgccuaguggggucucccuc

SEQ ID NO: 3392663 - RNA, 22 nt, Human
agcgccuccauccaaggccagg

SEQ ID NO: 3392664 - RNA, 14 nt, Human
agcgccucccucca

SEQ ID NO: 3392665 - RNA, 18 nt, Human
agcgccucccuccacccc

SEQ ID NO: 3392666 - RNA, 21 nt, Human
agcgccucccuccaccccagg

SEQ ID NO: 3392667 - RNA, 12 nt, Human
agcgccugcccc

SEQ ID NO: 3392668 - RNA, 17 nt, Human
agcgcggacauccccug

SEQ ID NO: 3392669 - RNA, 19 nt, Human
agcgcggacauccccugcu

SEQ ID NO: 3392670 - RNA, 18 nt, Human
agcgcggcccucccgagu

SEQ ID NO: 3392671 - RNA, 13 nt, Human
agcgcuaucuccc

SEQ ID NO: 3392672 - RNA, 17 nt, Human
agcgcuaucucccugcc

SEQ ID NO: 3392673 - RNA, 22 nt, Human
agcgcuccugccgcagagcugg

SEQ ID NO: 3392674 - RNA, 17 nt, Human
agcgcugccgcacccca

SEQ ID NO: 3392675 - RNA, 19 nt, Human
agcgcugccgcaccccaga

SEQ ID NO: 3392676 - RNA, 22 nt, Human
agcgcuugggcgccgugcuggg

SEQ ID NO: 3392677 - RNA, 21 nt, Human
agcgcuuucuggaaaagagga

SEQ ID NO: 3392678 - RNA, 16 nt, Human
agcgcuuuuccuuggc

SEQ ID NO: 3392679 - RNA, 22 nt, Human
agcggaaaagguuuuauuuugu

SEQ ID NO: 3392680 - RNA, 14 nt, Human
agcggacaguggca

SEQ ID NO: 3392681 - RNA, 19 nt, Human
agcggacaucagcugguca

SEQ ID NO: 3392682 - RNA, 15 nt, Human
agcggaggcugugug

SEQ ID NO: 3392683 - RNA, 21 nt, Human
agcggagguugcagugagcug

SEQ ID NO: 3392684 - RNA, 14 nt, Human
agcggcagaugggg

SEQ ID NO: 3392685 - RNA, 15 nt, Human
agcggcgaccgcccu

SEQ ID NO: 3392686 - RNA, 18 nt, Human
agcggcgaccgcccuccg

SEQ ID NO: 3392687 - RNA, 17 nt, Human
agcggcucaagcccagg

SEQ ID NO: 3392688 - RNA, 14 nt, Human
agcggcuggcagcc

SEQ ID NO: 3392689 - RNA, 17 nt, Human
agcggcuggugcagggc

SEQ ID NO: 3392690 - RNA, 15 nt, Human
agcgggaggcagagu

SEQ ID NO: 3392691 - RNA, 21 nt, Human
agcgggaggcagaguuugccu

SEQ ID NO: 3392692 - RNA, 13 nt, Human
agcggggacagcu

SEQ ID NO: 3392693 - RNA, 12 nt, Human
agcgggggaggg

SEQ ID NO: 3392694 - RNA, 14 nt, Human
agcggggggagggu

SEQ ID NO: 3392695 - RNA, 13 nt, Human
agcgggucugcuc

SEQ ID NO: 3392696 - RNA, 18 nt, Human
aggugccuccaggugugc

SEQ ID NO: 3392697 - RNA, 13 nt, Human
aggugccuccuga

SEQ ID NO: 3392698 - RNA, 13 nt, Human
aggugccuggagu

SEQ ID NO: 3392699 - RNA, 18 nt, Human
aggugccugucccacccc

SEQ ID NO: 3392700 - RNA, 22 nt, Human
aggugccuucuuauucucacuc

SEQ ID NO: 3392701 - RNA, 23 nt, Human
aggugccuucuuauucucacucc

SEQ ID NO: 3392702 - RNA, 10 nt, Human
aggugccuug

SEQ ID NO: 3392703 - RNA, 19 nt, Human
aggugccuuucaaauuuag

SEQ ID NO: 3392704 - RNA, 21 nt, Human
aggugcgaaugacaguagcau

SEQ ID NO: 3392705 - RNA, 18 nt, Human
aggugcuacaaaaacaca

SEQ ID NO: 3392706 - RNA, 19 nt, Human
aggugcuacaaaaacacag

SEQ ID NO: 3392707 - RNA, 20 nt, Human
aggugcuacaaaaacacagc

SEQ ID NO: 3392708 - RNA, 21 nt, Human
aggugcuacaaaaacacagca

SEQ ID NO: 3392709 - RNA, 21 nt, Human
aggugcuacacccuuuuccag

SEQ ID NO: 3392710 - RNA, 19 nt, Human
aggugcuaggaacacuccu

SEQ ID NO: 3392711 - RNA, 16 nt, Human
aggugcucaaaaugca

SEQ ID NO: 3392712 - RNA, 17 nt, Human
aggugcucaaaaugcaa

SEQ ID NO: 3392713 - RNA, 18 nt, Human
aggugcucacaccccauu

SEQ ID NO: 3392714 - RNA, 17 nt, Human
aggugcuccccugacag

SEQ ID NO: 3392715 - RNA, 16 nt, Human
aggugcugacggccag

SEQ ID NO: 3392716 - RNA, 17 nt, Human
aggugcugacggccagg

SEQ ID NO: 3392717 - RNA, 13 nt, Human
aggugcugcuuaa

SEQ ID NO: 3392718 - RNA, 20 nt, Human
aggugcuggagcacugggcu

SEQ ID NO: 3392719 - RNA, 12 nt, Human
aggugcugggag

SEQ ID NO: 3392720 - RNA, 15 nt, Human
aggugcugggaggga

SEQ ID NO: 3392721 - RNA, 17 nt, Human
aggugcuggggccuggu

SEQ ID NO: 3392722 - RNA, 14 nt, Human
aggugcuguccaug

SEQ ID NO: 3392723 - RNA, 23 nt, Human
aggugcuguuauccauggggaag

SEQ ID NO: 3392724 - RNA, 14 nt, Human
aggugcuguuguca

SEQ ID NO: 3392725 - RNA, 21 nt, Human
aggugcuguugucauugcuuu

SEQ ID NO: 3392726 - RNA, 19 nt, Human
aggugcuuaagcagaagca

SEQ ID NO: 3392727 - RNA, 18 nt, Human
agguggaaaaacaucuga

SEQ ID NO: 3392728 - RNA, 17 nt, Human
agguggaagaagggaga

SEQ ID NO: 3392729 - RNA, 22 nt, Human
agguggaagaagggagaagaaa

SEQ ID NO: 3392730 - RNA, 13 nt, Human
agguggaagcccu

SEQ ID NO: 3392731 - RNA, 19 nt, Human
agguggaagcccuccuucc

SEQ ID NO: 3392732 - RNA, 20 nt, Human
agguggaagcccuccuucca

SEQ ID NO: 3392733 - RNA, 18 nt, Human
agguggaaggcagacagc

SEQ ID NO: 3392734 - RNA, 17 nt, Human
agguggaauuauuuuaa

SEQ ID NO: 3392735 - RNA, 16 nt, Human
agguggacuggaaggg

SEQ ID NO: 3392736 - RNA, 18 nt, Human
agguggagcaaagugagg

SEQ ID NO: 3392737 - RNA, 22 nt, Human
agguggagcguucaccagugac

SEQ ID NO: 3392738 - RNA, 14 nt, Human
agguggagggaggg

SEQ ID NO: 3392739 - RNA, 20 nt, Human
agguggagguugcagugagc

SEQ ID NO: 3392740 - RNA, 16 nt, Human
agguggaucacagagg

SEQ ID NO: 3392741 - RNA, 15 nt, Human
agguggauggcccca

SEQ ID NO: 3392742 - RNA, 18 nt, Human
agguggcaaggcugugcu

SEQ ID NO: 3392743 - RNA, 23 nt, Human
agguggcacuuuuucauuugccu

SEQ ID NO: 3392744 - RNA, 14 nt, Human
agguggcagcccug

SEQ ID NO: 3392745 - RNA, 23 nt, Human
agguggcaucagugucuuuccac

SEQ ID NO: 3392746 - RNA, 21 nt, Human
agguggccuccuugcuuguua

SEQ ID NO: 3392747 - RNA, 17 nt, Human
agguggcuauggccacc

SEQ ID NO: 3392748 - RNA, 14 nt, Human
agguggcucuccag

SEQ ID NO: 3392749 - RNA, 23 nt, Human
agguggcugacccagucccuggg

SEQ ID NO: 3392750 - RNA, 15 nt, Human
agguggcugagcccc

SEQ ID NO: 3392751 - RNA, 13 nt, Human
agguggcugccug

SEQ ID NO: 3392752 - RNA, 12 nt, Human
aggugggaggau

SEQ ID NO: 3392753 - RNA, 20 nt, Human
aggugggaggaugugaauug

SEQ ID NO: 3392754 - RNA, 17 nt, Human
aggugggauccuccagg

SEQ ID NO: 3392755 - RNA, 19 nt, Human
aggugggcacuggauuagu

SEQ ID NO: 3392756 - RNA, 13 nt, Human
aggugggcaggug

SEQ ID NO: 3392757 - RNA, 19 nt, Human
aggugggccagccccuccc

SEQ ID NO: 3392758 - RNA, 21 nt, Human
aggugggccagccccucccac

SEQ ID NO: 3392759 - RNA, 13 nt, Human
aggugggcccagg

SEQ ID NO: 3392760 - RNA, 18 nt, Human
aggugggcccaggaccag

SEQ ID NO: 3392761 - RNA, 23 nt, Human
aggugggcccaggaccagcuggg

SEQ ID NO: 3392762 - RNA, 23 nt, Human
aggugggccgcaggcgggaaaag

SEQ ID NO: 3392763 - RNA, 19 nt, Human
aggugggccuugcuaccuc

SEQ ID NO: 3392764 - RNA, 21 nt, Human
aggugggccuugcuaccucaa

SEQ ID NO: 3392765 - RNA, 18 nt, Human
aggugggcgggcagcaca

SEQ ID NO: 3392766 - RNA, 14 nt, Human
aggugggcugggcc

SEQ ID NO: 3392767 - RNA, 15 nt, Human
aggugggcuucccag

SEQ ID NO: 3392768 - RNA, 21 nt, Human
aggugggcuucccaguggcug

SEQ ID NO: 3392769 - RNA, 13 nt, Human
agguggggacagg

SEQ ID NO: 3392770 - RNA, 19 nt, Human
agguggggagacugggcug

SEQ ID NO: 3392771 - RNA, 17 nt, Human
agguggggcgaggcagg

SEQ ID NO: 3392772 - RNA, 14 nt, Human
agguggggguuggc

SEQ ID NO: 3392773 - RNA, 20 nt, Human
agguggggguuggcugggua

SEQ ID NO: 3392774 - RNA, 23 nt, Human
aggugggguauuuaccacagcag

SEQ ID NO: 3392775 - RNA, 22 nt, Human
agguggggucuuugugagagug

SEQ ID NO: 3392776 - RNA, 14 nt, Human
aggugggucccggc

SEQ ID NO: 3392777 - RNA, 15 nt, Human
aggugggugucugcg

SEQ ID NO: 3392778 - RNA, 23 nt, Human
agguggguuuucaucaagacugg

SEQ ID NO: 3392779 - RNA, 19 nt, Human
agguggguuuucuucccau

SEQ ID NO: 3392780 - RNA, 20 nt, Human
aggugguaguaaaacacaga

SEQ ID NO: 3392781 - RNA, 15 nt, Human
aggugguaugugugu

SEQ ID NO: 3392782 - RNA, 15 nt, Human
agguggucugaaugu

SEQ ID NO: 3392783 - RNA, 16 nt, Human
agguggucugaauguu

SEQ ID NO: 3392784 - RNA, 17 nt, Human
agguggucugaauguuc

SEQ ID NO: 3392785 - RNA, 19 nt, Human
agguggucugaauguucug

SEQ ID NO: 3392786 - RNA, 21 nt, Human
agguggucugaauguucugac

SEQ ID NO: 3392787 - RNA, 21 nt, Human
agguggugggcauucucucuc

SEQ ID NO: 3392788 - RNA, 17 nt, Human
agguggugucacugucc

SEQ ID NO: 3392789 - RNA, 15 nt, Human
aggugguuuuaaagg

SEQ ID NO: 3392790 - RNA, 13 nt, Human
aggugucacaugg

SEQ ID NO: 3392791 - RNA, 18 nt, Human
aggugucaggcugcuggc

SEQ ID NO: 3392792 - RNA, 15 nt, Human
aggugucauacagau

SEQ ID NO: 3392793 - RNA, 15 nt, Human
aggugucauuuccau

SEQ ID NO: 3392794 - RNA, 19 nt, Human
agguguccccagcccacug

SEQ ID NO: 3392795 - RNA, 20 nt, Human
aggugucccugcacuugcag

SEQ ID NO: 3392796 - RNA, 14 nt, Human
aggugucucaggcu

SEQ ID NO: 3392797 - RNA, 14 nt, Human
aggugucuuccucc

SEQ ID NO: 3392798 - RNA, 23 nt, Human
aggugugaaccaccacacccagc

SEQ ID NO: 3392799 - RNA, 13 nt, Human
aggugugaggagg

SEQ ID NO: 3392800 - RNA, 17 nt, Human
aggugugaggcaggaga

SEQ ID NO: 3392801 - RNA, 15 nt, Human
aggugugauuauaaa

SEQ ID NO: 3392802 - RNA, 14 nt, Human
aggugugggggcug

SEQ ID NO: 3392803 - RNA, 16 nt, Human
aggugugggggcugca

SEQ ID NO: 3392804 - RNA, 18 nt, Human
agguguuaacauuccaag

SEQ ID NO: 3392805 - RNA, 23 nt, Human
agguguuaacauuccaagacucu

SEQ ID NO: 3392806 - RNA, 15 nt, Human
agguguuacuguaau

SEQ ID NO: 3392807 - RNA, 16 nt, Human
agguguuacuguaauu

SEQ ID NO: 3392808 - RNA, 21 nt, Human
agguguugaagaaauuauaaa

SEQ ID NO: 3392809 - RNA, 12 nt, Human
agguguugccaa

SEQ ID NO: 3392810 - RNA, 17 nt, Human
agguguuggcugcacgu

SEQ ID NO: 3392811 - RNA, 15 nt, Human
agguguugucccuuc

SEQ ID NO: 3392812 - RNA, 18 nt, Human
agguguuuaaagagaggu

SEQ ID NO: 3392813 - RNA, 11 nt, Human
agguguuuaua

SEQ ID NO: 3392814 - RNA, 17 nt, Human
agguguuuauuaaaauu

SEQ ID NO: 3392815 - RNA, 21 nt, Human
agguguuuauuaaaauucuga

SEQ ID NO: 3392816 - RNA, 14 nt, Human
agguguuugaaaau

SEQ ID NO: 3392817 - RNA, 17 nt, Human
agguguuuucuguguaa

SEQ ID NO: 3392818 - RNA, 18 nt, Human
agguguuuucuguguaac

SEQ ID NO: 3392819 - RNA, 19 nt, Human
agguguuuucuguguaacc

SEQ ID NO: 3392820 - RNA, 19 nt, Human
agguguuuuuuaugaagug

SEQ ID NO: 3392821 - RNA, 21 nt, Human
agguuaaaaaaauggcaguga

SEQ ID NO: 3392822 - RNA, 13 nt, Human
agguuaaauguuu

SEQ ID NO: 3392823 - RNA, 22 nt, Human
agguuaacuauguacaauauuu

SEQ ID NO: 3392824 - RNA, 13 nt, Human
agguuaauauuua

SEQ ID NO: 3392825 - RNA, 15 nt, Human
agguuacaacagauu

SEQ ID NO: 3392826 - RNA, 16 nt, Human
agguuacaacagauuu

SEQ ID NO: 3392827 - RNA, 19 nt, Human
agguuacaacagauuugug

SEQ ID NO: 3392828 - RNA, 21 nt, Human
agguuacaagccugcacaaua

SEQ ID NO: 3392829 - RNA, 15 nt, Human
agguuaccaagaagc

SEQ ID NO: 3392830 - RNA, 23 nt, Human
agguuagaaauaaugucaaaaau

SEQ ID NO: 3392831 - RNA, 18 nt, Human
agguuagaaccuagaagg

SEQ ID NO: 3392832 - RNA, 20 nt, Human
agguuagaaccuagaagggc

SEQ ID NO: 3392833 - RNA, 19 nt, Human
agguuaggcaguauaaaga

SEQ ID NO: 3392834 - RNA, 14 nt, Human
agguuauaauuuuu

SEQ ID NO: 3392835 - RNA, 16 nt, Human
agguuauaugaauaua

SEQ ID NO: 3392836 - RNA, 17 nt, Human
agguuauaugaauauau

SEQ ID NO: 3392837 - RNA, 21 nt, Human
agguuauugcaauaaaguaua

SEQ ID NO: 3392838 - RNA, 15 nt, Human
agguuauuuauuuaa

SEQ ID NO: 3392839 - RNA, 17 nt, Human
agguucaaagauauuuu

SEQ ID NO: 3392840 - RNA, 21 nt, Human
aguacuugugaaacacagcug

SEQ ID NO: 3392841 - RNA, 24 nt, Human
aguacuugugaaacacagcuguuc

SEQ ID NO: 3392842 - RNA, 13 nt, Human
aguacuuuauaga

SEQ ID NO: 3392843 - RNA, 13 nt, Human
aguacuuugugca

SEQ ID NO: 3392844 - RNA, 15 nt, Human
aguacuuugugcauu

SEQ ID NO: 3392845 - RNA, 13 nt, Human
aguacuuuuuuaa

SEQ ID NO: 3392846 - RNA, 16 nt, Human
aguacuuuuuuaaaua

SEQ ID NO: 3392847 - RNA, 23 nt, Human
aguacuuuuuuaaauauuuucua

SEQ ID NO: 3392848 - RNA, 22 nt, Human
aguagaaaaugugacccuccaa

SEQ ID NO: 3392849 - RNA, 21 nt, Human
aguagaaagacagagcuggga

SEQ ID NO: 3392850 - RNA, 15 nt, Human
aguagaaaggccuuu

SEQ ID NO: 3392851 - RNA, 15 nt, Human
aguagaaauaaaagu

SEQ ID NO: 3392852 - RNA, 18 nt, Human
aguagaaauaauaugcau

SEQ ID NO: 3392853 - RNA, 19 nt, Human
aguagaaauaauaugcauu

SEQ ID NO: 3392854 - RNA, 11 nt, Human
aguagaacugu

SEQ ID NO: 3392855 - RNA, 14 nt, Human
aguagaacuuugua

SEQ ID NO: 3392856 - RNA, 19 nt, Human
aguagaacuuuguauaguu

SEQ ID NO: 3392857 - RNA, 21 nt, Human
aguagaaggucggaggcuugg

SEQ ID NO: 3392858 - RNA, 14 nt, Human
aguagaauugauuu

SEQ ID NO: 3392859 - RNA, 15 nt, Human
aguagacacauuuaa

SEQ ID NO: 3392860 - RNA, 12 nt, Human
aguagacauuua

SEQ ID NO: 3392861 - RNA, 14 nt, Human
aguagacauuuuaa

SEQ ID NO: 3392862 - RNA, 17 nt, Human
aguagacauuuuaacaa

SEQ ID NO: 3392863 - RNA, 20 nt, Human
aguagacauuuuaacaagaa

SEQ ID NO: 3392864 - RNA, 16 nt, Human
aguagaccccuggcug

SEQ ID NO: 3392865 - RNA, 21 nt, Human
aguagaccuuguuacuucuga

SEQ ID NO: 3392866 - RNA, 19 nt, Human
aguagacuugcuuugguca

SEQ ID NO: 3392867 - RNA, 11 nt, Human
aguagagacag

SEQ ID NO: 3392868 - RNA, 12 nt, Human
aguagagacagg

SEQ ID NO: 3392869 - RNA, 13 nt, Human
aguagagccagcu

SEQ ID NO: 3392870 - RNA, 18 nt, Human
aguagagguacuagaaug

SEQ ID NO: 3392871 - RNA, 18 nt, Human
aguagagguauaauugug

SEQ ID NO: 3392872 - RNA, 20 nt, Human
aguagagguauaauugugug

SEQ ID NO: 3392873 - RNA, 22 nt, Human
aguagagguauaauugugugau

SEQ ID NO: 3392874 - RNA, 16 nt, Human
aguagagucaucucca

SEQ ID NO: 3392875 - RNA, 20 nt, Human
aguagauaauuucagggugc

SEQ ID NO: 3392876 - RNA, 14 nt, Human
aguagauauuacuu

SEQ ID NO: 3392877 - RNA, 15 nt, Human
aguagaucaugcaua

SEQ ID NO: 3392878 - RNA, 16 nt, Human
aguagauccauuucca

SEQ ID NO: 3392879 - RNA, 23 nt, Human
aguagauccauuuccauugcuua

SEQ ID NO: 3392880 - RNA, 22 nt, Human
aguagaugcauuuggguccagg

SEQ ID NO: 3392881 - RNA, 23 nt, Human
aguagaugcauuuggguccagga

SEQ ID NO: 3392882 - RNA, 20 nt, Human
aguagauuuacagaacaaag

SEQ ID NO: 3392883 - RNA, 16 nt, Human
aguagauuuucuuuaa

SEQ ID NO: 3392884 - RNA, 17 nt, Human
aguagauuuucuuuaaa

SEQ ID NO: 3392885 - RNA, 18 nt, Human
aguagauuuucuuuaaaa

SEQ ID NO: 3392886 - RNA, 20 nt, Human
aguagauuuucuuuaaaaga

SEQ ID NO: 3392887 - RNA, 23 nt, Human
aguagauuuucuuuaaaagaaug

SEQ ID NO: 3392888 - RNA, 22 nt, Human
aguagcaaguucuagagaagag

SEQ ID NO: 3392889 - RNA, 13 nt, Human
aguagcacaggcu

SEQ ID NO: 3392890 - RNA, 18 nt, Human
aguagcacccuggauuga

SEQ ID NO: 3392891 - RNA, 13 nt, Human
aguagcaggcccg

SEQ ID NO: 3392892 - RNA, 14 nt, Human
aguagcaugagaga

SEQ ID NO: 3392893 - RNA, 19 nt, Human
aguagcauguugagccagg

SEQ ID NO: 3392894 - RNA, 14 nt, Human
aguagcauuucauu

SEQ ID NO: 3392895 - RNA, 15 nt, Human
aguagcauuucauuc

SEQ ID NO: 3392896 - RNA, 23 nt, Human
aguagccaggguguggcccugcc

SEQ ID NO: 3392897 - RNA, 15 nt, Human
aguagcccuuucugu

SEQ ID NO: 3392898 - RNA, 17 nt, Human
aguagcccuuucugugu

SEQ ID NO: 3392899 - RNA, 19 nt, Human
aguagcccuuucugugugc

SEQ ID NO: 3392900 - RNA, 20 nt, Human
aguagcccuuucugugugca

SEQ ID NO: 3392901 - RNA, 15 nt, Human
aguagccgagagccu

SEQ ID NO: 3392902 - RNA, 17 nt, Human
aguagccgagagccugc

SEQ ID NO: 3392903 - RNA, 16 nt, Human
aguagcgcuauaguua

SEQ ID NO: 3392904 - RNA, 20 nt, Human
aguagcguuuuuuaaaugua

SEQ ID NO: 3392905 - RNA, 21 nt, Human
aguagcguuuuuuaaauguau

SEQ ID NO: 3392906 - RNA, 14 nt, Human
aguagcugagcuca

SEQ ID NO: 3392907 - RNA, 19 nt, Human
aguagcugggacuacaggc

SEQ ID NO: 3392908 - RNA, 13 nt, Human
aguagcuugcucc

SEQ ID NO: 3392909 - RNA, 14 nt, Human
aguagcuugcuccc

SEQ ID NO: 3392910 - RNA, 17 nt, Human
aguagcuugcucccugu

SEQ ID NO: 3392911 - RNA, 20 nt, Human
aguagcuugggacaaaucaa

SEQ ID NO: 3392912 - RNA, 20 nt, Human
aguagcuuugcacuuuucua

SEQ ID NO: 3392913 - RNA, 16 nt, Human
aguaggaagacuuugg

SEQ ID NO: 3392914 - RNA, 22 nt, Human
aguaggacaaggugcaggcagg

SEQ ID NO: 3392915 - RNA, 23 nt, Human
aguaggacaaggugcaggcaggc

SEQ ID NO: 3392916 - RNA, 13 nt, Human
aguaggagcccag

SEQ ID NO: 3392917 - RNA, 20 nt, Human
aguaggauaugccugcucuu

SEQ ID NO: 3392918 - RNA, 17 nt, Human
aguaggcucauuuacug

SEQ ID NO: 3392919 - RNA, 19 nt, Human
aguaggggaagaauaauuu

SEQ ID NO: 3392920 - RNA, 13 nt, Human
aguagggucaggc

SEQ ID NO: 3392921 - RNA, 14 nt, Human
aguaguaaaaauua

SEQ ID NO: 3392922 - RNA, 16 nt, Human
aguaguaauagagcaa

SEQ ID NO: 3392923 - RNA, 21 nt, Human
aguaguaccaaaugcuuuaaa

SEQ ID NO: 3392924 - RNA, 17 nt, Human
aguaguacuucuucugu

SEQ ID NO: 3392925 - RNA, 21 nt, Human
aguaguacuucuucuguaaua

SEQ ID NO: 3392926 - RNA, 14 nt, Human
aguaguacuugaaa

SEQ ID NO: 3392927 - RNA, 18 nt, Human
aguagucagcuagaucau

SEQ ID NO: 3392928 - RNA, 13 nt, Human
aguagucauuuca

SEQ ID NO: 3392929 - RNA, 13 nt, Human
aguagucugcuca

SEQ ID NO: 3392930 - RNA, 14 nt, Human
aguagucugcucac

SEQ ID NO: 3392931 - RNA, 18 nt, Human
aguagugagaagaauauu

SEQ ID NO: 3392932 - RNA, 21 nt, Human
aguagugagaagaauauuguu

SEQ ID NO: 3392933 - RNA, 23 nt, Human
aguagugucacugcuuguuaugc

SEQ ID NO: 3392934 - RNA, 20 nt, Human
aguagugucuggaucaguaa

SEQ ID NO: 3392935 - RNA, 12 nt, Human
aguaguuaaaaa

SEQ ID NO: 3392936 - RNA, 14 nt, Human
aguaguuaaaaaaa

SEQ ID NO: 3392937 - RNA, 15 nt, Human
aguaguuaauucugu

SEQ ID NO: 3392938 - RNA, 16 nt, Human
aguaguuaucauguua

SEQ ID NO: 3392939 - RNA, 14 nt, Human
aguaguuccugcua

SEQ ID NO: 3392940 - RNA, 15 nt, Human
aguaguucucaaagu

SEQ ID NO: 3392941 - RNA, 16 nt, Human
aguaguucuguauuug

SEQ ID NO: 3392942 - RNA, 15 nt, Human
aguaguuugcauuuc

SEQ ID NO: 3392943 - RNA, 16 nt, Human
aguaguuugcauuuca

SEQ ID NO: 3392944 - RNA, 20 nt, Human
aguaguuugcauuucagaaa

SEQ ID NO: 3392945 - RNA, 13 nt, Human
aguauaaaaacaa

SEQ ID NO: 3392946 - RNA, 21 nt, Human
aguauaaaauacaacaaagga

SEQ ID NO: 3392947 - RNA, 22 nt, Human
aguauaaaauaguaugaaaaug

SEQ ID NO: 3392948 - RNA, 17 nt, Human
aguauaaacaaaguuac

SEQ ID NO: 3392949 - RNA, 17 nt, Human
aguauaaagaauugugg

SEQ ID NO: 3392950 - RNA, 14 nt, Human
aguauaagaaaugc

SEQ ID NO: 3392951 - RNA, 16 nt, Human
aguauaagaaaugcau

SEQ ID NO: 3392952 - RNA, 18 nt, Human
aguauaagaaaugcauau

SEQ ID NO: 3392953 - RNA, 16 nt, Human
aguauaauuaacaugu

SEQ ID NO: 3392954 - RNA, 16 nt, Human
aguauagaaaaucuuc

SEQ ID NO: 3392955 - RNA, 20 nt, Human
aguauaucccaagugcacuu

SEQ ID NO: 3392956 - RNA, 22 nt, Human
aguauaucuggacaagccaacu

SEQ ID NO: 3392957 - RNA, 14 nt, Human
aguauauuaaaaau

SEQ ID NO: 3392958 - RNA, 15 nt, Human
aguauauuaaaaaug

SEQ ID NO: 3392959 - RNA, 22 nt, Human
aguauauuaaaaaugguaaaau

SEQ ID NO: 3392960 - RNA, 16 nt, Human
aguauauuauaauaga

SEQ ID NO: 3392961 - RNA, 14 nt, Human
aguauauuuauagu

SEQ ID NO: 3392962 - RNA, 17 nt, Human
aguauauuuauauaauu

SEQ ID NO: 3392963 - RNA, 19 nt, Human
aguauauuuauauaauuau

SEQ ID NO: 3392964 - RNA, 13 nt, Human
aguaucacugucu

SEQ ID NO: 3392965 - RNA, 23 nt, Human
aguaucagagauguccauuuuua

SEQ ID NO: 3392966 - RNA, 18 nt, Human
aguaucaggucucccacg

SEQ ID NO: 3392967 - RNA, 16 nt, Human
aguaucaguguuuuaa

SEQ ID NO: 3392968 - RNA, 13 nt, Human
aguaucaugaagc

SEQ ID NO: 3392969 - RNA, 15 nt, Human
aguaucaugcccugu

SEQ ID NO: 3392970 - RNA, 19 nt, Human
aguaucaugcccugugcaa

SEQ ID NO: 3392971 - RNA, 14 nt, Human
aguauccacuuugc

SEQ ID NO: 3392972 - RNA, 21 nt, Human
aguauccaugcucuugaccuu

SEQ ID NO: 3392973 - RNA, 18 nt, Human
aguaucccacauccaacu

SEQ ID NO: 3392974 - RNA, 16 nt, Human
aguauccuccagguuu

SEQ ID NO: 3392975 - RNA, 19 nt, Human
aguauccuccagguuuuuc

SEQ ID NO: 3392976 - RNA, 22 nt, Human
aguauccuccagguuuuucaau

SEQ ID NO: 3392977 - RNA, 23 nt, Human
aguauccuccagguuuuucaauu

SEQ ID NO: 3392978 - RNA, 18 nt, Human
aguauccugcuucugaua

SEQ ID NO: 3392979 - RNA, 19 nt, Human
aguaucggcacuguacaaa

SEQ ID NO: 3392980 - RNA, 18 nt, Human
aguaucgggggcuggggc

SEQ ID NO: 3392981 - RNA, 14 nt, Human
aguaucuaaaagug

SEQ ID NO: 3392982 - RNA, 23 nt, Human
aguaucuauauauguguauguac

SEQ ID NO: 3392983 - RNA, 15 nt, Human
aguaucucagggccu

SEQ ID NO: 3392984 - RNA, 22 nt, Human
aguaucucaucaacaaagaaau

SEQ ID NO: 3392985 - RNA, 21 nt, Human
aguucugccucugauguauuu

SEQ ID NO: 3392986 - RNA, 15 nt, Human
aguucugcucauucu

SEQ ID NO: 3392987 - RNA, 18 nt, Human
aguucugcuccagacagg

SEQ ID NO: 3392988 - RNA, 12 nt, Human
aguucugcuccu

SEQ ID NO: 3392989 - RNA, 18 nt, Human
aguucugcuccucuccag

SEQ ID NO: 3392990 - RNA, 23 nt, Human
aguucuggauggugugccuucca

SEQ ID NO: 3392991 - RNA, 19 nt, Human
aguucugggugcucccuac

SEQ ID NO: 3392992 - RNA, 12 nt, Human
aguucuguagaa

SEQ ID NO: 3392993 - RNA, 15 nt, Human
aguucuguagaaaug

SEQ ID NO: 3392994 - RNA, 21 nt, Human
aguucuguagagccuucugau

SEQ ID NO: 3392995 - RNA, 13 nt, Human
aguucuguauuug

SEQ ID NO: 3392996 - RNA, 14 nt, Human
aguucuguauuuga

SEQ ID NO: 3392997 - RNA, 20 nt, Human
aguucuguauuugaaagugc

SEQ ID NO: 3392998 - RNA, 23 nt, Human
aguucuguauuugaaagugccuu

SEQ ID NO: 3392999 - RNA, 16 nt, Human
aguucuguguauuuaa

SEQ ID NO: 3393000 - RNA, 20 nt, Human
aguucuguuauauccccugc

SEQ ID NO: 3393001 - RNA, 18 nt, Human
aguucuuaacccaguguc

SEQ ID NO: 3393002 - RNA, 19 nt, Human
aguucuuacugcuuaauuc

SEQ ID NO: 3393003 - RNA, 23 nt, Human
aguucuuacugcuuaauucaaau

SEQ ID NO: 3393004 - RNA, 15 nt, Human
aguucuuagauaucu

SEQ ID NO: 3393005 - RNA, 18 nt, Human
aguucuuagauaucuuuu

SEQ ID NO: 3393006 - RNA, 21 nt, Human
aguucuuagauaucuuuuuau

SEQ ID NO: 3393007 - RNA, 16 nt, Human
aguucuuagcccucua

SEQ ID NO: 3393008 - RNA, 20 nt, Human
aguucuuaguugcuguaugu

SEQ ID NO: 3393009 - RNA, 17 nt, Human
aguucuuaugaggaggg

SEQ ID NO: 3393010 - RNA, 21 nt, Human
aguucuuaugaggaggggagg

SEQ ID NO: 3393011 - RNA, 23 nt, Human
aguucuuggucccuccagaacca

SEQ ID NO: 3393012 - RNA, 15 nt, Human
aguucuuuaaacugu

SEQ ID NO: 3393013 - RNA, 16 nt, Human
aguucuuugauucugu

SEQ ID NO: 3393014 - RNA, 18 nt, Human
aguucuuugauucuguaa

SEQ ID NO: 3393015 - RNA, 15 nt, Human
aguucuuuggauucu

SEQ ID NO: 3393016 - RNA, 17 nt, Human
aguucuuuggcugaaag

SEQ ID NO: 3393017 - RNA, 15 nt, Human
aguucuuugggccag

SEQ ID NO: 3393018 - RNA, 18 nt, Human
aguucuuugggccagaca

SEQ ID NO: 3393019 - RNA, 21 nt, Human
aguucuuuguucauagcccag

SEQ ID NO: 3393020 - RNA, 22 nt, Human
aguucuuuguucauagcccagu

SEQ ID NO: 3393021 - RNA, 18 nt, Human
aguugaaaagacuccaaa

SEQ ID NO: 3393022 - RNA, 22 nt, Human
aguugaaaaucuuauaauuuaa

SEQ ID NO: 3393023 - RNA, 17 nt, Human
aguugaaccuauuucuc

SEQ ID NO: 3393024 - RNA, 23 nt, Human
aguugaacugauaguuacuguug

SEQ ID NO: 3393025 - RNA, 14 nt, Human
aguugaagacagag

SEQ ID NO: 3393026 - RNA, 14 nt, Human
aguugaagcaaauc

SEQ ID NO: 3393027 - RNA, 17 nt, Human
aguugaagucaugcucc

SEQ ID NO: 3393028 - RNA, 19 nt, Human
aguugaauacuugaaccau

SEQ ID NO: 3393029 - RNA, 10 nt, Human
aguugaauuu

SEQ ID NO: 3393030 - RNA, 15 nt, Human
aguugaauuuuacau

SEQ ID NO: 3393031 - RNA, 13 nt, Human
aguugaauuuuuu

SEQ ID NO: 3393032 - RNA, 21 nt, Human
aguugaauuuuuuuuaacauu

SEQ ID NO: 3393033 - RNA, 23 nt, Human
aguugaauuuuuuuuaacauucc

SEQ ID NO: 3393034 - RNA, 14 nt, Human
aguugagacaagaa

SEQ ID NO: 3393035 - RNA, 15 nt, Human
aguugagccagcaga

SEQ ID NO: 3393036 - RNA, 12 nt, Human
aguugagcccca

SEQ ID NO: 3393037 - RNA, 21 nt, Human
aguugagccccaaguccugaa

SEQ ID NO: 3393038 - RNA, 17 nt, Human
aguugagcuaugacuua

SEQ ID NO: 3393039 - RNA, 18 nt, Human
aguugaggaacuguacag

SEQ ID NO: 3393040 - RNA, 11 nt, Human
aguugaggcca

SEQ ID NO: 3393041 - RNA, 21 nt, Human
aguugauaaagauuuuuuaau

SEQ ID NO: 3393042 - RNA, 23 nt, Human
aguugauagcacagacccugccc

SEQ ID NO: 3393043 - RNA, 17 nt, Human
aguugaucuggaaccca

SEQ ID NO: 3393044 - RNA, 20 nt, Human
aguugaucuggaacccagac

SEQ ID NO: 3393045 - RNA, 13 nt, Human
aguugauuagaaa

SEQ ID NO: 3393046 - RNA, 23 nt, Human
aguugauucagcucugcaagaau

SEQ ID NO: 3393047 - RNA, 23 nt, Human
aguugauuuuuuuuuuuuuuucc

SEQ ID NO: 3393048 - RNA, 19 nt, Human
aguugcaacuuuguauaaa

SEQ ID NO: 3393049 - RNA, 20 nt, Human
aguugcaauugaauuaaauu

SEQ ID NO: 3393050 - RNA, 16 nt, Human
aguugcacagcaucuc

SEQ ID NO: 3393051 - RNA, 20 nt, Human
aguugcacagcaucucagcu

SEQ ID NO: 3393052 - RNA, 16 nt, Human
aguugcacagcuauga

SEQ ID NO: 3393053 - RNA, 17 nt, Human
aguugcacagcuaugaa

SEQ ID NO: 3393054 - RNA, 17 nt, Human
aguugcacggcugcuga

SEQ ID NO: 3393055 - RNA, 18 nt, Human
aguugcagacucaguuug

SEQ ID NO: 3393056 - RNA, 14 nt, Human
aguugcagcuguuu

SEQ ID NO: 3393057 - RNA, 21 nt, Human
aguugcagcuguuuuguugac

SEQ ID NO: 3393058 - RNA, 18 nt, Human
aguugcauagcaguauau

SEQ ID NO: 3393059 - RNA, 22 nt, Human
aguugcauagguuuaauaauuu

SEQ ID NO: 3393060 - RNA, 13 nt, Human
aguugcauguagu

SEQ ID NO: 3393061 - RNA, 19 nt, Human
aguugcauguaguaacacu

SEQ ID NO: 3393062 - RNA, 21 nt, Human
aguugcauguaguaacacuaa

SEQ ID NO: 3393063 - RNA, 13 nt, Human
aguugccaagaca

SEQ ID NO: 3393064 - RNA, 19 nt, Human
aguugccaagacaaaucaa

SEQ ID NO: 3393065 - RNA, 14 nt, Human
aguugccaccaccu

SEQ ID NO: 3393066 - RNA, 22 nt, Human
aguugccaccaccucuguggca

SEQ ID NO: 3393067 - RNA, 20 nt, Human
aguugccagucaccccggcc

SEQ ID NO: 3393068 - RNA, 23 nt, Human
aguugccagucaccccggccacc

SEQ ID NO: 3393069 - RNA, 17 nt, Human
aguugccuaaauccauu

SEQ ID NO: 3393070 - RNA, 22 nt, Human
aguugccuaaauccauuuggaa

SEQ ID NO: 3393071 - RNA, 21 nt, Human
aguugcgacggagagaaaaaa

SEQ ID NO: 3393072 - RNA, 22 nt, Human
aguugcgacggagagaaaaaag

SEQ ID NO: 3393073 - RNA, 20 nt, Human
aguugcguggacucugcaca

SEQ ID NO: 3393074 - RNA, 13 nt, Human
aguugcuaaacac

SEQ ID NO: 3393075 - RNA, 16 nt, Human
aguugcuaaacacugc

SEQ ID NO: 3393076 - RNA, 23 nt, Human
aguugcuauuuuuguaaaguuuc

SEQ ID NO: 3393077 - RNA, 21 nt, Human
aguugcuccgccucugcuggc

SEQ ID NO: 3393078 - RNA, 16 nt, Human
aguugcucuaugcuuu

SEQ ID NO: 3393079 - RNA, 21 nt, Human
aguugcugcuucucccaggca

SEQ ID NO: 3393080 - RNA, 21 nt, Human
aguugcugucagucuugaccu

SEQ ID NO: 3393081 - RNA, 14 nt, Human
aguugcugucauaa

SEQ ID NO: 3393082 - RNA, 14 nt, Human
aguugcuguuuacu

SEQ ID NO: 3393083 - RNA, 15 nt, Human
aguuggaauuuacca

SEQ ID NO: 3393084 - RNA, 17 nt, Human
aguuggagucacucuua

SEQ ID NO: 3393085 - RNA, 19 nt, Human
aguuggagugaguguggcu

SEQ ID NO: 3393086 - RNA, 21 nt, Human
aguuggaguucauucauauua

SEQ ID NO: 3393087 - RNA, 23 nt, Human
aguuggaguucauucauauuaca

SEQ ID NO: 3393088 - RNA, 22 nt, Human
aguuggccauauuuaccucagc

SEQ ID NO: 3393089 - RNA, 16 nt, Human
aguuggcuaggacccc

SEQ ID NO: 3393090 - RNA, 18 nt, Human
aguuggcuaggggagcag

SEQ ID NO: 3393091 - RNA, 15 nt, Human
aguuggcuucuguuu

SEQ ID NO: 3393092 - RNA, 19 nt, Human
aguuggcuucuguuucuag

SEQ ID NO: 3393093 - RNA, 15 nt, Human
aguugggagcacugg

SEQ ID NO: 3393094 - RNA, 16 nt, Human
aguugggagcacugga

SEQ ID NO: 3393095 - RNA, 20 nt, Human
aguugggcuugcuauucugu

SEQ ID NO: 3393096 - RNA, 16 nt, Human
aguuggggcagaggag

SEQ ID NO: 3393097 - RNA, 21 nt, Human
aguugggggucagugcugccu

SEQ ID NO: 3393098 - RNA, 21 nt, Human
aguuggggucuggcagccucc

SEQ ID NO: 3393099 - RNA, 17 nt, Human
aguuggguggaugccug

SEQ ID NO: 3393100 - RNA, 16 nt, Human
aguuggguguauugug

SEQ ID NO: 3393101 - RNA, 15 nt, Human
aguuggguuuuuuaa

SEQ ID NO: 3393102 - RNA, 16 nt, Human
aguugguaacuuuugu

SEQ ID NO: 3393103 - RNA, 20 nt, Human
aguugguaacuuuugugaau

SEQ ID NO: 3393104 - RNA, 14 nt, Human
aguugguauuaaua

SEQ ID NO: 3393105 - RNA, 11 nt, Human
aguuggucccc

SEQ ID NO: 3393106 - RNA, 20 nt, Human
aguuggugagaaaccuguau

SEQ ID NO: 3393107 - RNA, 13 nt, Human
aguuguaaauaua

SEQ ID NO: 3393108 - RNA, 19 nt, Human
aguuguaacuuauauugaa

SEQ ID NO: 3393109 - RNA, 13 nt, Human
aguuguacaugaa

SEQ ID NO: 3393110 - RNA, 15 nt, Human
aguuguacaugaaau

SEQ ID NO: 3393111 - RNA, 19 nt, Human
aguuguacuuuaaaaauuu

SEQ ID NO: 3393112 - RNA, 18 nt, Human
aguuguagaauguauugu

SEQ ID NO: 3393113 - RNA, 21 nt, Human
aguuguagaauguauuguacc

SEQ ID NO: 3393114 - RNA, 14 nt, Human
aguuguagacaaag

SEQ ID NO: 3393115 - RNA, 16 nt, Human
aguuguagacaaagua

SEQ ID NO: 3393116 - RNA, 17 nt, Human
aguuguaucucuuuuga

SEQ ID NO: 3393117 - RNA, 22 nt, Human
aguuguaucucuuuugaaucca

SEQ ID NO: 3393118 - RNA, 16 nt, Human
aguugucacaucagau

SEQ ID NO: 3393119 - RNA, 11 nt, Human
aguugucucug

SEQ ID NO: 3393120 - RNA, 13 nt, Human
aguugucuugucc

SEQ ID NO: 3393121 - RNA, 17 nt, Human
aguugugaaaguuuuga

SEQ ID NO: 3393122 - RNA, 21 nt, Human
aguugugaccuuaguguuucu

SEQ ID NO: 3393123 - RNA, 21 nt, Human
aguugugcagcuuuuggucau

SEQ ID NO: 3393124 - RNA, 14 nt, Human
aguugugcuuguuu

SEQ ID NO: 3393125 - RNA, 18 nt, Human
aguuguggauuucaguuu

SEQ ID NO: 3393126 - RNA, 17 nt, Human
aguugugggugggagag

SEQ ID NO: 3393127 - RNA, 19 nt, Human
aguuguguacucuggccuc

SEQ ID NO: 3393128 - RNA, 21 nt, Human
aguuguguacucuggccucug

SEQ ID NO: 3393129 - RNA, 23 nt, Human
aguuguuaauaaaaguacauguu

SEQ ID NO: 3393130 - RNA, 22 nt, Human
aguuguuaccccaagcgcccug

SEQ ID NO: 3393131 - RNA, 18 nt, Human
aguuguuacuaacuaaac

SEQ ID NO: 3393132 - RNA, 13 nt, Human
aguuguuauuaca

SEQ ID NO: 3393133 - RNA, 17 nt, Human
aguuguuauuuauugaa

SEQ ID NO: 3393134 - RNA, 20 nt, Human
aguuguucaacuauuuuauu

SEQ ID NO: 3393135 - RNA, 21 nt, Human
aguuguucgggccaaggaccu

SEQ ID NO: 3393136 - RNA, 18 nt, Human
aguuguucuuuuuagaaa

SEQ ID NO: 3393137 - RNA, 15 nt, Human
aguuguugcccuggg

SEQ ID NO: 3393138 - RNA, 15 nt, Human
aguuguuggccuccg

SEQ ID NO: 3393139 - RNA, 22 nt, Human
aguuguuguggguucuauguuu

SEQ ID NO: 3393140 - RNA, 16 nt, Human
aguuguuguguacaga

SEQ ID NO: 3393141 - RNA, 16 nt, Human
aguuguuucauugacu

SEQ ID NO: 3393142 - RNA, 19 nt, Human
aguuguuucauugacuauc

SEQ ID NO: 3393143 - RNA, 20 nt, Human
aguuguuugauucagacagc

SEQ ID NO: 3393144 - RNA, 21 nt, Human
aguuguuugauucagacagcu

SEQ ID NO: 3393145 - RNA, 19 nt, Human
aguuguuuuuguauauugg

SEQ ID NO: 3393146 - RNA, 22 nt, Human
aguuguuuuuguauauugguuu

SEQ ID NO: 3393147 - RNA, 17 nt, Human
aguuuaaaaaucaacuu

SEQ ID NO: 3393148 - RNA, 19 nt, Human
aguuuaaaaaucaacuuuu

SEQ ID NO: 3393149 - RNA, 18 nt, Human
aguuuaaaacagaagccu

SEQ ID NO: 3393150 - RNA, 13 nt, Human
aguuuaaaacagu

SEQ ID NO: 3393151 - RNA, 20 nt, Human
aguuuaaaacaguauuuauu

SEQ ID NO: 3393152 - RNA, 22 nt, Human
aguuuaacacaaguccugugaa

SEQ ID NO: 3393153 - RNA, 14 nt, Human
aguuuaaggaauau

SEQ ID NO: 3393154 - RNA, 17 nt, Human
aguuuaauaaauuuauu

SEQ ID NO: 3393155 - RNA, 16 nt, Human
aguuuaauauuaaagc

SEQ ID NO: 3393156 - RNA, 18 nt, Human
aguuuaauauuaaagcca

SEQ ID NO: 3393157 - RNA, 19 nt, Human
aguuuaauauuaaagccau

SEQ ID NO: 3393158 - RNA, 12 nt, Human
aguuuaaugaag

SEQ ID NO: 3393159 - RNA, 23 nt, Human
aguuuaauugaaagaauguaaag

SEQ ID NO: 3393160 - RNA, 15 nt, Human
aguuuaauugacuua

SEQ ID NO: 3393161 - RNA, 13 nt, Human
aguuuacagaaaa

SEQ ID NO: 3393162 - RNA, 18 nt, Human
aguuuacagaaaaaucuu

SEQ ID NO: 3393163 - RNA, 19 nt, Human
aguuuacagaaaaaucuug

SEQ ID NO: 3393164 - RNA, 22 nt, Human
aguuuacaucauuuuuguaucu

SEQ ID NO: 3393165 - RNA, 13 nt, Human
aguuuacauugua

SEQ ID NO: 3393166 - RNA, 12 nt, Human
aguuuacauuuu

SEQ ID NO: 3393167 - RNA, 19 nt, Human
aguuuacauuuuuauuuau

SEQ ID NO: 3393168 - RNA, 21 nt, Human
aguuuacauuuuuauuuauga

SEQ ID NO: 3393169 - RNA, 22 nt, Human
aguuuacauuuuuauuuaugaa

SEQ ID NO: 3393170 - RNA, 16 nt, Human
aguuuaccaucugaaa

SEQ ID NO: 3393171 - RNA, 16 nt, Human
aguuuaccucuuuaaa

SEQ ID NO: 3393172 - RNA, 20 nt, Human
aguuuacuagcuuuucaaac

SEQ ID NO: 3393173 - RNA, 16 nt, Human
aguuuagaacagguuu

SEQ ID NO: 3393174 - RNA, 14 nt, Human
aguuuagaggaaaa

SEQ ID NO: 3393175 - RNA, 14 nt, Human
aguuuagauuucaa

SEQ ID NO: 3393176 - RNA, 16 nt, Human
aguuuagcuggaaaag

SEQ ID NO: 3393177 - RNA, 18 nt, Human
aguuuagggaacaauuug

SEQ ID NO: 3393178 - RNA, 13 nt, Human
aguuuauaaaaga

SEQ ID NO: 3393179 - RNA, 13 nt, Human
aguuuauaaaagu

SEQ ID NO: 3393180 - RNA, 15 nt, Human
aguuuauauuuaacu

SEQ ID NO: 3393181 - RNA, 18 nt, Human
aguuuauauuuaacucuc

SEQ ID NO: 3393182 - RNA, 15 nt, Human
aguuuaucaugaagc

SEQ ID NO: 3393183 - RNA, 19 nt, Human
aguuuaucaugaagccugu

SEQ ID NO: 3393184 - RNA, 15 nt, Human
aguuuaucuguucau

SEQ ID NO: 3393185 - RNA, 15 nt, Human
aguuuaugucuaaag

SEQ ID NO: 3393186 - RNA, 16 nt, Human
aguuuaugucuaaaga

SEQ ID NO: 3393187 - RNA, 17 nt, Human
aguuuaugucucaguuu

SEQ ID NO: 3393188 - RNA, 21 nt, Human
aguuuauuccagagcugccag

SEQ ID NO: 3393189 - RNA, 16 nt, Human
aguuuauucucauuug

SEQ ID NO: 3393190 - RNA, 22 nt, Human
aguuuauugacaauaauuucag

SEQ ID NO: 3393191 - RNA, 13 nt, Human
aguuuauuuguug

SEQ ID NO: 3393192 - RNA, 16 nt, Human
aguuuauuuguugaga

SEQ ID NO: 3393193 - RNA, 18 nt, Human
aguuuauuuguugagagu

SEQ ID NO: 3393194 - RNA, 23 nt, Human
aguuuauuuuaaaacaauaggau

SEQ ID NO: 3393195 - RNA, 16 nt, Human
aguuucaaaaaucuga

SEQ ID NO: 3393196 - RNA, 21 nt, Human
aguuucaaaaaucugaagauu

SEQ ID NO: 3393197 - RNA, 21 nt, Human
aguuucaaacuuacuauuuug

SEQ ID NO: 3393198 - RNA, 16 nt, Human
aguuucaauaaaguuu

SEQ ID NO: 3393199 - RNA, 21 nt, Human
aguuucaauaaaguuugaucu

SEQ ID NO: 3393200 - RNA, 22 nt, Human
aguuucaaugugauucuaaugu

SEQ ID NO: 3393201 - RNA, 17 nt, Human
aguuucacagaaaauaa

SEQ ID NO: 3393202 - RNA, 18 nt, Human
aguuucagagaaguucug

SEQ ID NO: 3393203 - RNA, 16 nt, Human
aguuucagaguucuca

SEQ ID NO: 3393204 - RNA, 23 nt, Human
aguuucagauauauaucauauug

SEQ ID NO: 3393205 - RNA, 15 nt, Human
aguuucagcuuaaaa

SEQ ID NO: 3393206 - RNA, 20 nt, Human
aguuucaggauacaugugcc

SEQ ID NO: 3393207 - RNA, 18 nt, Human
aguuucaggugacaugug

SEQ ID NO: 3393208 - RNA, 22 nt, Human
aguuucaggugacaugugaaac

SEQ ID NO: 3393209 - RNA, 20 nt, Human
aguuucaguauuagaugcac

SEQ ID NO: 3393210 - RNA, 18 nt, Human
aguuucauagcuaagaaa

SEQ ID NO: 3393211 - RNA, 21 nt, Human
aguuucauguacaagaugaag

SEQ ID NO: 3393212 - RNA, 15 nt, Human
aguuuccaaaaccag

SEQ ID NO: 3393213 - RNA, 16 nt, Human
aguuuccaaaaccaga

SEQ ID NO: 3393214 - RNA, 17 nt, Human
aguuuccaagcaaaugu

SEQ ID NO: 3393215 - RNA, 19 nt, Human
aguuuccaagcaaauguua

SEQ ID NO: 3393216 - RNA, 17 nt, Human
aguuuccagucucaaaa

SEQ ID NO: 3393217 - RNA, 16 nt, Human
aguuucccuuccucca

SEQ ID NO: 3393218 - RNA, 20 nt, Human
aguuucccuuccuccauccu

SEQ ID NO: 3393219 - RNA, 23 nt, Human
aguuuccguuuccagguguuuau

SEQ ID NO: 3393220 - RNA, 15 nt, Human
aguuuccuaaaaguu

SEQ ID NO: 3393221 - RNA, 13 nt, Human
aguuuccucaggc

SEQ ID NO: 3393222 - RNA, 23 nt, Human
aguuuccucaggcugcuggagga

SEQ ID NO: 3393223 - RNA, 19 nt, Human
aguuuccuuuucugucucu

SEQ ID NO: 3393224 - RNA, 16 nt, Human
aguuuccuuuuuaaua

SEQ ID NO: 3393225 - RNA, 15 nt, Human
aguuucguuuucaaa

SEQ ID NO: 3393226 - RNA, 17 nt, Human
aguuucuaaacuggaga

SEQ ID NO: 3393227 - RNA, 15 nt, Human
aguuucuaagauucu

SEQ ID NO: 3393228 - RNA, 16 nt, Human
aguuucuaagauucua

SEQ ID NO: 3393229 - RNA, 20 nt, Human
aguuucuaagauucuaaagg

SEQ ID NO: 3393230 - RNA, 12 nt, Human
aguuucuaaggu

SEQ ID NO: 3393231 - RNA, 21 nt, Human
aguuucuagcuagaaauauga

SEQ ID NO: 3393232 - RNA, 18 nt, Human
aguuucucagauccuugu

SEQ ID NO: 3393233 - RNA, 23 nt, Human
aguuucucagauccuuguuucaa

SEQ ID NO: 3393234 - RNA, 11 nt, Human
aguuucucagc

SEQ ID NO: 3393235 - RNA, 13 nt, Human
aguuucucagcuc

SEQ ID NO: 3393236 - RNA, 23 nt, Human
aguuucucugcagaaacuacuga

SEQ ID NO: 3393237 - RNA, 22 nt, Human
aguuucugucguuaaaaacaga

SEQ ID NO: 3393238 - RNA, 17 nt, Human
aguuucugugguuggcu

SEQ ID NO: 3393239 - RNA, 13 nt, Human
aguuucuguucug

SEQ ID NO: 3393240 - RNA, 15 nt, Human
aguuucuguucugug

SEQ ID NO: 3393241 - RNA, 18 nt, Human
aguuucuguucuguggaa

SEQ ID NO: 3393242 - RNA, 14 nt, Human
aguuucuguuugau

SEQ ID NO: 3393243 - RNA, 14 nt, Human
aguuucuuuacauu

SEQ ID NO: 3393244 - RNA, 23 nt, Human
aguuucuuuccugccuucuucuu

SEQ ID NO: 3393245 - RNA, 18 nt, Human
aguuugaaauaagcuauu

SEQ ID NO: 3393246 - RNA, 20 nt, Human
aguuugaaauucugaauuug

SEQ ID NO: 3393247 - RNA, 15 nt, Human
aguuugaaggaaaca

SEQ ID NO: 3393248 - RNA, 12 nt, Human
aguuugaauguu

SEQ ID NO: 3393249 - RNA, 14 nt, Human
aguuugaauguuaa

SEQ ID NO: 3393250 - RNA, 21 nt, Human
aguuugaauuccuaaaauuau

SEQ ID NO: 3393251 - RNA, 15 nt, Human
aguuugagcugccuu

SEQ ID NO: 3393252 - RNA, 18 nt, Human
aguuugauaaauaguguu

SEQ ID NO: 3393253 - RNA, 20 nt, Human
aguuugaucacacuauuuua

SEQ ID NO: 3393254 - RNA, 14 nt, Human
aguuugauuaaauu

SEQ ID NO: 3393255 - RNA, 22 nt, Human
aguuugauuaaauucuugcaaa

SEQ ID NO: 3393256 - RNA, 23 nt, Human
aguuugauuaaauucuugcaaag

SEQ ID NO: 3393257 - RNA, 23 nt, Human
aguuugauuauucagugucacug

SEQ ID NO: 3393258 - RNA, 17 nt, Human
aguuugcaaaaaauguu

SEQ ID NO: 3393259 - RNA, 20 nt, Human
aguuugcacucaaaucuuaa

SEQ ID NO: 3393260 - RNA, 20 nt, Human
aguuugcagaaaagcaccug

SEQ ID NO: 3393261 - RNA, 13 nt, Human
aguuugcagagua

SEQ ID NO: 3393262 - RNA, 11 nt, Human
aguuugcaguu

SEQ ID NO: 3393263 - RNA, 12 nt, Human
aguuugcccugg

SEQ ID NO: 3393264 - RNA, 22 nt, Human
aguuugccggauacaaacuggu

SEQ ID NO: 3393265 - RNA, 15 nt, Human
aguuugcuaauguuu

SEQ ID NO: 3393266 - RNA, 18 nt, Human
aguuugcuguacuagaga

SEQ ID NO: 3393267 - RNA, 15 nt, Human
aguuugcuuguuucu

SEQ ID NO: 3393268 - RNA, 16 nt, Human
aguuuggauauguaaa

SEQ ID NO: 3393269 - RNA, 18 nt, Human
aguuuggcaaacucucca

SEQ ID NO: 3393270 - RNA, 15 nt, Human
aguuuggcauuugca

SEQ ID NO: 3393271 - RNA, 19 nt, Human
aguuugggaucccugucuu

SEQ ID NO: 3393272 - RNA, 20 nt, Human
aguuugggaucccugucuuu

SEQ ID NO: 3393273 - RNA, 20 nt, Human
auaaaguauagagagaaguu

SEQ ID NO: 3393274 - RNA, 15 nt, Human
auaaaguaucaucag

SEQ ID NO: 3393275 - RNA, 17 nt, Human
auaaaguaucaugcauu

SEQ ID NO: 3393276 - RNA, 19 nt, Human
auaaaguaugguauugaaa

SEQ ID NO: 3393277 - RNA, 23 nt, Human
auaaaguauuccaccuuaaauua

SEQ ID NO: 3393278 - RNA, 12 nt, Human
auaaaguauuua

SEQ ID NO: 3393279 - RNA, 14 nt, Human
auaaaguauuuaau

SEQ ID NO: 3393280 - RNA, 15 nt, Human
auaaaguauuuaauu

SEQ ID NO: 3393281 - RNA, 22 nt, Human
auaaaguggaaguauguauauu

SEQ ID NO: 3393282 - RNA, 13 nt, Human
auaaaguguaaua

SEQ ID NO: 3393283 - RNA, 13 nt, Human
auaaaguguuuuc

SEQ ID NO: 3393284 - RNA, 15 nt, Human
auaaaguguuuucag

SEQ ID NO: 3393285 - RNA, 12 nt, Human
auaaaguuagaa

SEQ ID NO: 3393286 - RNA, 21 nt, Human
auaaaguucugaguguuuuua

SEQ ID NO: 3393287 - RNA, 22 nt, Human
auaaaguugaagcuaagauuua

SEQ ID NO: 3393288 - RNA, 13 nt, Human
auaaaguuugauc

SEQ ID NO: 3393289 - RNA, 22 nt, Human
auaaaguuuuauauauuauaug

SEQ ID NO: 3393290 - RNA, 13 nt, Human
auaaauaaaaaua

SEQ ID NO: 3393291 - RNA, 12 nt, Human
auaaauaaauau

SEQ ID NO: 3393292 - RNA, 20 nt, Human
auaaauaacccauaauugaa

SEQ ID NO: 3393293 - RNA, 19 nt, Human
auaaauaacucaauggaaa

SEQ ID NO: 3393294 - RNA, 21 nt, Human
auaaauaaucggcccacagcu

SEQ ID NO: 3393295 - RNA, 18 nt, Human
auaaauaauugaaacaau

SEQ ID NO: 3393296 - RNA, 15 nt, Human
auaaauagaaaagua

SEQ ID NO: 3393297 - RNA, 21 nt, Human
auaaauagaugcuguguauau

SEQ ID NO: 3393298 - RNA, 18 nt, Human
auaaauagcuagacuggu

SEQ ID NO: 3393299 - RNA, 15 nt, Human
auaaauauaagccuu

SEQ ID NO: 3393300 - RNA, 15 nt, Human
auaaauauauauaaa

SEQ ID NO: 3393301 - RNA, 20 nt, Human
auaaauauauauaaauauau

SEQ ID NO: 3393302 - RNA, 21 nt, Human
auaaauauauauaaauauaua

SEQ ID NO: 3393303 - RNA, 21 nt, Human
auaaauauauauauauauaaa

SEQ ID NO: 3393304 - RNA, 23 nt, Human
auaaauauauauauauauaaaau

SEQ ID NO: 3393305 - RNA, 20 nt, Human
auaaauauauauauccucug

SEQ ID NO: 3393306 - RNA, 18 nt, Human
auaaauauauuauuacuu

SEQ ID NO: 3393307 - RNA, 23 nt, Human
auaaauauauuauuacuuguaaa

SEQ ID NO: 3393308 - RNA, 12 nt, Human
auaaauaugaag

SEQ ID NO: 3393309 - RNA, 22 nt, Human
auaaauaugccucuccuuugua

SEQ ID NO: 3393310 - RNA, 22 nt, Human
auaaauaugguuaauuucaugu

SEQ ID NO: 3393311 - RNA, 18 nt, Human
auaaauauguuucacaca

SEQ ID NO: 3393312 - RNA, 20 nt, Human
auaaauauuugacuugcaug

SEQ ID NO: 3393313 - RNA, 20 nt, Human
auaaaucauauugaugaaaa

SEQ ID NO: 3393314 - RNA, 21 nt, Human
auaaaucauauugaugaaaag

SEQ ID NO: 3393315 - RNA, 15 nt, Human
auaaauccagugacc

SEQ ID NO: 3393316 - RNA, 22 nt, Human
auaaauccagugaccucucucu

SEQ ID NO: 3393317 - RNA, 16 nt, Human
auaaaucgcuuuugau

SEQ ID NO: 3393318 - RNA, 21 nt, Human
auaaaucuaaugacauucaau

SEQ ID NO: 3393319 - RNA, 15 nt, Human
auaaaucugacccag

SEQ ID NO: 3393320 - RNA, 16 nt, Human
auaaaucugacccagu

SEQ ID NO: 3393321 - RNA, 15 nt, Human
auaaaucuuuggaaa

SEQ ID NO: 3393322 - RNA, 18 nt, Human
auaaaugaagcagcuuua

SEQ ID NO: 3393323 - RNA, 17 nt, Human
auaaaugaaguuuauac

SEQ ID NO: 3393324 - RNA, 22 nt, Human
auaaaugaaguuuauacaguac

SEQ ID NO: 3393325 - RNA, 12 nt, Human
auaaaugaaugu

SEQ ID NO: 3393326 - RNA, 16 nt, Human
auaaaugaauuuuagu

SEQ ID NO: 3393327 - RNA, 17 nt, Human
auaaaugaauuuuaguu

SEQ ID NO: 3393328 - RNA, 18 nt, Human
auaaaugagcuauguauu

SEQ ID NO: 3393329 - RNA, 16 nt, Human
auaaaugauucuuagu

SEQ ID NO: 3393330 - RNA, 22 nt, Human
auaaaugcaauauguauuaaua

SEQ ID NO: 3393331 - RNA, 23 nt, Human
auaaaugcuauuuuuuauuuuac

SEQ ID NO: 3393332 - RNA, 13 nt, Human
auaaaugcuuuua

SEQ ID NO: 3393333 - RNA, 14 nt, Human
auaaauggaaauca

SEQ ID NO: 3393334 - RNA, 20 nt, Human
auaaaugguuuggugcuuuu

SEQ ID NO: 3393335 - RNA, 17 nt, Human
auaaauguauaaauaua

SEQ ID NO: 3393336 - RNA, 13 nt, Human
auaaauguauaua

SEQ ID NO: 3393337 - RNA, 15 nt, Human
auaaauguauauaca

SEQ ID NO: 3393338 - RNA, 17 nt, Human
auaaauguauauacaca

SEQ ID NO: 3393339 - RNA, 21 nt, Human
auaaauguauauacacauaua

SEQ ID NO: 3393340 - RNA, 15 nt, Human
auaaauguauugauu

SEQ ID NO: 3393341 - RNA, 22 nt, Human
auaaaugucuuuuuuuuaaugu

SEQ ID NO: 3393342 - RNA, 17 nt, Human
auaaauguguguaugug

SEQ ID NO: 3393343 - RNA, 20 nt, Human
auaaauguguguaugugugu

SEQ ID NO: 3393344 - RNA, 19 nt, Human
auaaauuaaauauauguau

SEQ ID NO: 3393345 - RNA, 13 nt, Human
auaaauuauguuu

SEQ ID NO: 3393346 - RNA, 15 nt, Human
auaaauuauguuuau

SEQ ID NO: 3393347 - RNA, 13 nt, Human
auaaauuauuguu

SEQ ID NO: 3393348 - RNA, 17 nt, Human
auaaauuauuugauuau

SEQ ID NO: 3393349 - RNA, 20 nt, Human
auaaauucaacuuuguaaaa

SEQ ID NO: 3393350 - RNA, 16 nt, Human
auaaauucagauauau

SEQ ID NO: 3393351 - RNA, 23 nt, Human
auaaauucccaacuucucuugcu

SEQ ID NO: 3393352 - RNA, 21 nt, Human
auaaauucccuggccuuucau

SEQ ID NO: 3393353 - RNA, 13 nt, Human
auaaauugaaaua

SEQ ID NO: 3393354 - RNA, 19 nt, Human
auaaauugauuuuuauaaa

SEQ ID NO: 3393355 - RNA, 17 nt, Human
auaaauugcauaaagca

SEQ ID NO: 3393356 - RNA, 13 nt, Human
auaaauugcuccu

SEQ ID NO: 3393357 - RNA, 18 nt, Human
auaaauugcuccuugaca

SEQ ID NO: 3393358 - RNA, 19 nt, Human
auaaauuguaauuguaaag

SEQ ID NO: 3393359 - RNA, 15 nt, Human
auaaauugucuuaau

SEQ ID NO: 3393360 - RNA, 17 nt, Human
auaaauugucuuuaaaa

SEQ ID NO: 3393361 - RNA, 21 nt, Human
auaaauugucuuuaaaaacug

SEQ ID NO: 3393362 - RNA, 20 nt, Human
auaaauuguuuggcuuccuc

SEQ ID NO: 3393363 - RNA, 16 nt, Human
auaaauuuacuuuaca

SEQ ID NO: 3393364 - RNA, 19 nt, Human
auaaauuuauuuacugcua

SEQ ID NO: 3393365 - RNA, 18 nt, Human
auaaauuucuauuuuuau

SEQ ID NO: 3393366 - RNA, 18 nt, Human
auaaauuugacuuuucug

SEQ ID NO: 3393367 - RNA, 22 nt, Human
auaaauuuugaaaaguaauauu

SEQ ID NO: 3393368 - RNA, 13 nt, Human
auaacaaagaacc

SEQ ID NO: 3393369 - RNA, 23 nt, Human
auaacaaagaaccuaacauuuau

SEQ ID NO: 3393370 - RNA, 15 nt, Human
auaacaaagauaucu

SEQ ID NO: 3393371 - RNA, 19 nt, Human
auaacaaagauaucuuuuc

SEQ ID NO: 3393372 - RNA, 20 nt, Human
auaacaaaggauacuuauuu

SEQ ID NO: 3393373 - RNA, 16 nt, Human
auaacaaauaaccaac

SEQ ID NO: 3393374 - RNA, 14 nt, Human
auaacaacuucaua

SEQ ID NO: 3393375 - RNA, 13 nt, Human
auaacaacuuuuu

SEQ ID NO: 3393376 - RNA, 14 nt, Human
auaacaacuuuuuu

SEQ ID NO: 3393377 - RNA, 13 nt, Human
auaacaagaaaau

SEQ ID NO: 3393378 - RNA, 17 nt, Human
auaacaagaucuuucag

SEQ ID NO: 3393379 - RNA, 19 nt, Human
auaacaagaucuuucagga

SEQ ID NO: 3393380 - RNA, 14 nt, Human
auaacaaugaaagu

SEQ ID NO: 3393381 - RNA, 19 nt, Human
auaacaaugcuguauuuua

SEQ ID NO: 3393382 - RNA, 21 nt, Human
auaacaaugcuguauuuuaaa

SEQ ID NO: 3393383 - RNA, 14 nt, Human
auaacaauguuaag

SEQ ID NO: 3393384 - RNA, 18 nt, Human
auaacaauguuaaggaaa

SEQ ID NO: 3393385 - RNA, 15 nt, Human
auaacaauuguuugg

SEQ ID NO: 3393386 - RNA, 14 nt, Human
auaacacaauauga

SEQ ID NO: 3393387 - RNA, 14 nt, Human
auaacacacagcua

SEQ ID NO: 3393388 - RNA, 23 nt, Human
auaacacauuuuuuugcaugcau

SEQ ID NO: 3393389 - RNA, 19 nt, Human
auaacaccaccauucacaa

SEQ ID NO: 3393390 - RNA, 14 nt, Human
auaacaccugccac

SEQ ID NO: 3393391 - RNA, 15 nt, Human
auaacacuaaaauuu

SEQ ID NO: 3393392 - RNA, 23 nt, Human
auaacagaaagccugggugacau

SEQ ID NO: 3393393 - RNA, 14 nt, Human
auaacagaagaaaa

SEQ ID NO: 3393394 - RNA, 17 nt, Human
auaacagaagaaaauag

SEQ ID NO: 3393395 - RNA, 19 nt, Human
auaacagauuuuuuuugga

SEQ ID NO: 3393396 - RNA, 16 nt, Human
auaacagccgcuccag

SEQ ID NO: 3393397 - RNA, 22 nt, Human
auaacagcugcaauucccugga

SEQ ID NO: 3393398 - RNA, 16 nt, Human
auaacaggguaaauua

SEQ ID NO: 3393399 - RNA, 19 nt, Human
auaacaggguaaauuauuc

SEQ ID NO: 3393400 - RNA, 23 nt, Human
auaacagguuauuuuaguuucug

SEQ ID NO: 3393401 - RNA, 12 nt, Human
auaacagugcag

SEQ ID NO: 3393402 - RNA, 18 nt, Human
auaacagugcagggcaaa

SEQ ID NO: 3393403 - RNA, 15 nt, Human
auaacagugccauug

SEQ ID NO: 3393404 - RNA, 21 nt, Human
auaacagugccauugucuuua

SEQ ID NO: 3393405 - RNA, 19 nt, Human
auaacagugugguaguuaa

SEQ ID NO: 3393406 - RNA, 17 nt, Human
auaacauaaaucuguga

SEQ ID NO: 3393407 - RNA, 15 nt, Human
auaacauaacaaaua

SEQ ID NO: 3393408 - RNA, 14 nt, Human
auaacauauaugga

SEQ ID NO: 3393409 - RNA, 14 nt, Human
auaacauaugcagu

SEQ ID NO: 3393410 - RNA, 23 nt, Human
auaacaugaaaugauagauuuga

SEQ ID NO: 3393411 - RNA, 13 nt, Human
auaacauguaauu

SEQ ID NO: 3393412 - RNA, 14 nt, Human
auaacauuaccuua

SEQ ID NO: 3393413 - RNA, 19 nt, Human
auaacauuaccuuacugug

SEQ ID NO: 3393414 - RNA, 14 nt, Human
auaaccaaaugaaa

SEQ ID NO: 3393415 - RNA, 20 nt, Human
auaaccaauguuuaaaaaag

SEQ ID NO: 3393416 - RNA, 23 nt, Human
auaaccacaaagcacaguuugaa

SEQ ID NO: 3393417 - RNA, 18 nt, Human
auaauucugaaguuauau

SEQ ID NO: 3393418 - RNA, 20 nt, Human
auaauucugaaguuauauuu

SEQ ID NO: 3393419 - RNA, 23 nt, Human
auaauucugaguuuuguguuugu

SEQ ID NO: 3393420 - RNA, 23 nt, Human
auaauucuguacauagccuauau

SEQ ID NO: 3393421 - RNA, 15 nt, Human
auaauucuguacuga

SEQ ID NO: 3393422 - RNA, 17 nt, Human
auaauucuguacugauu

SEQ ID NO: 3393423 - RNA, 14 nt, Human
auaauucuuauuuu

SEQ ID NO: 3393424 - RNA, 14 nt, Human
auaauucuuguaua

SEQ ID NO: 3393425 - RNA, 19 nt, Human
auaauucuuguauauuaug

SEQ ID NO: 3393426 - RNA, 14 nt, Human
auaauucuuugauu

SEQ ID NO: 3393427 - RNA, 22 nt, Human
auaauugacaggauuauuggaa

SEQ ID NO: 3393428 - RNA, 22 nt, Human
auaauugcauugacuuucccca

SEQ ID NO: 3393429 - RNA, 22 nt, Human
auaauugccaaaaagugaaaua

SEQ ID NO: 3393430 - RNA, 20 nt, Human
auaauugcuauuuauuuuua

SEQ ID NO: 3393431 - RNA, 16 nt, Human
auaauuggauuuccua

SEQ ID NO: 3393432 - RNA, 20 nt, Human
auaauuggauuuccuaauac

SEQ ID NO: 3393433 - RNA, 24 nt, Human
auaauuguacaaaauuaagcaaau

SEQ ID NO: 3393434 - RNA, 12 nt, Human
auaauuguauca

SEQ ID NO: 3393435 - RNA, 21 nt, Human
auaauuguaucguauagcugu

SEQ ID NO: 3393436 - RNA, 20 nt, Human
auaauugugauuagacagaa

SEQ ID NO: 3393437 - RNA, 21 nt, Human
auaauugugugauauuucaga

SEQ ID NO: 3393438 - RNA, 15 nt, Human
auaauuguuguucug

SEQ ID NO: 3393439 - RNA, 19 nt, Human
auaauuguuguucuguuaa

SEQ ID NO: 3393440 - RNA, 21 nt, Human
auaauuguuguucuguuaacu

SEQ ID NO: 3393441 - RNA, 22 nt, Human
auaauuguuguucuguuaacug

SEQ ID NO: 3393442 - RNA, 14 nt, Human
auaauuguuuuuua

SEQ ID NO: 3393443 - RNA, 18 nt, Human
auaauuguuuuuuaucuu

SEQ ID NO: 3393444 - RNA, 23 nt, Human
auaauuguuuuuuaucuuuucua

SEQ ID NO: 3393445 - RNA, 13 nt, Human
auaauuuaccuaa

SEQ ID NO: 3393446 - RNA, 16 nt, Human
auaauuuaccuaagau

SEQ ID NO: 3393447 - RNA, 13 nt, Human
auaauuuacugug

SEQ ID NO: 3393448 - RNA, 14 nt, Human
auaauuucagggug

SEQ ID NO: 3393449 - RNA, 11 nt, Human
auaauuuccca

SEQ ID NO: 3393450 - RNA, 15 nt, Human
auaauuucgagauuu

SEQ ID NO: 3393451 - RNA, 18 nt, Human
auaauuugguauccuuau

SEQ ID NO: 3393452 - RNA, 16 nt, Human
auaauuuguuuccagc

SEQ ID NO: 3393453 - RNA, 11 nt, Human
auaauuuuaaa

SEQ ID NO: 3393454 - RNA, 21 nt, Human
auaauuuuaaaaaagccuucc

SEQ ID NO: 3393455 - RNA, 17 nt, Human
auaauuuuaaaaauggu

SEQ ID NO: 3393456 - RNA, 14 nt, Human
auaauuuuaagaaa

SEQ ID NO: 3393457 - RNA, 12 nt, Human
auaauuuuacaa

SEQ ID NO: 3393458 - RNA, 12 nt, Human
auaauuuuauga

SEQ ID NO: 3393459 - RNA, 19 nt, Human
auaauuuuaugaaugucuu

SEQ ID NO: 3393460 - RNA, 14 nt, Human
auaauuuucugaaa

SEQ ID NO: 3393461 - RNA, 15 nt, Human
auaauuuucugaaag

SEQ ID NO: 3393462 - RNA, 13 nt, Human
auaauuuucuuca

SEQ ID NO: 3393463 - RNA, 23 nt, Human
auaauuuucuucaugcaaugaca

SEQ ID NO: 3393464 - RNA, 21 nt, Human
auaauuuugcauaaaauugga

SEQ ID NO: 3393465 - RNA, 23 nt, Human
auaauuuuguaauguaucaaaua

SEQ ID NO: 3393466 - RNA, 20 nt, Human
auaauuuugugaagcaaaau

SEQ ID NO: 3393467 - RNA, 18 nt, Human
auaauuuuuaaaguauau

SEQ ID NO: 3393468 - RNA, 21 nt, Human
auaauuuuuaaaguauauauu

SEQ ID NO: 3393469 - RNA, 19 nt, Human
auaauuuuuauauuuaauu

SEQ ID NO: 3393470 - RNA, 22 nt, Human
auaauuuuuauauuugaaauau

SEQ ID NO: 3393471 - RNA, 15 nt, Human
auaauuuuuuauuca

SEQ ID NO: 3393472 - RNA, 18 nt, Human
auaauuuuuuuuaaaaua

SEQ ID NO: 3393473 - RNA, 13 nt, Human
auacaaaaagaaa

SEQ ID NO: 3393474 - RNA, 23 nt, Human
auacaaaaaucagccagacaugg

SEQ ID NO: 3393475 - RNA, 15 nt, Human
auacaaaaauuugcc

SEQ ID NO: 3393476 - RNA, 13 nt, Human
auacaaaagcaug

SEQ ID NO: 3393477 - RNA, 18 nt, Human
auacaaaccuaccaaaau

SEQ ID NO: 3393478 - RNA, 19 nt, Human
auacaaaggcuuauuaauu

SEQ ID NO: 3393479 - RNA, 19 nt, Human
auacaaaguuagagaacua

SEQ ID NO: 3393480 - RNA, 17 nt, Human
auacaaauauaaaucuu

SEQ ID NO: 3393481 - RNA, 17 nt, Human
auacaaaugcaucuuug

SEQ ID NO: 3393482 - RNA, 18 nt, Human
auacaaaugcaucuuuga

SEQ ID NO: 3393483 - RNA, 19 nt, Human
auacaaaugcaucuuugau

SEQ ID NO: 3393484 - RNA, 22 nt, Human
auacaaaugcaucuuugaugug

SEQ ID NO: 3393485 - RNA, 13 nt, Human
auacaaauggauu

SEQ ID NO: 3393486 - RNA, 22 nt, Human
auacaacaaaggcaaguuaaga

SEQ ID NO: 3393487 - RNA, 23 nt, Human
auacaacaaaggcaaguuaagag

SEQ ID NO: 3393488 - RNA, 20 nt, Human
auacaacaccaaaaaauauc

SEQ ID NO: 3393489 - RNA, 21 nt, Human
auacaacaccaaaaaauaucu

SEQ ID NO: 3393490 - RNA, 14 nt, Human
auacaacagugcua

SEQ ID NO: 3393491 - RNA, 18 nt, Human
auacaacagugcuaaaaa

SEQ ID NO: 3393492 - RNA, 15 nt, Human
auacaaccucccucu

SEQ ID NO: 3393493 - RNA, 20 nt, Human
auacaaccucccucuuguuu

SEQ ID NO: 3393494 - RNA, 14 nt, Human
auacaaccugcuug

SEQ ID NO: 3393495 - RNA, 15 nt, Human
auacaagauaagcuu

SEQ ID NO: 3393496 - RNA, 15 nt, Human
auacaagauugaaaa

SEQ ID NO: 3393497 - RNA, 12 nt, Human
auacaagccaaa

SEQ ID NO: 3393498 - RNA, 12 nt, Human
auacaauaaacu

SEQ ID NO: 3393499 - RNA, 12 nt, Human
auacaauaaauu

SEQ ID NO: 3393500 - RNA, 11 nt, Human
auacaauaaug

SEQ ID NO: 3393501 - RNA, 13 nt, Human
auacaauaaugga

SEQ ID NO: 3393502 - RNA, 15 nt, Human
auacaauaauggaaa

SEQ ID NO: 3393503 - RNA, 16 nt, Human
auacaauaauggaaaa

SEQ ID NO: 3393504 - RNA, 19 nt, Human
auacaauaauggaaaaaaa

SEQ ID NO: 3393505 - RNA, 19 nt, Human
auacaauauauaaaaauau

SEQ ID NO: 3393506 - RNA, 14 nt, Human
auacaauauauagc

SEQ ID NO: 3393507 - RNA, 16 nt, Human
auacaauauauagcug

SEQ ID NO: 3393508 - RNA, 21 nt, Human
auacaaugaugcuauuugcaa

SEQ ID NO: 3393509 - RNA, 17 nt, Human
auacaaugcugugcccu

SEQ ID NO: 3393510 - RNA, 16 nt, Human
auacaauuuuguuucu

SEQ ID NO: 3393511 - RNA, 17 nt, Human
auacaauuuuguuucug

SEQ ID NO: 3393512 - RNA, 14 nt, Human
auacacacacaaag

SEQ ID NO: 3393513 - RNA, 17 nt, Human
auacacacacaaagaga

SEQ ID NO: 3393514 - RNA, 13 nt, Human
auacacacacaca

SEQ ID NO: 3393515 - RNA, 21 nt, Human
auacacacacacacacagcca

SEQ ID NO: 3393516 - RNA, 23 nt, Human
auacacacacacacacagccaca

SEQ ID NO: 3393517 - RNA, 23 nt, Human
auacacacacacgcgugcacaca

SEQ ID NO: 3393518 - RNA, 13 nt, Human
auacacacaguua

SEQ ID NO: 3393519 - RNA, 19 nt, Human
auacacacauaugucauau

SEQ ID NO: 3393520 - RNA, 17 nt, Human
auacacacucaaaucaa

SEQ ID NO: 3393521 - RNA, 23 nt, Human
auacacauauaccuauaaugugu

SEQ ID NO: 3393522 - RNA, 21 nt, Human
auacaccaccucacuccuguu

SEQ ID NO: 3393523 - RNA, 19 nt, Human
auacaccagagauaauaug

SEQ ID NO: 3393524 - RNA, 17 nt, Human
auacaccagcauuccuu

SEQ ID NO: 3393525 - RNA, 18 nt, Human
auacaccagcauuccuuu

SEQ ID NO: 3393526 - RNA, 18 nt, Human
auacaccgggccuggaga

SEQ ID NO: 3393527 - RNA, 17 nt, Human
auacacgagguaugagg

SEQ ID NO: 3393528 - RNA, 19 nt, Human
auacacuaauuccuuucua

SEQ ID NO: 3393529 - RNA, 22 nt, Human
auacacuauuugugagcaaagg

SEQ ID NO: 3393530 - RNA, 13 nt, Human
auacacuuacacu

SEQ ID NO: 3393531 - RNA, 19 nt, Human
auacacuuguauaaaugua

SEQ ID NO: 3393532 - RNA, 23 nt, Human
auacagaaagauggaugugcuuu

SEQ ID NO: 3393533 - RNA, 18 nt, Human
auacagaacucuuucaaa

SEQ ID NO: 3393534 - RNA, 20 nt, Human
auacagaaucuuguuuugaa

SEQ ID NO: 3393535 - RNA, 20 nt, Human
auacagaauugugucugcag

SEQ ID NO: 3393536 - RNA, 21 nt, Human
auacagaauugugucugcagg

SEQ ID NO: 3393537 - RNA, 20 nt, Human
auacagaccgaacuguugua

SEQ ID NO: 3393538 - RNA, 21 nt, Human
auacagaccgaacuguuguau

SEQ ID NO: 3393539 - RNA, 23 nt, Human
auacagagaagucacagggcagu

SEQ ID NO: 3393540 - RNA, 13 nt, Human
auacagauaaaug

SEQ ID NO: 3393541 - RNA, 17 nt, Human
auacagauaaaugauuc

SEQ ID NO: 3393542 - RNA, 18 nt, Human
auacagauauauuuucuu

SEQ ID NO: 3393543 - RNA, 22 nt, Human
auacagaugaaaauuugagacu

SEQ ID NO: 3393544 - RNA, 13 nt, Human
auacagcaaagga

SEQ ID NO: 3393545 - RNA, 15 nt, Human
auacagcaaaggaaa

SEQ ID NO: 3393546 - RNA, 16 nt, Human
auacagcagcaagaaa

SEQ ID NO: 3393547 - RNA, 20 nt, Human
auacagcauuacaaauugcu

SEQ ID NO: 3393548 - RNA, 11 nt, Human
auacagcucua

SEQ ID NO: 3393549 - RNA, 12 nt, Human
auacagcuuucu

SEQ ID NO: 3393550 - RNA, 13 nt, Human
auacagcuuucug

SEQ ID NO: 3393551 - RNA, 16 nt, Human
auacagcuuuuggauu

SEQ ID NO: 3393552 - RNA, 13 nt, Human
auacaggaaacag

SEQ ID NO: 3393553 - RNA, 14 nt, Human
auacaggaaacagu

SEQ ID NO: 3393554 - RNA, 16 nt, Human
auacaggaaacaguug

SEQ ID NO: 3393555 - RNA, 17 nt, Human
auacaggaaugaagccu

SEQ ID NO: 3393556 - RNA, 19 nt, Human
auacaggauuauuuugauu

SEQ ID NO: 3393557 - RNA, 20 nt, Human
auacaggcuggaaaguaagg

SEQ ID NO: 3393558 - RNA, 16 nt, Human
auacagggaugguguu

SEQ ID NO: 3393559 - RNA, 15 nt, Human
auacaggucauauua

SEQ ID NO: 3393560 - RNA, 17 nt, Human
auacaguaacuuuaugu

SEQ ID NO: 3393561 - RNA, 13 nt, Human
auauuuugauuau

SEQ ID NO: 3393562 - RNA, 19 nt, Human
auauuuugauuauuguauu

SEQ ID NO: 3393563 - RNA, 19 nt, Human
auauuuugggaaucuuuuc

SEQ ID NO: 3393564 - RNA, 13 nt, Human
auauuuuguaaau

SEQ ID NO: 3393565 - RNA, 13 nt, Human
auauuuuguauau

SEQ ID NO: 3393566 - RNA, 16 nt, Human
auauuuuguaugcaag

SEQ ID NO: 3393567 - RNA, 22 nt, Human
auauuuuguaugcaagcaguuu

SEQ ID NO: 3393568 - RNA, 18 nt, Human
auauuuugugugaaauug

SEQ ID NO: 3393569 - RNA, 14 nt, Human
auauuuuuaaaaga

SEQ ID NO: 3393570 - RNA, 13 nt, Human
auauuuuuaaaga

SEQ ID NO: 3393571 - RNA, 12 nt, Human
auauuuuuaaga

SEQ ID NO: 3393572 - RNA, 16 nt, Human
auauuuuuagacucau

SEQ ID NO: 3393573 - RNA, 18 nt, Human
auauuuuuauauuuccuu

SEQ ID NO: 3393574 - RNA, 15 nt, Human
auauuuuuaucuuua

SEQ ID NO: 3393575 - RNA, 20 nt, Human
auauuuuuaucuuuauauga

SEQ ID NO: 3393576 - RNA, 13 nt, Human
auauuuuucacau

SEQ ID NO: 3393577 - RNA, 17 nt, Human
auauuuuucauaaacaa

SEQ ID NO: 3393578 - RNA, 18 nt, Human
auauuuuucauaaacaag

SEQ ID NO: 3393579 - RNA, 13 nt, Human
auauuuuucuuaa

SEQ ID NO: 3393580 - RNA, 17 nt, Human
auauuuuucuuaaaaag

SEQ ID NO: 3393581 - RNA, 23 nt, Human
auauuuuuuaaaaaucuauauuu

SEQ ID NO: 3393582 - RNA, 17 nt, Human
auauuuuuuaaaauaag

SEQ ID NO: 3393583 - RNA, 21 nt, Human
auauuuuuuaauuuaaagcuu

SEQ ID NO: 3393584 - RNA, 15 nt, Human
auauuuuuucugaau

SEQ ID NO: 3393585 - RNA, 21 nt, Human
auauuuuuuuaaaauguuaaa

SEQ ID NO: 3393586 - RNA, 17 nt, Human
auauuuuuuuaauuuaa

SEQ ID NO: 3393587 - RNA, 14 nt, Human
auauuuuuuuccuu

SEQ ID NO: 3393588 - RNA, 16 nt, Human
auauuuuuuucuaaga

SEQ ID NO: 3393589 - RNA, 16 nt, Human
auauuuuuuucugaaa

SEQ ID NO: 3393590 - RNA, 19 nt, Human
aucaaaaaaggcaguuacc

SEQ ID NO: 3393591 - RNA, 12 nt, Human
aucaaaaaggcu

SEQ ID NO: 3393592 - RNA, 16 nt, Human
aucaaaaaggcuuaua

SEQ ID NO: 3393593 - RNA, 21 nt, Human
aucaaaaaggcuuauaaaaca

SEQ ID NO: 3393594 - RNA, 23 nt, Human
aucaaaaaggcuuauaaaacaga

SEQ ID NO: 3393595 - RNA, 13 nt, Human
aucaaaaauaaug

SEQ ID NO: 3393596 - RNA, 15 nt, Human
aucaaaacuuucuuu

SEQ ID NO: 3393597 - RNA, 13 nt, Human
aucaaaagacaau

SEQ ID NO: 3393598 - RNA, 14 nt, Human
aucaaaagacaauu

SEQ ID NO: 3393599 - RNA, 15 nt, Human
aucaaaagacaauuc

SEQ ID NO: 3393600 - RNA, 24 nt, Human
aucaaaagguuaauaaaguaauua

SEQ ID NO: 3393601 - RNA, 13 nt, Human
aucaaaagugccu

SEQ ID NO: 3393602 - RNA, 17 nt, Human
aucaaaauaaauugaaa

SEQ ID NO: 3393603 - RNA, 13 nt, Human
aucaaaaucucuc

SEQ ID NO: 3393604 - RNA, 13 nt, Human
aucaaaaugaccu

SEQ ID NO: 3393605 - RNA, 23 nt, Human
aucaaaaugaccucaccauuuuu

SEQ ID NO: 3393606 - RNA, 15 nt, Human
aucaaaaugcucuua

SEQ ID NO: 3393607 - RNA, 19 nt, Human
aucaaaaugcucuuauuuc

SEQ ID NO: 3393608 - RNA, 23 nt, Human
aucaaacaccaacauaaaaauga

SEQ ID NO: 3393609 - RNA, 15 nt, Human
aucaaacauuuucug

SEQ ID NO: 3393610 - RNA, 14 nt, Human
aucaaacauuuuga

SEQ ID NO: 3393611 - RNA, 18 nt, Human
aucaaacccuagccuugc

SEQ ID NO: 3393612 - RNA, 20 nt, Human
aucaaacccuagccuugcuu

SEQ ID NO: 3393613 - RNA, 22 nt, Human
aucaaacccuagccuugcuugu

SEQ ID NO: 3393614 - RNA, 15 nt, Human
aucaaacugaagcca

SEQ ID NO: 3393615 - RNA, 17 nt, Human
aucaaagaauaagaaaa

SEQ ID NO: 3393616 - RNA, 18 nt, Human
aucaaagagagaaaauaa

SEQ ID NO: 3393617 - RNA, 19 nt, Human
aucaaagagguuuuaaaaa

SEQ ID NO: 3393618 - RNA, 20 nt, Human
aucaaagagguuuuaaaaaa

SEQ ID NO: 3393619 - RNA, 12 nt, Human
aucaaagaugaa

SEQ ID NO: 3393620 - RNA, 15 nt, Human
aucaaagcaaugcau

SEQ ID NO: 3393621 - RNA, 18 nt, Human
aucaaagcaucuugcauu

SEQ ID NO: 3393622 - RNA, 16 nt, Human
aucaaagccacacucu

SEQ ID NO: 3393623 - RNA, 20 nt, Human
aucaaagggauaaagaaaaa

SEQ ID NO: 3393624 - RNA, 20 nt, Human
aucaaagggugaaaauuauu

SEQ ID NO: 3393625 - RNA, 18 nt, Human
aucaaaguaggcaggacc

SEQ ID NO: 3393626 - RNA, 15 nt, Human
aucaaaguucugcuu

SEQ ID NO: 3393627 - RNA, 17 nt, Human
aucaaauaaaaauucua

SEQ ID NO: 3393628 - RNA, 14 nt, Human
aucaaauaagaaau

SEQ ID NO: 3393629 - RNA, 15 nt, Human
aucaaauaagaaaua

SEQ ID NO: 3393630 - RNA, 18 nt, Human
aucaaauaaguauuuaua

SEQ ID NO: 3393631 - RNA, 19 nt, Human
aucaaauaaguauuuauaa

SEQ ID NO: 3393632 - RNA, 15 nt, Human
aucaaauacuuuaaa

SEQ ID NO: 3393633 - RNA, 21 nt, Human
aucaaauagaaccacuaugaa

SEQ ID NO: 3393634 - RNA, 22 nt, Human
aucaaauauauucagccuggcu

SEQ ID NO: 3393635 - RNA, 17 nt, Human
aucaaauaugcaaagca

SEQ ID NO: 3393636 - RNA, 13 nt, Human
aucaaauauuaga

SEQ ID NO: 3393637 - RNA, 14 nt, Human
aucaaauauuagau

SEQ ID NO: 3393638 - RNA, 16 nt, Human
aucaaauauuagaugu

SEQ ID NO: 3393639 - RNA, 18 nt, Human
aucaaauauuagauguga

SEQ ID NO: 3393640 - RNA, 19 nt, Human
aucaaauauuagaugugau

SEQ ID NO: 3393641 - RNA, 20 nt, Human
aucaaaucuaccacuguaug

SEQ ID NO: 3393642 - RNA, 17 nt, Human
aucaaaugcaguauauu

SEQ ID NO: 3393643 - RNA, 19 nt, Human
aucaaaugcaguauauuuc

SEQ ID NO: 3393644 - RNA, 18 nt, Human
aucaaaugguaucuuuug

SEQ ID NO: 3393645 - RNA, 13 nt, Human
aucaaauguaaag

SEQ ID NO: 3393646 - RNA, 14 nt, Human
aucaaauguaaagu

SEQ ID NO: 3393647 - RNA, 12 nt, Human
aucaaauguuua

SEQ ID NO: 3393648 - RNA, 21 nt, Human
aucaaauguuuaaucauauaa

SEQ ID NO: 3393649 - RNA, 17 nt, Human
aucaaauuaauugugug

SEQ ID NO: 3393650 - RNA, 17 nt, Human
aucaacaauaaaauuuu

SEQ ID NO: 3393651 - RNA, 19 nt, Human
aucaacaccuuaauaugcu

SEQ ID NO: 3393652 - RNA, 13 nt, Human
aucaacagaagca

SEQ ID NO: 3393653 - RNA, 12 nt, Human
aucaacagggca

SEQ ID NO: 3393654 - RNA, 17 nt, Human
aucaacagugagagacu

SEQ ID NO: 3393655 - RNA, 15 nt, Human
aucaacaucuuuucu

SEQ ID NO: 3393656 - RNA, 23 nt, Human
aucaaccaccuauuuuugacaug

SEQ ID NO: 3393657 - RNA, 18 nt, Human
aucaaccccagacacugg

SEQ ID NO: 3393658 - RNA, 19 nt, Human
aucaaccccagacacuggu

SEQ ID NO: 3393659 - RNA, 22 nt, Human
aucaaccccuucgcuccugugu

SEQ ID NO: 3393660 - RNA, 12 nt, Human
aucaacuaaagu

SEQ ID NO: 3393661 - RNA, 15 nt, Human
aucaacuacuauuca

SEQ ID NO: 3393662 - RNA, 14 nt, Human
aucaacucaagaau

SEQ ID NO: 3393663 - RNA, 19 nt, Human
aucaacugggcugaacacu

SEQ ID NO: 3393664 - RNA, 12 nt, Human
aucaacuuaaca

SEQ ID NO: 3393665 - RNA, 12 nt, Human
aucaacuuuuua

SEQ ID NO: 3393666 - RNA, 18 nt, Human
aucaacuuuuuauugccu

SEQ ID NO: 3393667 - RNA, 12 nt, Human
aucaagaaaguc

SEQ ID NO: 3393668 - RNA, 15 nt, Human
aucaagaaaguguug

SEQ ID NO: 3393669 - RNA, 22 nt, Human
aucaagaagggcugcaugaugu

SEQ ID NO: 3393670 - RNA, 23 nt, Human
aucaagaauggggaucacagaga

SEQ ID NO: 3393671 - RNA, 23 nt, Human
aucaagagagguuaauaaaggaa

SEQ ID NO: 3393672 - RNA, 16 nt, Human
aucaagagccuuaaaa

SEQ ID NO: 3393673 - RNA, 18 nt, Human
aucaagagccuuaaaaca

SEQ ID NO: 3393674 - RNA, 15 nt, Human
aucaagagcugcccu

SEQ ID NO: 3393675 - RNA, 19 nt, Human
aucaagagcugcccuccuu

SEQ ID NO: 3393676 - RNA, 20 nt, Human
aucaagagcugcccuccuug

SEQ ID NO: 3393677 - RNA, 17 nt, Human
aucaagaggcugagaca

SEQ ID NO: 3393678 - RNA, 18 nt, Human
aucaagauaaaggacagu

SEQ ID NO: 3393679 - RNA, 16 nt, Human
aucaagcacagaagga

SEQ ID NO: 3393680 - RNA, 14 nt, Human
aucaagcagccaag

SEQ ID NO: 3393681 - RNA, 18 nt, Human
aucaagcagguuagagaa

SEQ ID NO: 3393682 - RNA, 19 nt, Human
aucaagcaugaaaggcuuu

SEQ ID NO: 3393683 - RNA, 22 nt, Human
aucaagcuucaguuuccugguc

SEQ ID NO: 3393684 - RNA, 14 nt, Human
aucaaggcacugcc

SEQ ID NO: 3393685 - RNA, 16 nt, Human
aucaagggaagaacua

SEQ ID NO: 3393686 - RNA, 18 nt, Human
aucaagggaagaacuauu

SEQ ID NO: 3393687 - RNA, 21 nt, Human
aucaagggccuaucuuggaga

SEQ ID NO: 3393688 - RNA, 16 nt, Human
aucaagggucaggccu

SEQ ID NO: 3393689 - RNA, 17 nt, Human
aucaagggucaggccuu

SEQ ID NO: 3393690 - RNA, 19 nt, Human
aucaagguuauaauuuuuu

SEQ ID NO: 3393691 - RNA, 15 nt, Human
aucaaguauagaaaa

SEQ ID NO: 3393692 - RNA, 21 nt, Human
aucaaguauagaaaaucuuca

SEQ ID NO: 3393693 - RNA, 13 nt, Human
aucaaguauuaua

SEQ ID NO: 3393694 - RNA, 14 nt, Human
aucaaguauuauaa

SEQ ID NO: 3393695 - RNA, 18 nt, Human
aucaaguauuauaccuuu

SEQ ID NO: 3393696 - RNA, 13 nt, Human
aucaaguauuuug

SEQ ID NO: 3393697 - RNA, 13 nt, Human
aucaagucuguuu

SEQ ID NO: 3393698 - RNA, 17 nt, Human
aucaaguggcaugugcu

SEQ ID NO: 3393699 - RNA, 22 nt, Human
aucaaguuggcuucuaaucaaa

SEQ ID NO: 3393700 - RNA, 20 nt, Human
aucaaguuguaacuuauauu

SEQ ID NO: 3393701 - RNA, 22 nt, Human
aucaaguuguaacuuauauuga

SEQ ID NO: 3393702 - RNA, 23 nt, Human
aucaaguuguaacuuauauugaa

SEQ ID NO: 3393703 - RNA, 18 nt, Human
aucaaguuuccaagcaaa

SEQ ID NO: 3393704 - RNA, 21 nt, Human
aucaaguuuccaagcaaaugu

SEQ ID NO: 3393705 - RNA, 17 nt, Human
aucaaguuuuaagugaa

SEQ ID NO: 3393706 - RNA, 21 nt, Human
aucauaggcaccuuuuacugu

SEQ ID NO: 3393707 - RNA, 16 nt, Human
aucauagguauuucaa

SEQ ID NO: 3393708 - RNA, 14 nt, Human
aucauaguuaacau

SEQ ID NO: 3393709 - RNA, 15 nt, Human
aucauaguuacugug

SEQ ID NO: 3393710 - RNA, 16 nt, Human
aucauaguuacugugu

SEQ ID NO: 3393711 - RNA, 19 nt, Human
aucauaguuacuguguaaa

SEQ ID NO: 3393712 - RNA, 21 nt, Human
aucauauaaauagaauguaaa

SEQ ID NO: 3393713 - RNA, 16 nt, Human
aucauauaauaaaugu

SEQ ID NO: 3393714 - RNA, 20 nt, Human
aucauauaauaaauguacau

SEQ ID NO: 3393715 - RNA, 19 nt, Human
aucauauauaauaaauuaa

SEQ ID NO: 3393716 - RNA, 16 nt, Human
aucauaugauucugcu

SEQ ID NO: 3393717 - RNA, 19 nt, Human
aucauaugauucugcuuuu

SEQ ID NO: 3393718 - RNA, 15 nt, Human
aucauauuauacaga

SEQ ID NO: 3393719 - RNA, 16 nt, Human
aucaucaagaagggcu

SEQ ID NO: 3393720 - RNA, 13 nt, Human
aucaucaaggcac

SEQ ID NO: 3393721 - RNA, 18 nt, Human
aucaucaaggcacugccu

SEQ ID NO: 3393722 - RNA, 22 nt, Human
aucaucacguauguuauacaac

SEQ ID NO: 3393723 - RNA, 18 nt, Human
aucaucaugcagcucaac

SEQ ID NO: 3393724 - RNA, 18 nt, Human
aucaucauguguguccac

SEQ ID NO: 3393725 - RNA, 16 nt, Human
aucauccacacaugaa

SEQ ID NO: 3393726 - RNA, 16 nt, Human
aucauccacauuguuu

SEQ ID NO: 3393727 - RNA, 21 nt, Human
aucauccacugugccaugugc

SEQ ID NO: 3393728 - RNA, 14 nt, Human
aucaucccagcugc

SEQ ID NO: 3393729 - RNA, 21 nt, Human
aucaucccaucuaagcugcag

SEQ ID NO: 3393730 - RNA, 17 nt, Human
aucauccugcagacaga

SEQ ID NO: 3393731 - RNA, 16 nt, Human
aucauccuuuccagca

SEQ ID NO: 3393732 - RNA, 15 nt, Human
aucaucgaaaauuca

SEQ ID NO: 3393733 - RNA, 24 nt, Human
aucaucggagucagccaggagcug

SEQ ID NO: 3393734 - RNA, 21 nt, Human
aucaucuauugcuggcaaaga

SEQ ID NO: 3393735 - RNA, 14 nt, Human
aucaucuauuuuga

SEQ ID NO: 3393736 - RNA, 13 nt, Human
aucaucucagcuc

SEQ ID NO: 3393737 - RNA, 19 nt, Human
aucaucucagcucacugca

SEQ ID NO: 3393738 - RNA, 23 nt, Human
aucaucugaaggggcaaauucuu

SEQ ID NO: 3393739 - RNA, 18 nt, Human
aucaucuguggaacccau

SEQ ID NO: 3393740 - RNA, 16 nt, Human
aucaucugugugaaaa

SEQ ID NO: 3393741 - RNA, 14 nt, Human
aucaugaaauaugc

SEQ ID NO: 3393742 - RNA, 15 nt, Human
aucaugaagccugug

SEQ ID NO: 3393743 - RNA, 17 nt, Human
aucaugaagcguggaga

SEQ ID NO: 3393744 - RNA, 23 nt, Human
aucaugaauaacugauuaguaag

SEQ ID NO: 3393745 - RNA, 16 nt, Human
aucaugaaugcuuuua

SEQ ID NO: 3393746 - RNA, 18 nt, Human
aucaugaauguguaacac

SEQ ID NO: 3393747 - RNA, 17 nt, Human
aucaugaauuaguuuua

SEQ ID NO: 3393748 - RNA, 19 nt, Human
aucaugaauuuauugcaca

SEQ ID NO: 3393749 - RNA, 15 nt, Human
aucaugaauuuuaaa

SEQ ID NO: 3393750 - RNA, 13 nt, Human
aucaugacauguu

SEQ ID NO: 3393751 - RNA, 16 nt, Human
aucaugacauguuaua

SEQ ID NO: 3393752 - RNA, 18 nt, Human
aucaugacauguuauaua

SEQ ID NO: 3393753 - RNA, 13 nt, Human
aucaugagccugc

SEQ ID NO: 3393754 - RNA, 15 nt, Human
aucaugagccugcug

SEQ ID NO: 3393755 - RNA, 19 nt, Human
aucaugcacacaauuagau

SEQ ID NO: 3393756 - RNA, 14 nt, Human
aucaugcauuguug

SEQ ID NO: 3393757 - RNA, 19 nt, Human
aucaugccaguauuuuuaa

SEQ ID NO: 3393758 - RNA, 21 nt, Human
aucaugcccggucccaccccu

SEQ ID NO: 3393759 - RNA, 12 nt, Human
aucaugcccugu

SEQ ID NO: 3393760 - RNA, 19 nt, Human
aucaugccucugaggccag

SEQ ID NO: 3393761 - RNA, 17 nt, Human
aucaugcuuuaaagugu

SEQ ID NO: 3393762 - RNA, 18 nt, Human
aucaugcuuugaaaaauc

SEQ ID NO: 3393763 - RNA, 19 nt, Human
aucauggaaugguuauaaa

SEQ ID NO: 3393764 - RNA, 21 nt, Human
aucauggauucauuacagcuu

SEQ ID NO: 3393765 - RNA, 19 nt, Human
aucauggccagcuggaggc

SEQ ID NO: 3393766 - RNA, 21 nt, Human
aucauggcuaagcuuaaaaaa

SEQ ID NO: 3393767 - RNA, 15 nt, Human
aucauggcucacugc

SEQ ID NO: 3393768 - RNA, 18 nt, Human
aucauggcucacugcagc

SEQ ID NO: 3393769 - RNA, 16 nt, Human
aucaugguguaauaag

SEQ ID NO: 3393770 - RNA, 18 nt, Human
aucaugguguaauaagac

SEQ ID NO: 3393771 - RNA, 13 nt, Human
aucauguacauuu

SEQ ID NO: 3393772 - RNA, 17 nt, Human
aucauguacuuuuuagu

SEQ ID NO: 3393773 - RNA, 14 nt, Human
aucaugucagagca

SEQ ID NO: 3393774 - RNA, 16 nt, Human
aucaugucagucugcu

SEQ ID NO: 3393775 - RNA, 16 nt, Human
aucaugucuauugucc

SEQ ID NO: 3393776 - RNA, 17 nt, Human
aucaugucuauugucca

SEQ ID NO: 3393777 - RNA, 21 nt, Human
aucaugucuauuguccaaagu

SEQ ID NO: 3393778 - RNA, 21 nt, Human
aucaugugaacccgggacgca

SEQ ID NO: 3393779 - RNA, 13 nt, Human
aucauguguaauc

SEQ ID NO: 3393780 - RNA, 15 nt, Human
aucauguguaaucaa

SEQ ID NO: 3393781 - RNA, 20 nt, Human
aucauguguaaucaauaaac

SEQ ID NO: 3393782 - RNA, 14 nt, Human
aucauguuaguaau

SEQ ID NO: 3393783 - RNA, 17 nt, Human
aucauguuaugauaaaa

SEQ ID NO: 3393784 - RNA, 20 nt, Human
aucauguuaugauaaaaaau

SEQ ID NO: 3393785 - RNA, 11 nt, Human
aucauguuguu

SEQ ID NO: 3393786 - RNA, 23 nt, Human
aucauguuuacagaggacaguau

SEQ ID NO: 3393787 - RNA, 17 nt, Human
aucauguuuaugagaaa

SEQ ID NO: 3393788 - RNA, 12 nt, Human
aucauguuucuu

SEQ ID NO: 3393789 - RNA, 22 nt, Human
aucauuaaagccugaguuugcu

SEQ ID NO: 3393790 - RNA, 12 nt, Human
aucauuaaaguu

SEQ ID NO: 3393791 - RNA, 13 nt, Human
aucauuaaaguuc

SEQ ID NO: 3393792 - RNA, 11 nt, Human
aucauuaauac

SEQ ID NO: 3393793 - RNA, 17 nt, Human
aucauuauuuauguauu

SEQ ID NO: 3393794 - RNA, 12 nt, Human
aucauucaagug

SEQ ID NO: 3393795 - RNA, 23 nt, Human
aucauucacggagauaugaagag

SEQ ID NO: 3393796 - RNA, 17 nt, Human
aucauucacuucacugu

SEQ ID NO: 3393797 - RNA, 21 nt, Human
aucauucacuucacugugcug

SEQ ID NO: 3393798 - RNA, 12 nt, Human
aucauucagaaa

SEQ ID NO: 3393799 - RNA, 13 nt, Human
aucauucagcaac

SEQ ID NO: 3393800 - RNA, 12 nt, Human
aucauucaucuu

SEQ ID NO: 3393801 - RNA, 22 nt, Human
aucauucauucuuagcucuuaa

SEQ ID NO: 3393802 - RNA, 15 nt, Human
aucauuccuuuuuau

SEQ ID NO: 3393803 - RNA, 23 nt, Human
aucauuccuuuuuauuuauaugu

SEQ ID NO: 3393804 - RNA, 14 nt, Human
aucauucuaaagau

SEQ ID NO: 3393805 - RNA, 16 nt, Human
aucauucucugucuca

SEQ ID NO: 3393806 - RNA, 18 nt, Human
aucauucuuacuaaaaag

SEQ ID NO: 3393807 - RNA, 12 nt, Human
aucauugaaauc

SEQ ID NO: 3393808 - RNA, 18 nt, Human
aucauugauugucagcua

SEQ ID NO: 3393809 - RNA, 14 nt, Human
aucauugcugucug

SEQ ID NO: 3393810 - RNA, 19 nt, Human
aucauugcuuccuccuccc

SEQ ID NO: 3393811 - RNA, 18 nt, Human
aucauugcuuugaagcag

SEQ ID NO: 3393812 - RNA, 22 nt, Human
aucauuggauucugagagcugu

SEQ ID NO: 3393813 - RNA, 16 nt, Human
aucauuguaaacauua

SEQ ID NO: 3393814 - RNA, 22 nt, Human
aucauuguacaguuuguuuaca

SEQ ID NO: 3393815 - RNA, 14 nt, Human
aucauuguauggau

SEQ ID NO: 3393816 - RNA, 19 nt, Human
aucauuguuggacauuugg

SEQ ID NO: 3393817 - RNA, 18 nt, Human
aucauuguuuugaauauu

SEQ ID NO: 3393818 - RNA, 12 nt, Human
aucauuuaauaa

SEQ ID NO: 3393819 - RNA, 14 nt, Human
aucauuuaauaaua

SEQ ID NO: 3393820 - RNA, 19 nt, Human
aucauuuaauaauauacuu

SEQ ID NO: 3393821 - RNA, 17 nt, Human
aucauuuauuuuaagca

SEQ ID NO: 3393822 - RNA, 16 nt, Human
aucauuucacuuguca

SEQ ID NO: 3393823 - RNA, 18 nt, Human
aucauuucuauuaaauga

SEQ ID NO: 3393824 - RNA, 11 nt, Human
aucauuucugg

SEQ ID NO: 3393825 - RNA, 17 nt, Human
aucauuugaacaacuag

SEQ ID NO: 3393826 - RNA, 13 nt, Human
aucauuugcuuuu

SEQ ID NO: 3393827 - RNA, 18 nt, Human
aucauuuguuggaaugaa

SEQ ID NO: 3393828 - RNA, 13 nt, Human
aucauuuguuuaa

SEQ ID NO: 3393829 - RNA, 18 nt, Human
aucauuuguuuaaaaagg

SEQ ID NO: 3393830 - RNA, 15 nt, Human
aucauuuuaauuauu

SEQ ID NO: 3393831 - RNA, 16 nt, Human
aucauuuuagaagacu

SEQ ID NO: 3393832 - RNA, 22 nt, Human
aucauuuuagaagacucuacca

SEQ ID NO: 3393833 - RNA, 16 nt, Human
aucauuuuaggaaagg

SEQ ID NO: 3393834 - RNA, 23 nt, Human
aucauuuuaugucaagggcagcu

SEQ ID NO: 3393835 - RNA, 13 nt, Human
aucauuuuccccc

SEQ ID NO: 3393836 - RNA, 15 nt, Human
aucauuuucccccca

SEQ ID NO: 3393837 - RNA, 22 nt, Human
aucauuuucuuaucuucugcaa

SEQ ID NO: 3393838 - RNA, 14 nt, Human
aucauuuugaaauu

SEQ ID NO: 3393839 - RNA, 16 nt, Human
aucauuuuguuuucca

SEQ ID NO: 3393840 - RNA, 14 nt, Human
aucauuuuuccuuc

SEQ ID NO: 3393841 - RNA, 13 nt, Human
aucauuuuuguac

SEQ ID NO: 3393842 - RNA, 14 nt, Human
aucauuuuuguaca

SEQ ID NO: 3393843 - RNA, 21 nt, Human
aucauuuuuuauauauaugca

SEQ ID NO: 3393844 - RNA, 12 nt, Human
auccaaaagaaa

SEQ ID NO: 3393845 - RNA, 13 nt, Human
auccaaaagaagc

SEQ ID NO: 3393846 - RNA, 22 nt, Human
auccaaaagaagcccccagcua

SEQ ID NO: 3393847 - RNA, 23 nt, Human
auccaaaauguguauuucuuaua

SEQ ID NO: 3393848 - RNA, 20 nt, Human
auccaaacauguauuuaugu

SEQ ID NO: 3393849 - RNA, 10 nt, Human
auccaaagac

SEQ ID NO: 3393850 - RNA, 15 nt, Human
auccaaagcagacag

SEQ ID NO: 3393851 - RNA, 23 nt, Human
auccaaauugugcuucuccccag

SEQ ID NO: 3393852 - RNA, 15 nt, Human
aucccauaugccugg

SEQ ID NO: 3393853 - RNA, 18 nt, Human
aucccauaugccugggca

SEQ ID NO: 3393854 - RNA, 13 nt, Human
aucccaucccauc

SEQ ID NO: 3393855 - RNA, 14 nt, Human
aucccaucccaucc

SEQ ID NO: 3393856 - RNA, 19 nt, Human
aucccaucccaucccaucc

SEQ ID NO: 3393857 - RNA, 19 nt, Human
aucccaucuaagcugcagc

SEQ ID NO: 3393858 - RNA, 16 nt, Human
aucccaugaacacacu

SEQ ID NO: 3393859 - RNA, 18 nt, Human
aucccaugagccucagca

SEQ ID NO: 3393860 - RNA, 19 nt, Human
aucccauguaacagaaagg

SEQ ID NO: 3393861 - RNA, 18 nt, Human
aucccauuaaucauuucc

SEQ ID NO: 3393862 - RNA, 17 nt, Human
aucccauugcccugguu

SEQ ID NO: 3393863 - RNA, 13 nt, Human
auccccaagccug

SEQ ID NO: 3393864 - RNA, 14 nt, Human
auccccaaguguga

SEQ ID NO: 3393865 - RNA, 16 nt, Human
auccccacccugggcu

SEQ ID NO: 3393866 - RNA, 15 nt, Human
auccccaccugucuu

SEQ ID NO: 3393867 - RNA, 15 nt, Human
auccccacgccacag

SEQ ID NO: 3393868 - RNA, 18 nt, Human
auccccacgccacagccc

SEQ ID NO: 3393869 - RNA, 23 nt, Human
auccccaggggucccagccaccc

SEQ ID NO: 3393870 - RNA, 15 nt, Human
auccccauccuccag

SEQ ID NO: 3393871 - RNA, 13 nt, Human
auccccaucuccc

SEQ ID NO: 3393872 - RNA, 20 nt, Human
auccccaugccuguggcugc

SEQ ID NO: 3393873 - RNA, 17 nt, Human
aucccccagaaaagaaa

SEQ ID NO: 3393874 - RNA, 12 nt, Human
aucccccagccu

SEQ ID NO: 3393875 - RNA, 15 nt, Human
auccccccaucuugc

SEQ ID NO: 3393876 - RNA, 17 nt, Human
auccccccaucuugcuu

SEQ ID NO: 3393877 - RNA, 19 nt, Human
aucccccccaccucucccu

SEQ ID NO: 3393878 - RNA, 13 nt, Human
auccccucccagu

SEQ ID NO: 3393879 - RNA, 15 nt, Human
auccccucccuguca

SEQ ID NO: 3393880 - RNA, 19 nt, Human
auccccucccugucaaagc

SEQ ID NO: 3393881 - RNA, 14 nt, Human
auccccuccuuggg

SEQ ID NO: 3393882 - RNA, 15 nt, Human
auccccuccuugggc

SEQ ID NO: 3393883 - RNA, 14 nt, Human
auccccugagcccc

SEQ ID NO: 3393884 - RNA, 12 nt, Human
auccccugccuc

SEQ ID NO: 3393885 - RNA, 23 nt, Human
auccccuuacccuuagaauccac

SEQ ID NO: 3393886 - RNA, 14 nt, Human
aucccgaaaaucuc

SEQ ID NO: 3393887 - RNA, 22 nt, Human
aucccgaagaauggagaggaac

SEQ ID NO: 3393888 - RNA, 14 nt, Human
aucccgagcaccuc

SEQ ID NO: 3393889 - RNA, 16 nt, Human
aucccgcucuuuuccu

SEQ ID NO: 3393890 - RNA, 16 nt, Human
aucccggaggaaaucu

SEQ ID NO: 3393891 - RNA, 19 nt, Human
aucccgugcaaaacaugcu

SEQ ID NO: 3393892 - RNA, 18 nt, Human
aucccguuuuccccauga

SEQ ID NO: 3393893 - RNA, 20 nt, Human
aucccguuuuccccaugaca

SEQ ID NO: 3393894 - RNA, 12 nt, Human
aucccuacaugu

SEQ ID NO: 3393895 - RNA, 14 nt, Human
aucccuacauguau

SEQ ID NO: 3393896 - RNA, 14 nt, Human
aucccuacccccua

SEQ ID NO: 3393897 - RNA, 19 nt, Human
aucccuaccgacccagggu

SEQ ID NO: 3393898 - RNA, 14 nt, Human
aucccuagcuguga

SEQ ID NO: 3393899 - RNA, 19 nt, Human
aucccucacccauccuaga

SEQ ID NO: 3393900 - RNA, 17 nt, Human
aucccucaccuguagca

SEQ ID NO: 3393901 - RNA, 18 nt, Human
aucccucaccuucugagu

SEQ ID NO: 3393902 - RNA, 11 nt, Human
aucccucaucu

SEQ ID NO: 3393903 - RNA, 19 nt, Human
aucccucccccccaugcac

SEQ ID NO: 3393904 - RNA, 21 nt, Human
aucccucccccccaugcacug

SEQ ID NO: 3393905 - RNA, 22 nt, Human
aucccucccccccaugcacugu

SEQ ID NO: 3393906 - RNA, 18 nt, Human
aucccucccuccaccucc

SEQ ID NO: 3393907 - RNA, 20 nt, Human
aucccucccuccaccucccu

SEQ ID NO: 3393908 - RNA, 12 nt, Human
aucccuccuguu

SEQ ID NO: 3393909 - RNA, 17 nt, Human
aucccucgauauuuuua

SEQ ID NO: 3393910 - RNA, 14 nt, Human
aucccucuccuccc

SEQ ID NO: 3393911 - RNA, 15 nt, Human
aucccugaggacuga

SEQ ID NO: 3393912 - RNA, 18 nt, Human
aucccugaggacugauuu

SEQ ID NO: 3393913 - RNA, 22 nt, Human
aucccugaggacugauuucaga

SEQ ID NO: 3393914 - RNA, 18 nt, Human
aucccugaggcuggacuc

SEQ ID NO: 3393915 - RNA, 12 nt, Human
aucccugcccau

SEQ ID NO: 3393916 - RNA, 15 nt, Human
aucccugccugguca

SEQ ID NO: 3393917 - RNA, 13 nt, Human
aucccugcucacu

SEQ ID NO: 3393918 - RNA, 22 nt, Human
aucccuggcccccucccuggau

SEQ ID NO: 3393919 - RNA, 17 nt, Human
aucccugggcauugcuu

SEQ ID NO: 3393920 - RNA, 18 nt, Human
aucccugggcauugcuuu

SEQ ID NO: 3393921 - RNA, 14 nt, Human
aucccugggccugc

SEQ ID NO: 3393922 - RNA, 15 nt, Human
aucccugggccugcu

SEQ ID NO: 3393923 - RNA, 20 nt, Human
aucccugggccugcugcuga

SEQ ID NO: 3393924 - RNA, 21 nt, Human
aucccugggccugcugcugag

SEQ ID NO: 3393925 - RNA, 20 nt, Human
aucccugggccuugggcucc

SEQ ID NO: 3393926 - RNA, 16 nt, Human
aucccugucuuuccua

SEQ ID NO: 3393927 - RNA, 18 nt, Human
aucccuguuacccagaga

SEQ ID NO: 3393928 - RNA, 13 nt, Human
aucccuguucauu

SEQ ID NO: 3393929 - RNA, 16 nt, Human
aucccuguucauugua

SEQ ID NO: 3393930 - RNA, 13 nt, Human
aucccuguuuaau

SEQ ID NO: 3393931 - RNA, 14 nt, Human
aucccuguuuaaua

SEQ ID NO: 3393932 - RNA, 15 nt, Human
aucccuguuuaauau

SEQ ID NO: 3393933 - RNA, 23 nt, Human
aucccuguuuaauauuuaaacag

SEQ ID NO: 3393934 - RNA, 12 nt, Human
aucccuuaagaa

SEQ ID NO: 3393935 - RNA, 21 nt, Human
aucccuuaauauccuaaacau

SEQ ID NO: 3393936 - RNA, 14 nt, Human
aucccuuccaccug

SEQ ID NO: 3393937 - RNA, 19 nt, Human
aucccuuccuuuuagccua

SEQ ID NO: 3393938 - RNA, 14 nt, Human
aucccuucucacag

SEQ ID NO: 3393939 - RNA, 17 nt, Human
aucccuucucacagcac

SEQ ID NO: 3393940 - RNA, 14 nt, Human
aucccuuuauuacc

SEQ ID NO: 3393941 - RNA, 16 nt, Human
aucccuuucccuuggu

SEQ ID NO: 3393942 - RNA, 20 nt, Human
auccgaaccuccucugugaa

SEQ ID NO: 3393943 - RNA, 14 nt, Human
auccgccagggccc

SEQ ID NO: 3393944 - RNA, 12 nt, Human
auccgcucucuu

SEQ ID NO: 3393945 - RNA, 17 nt, Human
auccgcucucuuccugc

SEQ ID NO: 3393946 - RNA, 18 nt, Human
auccgcucucuuccugcc

SEQ ID NO: 3393947 - RNA, 20 nt, Human
auccgcucucuuccugcccc

SEQ ID NO: 3393948 - RNA, 14 nt, Human
auccggagaagcug

SEQ ID NO: 3393949 - RNA, 14 nt, Human
auccggaggagaag

SEQ ID NO: 3393950 - RNA, 20 nt, Human
auccggcccccagagcgccc

SEQ ID NO: 3393951 - RNA, 16 nt, Human
auccggggccagcucc

SEQ ID NO: 3393952 - RNA, 17 nt, Human
auccguaguucccugaa

SEQ ID NO: 3393953 - RNA, 22 nt, Human
auccgugagcagugugucuccu

SEQ ID NO: 3393954 - RNA, 13 nt, Human
auccguguugcag

SEQ ID NO: 3393955 - RNA, 18 nt, Human
auccuaaauuuacccucu

SEQ ID NO: 3393956 - RNA, 18 nt, Human
auccuaacugaagagaca

SEQ ID NO: 3393957 - RNA, 16 nt, Human
auccuaagaaauaugu

SEQ ID NO: 3393958 - RNA, 19 nt, Human
auccuaagaaauaugugag

SEQ ID NO: 3393959 - RNA, 20 nt, Human
auccuaagaaauaugugaga

SEQ ID NO: 3393960 - RNA, 22 nt, Human
auccuaagaaauaugugagauu

SEQ ID NO: 3393961 - RNA, 14 nt, Human
auccuaagacacaa

SEQ ID NO: 3393962 - RNA, 21 nt, Human
auccuaagauguguucuuauu

SEQ ID NO: 3393963 - RNA, 21 nt, Human
auccuaagcuauucaguaaua

SEQ ID NO: 3393964 - RNA, 16 nt, Human
auccuaauaaaaaggu

SEQ ID NO: 3393965 - RNA, 15 nt, Human
auccuaauuucuccu

SEQ ID NO: 3393966 - RNA, 18 nt, Human
auccuaauuucuccuccc

SEQ ID NO: 3393967 - RNA, 20 nt, Human
auccuaauuucuccucccuu

SEQ ID NO: 3393968 - RNA, 22 nt, Human
auccuacacaccuaagggacau

SEQ ID NO: 3393969 - RNA, 16 nt, Human
auccuaccaaugcaug

SEQ ID NO: 3393970 - RNA, 17 nt, Human
auccuaccaaugcaugc

SEQ ID NO: 3393971 - RNA, 16 nt, Human
auccuacccccugugc

SEQ ID NO: 3393972 - RNA, 21 nt, Human
auccuacccucgggcccaccu

SEQ ID NO: 3393973 - RNA, 16 nt, Human
auccuaccuguuuugu

SEQ ID NO: 3393974 - RNA, 14 nt, Human
auccuacuucucca

SEQ ID NO: 3393975 - RNA, 23 nt, Human
auccuagauuauaucaaaguauu

SEQ ID NO: 3393976 - RNA, 16 nt, Human
auccuagcacaugcuu

SEQ ID NO: 3393977 - RNA, 19 nt, Human
auccuagccuuauccucug

SEQ ID NO: 3393978 - RNA, 21 nt, Human
auccuagccuuauccucugau

SEQ ID NO: 3393979 - RNA, 23 nt, Human
auccuagccuuauccucugaucu

SEQ ID NO: 3393980 - RNA, 20 nt, Human
auccuagucacuaccuucau

SEQ ID NO: 3393981 - RNA, 23 nt, Human
auccuagucucuaucauuaaagu

SEQ ID NO: 3393982 - RNA, 13 nt, Human
auccuagugcuuu

SEQ ID NO: 3393983 - RNA, 15 nt, Human
auccuaguuuccucu

SEQ ID NO: 3393984 - RNA, 23 nt, Human
auccuaucagccugucucuucca

SEQ ID NO: 3393985 - RNA, 18 nt, Human
auccuauccacugggcac

SEQ ID NO: 3393986 - RNA, 21 nt, Human
auccuaucucuccaaccagau

SEQ ID NO: 3393987 - RNA, 23 nt, Human
auccuaugugauuuuaacucugu

SEQ ID NO: 3393988 - RNA, 21 nt, Human
auccuauugaaccauguuugu

SEQ ID NO: 3393989 - RNA, 15 nt, Human
auccucaaacacugc

SEQ ID NO: 3393990 - RNA, 19 nt, Human
auccucaaagaaaguguau

SEQ ID NO: 3393991 - RNA, 14 nt, Human
auccucacugggug

SEQ ID NO: 3393992 - RNA, 19 nt, Human
auccucaguuccugcagca

SEQ ID NO: 3393993 - RNA, 22 nt, Human
auccucaguuccugcagcagag

SEQ ID NO: 3393994 - RNA, 18 nt, Human
auccucauacccaccccc

SEQ ID NO: 3393995 - RNA, 23 nt, Human
auccucauacccacccccaccca

SEQ ID NO: 3393996 - RNA, 16 nt, Human
auccucauauggccca

SEQ ID NO: 3393997 - RNA, 23 nt, Human
augcacagaguuguuacauuuuu

SEQ ID NO: 3393998 - RNA, 18 nt, Human
augcacagauauacuuug

SEQ ID NO: 3393999 - RNA, 14 nt, Human
augcacagcuaaca

SEQ ID NO: 3394000 - RNA, 18 nt, Human
augcacauauggacucug

SEQ ID NO: 3394001 - RNA, 17 nt, Human
augcacauccauuccca

SEQ ID NO: 3394002 - RNA, 11 nt, Human
augcaccaaac

SEQ ID NO: 3394003 - RNA, 18 nt, Human
augcaccaccaagccaag

SEQ ID NO: 3394004 - RNA, 13 nt, Human
augcaccagcccu

SEQ ID NO: 3394005 - RNA, 14 nt, Human
augcaccauuagaa

SEQ ID NO: 3394006 - RNA, 20 nt, Human
augcacccucauacacagaa

SEQ ID NO: 3394007 - RNA, 14 nt, Human
augcaccuaaagaa

SEQ ID NO: 3394008 - RNA, 15 nt, Human
augcaccuaaagaaa

SEQ ID NO: 3394009 - RNA, 23 nt, Human
augcaccuaaagaaaaacaaacu

SEQ ID NO: 3394010 - RNA, 24 nt, Human
augcaccugaauguuagauaguua

SEQ ID NO: 3394011 - RNA, 13 nt, Human
augcaccuggaau

SEQ ID NO: 3394012 - RNA, 16 nt, Human
augcaccuggaauaua

SEQ ID NO: 3394013 - RNA, 19 nt, Human
augcaccuggaauauauaa

SEQ ID NO: 3394014 - RNA, 16 nt, Human
augcaccuugugucug

SEQ ID NO: 3394015 - RNA, 15 nt, Human
augcacggccucgcg

SEQ ID NO: 3394016 - RNA, 14 nt, Human
augcacuauguaua

SEQ ID NO: 3394017 - RNA, 21 nt, Human
augcacuguucccccugugca

SEQ ID NO: 3394018 - RNA, 20 nt, Human
augcacuucaaauucaaaua

SEQ ID NO: 3394019 - RNA, 15 nt, Human
augcacuuugcuuua

SEQ ID NO: 3394020 - RNA, 16 nt, Human
augcacuuugcuuuaa

SEQ ID NO: 3394021 - RNA, 19 nt, Human
augcacuuuguucuggcuc

SEQ ID NO: 3394022 - RNA, 20 nt, Human
augcacuuuguucuggcucu

SEQ ID NO: 3394023 - RNA, 15 nt, Human
augcagaaagcaucc

SEQ ID NO: 3394024 - RNA, 20 nt, Human
augcagaaauagacaaaaag

SEQ ID NO: 3394025 - RNA, 21 nt, Human
augcagaaauagacaaaaagu

SEQ ID NO: 3394026 - RNA, 22 nt, Human
augcagaaauagacaaaaagua

SEQ ID NO: 3394027 - RNA, 19 nt, Human
augcagaacacauuucaaa

SEQ ID NO: 3394028 - RNA, 19 nt, Human
augcagaauguugauuaca

SEQ ID NO: 3394029 - RNA, 19 nt, Human
augcagagagccauuuugu

SEQ ID NO: 3394030 - RNA, 23 nt, Human
augcagagagccauuuugugaau

SEQ ID NO: 3394031 - RNA, 21 nt, Human
augcagagcgccgugaguucu

SEQ ID NO: 3394032 - RNA, 20 nt, Human
augcagaguucagggaagau

SEQ ID NO: 3394033 - RNA, 19 nt, Human
augcagaguugacaugaga

SEQ ID NO: 3394034 - RNA, 15 nt, Human
augcagaugccagag

SEQ ID NO: 3394035 - RNA, 16 nt, Human
augcagaugccagagc

SEQ ID NO: 3394036 - RNA, 19 nt, Human
augcagcagcuugcugcac

SEQ ID NO: 3394037 - RNA, 19 nt, Human
augcagcagggaugcccug

SEQ ID NO: 3394038 - RNA, 17 nt, Human
augcagcaucuaaguaa

SEQ ID NO: 3394039 - RNA, 21 nt, Human
augcagcccaugcccaccugc

SEQ ID NO: 3394040 - RNA, 16 nt, Human
augcagccgugaucaa

SEQ ID NO: 3394041 - RNA, 21 nt, Human
augcagccuaaggcuguauga

SEQ ID NO: 3394042 - RNA, 15 nt, Human
augcagccucacagu

SEQ ID NO: 3394043 - RNA, 20 nt, Human
augcagcgaaccaauauuug

SEQ ID NO: 3394044 - RNA, 22 nt, Human
augcagcgaaccaauauuugua

SEQ ID NO: 3394045 - RNA, 13 nt, Human
augcagcgugaag

SEQ ID NO: 3394046 - RNA, 14 nt, Human
augcagcuaucugg

SEQ ID NO: 3394047 - RNA, 15 nt, Human
augcagcugcacccu

SEQ ID NO: 3394048 - RNA, 15 nt, Human
augcagcuguggcag

SEQ ID NO: 3394049 - RNA, 15 nt, Human
augcagcuuauacga

SEQ ID NO: 3394050 - RNA, 15 nt, Human
augcagcuuugcaaa

SEQ ID NO: 3394051 - RNA, 16 nt, Human
augcaggcuccccuga

SEQ ID NO: 3394052 - RNA, 17 nt, Human
augcaggcuccccugag

SEQ ID NO: 3394053 - RNA, 20 nt, Human
augcaggggcaaacaccugc

SEQ ID NO: 3394054 - RNA, 22 nt, Human
augcaggggcaaacaccugcug

SEQ ID NO: 3394055 - RNA, 17 nt, Human
augcagggggcuccugg

SEQ ID NO: 3394056 - RNA, 21 nt, Human
augcaggucgcuacuggcaua

SEQ ID NO: 3394057 - RNA, 15 nt, Human
augcaguaugguaca

SEQ ID NO: 3394058 - RNA, 22 nt, Human
augcaguaugguacauuuuuca

SEQ ID NO: 3394059 - RNA, 16 nt, Human
augcagucuccucuuu

SEQ ID NO: 3394060 - RNA, 23 nt, Human
augcagucuccucuuuaaaacaa

SEQ ID NO: 3394061 - RNA, 20 nt, Human
augcagucuguccaggcucg

SEQ ID NO: 3394062 - RNA, 13 nt, Human
augcagucuuaga

SEQ ID NO: 3394063 - RNA, 22 nt, Human
augcagugauauggcagaagac

SEQ ID NO: 3394064 - RNA, 18 nt, Human
augcagugccccuagcuu

SEQ ID NO: 3394065 - RNA, 20 nt, Human
augcagugcucgcuguugcu

SEQ ID NO: 3394066 - RNA, 16 nt, Human
augcagugcugcuuug

SEQ ID NO: 3394067 - RNA, 19 nt, Human
augcaguguagauuuuaua

SEQ ID NO: 3394068 - RNA, 20 nt, Human
augcaguuacaaauuauaau

SEQ ID NO: 3394069 - RNA, 22 nt, Human
augcaguuacaaauuauaaugu

SEQ ID NO: 3394070 - RNA, 22 nt, Human
augcaguuagcugaagaauuga

SEQ ID NO: 3394071 - RNA, 15 nt, Human
augcaguucugaaga

SEQ ID NO: 3394072 - RNA, 19 nt, Human
augcaguucugaagaagau

SEQ ID NO: 3394073 - RNA, 15 nt, Human
augcaguucugagca

SEQ ID NO: 3394074 - RNA, 11 nt, Human
augcaguuuga

SEQ ID NO: 3394075 - RNA, 15 nt, Human
augcaguuugaaauu

SEQ ID NO: 3394076 - RNA, 16 nt, Human
augcaguuugaaauuc

SEQ ID NO: 3394077 - RNA, 19 nt, Human
augcaguuugaaauucuga

SEQ ID NO: 3394078 - RNA, 21 nt, Human
augcaguuugaaauucugaau

SEQ ID NO: 3394079 - RNA, 17 nt, Human
augcaguuuuucagagu

SEQ ID NO: 3394080 - RNA, 22 nt, Human
augcaguuuuucagaguggaau

SEQ ID NO: 3394081 - RNA, 14 nt, Human
augcauacaaguuu

SEQ ID NO: 3394082 - RNA, 23 nt, Human
augcauacauacacauauauaca

SEQ ID NO: 3394083 - RNA, 21 nt, Human
augcauacuucaaaaguauuu

SEQ ID NO: 3394084 - RNA, 15 nt, Human
augcauauaaugaau

SEQ ID NO: 3394085 - RNA, 18 nt, Human
augcauauaaugaauaaa

SEQ ID NO: 3394086 - RNA, 11 nt, Human
augcauauacu

SEQ ID NO: 3394087 - RNA, 15 nt, Human
augcauauauauaug

SEQ ID NO: 3394088 - RNA, 18 nt, Human
augcauaugucacuagaa

SEQ ID NO: 3394089 - RNA, 16 nt, Human
augcauauuguauuac

SEQ ID NO: 3394090 - RNA, 12 nt, Human
augcauauuugc

SEQ ID NO: 3394091 - RNA, 16 nt, Human
augcauauuuguuuau

SEQ ID NO: 3394092 - RNA, 23 nt, Human
augcauauuuuuuuucuuuuuac

SEQ ID NO: 3394093 - RNA, 15 nt, Human
augcaucagaaaggg

SEQ ID NO: 3394094 - RNA, 23 nt, Human
augcaucauuucaggaguuacug

SEQ ID NO: 3394095 - RNA, 17 nt, Human
augcauccauuccucag

SEQ ID NO: 3394096 - RNA, 22 nt, Human
augcaucucacuggaugcaaag

SEQ ID NO: 3394097 - RNA, 19 nt, Human
augcaucuccaccugcucc

SEQ ID NO: 3394098 - RNA, 20 nt, Human
augcaucuguuuauucuaua

SEQ ID NO: 3394099 - RNA, 12 nt, Human
augcaucuuuga

SEQ ID NO: 3394100 - RNA, 15 nt, Human
augcaucuuugaugu

SEQ ID NO: 3394101 - RNA, 16 nt, Human
augcaucuuugaugug

SEQ ID NO: 3394102 - RNA, 16 nt, Human
augcaugacagccucu

SEQ ID NO: 3394103 - RNA, 17 nt, Human
augcaugcuucuucuca

SEQ ID NO: 3394104 - RNA, 20 nt, Human
augcaugcuuuccauauuuu

SEQ ID NO: 3394105 - RNA, 20 nt, Human
augcauggaaaccugaaaaa

SEQ ID NO: 3394106 - RNA, 12 nt, Human
augcauggaaau

SEQ ID NO: 3394107 - RNA, 23 nt, Human
augcauggagggcugcccuguac

SEQ ID NO: 3394108 - RNA, 21 nt, Human
augcauggcagcaggccuguu

SEQ ID NO: 3394109 - RNA, 19 nt, Human
augcauggugcaguugaca

SEQ ID NO: 3394110 - RNA, 19 nt, Human
augcauggugccccaggac

SEQ ID NO: 3394111 - RNA, 13 nt, Human
augcaugguuuca

SEQ ID NO: 3394112 - RNA, 22 nt, Human
augcaugucaaacaugagaugu

SEQ ID NO: 3394113 - RNA, 16 nt, Human
augcauguccuguaaa

SEQ ID NO: 3394114 - RNA, 17 nt, Human
augcauguccuguaaag

SEQ ID NO: 3394115 - RNA, 18 nt, Human
augcaugucuuuuaaaau

SEQ ID NO: 3394116 - RNA, 14 nt, Human
augcaugugaagaa

SEQ ID NO: 3394117 - RNA, 16 nt, Human
augcaugugaagaaag

SEQ ID NO: 3394118 - RNA, 17 nt, Human
augcauuaaaagaaaau

SEQ ID NO: 3394119 - RNA, 20 nt, Human
augcauuaaaagaaaauaaa

SEQ ID NO: 3394120 - RNA, 15 nt, Human
augcauuaaaccugu

SEQ ID NO: 3394121 - RNA, 19 nt, Human
augcauucuucucuguugu

SEQ ID NO: 3394122 - RNA, 16 nt, Human
augcauuguaguuuaa

SEQ ID NO: 3394123 - RNA, 17 nt, Human
augcauuugaggucaag

SEQ ID NO: 3394124 - RNA, 19 nt, Human
augcauuuggguccaggag

SEQ ID NO: 3394125 - RNA, 22 nt, Human
augcauuuuaaaguuaaacauu

SEQ ID NO: 3394126 - RNA, 23 nt, Human
augcauuuuauuuuagacacaaa

SEQ ID NO: 3394127 - RNA, 19 nt, Human
augcauuuuguuugguauu

SEQ ID NO: 3394128 - RNA, 22 nt, Human
augcauuuuguuugguauugua

SEQ ID NO: 3394129 - RNA, 18 nt, Human
augccaaaaaaaaauaca

SEQ ID NO: 3394130 - RNA, 21 nt, Human
augccaaagaaugaauuucaa

SEQ ID NO: 3394131 - RNA, 18 nt, Human
augccaaagaucacuugu

SEQ ID NO: 3394132 - RNA, 18 nt, Human
augccaaagcuagggugg

SEQ ID NO: 3394133 - RNA, 22 nt, Human
augccaaagcuaggguggcccu

SEQ ID NO: 3394134 - RNA, 15 nt, Human
augccaacaagaaug

SEQ ID NO: 3394135 - RNA, 16 nt, Human
augccaagcacugugc

SEQ ID NO: 3394136 - RNA, 17 nt, Human
augccaagcacugugcu

SEQ ID NO: 3394137 - RNA, 18 nt, Human
augccaagcacugugcuc

SEQ ID NO: 3394138 - RNA, 23 nt, Human
augccaauacuagucaccccaag

SEQ ID NO: 3394139 - RNA, 17 nt, Human
augccacagcccuguca

SEQ ID NO: 3394140 - RNA, 23 nt, Human
augcuuccuagaaguuacugaau

SEQ ID NO: 3394141 - RNA, 15 nt, Human
augcuuccugacaau

SEQ ID NO: 3394142 - RNA, 20 nt, Human
augcuuccugacaaucaacu

SEQ ID NO: 3394143 - RNA, 22 nt, Human
augcuuccugacaaucaacucu

SEQ ID NO: 3394144 - RNA, 21 nt, Human
augcuuccuugccugaugaca

SEQ ID NO: 3394145 - RNA, 19 nt, Human
augcuucuaaguaaauaca

SEQ ID NO: 3394146 - RNA, 21 nt, Human
augcuucuaaguaaauacaau

SEQ ID NO: 3394147 - RNA, 16 nt, Human
augcuucucacugcca

SEQ ID NO: 3394148 - RNA, 16 nt, Human
augcuucucaucuugu

SEQ ID NO: 3394149 - RNA, 20 nt, Human
augcuucucaucuugugaaa

SEQ ID NO: 3394150 - RNA, 14 nt, Human
augcuucugggaga

SEQ ID NO: 3394151 - RNA, 14 nt, Human
augcuucuucucaa

SEQ ID NO: 3394152 - RNA, 12 nt, Human
augcuugaaaaa

SEQ ID NO: 3394153 - RNA, 18 nt, Human
augcuugaugguuuaugu

SEQ ID NO: 3394154 - RNA, 16 nt, Human
augcuugcaaaaacua

SEQ ID NO: 3394155 - RNA, 19 nt, Human
augcuugcaaaaacuacaa

SEQ ID NO: 3394156 - RNA, 20 nt, Human
augcuugcggcaaaaggaaa

SEQ ID NO: 3394157 - RNA, 23 nt, Human
augcuugcggcaaaaggaaagcu

SEQ ID NO: 3394158 - RNA, 22 nt, Human
augcuugcugcugauuuaaaca

SEQ ID NO: 3394159 - RNA, 23 nt, Human
augcuugcugcugauuuaaacac

SEQ ID NO: 3394160 - RNA, 17 nt, Human
augcuuguaacaagaaa

SEQ ID NO: 3394161 - RNA, 21 nt, Human
augcuuguaacaagaaaacau

SEQ ID NO: 3394162 - RNA, 15 nt, Human
augcuuguacauaau

SEQ ID NO: 3394163 - RNA, 13 nt, Human
augcuuguguuau

SEQ ID NO: 3394164 - RNA, 15 nt, Human
augcuuguguuucuu

SEQ ID NO: 3394165 - RNA, 20 nt, Human
augcuuuaccaaacagcaaa

SEQ ID NO: 3394166 - RNA, 18 nt, Human
augcuuuauuaauguuuu

SEQ ID NO: 3394167 - RNA, 22 nt, Human
augcuuuauuaauguuuucaaa

SEQ ID NO: 3394168 - RNA, 17 nt, Human
augcuuuauuuguaaau

SEQ ID NO: 3394169 - RNA, 22 nt, Human
augcuuuccauauuuuuuuccu

SEQ ID NO: 3394170 - RNA, 22 nt, Human
augcuuucugaacucgcuucuc

SEQ ID NO: 3394171 - RNA, 22 nt, Human
augcuuugaaaaaucacuugau

SEQ ID NO: 3394172 - RNA, 16 nt, Human
augcuuugaaacagaa

SEQ ID NO: 3394173 - RNA, 21 nt, Human
augcuuugaaauugaaccuuu

SEQ ID NO: 3394174 - RNA, 15 nt, Human
augcuuugcuuuguc

SEQ ID NO: 3394175 - RNA, 21 nt, Human
augcuuuuacugaacuuucuu

SEQ ID NO: 3394176 - RNA, 22 nt, Human
augcuuuuauauuuuuuuaaaa

SEQ ID NO: 3394177 - RNA, 14 nt, Human
augcuuuucucaaa

SEQ ID NO: 3394178 - RNA, 20 nt, Human
augcuuuucugucucugccu

SEQ ID NO: 3394179 - RNA, 16 nt, Human
augcuuuuuauuucug

SEQ ID NO: 3394180 - RNA, 23 nt, Human
augcuuuuuauuucugcauaugu

SEQ ID NO: 3394181 - RNA, 19 nt, Human
auggaaaaaaaaaaaagag

SEQ ID NO: 3394182 - RNA, 21 nt, Human
auggaaaaacuugugcuauaa

SEQ ID NO: 3394183 - RNA, 14 nt, Human
auggaaaaaugcca

SEQ ID NO: 3394184 - RNA, 19 nt, Human
auggaaaacgcucucuacu

SEQ ID NO: 3394185 - RNA, 19 nt, Human
auggaaaacuguguugcca

SEQ ID NO: 3394186 - RNA, 22 nt, Human
auggaaaagucuucaagggcug

SEQ ID NO: 3394187 - RNA, 18 nt, Human
auggaaacagaggaccag

SEQ ID NO: 3394188 - RNA, 21 nt, Human
auggaaacccgaggguugauu

SEQ ID NO: 3394189 - RNA, 17 nt, Human
auggaaaccucacgcug

SEQ ID NO: 3394190 - RNA, 22 nt, Human
auggaaacuguugccagagaug

SEQ ID NO: 3394191 - RNA, 23 nt, Human
auggaaagcagaguuuucauuaa

SEQ ID NO: 3394192 - RNA, 19 nt, Human
auggaaaucagccaaguuu

SEQ ID NO: 3394193 - RNA, 18 nt, Human
auggaaaugcaaacuggg

SEQ ID NO: 3394194 - RNA, 18 nt, Human
auggaaauucugcucaga

SEQ ID NO: 3394195 - RNA, 15 nt, Human
auggaacacagaacu

SEQ ID NO: 3394196 - RNA, 16 nt, Human
auggaacacucugaga

SEQ ID NO: 3394197 - RNA, 16 nt, Human
auggaaccaggcuugg

SEQ ID NO: 3394198 - RNA, 21 nt, Human
auggaaccugacguagcugca

SEQ ID NO: 3394199 - RNA, 23 nt, Human
auggaacucagcugucuguggcu

SEQ ID NO: 3394200 - RNA, 19 nt, Human
auggaacucauuccugccu

SEQ ID NO: 3394201 - RNA, 16 nt, Human
auggaacuuagccauu

SEQ ID NO: 3394202 - RNA, 17 nt, Human
auggaagacagcucuua

SEQ ID NO: 3394203 - RNA, 15 nt, Human
auggaagacaggaaa

SEQ ID NO: 3394204 - RNA, 16 nt, Human
auggaagacaggaaag

SEQ ID NO: 3394205 - RNA, 17 nt, Human
auggaagagaaaucuca

SEQ ID NO: 3394206 - RNA, 15 nt, Human
auggaagagagaaag

SEQ ID NO: 3394207 - RNA, 17 nt, Human
auggaagauuuuaaauu

SEQ ID NO: 3394208 - RNA, 20 nt, Human
auggaagcgguggucagaag

SEQ ID NO: 3394209 - RNA, 17 nt, Human
auggaagguuuguauau

SEQ ID NO: 3394210 - RNA, 15 nt, Human
auggaaguuuuccua

SEQ ID NO: 3394211 - RNA, 13 nt, Human
auggaauaaaagg

SEQ ID NO: 3394212 - RNA, 16 nt, Human
auggaauacucuuaua

SEQ ID NO: 3394213 - RNA, 17 nt, Human
auggaaugcuguguuaa

SEQ ID NO: 3394214 - RNA, 19 nt, Human
auggaaugguuauaaaagu

SEQ ID NO: 3394215 - RNA, 14 nt, Human
auggaauugauuug

SEQ ID NO: 3394216 - RNA, 23 nt, Human
auggaauuggagcucgugggaca

SEQ ID NO: 3394217 - RNA, 21 nt, Human
auggaauuuauaauucaguau

SEQ ID NO: 3394218 - RNA, 12 nt, Human
auggaauuugua

SEQ ID NO: 3394219 - RNA, 15 nt, Human
auggaauuuuuuugu

SEQ ID NO: 3394220 - RNA, 20 nt, Human
auggacaagagguacagggu

SEQ ID NO: 3394221 - RNA, 22 nt, Human
auggacacuuugaaauguguuu

SEQ ID NO: 3394222 - RNA, 14 nt, Human
auggacacuuuuca

SEQ ID NO: 3394223 - RNA, 18 nt, Human
auggacagggcaugccac

SEQ ID NO: 3394224 - RNA, 21 nt, Human
auggacaguucacacccugca

SEQ ID NO: 3394225 - RNA, 22 nt, Human
auggacaguucacacccugcaa

SEQ ID NO: 3394226 - RNA, 13 nt, Human
auggacauccugu

SEQ ID NO: 3394227 - RNA, 22 nt, Human
auggacauccuguauaagcacu

SEQ ID NO: 3394228 - RNA, 23 nt, Human
auggacauccuguauaagcacug

SEQ ID NO: 3394229 - RNA, 14 nt, Human
auggacaugaucuu

SEQ ID NO: 3394230 - RNA, 13 nt, Human
auggacauggugg

SEQ ID NO: 3394231 - RNA, 17 nt, Human
auggacauuuagaagaa

SEQ ID NO: 3394232 - RNA, 18 nt, Human
auggaccacuguuucuug

SEQ ID NO: 3394233 - RNA, 21 nt, Human
auggaccacuguuucuugcuu

SEQ ID NO: 3394234 - RNA, 23 nt, Human
auggaccaugcugucuggcacag

SEQ ID NO: 3394235 - RNA, 21 nt, Human
auggacccaauauuuaccaga

SEQ ID NO: 3394236 - RNA, 13 nt, Human
auggaccggagag

SEQ ID NO: 3394237 - RNA, 13 nt, Human
auggaccuaacau

SEQ ID NO: 3394238 - RNA, 15 nt, Human
auggaccuucuagaa

SEQ ID NO: 3394239 - RNA, 15 nt, Human
auggacggugcucca

SEQ ID NO: 3394240 - RNA, 21 nt, Human
auggacggugcuccaggcagg

SEQ ID NO: 3394241 - RNA, 20 nt, Human
auggacguguuaugacucca

SEQ ID NO: 3394242 - RNA, 13 nt, Human
auggacuaucugu

SEQ ID NO: 3394243 - RNA, 21 nt, Human
auggacuaucugucugguggc

SEQ ID NO: 3394244 - RNA, 15 nt, Human
auggacucugcacau

SEQ ID NO: 3394245 - RNA, 15 nt, Human
auggacugguuugag

SEQ ID NO: 3394246 - RNA, 17 nt, Human
auggacuguggugacuu

SEQ ID NO: 3394247 - RNA, 23 nt, Human
auggacuuguauauuuguacaaa

SEQ ID NO: 3394248 - RNA, 11 nt, Human
auggacuuugu

SEQ ID NO: 3394249 - RNA, 12 nt, Human
auggacuuuguu

SEQ ID NO: 3394250 - RNA, 14 nt, Human
auggagaaacccug

SEQ ID NO: 3394251 - RNA, 14 nt, Human
auggagaaagcuga

SEQ ID NO: 3394252 - RNA, 23 nt, Human
auggagaaagcugacuuggcugg

SEQ ID NO: 3394253 - RNA, 15 nt, Human
auggagaaccaccua

SEQ ID NO: 3394254 - RNA, 22 nt, Human
auggagaagaaaggccaucaga

SEQ ID NO: 3394255 - RNA, 15 nt, Human
auggagaagcugcag

SEQ ID NO: 3394256 - RNA, 16 nt, Human
auggagaagcugcagg

SEQ ID NO: 3394257 - RNA, 13 nt, Human
auggagaaggaag

SEQ ID NO: 3394258 - RNA, 15 nt, Human
auggagaaggaaggc

SEQ ID NO: 3394259 - RNA, 18 nt, Human
auggagacgcauuucggu

SEQ ID NO: 3394260 - RNA, 14 nt, Human
auggagacuccugc

SEQ ID NO: 3394261 - RNA, 18 nt, Human
auggagccagcucccucu

SEQ ID NO: 3394262 - RNA, 15 nt, Human
auggagccccagccc

SEQ ID NO: 3394263 - RNA, 15 nt, Human
auggagccucuucug

SEQ ID NO: 3394264 - RNA, 20 nt, Human
auggagccuggcacaggacu

SEQ ID NO: 3394265 - RNA, 22 nt, Human
auggagcucagagagggcaggc

SEQ ID NO: 3394266 - RNA, 20 nt, Human
auggaggaagaacugaaagg

SEQ ID NO: 3394267 - RNA, 18 nt, Human
auggaggacuccaggcag

SEQ ID NO: 3394268 - RNA, 17 nt, Human
auggaggagaagaauuu

SEQ ID NO: 3394269 - RNA, 16 nt, Human
auggaggaggaggcaa

SEQ ID NO: 3394270 - RNA, 12 nt, Human
auggaggcacac

SEQ ID NO: 3394271 - RNA, 17 nt, Human
auggaggcagaauccug

SEQ ID NO: 3394272 - RNA, 12 nt, Human
auggaggccugu

SEQ ID NO: 3394273 - RNA, 17 nt, Human
auggaggggaguguugg

SEQ ID NO: 3394274 - RNA, 15 nt, Human
auggaggggcagagc

SEQ ID NO: 3394275 - RNA, 20 nt, Human
auggaggggugguccugacu

SEQ ID NO: 3394276 - RNA, 12 nt, Human
auggagguucua

SEQ ID NO: 3394277 - RNA, 17 nt, Human
auggagguucuaaggcc

SEQ ID NO: 3394278 - RNA, 24 nt, Human
auggagguuucauacucuagauuu

SEQ ID NO: 3394279 - RNA, 21 nt, Human
auggagucauuugagucucuu

SEQ ID NO: 3394280 - RNA, 18 nt, Human
auggagugcaccaaagag

SEQ ID NO: 3394281 - RNA, 19 nt, Human
auggagugcuguuuuguua

SEQ ID NO: 3394282 - RNA, 21 nt, Human
auggagugcuguuuuguuaua

SEQ ID NO: 3394283 - RNA, 13 nt, Human
auggugccucugg

SEQ ID NO: 3394284 - RNA, 14 nt, Human
auggugccugagag

SEQ ID NO: 3394285 - RNA, 18 nt, Human
auggugccugagaggcag

SEQ ID NO: 3394286 - RNA, 16 nt, Human
auggugccuucauuug

SEQ ID NO: 3394287 - RNA, 16 nt, Human
auggugcucauuucau

SEQ ID NO: 3394288 - RNA, 17 nt, Human
auggugcuuaaguucca

SEQ ID NO: 3394289 - RNA, 23 nt, Human
auggugcuuguuaaugcuuucug

SEQ ID NO: 3394290 - RNA, 16 nt, Human
augguggacccagcgg

SEQ ID NO: 3394291 - RNA, 13 nt, Human
augguggagggcc

SEQ ID NO: 3394292 - RNA, 14 nt, Human
augguggagggcca

SEQ ID NO: 3394293 - RNA, 22 nt, Human
augguggaugauccccacgcca

SEQ ID NO: 3394294 - RNA, 16 nt, Human
augguggcgcgcaccu

SEQ ID NO: 3394295 - RNA, 13 nt, Human
augguggcugggu

SEQ ID NO: 3394296 - RNA, 15 nt, Human
augguggcuucagcu

SEQ ID NO: 3394297 - RNA, 22 nt, Human
augguggcuucagcuccagccc

SEQ ID NO: 3394298 - RNA, 23 nt, Human
augguggcuucuuuucuuuguau

SEQ ID NO: 3394299 - RNA, 14 nt, Human
auggugggcuucag

SEQ ID NO: 3394300 - RNA, 16 nt, Human
auggugggcuucaggg

SEQ ID NO: 3394301 - RNA, 23 nt, Human
auggugggcuucagggcaggugg

SEQ ID NO: 3394302 - RNA, 16 nt, Human
augguggggucuccuc

SEQ ID NO: 3394303 - RNA, 12 nt, Human
augguguaauaa

SEQ ID NO: 3394304 - RNA, 14 nt, Human
augguguaauaaga

SEQ ID NO: 3394305 - RNA, 16 nt, Human
augguguaauaagaca

SEQ ID NO: 3394306 - RNA, 18 nt, Human
augguguaauaagacaua

SEQ ID NO: 3394307 - RNA, 19 nt, Human
augguguucaaaaaacuug

SEQ ID NO: 3394308 - RNA, 21 nt, Human
augguguuuucauguaaauaa

SEQ ID NO: 3394309 - RNA, 18 nt, Human
augguguuuuucuuguaa

SEQ ID NO: 3394310 - RNA, 19 nt, Human
augguguuuuucuuguaaa

SEQ ID NO: 3394311 - RNA, 13 nt, Human
augguuaaacauu

SEQ ID NO: 3394312 - RNA, 18 nt, Human
augguuaagaguccaaga

SEQ ID NO: 3394313 - RNA, 15 nt, Human
augguuacacuguua

SEQ ID NO: 3394314 - RNA, 17 nt, Human
augguuacacuguuaga

SEQ ID NO: 3394315 - RNA, 14 nt, Human
augguuauaaaagu

SEQ ID NO: 3394316 - RNA, 16 nt, Human
augguuaugaaagaau

SEQ ID NO: 3394317 - RNA, 18 nt, Human
augguuaugaaagaauau

SEQ ID NO: 3394318 - RNA, 20 nt, Human
augguucagaauuaaacuuu

SEQ ID NO: 3394319 - RNA, 16 nt, Human
augguuccaugccuga

SEQ ID NO: 3394320 - RNA, 19 nt, Human
augguuccccuguucacuc

SEQ ID NO: 3394321 - RNA, 20 nt, Human
augguucucucaacaagaaa

SEQ ID NO: 3394322 - RNA, 18 nt, Human
augguucuggcuguuuga

SEQ ID NO: 3394323 - RNA, 13 nt, Human
augguuguacaua

SEQ ID NO: 3394324 - RNA, 13 nt, Human
augguuguauuag

SEQ ID NO: 3394325 - RNA, 19 nt, Human
augguuuauuuuguauugu

SEQ ID NO: 3394326 - RNA, 14 nt, Human
augguuucagcacu

SEQ ID NO: 3394327 - RNA, 15 nt, Human
augguuucagcacua

SEQ ID NO: 3394328 - RNA, 22 nt, Human
augguuugaauauaaacacuau

SEQ ID NO: 3394329 - RNA, 23 nt, Human
augguuugacucaucuuauaugg

SEQ ID NO: 3394330 - RNA, 17 nt, Human
augguuugcaaggaagc

SEQ ID NO: 3394331 - RNA, 15 nt, Human
augguuuuaaacuuu

SEQ ID NO: 3394332 - RNA, 13 nt, Human
augguuuuaagaa

SEQ ID NO: 3394333 - RNA, 14 nt, Human
augguuuucuccaa

SEQ ID NO: 3394334 - RNA, 20 nt, Human
augguuuucuccaagagcua

SEQ ID NO: 3394335 - RNA, 15 nt, Human
augguuuugugccau

SEQ ID NO: 3394336 - RNA, 18 nt, Human
augguuuuuaaauuuugu

SEQ ID NO: 3394337 - RNA, 14 nt, Human
auguaaaaauaacc

SEQ ID NO: 3394338 - RNA, 13 nt, Human
auguaaaacaaaa

SEQ ID NO: 3394339 - RNA, 15 nt, Human
auguaaaacaaaaaa

SEQ ID NO: 3394340 - RNA, 14 nt, Human
auguaaaacauuua

SEQ ID NO: 3394341 - RNA, 15 nt, Human
auguaaaacauuuau

SEQ ID NO: 3394342 - RNA, 20 nt, Human
auguaaaacauuuauuuuga

SEQ ID NO: 3394343 - RNA, 22 nt, Human
auguaaaagaacuuacugauua

SEQ ID NO: 3394344 - RNA, 23 nt, Human
auguaaaaggccaaaccucuguu

SEQ ID NO: 3394345 - RNA, 21 nt, Human
auguaaaagguauuaaauuga

SEQ ID NO: 3394346 - RNA, 15 nt, Human
auguaaaaucuuguc

SEQ ID NO: 3394347 - RNA, 12 nt, Human
auguaaaaugau

SEQ ID NO: 3394348 - RNA, 19 nt, Human
auguaaacaaaauuuaguu

SEQ ID NO: 3394349 - RNA, 15 nt, Human
auguaaacaaaucuu

SEQ ID NO: 3394350 - RNA, 22 nt, Human
auguaaacaaaucuuuccauau

SEQ ID NO: 3394351 - RNA, 14 nt, Human
auguaaacaggaga

SEQ ID NO: 3394352 - RNA, 20 nt, Human
auguaaacauaccaacaugu

SEQ ID NO: 3394353 - RNA, 15 nt, Human
auguaaacugccaua

SEQ ID NO: 3394354 - RNA, 14 nt, Human
auguaaacugugca

SEQ ID NO: 3394355 - RNA, 17 nt, Human
auguaaagaucaauaaa

SEQ ID NO: 3394356 - RNA, 13 nt, Human
auguaaagccaug

SEQ ID NO: 3394357 - RNA, 16 nt, Human
auguaaagugauauuu

SEQ ID NO: 3394358 - RNA, 16 nt, Human
auguaaagugucagaa

SEQ ID NO: 3394359 - RNA, 14 nt, Human
auguaaauaauucu

SEQ ID NO: 3394360 - RNA, 13 nt, Human
auguaaauacugu

SEQ ID NO: 3394361 - RNA, 20 nt, Human
auguaaaucccauuauucaa

SEQ ID NO: 3394362 - RNA, 22 nt, Human
auguaaaucccauuauucaaag

SEQ ID NO: 3394363 - RNA, 13 nt, Human
auguaaaugaagu

SEQ ID NO: 3394364 - RNA, 21 nt, Human
auguaaaugcaucuguccuca

SEQ ID NO: 3394365 - RNA, 15 nt, Human
auguaaauguaaacu

SEQ ID NO: 3394366 - RNA, 21 nt, Human
auguaaaugucucacugagca

SEQ ID NO: 3394367 - RNA, 14 nt, Human
auguaaaugugcau

SEQ ID NO: 3394368 - RNA, 17 nt, Human
auguaaauugacuguac

SEQ ID NO: 3394369 - RNA, 21 nt, Human
auguaacagccaggaguguua

SEQ ID NO: 3394370 - RNA, 16 nt, Human
auguaacagucugauc

SEQ ID NO: 3394371 - RNA, 23 nt, Human
auguaacugcauugagaacugca

SEQ ID NO: 3394372 - RNA, 19 nt, Human
auguaacugccuagaaaca

SEQ ID NO: 3394373 - RNA, 15 nt, Human
auguaacugcucuug

SEQ ID NO: 3394374 - RNA, 20 nt, Human
auguaacugcucuugggcaa

SEQ ID NO: 3394375 - RNA, 21 nt, Human
auguaacuguuaccauuggaa

SEQ ID NO: 3394376 - RNA, 22 nt, Human
auguaacuguuaccauuggaaa

SEQ ID NO: 3394377 - RNA, 12 nt, Human
auguaacuugaa

SEQ ID NO: 3394378 - RNA, 16 nt, Human
auguaacuuuuguaag

SEQ ID NO: 3394379 - RNA, 18 nt, Human
auguaacuuuuguaagac

SEQ ID NO: 3394380 - RNA, 15 nt, Human
auguaagaaucauug

SEQ ID NO: 3394381 - RNA, 21 nt, Human
auguaagagcuuuacaaaaag

SEQ ID NO: 3394382 - RNA, 22 nt, Human
auguaagagcuuuacaaaaaga

SEQ ID NO: 3394383 - RNA, 15 nt, Human
auguaagauuauaga

SEQ ID NO: 3394384 - RNA, 17 nt, Human
auguaagcucuacugag

SEQ ID NO: 3394385 - RNA, 22 nt, Human
auguaagcuguuuauuuuauau

SEQ ID NO: 3394386 - RNA, 23 nt, Human
auguaaggcuguguaagauuugu

SEQ ID NO: 3394387 - RNA, 20 nt, Human
auguaagggaaacugccagc

SEQ ID NO: 3394388 - RNA, 22 nt, Human
auguaagggaaacugccagcaa

SEQ ID NO: 3394389 - RNA, 22 nt, Human
auguaagguauaucauucuaaa

SEQ ID NO: 3394390 - RNA, 16 nt, Human
auguaaguaaacgguc

SEQ ID NO: 3394391 - RNA, 14 nt, Human
auguaagugggccc

SEQ ID NO: 3394392 - RNA, 14 nt, Human
auguaauaaacuuu

SEQ ID NO: 3394393 - RNA, 15 nt, Human
auguaauaaacuuua

SEQ ID NO: 3394394 - RNA, 22 nt, Human
auguaauaagguugaacacuuu

SEQ ID NO: 3394395 - RNA, 16 nt, Human
auguaauaaugugaau

SEQ ID NO: 3394396 - RNA, 21 nt, Human
auguaauacuucuugugugua

SEQ ID NO: 3394397 - RNA, 19 nt, Human
auguaaucucucugcagcu

SEQ ID NO: 3394398 - RNA, 22 nt, Human
auguaaucucucugcagcugcc

SEQ ID NO: 3394399 - RNA, 22 nt, Human
auguaaugcgauuuuauuacug

SEQ ID NO: 3394400 - RNA, 17 nt, Human
auguaauggcaguuaua

SEQ ID NO: 3394401 - RNA, 23 nt, Human
auguaaugugugguggccucagc

SEQ ID NO: 3394402 - RNA, 18 nt, Human
auguaauguuaauguuau

SEQ ID NO: 3394403 - RNA, 15 nt, Human
auguaauugaauaaa

SEQ ID NO: 3394404 - RNA, 17 nt, Human
auguaauuguaauuuug

SEQ ID NO: 3394405 - RNA, 19 nt, Human
auguaauuguaauuuugaa

SEQ ID NO: 3394406 - RNA, 13 nt, Human
auguaauuuaaau

SEQ ID NO: 3394407 - RNA, 15 nt, Human
auguaauuuaaauga

SEQ ID NO: 3394408 - RNA, 18 nt, Human
auguaauuuguguaauaa

SEQ ID NO: 3394409 - RNA, 21 nt, Human
auguaauuuguguaauaaagu

SEQ ID NO: 3394410 - RNA, 23 nt, Human
auguaauuuuauuuuaaaauuuc

SEQ ID NO: 3394411 - RNA, 16 nt, Human
auguaauuuuguguaa

SEQ ID NO: 3394412 - RNA, 23 nt, Human
auguaauuuuguguaagaaauac

SEQ ID NO: 3394413 - RNA, 19 nt, Human
auguacaauauuuuaagca

SEQ ID NO: 3394414 - RNA, 23 nt, Human
auguacagacauauuuaacuggu

SEQ ID NO: 3394415 - RNA, 16 nt, Human
auguacagauucuuuc

SEQ ID NO: 3394416 - RNA, 18 nt, Human
auguacagauucuuucag

SEQ ID NO: 3394417 - RNA, 17 nt, Human
auguacaggaugcuuug

SEQ ID NO: 3394418 - RNA, 17 nt, Human
auguacaguguucuguu

SEQ ID NO: 3394419 - RNA, 15 nt, Human
auguacauagugcua

SEQ ID NO: 3394420 - RNA, 17 nt, Human
auguacauagugcuaac

SEQ ID NO: 3394421 - RNA, 14 nt, Human
auguacauuuggaa

SEQ ID NO: 3394422 - RNA, 15 nt, Human
auguaccauguacau

SEQ ID NO: 3394423 - RNA, 16 nt, Human
auguaccguaggcuuu

SEQ ID NO: 3394424 - RNA, 16 nt, Human
auguaccuccccugcc

SEQ ID NO: 3394425 - RNA, 19 nt, Human
auguaccuccccugccuug

SEQ ID NO: 3394426 - RNA, 22 nt, Human
auguaccuccccugccuugcug

SEQ ID NO: 3394427 - RNA, 13 nt, Human
auucaucugucua

SEQ ID NO: 3394428 - RNA, 18 nt, Human
auucaucugucuauauuu

SEQ ID NO: 3394429 - RNA, 16 nt, Human
auucaucuucuucuuu

SEQ ID NO: 3394430 - RNA, 20 nt, Human
auucauggaccacuguuucu

SEQ ID NO: 3394431 - RNA, 17 nt, Human
auucauggccuggggga

SEQ ID NO: 3394432 - RNA, 17 nt, Human
auucauguuauauuuaa

SEQ ID NO: 3394433 - RNA, 15 nt, Human
auucauguuucuuaa

SEQ ID NO: 3394434 - RNA, 16 nt, Human
auucauuagucauguu

SEQ ID NO: 3394435 - RNA, 14 nt, Human
auucauuaguuuug

SEQ ID NO: 3394436 - RNA, 15 nt, Human
auucauuaguuuuga

SEQ ID NO: 3394437 - RNA, 19 nt, Human
auucauuauuuuuccacuu

SEQ ID NO: 3394438 - RNA, 12 nt, Human
auucauuccauu

SEQ ID NO: 3394439 - RNA, 19 nt, Human
auucauuccauucuggaag

SEQ ID NO: 3394440 - RNA, 22 nt, Human
auucauucuggucucucuauua

SEQ ID NO: 3394441 - RNA, 18 nt, Human
auucauucugugaucauu

SEQ ID NO: 3394442 - RNA, 22 nt, Human
auucauucugugaucauuuauu

SEQ ID NO: 3394443 - RNA, 14 nt, Human
auucauucuuagcu

SEQ ID NO: 3394444 - RNA, 19 nt, Human
auucauucuuagcucuuaa

SEQ ID NO: 3394445 - RNA, 16 nt, Human
auucauucuuuuugaa

SEQ ID NO: 3394446 - RNA, 21 nt, Human
auucauucuuuuugaaauguc

SEQ ID NO: 3394447 - RNA, 19 nt, Human
auucauuguauaaaaauag

SEQ ID NO: 3394448 - RNA, 13 nt, Human
auucauugucucu

SEQ ID NO: 3394449 - RNA, 16 nt, Human
auucauuuaaaaugau

SEQ ID NO: 3394450 - RNA, 17 nt, Human
auucauuuaaaaugauu

SEQ ID NO: 3394451 - RNA, 11 nt, Human
auucauuucaa

SEQ ID NO: 3394452 - RNA, 12 nt, Human
auucauuucaca

SEQ ID NO: 3394453 - RNA, 20 nt, Human
auucauuucacauuaauggu

SEQ ID NO: 3394454 - RNA, 22 nt, Human
auucauuucacauuaauggucu

SEQ ID NO: 3394455 - RNA, 12 nt, Human
auucauuuccug

SEQ ID NO: 3394456 - RNA, 15 nt, Human
auucauuuccugccc

SEQ ID NO: 3394457 - RNA, 21 nt, Human
auucauuuuaacaucugagaa

SEQ ID NO: 3394458 - RNA, 16 nt, Human
auucauuuucuagaua

SEQ ID NO: 3394459 - RNA, 17 nt, Human
auuccaaaaagcacaua

SEQ ID NO: 3394460 - RNA, 14 nt, Human
auuccaaacauggu

SEQ ID NO: 3394461 - RNA, 15 nt, Human
auuccaaagcuuuau

SEQ ID NO: 3394462 - RNA, 23 nt, Human
auuccaaagcuuuauuaccagug

SEQ ID NO: 3394463 - RNA, 20 nt, Human
auuccaaaugucuuuuagaa

SEQ ID NO: 3394464 - RNA, 23 nt, Human
auuccaacaaaggguuuuaaugu

SEQ ID NO: 3394465 - RNA, 14 nt, Human
auuccaacagcuca

SEQ ID NO: 3394466 - RNA, 20 nt, Human
auuccaacagcucaagucuu

SEQ ID NO: 3394467 - RNA, 14 nt, Human
auuccaacagugag

SEQ ID NO: 3394468 - RNA, 20 nt, Human
auuccaacaguuuaaugaag

SEQ ID NO: 3394469 - RNA, 22 nt, Human
auuccaagaauagcaucuguac

SEQ ID NO: 3394470 - RNA, 23 nt, Human
auuccaagcuuccauagcugcug

SEQ ID NO: 3394471 - RNA, 12 nt, Human
auuccaauaaac

SEQ ID NO: 3394472 - RNA, 18 nt, Human
auuccaauaugaugacuc

SEQ ID NO: 3394473 - RNA, 13 nt, Human
auuccaaucuaca

SEQ ID NO: 3394474 - RNA, 17 nt, Human
auuccaccuuaaauuaa

SEQ ID NO: 3394475 - RNA, 18 nt, Human
auuccaccuuaaauuaaa

SEQ ID NO: 3394476 - RNA, 19 nt, Human
auuccaccuuaaauuaaac

SEQ ID NO: 3394477 - RNA, 20 nt, Human
auuccaccuuaaauuaaaca

SEQ ID NO: 3394478 - RNA, 16 nt, Human
auuccacuacaccugg

SEQ ID NO: 3394479 - RNA, 22 nt, Human
auuccacuacaccuggcugagg

SEQ ID NO: 3394480 - RNA, 20 nt, Human
auuccacuuauaggaauuga

SEQ ID NO: 3394481 - RNA, 12 nt, Human
auuccagaauau

SEQ ID NO: 3394482 - RNA, 15 nt, Human
auuccagaaugcugu

SEQ ID NO: 3394483 - RNA, 20 nt, Human
auuccagaaugcuguacauc

SEQ ID NO: 3394484 - RNA, 16 nt, Human
auuccagacagucaca

SEQ ID NO: 3394485 - RNA, 23 nt, Human
auuccagacagucacaaauuucu

SEQ ID NO: 3394486 - RNA, 23 nt, Human
auuccagacugcuuccaauuuuc

SEQ ID NO: 3394487 - RNA, 17 nt, Human
auuccagagcacugcuc

SEQ ID NO: 3394488 - RNA, 17 nt, Human
auuccagagcugccagu

SEQ ID NO: 3394489 - RNA, 20 nt, Human
auuccagaucugcagucacu

SEQ ID NO: 3394490 - RNA, 16 nt, Human
auuccagaucuuucag

SEQ ID NO: 3394491 - RNA, 20 nt, Human
auuccagaucuuucagaaau

SEQ ID NO: 3394492 - RNA, 13 nt, Human
auuccagccccuc

SEQ ID NO: 3394493 - RNA, 12 nt, Human
auuccaggcucc

SEQ ID NO: 3394494 - RNA, 18 nt, Human
auuccagguggcaucagu

SEQ ID NO: 3394495 - RNA, 15 nt, Human
auuccaguuuguuua

SEQ ID NO: 3394496 - RNA, 14 nt, Human
auuccauaguauau

SEQ ID NO: 3394497 - RNA, 22 nt, Human
auuccauaguauauuaaaaaug

SEQ ID NO: 3394498 - RNA, 22 nt, Human
auuccauauuagaaaacuuugu

SEQ ID NO: 3394499 - RNA, 15 nt, Human
auuccauccauaaau

SEQ ID NO: 3394500 - RNA, 18 nt, Human
auuccauccauauacuuu

SEQ ID NO: 3394501 - RNA, 11 nt, Human
auuccauccuu

SEQ ID NO: 3394502 - RNA, 12 nt, Human
auuccaugaauc

SEQ ID NO: 3394503 - RNA, 13 nt, Human
auuccaugaaugu

SEQ ID NO: 3394504 - RNA, 23 nt, Human
auuccaugaauguaucaggaaau

SEQ ID NO: 3394505 - RNA, 17 nt, Human
auuccaugacugcuugc

SEQ ID NO: 3394506 - RNA, 23 nt, Human
auuccauguuuggaagacccuug

SEQ ID NO: 3394507 - RNA, 16 nt, Human
auuccauucuggauuu

SEQ ID NO: 3394508 - RNA, 20 nt, Human
auuccauugccuagcucuuu

SEQ ID NO: 3394509 - RNA, 16 nt, Human
auuccauugguccaag

SEQ ID NO: 3394510 - RNA, 17 nt, Human
auuccauugguccaaga

SEQ ID NO: 3394511 - RNA, 15 nt, Human
auuccauugugugag

SEQ ID NO: 3394512 - RNA, 16 nt, Human
auuccauugugugagu

SEQ ID NO: 3394513 - RNA, 21 nt, Human
auuccauuugaggauuuagaa

SEQ ID NO: 3394514 - RNA, 14 nt, Human
auucccaagcucug

SEQ ID NO: 3394515 - RNA, 14 nt, Human
auucccaccaaggu

SEQ ID NO: 3394516 - RNA, 19 nt, Human
auucccagagacaggaaaa

SEQ ID NO: 3394517 - RNA, 12 nt, Human
auucccagcucu

SEQ ID NO: 3394518 - RNA, 14 nt, Human
auucccagcugucu

SEQ ID NO: 3394519 - RNA, 16 nt, Human
auucccagcugucugu

SEQ ID NO: 3394520 - RNA, 17 nt, Human
auucccagcugucugug

SEQ ID NO: 3394521 - RNA, 19 nt, Human
auucccagguaggccaagg

SEQ ID NO: 3394522 - RNA, 22 nt, Human
auucccauugaaaauguaagua

SEQ ID NO: 3394523 - RNA, 20 nt, Human
auucccauuuugcaaaauuu

SEQ ID NO: 3394524 - RNA, 20 nt, Human
auuccccagccucucuuccu

SEQ ID NO: 3394525 - RNA, 21 nt, Human
auuccccagccucucuuccua

SEQ ID NO: 3394526 - RNA, 16 nt, Human
auuccccaggaggcca

SEQ ID NO: 3394527 - RNA, 16 nt, Human
auuccccaucucaggc

SEQ ID NO: 3394528 - RNA, 15 nt, Human
auuccccauucuucc

SEQ ID NO: 3394529 - RNA, 13 nt, Human
auucccccagugc

SEQ ID NO: 3394530 - RNA, 15 nt, Human
auuccccucugcugc

SEQ ID NO: 3394531 - RNA, 22 nt, Human
auuccccucugcugcugucccu

SEQ ID NO: 3394532 - RNA, 14 nt, Human
auuccccuguguca

SEQ ID NO: 3394533 - RNA, 20 nt, Human
auucccgggugcagaauugu

SEQ ID NO: 3394534 - RNA, 17 nt, Human
auucccuagaaacuucc

SEQ ID NO: 3394535 - RNA, 20 nt, Human
auucccuagaaacuuccaaa

SEQ ID NO: 3394536 - RNA, 21 nt, Human
auucccuagaaacuuccaaau

SEQ ID NO: 3394537 - RNA, 12 nt, Human
auucccucccca

SEQ ID NO: 3394538 - RNA, 15 nt, Human
auucccucucccagg

SEQ ID NO: 3394539 - RNA, 16 nt, Human
auucccucucccaggc

SEQ ID NO: 3394540 - RNA, 16 nt, Human
auucccucucucugac

SEQ ID NO: 3394541 - RNA, 22 nt, Human
auucccucucucugacucucaa

SEQ ID NO: 3394542 - RNA, 13 nt, Human
auucccugccugg

SEQ ID NO: 3394543 - RNA, 13 nt, Human
auucccuggccuu

SEQ ID NO: 3394544 - RNA, 16 nt, Human
auucccugggaucugg

SEQ ID NO: 3394545 - RNA, 20 nt, Human
auucccuucgacagcauuuu

SEQ ID NO: 3394546 - RNA, 19 nt, Human
auucccuuguuauucaaca

SEQ ID NO: 3394547 - RNA, 18 nt, Human
auuccguugucuguggau

SEQ ID NO: 3394548 - RNA, 19 nt, Human
auuccguugucuguggaug

SEQ ID NO: 3394549 - RNA, 19 nt, Human
auuccguuuacauuuuaga

SEQ ID NO: 3394550 - RNA, 15 nt, Human
auuccuaaacuaucu

SEQ ID NO: 3394551 - RNA, 15 nt, Human
auuccuaagccacuu

SEQ ID NO: 3394552 - RNA, 15 nt, Human
auuccuacagcacua

SEQ ID NO: 3394553 - RNA, 17 nt, Human
auuccuacagcacuacu

SEQ ID NO: 3394554 - RNA, 23 nt, Human
auuccuacagcacuacugggugu

SEQ ID NO: 3394555 - RNA, 17 nt, Human
auuccuaccucccugca

SEQ ID NO: 3394556 - RNA, 15 nt, Human
auuccuagauaaaaa

SEQ ID NO: 3394557 - RNA, 17 nt, Human
auuccuauauaguuuau

SEQ ID NO: 3394558 - RNA, 21 nt, Human
auuccuauugugauuugacug

SEQ ID NO: 3394559 - RNA, 23 nt, Human
auuccuauugugauuugacuguu

SEQ ID NO: 3394560 - RNA, 21 nt, Human
auuccucaacaguguuuucag

SEQ ID NO: 3394561 - RNA, 14 nt, Human
auuccucagggaca

SEQ ID NO: 3394562 - RNA, 14 nt, Human
auuccuccugcuca

SEQ ID NO: 3394563 - RNA, 12 nt, Human
auuccuccuggg

SEQ ID NO: 3394564 - RNA, 22 nt, Human
auuccuccugggccccucaucu

SEQ ID NO: 3394565 - RNA, 12 nt, Human
auuccucuggga

SEQ ID NO: 3394566 - RNA, 13 nt, Human
auuccucuguauu

SEQ ID NO: 3394567 - RNA, 13 nt, Human
auuccucuuugcu

SEQ ID NO: 3394568 - RNA, 14 nt, Human
auuccucuuugcuu

SEQ ID NO: 3394569 - RNA, 15 nt, Human
auuccucuuugcuuu

SEQ ID NO: 3394570 - RNA, 13 nt, Human
auuccugaaagaa

SEQ ID NO: 3394571 - RNA, 21 nt, Human
auuccugacccaggccgcagc

SEQ ID NO: 3394572 - RNA, 18 nt, Human
auuccugaccuccgccau

SEQ ID NO: 3394573 - RNA, 21 nt, Human
auuccugaugcuucuucagag

SEQ ID NO: 3394574 - RNA, 18 nt, Human
auuccugcccugcuguuu

SEQ ID NO: 3394575 - RNA, 19 nt, Human
auuccugcccugcuguuua

SEQ ID NO: 3394576 - RNA, 17 nt, Human
auuccugccugucuccu

SEQ ID NO: 3394577 - RNA, 18 nt, Human
auuccuggaaaccacagu

SEQ ID NO: 3394578 - RNA, 15 nt, Human
auuccugggcacagu

SEQ ID NO: 3394579 - RNA, 15 nt, Human
auuccugguacccag

SEQ ID NO: 3394580 - RNA, 23 nt, Human
auuccuguagcaucuucuggagu

SEQ ID NO: 3394581 - RNA, 16 nt, Human
auuccuguauguuguc

SEQ ID NO: 3394582 - RNA, 17 nt, Human
auuccuguauguugucc

SEQ ID NO: 3394583 - RNA, 21 nt, Human
auuccuuagcuuagaccucag

SEQ ID NO: 3394584 - RNA, 22 nt, Human
auuccuuagcuuagaccucagc

SEQ ID NO: 3394585 - RNA, 15 nt, Human
auuccuucagauuug

SEQ ID NO: 3394586 - RNA, 15 nt, Human
auuccuucagcacuu

SEQ ID NO: 3394587 - RNA, 17 nt, Human
auuccuucagcacuuua

SEQ ID NO: 3394588 - RNA, 22 nt, Human
auuccuuccacuaacucauagu

SEQ ID NO: 3394589 - RNA, 16 nt, Human
auuccuucccagaggg

SEQ ID NO: 3394590 - RNA, 21 nt, Human
auuccuucucccaucucuucc

SEQ ID NO: 3394591 - RNA, 14 nt, Human
auuccuucucugaa

SEQ ID NO: 3394592 - RNA, 16 nt, Human
auuccuucucugaaca

SEQ ID NO: 3394593 - RNA, 16 nt, Human
auuccuucuggccuuu

SEQ ID NO: 3394594 - RNA, 18 nt, Human
auuccuucuuuuuaaaau

SEQ ID NO: 3394595 - RNA, 20 nt, Human
auuccuugauaauguugugg

SEQ ID NO: 3394596 - RNA, 20 nt, Human
auuccuugaucauuuuggga

SEQ ID NO: 3394597 - RNA, 20 nt, Human
auuccuuggcaugccuucca

SEQ ID NO: 3394598 - RNA, 13 nt, Human
auuccuuucccuu

SEQ ID NO: 3394599 - RNA, 16 nt, Human
auuccuuucccuuccu

SEQ ID NO: 3394600 - RNA, 18 nt, Human
auuccuuuccugaucacu

SEQ ID NO: 3394601 - RNA, 15 nt, Human
auuccuuucucaucc

SEQ ID NO: 3394602 - RNA, 16 nt, Human
auuccuuugaagagga

SEQ ID NO: 3394603 - RNA, 15 nt, Human
auucgaaccaggaaa

SEQ ID NO: 3394604 - RNA, 16 nt, Human
auucgaaugacacugu

SEQ ID NO: 3394605 - RNA, 18 nt, Human
auucgaccugauuuacag

SEQ ID NO: 3394606 - RNA, 20 nt, Human
auucgaccugauuuacaguu

SEQ ID NO: 3394607 - RNA, 16 nt, Human
auucgagacagaaccu

SEQ ID NO: 3394608 - RNA, 19 nt, Human
auucgaucucauucaguau

SEQ ID NO: 3394609 - RNA, 20 nt, Human
auucgcccaaagccagacag

SEQ ID NO: 3394610 - RNA, 21 nt, Human
auucgcccaaagccagacagc

SEQ ID NO: 3394611 - RNA, 19 nt, Human
auucgcccgagcuguuuau

SEQ ID NO: 3394612 - RNA, 21 nt, Human
auucgguauccccccaucuug

SEQ ID NO: 3394613 - RNA, 18 nt, Human
auucguacauaauacuga

SEQ ID NO: 3394614 - RNA, 22 nt, Human
auucguacauaauacugaacca

SEQ ID NO: 3394615 - RNA, 21 nt, Human
auucgugauuuucaagcagca

SEQ ID NO: 3394616 - RNA, 14 nt, Human
auucuaaaaccauu

SEQ ID NO: 3394617 - RNA, 20 nt, Human
auucuaaaaugauuguagua

SEQ ID NO: 3394618 - RNA, 15 nt, Human
auucuaaaaugccuu

SEQ ID NO: 3394619 - RNA, 23 nt, Human
auucuaaaaugugauguucuaag

SEQ ID NO: 3394620 - RNA, 12 nt, Human
auucuaaagaua

SEQ ID NO: 3394621 - RNA, 14 nt, Human
auucuaaagauucu

SEQ ID NO: 3394622 - RNA, 17 nt, Human
auucuaaagauucuaua

SEQ ID NO: 3394623 - RNA, 22 nt, Human
auucuaaagauucuauaguucu

SEQ ID NO: 3394624 - RNA, 14 nt, Human
auucuaaauacaug

SEQ ID NO: 3394625 - RNA, 17 nt, Human
auucuaaaugaauguuu

SEQ ID NO: 3394626 - RNA, 12 nt, Human
auucuaaccaga

SEQ ID NO: 3394627 - RNA, 17 nt, Human
auucuaaccagagcaag

SEQ ID NO: 3394628 - RNA, 20 nt, Human
auucuaaccagagcaagcuu

SEQ ID NO: 3394629 - RNA, 23 nt, Human
auucuaaccagagcaagcuuuuu

SEQ ID NO: 3394630 - RNA, 24 nt, Human
auucuaagaaauaucugugaaaua

SEQ ID NO: 3394631 - RNA, 12 nt, Human
auucuaagacuu

SEQ ID NO: 3394632 - RNA, 23 nt, Human
auucuaaugauggcccauucuac

SEQ ID NO: 3394633 - RNA, 15 nt, Human
auucuacuugcucug

SEQ ID NO: 3394634 - RNA, 18 nt, Human
auucuacuugcucuggac

SEQ ID NO: 3394635 - RNA, 13 nt, Human
auucuacuuugag

SEQ ID NO: 3394636 - RNA, 22 nt, Human
auucuagaucagaugcuccaag

SEQ ID NO: 3394637 - RNA, 15 nt, Human
auucuagcuaaugua

SEQ ID NO: 3394638 - RNA, 17 nt, Human
auucuaggaccuguguc

SEQ ID NO: 3394639 - RNA, 19 nt, Human
auucuaggccuccuggccc

SEQ ID NO: 3394640 - RNA, 12 nt, Human
auucuagugcug

SEQ ID NO: 3394641 - RNA, 15 nt, Human
auucuauaaaacucu

SEQ ID NO: 3394642 - RNA, 13 nt, Human
auucuauaguucu

SEQ ID NO: 3394643 - RNA, 14 nt, Human
auucuauaguucua

SEQ ID NO: 3394644 - RNA, 16 nt, Human
auucuauaugaauuua

SEQ ID NO: 3394645 - RNA, 23 nt, Human
auucuauaugaauuuaaauauaa

SEQ ID NO: 3394646 - RNA, 21 nt, Human
auucuaucuuuuguuuccuuu

SEQ ID NO: 3394647 - RNA, 15 nt, Human
auucuauuaaagugc

SEQ ID NO: 3394648 - RNA, 20 nt, Human
auucuauuacauuuucagug

SEQ ID NO: 3394649 - RNA, 20 nt, Human
auucuauugccuucuuugaa

SEQ ID NO: 3394650 - RNA, 20 nt, Human
auucuauuuauauguacaug

SEQ ID NO: 3394651 - RNA, 18 nt, Human
auucuauuugcugggcuu

SEQ ID NO: 3394652 - RNA, 18 nt, Human
auucuauuuuagaauaaa

SEQ ID NO: 3394653 - RNA, 18 nt, Human
auucuauuuucauuuucu

SEQ ID NO: 3394654 - RNA, 21 nt, Human
auucuauuuucauuuucugca

SEQ ID NO: 3394655 - RNA, 12 nt, Human
auucucacaaua

SEQ ID NO: 3394656 - RNA, 13 nt, Human
auucucacaauag

SEQ ID NO: 3394657 - RNA, 17 nt, Human
auucucacuccaccacc

SEQ ID NO: 3394658 - RNA, 16 nt, Human
auucucagaaaggcaa

SEQ ID NO: 3394659 - RNA, 18 nt, Human
auucucagaaucucaaau

SEQ ID NO: 3394660 - RNA, 23 nt, Human
auucucagauauuuauauuuuua

SEQ ID NO: 3394661 - RNA, 21 nt, Human
auucucagggucucugcugcc

SEQ ID NO: 3394662 - RNA, 24 nt, Human
auucucagugccaacuguggcugg

SEQ ID NO: 3394663 - RNA, 15 nt, Human
auucucaucugcacc

SEQ ID NO: 3394664 - RNA, 15 nt, Human
auucucaugccucag

SEQ ID NO: 3394665 - RNA, 12 nt, Human
auucucauuaaa

SEQ ID NO: 3394666 - RNA, 18 nt, Human
auucucauuaaaagaaua

SEQ ID NO: 3394667 - RNA, 19 nt, Human
auucucauuaaaagaauau

SEQ ID NO: 3394668 - RNA, 12 nt, Human
auucucauucuu

SEQ ID NO: 3394669 - RNA, 18 nt, Human
auucucauuugucacaca

SEQ ID NO: 3394670 - RNA, 16 nt, Human
auucuccaccugccag

SEQ ID NO: 3394671 - RNA, 18 nt, Human
auucuccaccugccaggg

SEQ ID NO: 3394672 - RNA, 21 nt, Human
auucuccaccugccagggaca

SEQ ID NO: 3394673 - RNA, 16 nt, Human
auucuccauuuguuau

SEQ ID NO: 3394674 - RNA, 22 nt, Human
auucucccagguaccagcugcg

SEQ ID NO: 3394675 - RNA, 18 nt, Human
auucuccugccucagccu

SEQ ID NO: 3394676 - RNA, 19 nt, Human
auucuccugccucagccuc

SEQ ID NO: 3394677 - RNA, 22 nt, Human
auucuccugccuguagcaguga

SEQ ID NO: 3394678 - RNA, 15 nt, Human
auucuccuggaugcu

SEQ ID NO: 3394679 - RNA, 15 nt, Human
auucuccuucagccc

SEQ ID NO: 3394680 - RNA, 16 nt, Human
auucuccuucagcccu

SEQ ID NO: 3394681 - RNA, 21 nt, Human
auucuccuuguguuacuaagu

SEQ ID NO: 3394682 - RNA, 16 nt, Human
auucuccuuuuaugug

SEQ ID NO: 3394683 - RNA, 18 nt, Human
auucuccuuuuaugugua

SEQ ID NO: 3394684 - RNA, 18 nt, Human
auucucuaguuugauuaa

SEQ ID NO: 3394685 - RNA, 19 nt, Human
auucucuaguuugauuaaa

SEQ ID NO: 3394686 - RNA, 23 nt, Human
auucucuaguuugauuaaauucu

SEQ ID NO: 3394687 - RNA, 15 nt, Human
auucucuccaaaaau

SEQ ID NO: 3394688 - RNA, 19 nt, Human
auucucuccucagacugcu

SEQ ID NO: 3394689 - RNA, 21 nt, Human
auucucuccuguaccucuuga

SEQ ID NO: 3394690 - RNA, 16 nt, Human
auucucucuccugucc

SEQ ID NO: 3394691 - RNA, 11 nt, Human
auucucugagc

SEQ ID NO: 3394692 - RNA, 13 nt, Human
auucucugagcug

SEQ ID NO: 3394693 - RNA, 11 nt, Human
auucucuguac

SEQ ID NO: 3394694 - RNA, 18 nt, Human
auucucugucucauccau

SEQ ID NO: 3394695 - RNA, 22 nt, Human
auucucugugucuaagauucua

SEQ ID NO: 3394696 - RNA, 12 nt, Human
auucucuuaucc

SEQ ID NO: 3394697 - RNA, 20 nt, Human
auucucuuggcuggcuuccu

SEQ ID NO: 3394698 - RNA, 12 nt, Human
auucucuuuuaa

SEQ ID NO: 3394699 - RNA, 16 nt, Human
auucugaacaauucuc

SEQ ID NO: 3394700 - RNA, 19 nt, Human
auucugaacuaaagugcug

SEQ ID NO: 3394701 - RNA, 22 nt, Human
auucugaacuaaagugcugcac

SEQ ID NO: 3394702 - RNA, 15 nt, Human
auucugaagcaacau

SEQ ID NO: 3394703 - RNA, 19 nt, Human
auucugaaugcuucuaagu

SEQ ID NO: 3394704 - RNA, 13 nt, Human
auucugaauguac

SEQ ID NO: 3394705 - RNA, 16 nt, Human
auucugaauuugcaaa

SEQ ID NO: 3394706 - RNA, 22 nt, Human
auucugaauuugcaaaguacug

SEQ ID NO: 3394707 - RNA, 14 nt, Human
auucugaccuuaaa

SEQ ID NO: 3394708 - RNA, 18 nt, Human
auucugaccuuaaaugca

SEQ ID NO: 3394709 - RNA, 19 nt, Human
auucugagcauacucaaca

SEQ ID NO: 3394710 - RNA, 15 nt, Human
auucugaggcccugc

SEQ ID NO: 3394711 - RNA, 23 nt, Human
auucugaguuuuguguuuguugu

SEQ ID NO: 3394712 - RNA, 20 nt, Human
auucugauucgaaugacacu

SEQ ID NO: 3394713 - RNA, 22 nt, Human
auucugauucuggcuuuaagcc

SEQ ID NO: 3394714 - RNA, 22 nt, Human
auucugcagcaugaccugugac

SEQ ID NO: 3394715 - RNA, 17 nt, Human
auucugcaguaaaucuu

SEQ ID NO: 3394716 - RNA, 17 nt, Human
auugcacguggccucuu

SEQ ID NO: 3394717 - RNA, 16 nt, Human
auugcacuccagccug

SEQ ID NO: 3394718 - RNA, 13 nt, Human
auugcacucuaaa

SEQ ID NO: 3394719 - RNA, 23 nt, Human
auugcacucuaaaagguucaggg

SEQ ID NO: 3394720 - RNA, 13 nt, Human
auugcacuuuuaa

SEQ ID NO: 3394721 - RNA, 17 nt, Human
auugcaggauggugucu

SEQ ID NO: 3394722 - RNA, 17 nt, Human
auugcagguggaacuca

SEQ ID NO: 3394723 - RNA, 14 nt, Human
auugcaguuuauca

SEQ ID NO: 3394724 - RNA, 19 nt, Human
auugcauacuauuaaacau

SEQ ID NO: 3394725 - RNA, 16 nt, Human
auugcauauaacuuau

SEQ ID NO: 3394726 - RNA, 16 nt, Human
auugcaucaaagcauc

SEQ ID NO: 3394727 - RNA, 19 nt, Human
auugcaucacuguaucauu

SEQ ID NO: 3394728 - RNA, 19 nt, Human
auugcaucucaaaauuauu

SEQ ID NO: 3394729 - RNA, 22 nt, Human
auugcaucucccagauaaugug

SEQ ID NO: 3394730 - RNA, 23 nt, Human
auugcaucucccagauaauguga

SEQ ID NO: 3394731 - RNA, 15 nt, Human
auugcaugcugcuuu

SEQ ID NO: 3394732 - RNA, 14 nt, Human
auugcauucuauug

SEQ ID NO: 3394733 - RNA, 18 nt, Human
auugcauucuauugccuu

SEQ ID NO: 3394734 - RNA, 11 nt, Human
auugcauugac

SEQ ID NO: 3394735 - RNA, 17 nt, Human
auugcauuuccugacag

SEQ ID NO: 3394736 - RNA, 16 nt, Human
auugccaaaaaggaua

SEQ ID NO: 3394737 - RNA, 17 nt, Human
auugccaaaacccagcu

SEQ ID NO: 3394738 - RNA, 13 nt, Human
auugccaaacauu

SEQ ID NO: 3394739 - RNA, 22 nt, Human
auugccaaacauuaauguugau

SEQ ID NO: 3394740 - RNA, 15 nt, Human
auugccaccaggaga

SEQ ID NO: 3394741 - RNA, 21 nt, Human
auugccaccaggagaaccacu

SEQ ID NO: 3394742 - RNA, 21 nt, Human
auugccagcugacaucuugaa

SEQ ID NO: 3394743 - RNA, 18 nt, Human
auugccauauugcacaug

SEQ ID NO: 3394744 - RNA, 22 nt, Human
auugccauauugcacaugucuu

SEQ ID NO: 3394745 - RNA, 12 nt, Human
auugccaugugg

SEQ ID NO: 3394746 - RNA, 23 nt, Human
auugccauuucuuccacaagagc

SEQ ID NO: 3394747 - RNA, 14 nt, Human
auugcccaggcugg

SEQ ID NO: 3394748 - RNA, 20 nt, Human
auugcccaggcuggucuuga

SEQ ID NO: 3394749 - RNA, 22 nt, Human
auugcccccagggcacuucaca

SEQ ID NO: 3394750 - RNA, 20 nt, Human
auugccuaagaauaaacauu

SEQ ID NO: 3394751 - RNA, 13 nt, Human
auugccuauuuca

SEQ ID NO: 3394752 - RNA, 19 nt, Human
auugccucggcuggcuccc

SEQ ID NO: 3394753 - RNA, 13 nt, Human
auugccucugaga

SEQ ID NO: 3394754 - RNA, 22 nt, Human
auugccugcggucaaggccagc

SEQ ID NO: 3394755 - RNA, 15 nt, Human
auugccuguuucuga

SEQ ID NO: 3394756 - RNA, 15 nt, Human
auugccuucucacca

SEQ ID NO: 3394757 - RNA, 18 nt, Human
auugccuucucaccagcu

SEQ ID NO: 3394758 - RNA, 20 nt, Human
auugccuucuuugaagaagg

SEQ ID NO: 3394759 - RNA, 17 nt, Human
auugccuuugaauguua

SEQ ID NO: 3394760 - RNA, 22 nt, Human
auugccuuugaauguuaauuuu

SEQ ID NO: 3394761 - RNA, 23 nt, Human
auugccuuuuccuguaucuauuu

SEQ ID NO: 3394762 - RNA, 14 nt, Human
auugcgaaucuuuu

SEQ ID NO: 3394763 - RNA, 19 nt, Human
auugcgagagauguguguu

SEQ ID NO: 3394764 - RNA, 21 nt, Human
auugcgucuuagcagugauuu

SEQ ID NO: 3394765 - RNA, 13 nt, Human
auugcguuggucu

SEQ ID NO: 3394766 - RNA, 17 nt, Human
auugcguuggucucugc

SEQ ID NO: 3394767 - RNA, 20 nt, Human
auugcguuugaccuuuuaug

SEQ ID NO: 3394768 - RNA, 21 nt, Human
auugcguuugaccuuuuaugu

SEQ ID NO: 3394769 - RNA, 18 nt, Human
auugcuaaauguaacagu

SEQ ID NO: 3394770 - RNA, 15 nt, Human
auugcuaagaugcuc

SEQ ID NO: 3394771 - RNA, 18 nt, Human
auugcuaauguugcugga

SEQ ID NO: 3394772 - RNA, 23 nt, Human
auugcuaauugcuguugaaagca

SEQ ID NO: 3394773 - RNA, 21 nt, Human
auugcuacuacuuaccuacca

SEQ ID NO: 3394774 - RNA, 15 nt, Human
auugcuacuuccugc

SEQ ID NO: 3394775 - RNA, 19 nt, Human
auugcuacuuccugccugg

SEQ ID NO: 3394776 - RNA, 14 nt, Human
auugcuagagcucc

SEQ ID NO: 3394777 - RNA, 16 nt, Human
auugcuagagcuccuc

SEQ ID NO: 3394778 - RNA, 14 nt, Human
auugcuagauaaaa

SEQ ID NO: 3394779 - RNA, 17 nt, Human
auugcuaucuauugaua

SEQ ID NO: 3394780 - RNA, 22 nt, Human
auugcuaucuggaggccuucca

SEQ ID NO: 3394781 - RNA, 15 nt, Human
auugcuauguuacua

SEQ ID NO: 3394782 - RNA, 20 nt, Human
auugcuauguuacuauuuuc

SEQ ID NO: 3394783 - RNA, 13 nt, Human
auugcucacaguu

SEQ ID NO: 3394784 - RNA, 22 nt, Human
auugcucaucucaguccucaaa

SEQ ID NO: 3394785 - RNA, 18 nt, Human
auugcucccuaagacugu

SEQ ID NO: 3394786 - RNA, 19 nt, Human
auugcucugaauaugucau

SEQ ID NO: 3394787 - RNA, 18 nt, Human
auugcugaaaaugguauu

SEQ ID NO: 3394788 - RNA, 13 nt, Human
auugcugaaauuu

SEQ ID NO: 3394789 - RNA, 12 nt, Human
auugcugacugu

SEQ ID NO: 3394790 - RNA, 22 nt, Human
auugcugagccucugcucccca

SEQ ID NO: 3394791 - RNA, 23 nt, Human
auugcugagccucugcuccccag

SEQ ID NO: 3394792 - RNA, 16 nt, Human
auugcugauggugcaa

SEQ ID NO: 3394793 - RNA, 19 nt, Human
auugcugauggugcaauga

SEQ ID NO: 3394794 - RNA, 15 nt, Human
auugcugauuuuaau

SEQ ID NO: 3394795 - RNA, 21 nt, Human
auugcugcuccuuagcugcca

SEQ ID NO: 3394796 - RNA, 22 nt, Human
auugcugcuccuuagcugccaa

SEQ ID NO: 3394797 - RNA, 19 nt, Human
auugcuggcaaagacagaa

SEQ ID NO: 3394798 - RNA, 16 nt, Human
auugcuggucuuguaa

SEQ ID NO: 3394799 - RNA, 12 nt, Human
auugcuguguau

SEQ ID NO: 3394800 - RNA, 20 nt, Human
auugcuguguccaacuccag

SEQ ID NO: 3394801 - RNA, 18 nt, Human
auugcugugugucccagg

SEQ ID NO: 3394802 - RNA, 19 nt, Human
auugcuguugaaagcaaaa

SEQ ID NO: 3394803 - RNA, 12 nt, Human
auugcuguugcu

SEQ ID NO: 3394804 - RNA, 15 nt, Human
auugcuguuguccaa

SEQ ID NO: 3394805 - RNA, 21 nt, Human
auugcuguuguccaacuauuu

SEQ ID NO: 3394806 - RNA, 21 nt, Human
auugcuuacaagccuaagaau

SEQ ID NO: 3394807 - RNA, 14 nt, Human
auugcuuacauuuu

SEQ ID NO: 3394808 - RNA, 22 nt, Human
auugcuuacauuuuuacaauaa

SEQ ID NO: 3394809 - RNA, 13 nt, Human
auugcuuaguaaa

SEQ ID NO: 3394810 - RNA, 15 nt, Human
auugcuuaguaaaau

SEQ ID NO: 3394811 - RNA, 22 nt, Human
auugcuuaguaaaauuuauuuc

SEQ ID NO: 3394812 - RNA, 10 nt, Human
auugcuucuu

SEQ ID NO: 3394813 - RNA, 23 nt, Human
auugcuugaaagaaaauaugcau

SEQ ID NO: 3394814 - RNA, 15 nt, Human
auugcuugauacuuu

SEQ ID NO: 3394815 - RNA, 16 nt, Human
auugcuuguuggauuu

SEQ ID NO: 3394816 - RNA, 16 nt, Human
auugcuuuacugucaa

SEQ ID NO: 3394817 - RNA, 11 nt, Human
auugcuuucug

SEQ ID NO: 3394818 - RNA, 15 nt, Human
auugcuuucugaaau

SEQ ID NO: 3394819 - RNA, 17 nt, Human
auugcuuucugaaauua

SEQ ID NO: 3394820 - RNA, 15 nt, Human
auugcuuugaaacua

SEQ ID NO: 3394821 - RNA, 12 nt, Human
auugcuuuuaaa

SEQ ID NO: 3394822 - RNA, 16 nt, Human
auugcuuuuaaaauuu

SEQ ID NO: 3394823 - RNA, 21 nt, Human
auugcuuuuaaaauuuuaagc

SEQ ID NO: 3394824 - RNA, 15 nt, Human
auugcuuuugugcau

SEQ ID NO: 3394825 - RNA, 16 nt, Human
auugcuuuuuuaaaua

SEQ ID NO: 3394826 - RNA, 23 nt, Human
auugcuuuuuuccaaaacaaaaa

SEQ ID NO: 3394827 - RNA, 13 nt, Human
auuggaaaaauca

SEQ ID NO: 3394828 - RNA, 14 nt, Human
auuggaaaaaucac

SEQ ID NO: 3394829 - RNA, 15 nt, Human
auuggaaaagacuaa

SEQ ID NO: 3394830 - RNA, 14 nt, Human
auuggaaacaaguc

SEQ ID NO: 3394831 - RNA, 18 nt, Human
auuggaagaaauuccugu

SEQ ID NO: 3394832 - RNA, 19 nt, Human
auuggaagaaauuccugua

SEQ ID NO: 3394833 - RNA, 16 nt, Human
auuggaagaccccacc

SEQ ID NO: 3394834 - RNA, 24 nt, Human
auuggaagagcagcaccuccucag

SEQ ID NO: 3394835 - RNA, 20 nt, Human
auuggaagcagguuaaaugu

SEQ ID NO: 3394836 - RNA, 22 nt, Human
auuggaagcagguuaaauguuu

SEQ ID NO: 3394837 - RNA, 16 nt, Human
auuggaaggagacaca

SEQ ID NO: 3394838 - RNA, 18 nt, Human
auuggaaggagacacaga

SEQ ID NO: 3394839 - RNA, 21 nt, Human
auuggaaggagacacagaugu

SEQ ID NO: 3394840 - RNA, 18 nt, Human
auuggaaucugauauacu

SEQ ID NO: 3394841 - RNA, 18 nt, Human
auuggaauguucucagau

SEQ ID NO: 3394842 - RNA, 13 nt, Human
auuggacaguugu

SEQ ID NO: 3394843 - RNA, 21 nt, Human
auuggacaguugucuagagau

SEQ ID NO: 3394844 - RNA, 15 nt, Human
auuggaccaggccau

SEQ ID NO: 3394845 - RNA, 18 nt, Human
auuggagaguaaaaacug

SEQ ID NO: 3394846 - RNA, 16 nt, Human
auuggagaugcaaaua

SEQ ID NO: 3394847 - RNA, 20 nt, Human
auuggagaugccauccucuu

SEQ ID NO: 3394848 - RNA, 17 nt, Human
auuggagccaccaugcc

SEQ ID NO: 3394849 - RNA, 22 nt, Human
auuggagggugggagagcccag

SEQ ID NO: 3394850 - RNA, 15 nt, Human
auuggauaacaccac

SEQ ID NO: 3394851 - RNA, 13 nt, Human
auuggauacagca

SEQ ID NO: 3394852 - RNA, 11 nt, Human
auuggauauuu

SEQ ID NO: 3394853 - RNA, 16 nt, Human
auuggaucaaguauua

SEQ ID NO: 3394854 - RNA, 18 nt, Human
auuggauuauucauuuaa

SEQ ID NO: 3394855 - RNA, 14 nt, Human
auuggauuauuuaa

SEQ ID NO: 3394856 - RNA, 20 nt, Human
auuggauuauuuaauaacau

SEQ ID NO: 3394857 - RNA, 19 nt, Human
auuggauucugagagcugu

SEQ ID NO: 3394858 - RNA, 22 nt, Human
auuggauucugagagcugugca

SEQ ID NO: 3394859 - RNA, 15 nt, Human
auuggauuuccuaau

SEQ ID NO: 3394860 - RNA, 22 nt, Human
auuggauuuccuaauacuguca

SEQ ID NO: 3394861 - RNA, 12 nt, Human
auuuuuaaauug

SEQ ID NO: 3394862 - RNA, 21 nt, Human
auuuuuaagcaaaauauuauu

SEQ ID NO: 3394863 - RNA, 19 nt, Human
auuuuuaauauauacuaug

SEQ ID NO: 3394864 - RNA, 18 nt, Human
auuuuuaauauguaagga

SEQ ID NO: 3394865 - RNA, 23 nt, Human
auuuuuaauggggguagcagcug

SEQ ID NO: 3394866 - RNA, 20 nt, Human
auuuuuaauguuuuuaaaua

SEQ ID NO: 3394867 - RNA, 12 nt, Human
auuuuuaauuaa

SEQ ID NO: 3394868 - RNA, 22 nt, Human
auuuuuaauuaauugggccagc

SEQ ID NO: 3394869 - RNA, 19 nt, Human
auuuuuacaagaaguuuau

SEQ ID NO: 3394870 - RNA, 20 nt, Human
auuuuuacaagaaguuuauu

SEQ ID NO: 3394871 - RNA, 16 nt, Human
auuuuuacaaguuaua

SEQ ID NO: 3394872 - RNA, 19 nt, Human
auuuuuacaauaaauaauc

SEQ ID NO: 3394873 - RNA, 16 nt, Human
auuuuuacagaauugc

SEQ ID NO: 3394874 - RNA, 21 nt, Human
auuuuuacccuaaugucuuca

SEQ ID NO: 3394875 - RNA, 21 nt, Human
auuuuuacuagaacacagaaa

SEQ ID NO: 3394876 - RNA, 15 nt, Human
auuuuuacugccacu

SEQ ID NO: 3394877 - RNA, 16 nt, Human
auuuuuagaauaagaa

SEQ ID NO: 3394878 - RNA, 22 nt, Human
auuuuuagaauaagaauuugca

SEQ ID NO: 3394879 - RNA, 16 nt, Human
auuuuuagccuguguc

SEQ ID NO: 3394880 - RNA, 16 nt, Human
auuuuuauaaauacug

SEQ ID NO: 3394881 - RNA, 17 nt, Human
auuuuuauacaaaccua

SEQ ID NO: 3394882 - RNA, 13 nt, Human
auuuuuauacagu

SEQ ID NO: 3394883 - RNA, 18 nt, Human
auuuuuauaucagccuga

SEQ ID NO: 3394884 - RNA, 20 nt, Human
auuuuuauaucagccugagu

SEQ ID NO: 3394885 - RNA, 13 nt, Human
auuuuuauaucau

SEQ ID NO: 3394886 - RNA, 15 nt, Human
auuuuuauauuuacu

SEQ ID NO: 3394887 - RNA, 14 nt, Human
auuuuuauauuucc

SEQ ID NO: 3394888 - RNA, 19 nt, Human
auuuuuauauuugaaauau

SEQ ID NO: 3394889 - RNA, 15 nt, Human
auuuuuaucaggauu

SEQ ID NO: 3394890 - RNA, 19 nt, Human
auuuuuaucuuucgugaua

SEQ ID NO: 3394891 - RNA, 17 nt, Human
auuuuuaugccaccuga

SEQ ID NO: 3394892 - RNA, 22 nt, Human
auuuuuauuaauuuuaguuuuu

SEQ ID NO: 3394893 - RNA, 15 nt, Human
auuuuuauuaugcau

SEQ ID NO: 3394894 - RNA, 19 nt, Human
auuuuuauuaugcauaacu

SEQ ID NO: 3394895 - RNA, 20 nt, Human
auuuuuauuaugcauaacug

SEQ ID NO: 3394896 - RNA, 15 nt, Human
auuuuuauucauaag

SEQ ID NO: 3394897 - RNA, 14 nt, Human
auuuuuauuuauau

SEQ ID NO: 3394898 - RNA, 16 nt, Human
auuuuuauuuaugaag

SEQ ID NO: 3394899 - RNA, 19 nt, Human
auuuuuauuucagauuuug

SEQ ID NO: 3394900 - RNA, 13 nt, Human
auuuuuauuucuu

SEQ ID NO: 3394901 - RNA, 16 nt, Human
auuuuuauuuuucuaa

SEQ ID NO: 3394902 - RNA, 19 nt, Human
auuuuuauuuuuuagugca

SEQ ID NO: 3394903 - RNA, 14 nt, Human
auuuuucaaagcaa

SEQ ID NO: 3394904 - RNA, 23 nt, Human
auuuuucaaagcaauugaaaugc

SEQ ID NO: 3394905 - RNA, 14 nt, Human
auuuuucaacuuug

SEQ ID NO: 3394906 - RNA, 22 nt, Human
auuuuucaacuuugaauaaaga

SEQ ID NO: 3394907 - RNA, 23 nt, Human
auuuuucaacuuugaauaaagaa

SEQ ID NO: 3394908 - RNA, 16 nt, Human
auuuuucaauaaagca

SEQ ID NO: 3394909 - RNA, 17 nt, Human
auuuuucaauauauuga

SEQ ID NO: 3394910 - RNA, 20 nt, Human
auuuuucagaccuuuuaacu

SEQ ID NO: 3394911 - RNA, 20 nt, Human
auuuuucagcucucuguaua

SEQ ID NO: 3394912 - RNA, 16 nt, Human
auuuuucaguuccaag

SEQ ID NO: 3394913 - RNA, 15 nt, Human
auuuuucauaaacaa

SEQ ID NO: 3394914 - RNA, 19 nt, Human
auuuuucauauugugccaa

SEQ ID NO: 3394915 - RNA, 15 nt, Human
auuuuucauccuaaa

SEQ ID NO: 3394916 - RNA, 19 nt, Human
auuuuucauugauaugaaa

SEQ ID NO: 3394917 - RNA, 22 nt, Human
auuuuucauugauaugaaaaau

SEQ ID NO: 3394918 - RNA, 15 nt, Human
auuuuuccaaaauaa

SEQ ID NO: 3394919 - RNA, 13 nt, Human
auuuuuccaacua

SEQ ID NO: 3394920 - RNA, 10 nt, Human
auuuuuccua

SEQ ID NO: 3394921 - RNA, 23 nt, Human
auuuuucggaggccccacugaug

SEQ ID NO: 3394922 - RNA, 12 nt, Human
auuuuucuaacu

SEQ ID NO: 3394923 - RNA, 15 nt, Human
auuuuucugcacuga

SEQ ID NO: 3394924 - RNA, 16 nt, Human
auuuuucugcacugag

SEQ ID NO: 3394925 - RNA, 19 nt, Human
auuuuucuggagguugaua

SEQ ID NO: 3394926 - RNA, 22 nt, Human
auuuuucuuagggaaggauaca

SEQ ID NO: 3394927 - RNA, 14 nt, Human
auuuuucuucuuga

SEQ ID NO: 3394928 - RNA, 13 nt, Human
auuuuucuuuaca

SEQ ID NO: 3394929 - RNA, 14 nt, Human
auuuuugaaaaggc

SEQ ID NO: 3394930 - RNA, 20 nt, Human
auuuuugaaacugcauuugu

SEQ ID NO: 3394931 - RNA, 15 nt, Human
auuuuugaaugugau

SEQ ID NO: 3394932 - RNA, 13 nt, Human
auuuuugacagaa

SEQ ID NO: 3394933 - RNA, 14 nt, Human
auuuuugacagaau

SEQ ID NO: 3394934 - RNA, 21 nt, Human
auuuuugauaaagccucaagg

SEQ ID NO: 3394935 - RNA, 19 nt, Human
auuuuugauacuaagcauu

SEQ ID NO: 3394936 - RNA, 19 nt, Human
auuuuugcaauaaugcagu

SEQ ID NO: 3394937 - RNA, 15 nt, Human
auuuuugccauacau

SEQ ID NO: 3394938 - RNA, 21 nt, Human
auuuuugccucuuccagucuu

SEQ ID NO: 3394939 - RNA, 15 nt, Human
auuuuugcugagacu

SEQ ID NO: 3394940 - RNA, 15 nt, Human
auuuuugcuuuuaga

SEQ ID NO: 3394941 - RNA, 18 nt, Human
auuuuugcuuuuagaaaa

SEQ ID NO: 3394942 - RNA, 17 nt, Human
auuuuuggauugacagu

SEQ ID NO: 3394943 - RNA, 21 nt, Human
auuuuuggauugacaguaacu

SEQ ID NO: 3394944 - RNA, 19 nt, Human
auuuuuggcagucugaauu

SEQ ID NO: 3394945 - RNA, 21 nt, Human
auuuuuggggggaguaaagaa

SEQ ID NO: 3394946 - RNA, 19 nt, Human
auuuuugguauuugaaaca

SEQ ID NO: 3394947 - RNA, 19 nt, Human
auuuuuggugggaauccaa

SEQ ID NO: 3394948 - RNA, 15 nt, Human
auuuuugguugaaua

SEQ ID NO: 3394949 - RNA, 19 nt, Human
auuuuugguugucaauauu

SEQ ID NO: 3394950 - RNA, 22 nt, Human
auuuuuguaagacaauccaugu

SEQ ID NO: 3394951 - RNA, 12 nt, Human
auuuuuguaauu

SEQ ID NO: 3394952 - RNA, 21 nt, Human
auuuuuguacaguuugcugua

SEQ ID NO: 3394953 - RNA, 20 nt, Human
auuuuuguacccuuccuaca

SEQ ID NO: 3394954 - RNA, 15 nt, Human
auuuuuguaguagcg

SEQ ID NO: 3394955 - RNA, 19 nt, Human
auuuuuguauucaauuaaa

SEQ ID NO: 3394956 - RNA, 23 nt, Human
auuuuugucuuauauauauuucu

SEQ ID NO: 3394957 - RNA, 14 nt, Human
auuuuugucuugug

SEQ ID NO: 3394958 - RNA, 20 nt, Human
auuuuugugaaaugaaaaca

SEQ ID NO: 3394959 - RNA, 20 nt, Human
auuuuuguuacucucuucca

SEQ ID NO: 3394960 - RNA, 21 nt, Human
auuuuuguuuucauuaucuca

SEQ ID NO: 3394961 - RNA, 15 nt, Human
auuuuuuaaaaagca

SEQ ID NO: 3394962 - RNA, 18 nt, Human
auuuuuuaaaaagcaaaa

SEQ ID NO: 3394963 - RNA, 23 nt, Human
auuuuuuaaaacaagccaagaaa

SEQ ID NO: 3394964 - RNA, 15 nt, Human
auuuuuuaaaagaga

SEQ ID NO: 3394965 - RNA, 12 nt, Human
auuuuuuaaagc

SEQ ID NO: 3394966 - RNA, 20 nt, Human
auuuuuuaaaguuacuuugu

SEQ ID NO: 3394967 - RNA, 14 nt, Human
auuuuuuaaaugca

SEQ ID NO: 3394968 - RNA, 12 nt, Human
auuuuuuaagcu

SEQ ID NO: 3394969 - RNA, 17 nt, Human
auuuuuuaaggaaacaa

SEQ ID NO: 3394970 - RNA, 14 nt, Human
auuuuuuaauaauu

SEQ ID NO: 3394971 - RNA, 12 nt, Human
auuuuuuaauua

SEQ ID NO: 3394972 - RNA, 14 nt, Human
auuuuuuaauuauu

SEQ ID NO: 3394973 - RNA, 15 nt, Human
auuuuuuaauuauug

SEQ ID NO: 3394974 - RNA, 14 nt, Human
auuuuuuaauuguu

SEQ ID NO: 3394975 - RNA, 19 nt, Human
auuuuuuacauuuuacaca

SEQ ID NO: 3394976 - RNA, 13 nt, Human
auuuuuuauacag

SEQ ID NO: 3394977 - RNA, 13 nt, Human
auuuuuuauauau

SEQ ID NO: 3394978 - RNA, 21 nt, Human
auuuuuuaucaugcauguccu

SEQ ID NO: 3394979 - RNA, 15 nt, Human
auuuuuuauucuugu

SEQ ID NO: 3394980 - RNA, 14 nt, Human
auuuuuucagaccg

SEQ ID NO: 3394981 - RNA, 15 nt, Human
auuuuuucaguauua

SEQ ID NO: 3394982 - RNA, 13 nt, Human
auuuuuucauuuc

SEQ ID NO: 3394983 - RNA, 14 nt, Human
auuuuuuccaaaau

SEQ ID NO: 3394984 - RNA, 19 nt, Human
auuuuuugaaaagcagaca

SEQ ID NO: 3394985 - RNA, 13 nt, Human
auuuuuugaaaug

SEQ ID NO: 3394986 - RNA, 14 nt, Human
auuuuuugaaaugc

SEQ ID NO: 3394987 - RNA, 23 nt, Human
auuuuuugacuuuuuuuguaugu

SEQ ID NO: 3394988 - RNA, 14 nt, Human
auuuuuuguauaau

SEQ ID NO: 3394989 - RNA, 12 nt, Human
auuuuuugugug

SEQ ID NO: 3394990 - RNA, 17 nt, Human
auuuuuuguugacauua

SEQ ID NO: 3394991 - RNA, 18 nt, Human
auuuuuuuaaaauguuaa

SEQ ID NO: 3394992 - RNA, 15 nt, Human
auuuuuuuaacuuua

SEQ ID NO: 3394993 - RNA, 18 nt, Human
auuuuuuuaagcuguaaa

SEQ ID NO: 3394994 - RNA, 17 nt, Human
auuuuuuuagaaagcau

SEQ ID NO: 3394995 - RNA, 22 nt, Human
auuuuuuucacuggaguuacau

SEQ ID NO: 3394996 - RNA, 15 nt, Human
auuuuuuuccuuaca

SEQ ID NO: 3394997 - RNA, 21 nt, Human
auuuuuuuccuuacauaaaca

SEQ ID NO: 3394998 - RNA, 13 nt, Human
auuuuuuucuaau

SEQ ID NO: 3394999 - RNA, 16 nt, Human
auuuuuuucuaccuau

SEQ ID NO: 3395000 - RNA, 17 nt, Human
auuuuuuucugaaauuu

SEQ ID NO: 3395001 - RNA, 15 nt, Human
auuuuuuucugaauu

SEQ ID NO: 3395002 - RNA, 18 nt, Human
auuuuuuuguaauugcuu

SEQ ID NO: 3395003 - RNA, 23 nt, Human
auuuuuuuguagaugaaaaagca

SEQ ID NO: 3395004 - RNA, 14 nt, Human
auuuuuuuguauga

SEQ ID NO: 3395005 - RNA, 22 nt, Human
auuuuuuuuaaaauagaaauuu

SEQ ID NO: 3395006 - RNA, 20 nt, Human
caaacaccuucuuauuauau

SEQ ID NO: 3395007 - RNA, 20 nt, Human
caaacacugcaggcaucaca

SEQ ID NO: 3395008 - RNA, 16 nt, Human
caaacagaaaacaugu

SEQ ID NO: 3395009 - RNA, 13 nt, Human
caaacagaggccg

SEQ ID NO: 3395010 - RNA, 18 nt, Human
caaacagauucuuuuaug

SEQ ID NO: 3395011 - RNA, 13 nt, Human
caaacagccacac

SEQ ID NO: 3395012 - RNA, 20 nt, Human
caaacaggaucaguuaacua

SEQ ID NO: 3395013 - RNA, 14 nt, Human
caaacaggcucaga

SEQ ID NO: 3395014 - RNA, 19 nt, Human
caaacagggccucugcgga

SEQ ID NO: 3395015 - RNA, 15 nt, Human
caaacagucucagga

SEQ ID NO: 3395016 - RNA, 17 nt, Human
caaacagucucaggaaa

SEQ ID NO: 3395017 - RNA, 15 nt, Human
caaacagugacugua

SEQ ID NO: 3395018 - RNA, 17 nt, Human
caaacauauauaacaau

SEQ ID NO: 3395019 - RNA, 21 nt, Human
caaacauauauauacuauuaa

SEQ ID NO: 3395020 - RNA, 17 nt, Human
caaacaucacucugcug

SEQ ID NO: 3395021 - RNA, 18 nt, Human
caaacaucacucugcugc

SEQ ID NO: 3395022 - RNA, 21 nt, Human
caaacaucuggaaaauaaaag

SEQ ID NO: 3395023 - RNA, 12 nt, Human
caaacaugaagu

SEQ ID NO: 3395024 - RNA, 15 nt, Human
caaacauguauuuau

SEQ ID NO: 3395025 - RNA, 18 nt, Human
caaacauguauuuaugua

SEQ ID NO: 3395026 - RNA, 17 nt, Human
caaacauuaauguugau

SEQ ID NO: 3395027 - RNA, 21 nt, Human
caaacauuaauguugauuucu

SEQ ID NO: 3395028 - RNA, 22 nt, Human
caaacauuaauguugauuucua

SEQ ID NO: 3395029 - RNA, 18 nt, Human
caaacauuaguacuuuau

SEQ ID NO: 3395030 - RNA, 19 nt, Human
caaacauuaguacuuuaua

SEQ ID NO: 3395031 - RNA, 14 nt, Human
caaacauuggaaga

SEQ ID NO: 3395032 - RNA, 23 nt, Human
caaacauuuucuggccaguguuu

SEQ ID NO: 3395033 - RNA, 21 nt, Human
caaaccaagagauugcuaauu

SEQ ID NO: 3395034 - RNA, 22 nt, Human
caaaccaagucggaacagcaga

SEQ ID NO: 3395035 - RNA, 16 nt, Human
caaaccaccagaagcc

SEQ ID NO: 3395036 - RNA, 20 nt, Human
caaaccaccagaagcccaga

SEQ ID NO: 3395037 - RNA, 19 nt, Human
caaaccacuuuuugcagcu

SEQ ID NO: 3395038 - RNA, 20 nt, Human
caaaccacuuuuugcagcuu

SEQ ID NO: 3395039 - RNA, 13 nt, Human
caaaccagaagca

SEQ ID NO: 3395040 - RNA, 14 nt, Human
caaaccaucauuga

SEQ ID NO: 3395041 - RNA, 21 nt, Human
caaaccauuuuuaaaguagaa

SEQ ID NO: 3395042 - RNA, 14 nt, Human
caaacccaaaagaa

SEQ ID NO: 3395043 - RNA, 24 nt, Human
caaacccaguguuuuaggagcaug

SEQ ID NO: 3395044 - RNA, 21 nt, Human
caaacccauuuuagagacaga

SEQ ID NO: 3395045 - RNA, 14 nt, Human
caaacccccauucu

SEQ ID NO: 3395046 - RNA, 18 nt, Human
caaacccccuuugugcug

SEQ ID NO: 3395047 - RNA, 17 nt, Human
caaacccugucaaacau

SEQ ID NO: 3395048 - RNA, 18 nt, Human
caaacccugucaaacauu

SEQ ID NO: 3395049 - RNA, 14 nt, Human
caaacccuucagug

SEQ ID NO: 3395050 - RNA, 13 nt, Human
caaaccggcaggu

SEQ ID NO: 3395051 - RNA, 13 nt, Human
caaaccuaaguug

SEQ ID NO: 3395052 - RNA, 15 nt, Human
caaaccuaccaaaau

SEQ ID NO: 3395053 - RNA, 20 nt, Human
caaaccuagccccuuagccc

SEQ ID NO: 3395054 - RNA, 23 nt, Human
caaaccucuguucaguguaaaua

SEQ ID NO: 3395055 - RNA, 14 nt, Human
caaaccugccuggg

SEQ ID NO: 3395056 - RNA, 15 nt, Human
caaaccugccugggu

SEQ ID NO: 3395057 - RNA, 20 nt, Human
caaaccuuucuauaauuuua

SEQ ID NO: 3395058 - RNA, 20 nt, Human
caaacgcccuuuccuccuca

SEQ ID NO: 3395059 - RNA, 17 nt, Human
caaacgcugccugccca

SEQ ID NO: 3395060 - RNA, 19 nt, Human
caaacguauguaaauguau

SEQ ID NO: 3395061 - RNA, 16 nt, Human
caaacuaaaagacauu

SEQ ID NO: 3395062 - RNA, 14 nt, Human
caaacuaacaggcu

SEQ ID NO: 3395063 - RNA, 21 nt, Human
caaacucaaugcuuuauuugu

SEQ ID NO: 3395064 - RNA, 17 nt, Human
caaacucaccugccccu

SEQ ID NO: 3395065 - RNA, 18 nt, Human
caaacucacugcucaaga

SEQ ID NO: 3395066 - RNA, 18 nt, Human
caaacuccaagguucccu

SEQ ID NO: 3395067 - RNA, 14 nt, Human
caaacucucugaac

SEQ ID NO: 3395068 - RNA, 17 nt, Human
caaacugaagcagccuc

SEQ ID NO: 3395069 - RNA, 23 nt, Human
caaacugaagcagccucucccca

SEQ ID NO: 3395070 - RNA, 11 nt, Human
caaacugcaau

SEQ ID NO: 3395071 - RNA, 15 nt, Human
caaacugcaauagag

SEQ ID NO: 3395072 - RNA, 19 nt, Human
caaacugcaauagagacug

SEQ ID NO: 3395073 - RNA, 23 nt, Human
caaacugccuaagcccuccgcca

SEQ ID NO: 3395074 - RNA, 12 nt, Human
caaacuggaguc

SEQ ID NO: 3395075 - RNA, 20 nt, Human
caaacuggagucuggagugg

SEQ ID NO: 3395076 - RNA, 23 nt, Human
caaacuggagucuggagugggca

SEQ ID NO: 3395077 - RNA, 19 nt, Human
caaacugggaugaaacuaa

SEQ ID NO: 3395078 - RNA, 15 nt, Human
caaacuggggccucc

SEQ ID NO: 3395079 - RNA, 17 nt, Human
caaacuggggccucccu

SEQ ID NO: 3395080 - RNA, 16 nt, Human
caaacugguauucugu

SEQ ID NO: 3395081 - RNA, 21 nt, Human
caaacugguauucuguucugg

SEQ ID NO: 3395082 - RNA, 16 nt, Human
caaacuguauaacuug

SEQ ID NO: 3395083 - RNA, 14 nt, Human
caaacugugaagca

SEQ ID NO: 3395084 - RNA, 13 nt, Human
caaacuguugauu

SEQ ID NO: 3395085 - RNA, 15 nt, Human
caaacuuacuauuuu

SEQ ID NO: 3395086 - RNA, 16 nt, Human
caaacuuacuauuuug

SEQ ID NO: 3395087 - RNA, 13 nt, Human
caaacuucuuuca

SEQ ID NO: 3395088 - RNA, 18 nt, Human
caaacuuggauacuugga

SEQ ID NO: 3395089 - RNA, 21 nt, Human
caaacuuggguagaguuuaca

SEQ ID NO: 3395090 - RNA, 21 nt, Human
caaacuuuacuauggcccugg

SEQ ID NO: 3395091 - RNA, 21 nt, Human
caaacuuuagguuuuuuuaau

SEQ ID NO: 3395092 - RNA, 23 nt, Human
caaacuuuauugauucaccuccu

SEQ ID NO: 3395093 - RNA, 12 nt, Human
caaacuuuauuu

SEQ ID NO: 3395094 - RNA, 13 nt, Human
caaacuuugcauc

SEQ ID NO: 3395095 - RNA, 17 nt, Human
caaacuuuucaaggcuu

SEQ ID NO: 3395096 - RNA, 20 nt, Human
caaacuuuucaaggcuuaua

SEQ ID NO: 3395097 - RNA, 19 nt, Human
caaacuuuuccccuguccu

SEQ ID NO: 3395098 - RNA, 14 nt, Human
caaagaaaaugaaa

SEQ ID NO: 3395099 - RNA, 19 nt, Human
caaagaaagaaaguuuaga

SEQ ID NO: 3395100 - RNA, 14 nt, Human
caaagaaaguguau

SEQ ID NO: 3395101 - RNA, 16 nt, Human
caaagaaaguguauug

SEQ ID NO: 3395102 - RNA, 18 nt, Human
caaagaaaugaacauucc

SEQ ID NO: 3395103 - RNA, 19 nt, Human
caaagaaauuuccacucag

SEQ ID NO: 3395104 - RNA, 22 nt, Human
caaagaacauguagaaaacaaa

SEQ ID NO: 3395105 - RNA, 14 nt, Human
caaagaaccaaaga

SEQ ID NO: 3395106 - RNA, 19 nt, Human
caaagaaccaaagaagaaa

SEQ ID NO: 3395107 - RNA, 14 nt, Human
caaagaagacaugu

SEQ ID NO: 3395108 - RNA, 22 nt, Human
caaagaaggcauuugcaggguc

SEQ ID NO: 3395109 - RNA, 22 nt, Human
caaagaaucaccuaauuaauuu

SEQ ID NO: 3395110 - RNA, 22 nt, Human
caaagaauguuagagcacagua

SEQ ID NO: 3395111 - RNA, 18 nt, Human
caaagaauuccaaagcaa

SEQ ID NO: 3395112 - RNA, 14 nt, Human
caaagacaaaaguc

SEQ ID NO: 3395113 - RNA, 13 nt, Human
caaagacaaauag

SEQ ID NO: 3395114 - RNA, 15 nt, Human
caaagacaaauagua

SEQ ID NO: 3395115 - RNA, 16 nt, Human
caaagacaaauaguag

SEQ ID NO: 3395116 - RNA, 21 nt, Human
caaagacaaauucuguuucuu

SEQ ID NO: 3395117 - RNA, 21 nt, Human
caaagaccaauuuuuugugug

SEQ ID NO: 3395118 - RNA, 18 nt, Human
caaagacccuggcuuuca

SEQ ID NO: 3395119 - RNA, 16 nt, Human
caaagaccuugugugu

SEQ ID NO: 3395120 - RNA, 15 nt, Human
caaagagaaaaagaa

SEQ ID NO: 3395121 - RNA, 15 nt, Human
caaagagaaaacuua

SEQ ID NO: 3395122 - RNA, 23 nt, Human
caaagagaaugcccuucuccuua

SEQ ID NO: 3395123 - RNA, 14 nt, Human
caaagagacuggag

SEQ ID NO: 3395124 - RNA, 16 nt, Human
caaagagagaaaauaa

SEQ ID NO: 3395125 - RNA, 22 nt, Human
caaagagaguuuuuaauagaac

SEQ ID NO: 3395126 - RNA, 13 nt, Human
caaagagccugga

SEQ ID NO: 3395127 - RNA, 13 nt, Human
caaagagcugccu

SEQ ID NO: 3395128 - RNA, 13 nt, Human
caaagaggcaaga

SEQ ID NO: 3395129 - RNA, 18 nt, Human
caaagaggcacagagcca

SEQ ID NO: 3395130 - RNA, 14 nt, Human
caaagagggcuucc

SEQ ID NO: 3395131 - RNA, 22 nt, Human
caaagagggcuuccucuagaag

SEQ ID NO: 3395132 - RNA, 14 nt, Human
caaagagguuuuaa

SEQ ID NO: 3395133 - RNA, 20 nt, Human
caaagagugggcugcaucug

SEQ ID NO: 3395134 - RNA, 21 nt, Human
caaagaguucaagaaauaagu

SEQ ID NO: 3395135 - RNA, 14 nt, Human
caaagauagacagg

SEQ ID NO: 3395136 - RNA, 23 nt, Human
caaagauauauacacaggauccu

SEQ ID NO: 3395137 - RNA, 17 nt, Human
caaagauaucuuuucuu

SEQ ID NO: 3395138 - RNA, 21 nt, Human
caaagauaucuuuucuuuaga

SEQ ID NO: 3395139 - RNA, 23 nt, Human
caaagauauuuugcuuugugauu

SEQ ID NO: 3395140 - RNA, 21 nt, Human
caaagaucuguccucagccuu

SEQ ID NO: 3395141 - RNA, 12 nt, Human
caaagaugaaaa

SEQ ID NO: 3395142 - RNA, 20 nt, Human
caaagaugaaugaagcaaau

SEQ ID NO: 3395143 - RNA, 13 nt, Human
caaagaugaccau

SEQ ID NO: 3395144 - RNA, 21 nt, Human
caaagaugaucaguaugaaaa

SEQ ID NO: 3395145 - RNA, 15 nt, Human
caaagaugcagccgc

SEQ ID NO: 3395146 - RNA, 11 nt, Human
caaagaugcug

SEQ ID NO: 3395147 - RNA, 16 nt, Human
caaagauggcucagag

SEQ ID NO: 3395148 - RNA, 17 nt, Human
caaagauggcucagagg

SEQ ID NO: 3395149 - RNA, 18 nt, Human
caaagauggcucagaggg

SEQ ID NO: 3395150 - RNA, 20 nt, Human
caaaugguaggcauuuccua

SEQ ID NO: 3395151 - RNA, 13 nt, Human
caaaugguaucuu

SEQ ID NO: 3395152 - RNA, 15 nt, Human
caaaugguaucuuuu

SEQ ID NO: 3395153 - RNA, 23 nt, Human
caaauggugguuguuucuuccaa

SEQ ID NO: 3395154 - RNA, 12 nt, Human
caaauguaacua

SEQ ID NO: 3395155 - RNA, 21 nt, Human
caaauguaauguggcuucugg

SEQ ID NO: 3395156 - RNA, 21 nt, Human
caaauguaauugaauaaaguu

SEQ ID NO: 3395157 - RNA, 22 nt, Human
caaauguaguauggccuguguc

SEQ ID NO: 3395158 - RNA, 19 nt, Human
caaaugucagauacaaugu

SEQ ID NO: 3395159 - RNA, 20 nt, Human
caaaugucagauacaaugua

SEQ ID NO: 3395160 - RNA, 17 nt, Human
caaaugucaugcugccu

SEQ ID NO: 3395161 - RNA, 14 nt, Human
caaaugucuauaaa

SEQ ID NO: 3395162 - RNA, 18 nt, Human
caaaugucuuccuggauu

SEQ ID NO: 3395163 - RNA, 24 nt, Human
caaaugucuuuuagaagauagaug

SEQ ID NO: 3395164 - RNA, 14 nt, Human
caaauguggcuccu

SEQ ID NO: 3395165 - RNA, 23 nt, Human
caaauguguacauggcagaguuu

SEQ ID NO: 3395166 - RNA, 18 nt, Human
caaauguuacauagugua

SEQ ID NO: 3395167 - RNA, 18 nt, Human
caaauguuuaaacauuuu

SEQ ID NO: 3395168 - RNA, 13 nt, Human
caaauguuuaauc

SEQ ID NO: 3395169 - RNA, 16 nt, Human
caaauguuuaaucaua

SEQ ID NO: 3395170 - RNA, 22 nt, Human
caaauguuuacagggagccucc

SEQ ID NO: 3395171 - RNA, 13 nt, Human
caaauguuuauuu

SEQ ID NO: 3395172 - RNA, 16 nt, Human
caaauguuuauuuaaa

SEQ ID NO: 3395173 - RNA, 14 nt, Human
caaauguuucugca

SEQ ID NO: 3395174 - RNA, 21 nt, Human
caaauuaaaaaaaaauuguau

SEQ ID NO: 3395175 - RNA, 17 nt, Human
caaauuaaaaaagauaa

SEQ ID NO: 3395176 - RNA, 19 nt, Human
caaauuaaaaaagauaaac

SEQ ID NO: 3395177 - RNA, 15 nt, Human
caaauuaaaaagauu

SEQ ID NO: 3395178 - RNA, 21 nt, Human
caaauuaaaaagauucuuuuu

SEQ ID NO: 3395179 - RNA, 23 nt, Human
caaauuaaaaagauucuuuuucu

SEQ ID NO: 3395180 - RNA, 13 nt, Human
caaauuaacuuga

SEQ ID NO: 3395181 - RNA, 16 nt, Human
caaauuaauaaucuua

SEQ ID NO: 3395182 - RNA, 20 nt, Human
caaauuaauugugugaacuu

SEQ ID NO: 3395183 - RNA, 12 nt, Human
caaauuagaaaa

SEQ ID NO: 3395184 - RNA, 18 nt, Human
caaauuagaaaauguuau

SEQ ID NO: 3395185 - RNA, 22 nt, Human
caaauuagaaaauguuauuuaa

SEQ ID NO: 3395186 - RNA, 18 nt, Human
caaauuagaagacauuua

SEQ ID NO: 3395187 - RNA, 19 nt, Human
caaauuagguuuuguacaa

SEQ ID NO: 3395188 - RNA, 20 nt, Human
caaauuagguuuuguacaau

SEQ ID NO: 3395189 - RNA, 19 nt, Human
caaauuauaaaaagccacu

SEQ ID NO: 3395190 - RNA, 13 nt, Human
caaauuauaaugu

SEQ ID NO: 3395191 - RNA, 14 nt, Human
caaauuauaaugua

SEQ ID NO: 3395192 - RNA, 15 nt, Human
caaauuauaauguau

SEQ ID NO: 3395193 - RNA, 18 nt, Human
caaauuaucaagcuaaua

SEQ ID NO: 3395194 - RNA, 22 nt, Human
caaauuaucuugauacauucaa

SEQ ID NO: 3395195 - RNA, 19 nt, Human
caaauuaugcuaagaauuu

SEQ ID NO: 3395196 - RNA, 15 nt, Human
caaauuauuaaugaa

SEQ ID NO: 3395197 - RNA, 20 nt, Human
caaauuauuuguguaauaga

SEQ ID NO: 3395198 - RNA, 14 nt, Human
caaauucaguuuca

SEQ ID NO: 3395199 - RNA, 16 nt, Human
caaauucauauucugu

SEQ ID NO: 3395200 - RNA, 17 nt, Human
caaauucauauucuuuu

SEQ ID NO: 3395201 - RNA, 16 nt, Human
caaauucgcaaacuuu

SEQ ID NO: 3395202 - RNA, 17 nt, Human
caaauugaacucuuuga

SEQ ID NO: 3395203 - RNA, 20 nt, Human
caaauugcuuuuuuccaaaa

SEQ ID NO: 3395204 - RNA, 17 nt, Human
caaauuguaagcaugca

SEQ ID NO: 3395205 - RNA, 15 nt, Human
caaauuguaauuaau

SEQ ID NO: 3395206 - RNA, 21 nt, Human
caaauuguaauuaauaauaga

SEQ ID NO: 3395207 - RNA, 18 nt, Human
caaauuguaucuagugca

SEQ ID NO: 3395208 - RNA, 19 nt, Human
caaauugucaccugcuucu

SEQ ID NO: 3395209 - RNA, 20 nt, Human
caaauugucaccugcuucuc

SEQ ID NO: 3395210 - RNA, 18 nt, Human
caaauugugcuucucccc

SEQ ID NO: 3395211 - RNA, 16 nt, Human
caaauuuacagagaca

SEQ ID NO: 3395212 - RNA, 17 nt, Human
caaauuuacagagacag

SEQ ID NO: 3395213 - RNA, 21 nt, Human
caaauuuagaaacuaauugac

SEQ ID NO: 3395214 - RNA, 13 nt, Human
caaauuuauaauu

SEQ ID NO: 3395215 - RNA, 16 nt, Human
caaauuuaucaaagca

SEQ ID NO: 3395216 - RNA, 12 nt, Human
caaauuucuaaa

SEQ ID NO: 3395217 - RNA, 14 nt, Human
caaauuucuaaauc

SEQ ID NO: 3395218 - RNA, 17 nt, Human
caaauuugucuugccuu

SEQ ID NO: 3395219 - RNA, 21 nt, Human
caaauuuugaugccaagaaag

SEQ ID NO: 3395220 - RNA, 13 nt, Human
caaauuuuggcca

SEQ ID NO: 3395221 - RNA, 19 nt, Human
caaauuuuuauuuuuuagu

SEQ ID NO: 3395222 - RNA, 23 nt, Human
caaauuuuuauuuuuuagugcau

SEQ ID NO: 3395223 - RNA, 13 nt, Human
caacaaaaaauaa

SEQ ID NO: 3395224 - RNA, 23 nt, Human
caacaaaaauuugaaccaaaaca

SEQ ID NO: 3395225 - RNA, 14 nt, Human
caacaaaagaagcc

SEQ ID NO: 3395226 - RNA, 15 nt, Human
caacaaagaaacaaa

SEQ ID NO: 3395227 - RNA, 13 nt, Human
caacaaagaaaua

SEQ ID NO: 3395228 - RNA, 19 nt, Human
caacaaaggguuuuaaugu

SEQ ID NO: 3395229 - RNA, 18 nt, Human
caacaaccucaacugccu

SEQ ID NO: 3395230 - RNA, 19 nt, Human
caacaaccucaacugccua

SEQ ID NO: 3395231 - RNA, 22 nt, Human
caacaacgcuugugaauguauu

SEQ ID NO: 3395232 - RNA, 12 nt, Human
caacaagaagaa

SEQ ID NO: 3395233 - RNA, 18 nt, Human
caacaagaagaauuugaa

SEQ ID NO: 3395234 - RNA, 19 nt, Human
caacaagaauaaaggcagc

SEQ ID NO: 3395235 - RNA, 13 nt, Human
caacaagaaugca

SEQ ID NO: 3395236 - RNA, 20 nt, Human
caacaagaaugcauugauau

SEQ ID NO: 3395237 - RNA, 16 nt, Human
caacaaggcaaaaaca

SEQ ID NO: 3395238 - RNA, 14 nt, Human
caacaagggagaga

SEQ ID NO: 3395239 - RNA, 18 nt, Human
caacaagggagagaccuc

SEQ ID NO: 3395240 - RNA, 13 nt, Human
caacaaguaacuu

SEQ ID NO: 3395241 - RNA, 14 nt, Human
caacaauaaaacau

SEQ ID NO: 3395242 - RNA, 16 nt, Human
caacaauaaaauagca

SEQ ID NO: 3395243 - RNA, 17 nt, Human
caacaauccuagugcuu

SEQ ID NO: 3395244 - RNA, 15 nt, Human
caacaauugguaaaa

SEQ ID NO: 3395245 - RNA, 19 nt, Human
caacaauugguaaaacuca

SEQ ID NO: 3395246 - RNA, 20 nt, Human
caacaauuuagaaggaaaac

SEQ ID NO: 3395247 - RNA, 17 nt, Human
caacaauuuaugaauug

SEQ ID NO: 3395248 - RNA, 21 nt, Human
caacaauuugggcuuccuguu

SEQ ID NO: 3395249 - RNA, 12 nt, Human
caacaauuuuca

SEQ ID NO: 3395250 - RNA, 15 nt, Human
caacaauuuucagau

SEQ ID NO: 3395251 - RNA, 12 nt, Human
caacacaaagag

SEQ ID NO: 3395252 - RNA, 20 nt, Human
caacacaaagagaaaaagaa

SEQ ID NO: 3395253 - RNA, 22 nt, Human
caacacaaagagaaaaagaaau

SEQ ID NO: 3395254 - RNA, 23 nt, Human
caacacaaagagaaaaagaaaug

SEQ ID NO: 3395255 - RNA, 13 nt, Human
caacacaaagauu

SEQ ID NO: 3395256 - RNA, 18 nt, Human
caacacacacaugcuucc

SEQ ID NO: 3395257 - RNA, 23 nt, Human
caacacacacaugcuucccuuuc

SEQ ID NO: 3395258 - RNA, 22 nt, Human
caacacacagauuugagcucag

SEQ ID NO: 3395259 - RNA, 15 nt, Human
caacacagccugggc

SEQ ID NO: 3395260 - RNA, 15 nt, Human
caacaccaaaaaaua

SEQ ID NO: 3395261 - RNA, 23 nt, Human
caacaccaaaaaauaucuaguaa

SEQ ID NO: 3395262 - RNA, 22 nt, Human
caacaccaagcacagcagccug

SEQ ID NO: 3395263 - RNA, 15 nt, Human
caacaccacagacac

SEQ ID NO: 3395264 - RNA, 16 nt, Human
caacaccacagacaca

SEQ ID NO: 3395265 - RNA, 17 nt, Human
caacaccacagacacac

SEQ ID NO: 3395266 - RNA, 18 nt, Human
caacaccacagacacaca

SEQ ID NO: 3395267 - RNA, 19 nt, Human
caacaccacagacacacac

SEQ ID NO: 3395268 - RNA, 20 nt, Human
caacaccacagacacacaca

SEQ ID NO: 3395269 - RNA, 16 nt, Human
caacacccauuuuucc

SEQ ID NO: 3395270 - RNA, 22 nt, Human
caacaccucugcacaagcugca

SEQ ID NO: 3395271 - RNA, 20 nt, Human
caacaccuuguuucccucuc

SEQ ID NO: 3395272 - RNA, 19 nt, Human
caacacgcaccugccucag

SEQ ID NO: 3395273 - RNA, 16 nt, Human
caacacgcaggagcac

SEQ ID NO: 3395274 - RNA, 22 nt, Human
caacacucacauuuauucugcu

SEQ ID NO: 3395275 - RNA, 18 nt, Human
caacacucauugaccuga

SEQ ID NO: 3395276 - RNA, 22 nt, Human
caacacucauugaccugaggcc

SEQ ID NO: 3395277 - RNA, 23 nt, Human
caacacugauuuccccuuuugca

SEQ ID NO: 3395278 - RNA, 15 nt, Human
caacacugugcccug

SEQ ID NO: 3395279 - RNA, 16 nt, Human
caacacugugcccugg

SEQ ID NO: 3395280 - RNA, 23 nt, Human
caacacugugcccugguggagaa

SEQ ID NO: 3395281 - RNA, 19 nt, Human
caacacuguggguguguga

SEQ ID NO: 3395282 - RNA, 15 nt, Human
caacacuucagacug

SEQ ID NO: 3395283 - RNA, 19 nt, Human
caacacuucagacugcaag

SEQ ID NO: 3395284 - RNA, 15 nt, Human
caacacuuuaauggg

SEQ ID NO: 3395285 - RNA, 10 nt, Human
caacagaaaa

SEQ ID NO: 3395286 - RNA, 15 nt, Human
caacagaacuaaaug

SEQ ID NO: 3395287 - RNA, 15 nt, Human
caacagaaugaaaaa

SEQ ID NO: 3395288 - RNA, 16 nt, Human
caacagaaugaaaaau

SEQ ID NO: 3395289 - RNA, 17 nt, Human
caacagagaaggcagga

SEQ ID NO: 3395290 - RNA, 20 nt, Human
caacagagacugaauagaua

SEQ ID NO: 3395291 - RNA, 23 nt, Human
caacagaucuggaaccucagccu

SEQ ID NO: 3395292 - RNA, 15 nt, Human
caacagaugcuuuuc

SEQ ID NO: 3395293 - RNA, 15 nt, Human
caacagauuugugaa

SEQ ID NO: 3395294 - RNA, 14 nt, Human
caauuaaacggauu

SEQ ID NO: 3395295 - RNA, 23 nt, Human
caauuaaacggauuauuuuuuca

SEQ ID NO: 3395296 - RNA, 14 nt, Human
caauuaaauguagg

SEQ ID NO: 3395297 - RNA, 15 nt, Human
caauuaaggauuuua

SEQ ID NO: 3395298 - RNA, 20 nt, Human
caauuaaggauuuuaugcuu

SEQ ID NO: 3395299 - RNA, 15 nt, Human
caauuaauaguuugu

SEQ ID NO: 3395300 - RNA, 22 nt, Human
caauuaauaguuugucuauuuu

SEQ ID NO: 3395301 - RNA, 22 nt, Human
caauuaauugcuauuguguuau

SEQ ID NO: 3395302 - RNA, 14 nt, Human
caauuaauuuuaga

SEQ ID NO: 3395303 - RNA, 12 nt, Human
caauuaauuuuu

SEQ ID NO: 3395304 - RNA, 15 nt, Human
caauuagauuucuca

SEQ ID NO: 3395305 - RNA, 19 nt, Human
caauuagccucauaguuau

SEQ ID NO: 3395306 - RNA, 16 nt, Human
caauuagcuuauguua

SEQ ID NO: 3395307 - RNA, 15 nt, Human
caauuaggaagugua

SEQ ID NO: 3395308 - RNA, 22 nt, Human
caauuaggaaguguaacagcug

SEQ ID NO: 3395309 - RNA, 23 nt, Human
caauuaggaaguguaacagcuga

SEQ ID NO: 3395310 - RNA, 16 nt, Human
caauuaggauuuugau

SEQ ID NO: 3395311 - RNA, 16 nt, Human
caauuagggccuagcc

SEQ ID NO: 3395312 - RNA, 13 nt, Human
caauuaguuuccu

SEQ ID NO: 3395313 - RNA, 18 nt, Human
caauuaguuuccuuuuua

SEQ ID NO: 3395314 - RNA, 14 nt, Human
caauuauaguuucu

SEQ ID NO: 3395315 - RNA, 15 nt, Human
caauuaugaaaauaa

SEQ ID NO: 3395316 - RNA, 15 nt, Human
caauuauugauauau

SEQ ID NO: 3395317 - RNA, 22 nt, Human
caauuauugauauauauuauaa

SEQ ID NO: 3395318 - RNA, 13 nt, Human
caauuauuuuuac

SEQ ID NO: 3395319 - RNA, 15 nt, Human
caauucaaaaaugua

SEQ ID NO: 3395320 - RNA, 12 nt, Human
caauucaaaaca

SEQ ID NO: 3395321 - RNA, 13 nt, Human
caauucaaaaguu

SEQ ID NO: 3395322 - RNA, 13 nt, Human
caauucaaagcug

SEQ ID NO: 3395323 - RNA, 22 nt, Human
caauucaauacaaacaaucucu

SEQ ID NO: 3395324 - RNA, 20 nt, Human
caauucacaucuaaccucau

SEQ ID NO: 3395325 - RNA, 23 nt, Human
caauucagacaggcaaauaaaag

SEQ ID NO: 3395326 - RNA, 14 nt, Human
caauucaugaacuu

SEQ ID NO: 3395327 - RNA, 21 nt, Human
caauucaugaacuucgcauca

SEQ ID NO: 3395328 - RNA, 19 nt, Human
caauuccaacaguuuaaug

SEQ ID NO: 3395329 - RNA, 10 nt, Human
caauuccaau

SEQ ID NO: 3395330 - RNA, 13 nt, Human
caauuccaccugc

SEQ ID NO: 3395331 - RNA, 13 nt, Human
caauuccacucug

SEQ ID NO: 3395332 - RNA, 22 nt, Human
caauuccacucugauagaauua

SEQ ID NO: 3395333 - RNA, 14 nt, Human
caauuccaucaccc

SEQ ID NO: 3395334 - RNA, 12 nt, Human
caauuccccucu

SEQ ID NO: 3395335 - RNA, 18 nt, Human
caauuccuagauaaaaag

SEQ ID NO: 3395336 - RNA, 22 nt, Human
caauuccuagauaaaaagaugg

SEQ ID NO: 3395337 - RNA, 15 nt, Human
caauuccucauccuc

SEQ ID NO: 3395338 - RNA, 18 nt, Human
caauuccucauccucaga

SEQ ID NO: 3395339 - RNA, 22 nt, Human
caauuccucauccucagaugcu

SEQ ID NO: 3395340 - RNA, 23 nt, Human
caauuccucauccucagaugcuc

SEQ ID NO: 3395341 - RNA, 15 nt, Human
caauucuccugccuu

SEQ ID NO: 3395342 - RNA, 21 nt, Human
caauucuccugccuuugccuc

SEQ ID NO: 3395343 - RNA, 17 nt, Human
caauucuuacaaacaug

SEQ ID NO: 3395344 - RNA, 22 nt, Human
caauucuucccuaucuuugcca

SEQ ID NO: 3395345 - RNA, 23 nt, Human
caauucuuuauacaacagugcua

SEQ ID NO: 3395346 - RNA, 21 nt, Human
caauugaacuuaaauaaaugu

SEQ ID NO: 3395347 - RNA, 20 nt, Human
caauugaaggaucaucugaa

SEQ ID NO: 3395348 - RNA, 17 nt, Human
caauugaaguaaacuuu

SEQ ID NO: 3395349 - RNA, 21 nt, Human
caauugaaguaaacuuuuugu

SEQ ID NO: 3395350 - RNA, 14 nt, Human
caauugacaacagu

SEQ ID NO: 3395351 - RNA, 19 nt, Human
caauugauuuuaaaccaua

SEQ ID NO: 3395352 - RNA, 18 nt, Human
caauugcugcaucuuagu

SEQ ID NO: 3395353 - RNA, 20 nt, Human
caauugcuuacucauuaaaa

SEQ ID NO: 3395354 - RNA, 18 nt, Human
caauuggaagucuaagaa

SEQ ID NO: 3395355 - RNA, 20 nt, Human
caauuggauacgacaacuug

SEQ ID NO: 3395356 - RNA, 22 nt, Human
caauugggauggcgcuaggcau

SEQ ID NO: 3395357 - RNA, 19 nt, Human
caauuguaaaacugaggca

SEQ ID NO: 3395358 - RNA, 21 nt, Human
caauugugagccaccacgucc

SEQ ID NO: 3395359 - RNA, 14 nt, Human
caauugugcugcca

SEQ ID NO: 3395360 - RNA, 21 nt, Human
caauugugggcauaaacuguu

SEQ ID NO: 3395361 - RNA, 20 nt, Human
caauuguguagccuuuuugu

SEQ ID NO: 3395362 - RNA, 14 nt, Human
caauuguugacagu

SEQ ID NO: 3395363 - RNA, 23 nt, Human
caauuguugacaguucugaagaa

SEQ ID NO: 3395364 - RNA, 20 nt, Human
caauuuaaacccauuuuagu

SEQ ID NO: 3395365 - RNA, 13 nt, Human
caauuuaaagcaa

SEQ ID NO: 3395366 - RNA, 14 nt, Human
caauuuaaauguua

SEQ ID NO: 3395367 - RNA, 13 nt, Human
caauuuacaaagu

SEQ ID NO: 3395368 - RNA, 14 nt, Human
caauuuacaaagug

SEQ ID NO: 3395369 - RNA, 15 nt, Human
caauuuacaaagugu

SEQ ID NO: 3395370 - RNA, 18 nt, Human
caauuuacaaagugugua

SEQ ID NO: 3395371 - RNA, 20 nt, Human
caauuuauaaaauagaaaua

SEQ ID NO: 3395372 - RNA, 13 nt, Human
caauuuauaccuc

SEQ ID NO: 3395373 - RNA, 21 nt, Human
caauuuauauuuaauaaaauu

SEQ ID NO: 3395374 - RNA, 14 nt, Human
caauuuauuaaaau

SEQ ID NO: 3395375 - RNA, 20 nt, Human
caauuuauuauggcacauca

SEQ ID NO: 3395376 - RNA, 17 nt, Human
caauuuauucaagaaaa

SEQ ID NO: 3395377 - RNA, 16 nt, Human
caauuuauugcacaaa

SEQ ID NO: 3395378 - RNA, 22 nt, Human
caauuuauugcacaaaauauaa

SEQ ID NO: 3395379 - RNA, 13 nt, Human
caauuuauuugaa

SEQ ID NO: 3395380 - RNA, 15 nt, Human
caauuuauuugaaug

SEQ ID NO: 3395381 - RNA, 19 nt, Human
caauuuauuuuauuuuagc

SEQ ID NO: 3395382 - RNA, 19 nt, Human
caauuucaagguucuaacc

SEQ ID NO: 3395383 - RNA, 11 nt, Human
caauuucaagu

SEQ ID NO: 3395384 - RNA, 19 nt, Human
caauuucaauuuugucugu

SEQ ID NO: 3395385 - RNA, 19 nt, Human
caauuuccuuuauauuuag

SEQ ID NO: 3395386 - RNA, 20 nt, Human
caauuuccuuuauauuuagu

SEQ ID NO: 3395387 - RNA, 12 nt, Human
caauuucucccc

SEQ ID NO: 3395388 - RNA, 13 nt, Human
caauuucucccca

SEQ ID NO: 3395389 - RNA, 14 nt, Human
caauuucuccccag

SEQ ID NO: 3395390 - RNA, 15 nt, Human
caauuucuccccagg

SEQ ID NO: 3395391 - RNA, 13 nt, Human
caauuucugaaca

SEQ ID NO: 3395392 - RNA, 22 nt, Human
caauuucuguccuucagaugga

SEQ ID NO: 3395393 - RNA, 22 nt, Human
caauuucuguguugccaagcuc

SEQ ID NO: 3395394 - RNA, 16 nt, Human
caauuugauacauaau

SEQ ID NO: 3395395 - RNA, 14 nt, Human
caauuugcacauua

SEQ ID NO: 3395396 - RNA, 19 nt, Human
caauuuggcaauuuugugg

SEQ ID NO: 3395397 - RNA, 21 nt, Human
caauuugggcuuccuguuugu

SEQ ID NO: 3395398 - RNA, 19 nt, Human
caauuuguaaaaacagcau

SEQ ID NO: 3395399 - RNA, 23 nt, Human
caauuuguaaaaacagcauugcu

SEQ ID NO: 3395400 - RNA, 23 nt, Human
caauuuguaauugcuuacauuuu

SEQ ID NO: 3395401 - RNA, 16 nt, Human
caauuuguauaaaaug

SEQ ID NO: 3395402 - RNA, 18 nt, Human
caauuugucauuuugaag

SEQ ID NO: 3395403 - RNA, 19 nt, Human
caauuuguuugugcuucua

SEQ ID NO: 3395404 - RNA, 12 nt, Human
caauuuuaaaga

SEQ ID NO: 3395405 - RNA, 22 nt, Human
caauuuuaacuuagagcuuuuu

SEQ ID NO: 3395406 - RNA, 17 nt, Human
caauuuuaaugcuauuu

SEQ ID NO: 3395407 - RNA, 19 nt, Human
caauuuuaauuuaguaaau

SEQ ID NO: 3395408 - RNA, 21 nt, Human
caauuuuaauuuaguaaaugu

SEQ ID NO: 3395409 - RNA, 14 nt, Human
caauuuucacugug

SEQ ID NO: 3395410 - RNA, 15 nt, Human
caauuuucacugugu

SEQ ID NO: 3395411 - RNA, 12 nt, Human
caauuuucagau

SEQ ID NO: 3395412 - RNA, 10 nt, Human
caauuuuccu

SEQ ID NO: 3395413 - RNA, 15 nt, Human
caauuuuccuugaag

SEQ ID NO: 3395414 - RNA, 18 nt, Human
caauuuuccuugaagccg

SEQ ID NO: 3395415 - RNA, 16 nt, Human
caauuuucuaagcaau

SEQ ID NO: 3395416 - RNA, 22 nt, Human
caauuuucuaagcaauuucuug

SEQ ID NO: 3395417 - RNA, 19 nt, Human
caauuuucuuuaaccaguc

SEQ ID NO: 3395418 - RNA, 18 nt, Human
caauuuugcaugcucgau

SEQ ID NO: 3395419 - RNA, 12 nt, Human
caauuuuguaac

SEQ ID NO: 3395420 - RNA, 14 nt, Human
caauuuuugccuuc

SEQ ID NO: 3395421 - RNA, 18 nt, Human
caauuuuugucucagaag

SEQ ID NO: 3395422 - RNA, 20 nt, Human
caauuuuuuaagugaaaaua

SEQ ID NO: 3395423 - RNA, 17 nt, Human
caauuuuuuuuauuagu

SEQ ID NO: 3395424 - RNA, 23 nt, Human
caauuuuuuuuauuaguauuguu

SEQ ID NO: 3395425 - RNA, 16 nt, Human
caauuuuuuuuuccuu

SEQ ID NO: 3395426 - RNA, 12 nt, Human
cacaaaaaugaa

SEQ ID NO: 3395427 - RNA, 20 nt, Human
cacaaaaauuugaacacugg

SEQ ID NO: 3395428 - RNA, 17 nt, Human
cacaaaaccuguccuau

SEQ ID NO: 3395429 - RNA, 20 nt, Human
cacaaaacuccgcccccagc

SEQ ID NO: 3395430 - RNA, 23 nt, Human
cacaaaacuccgcccccagccua

SEQ ID NO: 3395431 - RNA, 18 nt, Human
cacaaaaguuucucuuuu

SEQ ID NO: 3395432 - RNA, 14 nt, Human
cacaaacagaggcc

SEQ ID NO: 3395433 - RNA, 20 nt, Human
cacaaaccacaacugacaca

SEQ ID NO: 3395434 - RNA, 15 nt, Human
cacaaaccaugcaaa

SEQ ID NO: 3395435 - RNA, 17 nt, Human
cacaaaccugccugggu

SEQ ID NO: 3395436 - RNA, 13 nt, Human
cacaaacucacca

SEQ ID NO: 3395437 - RNA, 17 nt, Human
cacaaacuguaauacaa

SEQ ID NO: 3395438 - RNA, 16 nt, Human
cacaaagacccuggcu

SEQ ID NO: 3395439 - RNA, 12 nt, Human
cacacagcugcc

SEQ ID NO: 3395440 - RNA, 14 nt, Human
cacacagcugccgg

SEQ ID NO: 3395441 - RNA, 18 nt, Human
cacacaggacccccuucc

SEQ ID NO: 3395442 - RNA, 19 nt, Human
cacacaggcaacugaggca

SEQ ID NO: 3395443 - RNA, 20 nt, Human
cacacaggcaacugaggcag

SEQ ID NO: 3395444 - RNA, 17 nt, Human
cacacaggcauuuccug

SEQ ID NO: 3395445 - RNA, 20 nt, Human
cacacaggcauuuccugggu

SEQ ID NO: 3395446 - RNA, 18 nt, Human
cacacagguggugucacu

SEQ ID NO: 3395447 - RNA, 20 nt, Human
cacacaguauuacuucugcu

SEQ ID NO: 3395448 - RNA, 18 nt, Human
cacacagugagucgagga

SEQ ID NO: 3395449 - RNA, 15 nt, Human
cacacauacacacac

SEQ ID NO: 3395450 - RNA, 23 nt, Human
cacacauauaaacaucacacaca

SEQ ID NO: 3395451 - RNA, 15 nt, Human
cacacaucaucugua

SEQ ID NO: 3395452 - RNA, 12 nt, Human
cacacaucccag

SEQ ID NO: 3395453 - RNA, 14 nt, Human
cacacaucccagcc

SEQ ID NO: 3395454 - RNA, 17 nt, Human
cacacaucccagcccaa

SEQ ID NO: 3395455 - RNA, 18 nt, Human
cacacaugcauacacaca

SEQ ID NO: 3395456 - RNA, 19 nt, Human
cacacaugcauacacacac

SEQ ID NO: 3395457 - RNA, 14 nt, Human
cacacauuucacug

SEQ ID NO: 3395458 - RNA, 13 nt, Human
cacacauuugccu

SEQ ID NO: 3395459 - RNA, 18 nt, Human
cacacauuuguguaaaca

SEQ ID NO: 3395460 - RNA, 20 nt, Human
cacacauuuuuuaaaugcac

SEQ ID NO: 3395461 - RNA, 20 nt, Human
cacaccaaagggagaguucc

SEQ ID NO: 3395462 - RNA, 16 nt, Human
cacaccacaucuaagc

SEQ ID NO: 3395463 - RNA, 22 nt, Human
cacaccagagcccaccuuggcu

SEQ ID NO: 3395464 - RNA, 12 nt, Human
cacaccagccau

SEQ ID NO: 3395465 - RNA, 17 nt, Human
cacaccaggcugugggc

SEQ ID NO: 3395466 - RNA, 20 nt, Human
cacaccaggcugugggccuc

SEQ ID NO: 3395467 - RNA, 22 nt, Human
cacaccaggcugugggccucaa

SEQ ID NO: 3395468 - RNA, 18 nt, Human
cacaccagggccagccuc

SEQ ID NO: 3395469 - RNA, 15 nt, Human
cacaccauaagcuac

SEQ ID NO: 3395470 - RNA, 14 nt, Human
cacacccaaagcug

SEQ ID NO: 3395471 - RNA, 19 nt, Human
cacacccaaagcugagccu

SEQ ID NO: 3395472 - RNA, 14 nt, Human
cacacccacucagc

SEQ ID NO: 3395473 - RNA, 13 nt, Human
cacacccagccuc

SEQ ID NO: 3395474 - RNA, 16 nt, Human
cacacccagccucagu

SEQ ID NO: 3395475 - RNA, 19 nt, Human
cacacccagccucaguccu

SEQ ID NO: 3395476 - RNA, 23 nt, Human
cacacccaggcacuuaagcacaa

SEQ ID NO: 3395477 - RNA, 14 nt, Human
cacaccccaccugc

SEQ ID NO: 3395478 - RNA, 15 nt, Human
cacaccccaccugcg

SEQ ID NO: 3395479 - RNA, 19 nt, Human
cacaccccaccugcgcuuc

SEQ ID NO: 3395480 - RNA, 13 nt, Human
cacacccccaccc

SEQ ID NO: 3395481 - RNA, 22 nt, Human
cacacccugaggucagggagug

SEQ ID NO: 3395482 - RNA, 20 nt, Human
cacaccgagggcgaccccgu

SEQ ID NO: 3395483 - RNA, 23 nt, Human
cacaccuaagggacauguuuuga

SEQ ID NO: 3395484 - RNA, 15 nt, Human
cacaccuagccagcu

SEQ ID NO: 3395485 - RNA, 17 nt, Human
cacaccucaguucccuu

SEQ ID NO: 3395486 - RNA, 21 nt, Human
cacaccucaguucccuuggcc

SEQ ID NO: 3395487 - RNA, 16 nt, Human
cacaccucccugaacc

SEQ ID NO: 3395488 - RNA, 17 nt, Human
cacaccucccugaacca

SEQ ID NO: 3395489 - RNA, 16 nt, Human
cacaccuccucccacu

SEQ ID NO: 3395490 - RNA, 21 nt, Human
cacaccuccucccacugccca

SEQ ID NO: 3395491 - RNA, 23 nt, Human
cacaccuccucccacugcccacu

SEQ ID NO: 3395492 - RNA, 16 nt, Human
cacaccugacucugaa

SEQ ID NO: 3395493 - RNA, 13 nt, Human
cacaccuggcccu

SEQ ID NO: 3395494 - RNA, 17 nt, Human
cacaccuggcccugggg

SEQ ID NO: 3395495 - RNA, 16 nt, Human
cacaccuguagcacuu

SEQ ID NO: 3395496 - RNA, 19 nt, Human
cacaccuguagucccagcu

SEQ ID NO: 3395497 - RNA, 20 nt, Human
cacacgaccggggccagcac

SEQ ID NO: 3395498 - RNA, 17 nt, Human
cacacgagaaccugaag

SEQ ID NO: 3395499 - RNA, 23 nt, Human
cacacgcacacacacacacagga

SEQ ID NO: 3395500 - RNA, 13 nt, Human
cacacgcacgcac

SEQ ID NO: 3395501 - RNA, 15 nt, Human
cacacgcacgcacac

SEQ ID NO: 3395502 - RNA, 14 nt, Human
cacacgcaggaacu

SEQ ID NO: 3395503 - RNA, 21 nt, Human
cacacgcaggaacucccagca

SEQ ID NO: 3395504 - RNA, 17 nt, Human
cacacgccucccacugg

SEQ ID NO: 3395505 - RNA, 14 nt, Human
cacacgcugccuuc

SEQ ID NO: 3395506 - RNA, 18 nt, Human
cacacggaggcaucugca

SEQ ID NO: 3395507 - RNA, 20 nt, Human
cacacggaggcaucugcacc

SEQ ID NO: 3395508 - RNA, 20 nt, Human
cacacgucauuucuuagcua

SEQ ID NO: 3395509 - RNA, 16 nt, Human
cacacuacaccacaca

SEQ ID NO: 3395510 - RNA, 18 nt, Human
cacacuacaccacacaca

SEQ ID NO: 3395511 - RNA, 23 nt, Human
cacacuacaccacacacaacagc

SEQ ID NO: 3395512 - RNA, 22 nt, Human
cacacuaccgaaugugucuuua

SEQ ID NO: 3395513 - RNA, 17 nt, Human
cacacuagccucuccag

SEQ ID NO: 3395514 - RNA, 18 nt, Human
cacacuagccucuccagg

SEQ ID NO: 3395515 - RNA, 18 nt, Human
cacacuauuaccaugaga

SEQ ID NO: 3395516 - RNA, 12 nt, Human
cacacuauuuua

SEQ ID NO: 3395517 - RNA, 14 nt, Human
cacacuauuuuaga

SEQ ID NO: 3395518 - RNA, 14 nt, Human
cacacucccaaggu

SEQ ID NO: 3395519 - RNA, 17 nt, Human
cacacuccccugcacug

SEQ ID NO: 3395520 - RNA, 21 nt, Human
cacacucccgagacggcacug

SEQ ID NO: 3395521 - RNA, 17 nt, Human
cacacugaggcagggaa

SEQ ID NO: 3395522 - RNA, 18 nt, Human
cacacugaggcagggaag

SEQ ID NO: 3395523 - RNA, 17 nt, Human
cacacugcaagagccuu

SEQ ID NO: 3395524 - RNA, 18 nt, Human
cacacugcaagagccuug

SEQ ID NO: 3395525 - RNA, 20 nt, Human
cacacugcaagagccuuggu

SEQ ID NO: 3395526 - RNA, 21 nt, Human
cacacugcaagagccuuggug

SEQ ID NO: 3395527 - RNA, 12 nt, Human
cacacugcacaa

SEQ ID NO: 3395528 - RNA, 18 nt, Human
cacacugcacuguuuuca

SEQ ID NO: 3395529 - RNA, 23 nt, Human
cacacugcuaggugggccagccc

SEQ ID NO: 3395530 - RNA, 19 nt, Human
cacacuggggugccgccug

SEQ ID NO: 3395531 - RNA, 21 nt, Human
cacacugggugcccaagcuca

SEQ ID NO: 3395532 - RNA, 15 nt, Human
cacacuggugacugc

SEQ ID NO: 3395533 - RNA, 16 nt, Human
cacacugguucucaau

SEQ ID NO: 3395534 - RNA, 18 nt, Human
cacacugguucucaauga

SEQ ID NO: 3395535 - RNA, 19 nt, Human
cacacugguucucaaugaa

SEQ ID NO: 3395536 - RNA, 23 nt, Human
cacacuguagcauuacagugggu

SEQ ID NO: 3395537 - RNA, 12 nt, Human
cacacugugaca

SEQ ID NO: 3395538 - RNA, 14 nt, Human
cacacugugacaca

SEQ ID NO: 3395539 - RNA, 14 nt, Human
cacacugugcuuuc

SEQ ID NO: 3395540 - RNA, 20 nt, Human
cacacugugcuuucuauugu

SEQ ID NO: 3395541 - RNA, 22 nt, Human
cacacugugcuuucuauuguac

SEQ ID NO: 3395542 - RNA, 23 nt, Human
cacacugugcuuucuauuguaca

SEQ ID NO: 3395543 - RNA, 19 nt, Human
cacacuguguccuggugcu

SEQ ID NO: 3395544 - RNA, 20 nt, Human
cacacuguguccuggugcuc

SEQ ID NO: 3395545 - RNA, 14 nt, Human
cacacuuacuuuuu

SEQ ID NO: 3395546 - RNA, 16 nt, Human
cacacuuagcuggaga

SEQ ID NO: 3395547 - RNA, 20 nt, Human
cacacuucaggcucuucucc

SEQ ID NO: 3395548 - RNA, 22 nt, Human
cacacuucaggcucuucuccuu

SEQ ID NO: 3395549 - RNA, 15 nt, Human
cacacuuccugucca

SEQ ID NO: 3395550 - RNA, 19 nt, Human
cacacuuccuguccagaga

SEQ ID NO: 3395551 - RNA, 20 nt, Human
cacacuuccuguccagagag

SEQ ID NO: 3395552 - RNA, 23 nt, Human
cacacuuccuguccagagagaga

SEQ ID NO: 3395553 - RNA, 17 nt, Human
cacacuucucaggacac

SEQ ID NO: 3395554 - RNA, 16 nt, Human
cacacuugaaaccuuu

SEQ ID NO: 3395555 - RNA, 19 nt, Human
cacacuugagaggaugaau

SEQ ID NO: 3395556 - RNA, 22 nt, Human
cacacuugguuggguccucaca

SEQ ID NO: 3395557 - RNA, 10 nt, Human
cacacuuguc

SEQ ID NO: 3395558 - RNA, 19 nt, Human
cacacuugugugugggcug

SEQ ID NO: 3395559 - RNA, 23 nt, Human
cacacuugugugugggcugugag

SEQ ID NO: 3395560 - RNA, 12 nt, Human
cacacuuuggua

SEQ ID NO: 3395561 - RNA, 12 nt, Human
cacagaaaauau

SEQ ID NO: 3395562 - RNA, 14 nt, Human
cacagaaaauauac

SEQ ID NO: 3395563 - RNA, 18 nt, Human
cacagaaaauauacugua

SEQ ID NO: 3395564 - RNA, 20 nt, Human
cacagaaaauauacuguaaa

SEQ ID NO: 3395565 - RNA, 22 nt, Human
cacagaaaauggaagacagcuc

SEQ ID NO: 3395566 - RNA, 19 nt, Human
cacagaaaauucuucucca

SEQ ID NO: 3395567 - RNA, 13 nt, Human
cacagaaacacaa

SEQ ID NO: 3395568 - RNA, 18 nt, Human
cacagaaacacaauauuu

SEQ ID NO: 3395569 - RNA, 15 nt, Human
cacagaaacacugcc

SEQ ID NO: 3395570 - RNA, 16 nt, Human
cacagaaaccaauuuu

SEQ ID NO: 3395571 - RNA, 12 nt, Human
cacagaaaccuu

SEQ ID NO: 3395572 - RNA, 11 nt, Human
cacagaaagag

SEQ ID NO: 3395573 - RNA, 14 nt, Human
cacagaaagagagc

SEQ ID NO: 3395574 - RNA, 23 nt, Human
cacagaaauauauauacauaugu

SEQ ID NO: 3395575 - RNA, 22 nt, Human
cacagaaaugagaucaggcucu

SEQ ID NO: 3395576 - RNA, 16 nt, Human
cacagaaaugcugcug

SEQ ID NO: 3395577 - RNA, 18 nt, Human
cacagaaaugcugcuggc

SEQ ID NO: 3395578 - RNA, 21 nt, Human
cacagaaaugcugcuggccaa

SEQ ID NO: 3395579 - RNA, 13 nt, Human
cacagaacccuug

SEQ ID NO: 3395580 - RNA, 18 nt, Human
cacagaaggggacugcca

SEQ ID NO: 3395581 - RNA, 22 nt, Human
cacagaaggggacugccaccuc

SEQ ID NO: 3395582 - RNA, 22 nt, Human
cacagaaguccuguaugucugu

SEQ ID NO: 3395583 - RNA, 18 nt, Human
cacaucagcuagcaaaag

SEQ ID NO: 3395584 - RNA, 13 nt, Human
cacaucagcuugc

SEQ ID NO: 3395585 - RNA, 17 nt, Human
cacaucagucacaaguu

SEQ ID NO: 3395586 - RNA, 19 nt, Human
cacaucaucuguaagcugu

SEQ ID NO: 3395587 - RNA, 22 nt, Human
cacauccauucccaagaaaugc

SEQ ID NO: 3395588 - RNA, 13 nt, Human
cacaucccacccc

SEQ ID NO: 3395589 - RNA, 21 nt, Human
cacaucccaccccauccucca

SEQ ID NO: 3395590 - RNA, 15 nt, Human
cacaucccagcccaa

SEQ ID NO: 3395591 - RNA, 12 nt, Human
cacaucccaggc

SEQ ID NO: 3395592 - RNA, 16 nt, Human
cacaucccugggccug

SEQ ID NO: 3395593 - RNA, 18 nt, Human
cacaucccugggccugcu

SEQ ID NO: 3395594 - RNA, 21 nt, Human
cacaucccugggccugcugcu

SEQ ID NO: 3395595 - RNA, 23 nt, Human
cacauccgcgugugccugugugc

SEQ ID NO: 3395596 - RNA, 21 nt, Human
cacauccuugacuuuuuagau

SEQ ID NO: 3395597 - RNA, 15 nt, Human
cacauccuuucuaaa

SEQ ID NO: 3395598 - RNA, 14 nt, Human
cacaucuaagccug

SEQ ID NO: 3395599 - RNA, 17 nt, Human
cacaucuaagccugaag

SEQ ID NO: 3395600 - RNA, 21 nt, Human
cacaucucaacaggccucagg

SEQ ID NO: 3395601 - RNA, 22 nt, Human
cacaucuccuccauacucagga

SEQ ID NO: 3395602 - RNA, 15 nt, Human
cacaucuugcucugc

SEQ ID NO: 3395603 - RNA, 21 nt, Human
cacaucuuggcuauguaauuc

SEQ ID NO: 3395604 - RNA, 15 nt, Human
cacaucuuuaucugu

SEQ ID NO: 3395605 - RNA, 21 nt, Human
cacaugaaaccuacacacugu

SEQ ID NO: 3395606 - RNA, 15 nt, Human
cacaugaacuuagau

SEQ ID NO: 3395607 - RNA, 18 nt, Human
cacaugaagaaauacugc

SEQ ID NO: 3395608 - RNA, 20 nt, Human
cacaugaaguccaagcauuu

SEQ ID NO: 3395609 - RNA, 18 nt, Human
cacaugaauuauuacagu

SEQ ID NO: 3395610 - RNA, 15 nt, Human
cacaugagauaauau

SEQ ID NO: 3395611 - RNA, 21 nt, Human
cacaugagaucuaggugagga

SEQ ID NO: 3395612 - RNA, 19 nt, Human
cacaugauuucacaaauau

SEQ ID NO: 3395613 - RNA, 20 nt, Human
cacaugauuucacaaauauu

SEQ ID NO: 3395614 - RNA, 20 nt, Human
cacaugcaaggucauuuuuu

SEQ ID NO: 3395615 - RNA, 12 nt, Human
cacaugcacaca

SEQ ID NO: 3395616 - RNA, 13 nt, Human
cacaugcacacac

SEQ ID NO: 3395617 - RNA, 14 nt, Human
cacaugcagcugca

SEQ ID NO: 3395618 - RNA, 14 nt, Human
cacaugcauacaca

SEQ ID NO: 3395619 - RNA, 19 nt, Human
cacaugccaggggccuuug

SEQ ID NO: 3395620 - RNA, 18 nt, Human
cacaugccucucucaggc

SEQ ID NO: 3395621 - RNA, 21 nt, Human
cacaugccucucucaggccaa

SEQ ID NO: 3395622 - RNA, 9 nt, Human
cacaugcua

SEQ ID NO: 3395623 - RNA, 22 nt, Human
cacaugcucaaugacucucugg

SEQ ID NO: 3395624 - RNA, 19 nt, Human
cacaugcuggacaggucug

SEQ ID NO: 3395625 - RNA, 16 nt, Human
cacaugcuggccagcc

SEQ ID NO: 3395626 - RNA, 19 nt, Human
cacaugcuggccagccugg

SEQ ID NO: 3395627 - RNA, 14 nt, Human
cacauggaaaccca

SEQ ID NO: 3395628 - RNA, 17 nt, Human
cacauggaaugaggguu

SEQ ID NO: 3395629 - RNA, 19 nt, Human
cacauggcuuccuccugcg

SEQ ID NO: 3395630 - RNA, 23 nt, Human
cacaugggagcaguccaugcaug

SEQ ID NO: 3395631 - RNA, 18 nt, Human
cacaugggugaacacuca

SEQ ID NO: 3395632 - RNA, 22 nt, Human
cacauggugacuuuugaaaaga

SEQ ID NO: 3395633 - RNA, 14 nt, Human
cacauguauguuuu

SEQ ID NO: 3395634 - RNA, 20 nt, Human
cacaugucaccguggaccuu

SEQ ID NO: 3395635 - RNA, 13 nt, Human
cacaugucuuaau

SEQ ID NO: 3395636 - RNA, 17 nt, Human
cacaugucuuaaugaag

SEQ ID NO: 3395637 - RNA, 18 nt, Human
cacaugucuuaaugaagu

SEQ ID NO: 3395638 - RNA, 22 nt, Human
cacaugucuuaaugaaguuuga

SEQ ID NO: 3395639 - RNA, 13 nt, Human
cacaugugacaca

SEQ ID NO: 3395640 - RNA, 15 nt, Human
cacaugugacacaua

SEQ ID NO: 3395641 - RNA, 22 nt, Human
cacaugugagcaugucacuucc

SEQ ID NO: 3395642 - RNA, 14 nt, Human
cacaugugcugccc

SEQ ID NO: 3395643 - RNA, 12 nt, Human
cacauguuacug

SEQ ID NO: 3395644 - RNA, 21 nt, Human
cacauguuuagaguugcaauc

SEQ ID NO: 3395645 - RNA, 13 nt, Human
cacauguuuucaa

SEQ ID NO: 3395646 - RNA, 14 nt, Human
cacauguuuucaaa

SEQ ID NO: 3395647 - RNA, 15 nt, Human
cacauguuuucaaau

SEQ ID NO: 3395648 - RNA, 18 nt, Human
cacauguuuucaaaugga

SEQ ID NO: 3395649 - RNA, 19 nt, Human
cacauuaaaaaaugaaaua

SEQ ID NO: 3395650 - RNA, 22 nt, Human
cacauuaaaaaaugaaauauuu

SEQ ID NO: 3395651 - RNA, 16 nt, Human
cacauuaaagaagacc

SEQ ID NO: 3395652 - RNA, 17 nt, Human
cacauuaaagguacuuu

SEQ ID NO: 3395653 - RNA, 13 nt, Human
cacauuagaacuu

SEQ ID NO: 3395654 - RNA, 14 nt, Human
cacauuagaacuuc

SEQ ID NO: 3395655 - RNA, 21 nt, Human
cacauuagauuuuauuuuacu

SEQ ID NO: 3395656 - RNA, 22 nt, Human
cacauuaucgggagcagugucu

SEQ ID NO: 3395657 - RNA, 23 nt, Human
cacauuaucgggagcagugucuu

SEQ ID NO: 3395658 - RNA, 15 nt, Human
cacauuaucuucugg

SEQ ID NO: 3395659 - RNA, 13 nt, Human
cacauuauuugca

SEQ ID NO: 3395660 - RNA, 17 nt, Human
cacauucaacccuggag

SEQ ID NO: 3395661 - RNA, 20 nt, Human
cacauucaacccuggagagu

SEQ ID NO: 3395662 - RNA, 17 nt, Human
cacauucaggaagauga

SEQ ID NO: 3395663 - RNA, 11 nt, Human
cacauuccccu

SEQ ID NO: 3395664 - RNA, 16 nt, Human
cacauucggcucccug

SEQ ID NO: 3395665 - RNA, 17 nt, Human
cacauucggcucccugg

SEQ ID NO: 3395666 - RNA, 21 nt, Human
cacauucuggcucagggaggu

SEQ ID NO: 3395667 - RNA, 16 nt, Human
cacauucuuauaaaua

SEQ ID NO: 3395668 - RNA, 22 nt, Human
cacauugagcugauauaaauuc

SEQ ID NO: 3395669 - RNA, 23 nt, Human
cacauugcauucuauugccuucu

SEQ ID NO: 3395670 - RNA, 21 nt, Human
cacauuggaagagcagcaccu

SEQ ID NO: 3395671 - RNA, 18 nt, Human
cacauuggagauguuuag

SEQ ID NO: 3395672 - RNA, 18 nt, Human
cacauugggcagcgcccu

SEQ ID NO: 3395673 - RNA, 22 nt, Human
cacauugggcagcgcccuuccu

SEQ ID NO: 3395674 - RNA, 21 nt, Human
cacauuggucuaucuacuggc

SEQ ID NO: 3395675 - RNA, 20 nt, Human
cacauugguguuguacucaa

SEQ ID NO: 3395676 - RNA, 12 nt, Human
cacauugugcag

SEQ ID NO: 3395677 - RNA, 20 nt, Human
cacauugugucacaucauga

SEQ ID NO: 3395678 - RNA, 16 nt, Human
cacauuguuauuuuca

SEQ ID NO: 3395679 - RNA, 17 nt, Human
cacauuguuguuuuuuu

SEQ ID NO: 3395680 - RNA, 22 nt, Human
cacauuguuguuuuuuuaauag

SEQ ID NO: 3395681 - RNA, 12 nt, Human
cacauuguuuua

SEQ ID NO: 3395682 - RNA, 16 nt, Human
cacauuguuuuaaaaa

SEQ ID NO: 3395683 - RNA, 18 nt, Human
cacauuguuuuaaaaaga

SEQ ID NO: 3395684 - RNA, 19 nt, Human
cacauuuaagagacaguca

SEQ ID NO: 3395685 - RNA, 13 nt, Human
cacauuuaaggau

SEQ ID NO: 3395686 - RNA, 19 nt, Human
cacauuuagucucuuuauu

SEQ ID NO: 3395687 - RNA, 19 nt, Human
cacauuugcuuuuugugau

SEQ ID NO: 3395688 - RNA, 15 nt, Human
cacauuuuaaaagug

SEQ ID NO: 3395689 - RNA, 18 nt, Human
cacauuuuaguccagaga

SEQ ID NO: 3395690 - RNA, 17 nt, Human
cacauuuuauuuuauua

SEQ ID NO: 3395691 - RNA, 20 nt, Human
cacauuuuauuuuauuaugc

SEQ ID NO: 3395692 - RNA, 21 nt, Human
cacauuuuauuuuauuaugca

SEQ ID NO: 3395693 - RNA, 18 nt, Human
cacauuuuccuuuucaaa

SEQ ID NO: 3395694 - RNA, 19 nt, Human
cacauuuugguucuucuca

SEQ ID NO: 3395695 - RNA, 16 nt, Human
cacauuuuuaaauugu

SEQ ID NO: 3395696 - RNA, 21 nt, Human
cacauuuuuauaccuguuuaa

SEQ ID NO: 3395697 - RNA, 13 nt, Human
cacauuuuucuua

SEQ ID NO: 3395698 - RNA, 14 nt, Human
cacauuuuucuuag

SEQ ID NO: 3395699 - RNA, 17 nt, Human
cacauuuuuuaaaugca

SEQ ID NO: 3395700 - RNA, 14 nt, Human
caccaaaaaccuau

SEQ ID NO: 3395701 - RNA, 15 nt, Human
caccaaaagaaguaa

SEQ ID NO: 3395702 - RNA, 18 nt, Human
caccaaaauaagaaaaga

SEQ ID NO: 3395703 - RNA, 14 nt, Human
caccaaagaugcag

SEQ ID NO: 3395704 - RNA, 18 nt, Human
caccaaagaugcagccgc

SEQ ID NO: 3395705 - RNA, 14 nt, Human
caccaaagcugccc

SEQ ID NO: 3395706 - RNA, 13 nt, Human
caccaaaggccag

SEQ ID NO: 3395707 - RNA, 22 nt, Human
caccaaagggagaguuccagag

SEQ ID NO: 3395708 - RNA, 15 nt, Human
caccaaaguauuuuu

SEQ ID NO: 3395709 - RNA, 13 nt, Human
caccaaaguucua

SEQ ID NO: 3395710 - RNA, 18 nt, Human
caccaaaucaaaaucucu

SEQ ID NO: 3395711 - RNA, 21 nt, Human
caccaaaucaaaaucucucca

SEQ ID NO: 3395712 - RNA, 14 nt, Human
caccaacaucccau

SEQ ID NO: 3395713 - RNA, 17 nt, Human
caccaacaucccauugc

SEQ ID NO: 3395714 - RNA, 22 nt, Human
caccaacaucccauugcccugg

SEQ ID NO: 3395715 - RNA, 14 nt, Human
caccaacccagccg

SEQ ID NO: 3395716 - RNA, 17 nt, Human
caccaacccagccgcug

SEQ ID NO: 3395717 - RNA, 13 nt, Human
caccaacccucag

SEQ ID NO: 3395718 - RNA, 14 nt, Human
caccaacccucagg

SEQ ID NO: 3395719 - RNA, 15 nt, Human
caccaaccgacaggc

SEQ ID NO: 3395720 - RNA, 14 nt, Human
caccaacgucugug

SEQ ID NO: 3395721 - RNA, 22 nt, Human
caccaacuccuaguucuagaaa

SEQ ID NO: 3395722 - RNA, 18 nt, Human
caccaacucuugcagguc

SEQ ID NO: 3395723 - RNA, 16 nt, Human
caccaacuuacaaaaa

SEQ ID NO: 3395724 - RNA, 15 nt, Human
caccaagaaagcagg

SEQ ID NO: 3395725 - RNA, 19 nt, Human
caccaagacuugaaggugc

SEQ ID NO: 3395726 - RNA, 16 nt, Human
caccaagcacagcagc

SEQ ID NO: 3395727 - RNA, 21 nt, Human
caccaagcaggaaaugaaaau

SEQ ID NO: 3395728 - RNA, 18 nt, Human
cacuucagggcagauuuu

SEQ ID NO: 3395729 - RNA, 19 nt, Human
cacuucagggcagauuuua

SEQ ID NO: 3395730 - RNA, 23 nt, Human
cacuucagggcagauuuuaguuu

SEQ ID NO: 3395731 - RNA, 18 nt, Human
cacuucagguauaccuca

SEQ ID NO: 3395732 - RNA, 19 nt, Human
cacuucagguauaccucac

SEQ ID NO: 3395733 - RNA, 14 nt, Human
cacuucauaaucca

SEQ ID NO: 3395734 - RNA, 16 nt, Human
cacuucauugagaguu

SEQ ID NO: 3395735 - RNA, 20 nt, Human
cacuuccaccagccugcacu

SEQ ID NO: 3395736 - RNA, 12 nt, Human
cacuuccagggg

SEQ ID NO: 3395737 - RNA, 12 nt, Human
cacuuccccucc

SEQ ID NO: 3395738 - RNA, 13 nt, Human
cacuuccccuccu

SEQ ID NO: 3395739 - RNA, 15 nt, Human
cacuuccccuccuac

SEQ ID NO: 3395740 - RNA, 21 nt, Human
cacuuccccuccuaccccucc

SEQ ID NO: 3395741 - RNA, 16 nt, Human
cacuucccuacaugga

SEQ ID NO: 3395742 - RNA, 14 nt, Human
cacuucccucuguu

SEQ ID NO: 3395743 - RNA, 18 nt, Human
cacuucccucuguuucuc

SEQ ID NO: 3395744 - RNA, 13 nt, Human
cacuucccugcug

SEQ ID NO: 3395745 - RNA, 14 nt, Human
cacuucccugcugc

SEQ ID NO: 3395746 - RNA, 16 nt, Human
cacuucccugcugccu

SEQ ID NO: 3395747 - RNA, 18 nt, Human
cacuucccugcugccugu

SEQ ID NO: 3395748 - RNA, 18 nt, Human
cacuucccugcuuaaauu

SEQ ID NO: 3395749 - RNA, 17 nt, Human
cacuuccgucacauccc

SEQ ID NO: 3395750 - RNA, 23 nt, Human
cacuuccuacaagagcagccugu

SEQ ID NO: 3395751 - RNA, 14 nt, Human
cacuuccugccuaa

SEQ ID NO: 3395752 - RNA, 13 nt, Human
cacuuccugucca

SEQ ID NO: 3395753 - RNA, 17 nt, Human
cacuuccuguccagaga

SEQ ID NO: 3395754 - RNA, 23 nt, Human
cacuucggccaggucacacgacc

SEQ ID NO: 3395755 - RNA, 23 nt, Human
cacuucgggcuguguaaacacag

SEQ ID NO: 3395756 - RNA, 23 nt, Human
cacuucgugggaucugccccucc

SEQ ID NO: 3395757 - RNA, 19 nt, Human
cacuucuaagaaaagccua

SEQ ID NO: 3395758 - RNA, 21 nt, Human
cacuucuaaguugaguauauu

SEQ ID NO: 3395759 - RNA, 15 nt, Human
cacuucucaggacac

SEQ ID NO: 3395760 - RNA, 22 nt, Human
cacuucucaggacacaggccug

SEQ ID NO: 3395761 - RNA, 23 nt, Human
cacuucucuuaaacuugugaaug

SEQ ID NO: 3395762 - RNA, 13 nt, Human
cacuucugaccac

SEQ ID NO: 3395763 - RNA, 14 nt, Human
cacuucugcacuug

SEQ ID NO: 3395764 - RNA, 22 nt, Human
cacuucugugagacccccacac

SEQ ID NO: 3395765 - RNA, 16 nt, Human
cacuucuuccuuucuc

SEQ ID NO: 3395766 - RNA, 17 nt, Human
cacuucuuccuuucucu

SEQ ID NO: 3395767 - RNA, 19 nt, Human
cacuucuuccuuucucuuu

SEQ ID NO: 3395768 - RNA, 14 nt, Human
cacuucuucugucc

SEQ ID NO: 3395769 - RNA, 17 nt, Human
cacuucuuucccuuccu

SEQ ID NO: 3395770 - RNA, 22 nt, Human
cacuugaacaaaaucuguugcc

SEQ ID NO: 3395771 - RNA, 20 nt, Human
cacuugaacccgggaggcag

SEQ ID NO: 3395772 - RNA, 16 nt, Human
cacuugacaucaacug

SEQ ID NO: 3395773 - RNA, 13 nt, Human
cacuugagagaaa

SEQ ID NO: 3395774 - RNA, 13 nt, Human
cacuugagaggau

SEQ ID NO: 3395775 - RNA, 15 nt, Human
cacuugaggccugau

SEQ ID NO: 3395776 - RNA, 16 nt, Human
cacuugaggccugauc

SEQ ID NO: 3395777 - RNA, 20 nt, Human
cacuugaggccugaucugcc

SEQ ID NO: 3395778 - RNA, 18 nt, Human
cacuugaggucaggaguu

SEQ ID NO: 3395779 - RNA, 23 nt, Human
cacuugaugauacaaugaacacu

SEQ ID NO: 3395780 - RNA, 23 nt, Human
cacuugcacgcccaugugugagu

SEQ ID NO: 3395781 - RNA, 18 nt, Human
cacuugcagacucuacag

SEQ ID NO: 3395782 - RNA, 19 nt, Human
cacuugcagacucuacaga

SEQ ID NO: 3395783 - RNA, 18 nt, Human
cacuugcaguggaagaua

SEQ ID NO: 3395784 - RNA, 13 nt, Human
cacuugcaucugu

SEQ ID NO: 3395785 - RNA, 14 nt, Human
cacuugcccacacc

SEQ ID NO: 3395786 - RNA, 12 nt, Human
cacuugccuggg

SEQ ID NO: 3395787 - RNA, 22 nt, Human
cacuugcggauauucuggacug

SEQ ID NO: 3395788 - RNA, 16 nt, Human
cacuugcuggaagacg

SEQ ID NO: 3395789 - RNA, 18 nt, Human
cacuuggacucuugcucu

SEQ ID NO: 3395790 - RNA, 15 nt, Human
cacuuggcagccuug

SEQ ID NO: 3395791 - RNA, 16 nt, Human
cacuuggcagccuugu

SEQ ID NO: 3395792 - RNA, 17 nt, Human
cacuuggcaucagcugg

SEQ ID NO: 3395793 - RNA, 19 nt, Human
cacuuggcaucagcuggcg

SEQ ID NO: 3395794 - RNA, 20 nt, Human
cacuuggccaagcagggagg

SEQ ID NO: 3395795 - RNA, 22 nt, Human
cacuuggcccaaguggcagagc

SEQ ID NO: 3395796 - RNA, 18 nt, Human
cacuugggggcucagcaa

SEQ ID NO: 3395797 - RNA, 16 nt, Human
cacuugggucuucccu

SEQ ID NO: 3395798 - RNA, 20 nt, Human
cacuuggugauauguccuau

SEQ ID NO: 3395799 - RNA, 19 nt, Human
cacuugguuggguccucac

SEQ ID NO: 3395800 - RNA, 20 nt, Human
cacuugguuggguccucaca

SEQ ID NO: 3395801 - RNA, 21 nt, Human
cacuugguuggguccucacau

SEQ ID NO: 3395802 - RNA, 14 nt, Human
cacuuguagauuug

SEQ ID NO: 3395803 - RNA, 12 nt, Human
cacuuguauaaa

SEQ ID NO: 3395804 - RNA, 19 nt, Human
cacuuguauaaauguauau

SEQ ID NO: 3395805 - RNA, 20 nt, Human
cacuuguauaaauguauaua

SEQ ID NO: 3395806 - RNA, 16 nt, Human
cacuuguauauacgca

SEQ ID NO: 3395807 - RNA, 16 nt, Human
cacuugucaauaaaau

SEQ ID NO: 3395808 - RNA, 20 nt, Human
cacuugucaggagugugugu

SEQ ID NO: 3395809 - RNA, 14 nt, Human
cacuuguccagcug

SEQ ID NO: 3395810 - RNA, 16 nt, Human
cacuuguccaugugaa

SEQ ID NO: 3395811 - RNA, 20 nt, Human
cacuugucccacuaucuggg

SEQ ID NO: 3395812 - RNA, 19 nt, Human
cacuuguccuuagccugga

SEQ ID NO: 3395813 - RNA, 19 nt, Human
cacuugucucauuuuaaug

SEQ ID NO: 3395814 - RNA, 22 nt, Human
cacuugucucauuuuaauguaa

SEQ ID NO: 3395815 - RNA, 11 nt, Human
cacuugugaau

SEQ ID NO: 3395816 - RNA, 13 nt, Human
cacuugugacuuu

SEQ ID NO: 3395817 - RNA, 20 nt, Human
cacuugugacuuuugcuuua

SEQ ID NO: 3395818 - RNA, 19 nt, Human
cacuugugauuauaaaauu

SEQ ID NO: 3395819 - RNA, 20 nt, Human
cacuugugcuuugcucuugu

SEQ ID NO: 3395820 - RNA, 14 nt, Human
cacuuguguguggg

SEQ ID NO: 3395821 - RNA, 17 nt, Human
cacuugugugugggcug

SEQ ID NO: 3395822 - RNA, 19 nt, Human
cacuuguguuuugcaagcc

SEQ ID NO: 3395823 - RNA, 13 nt, Human
cacuuguuccagc

SEQ ID NO: 3395824 - RNA, 17 nt, Human
cacuuguuccagcucuu

SEQ ID NO: 3395825 - RNA, 13 nt, Human
cacuuuaaaacac

SEQ ID NO: 3395826 - RNA, 18 nt, Human
cacuuuaagagagaaauc

SEQ ID NO: 3395827 - RNA, 14 nt, Human
cacuuuacccaccu

SEQ ID NO: 3395828 - RNA, 15 nt, Human
cacuuuagaugcuga

SEQ ID NO: 3395829 - RNA, 16 nt, Human
cacuuuagaugcugau

SEQ ID NO: 3395830 - RNA, 15 nt, Human
cacuuuagggcugua

SEQ ID NO: 3395831 - RNA, 21 nt, Human
cacuuuaugccggaugugcuu

SEQ ID NO: 3395832 - RNA, 22 nt, Human
cacuuuaugccggaugugcuuu

SEQ ID NO: 3395833 - RNA, 20 nt, Human
cacuuuauugccaaaaccca

SEQ ID NO: 3395834 - RNA, 17 nt, Human
cacuuucacauagaugu

SEQ ID NO: 3395835 - RNA, 12 nt, Human
cacuuucagcug

SEQ ID NO: 3395836 - RNA, 13 nt, Human
cacuuucagcugu

SEQ ID NO: 3395837 - RNA, 14 nt, Human
cacuuucagcuguc

SEQ ID NO: 3395838 - RNA, 15 nt, Human
cacuuucagcugucu

SEQ ID NO: 3395839 - RNA, 17 nt, Human
cacuuucagcugucuuu

SEQ ID NO: 3395840 - RNA, 16 nt, Human
cacuuucauugccagu

SEQ ID NO: 3395841 - RNA, 12 nt, Human
cacuuucauuuu

SEQ ID NO: 3395842 - RNA, 13 nt, Human
cacuuuccacuuc

SEQ ID NO: 3395843 - RNA, 17 nt, Human
cacuuuccacuucuucc

SEQ ID NO: 3395844 - RNA, 22 nt, Human
cacuuuccccgugggccauggc

SEQ ID NO: 3395845 - RNA, 16 nt, Human
cacuuucuaauguuuc

SEQ ID NO: 3395846 - RNA, 13 nt, Human
cacuuucuagcca

SEQ ID NO: 3395847 - RNA, 18 nt, Human
cacuuucuagccagagga

SEQ ID NO: 3395848 - RNA, 20 nt, Human
cacuuucuagccagaggaga

SEQ ID NO: 3395849 - RNA, 11 nt, Human
cacuuucucuu

SEQ ID NO: 3395850 - RNA, 22 nt, Human
cacuuucucuucuuguuucucc

SEQ ID NO: 3395851 - RNA, 11 nt, Human
cacuuucuuau

SEQ ID NO: 3395852 - RNA, 16 nt, Human
cacuuugaaauaccuc

SEQ ID NO: 3395853 - RNA, 19 nt, Human
cacuuugaaauguguuucu

SEQ ID NO: 3395854 - RNA, 13 nt, Human
cacuuugacacuu

SEQ ID NO: 3395855 - RNA, 20 nt, Human
cacuuugaugucauguguuc

SEQ ID NO: 3395856 - RNA, 17 nt, Human
cacuuugcacagcucuc

SEQ ID NO: 3395857 - RNA, 21 nt, Human
cacuuugcacgacgcccucuc

SEQ ID NO: 3395858 - RNA, 19 nt, Human
cacuuugcacugauauauc

SEQ ID NO: 3395859 - RNA, 13 nt, Human
cacuuugccuccu

SEQ ID NO: 3395860 - RNA, 20 nt, Human
cacuuuggaaguuuguguuc

SEQ ID NO: 3395861 - RNA, 20 nt, Human
cacuuuggauuucaucagac

SEQ ID NO: 3395862 - RNA, 13 nt, Human
cacuuuggcccag

SEQ ID NO: 3395863 - RNA, 16 nt, Human
cacuuuggcccagggu

SEQ ID NO: 3395864 - RNA, 18 nt, Human
cacuuuggcuuauaauuc

SEQ ID NO: 3395865 - RNA, 12 nt, Human
cacuuuggggga

SEQ ID NO: 3395866 - RNA, 19 nt, Human
cacuuugguacauggccag

SEQ ID NO: 3395867 - RNA, 20 nt, Human
cacuuugguacauggccagu

SEQ ID NO: 3395868 - RNA, 22 nt, Human
cacuuugguaccagauaacuuu

SEQ ID NO: 3395869 - RNA, 13 nt, Human
cacuuuguucugg

SEQ ID NO: 3395870 - RNA, 14 nt, Human
cacuuuguucuggc

SEQ ID NO: 3395871 - RNA, 17 nt, Human
cacuuuuaauaaacuuu

SEQ ID NO: 3395872 - RNA, 17 nt, Human
cacuuuuaaugaacaaa

SEQ ID NO: 3395873 - RNA, 18 nt, Human
cagacacaggcccggcuc

SEQ ID NO: 3395874 - RNA, 22 nt, Human
cagacacaggcccggcuccagg

SEQ ID NO: 3395875 - RNA, 15 nt, Human
cagacacaggcccuc

SEQ ID NO: 3395876 - RNA, 17 nt, Human
cagacacauguccaaga

SEQ ID NO: 3395877 - RNA, 22 nt, Human
cagacacauguccaagaagccc

SEQ ID NO: 3395878 - RNA, 15 nt, Human
cagacacccuuggag

SEQ ID NO: 3395879 - RNA, 19 nt, Human
cagacaccuugacagggca

SEQ ID NO: 3395880 - RNA, 14 nt, Human
cagacaccuuggac

SEQ ID NO: 3395881 - RNA, 19 nt, Human
cagacacgagccaccucac

SEQ ID NO: 3395882 - RNA, 17 nt, Human
cagacacggaucugaga

SEQ ID NO: 3395883 - RNA, 18 nt, Human
cagacacuaaguuauagu

SEQ ID NO: 3395884 - RNA, 21 nt, Human
cagacacuaaguuauaguaua

SEQ ID NO: 3395885 - RNA, 12 nt, Human
cagacacucugc

SEQ ID NO: 3395886 - RNA, 13 nt, Human
cagacacucugcu

SEQ ID NO: 3395887 - RNA, 21 nt, Human
cagacacugaccauccacucu

SEQ ID NO: 3395888 - RNA, 19 nt, Human
cagacacuuuggaaguuug

SEQ ID NO: 3395889 - RNA, 21 nt, Human
cagacacuuuuuugaguggau

SEQ ID NO: 3395890 - RNA, 23 nt, Human
cagacagaagucacucaauuguu

SEQ ID NO: 3395891 - RNA, 17 nt, Human
cagacagaagucuccuc

SEQ ID NO: 3395892 - RNA, 14 nt, Human
cagacagacacaca

SEQ ID NO: 3395893 - RNA, 20 nt, Human
cagacagagaauaugucugc

SEQ ID NO: 3395894 - RNA, 21 nt, Human
cagacagagaauaugucugcu

SEQ ID NO: 3395895 - RNA, 15 nt, Human
cagacagagccagga

SEQ ID NO: 3395896 - RNA, 17 nt, Human
cagacagaucuggaaug

SEQ ID NO: 3395897 - RNA, 21 nt, Human
cagacagauggaaaagggaga

SEQ ID NO: 3395898 - RNA, 17 nt, Human
cagacagcagcucaggc

SEQ ID NO: 3395899 - RNA, 14 nt, Human
cagacagcaggcag

SEQ ID NO: 3395900 - RNA, 16 nt, Human
cagacagcaggcagcg

SEQ ID NO: 3395901 - RNA, 11 nt, Human
cagacagcucc

SEQ ID NO: 3395902 - RNA, 17 nt, Human
cagacagcucccucugc

SEQ ID NO: 3395903 - RNA, 13 nt, Human
cagacagcugccu

SEQ ID NO: 3395904 - RNA, 14 nt, Human
cagacagcugccug

SEQ ID NO: 3395905 - RNA, 15 nt, Human
cagacaggaccccug

SEQ ID NO: 3395906 - RNA, 16 nt, Human
cagacaggaccccugc

SEQ ID NO: 3395907 - RNA, 23 nt, Human
cagacaggaccccugcaguuccc

SEQ ID NO: 3395908 - RNA, 21 nt, Human
cagacaggagaaaugcaucca

SEQ ID NO: 3395909 - RNA, 12 nt, Human
cagacaggagga

SEQ ID NO: 3395910 - RNA, 20 nt, Human
cagacaggccccgugaggca

SEQ ID NO: 3395911 - RNA, 14 nt, Human
cagacaggcucuua

SEQ ID NO: 3395912 - RNA, 18 nt, Human
cagacaggcucuuagcag

SEQ ID NO: 3395913 - RNA, 18 nt, Human
cagacaggguucauugaa

SEQ ID NO: 3395914 - RNA, 16 nt, Human
cagacagguuuucaca

SEQ ID NO: 3395915 - RNA, 22 nt, Human
cagacagguuuucacauaaaug

SEQ ID NO: 3395916 - RNA, 17 nt, Human
cagacagucacaaauuu

SEQ ID NO: 3395917 - RNA, 20 nt, Human
cagacagucacaaauuucuc

SEQ ID NO: 3395918 - RNA, 11 nt, Human
cagacauaaag

SEQ ID NO: 3395919 - RNA, 22 nt, Human
cagacauaaaggaaaagacaca

SEQ ID NO: 3395920 - RNA, 17 nt, Human
cagacauacgaaacaca

SEQ ID NO: 3395921 - RNA, 17 nt, Human
cagacaugguggggucu

SEQ ID NO: 3395922 - RNA, 22 nt, Human
cagacaugguggggucuccuca

SEQ ID NO: 3395923 - RNA, 23 nt, Human
cagacaugguggggucuccucag

SEQ ID NO: 3395924 - RNA, 22 nt, Human
cagacauguggugggacaggga

SEQ ID NO: 3395925 - RNA, 22 nt, Human
cagacauguuuuccgugaaaac

SEQ ID NO: 3395926 - RNA, 16 nt, Human
cagacauucugccagg

SEQ ID NO: 3395927 - RNA, 19 nt, Human
cagacauuguuuugccaac

SEQ ID NO: 3395928 - RNA, 13 nt, Human
cagacauuuuaaa

SEQ ID NO: 3395929 - RNA, 20 nt, Human
cagaccacaaaacuuuucua

SEQ ID NO: 3395930 - RNA, 16 nt, Human
cagaccacauugcuuu

SEQ ID NO: 3395931 - RNA, 22 nt, Human
cagaccaccccgccugcccuca

SEQ ID NO: 3395932 - RNA, 23 nt, Human
cagaccacgcccguccugccugu

SEQ ID NO: 3395933 - RNA, 13 nt, Human
cagaccacggcuc

SEQ ID NO: 3395934 - RNA, 12 nt, Human
cagaccagagcu

SEQ ID NO: 3395935 - RNA, 17 nt, Human
cagaccagagcucugga

SEQ ID NO: 3395936 - RNA, 15 nt, Human
cagaccagauuaaac

SEQ ID NO: 3395937 - RNA, 12 nt, Human
cagaccccagcg

SEQ ID NO: 3395938 - RNA, 15 nt, Human
cagacccccaccccu

SEQ ID NO: 3395939 - RNA, 18 nt, Human
cagacccccaccccuucc

SEQ ID NO: 3395940 - RNA, 19 nt, Human
cagacccccaccccuuccc

SEQ ID NO: 3395941 - RNA, 22 nt, Human
cagacccccaccccuuccccac

SEQ ID NO: 3395942 - RNA, 19 nt, Human
cagaccccgacaccggcca

SEQ ID NO: 3395943 - RNA, 16 nt, Human
cagaccccucuggcca

SEQ ID NO: 3395944 - RNA, 20 nt, Human
cagaccccucuggccaggau

SEQ ID NO: 3395945 - RNA, 22 nt, Human
cagaccccucuggccaggaugg

SEQ ID NO: 3395946 - RNA, 16 nt, Human
cagaccccuggcuuuu

SEQ ID NO: 3395947 - RNA, 18 nt, Human
cagaccccuggcuuuuca

SEQ ID NO: 3395948 - RNA, 21 nt, Human
cagaccccuggcuuuucacug

SEQ ID NO: 3395949 - RNA, 22 nt, Human
cagaccccuggcuuuucacugc

SEQ ID NO: 3395950 - RNA, 16 nt, Human
cagaccccuucagcca

SEQ ID NO: 3395951 - RNA, 15 nt, Human
cagaccccuuggcca

SEQ ID NO: 3395952 - RNA, 17 nt, Human
cagacccuaccccacca

SEQ ID NO: 3395953 - RNA, 18 nt, Human
cagacccuaccccaccac

SEQ ID NO: 3395954 - RNA, 15 nt, Human
cagacccugcccugu

SEQ ID NO: 3395955 - RNA, 22 nt, Human
cagacccugcccugugggcccc

SEQ ID NO: 3395956 - RNA, 14 nt, Human
cagacccuggagga

SEQ ID NO: 3395957 - RNA, 18 nt, Human
cagacccuggaggcccca

SEQ ID NO: 3395958 - RNA, 19 nt, Human
cagacccuggaggccccaa

SEQ ID NO: 3395959 - RNA, 15 nt, Human
cagaccgucuuccuc

SEQ ID NO: 3395960 - RNA, 20 nt, Human
cagaccgucuuccuccaacc

SEQ ID NO: 3395961 - RNA, 22 nt, Human
cagaccuaggauuucaugauuu

SEQ ID NO: 3395962 - RNA, 12 nt, Human
cagaccucccca

SEQ ID NO: 3395963 - RNA, 19 nt, Human
cagaccuccccagccccua

SEQ ID NO: 3395964 - RNA, 21 nt, Human
cagaccuccccagccccuagc

SEQ ID NO: 3395965 - RNA, 20 nt, Human
cagaccugauccuggaggcc

SEQ ID NO: 3395966 - RNA, 14 nt, Human
cagaccugccuuug

SEQ ID NO: 3395967 - RNA, 13 nt, Human
cagaccugcuuuu

SEQ ID NO: 3395968 - RNA, 21 nt, Human
cagaccugcuuuuugaaauga

SEQ ID NO: 3395969 - RNA, 16 nt, Human
cagaccuggaagaaca

SEQ ID NO: 3395970 - RNA, 15 nt, Human
cagaccuggagcccc

SEQ ID NO: 3395971 - RNA, 16 nt, Human
cagaccuggagccccu

SEQ ID NO: 3395972 - RNA, 23 nt, Human
cagaccuggagccccuggguggg

SEQ ID NO: 3395973 - RNA, 13 nt, Human
cagaccuguccuc

SEQ ID NO: 3395974 - RNA, 19 nt, Human
cagaccuguuagcagacag

SEQ ID NO: 3395975 - RNA, 20 nt, Human
cagaccuguuagcagacagg

SEQ ID NO: 3395976 - RNA, 16 nt, Human
cagacgccugaggaac

SEQ ID NO: 3395977 - RNA, 13 nt, Human
cagacgccuggcu

SEQ ID NO: 3395978 - RNA, 20 nt, Human
cagacgcucauucagcaucu

SEQ ID NO: 3395979 - RNA, 15 nt, Human
cagacggcacccacc

SEQ ID NO: 3395980 - RNA, 16 nt, Human
cagacggcacccaccc

SEQ ID NO: 3395981 - RNA, 17 nt, Human
cagacgguucaccagcc

SEQ ID NO: 3395982 - RNA, 15 nt, Human
cagacgucccuccac

SEQ ID NO: 3395983 - RNA, 20 nt, Human
cagacuacuauuuucuuuuu

SEQ ID NO: 3395984 - RNA, 22 nt, Human
cagacuagaauucuagugcugc

SEQ ID NO: 3395985 - RNA, 23 nt, Human
cagacuagauggaccugccugca

SEQ ID NO: 3395986 - RNA, 21 nt, Human
cagacuagauguaguauuuuu

SEQ ID NO: 3395987 - RNA, 19 nt, Human
cagacuauuuaacuugagg

SEQ ID NO: 3395988 - RNA, 22 nt, Human
cagacuauuuuuagauuuucuu

SEQ ID NO: 3395989 - RNA, 23 nt, Human
cagacucaaaugcucagaccagc

SEQ ID NO: 3395990 - RNA, 14 nt, Human
cagacucagacauu

SEQ ID NO: 3395991 - RNA, 20 nt, Human
cagacucagagcucucucua

SEQ ID NO: 3395992 - RNA, 18 nt, Human
cagacucaguuugucaga

SEQ ID NO: 3395993 - RNA, 19 nt, Human
cagacucauccugaacagc

SEQ ID NO: 3395994 - RNA, 22 nt, Human
cagacucauccugaacagcaug

SEQ ID NO: 3395995 - RNA, 14 nt, Human
cagacuccugagga

SEQ ID NO: 3395996 - RNA, 21 nt, Human
cagacuccugaggacagcugu

SEQ ID NO: 3395997 - RNA, 17 nt, Human
cagacucuacagaggcc

SEQ ID NO: 3395998 - RNA, 18 nt, Human
cagacucuacagaggcca

SEQ ID NO: 3395999 - RNA, 21 nt, Human
cagacucuacagaggccaugg

SEQ ID NO: 3396000 - RNA, 19 nt, Human
cagacucucagcccagaag

SEQ ID NO: 3396001 - RNA, 22 nt, Human
cagacucucucugggaggccau

SEQ ID NO: 3396002 - RNA, 13 nt, Human
cagacucuugccu

SEQ ID NO: 3396003 - RNA, 18 nt, Human
cagacucuuuaugcuugc

SEQ ID NO: 3396004 - RNA, 23 nt, Human
cagacucuuuuuguaccugguga

SEQ ID NO: 3396005 - RNA, 20 nt, Human
cagacugacaaauguguauc

SEQ ID NO: 3396006 - RNA, 22 nt, Human
cagacugaccuugaugagcugu

SEQ ID NO: 3396007 - RNA, 14 nt, Human
cagacugcacccag

SEQ ID NO: 3396008 - RNA, 16 nt, Human
cagacugcacccagga

SEQ ID NO: 3396009 - RNA, 19 nt, Human
cagacugcacccaggaggg

SEQ ID NO: 3396010 - RNA, 15 nt, Human
cagacugcugggacu

SEQ ID NO: 3396011 - RNA, 16 nt, Human
cagacuggaagcacag

SEQ ID NO: 3396012 - RNA, 17 nt, Human
cagacuggaagcacagc

SEQ ID NO: 3396013 - RNA, 21 nt, Human
cagacuggccugaggagcagc

SEQ ID NO: 3396014 - RNA, 17 nt, Human
cagacuggugagcagac

SEQ ID NO: 3396015 - RNA, 23 nt, Human
cagacuguguauucauugaaguc

SEQ ID NO: 3396016 - RNA, 20 nt, Human
cagacuucccagcuaggaag

SEQ ID NO: 3396017 - RNA, 15 nt, Human
cagacuuccuugaga

SEQ ID NO: 3396018 - RNA, 14 nt, Human
cagacuucuccaga

SEQ ID NO: 3396019 - RNA, 16 nt, Human
cagacuucuccagacc

SEQ ID NO: 3396020 - RNA, 13 nt, Human
cagacuugagaac

SEQ ID NO: 3396021 - RNA, 19 nt, Human
cagacuugagaacuugaca

SEQ ID NO: 3396022 - RNA, 20 nt, Human
cagacuugccaugugacucu

SEQ ID NO: 3396023 - RNA, 23 nt, Human
cagacuuguauauucuauuuuac

SEQ ID NO: 3396024 - RNA, 15 nt, Human
cagacuuuaaagaau

SEQ ID NO: 3396025 - RNA, 21 nt, Human
cagacuuuacaugacacagcu

SEQ ID NO: 3396026 - RNA, 22 nt, Human
cagacuuuggaaaaugcauugu

SEQ ID NO: 3396027 - RNA, 17 nt, Human
cagacuuuuaaagacuu

SEQ ID NO: 3396028 - RNA, 19 nt, Human
cagacuuuuaaagacuugc

SEQ ID NO: 3396029 - RNA, 15 nt, Human
cagacuuuuguacau

SEQ ID NO: 3396030 - RNA, 17 nt, Human
cagagaaaaagggaggg

SEQ ID NO: 3396031 - RNA, 18 nt, Human
cagagaaaaagggagggg

SEQ ID NO: 3396032 - RNA, 20 nt, Human
cagagaaaaaugcuccccac

SEQ ID NO: 3396033 - RNA, 23 nt, Human
cagagaaaaaugcuccccacagc

SEQ ID NO: 3396034 - RNA, 13 nt, Human
cagagaaaccagc

SEQ ID NO: 3396035 - RNA, 15 nt, Human
cagagaaaccagcuu

SEQ ID NO: 3396036 - RNA, 13 nt, Human
cagagaaagcgca

SEQ ID NO: 3396037 - RNA, 17 nt, Human
cagagaaaggcaaggga

SEQ ID NO: 3396038 - RNA, 19 nt, Human
cagagaaaguacuucucca

SEQ ID NO: 3396039 - RNA, 14 nt, Human
cagagaaccaggcu

SEQ ID NO: 3396040 - RNA, 20 nt, Human
cagagaacuaacacuauuuu

SEQ ID NO: 3396041 - RNA, 17 nt, Human
cagagaacuaguggugg

SEQ ID NO: 3396042 - RNA, 18 nt, Human
cagagaagaaagaacgga

SEQ ID NO: 3396043 - RNA, 23 nt, Human
cagagaagagaguauuggguaga

SEQ ID NO: 3396044 - RNA, 12 nt, Human
cagagaagccag

SEQ ID NO: 3396045 - RNA, 13 nt, Human
cagagaagccagc

SEQ ID NO: 3396046 - RNA, 20 nt, Human
cagagaagccagcuuguuua

SEQ ID NO: 3396047 - RNA, 17 nt, Human
cagagaagccccuuccc

SEQ ID NO: 3396048 - RNA, 18 nt, Human
cagagaagccccuucccc

SEQ ID NO: 3396049 - RNA, 11 nt, Human
cagagaagccu

SEQ ID NO: 3396050 - RNA, 12 nt, Human
cagagaagccuu

SEQ ID NO: 3396051 - RNA, 18 nt, Human
cagagaagccuucaagcu

SEQ ID NO: 3396052 - RNA, 21 nt, Human
cagagaagccuucaagcucug

SEQ ID NO: 3396053 - RNA, 23 nt, Human
cagagaagccuucaagcucugag

SEQ ID NO: 3396054 - RNA, 19 nt, Human
cagagaagcucucgggcua

SEQ ID NO: 3396055 - RNA, 15 nt, Human
cagagaagcugggga

SEQ ID NO: 3396056 - RNA, 16 nt, Human
cagagaaggcagcagg

SEQ ID NO: 3396057 - RNA, 22 nt, Human
cagagaagggcauaaaacagcu

SEQ ID NO: 3396058 - RNA, 20 nt, Human
cagagaagggcuccugcagg

SEQ ID NO: 3396059 - RNA, 13 nt, Human
cagagaagucaca

SEQ ID NO: 3396060 - RNA, 16 nt, Human
cagagaagucacaggg

SEQ ID NO: 3396061 - RNA, 18 nt, Human
cagagaagucacagggca

SEQ ID NO: 3396062 - RNA, 20 nt, Human
cagagaagucacagggcagu

SEQ ID NO: 3396063 - RNA, 15 nt, Human
cagagaagugacagg

SEQ ID NO: 3396064 - RNA, 19 nt, Human
cagagaagugacagggaag

SEQ ID NO: 3396065 - RNA, 22 nt, Human
cagagaagugacagggaagcua

SEQ ID NO: 3396066 - RNA, 11 nt, Human
cagagaauaua

SEQ ID NO: 3396067 - RNA, 20 nt, Human
cagagaauaugucugcuccu

SEQ ID NO: 3396068 - RNA, 19 nt, Human
cagagaaucauacuuagca

SEQ ID NO: 3396069 - RNA, 19 nt, Human
cagagaaugaaagggccca

SEQ ID NO: 3396070 - RNA, 19 nt, Human
cagagaaugacagcaaaca

SEQ ID NO: 3396071 - RNA, 15 nt, Human
cagagaauucucuua

SEQ ID NO: 3396072 - RNA, 20 nt, Human
cagagacaaaauauuuccca

SEQ ID NO: 3396073 - RNA, 22 nt, Human
cagagacaaauauuucuagaca

SEQ ID NO: 3396074 - RNA, 23 nt, Human
cagagacaacagguaaaacaggg

SEQ ID NO: 3396075 - RNA, 16 nt, Human
cagagacaaggagggc

SEQ ID NO: 3396076 - RNA, 16 nt, Human
cagagacacaagccuu

SEQ ID NO: 3396077 - RNA, 15 nt, Human
cagagacaccugcac

SEQ ID NO: 3396078 - RNA, 21 nt, Human
cagagacacuguugauaaaaa

SEQ ID NO: 3396079 - RNA, 22 nt, Human
cagagacacuguugauaaaaac

SEQ ID NO: 3396080 - RNA, 23 nt, Human
cagagacacuguugauaaaaacu

SEQ ID NO: 3396081 - RNA, 10 nt, Human
cagagacaga

SEQ ID NO: 3396082 - RNA, 22 nt, Human
cagagacaggaaaauccucugg

SEQ ID NO: 3396083 - RNA, 23 nt, Human
cagagacaggcccaagagaugaa

SEQ ID NO: 3396084 - RNA, 15 nt, Human
cagagacauacuuga

SEQ ID NO: 3396085 - RNA, 19 nt, Human
cagagacauacuugaaggg

SEQ ID NO: 3396086 - RNA, 17 nt, Human
cagagacaucagcccuu

SEQ ID NO: 3396087 - RNA, 23 nt, Human
cagagacaucagcccuugggggu

SEQ ID NO: 3396088 - RNA, 16 nt, Human
cagagacaugcagaga

SEQ ID NO: 3396089 - RNA, 18 nt, Human
cagagacaugcagagauu

SEQ ID NO: 3396090 - RNA, 13 nt, Human
cagagacauuccu

SEQ ID NO: 3396091 - RNA, 15 nt, Human
cagagaccaggcugu

SEQ ID NO: 3396092 - RNA, 13 nt, Human
cagagaccauccc

SEQ ID NO: 3396093 - RNA, 16 nt, Human
cagagaccaucccuga

SEQ ID NO: 3396094 - RNA, 17 nt, Human
cagagaccaucccugaa

SEQ ID NO: 3396095 - RNA, 18 nt, Human
cagagaccaucccugaag

SEQ ID NO: 3396096 - RNA, 13 nt, Human
cagagacccagcg

SEQ ID NO: 3396097 - RNA, 20 nt, Human
cagagacccucugccaccag

SEQ ID NO: 3396098 - RNA, 13 nt, Human
cagagaccguccu

SEQ ID NO: 3396099 - RNA, 18 nt, Human
cagagaccguccucaccc

SEQ ID NO: 3396100 - RNA, 18 nt, Human
cagagaccuccugccucc

SEQ ID NO: 3396101 - RNA, 15 nt, Human
cagagaccugaagug

SEQ ID NO: 3396102 - RNA, 23 nt, Human
cagagacuccugcaggcagccag

SEQ ID NO: 3396103 - RNA, 17 nt, Human
cagagacuuuagggggu

SEQ ID NO: 3396104 - RNA, 14 nt, Human
cagagacuuuguag

SEQ ID NO: 3396105 - RNA, 20 nt, Human
cagagagaaauaagugcccu

SEQ ID NO: 3396106 - RNA, 16 nt, Human
cagagagaagagcccc

SEQ ID NO: 3396107 - RNA, 17 nt, Human
cagagagaagagcccca

SEQ ID NO: 3396108 - RNA, 21 nt, Human
cagagagaagagccccacucu

SEQ ID NO: 3396109 - RNA, 16 nt, Human
cagagagaauggcuuu

SEQ ID NO: 3396110 - RNA, 22 nt, Human
cagagagacagacuugagaacu

SEQ ID NO: 3396111 - RNA, 16 nt, Human
cagagagacccuugug

SEQ ID NO: 3396112 - RNA, 20 nt, Human
cagagagagaagugccccug

SEQ ID NO: 3396113 - RNA, 11 nt, Human
cagagagcagu

SEQ ID NO: 3396114 - RNA, 12 nt, Human
cagagagcauua

SEQ ID NO: 3396115 - RNA, 19 nt, Human
cagagaggaaauucuccac

SEQ ID NO: 3396116 - RNA, 16 nt, Human
cagagaggacgugggc

SEQ ID NO: 3396117 - RNA, 13 nt, Human
cagagaggagaaa

SEQ ID NO: 3396118 - RNA, 17 nt, Human
cagagaggagaaacaca

SEQ ID NO: 3396119 - RNA, 20 nt, Human
cagagaggagucagagagaa

SEQ ID NO: 3396120 - RNA, 16 nt, Human
cagagaggccaggugc

SEQ ID NO: 3396121 - RNA, 18 nt, Human
cagagaggccaggugcag

SEQ ID NO: 3396122 - RNA, 13 nt, Human
cagagagggcagg

SEQ ID NO: 3396123 - RNA, 18 nt, Human
cagagagggcaggcauga

SEQ ID NO: 3396124 - RNA, 22 nt, Human
cagagagggggccaccucccca

SEQ ID NO: 3396125 - RNA, 16 nt, Human
cagagagggugggagu

SEQ ID NO: 3396126 - RNA, 20 nt, Human
cagagagggugggagugggc

SEQ ID NO: 3396127 - RNA, 23 nt, Human
cagagagggugggagugggccca

SEQ ID NO: 3396128 - RNA, 12 nt, Human
cagagaguccca

SEQ ID NO: 3396129 - RNA, 23 nt, Human
cagagagucccacugccucaggu

SEQ ID NO: 3396130 - RNA, 17 nt, Human
cagagaguccucuggau

SEQ ID NO: 3396131 - RNA, 19 nt, Human
cagagaguccucuggaugg

SEQ ID NO: 3396132 - RNA, 13 nt, Human
cagagaguggcuc

SEQ ID NO: 3396133 - RNA, 15 nt, Human
cagagaguggcuccu

SEQ ID NO: 3396134 - RNA, 20 nt, Human
cagagaugcaccaccaagcc

SEQ ID NO: 3396135 - RNA, 16 nt, Human
cagagaugccuccacc

SEQ ID NO: 3396136 - RNA, 15 nt, Human
cagagaugccucccu

SEQ ID NO: 3396137 - RNA, 23 nt, Human
cagagauggagguucucucggag

SEQ ID NO: 3396138 - RNA, 16 nt, Human
cagagauucugaacua

SEQ ID NO: 3396139 - RNA, 19 nt, Human
cagagauugaacuccaaga

SEQ ID NO: 3396140 - RNA, 16 nt, Human
cagagauugcuucuca

SEQ ID NO: 3396141 - RNA, 24 nt, Human
cagagauuggguuuuuggacuucu

SEQ ID NO: 3396142 - RNA, 19 nt, Human
cagagauuucucauugacu

SEQ ID NO: 3396143 - RNA, 14 nt, Human
cagagcaaaauaau

SEQ ID NO: 3396144 - RNA, 16 nt, Human
cagagcaaagggccag

SEQ ID NO: 3396145 - RNA, 17 nt, Human
cagagcaaagggccagg

SEQ ID NO: 3396146 - RNA, 20 nt, Human
cagagcaagauccugucuuu

SEQ ID NO: 3396147 - RNA, 15 nt, Human
cagagcaagucugca

SEQ ID NO: 3396148 - RNA, 18 nt, Human
cagagcaagucugcaggu

SEQ ID NO: 3396149 - RNA, 14 nt, Human
cagagcaagugaga

SEQ ID NO: 3396150 - RNA, 20 nt, Human
cagagcaagugagacccugu

SEQ ID NO: 3396151 - RNA, 21 nt, Human
cagagcacuagguucaauucc

SEQ ID NO: 3396152 - RNA, 16 nt, Human
cagagcacuguauacc

SEQ ID NO: 3396153 - RNA, 11 nt, Human
cagagcagaga

SEQ ID NO: 3396154 - RNA, 18 nt, Human
cagagcagagaccauccc

SEQ ID NO: 3396155 - RNA, 19 nt, Human
cagagcagagaccaucccu

SEQ ID NO: 3396156 - RNA, 15 nt, Human
cagagcagaugcaga

SEQ ID NO: 3396157 - RNA, 16 nt, Human
cagagcagaugcagag

SEQ ID NO: 3396158 - RNA, 12 nt, Human
cagagcaggacc

SEQ ID NO: 3396159 - RNA, 15 nt, Human
cagagcaggaccucc

SEQ ID NO: 3396160 - RNA, 22 nt, Human
cagcugccgggccugauuuggu

SEQ ID NO: 3396161 - RNA, 9 nt, Human
cagcugccu

SEQ ID NO: 3396162 - RNA, 23 nt, Human
cagcugccuaggauucacacccc

SEQ ID NO: 3396163 - RNA, 17 nt, Human
cagcugccucacuuccu

SEQ ID NO: 3396164 - RNA, 11 nt, Human
cagcugccucc

SEQ ID NO: 3396165 - RNA, 17 nt, Human
cagcugccuccccuccu

SEQ ID NO: 3396166 - RNA, 19 nt, Human
cagcugccuccccuccucu

SEQ ID NO: 3396167 - RNA, 12 nt, Human
cagcugccucuu

SEQ ID NO: 3396168 - RNA, 13 nt, Human
cagcugccucuuc

SEQ ID NO: 3396169 - RNA, 19 nt, Human
cagcugccucuucccucuu

SEQ ID NO: 3396170 - RNA, 12 nt, Human
cagcugccugca

SEQ ID NO: 3396171 - RNA, 22 nt, Human
cagcugccuggaagagcagccc

SEQ ID NO: 3396172 - RNA, 23 nt, Human
cagcugccugggaucccucaucc

SEQ ID NO: 3396173 - RNA, 19 nt, Human
cagcugcgcuugcuuuucu

SEQ ID NO: 3396174 - RNA, 20 nt, Human
cagcugcgguccacccagga

SEQ ID NO: 3396175 - RNA, 17 nt, Human
cagcugcuccccucccu

SEQ ID NO: 3396176 - RNA, 11 nt, Human
cagcugcucug

SEQ ID NO: 3396177 - RNA, 16 nt, Human
cagcugcugagccgca

SEQ ID NO: 3396178 - RNA, 19 nt, Human
cagcugcugagccgcagag

SEQ ID NO: 3396179 - RNA, 20 nt, Human
cagcugcugagccgcagaga

SEQ ID NO: 3396180 - RNA, 23 nt, Human
cagcugcuugugucccuccuggg

SEQ ID NO: 3396181 - RNA, 22 nt, Human
cagcugcuuuguuaccuuaaaa

SEQ ID NO: 3396182 - RNA, 23 nt, Human
cagcuggacagaggggacucugg

SEQ ID NO: 3396183 - RNA, 24 nt, Human
cagcuggacagaggggacucuggg

SEQ ID NO: 3396184 - RNA, 16 nt, Human
cagcuggacccugacc

SEQ ID NO: 3396185 - RNA, 17 nt, Human
cagcuggacccugacca

SEQ ID NO: 3396186 - RNA, 15 nt, Human
cagcuggacucugca

SEQ ID NO: 3396187 - RNA, 18 nt, Human
cagcuggagaaauauggu

SEQ ID NO: 3396188 - RNA, 13 nt, Human
cagcuggaggcag

SEQ ID NO: 3396189 - RNA, 22 nt, Human
cagcuggaggcaggggcuuccu

SEQ ID NO: 3396190 - RNA, 15 nt, Human
cagcuggauuggguu

SEQ ID NO: 3396191 - RNA, 15 nt, Human
cagcuggcagcagag

SEQ ID NO: 3396192 - RNA, 18 nt, Human
cagcuggcagcagagugu

SEQ ID NO: 3396193 - RNA, 16 nt, Human
cagcuggccgggagcc

SEQ ID NO: 3396194 - RNA, 16 nt, Human
cagcuggccuuuguaa

SEQ ID NO: 3396195 - RNA, 18 nt, Human
cagcuggcucuacuuccc

SEQ ID NO: 3396196 - RNA, 19 nt, Human
cagcugggagcuggcccgu

SEQ ID NO: 3396197 - RNA, 14 nt, Human
cagcugggaggcaa

SEQ ID NO: 3396198 - RNA, 23 nt, Human
cagcugggaggcaagaggggugg

SEQ ID NO: 3396199 - RNA, 23 nt, Human
cagcugggaucacauguggacuu

SEQ ID NO: 3396200 - RNA, 20 nt, Human
cagcugggccgggacccagg

SEQ ID NO: 3396201 - RNA, 23 nt, Human
cagcugggccgggacccagggcc

SEQ ID NO: 3396202 - RNA, 16 nt, Human
cagcugggcucugcaa

SEQ ID NO: 3396203 - RNA, 17 nt, Human
cagcugggcucugcaau

SEQ ID NO: 3396204 - RNA, 16 nt, Human
cagcugggcucugcca

SEQ ID NO: 3396205 - RNA, 14 nt, Human
cagcuggggccagg

SEQ ID NO: 3396206 - RNA, 14 nt, Human
cagcugggucaggc

SEQ ID NO: 3396207 - RNA, 20 nt, Human
cagcugggucaggcagggug

SEQ ID NO: 3396208 - RNA, 16 nt, Human
cagcuggguggcacug

SEQ ID NO: 3396209 - RNA, 16 nt, Human
cagcuggguuggaaaa

SEQ ID NO: 3396210 - RNA, 17 nt, Human
cagcuggguuggaaaac

SEQ ID NO: 3396211 - RNA, 23 nt, Human
cagcuggugcccugcuuucagau

SEQ ID NO: 3396212 - RNA, 22 nt, Human
cagcuggugggaagcgucuguc

SEQ ID NO: 3396213 - RNA, 11 nt, Human
cagcuggugua

SEQ ID NO: 3396214 - RNA, 15 nt, Human
cagcugguguagcua

SEQ ID NO: 3396215 - RNA, 19 nt, Human
cagcugguguagcuacaga

SEQ ID NO: 3396216 - RNA, 18 nt, Human
cagcugguugagguuuca

SEQ ID NO: 3396217 - RNA, 18 nt, Human
cagcuguaacacagcuga

SEQ ID NO: 3396218 - RNA, 22 nt, Human
cagcuguaagaagagacuggga

SEQ ID NO: 3396219 - RNA, 16 nt, Human
cagcugucaaggcuca

SEQ ID NO: 3396220 - RNA, 14 nt, Human
cagcugucaagggc

SEQ ID NO: 3396221 - RNA, 18 nt, Human
cagcugucaucaauuaaa

SEQ ID NO: 3396222 - RNA, 17 nt, Human
cagcuguccccccacuc

SEQ ID NO: 3396223 - RNA, 16 nt, Human
cagcugucccugucac

SEQ ID NO: 3396224 - RNA, 17 nt, Human
cagcugucccugucacc

SEQ ID NO: 3396225 - RNA, 18 nt, Human
cagcugucccugucacca

SEQ ID NO: 3396226 - RNA, 22 nt, Human
cagcugucccugucaccaagcu

SEQ ID NO: 3396227 - RNA, 16 nt, Human
cagcuguccugcagca

SEQ ID NO: 3396228 - RNA, 16 nt, Human
cagcugucuuuuggag

SEQ ID NO: 3396229 - RNA, 14 nt, Human
cagcugugccucgc

SEQ ID NO: 3396230 - RNA, 18 nt, Human
cagcugugcucuggacag

SEQ ID NO: 3396231 - RNA, 14 nt, Human
cagcugugcuuaug

SEQ ID NO: 3396232 - RNA, 12 nt, Human
cagcuguggcag

SEQ ID NO: 3396233 - RNA, 23 nt, Human
cagcuguggcagaguuacaguuc

SEQ ID NO: 3396234 - RNA, 22 nt, Human
cagcuguguccaaaaccgccag

SEQ ID NO: 3396235 - RNA, 15 nt, Human
cagcuguucagcugg

SEQ ID NO: 3396236 - RNA, 20 nt, Human
cagcuguucugucccuugga

SEQ ID NO: 3396237 - RNA, 23 nt, Human
cagcuguugacucuaguacugug

SEQ ID NO: 3396238 - RNA, 22 nt, Human
cagcuguugucucuucuccuua

SEQ ID NO: 3396239 - RNA, 15 nt, Human
cagcuguuugucaua

SEQ ID NO: 3396240 - RNA, 21 nt, Human
cagcuguuuuaguuaaauuuc

SEQ ID NO: 3396241 - RNA, 15 nt, Human
cagcuuaaaguaacc

SEQ ID NO: 3396242 - RNA, 18 nt, Human
cagcuuacacaaaucuau

SEQ ID NO: 3396243 - RNA, 14 nt, Human
cagcuuagauuuca

SEQ ID NO: 3396244 - RNA, 15 nt, Human
cagcuuagauuucau

SEQ ID NO: 3396245 - RNA, 17 nt, Human
cagcuuagggcccugga

SEQ ID NO: 3396246 - RNA, 16 nt, Human
cagcuuauucacaaga

SEQ ID NO: 3396247 - RNA, 14 nt, Human
cagcuuauugucua

SEQ ID NO: 3396248 - RNA, 20 nt, Human
cagcuuauugucuagugaaa

SEQ ID NO: 3396249 - RNA, 12 nt, Human
cagcuuauuguu

SEQ ID NO: 3396250 - RNA, 14 nt, Human
cagcuucaccagag

SEQ ID NO: 3396251 - RNA, 15 nt, Human
cagcuucacuucuga

SEQ ID NO: 3396252 - RNA, 16 nt, Human
cagcuucacuucugac

SEQ ID NO: 3396253 - RNA, 13 nt, Human
cagcuucagugau

SEQ ID NO: 3396254 - RNA, 20 nt, Human
cagcuucaugccuuuguaag

SEQ ID NO: 3396255 - RNA, 15 nt, Human
cagcuucauuugugu

SEQ ID NO: 3396256 - RNA, 17 nt, Human
cagcuucauuuguguca

SEQ ID NO: 3396257 - RNA, 11 nt, Human
cagcuuccagc

SEQ ID NO: 3396258 - RNA, 12 nt, Human
cagcuuccagca

SEQ ID NO: 3396259 - RNA, 17 nt, Human
cagcuuccccaguagcu

SEQ ID NO: 3396260 - RNA, 22 nt, Human
cagcuuccccucucuccuccug

SEQ ID NO: 3396261 - RNA, 23 nt, Human
cagcuuccccucucuccuccugc

SEQ ID NO: 3396262 - RNA, 14 nt, Human
cagcuuccuaccca

SEQ ID NO: 3396263 - RNA, 22 nt, Human
cagcuuccuacccacaccucug

SEQ ID NO: 3396264 - RNA, 12 nt, Human
cagcuuccuguc

SEQ ID NO: 3396265 - RNA, 13 nt, Human
cagcuuccuucag

SEQ ID NO: 3396266 - RNA, 18 nt, Human
cagcuucuauccuugacu

SEQ ID NO: 3396267 - RNA, 19 nt, Human
cagcuucuauuagccaguc

SEQ ID NO: 3396268 - RNA, 21 nt, Human
cagcuucucauccugcaggca

SEQ ID NO: 3396269 - RNA, 14 nt, Human
cagcuucuccaggc

SEQ ID NO: 3396270 - RNA, 13 nt, Human
cagcuucugccac

SEQ ID NO: 3396271 - RNA, 20 nt, Human
cagcuucugccacuucccag

SEQ ID NO: 3396272 - RNA, 23 nt, Human
cagcuucugccacuucccaggua

SEQ ID NO: 3396273 - RNA, 20 nt, Human
cagcuucugcccccugcaga

SEQ ID NO: 3396274 - RNA, 22 nt, Human
cagcuucuuaauauaacugccu

SEQ ID NO: 3396275 - RNA, 20 nt, Human
cagcuugaccgugaggccag

SEQ ID NO: 3396276 - RNA, 19 nt, Human
cagcuugaccugaggcugu

SEQ ID NO: 3396277 - RNA, 20 nt, Human
cagcuugaccugaggcugug

SEQ ID NO: 3396278 - RNA, 14 nt, Human
cagcuugagccggg

SEQ ID NO: 3396279 - RNA, 21 nt, Human
cagcuugccagaugcugcaga

SEQ ID NO: 3396280 - RNA, 13 nt, Human
cagcuugccccgg

SEQ ID NO: 3396281 - RNA, 19 nt, Human
cagcuugcugcccuaggcu

SEQ ID NO: 3396282 - RNA, 13 nt, Human
cagcuuggcucag

SEQ ID NO: 3396283 - RNA, 18 nt, Human
cagcuugggagagccccu

SEQ ID NO: 3396284 - RNA, 23 nt, Human
cagcuugggagagccccuggggc

SEQ ID NO: 3396285 - RNA, 13 nt, Human
cagcuugggcaga

SEQ ID NO: 3396286 - RNA, 16 nt, Human
cagcuugggcccagcu

SEQ ID NO: 3396287 - RNA, 17 nt, Human
cagcuuggggccaucgg

SEQ ID NO: 3396288 - RNA, 20 nt, Human
cagcuuguaaauagcucagg

SEQ ID NO: 3396289 - RNA, 21 nt, Human
cagcuuguaaauagcucaggu

SEQ ID NO: 3396290 - RNA, 22 nt, Human
cagcuuguaaauagcucaggug

SEQ ID NO: 3396291 - RNA, 17 nt, Human
cagcuuguggagcccca

SEQ ID NO: 3396292 - RNA, 15 nt, Human
cagcuuguguuguca

SEQ ID NO: 3396293 - RNA, 17 nt, Human
cagcuuguuauuuauaa

SEQ ID NO: 3396294 - RNA, 15 nt, Human
cagcuuguuuacaug

SEQ ID NO: 3396295 - RNA, 18 nt, Human
cagcuuguuuacaugcuu

SEQ ID NO: 3396296 - RNA, 18 nt, Human
cagcuuuaaacucaggga

SEQ ID NO: 3396297 - RNA, 22 nt, Human
cagcuuuaaacucagggacaga

SEQ ID NO: 3396298 - RNA, 18 nt, Human
cagcuuuagaaucccagc

SEQ ID NO: 3396299 - RNA, 19 nt, Human
cagcuuucccugccucuca

SEQ ID NO: 3396300 - RNA, 21 nt, Human
cagcuuucuugcucccuucag

SEQ ID NO: 3396301 - RNA, 16 nt, Human
cagcuuugagaagccu

SEQ ID NO: 3396302 - RNA, 16 nt, Human
cagcuuugaucccuga

SEQ ID NO: 3396303 - RNA, 20 nt, Human
cagcuuugaucccugacauc

SEQ ID NO: 3396304 - RNA, 19 nt, Human
caggaguguccucuucccu

SEQ ID NO: 3396305 - RNA, 22 nt, Human
caggaguucaagaccagccugg

SEQ ID NO: 3396306 - RNA, 23 nt, Human
caggaguucaagaccagccuggc

SEQ ID NO: 3396307 - RNA, 23 nt, Human
caggaguucgagaccagccuggc

SEQ ID NO: 3396308 - RNA, 19 nt, Human
caggaguucgaggcugcag

SEQ ID NO: 3396309 - RNA, 21 nt, Human
caggaguucgaggcugcaguc

SEQ ID NO: 3396310 - RNA, 16 nt, Human
caggaguuggaagugu

SEQ ID NO: 3396311 - RNA, 19 nt, Human
caggaguuucguuuucaaa

SEQ ID NO: 3396312 - RNA, 21 nt, Human
caggaguuugagaccaaccug

SEQ ID NO: 3396313 - RNA, 14 nt, Human
caggaguuuggcca

SEQ ID NO: 3396314 - RNA, 18 nt, Human
caggauaaacugaaaacu

SEQ ID NO: 3396315 - RNA, 14 nt, Human
caggauacaugugc

SEQ ID NO: 3396316 - RNA, 17 nt, Human
caggauacucugucaga

SEQ ID NO: 3396317 - RNA, 18 nt, Human
caggauacucugucagau

SEQ ID NO: 3396318 - RNA, 13 nt, Human
caggauagacuuu

SEQ ID NO: 3396319 - RNA, 14 nt, Human
caggauagagacug

SEQ ID NO: 3396320 - RNA, 17 nt, Human
caggauagauaacucuu

SEQ ID NO: 3396321 - RNA, 17 nt, Human
caggauauauuuuauuu

SEQ ID NO: 3396322 - RNA, 23 nt, Human
caggauaucacauuggagucacu

SEQ ID NO: 3396323 - RNA, 21 nt, Human
caggauauccuuaucagagcu

SEQ ID NO: 3396324 - RNA, 22 nt, Human
caggauauccuuaucagagcua

SEQ ID NO: 3396325 - RNA, 17 nt, Human
caggaucaguuaacuau

SEQ ID NO: 3396326 - RNA, 21 nt, Human
caggaucaugguguaauaaga

SEQ ID NO: 3396327 - RNA, 22 nt, Human
caggaucaugguguaauaagac

SEQ ID NO: 3396328 - RNA, 17 nt, Human
caggauccaagcuaagc

SEQ ID NO: 3396329 - RNA, 19 nt, Human
caggauccuauucucacca

SEQ ID NO: 3396330 - RNA, 20 nt, Human
caggauccuauucucaccag

SEQ ID NO: 3396331 - RNA, 22 nt, Human
caggauccuauucucaccagga

SEQ ID NO: 3396332 - RNA, 19 nt, Human
caggaucuauuuuuggagg

SEQ ID NO: 3396333 - RNA, 20 nt, Human
caggaucuauuuuuggaggu

SEQ ID NO: 3396334 - RNA, 21 nt, Human
caggaucuauuuuuggagguu

SEQ ID NO: 3396335 - RNA, 17 nt, Human
caggaucucaccaggca

SEQ ID NO: 3396336 - RNA, 18 nt, Human
caggaucucaccaggcag

SEQ ID NO: 3396337 - RNA, 19 nt, Human
caggaucucaccaggcagc

SEQ ID NO: 3396338 - RNA, 22 nt, Human
caggaucucaccaggcagccuc

SEQ ID NO: 3396339 - RNA, 16 nt, Human
caggaugaccuggaua

SEQ ID NO: 3396340 - RNA, 13 nt, Human
caggaugcccagg

SEQ ID NO: 3396341 - RNA, 22 nt, Human
caggaugcccagggccacucug

SEQ ID NO: 3396342 - RNA, 24 nt, Human
caggaugcccagggccacucugcc

SEQ ID NO: 3396343 - RNA, 13 nt, Human
caggaugcuggcc

SEQ ID NO: 3396344 - RNA, 23 nt, Human
caggauggccgggcgcgguggcu

SEQ ID NO: 3396345 - RNA, 24 nt, Human
caggauggccuggccagggccugg

SEQ ID NO: 3396346 - RNA, 23 nt, Human
caggauggcgcaggaacucaaua

SEQ ID NO: 3396347 - RNA, 18 nt, Human
caggaugggggcuggccu

SEQ ID NO: 3396348 - RNA, 15 nt, Human
caggaugguaauucu

SEQ ID NO: 3396349 - RNA, 15 nt, Human
caggauguguuugcu

SEQ ID NO: 3396350 - RNA, 17 nt, Human
caggauuccucuuuucu

SEQ ID NO: 3396351 - RNA, 20 nt, Human
caggauuccucuuuucucug

SEQ ID NO: 3396352 - RNA, 22 nt, Human
caggauucucaccagcuguguc

SEQ ID NO: 3396353 - RNA, 17 nt, Human
caggauucuuccucccu

SEQ ID NO: 3396354 - RNA, 20 nt, Human
caggauucuuccucccuccc

SEQ ID NO: 3396355 - RNA, 17 nt, Human
caggauugcgagagaug

SEQ ID NO: 3396356 - RNA, 21 nt, Human
caggauugcgagagaugugug

SEQ ID NO: 3396357 - RNA, 23 nt, Human
caggauugcgagagauguguguu

SEQ ID NO: 3396358 - RNA, 14 nt, Human
caggauuggggaag

SEQ ID NO: 3396359 - RNA, 15 nt, Human
caggauuuaaaaacu

SEQ ID NO: 3396360 - RNA, 22 nt, Human
caggauuugaacucagaucugu

SEQ ID NO: 3396361 - RNA, 15 nt, Human
caggauuugcacaga

SEQ ID NO: 3396362 - RNA, 22 nt, Human
caggauuugcacagaagcacau

SEQ ID NO: 3396363 - RNA, 16 nt, Human
caggauuuuaaucuuu

SEQ ID NO: 3396364 - RNA, 21 nt, Human
caggcaaacauuuucucuuag

SEQ ID NO: 3396365 - RNA, 11 nt, Human
caggcaaauca

SEQ ID NO: 3396366 - RNA, 15 nt, Human
caggcaacugaggca

SEQ ID NO: 3396367 - RNA, 19 nt, Human
caggcaacuucaguccugg

SEQ ID NO: 3396368 - RNA, 14 nt, Human
caggcaagcaccuc

SEQ ID NO: 3396369 - RNA, 14 nt, Human
caggcaaggcugug

SEQ ID NO: 3396370 - RNA, 17 nt, Human
caggcaaggcuguggac

SEQ ID NO: 3396371 - RNA, 22 nt, Human
caggcaaggucuggccucaggu

SEQ ID NO: 3396372 - RNA, 20 nt, Human
caggcaaugcuggcuguugg

SEQ ID NO: 3396373 - RNA, 22 nt, Human
caggcaauggccuaaacuucag

SEQ ID NO: 3396374 - RNA, 14 nt, Human
caggcacaaaauga

SEQ ID NO: 3396375 - RNA, 16 nt, Human
caggcacacaccacca

SEQ ID NO: 3396376 - RNA, 15 nt, Human
caggcacacacugug

SEQ ID NO: 3396377 - RNA, 12 nt, Human
caggcacacagc

SEQ ID NO: 3396378 - RNA, 14 nt, Human
caggcacagcacag

SEQ ID NO: 3396379 - RNA, 13 nt, Human
caggcacagcuga

SEQ ID NO: 3396380 - RNA, 15 nt, Human
caggcacagcugagu

SEQ ID NO: 3396381 - RNA, 15 nt, Human
caggcacaggcaggg

SEQ ID NO: 3396382 - RNA, 18 nt, Human
caggcacaggcagggcag

SEQ ID NO: 3396383 - RNA, 14 nt, Human
caggcaccaggcag

SEQ ID NO: 3396384 - RNA, 23 nt, Human
caggcacccaccaucaugucugg

SEQ ID NO: 3396385 - RNA, 18 nt, Human
caggcacccccuggagag

SEQ ID NO: 3396386 - RNA, 13 nt, Human
caggcacccuucu

SEQ ID NO: 3396387 - RNA, 21 nt, Human
caggcacccuucuuuccucuu

SEQ ID NO: 3396388 - RNA, 15 nt, Human
caggcaccucacaga

SEQ ID NO: 3396389 - RNA, 20 nt, Human
caggcacgaacccaccugcu

SEQ ID NO: 3396390 - RNA, 21 nt, Human
caggcacgaacccaccugcug

SEQ ID NO: 3396391 - RNA, 22 nt, Human
caggcacgaacccaccugcuga

SEQ ID NO: 3396392 - RNA, 16 nt, Human
caggcacggguggucc

SEQ ID NO: 3396393 - RNA, 18 nt, Human
caggcacggguggucccc

SEQ ID NO: 3396394 - RNA, 19 nt, Human
caggcacgggugguccccg

SEQ ID NO: 3396395 - RNA, 20 nt, Human
caggcacgggugguccccgu

SEQ ID NO: 3396396 - RNA, 23 nt, Human
caggcacgggugguccccguucc

SEQ ID NO: 3396397 - RNA, 16 nt, Human
caggcacugcccuggu

SEQ ID NO: 3396398 - RNA, 17 nt, Human
caggcacugcugcccag

SEQ ID NO: 3396399 - RNA, 21 nt, Human
caggcacuuggcagccuugug

SEQ ID NO: 3396400 - RNA, 13 nt, Human
caggcagaaagag

SEQ ID NO: 3396401 - RNA, 10 nt, Human
caggcagaca

SEQ ID NO: 3396402 - RNA, 14 nt, Human
caggcagacacgga

SEQ ID NO: 3396403 - RNA, 16 nt, Human
caggcagacuacacag

SEQ ID NO: 3396404 - RNA, 23 nt, Human
caggcagagaaucauacuuagca

SEQ ID NO: 3396405 - RNA, 14 nt, Human
caggcagagcccag

SEQ ID NO: 3396406 - RNA, 15 nt, Human
caggcagaggcccag

SEQ ID NO: 3396407 - RNA, 19 nt, Human
caggcagaggcccaggcug

SEQ ID NO: 3396408 - RNA, 21 nt, Human
caggcagaggcccaggcugcc

SEQ ID NO: 3396409 - RNA, 13 nt, Human
caggcagauccag

SEQ ID NO: 3396410 - RNA, 21 nt, Human
caggcagaucugugccccaug

SEQ ID NO: 3396411 - RNA, 11 nt, Human
caggcagcaga

SEQ ID NO: 3396412 - RNA, 16 nt, Human
caggcagcagacacau

SEQ ID NO: 3396413 - RNA, 17 nt, Human
caggcagcagacacaug

SEQ ID NO: 3396414 - RNA, 17 nt, Human
caggcagccagcaucug

SEQ ID NO: 3396415 - RNA, 21 nt, Human
caggcagccagcaucugggcc

SEQ ID NO: 3396416 - RNA, 16 nt, Human
caggcagccaggccac

SEQ ID NO: 3396417 - RNA, 17 nt, Human
caggcagccaggccaca

SEQ ID NO: 3396418 - RNA, 23 nt, Human
caggcagccagugcccugagcca

SEQ ID NO: 3396419 - RNA, 13 nt, Human
caggcagccucug

SEQ ID NO: 3396420 - RNA, 14 nt, Human
caggcagccucugg

SEQ ID NO: 3396421 - RNA, 15 nt, Human
caggcagccucuggg

SEQ ID NO: 3396422 - RNA, 18 nt, Human
caggcagccucugucagg

SEQ ID NO: 3396423 - RNA, 14 nt, Human
caggcagcgccaag

SEQ ID NO: 3396424 - RNA, 21 nt, Human
caggcagcucauaagagccac

SEQ ID NO: 3396425 - RNA, 14 nt, Human
caggcagcuuucua

SEQ ID NO: 3396426 - RNA, 17 nt, Human
caggcagcuuucuagaa

SEQ ID NO: 3396427 - RNA, 18 nt, Human
caggcagcuuucuagaag

SEQ ID NO: 3396428 - RNA, 13 nt, Human
caggcaggaacaa

SEQ ID NO: 3396429 - RNA, 20 nt, Human
caggcaggaacaaacagggc

SEQ ID NO: 3396430 - RNA, 20 nt, Human
caggcaggaaggcugagagg

SEQ ID NO: 3396431 - RNA, 18 nt, Human
caggcaggaagggcagga

SEQ ID NO: 3396432 - RNA, 21 nt, Human
caggcaggccaaggccuucuc

SEQ ID NO: 3396433 - RNA, 20 nt, Human
caggcaggcuaaggcgugga

SEQ ID NO: 3396434 - RNA, 23 nt, Human
caggcaggcuaaggcguggagcu

SEQ ID NO: 3396435 - RNA, 16 nt, Human
caggcaggcucccagg

SEQ ID NO: 3396436 - RNA, 11 nt, Human
caggcagggcu

SEQ ID NO: 3396437 - RNA, 12 nt, Human
caggcagggcuc

SEQ ID NO: 3396438 - RNA, 18 nt, Human
caggcagggcucuccugg

SEQ ID NO: 3396439 - RNA, 17 nt, Human
caggcaggggcccugca

SEQ ID NO: 3396440 - RNA, 23 nt, Human
caggcaggggcccugcagcucuc

SEQ ID NO: 3396441 - RNA, 21 nt, Human
caggcagggguggggguggag

SEQ ID NO: 3396442 - RNA, 22 nt, Human
caggcagggguggggguggagg

SEQ ID NO: 3396443 - RNA, 20 nt, Human
caggcagguagccaggggga

SEQ ID NO: 3396444 - RNA, 19 nt, Human
caggcagguccaggguuug

SEQ ID NO: 3396445 - RNA, 12 nt, Human
caggcaggucuu

SEQ ID NO: 3396446 - RNA, 14 nt, Human
caggcaggugccug

SEQ ID NO: 3396447 - RNA, 21 nt, Human
cagggaaguggggagaggugg

SEQ ID NO: 3396448 - RNA, 23 nt, Human
cagggaaugccugagugccuggc

SEQ ID NO: 3396449 - RNA, 15 nt, Human
cagggacacacagcc

SEQ ID NO: 3396450 - RNA, 20 nt, Human
cagggacaccagccaggcuc

SEQ ID NO: 3396451 - RNA, 17 nt, Human
cagggacaccugggaga

SEQ ID NO: 3396452 - RNA, 21 nt, Human
cagggacacgggcagccuggc

SEQ ID NO: 3396453 - RNA, 14 nt, Human
cagggacagagaca

SEQ ID NO: 3396454 - RNA, 17 nt, Human
cagggacagagacaccu

SEQ ID NO: 3396455 - RNA, 20 nt, Human
cagggacagagacaccugca

SEQ ID NO: 3396456 - RNA, 23 nt, Human
cagggacagagacaccugcaccu

SEQ ID NO: 3396457 - RNA, 13 nt, Human
cagggacagagcc

SEQ ID NO: 3396458 - RNA, 15 nt, Human
cagggacagagccau

SEQ ID NO: 3396459 - RNA, 16 nt, Human
cagggacagagccaug

SEQ ID NO: 3396460 - RNA, 17 nt, Human
cagggacagagccaugc

SEQ ID NO: 3396461 - RNA, 12 nt, Human
cagggacaggau

SEQ ID NO: 3396462 - RNA, 15 nt, Human
cagggaccaaggacc

SEQ ID NO: 3396463 - RNA, 18 nt, Human
cagggaccaaggaccccu

SEQ ID NO: 3396464 - RNA, 19 nt, Human
cagggaccaaggaccccuc

SEQ ID NO: 3396465 - RNA, 16 nt, Human
cagggaccacacccug

SEQ ID NO: 3396466 - RNA, 17 nt, Human
cagggaccacagcaagg

SEQ ID NO: 3396467 - RNA, 20 nt, Human
cagggaccacagcaaggcac

SEQ ID NO: 3396468 - RNA, 17 nt, Human
cagggacccacggagcc

SEQ ID NO: 3396469 - RNA, 14 nt, Human
cagggaccccugcc

SEQ ID NO: 3396470 - RNA, 15 nt, Human
cagggaccccugccc

SEQ ID NO: 3396471 - RNA, 16 nt, Human
cagggaccccugcccu

SEQ ID NO: 3396472 - RNA, 21 nt, Human
cagggaccuuuggagaccauu

SEQ ID NO: 3396473 - RNA, 22 nt, Human
cagggacucaucuuucccuccu

SEQ ID NO: 3396474 - RNA, 23 nt, Human
cagggacucaucuuucccuccuu

SEQ ID NO: 3396475 - RNA, 23 nt, Human
cagggacuguuccugucucagca

SEQ ID NO: 3396476 - RNA, 21 nt, Human
cagggacuucaggaucaaguc

SEQ ID NO: 3396477 - RNA, 13 nt, Human
cagggagaagcuc

SEQ ID NO: 3396478 - RNA, 12 nt, Human
cagggagacaga

SEQ ID NO: 3396479 - RNA, 19 nt, Human
cagggagaccgagcgcuuu

SEQ ID NO: 3396480 - RNA, 20 nt, Human
cagggagaccuggacacagg

SEQ ID NO: 3396481 - RNA, 21 nt, Human
cagggagaccuggacacaggc

SEQ ID NO: 3396482 - RNA, 22 nt, Human
cagggagacgguuuccagggag

SEQ ID NO: 3396483 - RNA, 19 nt, Human
cagggagagcccaggagcu

SEQ ID NO: 3396484 - RNA, 22 nt, Human
cagggagcggaaagcagcucaa

SEQ ID NO: 3396485 - RNA, 18 nt, Human
cagggagcugcaggggca

SEQ ID NO: 3396486 - RNA, 15 nt, Human
cagggagcugggccc

SEQ ID NO: 3396487 - RNA, 16 nt, Human
cagggagcugggcccg

SEQ ID NO: 3396488 - RNA, 17 nt, Human
cagggaggaagaagcuu

SEQ ID NO: 3396489 - RNA, 17 nt, Human
cagggaggacgcucucu

SEQ ID NO: 3396490 - RNA, 18 nt, Human
cagggaggacgcucucug

SEQ ID NO: 3396491 - RNA, 23 nt, Human
cagggaggagaggggaagggcca

SEQ ID NO: 3396492 - RNA, 15 nt, Human
cagggaggaggcaga

SEQ ID NO: 3396493 - RNA, 21 nt, Human
cagggaggaggcagagaagaa

SEQ ID NO: 3396494 - RNA, 18 nt, Human
cagggaggagguggcagc

SEQ ID NO: 3396495 - RNA, 19 nt, Human
cagggaggagguggcagcc

SEQ ID NO: 3396496 - RNA, 23 nt, Human
cagggaggagguggcagcccugu

SEQ ID NO: 3396497 - RNA, 22 nt, Human
cagggaggcaccauucaggaac

SEQ ID NO: 3396498 - RNA, 16 nt, Human
cagggaggcagccgcc

SEQ ID NO: 3396499 - RNA, 21 nt, Human
cagggaggcagccgccccauc

SEQ ID NO: 3396500 - RNA, 15 nt, Human
cagggaggccgaagc

SEQ ID NO: 3396501 - RNA, 13 nt, Human
cagggaggcuggu

SEQ ID NO: 3396502 - RNA, 16 nt, Human
cagggagggccugggc

SEQ ID NO: 3396503 - RNA, 19 nt, Human
cagggaggggccggcccug

SEQ ID NO: 3396504 - RNA, 20 nt, Human
cagggaggucaggcccugga

SEQ ID NO: 3396505 - RNA, 14 nt, Human
cagggagguggcug

SEQ ID NO: 3396506 - RNA, 20 nt, Human
cagggaggugugaggcagga

SEQ ID NO: 3396507 - RNA, 22 nt, Human
cagggaggugugaggcaggaga

SEQ ID NO: 3396508 - RNA, 22 nt, Human
cagggaguccgaaagggacuug

SEQ ID NO: 3396509 - RNA, 16 nt, Human
cagggagugcuggcuc

SEQ ID NO: 3396510 - RNA, 17 nt, Human
cagggagugcuggcuca

SEQ ID NO: 3396511 - RNA, 16 nt, Human
cagggaugagcaugga

SEQ ID NO: 3396512 - RNA, 21 nt, Human
cagggaugagcauggagcugg

SEQ ID NO: 3396513 - RNA, 16 nt, Human
cagggaugcccuggag

SEQ ID NO: 3396514 - RNA, 23 nt, Human
cagggaugcccuggagguggcug

SEQ ID NO: 3396515 - RNA, 17 nt, Human
cagggauuaaccucugc

SEQ ID NO: 3396516 - RNA, 19 nt, Human
cagggauuaaccucugcac

SEQ ID NO: 3396517 - RNA, 18 nt, Human
cagggauugauuuuaaaa

SEQ ID NO: 3396518 - RNA, 23 nt, Human
cagggcaaaauauucacugggcc

SEQ ID NO: 3396519 - RNA, 22 nt, Human
cagggcaaagccaggucccucu

SEQ ID NO: 3396520 - RNA, 23 nt, Human
cagggcaaagccaggucccucuc

SEQ ID NO: 3396521 - RNA, 14 nt, Human
cagggcaaaugaca

SEQ ID NO: 3396522 - RNA, 20 nt, Human
cagggcaaaugacaugcacu

SEQ ID NO: 3396523 - RNA, 15 nt, Human
cagggcaaggccauu

SEQ ID NO: 3396524 - RNA, 21 nt, Human
cagggcaaggguuaaggccug

SEQ ID NO: 3396525 - RNA, 23 nt, Human
cagggcaaggguuaaggccugaa

SEQ ID NO: 3396526 - RNA, 18 nt, Human
cagggcaaugaugaauga

SEQ ID NO: 3396527 - RNA, 14 nt, Human
cagggcacaccggg

SEQ ID NO: 3396528 - RNA, 15 nt, Human
cagggcacaccgggc

SEQ ID NO: 3396529 - RNA, 22 nt, Human
cagggcacaccgggcacucaga

SEQ ID NO: 3396530 - RNA, 23 nt, Human
cagggcacaccgggcacucagaa

SEQ ID NO: 3396531 - RNA, 22 nt, Human
cagggcacaggagcuaccugug

SEQ ID NO: 3396532 - RNA, 18 nt, Human
cagggcaccaagcccaca

SEQ ID NO: 3396533 - RNA, 21 nt, Human
cagggcacccuguggcccugg

SEQ ID NO: 3396534 - RNA, 12 nt, Human
cagggcacgugg

SEQ ID NO: 3396535 - RNA, 11 nt, Human
cagggcacugc

SEQ ID NO: 3396536 - RNA, 17 nt, Human
cagggcacuucacagag

SEQ ID NO: 3396537 - RNA, 20 nt, Human
cagggcacuucacagagugu

SEQ ID NO: 3396538 - RNA, 12 nt, Human
cagggcagagcc

SEQ ID NO: 3396539 - RNA, 16 nt, Human
cagggcagagccggga

SEQ ID NO: 3396540 - RNA, 12 nt, Human
cagggcagccag

SEQ ID NO: 3396541 - RNA, 17 nt, Human
cagggcagccagggaga

SEQ ID NO: 3396542 - RNA, 18 nt, Human
cagggcagccagggagag

SEQ ID NO: 3396543 - RNA, 22 nt, Human
cagggcagccagggagagccca

SEQ ID NO: 3396544 - RNA, 20 nt, Human
cagggcagccgucaccccug

SEQ ID NO: 3396545 - RNA, 21 nt, Human
cagggcagccucccccggcuc

SEQ ID NO: 3396546 - RNA, 17 nt, Human
cagggcagccugccugg

SEQ ID NO: 3396547 - RNA, 14 nt, Human
cagggcagcgccag

SEQ ID NO: 3396548 - RNA, 16 nt, Human
cagggcagcgccaggc

SEQ ID NO: 3396549 - RNA, 22 nt, Human
cagggcagcgccaggcugacca

SEQ ID NO: 3396550 - RNA, 22 nt, Human
cagggcagcugggcccaacccu

SEQ ID NO: 3396551 - RNA, 20 nt, Human
cagggcaggaccagcccacg

SEQ ID NO: 3396552 - RNA, 22 nt, Human
cagggcaggaccagcccacgcu

SEQ ID NO: 3396553 - RNA, 13 nt, Human
cagggcagggcca

SEQ ID NO: 3396554 - RNA, 16 nt, Human
cagggcagggcucuga

SEQ ID NO: 3396555 - RNA, 13 nt, Human
cagggcagguggg

SEQ ID NO: 3396556 - RNA, 15 nt, Human
cagggcaguaccuga

SEQ ID NO: 3396557 - RNA, 19 nt, Human
cagggcaguaccugagggu

SEQ ID NO: 3396558 - RNA, 16 nt, Human
cagggcaucuccagga

SEQ ID NO: 3396559 - RNA, 18 nt, Human
cagggcaucuccaggaag

SEQ ID NO: 3396560 - RNA, 15 nt, Human
cagggcaucuccugu

SEQ ID NO: 3396561 - RNA, 18 nt, Human
cagggcaucucugggcug

SEQ ID NO: 3396562 - RNA, 20 nt, Human
cagggcaucucugggcugga

SEQ ID NO: 3396563 - RNA, 14 nt, Human
cagggcaucuggga

SEQ ID NO: 3396564 - RNA, 15 nt, Human
cagggcaugaaauga

SEQ ID NO: 3396565 - RNA, 19 nt, Human
cagggccaaaagcuucccu

SEQ ID NO: 3396566 - RNA, 22 nt, Human
cagggccaaacgcugagccacc

SEQ ID NO: 3396567 - RNA, 13 nt, Human
cagggccaacccu

SEQ ID NO: 3396568 - RNA, 17 nt, Human
cagggccaacuugaggg

SEQ ID NO: 3396569 - RNA, 18 nt, Human
cagggccacgugccaggc

SEQ ID NO: 3396570 - RNA, 16 nt, Human
cagggccacucugccu

SEQ ID NO: 3396571 - RNA, 14 nt, Human
cagggccagccucu

SEQ ID NO: 3396572 - RNA, 15 nt, Human
cagggccagccucua

SEQ ID NO: 3396573 - RNA, 19 nt, Human
cagggccagccucuagagc

SEQ ID NO: 3396574 - RNA, 15 nt, Human
cagggccaguggggc

SEQ ID NO: 3396575 - RNA, 16 nt, Human
cagggccaguggggcc

SEQ ID NO: 3396576 - RNA, 19 nt, Human
cagggccaguggggccugu

SEQ ID NO: 3396577 - RNA, 20 nt, Human
cagggccaguggggccugug

SEQ ID NO: 3396578 - RNA, 16 nt, Human
cagggccaugcugagg

SEQ ID NO: 3396579 - RNA, 17 nt, Human
cagggccaugcugaggc

SEQ ID NO: 3396580 - RNA, 21 nt, Human
cagggccaugcugaggccugg

SEQ ID NO: 3396581 - RNA, 18 nt, Human
cagggccauggcucaggg

SEQ ID NO: 3396582 - RNA, 20 nt, Human
cagggccaugucagacacag

SEQ ID NO: 3396583 - RNA, 13 nt, Human
cagggcccagagc

SEQ ID NO: 3396584 - RNA, 14 nt, Human
cagggcccagagcc

SEQ ID NO: 3396585 - RNA, 18 nt, Human
cagggcccagagcccagc

SEQ ID NO: 3396586 - RNA, 19 nt, Human
cagggcccagagcccagcu

SEQ ID NO: 3396587 - RNA, 17 nt, Human
cagggcccagaggcuga

SEQ ID NO: 3396588 - RNA, 22 nt, Human
cagggccccagcacuaaagcag

SEQ ID NO: 3396589 - RNA, 16 nt, Human
cagggcccccaucuca

SEQ ID NO: 3396590 - RNA, 19 nt, Human
cauauagcaaaacuuuuaa

SEQ ID NO: 3396591 - RNA, 18 nt, Human
cauauaggugauguuugc

SEQ ID NO: 3396592 - RNA, 19 nt, Human
cauauaggugauguuugcu

SEQ ID NO: 3396593 - RNA, 15 nt, Human
cauauauaacaaugc

SEQ ID NO: 3396594 - RNA, 22 nt, Human
cauauauagacagcuuugacug

SEQ ID NO: 3396595 - RNA, 14 nt, Human
cauauauauacuau

SEQ ID NO: 3396596 - RNA, 22 nt, Human
cauauauauguuuuaagaggca

SEQ ID NO: 3396597 - RNA, 12 nt, Human
cauauauauuac

SEQ ID NO: 3396598 - RNA, 13 nt, Human
cauauauauuaca

SEQ ID NO: 3396599 - RNA, 18 nt, Human
cauauauuuuuauauuua

SEQ ID NO: 3396600 - RNA, 15 nt, Human
cauauauuuuuuaaa

SEQ ID NO: 3396601 - RNA, 21 nt, Human
cauauauuuuuuaaaauaagu

SEQ ID NO: 3396602 - RNA, 23 nt, Human
cauaucaaaaaguauuaaaacua

SEQ ID NO: 3396603 - RNA, 13 nt, Human
cauaucaguugag

SEQ ID NO: 3396604 - RNA, 14 nt, Human
cauauccaaguuug

SEQ ID NO: 3396605 - RNA, 12 nt, Human
cauauccugccu

SEQ ID NO: 3396606 - RNA, 21 nt, Human
cauauccuuuuagucugcaua

SEQ ID NO: 3396607 - RNA, 18 nt, Human
cauaucuaaccagugauu

SEQ ID NO: 3396608 - RNA, 21 nt, Human
cauaucuaguaugaaauuaua

SEQ ID NO: 3396609 - RNA, 13 nt, Human
cauaucucuaauu

SEQ ID NO: 3396610 - RNA, 15 nt, Human
cauaucugccuuuau

SEQ ID NO: 3396611 - RNA, 18 nt, Human
cauaucugccuuuauugu

SEQ ID NO: 3396612 - RNA, 20 nt, Human
cauaucugccuuuauugugu

SEQ ID NO: 3396613 - RNA, 20 nt, Human
cauaucuuaauauauuucua

SEQ ID NO: 3396614 - RNA, 20 nt, Human
cauaucuugcgaauccaagc

SEQ ID NO: 3396615 - RNA, 15 nt, Human
cauaucuuuauuaau

SEQ ID NO: 3396616 - RNA, 18 nt, Human
cauaugaaaauacaacuu

SEQ ID NO: 3396617 - RNA, 21 nt, Human
cauaugaacagcuguucaguu

SEQ ID NO: 3396618 - RNA, 14 nt, Human
cauaugaacuuuca

SEQ ID NO: 3396619 - RNA, 17 nt, Human
cauaugaauuguacaga

SEQ ID NO: 3396620 - RNA, 19 nt, Human
cauaugacaaauguuucua

SEQ ID NO: 3396621 - RNA, 15 nt, Human
cauaugacuugaucu

SEQ ID NO: 3396622 - RNA, 13 nt, Human
cauaugaggaugc

SEQ ID NO: 3396623 - RNA, 15 nt, Human
cauaugaucuguuuu

SEQ ID NO: 3396624 - RNA, 15 nt, Human
cauaugauguacaug

SEQ ID NO: 3396625 - RNA, 23 nt, Human
cauaugauugugcacauacuuga

SEQ ID NO: 3396626 - RNA, 21 nt, Human
cauaugauuucacuagaaaag

SEQ ID NO: 3396627 - RNA, 21 nt, Human
cauaugcaccuugugucugua

SEQ ID NO: 3396628 - RNA, 13 nt, Human
cauaugcagaaau

SEQ ID NO: 3396629 - RNA, 14 nt, Human
cauaugcagaaaua

SEQ ID NO: 3396630 - RNA, 20 nt, Human
cauaugcagaaauagacaaa

SEQ ID NO: 3396631 - RNA, 20 nt, Human
cauaugcauauuuuuuuucu

SEQ ID NO: 3396632 - RNA, 15 nt, Human
cauaugcccacauuu

SEQ ID NO: 3396633 - RNA, 23 nt, Human
cauaugcccacauuuagucucuu

SEQ ID NO: 3396634 - RNA, 20 nt, Human
cauaugccugggcagaagga

SEQ ID NO: 3396635 - RNA, 22 nt, Human
cauaugccuuggggaggacaaa

SEQ ID NO: 3396636 - RNA, 16 nt, Human
cauaugcuaccaccag

SEQ ID NO: 3396637 - RNA, 19 nt, Human
cauaugcuaccaccagcug

SEQ ID NO: 3396638 - RNA, 23 nt, Human
cauaugcuaccaccagcuguguc

SEQ ID NO: 3396639 - RNA, 11 nt, Human
cauauggaugu

SEQ ID NO: 3396640 - RNA, 16 nt, Human
cauauggauguuacuc

SEQ ID NO: 3396641 - RNA, 23 nt, Human
cauauggauuuucuauuguuacu

SEQ ID NO: 3396642 - RNA, 16 nt, Human
cauauggcccaguguc

SEQ ID NO: 3396643 - RNA, 14 nt, Human
cauauguaaaauaa

SEQ ID NO: 3396644 - RNA, 13 nt, Human
cauauguaaacau

SEQ ID NO: 3396645 - RNA, 14 nt, Human
cauauguaaacaua

SEQ ID NO: 3396646 - RNA, 15 nt, Human
cauauguaccaugua

SEQ ID NO: 3396647 - RNA, 21 nt, Human
cauaugucacuagaauggaua

SEQ ID NO: 3396648 - RNA, 13 nt, Human
cauauguuaagca

SEQ ID NO: 3396649 - RNA, 15 nt, Human
cauauguugcucagu

SEQ ID NO: 3396650 - RNA, 22 nt, Human
cauauguuucgcugauauaugu

SEQ ID NO: 3396651 - RNA, 14 nt, Human
cauauguuugguaa

SEQ ID NO: 3396652 - RNA, 13 nt, Human
cauauuaagaaug

SEQ ID NO: 3396653 - RNA, 14 nt, Human
cauauuaauacaau

SEQ ID NO: 3396654 - RNA, 23 nt, Human
cauauuaauacaaugaugcuauu

SEQ ID NO: 3396655 - RNA, 14 nt, Human
cauauuaauauauu

SEQ ID NO: 3396656 - RNA, 15 nt, Human
cauauuacaauauuu

SEQ ID NO: 3396657 - RNA, 16 nt, Human
cauauuacaauauuug

SEQ ID NO: 3396658 - RNA, 21 nt, Human
cauauuaccacagacauacua

SEQ ID NO: 3396659 - RNA, 22 nt, Human
cauauuacuguacaugggacua

SEQ ID NO: 3396660 - RNA, 18 nt, Human
cauauuagaaaacuuugu

SEQ ID NO: 3396661 - RNA, 20 nt, Human
cauauuagaaaacuuuguua

SEQ ID NO: 3396662 - RNA, 21 nt, Human
cauauuagaaaacuuuguuag

SEQ ID NO: 3396663 - RNA, 21 nt, Human
cauauuagacuucuguuuuca

SEQ ID NO: 3396664 - RNA, 19 nt, Human
cauauuagcgacaacagau

SEQ ID NO: 3396665 - RNA, 21 nt, Human
cauauuauuuuauguugcaua

SEQ ID NO: 3396666 - RNA, 15 nt, Human
cauauucaggaagcu

SEQ ID NO: 3396667 - RNA, 20 nt, Human
cauauucaggaagcucaggg

SEQ ID NO: 3396668 - RNA, 22 nt, Human
cauauucaggaagcucagggcc

SEQ ID NO: 3396669 - RNA, 23 nt, Human
cauauucauguaaacaaaauuua

SEQ ID NO: 3396670 - RNA, 16 nt, Human
cauauuccauauuuau

SEQ ID NO: 3396671 - RNA, 18 nt, Human
cauauuccugcagccugg

SEQ ID NO: 3396672 - RNA, 15 nt, Human
cauauucuaaaacca

SEQ ID NO: 3396673 - RNA, 13 nt, Human
cauauucugucug

SEQ ID NO: 3396674 - RNA, 15 nt, Human
cauauucuguuggaa

SEQ ID NO: 3396675 - RNA, 17 nt, Human
cauauucuguuggccag

SEQ ID NO: 3396676 - RNA, 22 nt, Human
cauauucuguuggccaguguga

SEQ ID NO: 3396677 - RNA, 17 nt, Human
cauauucuuucaauucu

SEQ ID NO: 3396678 - RNA, 20 nt, Human
cauauucuuuucugcaaaau

SEQ ID NO: 3396679 - RNA, 13 nt, Human
cauauugacuuuu

SEQ ID NO: 3396680 - RNA, 14 nt, Human
cauauugaugaaaa

SEQ ID NO: 3396681 - RNA, 20 nt, Human
cauauugaugaaaagauuua

SEQ ID NO: 3396682 - RNA, 14 nt, Human
cauauugcacaugu

SEQ ID NO: 3396683 - RNA, 15 nt, Human
cauauugcacauguc

SEQ ID NO: 3396684 - RNA, 19 nt, Human
cauauugcacaugucuuaa

SEQ ID NO: 3396685 - RNA, 17 nt, Human
cauauugcugagagaaa

SEQ ID NO: 3396686 - RNA, 19 nt, Human
cauauugcuuuuucuaaug

SEQ ID NO: 3396687 - RNA, 16 nt, Human
cauauuggaaaaauca

SEQ ID NO: 3396688 - RNA, 17 nt, Human
cauauuggcauggauuu

SEQ ID NO: 3396689 - RNA, 14 nt, Human
cauauugguauuca

SEQ ID NO: 3396690 - RNA, 16 nt, Human
cauauugguauucacu

SEQ ID NO: 3396691 - RNA, 17 nt, Human
cauauuguaaaacaggu

SEQ ID NO: 3396692 - RNA, 19 nt, Human
cauauuguaaaacagguag

SEQ ID NO: 3396693 - RNA, 12 nt, Human
cauauuguacac

SEQ ID NO: 3396694 - RNA, 15 nt, Human
cauauuguacacuuu

SEQ ID NO: 3396695 - RNA, 23 nt, Human
cauauuguacacuuuuuugggga

SEQ ID NO: 3396696 - RNA, 13 nt, Human
cauauugugccaa

SEQ ID NO: 3396697 - RNA, 22 nt, Human
cauauugugccaauauguauug

SEQ ID NO: 3396698 - RNA, 15 nt, Human
cauauuuaauguuuu

SEQ ID NO: 3396699 - RNA, 20 nt, Human
cauauuuaauguuuuaaaug

SEQ ID NO: 3396700 - RNA, 21 nt, Human
cauauuuaauguuuuaaaugu

SEQ ID NO: 3396701 - RNA, 16 nt, Human
cauauuuaccucagcc

SEQ ID NO: 3396702 - RNA, 19 nt, Human
cauauuuaccucagccugg

SEQ ID NO: 3396703 - RNA, 16 nt, Human
cauauuuacuaccuua

SEQ ID NO: 3396704 - RNA, 21 nt, Human
cauauuuauccaaaaugugua

SEQ ID NO: 3396705 - RNA, 18 nt, Human
cauauuuauuuucuuuug

SEQ ID NO: 3396706 - RNA, 15 nt, Human
cauauuugcauaugu

SEQ ID NO: 3396707 - RNA, 12 nt, Human
cauauuuggaag

SEQ ID NO: 3396708 - RNA, 19 nt, Human
cauauuuguaaaaugacaa

SEQ ID NO: 3396709 - RNA, 22 nt, Human
cauauuuguauaguugcuugcc

SEQ ID NO: 3396710 - RNA, 14 nt, Human
cauauuuguggaau

SEQ ID NO: 3396711 - RNA, 18 nt, Human
cauauuuuaaacagagga

SEQ ID NO: 3396712 - RNA, 17 nt, Human
cauauuuuauuacuguu

SEQ ID NO: 3396713 - RNA, 18 nt, Human
cauauuuuauuacuguuu

SEQ ID NO: 3396714 - RNA, 13 nt, Human
cauauuuucacag

SEQ ID NO: 3396715 - RNA, 18 nt, Human
cauauuuucaccauuuga

SEQ ID NO: 3396716 - RNA, 14 nt, Human
cauauuuuucaaaa

SEQ ID NO: 3396717 - RNA, 21 nt, Human
cauauuuuucacauaucuagu

SEQ ID NO: 3396718 - RNA, 18 nt, Human
cauauuuuuuuccuuaca

SEQ ID NO: 3396719 - RNA, 21 nt, Human
caucaaaaaaggcaguuacca

SEQ ID NO: 3396720 - RNA, 12 nt, Human
caucaaaagaca

SEQ ID NO: 3396721 - RNA, 14 nt, Human
caucaaaagacaau

SEQ ID NO: 3396722 - RNA, 16 nt, Human
caucaaaagacaauuc

SEQ ID NO: 3396723 - RNA, 18 nt, Human
caucaaaagacaauucuu

SEQ ID NO: 3396724 - RNA, 22 nt, Human
caucaaaagacaauucuuuaua

SEQ ID NO: 3396725 - RNA, 13 nt, Human
caucaaaaugcuu

SEQ ID NO: 3396726 - RNA, 17 nt, Human
caucaaacucuuaguua

SEQ ID NO: 3396727 - RNA, 16 nt, Human
caucaaaguggcaaaa

SEQ ID NO: 3396728 - RNA, 13 nt, Human
caucaaauaagaa

SEQ ID NO: 3396729 - RNA, 21 nt, Human
caucaaaugaauaaugccuuu

SEQ ID NO: 3396730 - RNA, 19 nt, Human
caucaacuaaaguuguacu

SEQ ID NO: 3396731 - RNA, 23 nt, Human
caucaacuaaaguuguacuuuaa

SEQ ID NO: 3396732 - RNA, 12 nt, Human
caucaacugaau

SEQ ID NO: 3396733 - RNA, 13 nt, Human
caucaagaagggc

SEQ ID NO: 3396734 - RNA, 20 nt, Human
caucaagaagggcugcauga

SEQ ID NO: 3396735 - RNA, 22 nt, Human
caucaagaagggcugcaugaug

SEQ ID NO: 3396736 - RNA, 13 nt, Human
caucaagacugga

SEQ ID NO: 3396737 - RNA, 15 nt, Human
caucaagacuggaag

SEQ ID NO: 3396738 - RNA, 17 nt, Human
caucaagagacugaguc

SEQ ID NO: 3396739 - RNA, 21 nt, Human
caucaagcacagaaggaggag

SEQ ID NO: 3396740 - RNA, 18 nt, Human
caucaaggcacugccuga

SEQ ID NO: 3396741 - RNA, 14 nt, Human
caucaaguaauaca

SEQ ID NO: 3396742 - RNA, 22 nt, Human
caucaaguuauugacaaacucu

SEQ ID NO: 3396743 - RNA, 19 nt, Human
caucaaguugugccaaauu

SEQ ID NO: 3396744 - RNA, 21 nt, Human
caucaauccugauuccucucu

SEQ ID NO: 3396745 - RNA, 22 nt, Human
caucaauggggccagucaggcc

SEQ ID NO: 3396746 - RNA, 16 nt, Human
caucaauguucauugu

SEQ ID NO: 3396747 - RNA, 11 nt, Human
caucaauuccc

SEQ ID NO: 3396748 - RNA, 17 nt, Human
caucacaagaacacaca

SEQ ID NO: 3396749 - RNA, 15 nt, Human
caucacacacaugga

SEQ ID NO: 3396750 - RNA, 12 nt, Human
caucacagaaug

SEQ ID NO: 3396751 - RNA, 14 nt, Human
caucacagcagccu

SEQ ID NO: 3396752 - RNA, 13 nt, Human
caucacagcuugu

SEQ ID NO: 3396753 - RNA, 20 nt, Human
caucacagggcagagccggg

SEQ ID NO: 3396754 - RNA, 19 nt, Human
caucacagggugggccucg

SEQ ID NO: 3396755 - RNA, 21 nt, Human
caucacaguuuugguugcuuu

SEQ ID NO: 3396756 - RNA, 22 nt, Human
caucacaguuuugguugcuuua

SEQ ID NO: 3396757 - RNA, 13 nt, Human
caucacauuuuug

SEQ ID NO: 3396758 - RNA, 14 nt, Human
caucaccuacucac

SEQ ID NO: 3396759 - RNA, 13 nt, Human
caucaccucaggc

SEQ ID NO: 3396760 - RNA, 17 nt, Human
caucaccuuagaccacc

SEQ ID NO: 3396761 - RNA, 23 nt, Human
caucaccuuagaccaccaagccu

SEQ ID NO: 3396762 - RNA, 16 nt, Human
caucaccuuaggcagg

SEQ ID NO: 3396763 - RNA, 19 nt, Human
caucaccuuaggcagggaa

SEQ ID NO: 3396764 - RNA, 22 nt, Human
caucaccuuaggcagggaagug

SEQ ID NO: 3396765 - RNA, 16 nt, Human
caucacuauccaugca

SEQ ID NO: 3396766 - RNA, 15 nt, Human
caucacuccccucca

SEQ ID NO: 3396767 - RNA, 16 nt, Human
caucacucugcugcuu

SEQ ID NO: 3396768 - RNA, 23 nt, Human
caucacugaguuuuccauggcag

SEQ ID NO: 3396769 - RNA, 12 nt, Human
caucacuguauc

SEQ ID NO: 3396770 - RNA, 13 nt, Human
caucacuguggcu

SEQ ID NO: 3396771 - RNA, 22 nt, Human
caucacuuaacggaccaaagca

SEQ ID NO: 3396772 - RNA, 14 nt, Human
caucagaaaggaau

SEQ ID NO: 3396773 - RNA, 12 nt, Human
caucagaacagc

SEQ ID NO: 3396774 - RNA, 15 nt, Human
caucagaaggagaag

SEQ ID NO: 3396775 - RNA, 23 nt, Human
caucagaaggagaaggaaggaga

SEQ ID NO: 3396776 - RNA, 17 nt, Human
caucagagcaaauuugg

SEQ ID NO: 3396777 - RNA, 23 nt, Human
caucagauaagacauaucucuaa

SEQ ID NO: 3396778 - RNA, 19 nt, Human
caucagauggaaauauuuu

SEQ ID NO: 3396779 - RNA, 17 nt, Human
caucagcacgauuucug

SEQ ID NO: 3396780 - RNA, 21 nt, Human
caucagcacgauuucuguuua

SEQ ID NO: 3396781 - RNA, 12 nt, Human
caucagccagcu

SEQ ID NO: 3396782 - RNA, 16 nt, Human
caucagcuauucaguu

SEQ ID NO: 3396783 - RNA, 14 nt, Human
caucagcuccagcu

SEQ ID NO: 3396784 - RNA, 17 nt, Human
caucagcugcugaaaca

SEQ ID NO: 3396785 - RNA, 19 nt, Human
caucagcuguaagaagaga

SEQ ID NO: 3396786 - RNA, 23 nt, Human
caucagcuguaagaagagacugg

SEQ ID NO: 3396787 - RNA, 20 nt, Human
caucagcuugcccuguuaaa

SEQ ID NO: 3396788 - RNA, 14 nt, Human
caucaggacccugg

SEQ ID NO: 3396789 - RNA, 13 nt, Human
caucaggacucuu

SEQ ID NO: 3396790 - RNA, 13 nt, Human
caucaggaugaac

SEQ ID NO: 3396791 - RNA, 14 nt, Human
caucaggccaggcc

SEQ ID NO: 3396792 - RNA, 15 nt, Human
caucaggccaggccc

SEQ ID NO: 3396793 - RNA, 19 nt, Human
caucaggccuagaggccug

SEQ ID NO: 3396794 - RNA, 11 nt, Human
caucaggcuuu

SEQ ID NO: 3396795 - RNA, 12 nt, Human
caucagggccug

SEQ ID NO: 3396796 - RNA, 12 nt, Human
caucagggggaa

SEQ ID NO: 3396797 - RNA, 14 nt, Human
caucagggggaaga

SEQ ID NO: 3396798 - RNA, 19 nt, Human
caucagggggaagaagcag

SEQ ID NO: 3396799 - RNA, 19 nt, Human
caucaggguaggcuggagu

SEQ ID NO: 3396800 - RNA, 15 nt, Human
caucaggugaggugu

SEQ ID NO: 3396801 - RNA, 16 nt, Human
caucagguuccauccc

SEQ ID NO: 3396802 - RNA, 15 nt, Human
caucaguacuuguuu

SEQ ID NO: 3396803 - RNA, 16 nt, Human
caucaguauugaagca

SEQ ID NO: 3396804 - RNA, 22 nt, Human
caucaguauugaagcauuuuau

SEQ ID NO: 3396805 - RNA, 22 nt, Human
caucaguguacccccgcccagg

SEQ ID NO: 3396806 - RNA, 23 nt, Human
caucaguguacccccgcccaggc

SEQ ID NO: 3396807 - RNA, 24 nt, Human
caucaguguacccccgcccaggcu

SEQ ID NO: 3396808 - RNA, 22 nt, Human
caucaguuacucugaagggcau

SEQ ID NO: 3396809 - RNA, 16 nt, Human
caucaguuagagcuga

SEQ ID NO: 3396810 - RNA, 18 nt, Human
caucauaaaauaaaguau

SEQ ID NO: 3396811 - RNA, 15 nt, Human
caucauacacuuccu

SEQ ID NO: 3396812 - RNA, 16 nt, Human
caucauauuauacaga

SEQ ID NO: 3396813 - RNA, 19 nt, Human
caucaucaaggcacugccu

SEQ ID NO: 3396814 - RNA, 20 nt, Human
caucaucaaggcacugccug

SEQ ID NO: 3396815 - RNA, 14 nt, Human
caucaucagggccu

SEQ ID NO: 3396816 - RNA, 18 nt, Human
caucaucauggccagcug

SEQ ID NO: 3396817 - RNA, 24 nt, Human
caucaucauggccagcuggaggca

SEQ ID NO: 3396818 - RNA, 13 nt, Human
caucaucccagcu

SEQ ID NO: 3396819 - RNA, 15 nt, Human
caucaucccagcugc

SEQ ID NO: 3396820 - RNA, 14 nt, Human
caucaucucagcuc

SEQ ID NO: 3396821 - RNA, 13 nt, Human
caucaucugggaa

SEQ ID NO: 3396822 - RNA, 22 nt, Human
caucaucugggaacuugucaca

SEQ ID NO: 3396823 - RNA, 23 nt, Human
caucaucugggaacuugucacag

SEQ ID NO: 3396824 - RNA, 19 nt, Human
caucaucuguaagcuguuu

SEQ ID NO: 3396825 - RNA, 17 nt, Human
caucaugaccagcaaau

SEQ ID NO: 3396826 - RNA, 16 nt, Human
caucaugaguucugcu

SEQ ID NO: 3396827 - RNA, 18 nt, Human
caucaugaguucugcuga

SEQ ID NO: 3396828 - RNA, 13 nt, Human
caucaugcagcuc

SEQ ID NO: 3396829 - RNA, 12 nt, Human
caucaugcaugu

SEQ ID NO: 3396830 - RNA, 17 nt, Human
caucaugccucugaggc

SEQ ID NO: 3396831 - RNA, 21 nt, Human
caucaugcuggaaccugcaaa

SEQ ID NO: 3396832 - RNA, 13 nt, Human
caucauggccagc

SEQ ID NO: 3396833 - RNA, 22 nt, Human
caucauguccccaaaccugcaa

SEQ ID NO: 3396834 - RNA, 13 nt, Human
caucauguuuaca

SEQ ID NO: 3396835 - RNA, 10 nt, Human
caucauuaga

SEQ ID NO: 3396836 - RNA, 17 nt, Human
caucauuauaaacguga

SEQ ID NO: 3396837 - RNA, 14 nt, Human
caucauuauuuaug

SEQ ID NO: 3396838 - RNA, 17 nt, Human
caucauucacuucacug

SEQ ID NO: 3396839 - RNA, 18 nt, Human
caucauucacuucacugu

SEQ ID NO: 3396840 - RNA, 15 nt, Human
caucauuccaggccc

SEQ ID NO: 3396841 - RNA, 23 nt, Human
caucauucccucucaucucaggu

SEQ ID NO: 3396842 - RNA, 22 nt, Human
caucauuccuugagaaaaacaa

SEQ ID NO: 3396843 - RNA, 12 nt, Human
caucauucucug

SEQ ID NO: 3396844 - RNA, 14 nt, Human
caucauucucuguc

SEQ ID NO: 3396845 - RNA, 15 nt, Human
caucauucucugucu

SEQ ID NO: 3396846 - RNA, 16 nt, Human
caucauucucugucuc

SEQ ID NO: 3396847 - RNA, 21 nt, Human
caucauucucugucucaucca

SEQ ID NO: 3396848 - RNA, 13 nt, Human
caucauugaaauc

SEQ ID NO: 3396849 - RNA, 15 nt, Human
caucauugaaaucuu

SEQ ID NO: 3396850 - RNA, 20 nt, Human
caucauugaaaucuuuuugc

SEQ ID NO: 3396851 - RNA, 18 nt, Human
caucauugcugucugcag

SEQ ID NO: 3396852 - RNA, 15 nt, Human
caucauuguauauau

SEQ ID NO: 3396853 - RNA, 19 nt, Human
caucauuguauauaugugu

SEQ ID NO: 3396854 - RNA, 12 nt, Human
caucauuucaag

SEQ ID NO: 3396855 - RNA, 16 nt, Human
caucauuuugcauuca

SEQ ID NO: 3396856 - RNA, 22 nt, Human
caucauuuugcauucaaauuaa

SEQ ID NO: 3396857 - RNA, 17 nt, Human
cauccaaaaucuugauc

SEQ ID NO: 3396858 - RNA, 16 nt, Human
cauccaaagcagacag

SEQ ID NO: 3396859 - RNA, 21 nt, Human
cauccaaagcagacagcucca

SEQ ID NO: 3396860 - RNA, 16 nt, Human
cauccaacuccagcaa

SEQ ID NO: 3396861 - RNA, 17 nt, Human
cauccaacuccagcaac

SEQ ID NO: 3396862 - RNA, 17 nt, Human
cauccaagagugcgccg

SEQ ID NO: 3396863 - RNA, 22 nt, Human
cauccaaggaagggauguauuu

SEQ ID NO: 3396864 - RNA, 15 nt, Human
cauccaaguggcaua

SEQ ID NO: 3396865 - RNA, 14 nt, Human
cauccaaguggccu

SEQ ID NO: 3396866 - RNA, 14 nt, Human
cauccaaguuaaau

SEQ ID NO: 3396867 - RNA, 17 nt, Human
cauccaauaggaaugcu

SEQ ID NO: 3396868 - RNA, 13 nt, Human
cauccaauccuca

SEQ ID NO: 3396869 - RNA, 17 nt, Human
cauccaauccucacugg

SEQ ID NO: 3396870 - RNA, 19 nt, Human
cauccaauccucacugggu

SEQ ID NO: 3396871 - RNA, 21 nt, Human
cauccaauccucacugggugg

SEQ ID NO: 3396872 - RNA, 18 nt, Human
cauccacacacgcaggaa

SEQ ID NO: 3396873 - RNA, 14 nt, Human
cauccacacaugaa

SEQ ID NO: 3396874 - RNA, 17 nt, Human
cauccacaugggagccg

SEQ ID NO: 3396875 - RNA, 18 nt, Human
cauccacauuguuuuaaa

SEQ ID NO: 3396876 - RNA, 12 nt, Human
cauccaccccag

SEQ ID NO: 3396877 - RNA, 17 nt, Human
cauccaccguccccucc

SEQ ID NO: 3396878 - RNA, 15 nt, Human
cauccaccuccuucu

SEQ ID NO: 3396879 - RNA, 22 nt, Human
cauccacuagugcaaaucauag

SEQ ID NO: 3396880 - RNA, 18 nt, Human
cauccacucuacccuccc

SEQ ID NO: 3396881 - RNA, 18 nt, Human
caucucugggcuggauga

SEQ ID NO: 3396882 - RNA, 13 nt, Human
caucucuguccca

SEQ ID NO: 3396883 - RNA, 17 nt, Human
caucucuuagcuccccu

SEQ ID NO: 3396884 - RNA, 19 nt, Human
caucucuuagcuccccucc

SEQ ID NO: 3396885 - RNA, 23 nt, Human
caucucuuccuacccaaccacuc

SEQ ID NO: 3396886 - RNA, 16 nt, Human
caucugaaagccacgu

SEQ ID NO: 3396887 - RNA, 14 nt, Human
caucugaaaguaga

SEQ ID NO: 3396888 - RNA, 22 nt, Human
caucugaaggggcaaauucuuu

SEQ ID NO: 3396889 - RNA, 18 nt, Human
caucugaauuugcccugg

SEQ ID NO: 3396890 - RNA, 16 nt, Human
caucugacacaaaaaa

SEQ ID NO: 3396891 - RNA, 15 nt, Human
caucugaccagcagc

SEQ ID NO: 3396892 - RNA, 17 nt, Human
caucugaccucuaccuu

SEQ ID NO: 3396893 - RNA, 14 nt, Human
caucugagaaugaa

SEQ ID NO: 3396894 - RNA, 23 nt, Human
caucugagagaggcuaaaauguu

SEQ ID NO: 3396895 - RNA, 18 nt, Human
caucugaggcauccagca

SEQ ID NO: 3396896 - RNA, 23 nt, Human
caucugagguccugugaucuuau

SEQ ID NO: 3396897 - RNA, 21 nt, Human
caucugaguccuggaugauac

SEQ ID NO: 3396898 - RNA, 19 nt, Human
caucugauuugcauauuca

SEQ ID NO: 3396899 - RNA, 16 nt, Human
caucugcaccccuucu

SEQ ID NO: 3396900 - RNA, 22 nt, Human
caucugcaccccuucucuccuc

SEQ ID NO: 3396901 - RNA, 23 nt, Human
caucugcacccucgaugaagccc

SEQ ID NO: 3396902 - RNA, 13 nt, Human
caucugcacccuu

SEQ ID NO: 3396903 - RNA, 15 nt, Human
caucugcacccuucu

SEQ ID NO: 3396904 - RNA, 18 nt, Human
caucugcacccuucuuuu

SEQ ID NO: 3396905 - RNA, 19 nt, Human
caucugcauuuucacccca

SEQ ID NO: 3396906 - RNA, 19 nt, Human
caucugcccaacuguguag

SEQ ID NO: 3396907 - RNA, 22 nt, Human
caucugcccaacuguguagcau

SEQ ID NO: 3396908 - RNA, 11 nt, Human
caucugcccag

SEQ ID NO: 3396909 - RNA, 14 nt, Human
caucugcccaggac

SEQ ID NO: 3396910 - RNA, 22 nt, Human
caucugcccaggacggggccgg

SEQ ID NO: 3396911 - RNA, 21 nt, Human
caucugcccaggggugccccc

SEQ ID NO: 3396912 - RNA, 15 nt, Human
caucugccccucccc

SEQ ID NO: 3396913 - RNA, 16 nt, Human
caucugccccuccccc

SEQ ID NO: 3396914 - RNA, 17 nt, Human
caucugccccuccccca

SEQ ID NO: 3396915 - RNA, 18 nt, Human
caucugccccucccccaa

SEQ ID NO: 3396916 - RNA, 19 nt, Human
caucugccccucccccaac

SEQ ID NO: 3396917 - RNA, 12 nt, Human
caucugcccgcc

SEQ ID NO: 3396918 - RNA, 13 nt, Human
caucugcccgccu

SEQ ID NO: 3396919 - RNA, 22 nt, Human
caucugcccgccugcccaccug

SEQ ID NO: 3396920 - RNA, 23 nt, Human
caucugcccgccugcccaccugc

SEQ ID NO: 3396921 - RNA, 12 nt, Human
caucugcuaaua

SEQ ID NO: 3396922 - RNA, 14 nt, Human
caucugcuccugga

SEQ ID NO: 3396923 - RNA, 19 nt, Human
caucugcugguccguggga

SEQ ID NO: 3396924 - RNA, 16 nt, Human
caucugcuucaggccc

SEQ ID NO: 3396925 - RNA, 22 nt, Human
caucuggaaaauaaaaggucua

SEQ ID NO: 3396926 - RNA, 17 nt, Human
caucuggaaccaucaga

SEQ ID NO: 3396927 - RNA, 21 nt, Human
caucuggaagaucauuuugaa

SEQ ID NO: 3396928 - RNA, 23 nt, Human
caucuggauaggagccugcuggu

SEQ ID NO: 3396929 - RNA, 23 nt, Human
caucuggccguugauguuggcug

SEQ ID NO: 3396930 - RNA, 12 nt, Human
caucuggccugg

SEQ ID NO: 3396931 - RNA, 15 nt, Human
caucuggccuggcca

SEQ ID NO: 3396932 - RNA, 17 nt, Human
caucuggccuggccugg

SEQ ID NO: 3396933 - RNA, 20 nt, Human
caucuggccuuacaccucgu

SEQ ID NO: 3396934 - RNA, 14 nt, Human
caucuggcucuaau

SEQ ID NO: 3396935 - RNA, 23 nt, Human
caucuggcuuauuuuaaugugau

SEQ ID NO: 3396936 - RNA, 12 nt, Human
caucugggaaag

SEQ ID NO: 3396937 - RNA, 18 nt, Human
caucugggccuuggccug

SEQ ID NO: 3396938 - RNA, 23 nt, Human
caucugggccuuggccuggagca

SEQ ID NO: 3396939 - RNA, 17 nt, Human
caucugggcuccuccag

SEQ ID NO: 3396940 - RNA, 19 nt, Human
caucuggggagcaggcagc

SEQ ID NO: 3396941 - RNA, 23 nt, Human
caucuggggagcaggcagccagc

SEQ ID NO: 3396942 - RNA, 15 nt, Human
caucugggggagugg

SEQ ID NO: 3396943 - RNA, 20 nt, Human
caucuggguagcuguaaggc

SEQ ID NO: 3396944 - RNA, 15 nt, Human
caucuggguccuugc

SEQ ID NO: 3396945 - RNA, 20 nt, Human
caucugguagaagggaaagc

SEQ ID NO: 3396946 - RNA, 22 nt, Human
caucuguaaaucuacacacggu

SEQ ID NO: 3396947 - RNA, 16 nt, Human
caucuguaacucuaaa

SEQ ID NO: 3396948 - RNA, 17 nt, Human
caucuguaccucugccu

SEQ ID NO: 3396949 - RNA, 21 nt, Human
caucuguacuugguccaacug

SEQ ID NO: 3396950 - RNA, 19 nt, Human
caucuguauacccucuguu

SEQ ID NO: 3396951 - RNA, 20 nt, Human
caucuguauacccucuguuu

SEQ ID NO: 3396952 - RNA, 21 nt, Human
caucuguauacccucuguuuc

SEQ ID NO: 3396953 - RNA, 13 nt, Human
caucugucccccu

SEQ ID NO: 3396954 - RNA, 15 nt, Human
caucugucccccuuu

SEQ ID NO: 3396955 - RNA, 17 nt, Human
caucugucccuccggga

SEQ ID NO: 3396956 - RNA, 14 nt, Human
caucugucuaaaga

SEQ ID NO: 3396957 - RNA, 23 nt, Human
caucugucugccaaccuaaaacu

SEQ ID NO: 3396958 - RNA, 23 nt, Human
caucugucuggaggggagcucug

SEQ ID NO: 3396959 - RNA, 18 nt, Human
caucugugaaaggaaaga

SEQ ID NO: 3396960 - RNA, 14 nt, Human
caucugugauggga

SEQ ID NO: 3396961 - RNA, 17 nt, Human
caucugugcacugccca

SEQ ID NO: 3396962 - RNA, 21 nt, Human
caucugugcacugcccaugga

SEQ ID NO: 3396963 - RNA, 17 nt, Human
caucuguguuucaagug

SEQ ID NO: 3396964 - RNA, 19 nt, Human
caucuguguuucaaguggg

SEQ ID NO: 3396965 - RNA, 18 nt, Human
caucuguuacacaaagaa

SEQ ID NO: 3396966 - RNA, 16 nt, Human
caucuguuagggccuu

SEQ ID NO: 3396967 - RNA, 15 nt, Human
caucuuaacucuuug

SEQ ID NO: 3396968 - RNA, 23 nt, Human
caucuuagagcaaagagccagca

SEQ ID NO: 3396969 - RNA, 21 nt, Human
caucuuagguuggcaaaaagg

SEQ ID NO: 3396970 - RNA, 22 nt, Human
caucuuagguuggcaaaaaggc

SEQ ID NO: 3396971 - RNA, 20 nt, Human
caucuuaguauuugcauauu

SEQ ID NO: 3396972 - RNA, 21 nt, Human
caucuuaugcuaacuguagau

SEQ ID NO: 3396973 - RNA, 15 nt, Human
caucuuauucagcac

SEQ ID NO: 3396974 - RNA, 17 nt, Human
caucuucacccaggccu

SEQ ID NO: 3396975 - RNA, 18 nt, Human
caucuucacccaggccua

SEQ ID NO: 3396976 - RNA, 23 nt, Human
caucuucaguugucucugaugca

SEQ ID NO: 3396977 - RNA, 22 nt, Human
caucuuccacaggucucagaau

SEQ ID NO: 3396978 - RNA, 14 nt, Human
caucuuccaggugg

SEQ ID NO: 3396979 - RNA, 14 nt, Human
caucuucccaaccc

SEQ ID NO: 3396980 - RNA, 12 nt, Human
caucuucccagc

SEQ ID NO: 3396981 - RNA, 14 nt, Human
caucuucccagcag

SEQ ID NO: 3396982 - RNA, 14 nt, Human
caucuuccuguguc

SEQ ID NO: 3396983 - RNA, 17 nt, Human
caucuuccuguguccug

SEQ ID NO: 3396984 - RNA, 14 nt, Human
caucuucgggacca

SEQ ID NO: 3396985 - RNA, 18 nt, Human
caucuucgggaccaggau

SEQ ID NO: 3396986 - RNA, 17 nt, Human
caucuucgucuucacuc

SEQ ID NO: 3396987 - RNA, 12 nt, Human
caucuucucagc

SEQ ID NO: 3396988 - RNA, 14 nt, Human
caucuucucagcuc

SEQ ID NO: 3396989 - RNA, 17 nt, Human
caucuucugccuuaguc

SEQ ID NO: 3396990 - RNA, 22 nt, Human
caucuucuuugcagccugggug

SEQ ID NO: 3396991 - RNA, 20 nt, Human
caucuugaagggcccaggag

SEQ ID NO: 3396992 - RNA, 16 nt, Human
caucuugaauuguaag

SEQ ID NO: 3396993 - RNA, 21 nt, Human
caucuugaauuguaaggaaug

SEQ ID NO: 3396994 - RNA, 20 nt, Human
caucuugacagagccugccc

SEQ ID NO: 3396995 - RNA, 21 nt, Human
caucuugaucugcucagcccu

SEQ ID NO: 3396996 - RNA, 22 nt, Human
caucuugaucugcucagcccug

SEQ ID NO: 3396997 - RNA, 16 nt, Human
caucuugcauuaugca

SEQ ID NO: 3396998 - RNA, 13 nt, Human
caucuugccucca

SEQ ID NO: 3396999 - RNA, 16 nt, Human
caucuugccuccaggu

SEQ ID NO: 3397000 - RNA, 23 nt, Human
caucuugccuccaggugcagagg

SEQ ID NO: 3397001 - RNA, 17 nt, Human
caucuugcuaccaguau

SEQ ID NO: 3397002 - RNA, 23 nt, Human
caucuugcuaccaguauuuagaa

SEQ ID NO: 3397003 - RNA, 13 nt, Human
caucuugcucugc

SEQ ID NO: 3397004 - RNA, 20 nt, Human
caucuugcucugcugacaga

SEQ ID NO: 3397005 - RNA, 13 nt, Human
caucuugcuuccc

SEQ ID NO: 3397006 - RNA, 12 nt, Human
caucuugguaaa

SEQ ID NO: 3397007 - RNA, 14 nt, Human
caucuugguaaauu

SEQ ID NO: 3397008 - RNA, 17 nt, Human
caucuuguauacacaua

SEQ ID NO: 3397009 - RNA, 13 nt, Human
caucuugugaaau

SEQ ID NO: 3397010 - RNA, 15 nt, Human
caucuuguguuuuau

SEQ ID NO: 3397011 - RNA, 16 nt, Human
caucuuuaucuguucu

SEQ ID NO: 3397012 - RNA, 13 nt, Human
caucuuucacauu

SEQ ID NO: 3397013 - RNA, 13 nt, Human
caucuuucccucc

SEQ ID NO: 3397014 - RNA, 15 nt, Human
caucuuucccuccuu

SEQ ID NO: 3397015 - RNA, 21 nt, Human
caucuuugaaauuauguaaau

SEQ ID NO: 3397016 - RNA, 15 nt, Human
caucuuugauguguu

SEQ ID NO: 3397017 - RNA, 17 nt, Human
caucuuugcagguugcu

SEQ ID NO: 3397018 - RNA, 14 nt, Human
caucuuugccucuc

SEQ ID NO: 3397019 - RNA, 23 nt, Human
caucuuugccuugggcugcuccu

SEQ ID NO: 3397020 - RNA, 15 nt, Human
caucuuuggggaggu

SEQ ID NO: 3397021 - RNA, 16 nt, Human
caucuuuuaagacaaa

SEQ ID NO: 3397022 - RNA, 13 nt, Human
caucuuuuacauu

SEQ ID NO: 3397023 - RNA, 16 nt, Human
caucuuuucuugccuc

SEQ ID NO: 3397024 - RNA, 21 nt, Human
caucuuuucuugccucugucc

SEQ ID NO: 3397025 - RNA, 19 nt, Human
cauuuucuauaacagauau

SEQ ID NO: 3397026 - RNA, 12 nt, Human
cauuuucucuua

SEQ ID NO: 3397027 - RNA, 17 nt, Human
cauuuucugaaacuaau

SEQ ID NO: 3397028 - RNA, 20 nt, Human
cauuuucugaaacuaaugaa

SEQ ID NO: 3397029 - RNA, 11 nt, Human
cauuuucugca

SEQ ID NO: 3397030 - RNA, 14 nt, Human
cauuuucugcaucu

SEQ ID NO: 3397031 - RNA, 17 nt, Human
cauuuucugcaucucca

SEQ ID NO: 3397032 - RNA, 23 nt, Human
cauuuucuggccaguguuuaaaa

SEQ ID NO: 3397033 - RNA, 21 nt, Human
cauuuucuggguucugggugg

SEQ ID NO: 3397034 - RNA, 12 nt, Human
cauuuucugugg

SEQ ID NO: 3397035 - RNA, 23 nt, Human
cauuuucuuauugcgcugcuacc

SEQ ID NO: 3397036 - RNA, 13 nt, Human
cauuuugaagcua

SEQ ID NO: 3397037 - RNA, 16 nt, Human
cauuuugaagcuaauu

SEQ ID NO: 3397038 - RNA, 17 nt, Human
cauuuugaagcuaauua

SEQ ID NO: 3397039 - RNA, 15 nt, Human
cauuuugaaucacau

SEQ ID NO: 3397040 - RNA, 13 nt, Human
cauuuugcaaaau

SEQ ID NO: 3397041 - RNA, 15 nt, Human
cauuuugcagcagug

SEQ ID NO: 3397042 - RNA, 15 nt, Human
cauuuugccaaaauu

SEQ ID NO: 3397043 - RNA, 24 nt, Human
cauuuugcuaaaugugaaugauga

SEQ ID NO: 3397044 - RNA, 15 nt, Human
cauuuugcuucauag

SEQ ID NO: 3397045 - RNA, 20 nt, Human
cauuuuggaaguuuucagga

SEQ ID NO: 3397046 - RNA, 22 nt, Human
cauuuuggaaguuuucaggacu

SEQ ID NO: 3397047 - RNA, 22 nt, Human
cauuuuggagaguuuccugaaa

SEQ ID NO: 3397048 - RNA, 12 nt, Human
cauuuuggcgcu

SEQ ID NO: 3397049 - RNA, 22 nt, Human
cauuuuggcgcuauuacaaaua

SEQ ID NO: 3397050 - RNA, 23 nt, Human
cauuuugguaagagacagaaugu

SEQ ID NO: 3397051 - RNA, 14 nt, Human
cauuuugguacuuu

SEQ ID NO: 3397052 - RNA, 19 nt, Human
cauuuuguaacaaaugaac

SEQ ID NO: 3397053 - RNA, 12 nt, Human
cauuuuguaaua

SEQ ID NO: 3397054 - RNA, 13 nt, Human
cauuuuguaauaa

SEQ ID NO: 3397055 - RNA, 12 nt, Human
cauuuuguacca

SEQ ID NO: 3397056 - RNA, 22 nt, Human
cauuuuguaccaaccauccaau

SEQ ID NO: 3397057 - RNA, 18 nt, Human
cauuuuguauaauuguau

SEQ ID NO: 3397058 - RNA, 12 nt, Human
cauuuugugaag

SEQ ID NO: 3397059 - RNA, 17 nt, Human
cauuuugugaagcccug

SEQ ID NO: 3397060 - RNA, 20 nt, Human
cauuuugugaagcccuguug

SEQ ID NO: 3397061 - RNA, 15 nt, Human
cauuuugugaaugga

SEQ ID NO: 3397062 - RNA, 18 nt, Human
cauuuugugaauggauug

SEQ ID NO: 3397063 - RNA, 13 nt, Human
cauuuuguucuua

SEQ ID NO: 3397064 - RNA, 19 nt, Human
cauuuuguucuuacacaua

SEQ ID NO: 3397065 - RNA, 23 nt, Human
cauuuuguuguguguaugcugcu

SEQ ID NO: 3397066 - RNA, 19 nt, Human
cauuuuguuugguauugua

SEQ ID NO: 3397067 - RNA, 21 nt, Human
cauuuuguuugguauuguauu

SEQ ID NO: 3397068 - RNA, 17 nt, Human
cauuuuuaaauguguuu

SEQ ID NO: 3397069 - RNA, 20 nt, Human
cauuuuuaagugcugcauuu

SEQ ID NO: 3397070 - RNA, 14 nt, Human
cauuuuuacaaguu

SEQ ID NO: 3397071 - RNA, 15 nt, Human
cauuuuuacaauaaa

SEQ ID NO: 3397072 - RNA, 17 nt, Human
cauuuuuacaauaaaua

SEQ ID NO: 3397073 - RNA, 19 nt, Human
cauuuuuacaauguaauua

SEQ ID NO: 3397074 - RNA, 17 nt, Human
cauuuuuaguagagaca

SEQ ID NO: 3397075 - RNA, 20 nt, Human
cauuuuuauaccuguuuaaa

SEQ ID NO: 3397076 - RNA, 22 nt, Human
cauuuuuaucaggauuuccucu

SEQ ID NO: 3397077 - RNA, 17 nt, Human
cauuuuucaaagcaauu

SEQ ID NO: 3397078 - RNA, 17 nt, Human
cauuuuucaacuuugaa

SEQ ID NO: 3397079 - RNA, 21 nt, Human
cauuuuucaauauauugaacu

SEQ ID NO: 3397080 - RNA, 21 nt, Human
cauuuuucagaccuuuuaacu

SEQ ID NO: 3397081 - RNA, 20 nt, Human
cauuuuucagauauaaaaga

SEQ ID NO: 3397082 - RNA, 20 nt, Human
cauuuuucccaggcaaauaa

SEQ ID NO: 3397083 - RNA, 16 nt, Human
cauuuuuccuucccuu

SEQ ID NO: 3397084 - RNA, 14 nt, Human
cauuuuucuuccag

SEQ ID NO: 3397085 - RNA, 12 nt, Human
cauuuuuguaaa

SEQ ID NO: 3397086 - RNA, 20 nt, Human
cauuuuuguacaguuugcug

SEQ ID NO: 3397087 - RNA, 20 nt, Human
cauuuuuguauuuuguuuaa

SEQ ID NO: 3397088 - RNA, 22 nt, Human
cauuuuuguuucuaccucccag

SEQ ID NO: 3397089 - RNA, 18 nt, Human
cauuuuuuaaggaaacaa

SEQ ID NO: 3397090 - RNA, 21 nt, Human
cauuuuuuaugggcauugaca

SEQ ID NO: 3397091 - RNA, 13 nt, Human
cauuuuuucaguc

SEQ ID NO: 3397092 - RNA, 16 nt, Human
cauuuuuuccuguuug

SEQ ID NO: 3397093 - RNA, 14 nt, Human
cauuuuuugaaaug

SEQ ID NO: 3397094 - RNA, 18 nt, Human
cauuuuuugggcagcaau

SEQ ID NO: 3397095 - RNA, 17 nt, Human
cauuuuuuuaauuuauu

SEQ ID NO: 3397096 - RNA, 15 nt, Human
cauuuuuuuccaggc

SEQ ID NO: 3397097 - RNA, 18 nt, Human
cauuuuuuuccaggcugg

SEQ ID NO: 3397098 - RNA, 18 nt, Human
cauuuuuuuccuugcaaa

SEQ ID NO: 3397099 - RNA, 22 nt, Human
cauuuuuuuuaagaaaaaggau

SEQ ID NO: 3397100 - RNA, 20 nt, Human
cauuuuuuuuuuuaauuuug

SEQ ID NO: 3397101 - RNA, 19 nt, Human
ccaaaaaaaaauacaugcu

SEQ ID NO: 3397102 - RNA, 22 nt, Human
ccaaaaaagcuguauuuugaaa

SEQ ID NO: 3397103 - RNA, 22 nt, Human
ccaaaaaauucuacaacacaca

SEQ ID NO: 3397104 - RNA, 15 nt, Human
ccaaaaagaccagac

SEQ ID NO: 3397105 - RNA, 14 nt, Human
ccaaaaagcacaua

SEQ ID NO: 3397106 - RNA, 22 nt, Human
ccaaaaagguugcuguuucaca

SEQ ID NO: 3397107 - RNA, 13 nt, Human
ccaaaaauagcua

SEQ ID NO: 3397108 - RNA, 22 nt, Human
ccaaaaauuacuuaguauugca

SEQ ID NO: 3397109 - RNA, 15 nt, Human
ccaaaaccacagccc

SEQ ID NO: 3397110 - RNA, 15 nt, Human
ccaaaaccgccagcu

SEQ ID NO: 3397111 - RNA, 16 nt, Human
ccaaaaccgccagcuc

SEQ ID NO: 3397112 - RNA, 17 nt, Human
ccaaaacugagcauaag

SEQ ID NO: 3397113 - RNA, 11 nt, Human
ccaaaacugug

SEQ ID NO: 3397114 - RNA, 11 nt, Human
ccaaaagaaaa

SEQ ID NO: 3397115 - RNA, 16 nt, Human
ccaaaagaaacugaca

SEQ ID NO: 3397116 - RNA, 22 nt, Human
ccaaaagaagcccccagcuaag

SEQ ID NO: 3397117 - RNA, 18 nt, Human
ccaaaagauugcugaaaa

SEQ ID NO: 3397118 - RNA, 15 nt, Human
ccaaaagcuagacag

SEQ ID NO: 3397119 - RNA, 15 nt, Human
ccaaaagcuuuuuau

SEQ ID NO: 3397120 - RNA, 13 nt, Human
ccaaaaggaaaaa

SEQ ID NO: 3397121 - RNA, 18 nt, Human
ccaaaaggaaaaagcucc

SEQ ID NO: 3397122 - RNA, 14 nt, Human
ccaaaaggcagaag

SEQ ID NO: 3397123 - RNA, 18 nt, Human
ccaaaaguaucgggggcu

SEQ ID NO: 3397124 - RNA, 18 nt, Human
ccaaaaguggaagugaca

SEQ ID NO: 3397125 - RNA, 17 nt, Human
ccaaaaguuacauguuu

SEQ ID NO: 3397126 - RNA, 14 nt, Human
ccaaaaguuauuaa

SEQ ID NO: 3397127 - RNA, 21 nt, Human
ccaaaauaaaacuuuuuaaaa

SEQ ID NO: 3397128 - RNA, 23 nt, Human
ccaaaauaaauaaggaaaagcuu

SEQ ID NO: 3397129 - RNA, 14 nt, Human
ccaaaauaagaaaa

SEQ ID NO: 3397130 - RNA, 16 nt, Human
ccaaaaucucaagaaa

SEQ ID NO: 3397131 - RNA, 20 nt, Human
ccaaaauguuggucauuuua

SEQ ID NO: 3397132 - RNA, 14 nt, Human
ccaaaauuaaggug

SEQ ID NO: 3397133 - RNA, 21 nt, Human
ccaaaauuuauuuuauaagaa

SEQ ID NO: 3397134 - RNA, 22 nt, Human
ccaaaauuuauuuuauaagaaa

SEQ ID NO: 3397135 - RNA, 16 nt, Human
ccaaacaaauaugcaa

SEQ ID NO: 3397136 - RNA, 18 nt, Human
ccaaacacacagaagggg

SEQ ID NO: 3397137 - RNA, 14 nt, Human
ccaaacacaggcaa

SEQ ID NO: 3397138 - RNA, 22 nt, Human
ccaaacaccuuccagcuccugu

SEQ ID NO: 3397139 - RNA, 12 nt, Human
ccaaacauguau

SEQ ID NO: 3397140 - RNA, 17 nt, Human
ccaaacauguauuuaug

SEQ ID NO: 3397141 - RNA, 18 nt, Human
ccaaacauguauuuaugu

SEQ ID NO: 3397142 - RNA, 16 nt, Human
ccaaaccaccuucccu

SEQ ID NO: 3397143 - RNA, 22 nt, Human
ccaaaccacuuuuugcagcuuu

SEQ ID NO: 3397144 - RNA, 16 nt, Human
ccaaaccaggacccug

SEQ ID NO: 3397145 - RNA, 19 nt, Human
ccaaacccccauucugucc

SEQ ID NO: 3397146 - RNA, 14 nt, Human
ccaaacccugucug

SEQ ID NO: 3397147 - RNA, 18 nt, Human
ccaaaccggcaggugcga

SEQ ID NO: 3397148 - RNA, 13 nt, Human
ccaaaccucaagu

SEQ ID NO: 3397149 - RNA, 15 nt, Human
ccaaaccucaccaac

SEQ ID NO: 3397150 - RNA, 11 nt, Human
ccaaaccucug

SEQ ID NO: 3397151 - RNA, 17 nt, Human
ccaaaccucugugagca

SEQ ID NO: 3397152 - RNA, 21 nt, Human
ccaaaccucuguucaguguaa

SEQ ID NO: 3397153 - RNA, 22 nt, Human
ccaaaccugcaagggcucccca

SEQ ID NO: 3397154 - RNA, 21 nt, Human
ccaaacgcccuuuccuccuca

SEQ ID NO: 3397155 - RNA, 14 nt, Human
ccaaacuaauuuuu

SEQ ID NO: 3397156 - RNA, 20 nt, Human
ccaaacucaccugccccuca

SEQ ID NO: 3397157 - RNA, 18 nt, Human
ccaaacucuucccucucu

SEQ ID NO: 3397158 - RNA, 21 nt, Human
ccaaacugacucaacagucau

SEQ ID NO: 3397159 - RNA, 16 nt, Human
ccaaagacaaauagua

SEQ ID NO: 3397160 - RNA, 21 nt, Human
ccaaagagcacaaacauuuuu

SEQ ID NO: 3397161 - RNA, 18 nt, Human
ccaaagagccuggagaag

SEQ ID NO: 3397162 - RNA, 12 nt, Human
ccaaagagcugc

SEQ ID NO: 3397163 - RNA, 16 nt, Human
ccaaagagcugccuaa

SEQ ID NO: 3397164 - RNA, 13 nt, Human
ccaaagaggcugc

SEQ ID NO: 3397165 - RNA, 21 nt, Human
ccaaagauauauacacaggau

SEQ ID NO: 3397166 - RNA, 16 nt, Human
ccaaagaugcagccgc

SEQ ID NO: 3397167 - RNA, 18 nt, Human
ccaaagaugcagccgccu

SEQ ID NO: 3397168 - RNA, 19 nt, Human
ccaaagaugcagccgccuu

SEQ ID NO: 3397169 - RNA, 22 nt, Human
ccaaagaugcagccgccuuccu

SEQ ID NO: 3397170 - RNA, 21 nt, Human
ccaaggaaaccacagcugcug

SEQ ID NO: 3397171 - RNA, 22 nt, Human
ccaaggaaaccacagcugcugg

SEQ ID NO: 3397172 - RNA, 14 nt, Human
ccaaggaaaggcac

SEQ ID NO: 3397173 - RNA, 15 nt, Human
ccaaggaaauauauu

SEQ ID NO: 3397174 - RNA, 14 nt, Human
ccaaggaccagguu

SEQ ID NO: 3397175 - RNA, 13 nt, Human
ccaaggacugccg

SEQ ID NO: 3397176 - RNA, 15 nt, Human
ccaaggagaaacaga

SEQ ID NO: 3397177 - RNA, 19 nt, Human
ccaaggagaaacagagaca

SEQ ID NO: 3397178 - RNA, 21 nt, Human
ccaaggagaaacagagacagg

SEQ ID NO: 3397179 - RNA, 14 nt, Human
ccaaggagaugaag

SEQ ID NO: 3397180 - RNA, 23 nt, Human
ccaaggagaugaagcaaacacau

SEQ ID NO: 3397181 - RNA, 20 nt, Human
ccaaggagcacaggucccac

SEQ ID NO: 3397182 - RNA, 12 nt, Human
ccaaggagcugc

SEQ ID NO: 3397183 - RNA, 14 nt, Human
ccaaggagcugcua

SEQ ID NO: 3397184 - RNA, 13 nt, Human
ccaaggaggaaaa

SEQ ID NO: 3397185 - RNA, 12 nt, Human
ccaaggaggauu

SEQ ID NO: 3397186 - RNA, 20 nt, Human
ccaaggagggugagugcaag

SEQ ID NO: 3397187 - RNA, 18 nt, Human
ccaaggccaaaggaagca

SEQ ID NO: 3397188 - RNA, 15 nt, Human
ccaaggccagagugg

SEQ ID NO: 3397189 - RNA, 19 nt, Human
ccaaggccagaguggccug

SEQ ID NO: 3397190 - RNA, 19 nt, Human
ccaaggcccccugccugcc

SEQ ID NO: 3397191 - RNA, 13 nt, Human
ccaaggccuuccc

SEQ ID NO: 3397192 - RNA, 14 nt, Human
ccaaggcggccccu

SEQ ID NO: 3397193 - RNA, 15 nt, Human
ccaaggcggccccuc

SEQ ID NO: 3397194 - RNA, 23 nt, Human
ccaaggcguccgcgcgccagcac

SEQ ID NO: 3397195 - RNA, 16 nt, Human
ccaaggcucugagcaa

SEQ ID NO: 3397196 - RNA, 13 nt, Human
ccaaggcucuguu

SEQ ID NO: 3397197 - RNA, 14 nt, Human
ccaaggcuggggga

SEQ ID NO: 3397198 - RNA, 22 nt, Human
ccaaggcuucuccaauucugcc

SEQ ID NO: 3397199 - RNA, 16 nt, Human
ccaagggaaccugugu

SEQ ID NO: 3397200 - RNA, 13 nt, Human
ccaagggaggcug

SEQ ID NO: 3397201 - RNA, 15 nt, Human
ccaagggaggcugcu

SEQ ID NO: 3397202 - RNA, 24 nt, Human
ccaagggaguuaggcuauucacaa

SEQ ID NO: 3397203 - RNA, 20 nt, Human
ccaagggaugaaagagaagg

SEQ ID NO: 3397204 - RNA, 18 nt, Human
ccaagggauggacaucuu

SEQ ID NO: 3397205 - RNA, 18 nt, Human
ccaagggcaaaauuccca

SEQ ID NO: 3397206 - RNA, 22 nt, Human
ccaagggcaaaauucccaggga

SEQ ID NO: 3397207 - RNA, 15 nt, Human
ccaagggccuggccu

SEQ ID NO: 3397208 - RNA, 18 nt, Human
ccaagggccuggccugag

SEQ ID NO: 3397209 - RNA, 20 nt, Human
ccaagggcuucugcacccuc

SEQ ID NO: 3397210 - RNA, 23 nt, Human
ccaagggcuucugcacccuccac

SEQ ID NO: 3397211 - RNA, 21 nt, Human
ccaaggggagucaccuucccu

SEQ ID NO: 3397212 - RNA, 22 nt, Human
ccaaggggauuuuuaugucugg

SEQ ID NO: 3397213 - RNA, 16 nt, Human
ccaaggggcagucugg

SEQ ID NO: 3397214 - RNA, 14 nt, Human
ccaaggggccugag

SEQ ID NO: 3397215 - RNA, 16 nt, Human
ccaaggggcuucaggu

SEQ ID NO: 3397216 - RNA, 20 nt, Human
ccaaggguucagagacucag

SEQ ID NO: 3397217 - RNA, 16 nt, Human
ccaagguaccauccua

SEQ ID NO: 3397218 - RNA, 16 nt, Human
ccaaggucugagcacu

SEQ ID NO: 3397219 - RNA, 16 nt, Human
ccaaggucuucuuaau

SEQ ID NO: 3397220 - RNA, 15 nt, Human
ccaaggugauguugu

SEQ ID NO: 3397221 - RNA, 20 nt, Human
ccaaggugggcugagcccug

SEQ ID NO: 3397222 - RNA, 20 nt, Human
ccaagguggguagaucacga

SEQ ID NO: 3397223 - RNA, 13 nt, Human
ccaagguggucug

SEQ ID NO: 3397224 - RNA, 15 nt, Human
ccaagguggucugcu

SEQ ID NO: 3397225 - RNA, 16 nt, Human
ccaagguguccuacag

SEQ ID NO: 3397226 - RNA, 16 nt, Human
ccaagguuacuuaauu

SEQ ID NO: 3397227 - RNA, 16 nt, Human
ccaagguucccuugug

SEQ ID NO: 3397228 - RNA, 19 nt, Human
ccaagguuuaaagagucua

SEQ ID NO: 3397229 - RNA, 22 nt, Human
ccaagguuuaaagagucuagau

SEQ ID NO: 3397230 - RNA, 21 nt, Human
ccaagguuuuauaaggcugau

SEQ ID NO: 3397231 - RNA, 20 nt, Human
ccaaguagcugagacuacag

SEQ ID NO: 3397232 - RNA, 18 nt, Human
ccaaguagucugcucaca

SEQ ID NO: 3397233 - RNA, 21 nt, Human
ccaaguauagccuauggcaga

SEQ ID NO: 3397234 - RNA, 14 nt, Human
ccaaguauuuauua

SEQ ID NO: 3397235 - RNA, 13 nt, Human
ccaaguauuuugc

SEQ ID NO: 3397236 - RNA, 20 nt, Human
ccaagucaagugaaaaagga

SEQ ID NO: 3397237 - RNA, 20 nt, Human
ccaagucacacgcuuuugaa

SEQ ID NO: 3397238 - RNA, 21 nt, Human
ccaagucagcuuugccuucca

SEQ ID NO: 3397239 - RNA, 13 nt, Human
ccaaguccagauu

SEQ ID NO: 3397240 - RNA, 19 nt, Human
ccaaguccagguccuggug

SEQ ID NO: 3397241 - RNA, 12 nt, Human
ccaagucccacc

SEQ ID NO: 3397242 - RNA, 22 nt, Human
ccaagucccuguuuucugagcc

SEQ ID NO: 3397243 - RNA, 16 nt, Human
ccaaguccugaagagg

SEQ ID NO: 3397244 - RNA, 19 nt, Human
ccaagucggaacagcagau

SEQ ID NO: 3397245 - RNA, 17 nt, Human
ccaagucuacagaguga

SEQ ID NO: 3397246 - RNA, 14 nt, Human
ccaagucucagugg

SEQ ID NO: 3397247 - RNA, 18 nt, Human
ccaagugaacacuagcca

SEQ ID NO: 3397248 - RNA, 22 nt, Human
ccaagugaccuauaccuguguu

SEQ ID NO: 3397249 - RNA, 20 nt, Human
ccaagugagucucucugggc

SEQ ID NO: 3397250 - RNA, 16 nt, Human
ccaagugcacuuucua

SEQ ID NO: 3397251 - RNA, 17 nt, Human
ccaagugcacuuucuaa

SEQ ID NO: 3397252 - RNA, 17 nt, Human
ccaagugccagaggugg

SEQ ID NO: 3397253 - RNA, 21 nt, Human
ccaagugccagaggugggcag

SEQ ID NO: 3397254 - RNA, 22 nt, Human
ccaagugccagaggugggcagg

SEQ ID NO: 3397255 - RNA, 23 nt, Human
ccaaguggagccugacagccaga

SEQ ID NO: 3397256 - RNA, 13 nt, Human
ccaaguggcagag

SEQ ID NO: 3397257 - RNA, 18 nt, Human
ccaaguggcagagcuugg

SEQ ID NO: 3397258 - RNA, 16 nt, Human
ccaagugggggcagag

SEQ ID NO: 3397259 - RNA, 15 nt, Human
ccaaguggggugcug

SEQ ID NO: 3397260 - RNA, 16 nt, Human
ccaaguggggugcugg

SEQ ID NO: 3397261 - RNA, 10 nt, Human
ccaagugugc

SEQ ID NO: 3397262 - RNA, 20 nt, Human
ccaagugugcauauuguaca

SEQ ID NO: 3397263 - RNA, 15 nt, Human
ccaaguuauaaauca

SEQ ID NO: 3397264 - RNA, 20 nt, Human
ccaaguuauaaaucaauguc

SEQ ID NO: 3397265 - RNA, 14 nt, Human
ccaaguuuauauac

SEQ ID NO: 3397266 - RNA, 22 nt, Human
ccaaguuuugugaaauuuuuca

SEQ ID NO: 3397267 - RNA, 22 nt, Human
ccaauaaaagcaauuccaaccu

SEQ ID NO: 3397268 - RNA, 14 nt, Human
ccaauaacacacag

SEQ ID NO: 3397269 - RNA, 23 nt, Human
ccaauaauaaaugcccucuucuc

SEQ ID NO: 3397270 - RNA, 16 nt, Human
ccaauaccccauggac

SEQ ID NO: 3397271 - RNA, 18 nt, Human
ccaauagauuccccauug

SEQ ID NO: 3397272 - RNA, 15 nt, Human
ccaauagcugcccau

SEQ ID NO: 3397273 - RNA, 16 nt, Human
ccaauaggcaaauuaa

SEQ ID NO: 3397274 - RNA, 22 nt, Human
ccaauagggcugagcucucugu

SEQ ID NO: 3397275 - RNA, 19 nt, Human
ccaauauccuaauaaaaag

SEQ ID NO: 3397276 - RNA, 22 nt, Human
ccaauaugugauuuuuuuuccc

SEQ ID NO: 3397277 - RNA, 20 nt, Human
ccaauauucauagcagcuua

SEQ ID NO: 3397278 - RNA, 14 nt, Human
ccaauauuguacag

SEQ ID NO: 3397279 - RNA, 18 nt, Human
ccaauauuguacaguuuu

SEQ ID NO: 3397280 - RNA, 12 nt, Human
ccaauauuuaaa

SEQ ID NO: 3397281 - RNA, 22 nt, Human
ccaauauuuucuuuaaugcuuu

SEQ ID NO: 3397282 - RNA, 16 nt, Human
ccaaucaaucuugcau

SEQ ID NO: 3397283 - RNA, 15 nt, Human
ccaaucagagaccag

SEQ ID NO: 3397284 - RNA, 16 nt, Human
ccaaucagcacugaaa

SEQ ID NO: 3397285 - RNA, 22 nt, Human
ccaaucaguagcuuaagaaaaa

SEQ ID NO: 3397286 - RNA, 13 nt, Human
ccaauccagguac

SEQ ID NO: 3397287 - RNA, 23 nt, Human
ccaauccagguacgcacagacag

SEQ ID NO: 3397288 - RNA, 16 nt, Human
ccaauccccuccuugg

SEQ ID NO: 3397289 - RNA, 15 nt, Human
ccaauccucacuggg

SEQ ID NO: 3397290 - RNA, 17 nt, Human
ccaauccucacugggug

SEQ ID NO: 3397291 - RNA, 19 nt, Human
ccaaucugcaauuucuacu

SEQ ID NO: 3397292 - RNA, 17 nt, Human
ccaaucuuacuuuguaa

SEQ ID NO: 3397293 - RNA, 20 nt, Human
ccaaucuuacuuuguaaauu

SEQ ID NO: 3397294 - RNA, 23 nt, Human
ccaaugaaaaaauguauaugcac

SEQ ID NO: 3397295 - RNA, 21 nt, Human
ccaaugagacucuagggucca

SEQ ID NO: 3397296 - RNA, 21 nt, Human
ccaaugagcuuucugaacagc

SEQ ID NO: 3397297 - RNA, 15 nt, Human
ccaaugauggucacc

SEQ ID NO: 3397298 - RNA, 15 nt, Human
ccaaugcaagacgcc

SEQ ID NO: 3397299 - RNA, 20 nt, Human
ccaaugcacuuuguucuggc

SEQ ID NO: 3397300 - RNA, 12 nt, Human
ccaauggaaacc

SEQ ID NO: 3397301 - RNA, 23 nt, Human
ccaauggacuaacuugucuuugg

SEQ ID NO: 3397302 - RNA, 15 nt, Human
ccaauguacccaccg

SEQ ID NO: 3397303 - RNA, 20 nt, Human
ccaauguaggagcugccuug

SEQ ID NO: 3397304 - RNA, 14 nt, Human
ccaaugucuggaga

SEQ ID NO: 3397305 - RNA, 12 nt, Human
ccaaugucuuga

SEQ ID NO: 3397306 - RNA, 19 nt, Human
ccaauguuagagacuuuuu

SEQ ID NO: 3397307 - RNA, 23 nt, Human
ccaauguuucaagaggagccccc

SEQ ID NO: 3397308 - RNA, 13 nt, Human
ccaauuaaggauu

SEQ ID NO: 3397309 - RNA, 19 nt, Human
ccaauuaaguccuacuuua

SEQ ID NO: 3397310 - RNA, 23 nt, Human
ccaauuaggaaguguaacagcug

SEQ ID NO: 3397311 - RNA, 21 nt, Human
ccaauuaggggguaaggcccc

SEQ ID NO: 3397312 - RNA, 15 nt, Human
ccaauuaguuuccuu

SEQ ID NO: 3397313 - RNA, 22 nt, Human
ccaauuauaugagacguuuuug

SEQ ID NO: 3397314 - RNA, 14 nt, Human
ccaauuauguuaaa

SEQ ID NO: 3397315 - RNA, 15 nt, Human
ccaauuauugauaua

SEQ ID NO: 3397316 - RNA, 18 nt, Human
ccaauuauugauauauau

SEQ ID NO: 3397317 - RNA, 21 nt, Human
ccaauuauugauauauauuau

SEQ ID NO: 3397318 - RNA, 22 nt, Human
ccaauuauuugacuuuaauuua

SEQ ID NO: 3397319 - RNA, 13 nt, Human
ccaauucaauaca

SEQ ID NO: 3397320 - RNA, 24 nt, Human
ccaauuccucauccucagaugcuc

SEQ ID NO: 3397321 - RNA, 22 nt, Human
ccaauucuaucuuuuguuuccu

SEQ ID NO: 3397322 - RNA, 18 nt, Human
ccaauucuuacaaacaug

SEQ ID NO: 3397323 - RNA, 19 nt, Human
ccaauucuuacaaacaugu

SEQ ID NO: 3397324 - RNA, 14 nt, Human
ccaauugugcugcc

SEQ ID NO: 3397325 - RNA, 21 nt, Human
ccaauuucggauuuuuuccaa

SEQ ID NO: 3397326 - RNA, 22 nt, Human
ccaauuucggauuuuuuccaaa

SEQ ID NO: 3397327 - RNA, 23 nt, Human
ccaauuucggauuuuuuccaaaa

SEQ ID NO: 3397328 - RNA, 19 nt, Human
ccaauuugcacauuaaaug

SEQ ID NO: 3397329 - RNA, 13 nt, Human
ccaauuuucaaag

SEQ ID NO: 3397330 - RNA, 13 nt, Human
ccacaaaaauuga

SEQ ID NO: 3397331 - RNA, 22 nt, Human
ccacaaaggccaaacugcugga

SEQ ID NO: 3397332 - RNA, 13 nt, Human
ccacaacacacag

SEQ ID NO: 3397333 - RNA, 19 nt, Human
ccacaacaugaaaacucca

SEQ ID NO: 3397334 - RNA, 17 nt, Human
ccacaacaugaggccac

SEQ ID NO: 3397335 - RNA, 15 nt, Human
ccacaagauucccag

SEQ ID NO: 3397336 - RNA, 19 nt, Human
ccacaagauucccagagac

SEQ ID NO: 3397337 - RNA, 20 nt, Human
ccacaagauucccagagaca

SEQ ID NO: 3397338 - RNA, 21 nt, Human
ccacaagauucccagagacag

SEQ ID NO: 3397339 - RNA, 14 nt, Human
ccacaagccugagg

SEQ ID NO: 3397340 - RNA, 13 nt, Human
ccacaaggaagaa

SEQ ID NO: 3397341 - RNA, 16 nt, Human
ccacaaggaagaaauu

SEQ ID NO: 3397342 - RNA, 21 nt, Human
ccacaaggacuuccuguccag

SEQ ID NO: 3397343 - RNA, 17 nt, Human
ccacaaggcuguugcau

SEQ ID NO: 3397344 - RNA, 21 nt, Human
ccacaaguggugguaacccug

SEQ ID NO: 3397345 - RNA, 15 nt, Human
ccacaaguuaaauaa

SEQ ID NO: 3397346 - RNA, 20 nt, Human
ccacaaguuaaauaaaucau

SEQ ID NO: 3397347 - RNA, 22 nt, Human
ccacaauaaccaagauauuuuu

SEQ ID NO: 3397348 - RNA, 23 nt, Human
ccacaauccuauucucgggcuga

SEQ ID NO: 3397349 - RNA, 20 nt, Human
ccacaaucuuaaggggcagc

SEQ ID NO: 3397350 - RNA, 21 nt, Human
ccacacaacauccaaguggcc

SEQ ID NO: 3397351 - RNA, 20 nt, Human
ccacacaaggauagaugcug

SEQ ID NO: 3397352 - RNA, 15 nt, Human
ccacacaagugcagu

SEQ ID NO: 3397353 - RNA, 21 nt, Human
ccacacacaacagccaacagc

SEQ ID NO: 3397354 - RNA, 13 nt, Human
ccacacacacaaa

SEQ ID NO: 3397355 - RNA, 14 nt, Human
ccacacacacacac

SEQ ID NO: 3397356 - RNA, 13 nt, Human
ccacacacacaga

SEQ ID NO: 3397357 - RNA, 14 nt, Human
ccacacacacagaa

SEQ ID NO: 3397358 - RNA, 18 nt, Human
ccacacacacagaaaaua

SEQ ID NO: 3397359 - RNA, 23 nt, Human
ccacacacacagaaaauauacug

SEQ ID NO: 3397360 - RNA, 20 nt, Human
ccacacacagcugggcugug

SEQ ID NO: 3397361 - RNA, 12 nt, Human
ccacacacaggu

SEQ ID NO: 3397362 - RNA, 12 nt, Human
ccacacacccca

SEQ ID NO: 3397363 - RNA, 15 nt, Human
ccacacacucgcccg

SEQ ID NO: 3397364 - RNA, 19 nt, Human
ccacacagcuacagcuuuc

SEQ ID NO: 3397365 - RNA, 12 nt, Human
ccacacagcugc

SEQ ID NO: 3397366 - RNA, 23 nt, Human
ccacacagugcucaaggccagcu

SEQ ID NO: 3397367 - RNA, 23 nt, Human
ccacacaucaguaauguauucua

SEQ ID NO: 3397368 - RNA, 19 nt, Human
ccacacauuucacugucug

SEQ ID NO: 3397369 - RNA, 20 nt, Human
ccacacauuucacugucugu

SEQ ID NO: 3397370 - RNA, 15 nt, Human
ccacaccaaaccucu

SEQ ID NO: 3397371 - RNA, 14 nt, Human
ccacaccagcccca

SEQ ID NO: 3397372 - RNA, 14 nt, Human
ccacaccaggccgu

SEQ ID NO: 3397373 - RNA, 22 nt, Human
ccacaccauaagcuacugccau

SEQ ID NO: 3397374 - RNA, 12 nt, Human
ccacacccagcc

SEQ ID NO: 3397375 - RNA, 20 nt, Human
ccacacccagcccacuucug

SEQ ID NO: 3397376 - RNA, 14 nt, Human
ccacacccagccuc

SEQ ID NO: 3397377 - RNA, 19 nt, Human
ccacacccagccucagucc

SEQ ID NO: 3397378 - RNA, 16 nt, Human
ccacacccagcucagc

SEQ ID NO: 3397379 - RNA, 19 nt, Human
ccacaccccaacacuucca

SEQ ID NO: 3397380 - RNA, 15 nt, Human
ccacacccccacccc

SEQ ID NO: 3397381 - RNA, 19 nt, Human
ccacacccuguacuguucu

SEQ ID NO: 3397382 - RNA, 18 nt, Human
ccacaccguguaaaccaa

SEQ ID NO: 3397383 - RNA, 19 nt, Human
ccacaccucaguucccuug

SEQ ID NO: 3397384 - RNA, 17 nt, Human
ccacaccuccacaguuc

SEQ ID NO: 3397385 - RNA, 15 nt, Human
ccacaccuccuuccc

SEQ ID NO: 3397386 - RNA, 16 nt, Human
ccacaccucugccaga

SEQ ID NO: 3397387 - RNA, 12 nt, Human
ccacaccugagc

SEQ ID NO: 3397388 - RNA, 13 nt, Human
ccacaccugcggc

SEQ ID NO: 3397389 - RNA, 14 nt, Human
ccacaccuggcacu

SEQ ID NO: 3397390 - RNA, 14 nt, Human
ccacaccuggcccu

SEQ ID NO: 3397391 - RNA, 12 nt, Human
ccacacuccagc

SEQ ID NO: 3397392 - RNA, 17 nt, Human
ccacacuccagcuggga

SEQ ID NO: 3397393 - RNA, 15 nt, Human
ccacacucccaaggu

SEQ ID NO: 3397394 - RNA, 23 nt, Human
ccacacucccaagguuggagccc

SEQ ID NO: 3397395 - RNA, 16 nt, Human
ccacacucuccaucac

SEQ ID NO: 3397396 - RNA, 20 nt, Human
ccacacucuucuaugaccca

SEQ ID NO: 3397397 - RNA, 19 nt, Human
ccacacugauccagcccug

SEQ ID NO: 3397398 - RNA, 14 nt, Human
ccacacugcacaau

SEQ ID NO: 3397399 - RNA, 13 nt, Human
ccacacuggacuc

SEQ ID NO: 3397400 - RNA, 14 nt, Human
ccacacuggacucc

SEQ ID NO: 3397401 - RNA, 22 nt, Human
ccacacuggacuccggcccucc

SEQ ID NO: 3397402 - RNA, 13 nt, Human
ccacacugugaca

SEQ ID NO: 3397403 - RNA, 18 nt, Human
ccacacuucaaacuacuu

SEQ ID NO: 3397404 - RNA, 21 nt, Human
ccacacuucaggcucuucucc

SEQ ID NO: 3397405 - RNA, 16 nt, Human
ccacacuuccugucca

SEQ ID NO: 3397406 - RNA, 18 nt, Human
ccacacuuccuguccaga

SEQ ID NO: 3397407 - RNA, 15 nt, Human
ccacacuucucagga

SEQ ID NO: 3397408 - RNA, 17 nt, Human
ccacacuucucaggaca

SEQ ID NO: 3397409 - RNA, 21 nt, Human
ccacacuucucaggacacagg

SEQ ID NO: 3397410 - RNA, 24 nt, Human
ccacacuucucaggacacaggccu

SEQ ID NO: 3397411 - RNA, 23 nt, Human
ccacagaaaagaaaguucaugcu

SEQ ID NO: 3397412 - RNA, 13 nt, Human
ccacagaaagaga

SEQ ID NO: 3397413 - RNA, 14 nt, Human
ccacagaaagagag

SEQ ID NO: 3397414 - RNA, 15 nt, Human
ccacagaaagagagc

SEQ ID NO: 3397415 - RNA, 20 nt, Human
ccacagaagacuucccagcu

SEQ ID NO: 3397416 - RNA, 18 nt, Human
ccacagaagccaggagca

SEQ ID NO: 3397417 - RNA, 22 nt, Human
ccacagaagccaggagcaaaug

SEQ ID NO: 3397418 - RNA, 16 nt, Human
ccacagaagugcuuuc

SEQ ID NO: 3397419 - RNA, 23 nt, Human
ccacagacaaaagcgcuuuuccu

SEQ ID NO: 3397420 - RNA, 21 nt, Human
ccacagacaagguagcccugg

SEQ ID NO: 3397421 - RNA, 13 nt, Human
ccacagacacaca

SEQ ID NO: 3397422 - RNA, 15 nt, Human
ccacagacacacaca

SEQ ID NO: 3397423 - RNA, 21 nt, Human
ccacagacacacacacgcacg

SEQ ID NO: 3397424 - RNA, 17 nt, Human
ccacagagacaaggagg

SEQ ID NO: 3397425 - RNA, 18 nt, Human
ccacagagagucccacug

SEQ ID NO: 3397426 - RNA, 14 nt, Human
ccacagagcgggga

SEQ ID NO: 3397427 - RNA, 16 nt, Human
ccacagaguaagacau

SEQ ID NO: 3397428 - RNA, 17 nt, Human
ccacagaguaagacauu

SEQ ID NO: 3397429 - RNA, 16 nt, Human
ccacagaguguagcca

SEQ ID NO: 3397430 - RNA, 18 nt, Human
ccacagaugccuccaccc

SEQ ID NO: 3397431 - RNA, 20 nt, Human
ccacagcacagcucccugcc

SEQ ID NO: 3397432 - RNA, 14 nt, Human
ccacagcagcauuu

SEQ ID NO: 3397433 - RNA, 14 nt, Human
ccacagcagguccu

SEQ ID NO: 3397434 - RNA, 18 nt, Human
ccacagcaguugaaaaga

SEQ ID NO: 3397435 - RNA, 15 nt, Human
ccacagccagcaccu

SEQ ID NO: 3397436 - RNA, 18 nt, Human
ccacagccagcaccuggc

SEQ ID NO: 3397437 - RNA, 19 nt, Human
ccacagccagcaccuggca

SEQ ID NO: 3397438 - RNA, 22 nt, Human
ccacagccagcaccuggcaucg

SEQ ID NO: 3397439 - RNA, 13 nt, Human
ccacagccagggg

SEQ ID NO: 3397440 - RNA, 15 nt, Human
ccacagcccagccac

SEQ ID NO: 3397441 - RNA, 19 nt, Human
ccacagcccagccacggac

SEQ ID NO: 3397442 - RNA, 19 nt, Human
ccacagcccgcaugcagca

SEQ ID NO: 3397443 - RNA, 17 nt, Human
ccacagcccugucagca

SEQ ID NO: 3397444 - RNA, 19 nt, Human
ccacagcccugucagcaug

SEQ ID NO: 3397445 - RNA, 18 nt, Human
ccacagccgcagccuccc

SEQ ID NO: 3397446 - RNA, 16 nt, Human
ccacagccuccccugc

SEQ ID NO: 3397447 - RNA, 19 nt, Human
ccacagccuccccugccag

SEQ ID NO: 3397448 - RNA, 17 nt, Human
ccacagcgagggcagcu

SEQ ID NO: 3397449 - RNA, 19 nt, Human
ccacagcgagggcagcugc

SEQ ID NO: 3397450 - RNA, 21 nt, Human
ccacagcgagggcagcugcua

SEQ ID NO: 3397451 - RNA, 12 nt, Human
ccacagcguccc

SEQ ID NO: 3397452 - RNA, 16 nt, Human
ccacagcgucccuggc

SEQ ID NO: 3397453 - RNA, 21 nt, Human
ccacagcgucccuggcgcagg

SEQ ID NO: 3397454 - RNA, 13 nt, Human
ccacagcucccac

SEQ ID NO: 3397455 - RNA, 15 nt, Human
ccacagcucccaccc

SEQ ID NO: 3397456 - RNA, 14 nt, Human
ccacagcugcugga

SEQ ID NO: 3397457 - RNA, 14 nt, Human
ccacagcuuccugu

SEQ ID NO: 3397458 - RNA, 22 nt, Human
ccacagcuuuuuaccaaguuuc

SEQ ID NO: 3397459 - RNA, 13 nt, Human
ccaccuggccacc

SEQ ID NO: 3397460 - RNA, 15 nt, Human
ccaccuggccaccug

SEQ ID NO: 3397461 - RNA, 13 nt, Human
ccaccuggccucu

SEQ ID NO: 3397462 - RNA, 15 nt, Human
ccaccuggccucugc

SEQ ID NO: 3397463 - RNA, 16 nt, Human
ccaccuggccucugca

SEQ ID NO: 3397464 - RNA, 18 nt, Human
ccaccuggccucugcacu

SEQ ID NO: 3397465 - RNA, 12 nt, Human
ccaccuggcucu

SEQ ID NO: 3397466 - RNA, 15 nt, Human
ccaccuggggcaguc

SEQ ID NO: 3397467 - RNA, 20 nt, Human
ccaccuggggcagucaccug

SEQ ID NO: 3397468 - RNA, 21 nt, Human
ccaccugguacucccucucag

SEQ ID NO: 3397469 - RNA, 19 nt, Human
ccaccugucaaacaaagcc

SEQ ID NO: 3397470 - RNA, 13 nt, Human
ccaccugucccac

SEQ ID NO: 3397471 - RNA, 15 nt, Human
ccaccugucccaccu

SEQ ID NO: 3397472 - RNA, 15 nt, Human
ccaccugucucagcc

SEQ ID NO: 3397473 - RNA, 16 nt, Human
ccaccugucucagccu

SEQ ID NO: 3397474 - RNA, 14 nt, Human
ccaccugucugucu

SEQ ID NO: 3397475 - RNA, 14 nt, Human
ccaccugucuucaa

SEQ ID NO: 3397476 - RNA, 18 nt, Human
ccaccuuaaauuaaacaa

SEQ ID NO: 3397477 - RNA, 18 nt, Human
ccaccuucaauuccuggg

SEQ ID NO: 3397478 - RNA, 11 nt, Human
ccaccuuccca

SEQ ID NO: 3397479 - RNA, 14 nt, Human
ccaccuucccagcu

SEQ ID NO: 3397480 - RNA, 15 nt, Human
ccaccuuggcucaag

SEQ ID NO: 3397481 - RNA, 15 nt, Human
ccaccuuggcugcag

SEQ ID NO: 3397482 - RNA, 19 nt, Human
ccaccuuggcugcagggag

SEQ ID NO: 3397483 - RNA, 17 nt, Human
ccaccuuguuggagccu

SEQ ID NO: 3397484 - RNA, 19 nt, Human
ccaccuuguuggagccugc

SEQ ID NO: 3397485 - RNA, 20 nt, Human
ccaccuuguuggagccugca

SEQ ID NO: 3397486 - RNA, 23 nt, Human
ccaccuuucagauaacuguuauu

SEQ ID NO: 3397487 - RNA, 22 nt, Human
ccaccuuuggaaagcucugacc

SEQ ID NO: 3397488 - RNA, 15 nt, Human
ccacgaauuugcugg

SEQ ID NO: 3397489 - RNA, 19 nt, Human
ccacgaauuugcuggggaa

SEQ ID NO: 3397490 - RNA, 18 nt, Human
ccacgacuggccagggcc

SEQ ID NO: 3397491 - RNA, 16 nt, Human
ccacgacugucuccau

SEQ ID NO: 3397492 - RNA, 15 nt, Human
ccacgagagcgcagc

SEQ ID NO: 3397493 - RNA, 15 nt, Human
ccacgagggcuggcu

SEQ ID NO: 3397494 - RNA, 17 nt, Human
ccacgagggcuggcugg

SEQ ID NO: 3397495 - RNA, 20 nt, Human
ccacgagggcuggcuggccu

SEQ ID NO: 3397496 - RNA, 16 nt, Human
ccacgagggugccgug

SEQ ID NO: 3397497 - RNA, 17 nt, Human
ccacgauuuucuccagc

SEQ ID NO: 3397498 - RNA, 13 nt, Human
ccacgcagccagg

SEQ ID NO: 3397499 - RNA, 14 nt, Human
ccacgcagccagga

SEQ ID NO: 3397500 - RNA, 16 nt, Human
ccacgcagccaggaca

SEQ ID NO: 3397501 - RNA, 17 nt, Human
ccacgcagccaggacac

SEQ ID NO: 3397502 - RNA, 18 nt, Human
ccacgccacagcccuuuu

SEQ ID NO: 3397503 - RNA, 21 nt, Human
ccacgccacagcccuuuuguc

SEQ ID NO: 3397504 - RNA, 16 nt, Human
ccacgcccccacuggu

SEQ ID NO: 3397505 - RNA, 19 nt, Human
ccacgcccccacuggugac

SEQ ID NO: 3397506 - RNA, 13 nt, Human
ccacgcccggcua

SEQ ID NO: 3397507 - RNA, 15 nt, Human
ccacgcccguccugc

SEQ ID NO: 3397508 - RNA, 18 nt, Human
ccacgcccguccugccug

SEQ ID NO: 3397509 - RNA, 19 nt, Human
ccacgcccguccugccugu

SEQ ID NO: 3397510 - RNA, 21 nt, Human
ccacgcccguccugccugugg

SEQ ID NO: 3397511 - RNA, 23 nt, Human
ccacgcccguccugccuguggcg

SEQ ID NO: 3397512 - RNA, 23 nt, Human
ccacgcccucauuacggcuccuc

SEQ ID NO: 3397513 - RNA, 15 nt, Human
ccacgcccuccccuc

SEQ ID NO: 3397514 - RNA, 20 nt, Human
ccacgcccuccccuccccug

SEQ ID NO: 3397515 - RNA, 13 nt, Human
ccacgcuccagcu

SEQ ID NO: 3397516 - RNA, 18 nt, Human
ccacgcuggaccuugaac

SEQ ID NO: 3397517 - RNA, 16 nt, Human
ccacgcuggagugcag

SEQ ID NO: 3397518 - RNA, 20 nt, Human
ccacgcuggagugcagugag

SEQ ID NO: 3397519 - RNA, 20 nt, Human
ccacgcugucuccagacccc

SEQ ID NO: 3397520 - RNA, 22 nt, Human
ccacggaccaaagggagucugc

SEQ ID NO: 3397521 - RNA, 12 nt, Human
ccacggagccac

SEQ ID NO: 3397522 - RNA, 16 nt, Human
ccacggccacuggcca

SEQ ID NO: 3397523 - RNA, 15 nt, Human
ccacggccaggccag

SEQ ID NO: 3397524 - RNA, 18 nt, Human
ccacggccaggccagagg

SEQ ID NO: 3397525 - RNA, 23 nt, Human
ccacggccaggccagagggagug

SEQ ID NO: 3397526 - RNA, 20 nt, Human
ccacggccgcuccaggggug

SEQ ID NO: 3397527 - RNA, 20 nt, Human
ccacggcguuguaccuguag

SEQ ID NO: 3397528 - RNA, 13 nt, Human
ccacggcuaagag

SEQ ID NO: 3397529 - RNA, 18 nt, Human
ccacggcuggagcugccu

SEQ ID NO: 3397530 - RNA, 18 nt, Human
ccacgggaaguuuagaga

SEQ ID NO: 3397531 - RNA, 13 nt, Human
ccacguacugcag

SEQ ID NO: 3397532 - RNA, 16 nt, Human
ccacguccugucagug

SEQ ID NO: 3397533 - RNA, 20 nt, Human
ccacgucugcuaacuuggag

SEQ ID NO: 3397534 - RNA, 22 nt, Human
ccacguguaacugucagccggg

SEQ ID NO: 3397535 - RNA, 12 nt, Human
ccacgugucuuc

SEQ ID NO: 3397536 - RNA, 14 nt, Human
ccacguucaccccu

SEQ ID NO: 3397537 - RNA, 17 nt, Human
ccacguucaccccucca

SEQ ID NO: 3397538 - RNA, 16 nt, Human
ccacuaaaaauauugu

SEQ ID NO: 3397539 - RNA, 17 nt, Human
ccacuaaccuugccugg

SEQ ID NO: 3397540 - RNA, 22 nt, Human
ccacuaacuagagcagcccugg

SEQ ID NO: 3397541 - RNA, 18 nt, Human
ccacuaacuccugagaaa

SEQ ID NO: 3397542 - RNA, 21 nt, Human
ccacuaagaaccccucugcuu

SEQ ID NO: 3397543 - RNA, 14 nt, Human
ccacuaagcagagg

SEQ ID NO: 3397544 - RNA, 13 nt, Human
ccacuaaugcaaa

SEQ ID NO: 3397545 - RNA, 20 nt, Human
ccacuacacuccagccugag

SEQ ID NO: 3397546 - RNA, 17 nt, Human
ccacuacauucuguuaa

SEQ ID NO: 3397547 - RNA, 12 nt, Human
ccacuacugcag

SEQ ID NO: 3397548 - RNA, 13 nt, Human
ccacuacugcagc

SEQ ID NO: 3397549 - RNA, 16 nt, Human
ccacuagacucuucac

SEQ ID NO: 3397550 - RNA, 14 nt, Human
ccacuaggcugggu

SEQ ID NO: 3397551 - RNA, 15 nt, Human
ccacuaggcugggug

SEQ ID NO: 3397552 - RNA, 20 nt, Human
ccacuaggcugggugcccac

SEQ ID NO: 3397553 - RNA, 23 nt, Human
ccacuaguaaguaauuaugcacu

SEQ ID NO: 3397554 - RNA, 21 nt, Human
ccacuauggucaucuuuuucu

SEQ ID NO: 3397555 - RNA, 14 nt, Human
ccacucaaaggcca

SEQ ID NO: 3397556 - RNA, 19 nt, Human
ccacucaaaggccagaccu

SEQ ID NO: 3397557 - RNA, 20 nt, Human
ccacucaaauuaaucuuucu

SEQ ID NO: 3397558 - RNA, 12 nt, Human
ccacucaagcca

SEQ ID NO: 3397559 - RNA, 17 nt, Human
ccacucaagccaagcag

SEQ ID NO: 3397560 - RNA, 14 nt, Human
ccacucacacagcc

SEQ ID NO: 3397561 - RNA, 16 nt, Human
ccacucacacagccag

SEQ ID NO: 3397562 - RNA, 18 nt, Human
ccacucacacagccaggu

SEQ ID NO: 3397563 - RNA, 21 nt, Human
ccacucacacagccaggugcc

SEQ ID NO: 3397564 - RNA, 11 nt, Human
ccacucacccc

SEQ ID NO: 3397565 - RNA, 18 nt, Human
ccacucacuaggccccca

SEQ ID NO: 3397566 - RNA, 22 nt, Human
ccacucacuaggcccccacuug

SEQ ID NO: 3397567 - RNA, 13 nt, Human
ccacucagagaca

SEQ ID NO: 3397568 - RNA, 13 nt, Human
ccacucagccccu

SEQ ID NO: 3397569 - RNA, 14 nt, Human
ccacucagccccua

SEQ ID NO: 3397570 - RNA, 16 nt, Human
ccacucagccccuagg

SEQ ID NO: 3397571 - RNA, 17 nt, Human
ccacucagccccuagga

SEQ ID NO: 3397572 - RNA, 11 nt, Human
ccacucagcuc

SEQ ID NO: 3397573 - RNA, 20 nt, Human
ccacucaggaggcugaggca

SEQ ID NO: 3397574 - RNA, 14 nt, Human
ccacucagggguca

SEQ ID NO: 3397575 - RNA, 19 nt, Human
ccacucaugugacucuuuc

SEQ ID NO: 3397576 - RNA, 14 nt, Human
ccacucauuucauc

SEQ ID NO: 3397577 - RNA, 17 nt, Human
ccacuccagaccccugg

SEQ ID NO: 3397578 - RNA, 17 nt, Human
ccacuccaucugguaga

SEQ ID NO: 3397579 - RNA, 21 nt, Human
ccacucccacuucccugacac

SEQ ID NO: 3397580 - RNA, 22 nt, Human
ccacucccagcaucgcacucug

SEQ ID NO: 3397581 - RNA, 15 nt, Human
ccacucccaggcagc

SEQ ID NO: 3397582 - RNA, 22 nt, Human
ccacuccccuccacucucuacc

SEQ ID NO: 3397583 - RNA, 18 nt, Human
ccacucccuccuaaccua

SEQ ID NO: 3397584 - RNA, 20 nt, Human
ccacuccgagaggugggcca

SEQ ID NO: 3397585 - RNA, 12 nt, Human
ccacuccuccaa

SEQ ID NO: 3397586 - RNA, 14 nt, Human
ccacuccucugacu

SEQ ID NO: 3397587 - RNA, 15 nt, Human
ccacuccuguacacu

SEQ ID NO: 3397588 - RNA, 14 nt, Human
ccacuccuuccugc

SEQ ID NO: 3397589 - RNA, 18 nt, Human
ccacuccuuccugcccca

SEQ ID NO: 3397590 - RNA, 21 nt, Human
ccacucuaggggucaggcucc

SEQ ID NO: 3397591 - RNA, 16 nt, Human
ccacucucagaggccc

SEQ ID NO: 3397592 - RNA, 13 nt, Human
ccacucuccccac

SEQ ID NO: 3397593 - RNA, 15 nt, Human
ccacucuccccacac

SEQ ID NO: 3397594 - RNA, 13 nt, Human
ccacucuccuagg

SEQ ID NO: 3397595 - RNA, 12 nt, Human
ccacucuccuug

SEQ ID NO: 3397596 - RNA, 23 nt, Human
ccacucuccuugcuacccagaaa

SEQ ID NO: 3397597 - RNA, 17 nt, Human
ccacucucuaccagaua

SEQ ID NO: 3397598 - RNA, 21 nt, Human
ccacucucucuuguucuuacu

SEQ ID NO: 3397599 - RNA, 22 nt, Human
ccacucucucuuguucuuacuu

SEQ ID NO: 3397600 - RNA, 14 nt, Human
ccacucugcucuga

SEQ ID NO: 3397601 - RNA, 15 nt, Human
ccacucugcucugau

SEQ ID NO: 3397602 - RNA, 23 nt, Human
ccacucuggauucagccuucuuu

SEQ ID NO: 3397603 - RNA, 13 nt, Human
ccacucuggcagc

SEQ ID NO: 3397604 - RNA, 21 nt, Human
ccacucuggcagccacacuuc

SEQ ID NO: 3397605 - RNA, 21 nt, Human
ccagugggaggggcaggcuga

SEQ ID NO: 3397606 - RNA, 15 nt, Human
ccaguggggccugug

SEQ ID NO: 3397607 - RNA, 16 nt, Human
ccaguggggccugugg

SEQ ID NO: 3397608 - RNA, 15 nt, Human
ccagugguauccugu

SEQ ID NO: 3397609 - RNA, 14 nt, Human
ccaguguagccuug

SEQ ID NO: 3397610 - RNA, 23 nt, Human
ccaguguccugagcucagcgugg

SEQ ID NO: 3397611 - RNA, 21 nt, Human
ccagugucuauaaaagaaaca

SEQ ID NO: 3397612 - RNA, 13 nt, Human
ccagugucuuccu

SEQ ID NO: 3397613 - RNA, 23 nt, Human
ccagugugacaaggauugcuacu

SEQ ID NO: 3397614 - RNA, 13 nt, Human
ccagugugggcuu

SEQ ID NO: 3397615 - RNA, 17 nt, Human
ccaguguuagggaaggg

SEQ ID NO: 3397616 - RNA, 15 nt, Human
ccaguguuguuugua

SEQ ID NO: 3397617 - RNA, 17 nt, Human
ccaguguuguuuguaaa

SEQ ID NO: 3397618 - RNA, 18 nt, Human
ccaguguuguuuguaaau

SEQ ID NO: 3397619 - RNA, 21 nt, Human
ccaguguuguuuguaaauaag

SEQ ID NO: 3397620 - RNA, 21 nt, Human
ccaguuaaggaccguggcccu

SEQ ID NO: 3397621 - RNA, 22 nt, Human
ccaguuaaggaccguggcccug

SEQ ID NO: 3397622 - RNA, 21 nt, Human
ccaguuagacuaguccccggu

SEQ ID NO: 3397623 - RNA, 22 nt, Human
ccaguuagccucugcaggaugu

SEQ ID NO: 3397624 - RNA, 14 nt, Human
ccaguuauggcuau

SEQ ID NO: 3397625 - RNA, 17 nt, Human
ccaguuaugugaaugau

SEQ ID NO: 3397626 - RNA, 21 nt, Human
ccaguucaggagucccaagga

SEQ ID NO: 3397627 - RNA, 20 nt, Human
ccaguucaguaccuggagga

SEQ ID NO: 3397628 - RNA, 16 nt, Human
ccaguuccucuuuugu

SEQ ID NO: 3397629 - RNA, 20 nt, Human
ccaguucgccuggagcccuc

SEQ ID NO: 3397630 - RNA, 13 nt, Human
ccaguucugcucc

SEQ ID NO: 3397631 - RNA, 22 nt, Human
ccaguucugcuccucuccaggc

SEQ ID NO: 3397632 - RNA, 21 nt, Human
ccaguugcacuuggccucugg

SEQ ID NO: 3397633 - RNA, 22 nt, Human
ccaguuggagcagaugccuccc

SEQ ID NO: 3397634 - RNA, 19 nt, Human
ccaguugggagcacuggag

SEQ ID NO: 3397635 - RNA, 19 nt, Human
ccaguuggguggaugccug

SEQ ID NO: 3397636 - RNA, 23 nt, Human
ccaguuggguggaugccuggugg

SEQ ID NO: 3397637 - RNA, 14 nt, Human
ccaguuguccuccu

SEQ ID NO: 3397638 - RNA, 19 nt, Human
ccaguuuaaucauugccug

SEQ ID NO: 3397639 - RNA, 23 nt, Human
ccaguuuagauuucaagaaaaaa

SEQ ID NO: 3397640 - RNA, 21 nt, Human
ccaguuucagguguuuaguug

SEQ ID NO: 3397641 - RNA, 16 nt, Human
ccaguuuccuugggag

SEQ ID NO: 3397642 - RNA, 19 nt, Human
ccaguuucuaaacuggaga

SEQ ID NO: 3397643 - RNA, 20 nt, Human
ccaguuucuaaacuggagac

SEQ ID NO: 3397644 - RNA, 17 nt, Human
ccaguuugcaccugucc

SEQ ID NO: 3397645 - RNA, 13 nt, Human
ccauaaaaagcug

SEQ ID NO: 3397646 - RNA, 14 nt, Human
ccauaaaaagcuga

SEQ ID NO: 3397647 - RNA, 15 nt, Human
ccauaaccacugaag

SEQ ID NO: 3397648 - RNA, 13 nt, Human
ccauaacugaaca

SEQ ID NO: 3397649 - RNA, 17 nt, Human
ccauaagccuccauuua

SEQ ID NO: 3397650 - RNA, 21 nt, Human
ccauaagccuccauuuaguuc

SEQ ID NO: 3397651 - RNA, 18 nt, Human
ccauaagcuacugccauc

SEQ ID NO: 3397652 - RNA, 20 nt, Human
ccauaagguuucguuucugu

SEQ ID NO: 3397653 - RNA, 19 nt, Human
ccauaauaaaaggcuuuga

SEQ ID NO: 3397654 - RNA, 12 nt, Human
ccauaauacaaa

SEQ ID NO: 3397655 - RNA, 14 nt, Human
ccauaauacaaaag

SEQ ID NO: 3397656 - RNA, 14 nt, Human
ccauaaucuggacu

SEQ ID NO: 3397657 - RNA, 23 nt, Human
ccauaaugcuaauuuaaagagac

SEQ ID NO: 3397658 - RNA, 16 nt, Human
ccauaauguucugcua

SEQ ID NO: 3397659 - RNA, 17 nt, Human
ccauaauuuucuucaug

SEQ ID NO: 3397660 - RNA, 20 nt, Human
ccauacacuuuguugcaaga

SEQ ID NO: 3397661 - RNA, 13 nt, Human
ccauacagcucua

SEQ ID NO: 3397662 - RNA, 14 nt, Human
ccauacauuugugu

SEQ ID NO: 3397663 - RNA, 22 nt, Human
ccauaccacccaaugcugaugu

SEQ ID NO: 3397664 - RNA, 12 nt, Human
ccauacuaauua

SEQ ID NO: 3397665 - RNA, 13 nt, Human
ccauacuaauuau

SEQ ID NO: 3397666 - RNA, 23 nt, Human
ccauacuaauuauacccccugca

SEQ ID NO: 3397667 - RNA, 14 nt, Human
ccauacucauuucu

SEQ ID NO: 3397668 - RNA, 13 nt, Human
ccauacuggccuc

SEQ ID NO: 3397669 - RNA, 14 nt, Human
ccauacuggccucg

SEQ ID NO: 3397670 - RNA, 18 nt, Human
ccauacuggccucgccug

SEQ ID NO: 3397671 - RNA, 17 nt, Human
ccauagaaacaugacac

SEQ ID NO: 3397672 - RNA, 16 nt, Human
ccauagacaugaaagg

SEQ ID NO: 3397673 - RNA, 20 nt, Human
ccauagaguacacugccugc

SEQ ID NO: 3397674 - RNA, 18 nt, Human
ccauagauacucucuucu

SEQ ID NO: 3397675 - RNA, 16 nt, Human
ccauagaucuucugaa

SEQ ID NO: 3397676 - RNA, 17 nt, Human
ccauagaucuucugaaa

SEQ ID NO: 3397677 - RNA, 20 nt, Human
ccauagaucuucugaaauga

SEQ ID NO: 3397678 - RNA, 18 nt, Human
ccauagccaccccagaaa

SEQ ID NO: 3397679 - RNA, 16 nt, Human
ccauagcuccugcucc

SEQ ID NO: 3397680 - RNA, 19 nt, Human
ccauagcuccugcuccaca

SEQ ID NO: 3397681 - RNA, 14 nt, Human
ccauagcugcugcc

SEQ ID NO: 3397682 - RNA, 16 nt, Human
ccauaggcccacacac

SEQ ID NO: 3397683 - RNA, 17 nt, Human
ccauaggcccacacaca

SEQ ID NO: 3397684 - RNA, 19 nt, Human
ccauaggcccacacacagg

SEQ ID NO: 3397685 - RNA, 12 nt, Human
ccauaggucacc

SEQ ID NO: 3397686 - RNA, 18 nt, Human
ccauaguaacugacauga

SEQ ID NO: 3397687 - RNA, 21 nt, Human
ccauaguaacugacaugauua

SEQ ID NO: 3397688 - RNA, 22 nt, Human
ccauaguauauuaaaaauggua

SEQ ID NO: 3397689 - RNA, 21 nt, Human
ccauaguaugggacuggccuc

SEQ ID NO: 3397690 - RNA, 14 nt, Human
ccauagucccugcc

SEQ ID NO: 3397691 - RNA, 21 nt, Human
ccauaguggaucacucaccau

SEQ ID NO: 3397692 - RNA, 17 nt, Human
ccauaguuacuguaaaa

SEQ ID NO: 3397693 - RNA, 18 nt, Human
ccauaguugacaguucca

SEQ ID NO: 3397694 - RNA, 18 nt, Human
ccauaguuuggcauuugc

SEQ ID NO: 3397695 - RNA, 22 nt, Human
ccauauaaguuugaaggaaaca

SEQ ID NO: 3397696 - RNA, 23 nt, Human
ccauauaaguuugaaggaaacag

SEQ ID NO: 3397697 - RNA, 13 nt, Human
ccauauccugccu

SEQ ID NO: 3397698 - RNA, 15 nt, Human
ccauauccuggugcc

SEQ ID NO: 3397699 - RNA, 16 nt, Human
ccauaucuaaccagug

SEQ ID NO: 3397700 - RNA, 16 nt, Human
ccauaucuuaaagaaa

SEQ ID NO: 3397701 - RNA, 17 nt, Human
ccauaugaauuguacag

SEQ ID NO: 3397702 - RNA, 14 nt, Human
ccauaugcagaaau

SEQ ID NO: 3397703 - RNA, 13 nt, Human
ccauaugccuggg

SEQ ID NO: 3397704 - RNA, 19 nt, Human
ccauaugcuaccaccagcu

SEQ ID NO: 3397705 - RNA, 16 nt, Human
ccauauggauccacug

SEQ ID NO: 3397706 - RNA, 12 nt, Human
ccauaugugcuu

SEQ ID NO: 3397707 - RNA, 12 nt, Human
ccauauuaaauu

SEQ ID NO: 3397708 - RNA, 22 nt, Human
ccauauuagaaaacuuuguuag

SEQ ID NO: 3397709 - RNA, 13 nt, Human
ccauauugcacau

SEQ ID NO: 3397710 - RNA, 23 nt, Human
ccauauugcacaugucuuaauga

SEQ ID NO: 3397711 - RNA, 19 nt, Human
ccauauuuaccucagccug

SEQ ID NO: 3397712 - RNA, 12 nt, Human
ccauauuuguaa

SEQ ID NO: 3397713 - RNA, 15 nt, Human
ccauauuuguaaaau

SEQ ID NO: 3397714 - RNA, 17 nt, Human
ccauauuuguaaaauga

SEQ ID NO: 3397715 - RNA, 22 nt, Human
ccauauuuguaaaaugacaauc

SEQ ID NO: 3397716 - RNA, 19 nt, Human
ccauauuuuacuuggaaau

SEQ ID NO: 3397717 - RNA, 20 nt, Human
ccauauuuuauuacuguuua

SEQ ID NO: 3397718 - RNA, 15 nt, Human
ccauauuuuuuuccu

SEQ ID NO: 3397719 - RNA, 17 nt, Human
ccauauuuuuuuccuua

SEQ ID NO: 3397720 - RNA, 19 nt, Human
ccaucaaaaugcuuuuuau

SEQ ID NO: 3397721 - RNA, 18 nt, Human
ccaucaacaaaaauuguc

SEQ ID NO: 3397722 - RNA, 12 nt, Human
ccaucaagccac

SEQ ID NO: 3397723 - RNA, 12 nt, Human
ccaucaaguacc

SEQ ID NO: 3397724 - RNA, 18 nt, Human
ccaucaaguugcacacuc

SEQ ID NO: 3397725 - RNA, 14 nt, Human
ccaucacagcuugu

SEQ ID NO: 3397726 - RNA, 18 nt, Human
ccaucaccuuagaccacc

SEQ ID NO: 3397727 - RNA, 23 nt, Human
ccaucaccuuagaccaccaagcc

SEQ ID NO: 3397728 - RNA, 16 nt, Human
ccaucacgccugugca

SEQ ID NO: 3397729 - RNA, 18 nt, Human
ccaucacugaguuuucca

SEQ ID NO: 3397730 - RNA, 19 nt, Human
ccaucacugcgccacugcu

SEQ ID NO: 3397731 - RNA, 21 nt, Human
ccaucagcccaacgggaagca

SEQ ID NO: 3397732 - RNA, 15 nt, Human
ccaucauaggaaggg

SEQ ID NO: 3397733 - RNA, 15 nt, Human
ccaucaucccagcug

SEQ ID NO: 3397734 - RNA, 16 nt, Human
ccaucaucccagcugc

SEQ ID NO: 3397735 - RNA, 13 nt, Human
ccaucauccuacu

SEQ ID NO: 3397736 - RNA, 14 nt, Human
ccaucauccucugg

SEQ ID NO: 3397737 - RNA, 13 nt, Human
ccaucaucuccug

SEQ ID NO: 3397738 - RNA, 22 nt, Human
ccaucaugcccggucccacccc

SEQ ID NO: 3397739 - RNA, 22 nt, Human
ccaucauggggggagcacccug

SEQ ID NO: 3397740 - RNA, 14 nt, Human
ccaucaugucccca

SEQ ID NO: 3397741 - RNA, 20 nt, Human
ccaucauguuuacagaggac

SEQ ID NO: 3397742 - RNA, 17 nt, Human
ccaucauuauaaacgug

SEQ ID NO: 3397743 - RNA, 14 nt, Human
ccaucauugaaauc

SEQ ID NO: 3397744 - RNA, 16 nt, Human
ccaucauugaaaucuu

SEQ ID NO: 3397745 - RNA, 22 nt, Human
ccaucauugaaaucuuuuugcu

SEQ ID NO: 3397746 - RNA, 18 nt, Human
ccaucauugcugucugca

SEQ ID NO: 3397747 - RNA, 13 nt, Human
ccaucauuucugg

SEQ ID NO: 3397748 - RNA, 15 nt, Human
ccauccaaggccagg

SEQ ID NO: 3397749 - RNA, 19 nt, Human
ccauccaccgcugcuccac

SEQ ID NO: 3397750 - RNA, 20 nt, Human
ccaugacccaccccugugcu

SEQ ID NO: 3397751 - RNA, 16 nt, Human
ccaugacccaggcugg

SEQ ID NO: 3397752 - RNA, 18 nt, Human
ccaugacccaggcugggc

SEQ ID NO: 3397753 - RNA, 15 nt, Human
ccaugaccuccagcu

SEQ ID NO: 3397754 - RNA, 16 nt, Human
ccaugaccuuacauuu

SEQ ID NO: 3397755 - RNA, 22 nt, Human
ccaugacgcaaagagagauuuu

SEQ ID NO: 3397756 - RNA, 12 nt, Human
ccaugacugcuu

SEQ ID NO: 3397757 - RNA, 13 nt, Human
ccaugagaagagg

SEQ ID NO: 3397758 - RNA, 17 nt, Human
ccaugagaagagggccu

SEQ ID NO: 3397759 - RNA, 18 nt, Human
ccaugagaagagggccug

SEQ ID NO: 3397760 - RNA, 19 nt, Human
ccaugagaagagggccugu

SEQ ID NO: 3397761 - RNA, 23 nt, Human
ccaugagaauguuuuagcacagc

SEQ ID NO: 3397762 - RNA, 18 nt, Human
ccaugagagcgcagcccg

SEQ ID NO: 3397763 - RNA, 20 nt, Human
ccaugagauagcauuagcug

SEQ ID NO: 3397764 - RNA, 23 nt, Human
ccaugagaugauacauccaaagc

SEQ ID NO: 3397765 - RNA, 22 nt, Human
ccaugagcaccccaaggcugcg

SEQ ID NO: 3397766 - RNA, 23 nt, Human
ccaugagcuccagacccccagca

SEQ ID NO: 3397767 - RNA, 16 nt, Human
ccaugaggaacaaggc

SEQ ID NO: 3397768 - RNA, 18 nt, Human
ccaugaggaacaaggcaa

SEQ ID NO: 3397769 - RNA, 18 nt, Human
ccaugaggaguugcuguu

SEQ ID NO: 3397770 - RNA, 20 nt, Human
ccaugagggagaugccauga

SEQ ID NO: 3397771 - RNA, 16 nt, Human
ccaugaguccccuguu

SEQ ID NO: 3397772 - RNA, 20 nt, Human
ccaugaguggcauggccacc

SEQ ID NO: 3397773 - RNA, 21 nt, Human
ccaugaguggcauggccacca

SEQ ID NO: 3397774 - RNA, 19 nt, Human
ccaugaguuccagaaagua

SEQ ID NO: 3397775 - RNA, 14 nt, Human
ccaugaucccugug

SEQ ID NO: 3397776 - RNA, 17 nt, Human
ccaugaucccuguguug

SEQ ID NO: 3397777 - RNA, 14 nt, Human
ccaugauggcaaca

SEQ ID NO: 3397778 - RNA, 15 nt, Human
ccaugauggcaacag

SEQ ID NO: 3397779 - RNA, 21 nt, Human
ccaugauggcaacagaucugg

SEQ ID NO: 3397780 - RNA, 19 nt, Human
ccaugauggugcugaccuc

SEQ ID NO: 3397781 - RNA, 22 nt, Human
ccaugauggugcugaccucugg

SEQ ID NO: 3397782 - RNA, 18 nt, Human
ccaugauguuuuccauga

SEQ ID NO: 3397783 - RNA, 19 nt, Human
ccaugcaauauuuccucau

SEQ ID NO: 3397784 - RNA, 13 nt, Human
ccaugcaccaaac

SEQ ID NO: 3397785 - RNA, 17 nt, Human
ccaugcacugugaagga

SEQ ID NO: 3397786 - RNA, 14 nt, Human
ccaugcaggcccuu

SEQ ID NO: 3397787 - RNA, 13 nt, Human
ccaugcagguggu

SEQ ID NO: 3397788 - RNA, 11 nt, Human
ccaugcauuuc

SEQ ID NO: 3397789 - RNA, 20 nt, Human
ccaugccaaagcuagggugg

SEQ ID NO: 3397790 - RNA, 13 nt, Human
ccaugccacguuc

SEQ ID NO: 3397791 - RNA, 14 nt, Human
ccaugccaggaacc

SEQ ID NO: 3397792 - RNA, 21 nt, Human
ccaugcccaccugcccaucac

SEQ ID NO: 3397793 - RNA, 17 nt, Human
ccaugccgucugccgga

SEQ ID NO: 3397794 - RNA, 14 nt, Human
ccaugccucagccc

SEQ ID NO: 3397795 - RNA, 23 nt, Human
ccaugccucccccuagccauuuu

SEQ ID NO: 3397796 - RNA, 15 nt, Human
ccaugccuccucagg

SEQ ID NO: 3397797 - RNA, 12 nt, Human
ccaugccugagg

SEQ ID NO: 3397798 - RNA, 15 nt, Human
ccaugccugagggug

SEQ ID NO: 3397799 - RNA, 18 nt, Human
ccaugccuguccagccug

SEQ ID NO: 3397800 - RNA, 14 nt, Human
ccaugcgcccccuc

SEQ ID NO: 3397801 - RNA, 15 nt, Human
ccaugcgcucagggc

SEQ ID NO: 3397802 - RNA, 22 nt, Human
ccaugcuccucacugcccgcac

SEQ ID NO: 3397803 - RNA, 24 nt, Human
ccaugcuccucuuccccagacgcc

SEQ ID NO: 3397804 - RNA, 18 nt, Human
ccaugcuccuggcccacu

SEQ ID NO: 3397805 - RNA, 16 nt, Human
ccaugcugaagggacc

SEQ ID NO: 3397806 - RNA, 16 nt, Human
ccaugcugaggccugg

SEQ ID NO: 3397807 - RNA, 18 nt, Human
ccaugcugaggccugggc

SEQ ID NO: 3397808 - RNA, 19 nt, Human
ccaugcugaggccugggcc

SEQ ID NO: 3397809 - RNA, 15 nt, Human
ccaugcugcccugug

SEQ ID NO: 3397810 - RNA, 14 nt, Human
ccaugcugccucca

SEQ ID NO: 3397811 - RNA, 14 nt, Human
ccaugcugcugggg

SEQ ID NO: 3397812 - RNA, 21 nt, Human
ccaugcugcuggggaagacag

SEQ ID NO: 3397813 - RNA, 16 nt, Human
ccaugcuggagccugu

SEQ ID NO: 3397814 - RNA, 20 nt, Human
ccaugcuggagccuguguaa

SEQ ID NO: 3397815 - RNA, 21 nt, Human
ccaugcuggagccuguguaac

SEQ ID NO: 3397816 - RNA, 16 nt, Human
ccaugcugggaagacg

SEQ ID NO: 3397817 - RNA, 22 nt, Human
ccaugcugucuggcacagccug

SEQ ID NO: 3397818 - RNA, 22 nt, Human
ccaugcugugcgcccagggcug

SEQ ID NO: 3397819 - RNA, 15 nt, Human
ccaugcuugggugua

SEQ ID NO: 3397820 - RNA, 16 nt, Human
ccauggaaaaaugcca

SEQ ID NO: 3397821 - RNA, 19 nt, Human
ccauggacacuacacccag

SEQ ID NO: 3397822 - RNA, 17 nt, Human
ccauggacacuccagug

SEQ ID NO: 3397823 - RNA, 21 nt, Human
ccauggacacuccagugccag

SEQ ID NO: 3397824 - RNA, 18 nt, Human
ccauggacaggcuggcuc

SEQ ID NO: 3397825 - RNA, 22 nt, Human
ccauggacucuacacugugaac

SEQ ID NO: 3397826 - RNA, 16 nt, Human
ccauggacucuguccu

SEQ ID NO: 3397827 - RNA, 23 nt, Human
ccauggacuucacauaagcucag

SEQ ID NO: 3397828 - RNA, 14 nt, Human
ccauggacuuuaua

SEQ ID NO: 3397829 - RNA, 14 nt, Human
ccauggagaaagcu

SEQ ID NO: 3397830 - RNA, 20 nt, Human
ccauggagaaagcugacuug

SEQ ID NO: 3397831 - RNA, 15 nt, Human
ccauggagagcugga

SEQ ID NO: 3397832 - RNA, 22 nt, Human
ccauggagagcuggagccuggu

SEQ ID NO: 3397833 - RNA, 18 nt, Human
ccauggagauugaccugg

SEQ ID NO: 3397834 - RNA, 19 nt, Human
ccauggagauugaccugga

SEQ ID NO: 3397835 - RNA, 17 nt, Human
ccauggagccagcuccc

SEQ ID NO: 3397836 - RNA, 14 nt, Human
ccauggagccccag

SEQ ID NO: 3397837 - RNA, 16 nt, Human
ccauggagccccagcc

SEQ ID NO: 3397838 - RNA, 19 nt, Human
ccauggagggagggagugg

SEQ ID NO: 3397839 - RNA, 14 nt, Human
ccauggaguggcag

SEQ ID NO: 3397840 - RNA, 19 nt, Human
ccauggaguggcagcccag

SEQ ID NO: 3397841 - RNA, 16 nt, Human
ccauggauggaaaacg

SEQ ID NO: 3397842 - RNA, 23 nt, Human
ccauggcacucuauguucuaaga

SEQ ID NO: 3397843 - RNA, 13 nt, Human
ccauggcccugcc

SEQ ID NO: 3397844 - RNA, 18 nt, Human
ccauggccggcuuucagg

SEQ ID NO: 3397845 - RNA, 18 nt, Human
ccauggccugcaaacugg

SEQ ID NO: 3397846 - RNA, 19 nt, Human
ccauggcgugucccucucg

SEQ ID NO: 3397847 - RNA, 17 nt, Human
ccauggcucaggguggu

SEQ ID NO: 3397848 - RNA, 22 nt, Human
ccaugggagcugguuagaaaug

SEQ ID NO: 3397849 - RNA, 21 nt, Human
ccaugggaggccuuucccuaa

SEQ ID NO: 3397850 - RNA, 17 nt, Human
ccaugggaggcuggagu

SEQ ID NO: 3397851 - RNA, 21 nt, Human
ccaugggcacaaagggcccag

SEQ ID NO: 3397852 - RNA, 15 nt, Human
ccaugggcacugcug

SEQ ID NO: 3397853 - RNA, 17 nt, Human
ccaugggcagagcccaa

SEQ ID NO: 3397854 - RNA, 12 nt, Human
ccaugggcagga

SEQ ID NO: 3397855 - RNA, 13 nt, Human
ccaugggccuccu

SEQ ID NO: 3397856 - RNA, 15 nt, Human
ccaugggccuccugu

SEQ ID NO: 3397857 - RNA, 13 nt, Human
ccaugggcucuga

SEQ ID NO: 3397858 - RNA, 12 nt, Human
ccauggggaggg

SEQ ID NO: 3397859 - RNA, 18 nt, Human
ccauggggagggauucug

SEQ ID NO: 3397860 - RNA, 13 nt, Human
ccaugggggcagg

SEQ ID NO: 3397861 - RNA, 23 nt, Human
ccauggggucucucacagacagg

SEQ ID NO: 3397862 - RNA, 20 nt, Human
ccaugguacccccuucuggg

SEQ ID NO: 3397863 - RNA, 20 nt, Human
ccauggucggaaaacaugcu

SEQ ID NO: 3397864 - RNA, 20 nt, Human
ccauggugaugguguagccc

SEQ ID NO: 3397865 - RNA, 14 nt, Human
ccauggugcuuguu

SEQ ID NO: 3397866 - RNA, 14 nt, Human
ccaugguugagaaa

SEQ ID NO: 3397867 - RNA, 14 nt, Human
ccauguaaaacaaa

SEQ ID NO: 3397868 - RNA, 14 nt, Human
ccauguaaauacca

SEQ ID NO: 3397869 - RNA, 23 nt, Human
ccauguaaauaccagacugcagg

SEQ ID NO: 3397870 - RNA, 11 nt, Human
ccauguaacug

SEQ ID NO: 3397871 - RNA, 18 nt, Human
ccauguaacugccuagaa

SEQ ID NO: 3397872 - RNA, 23 nt, Human
ccauguaauggcaguuauauuuu

SEQ ID NO: 3397873 - RNA, 15 nt, Human
ccauguacuguaguu

SEQ ID NO: 3397874 - RNA, 16 nt, Human
ccauguacuguaguuu

SEQ ID NO: 3397875 - RNA, 18 nt, Human
ccauguagaagcugcauc

SEQ ID NO: 3397876 - RNA, 22 nt, Human
ccauguagcccccuggccucug

SEQ ID NO: 3397877 - RNA, 15 nt, Human
ccauguaugcauaau

SEQ ID NO: 3397878 - RNA, 23 nt, Human
ccauguauggaaucccacuguau

SEQ ID NO: 3397879 - RNA, 16 nt, Human
ccaugucaaacaaaua

SEQ ID NO: 3397880 - RNA, 22 nt, Human
ccaugucaagagucgcugugcc

SEQ ID NO: 3397881 - RNA, 15 nt, Human
ccaugucaagauuca

SEQ ID NO: 3397882 - RNA, 19 nt, Human
ccaugucaagauucagcua

SEQ ID NO: 3397883 - RNA, 14 nt, Human
ccauguccaaagag

SEQ ID NO: 3397884 - RNA, 17 nt, Human
ccauguccaaagaggcu

SEQ ID NO: 3397885 - RNA, 19 nt, Human
ccauguccaaagaggcugc

SEQ ID NO: 3397886 - RNA, 15 nt, Human
ccauguccccuccca

SEQ ID NO: 3397887 - RNA, 16 nt, Human
ccauguccuaugugug

SEQ ID NO: 3397888 - RNA, 17 nt, Human
ccaugucgccucugcau

SEQ ID NO: 3397889 - RNA, 19 nt, Human
ccaugucgccucugcauuc

SEQ ID NO: 3397890 - RNA, 14 nt, Human
ccaugucggccucu

SEQ ID NO: 3397891 - RNA, 16 nt, Human
ccaugucuucucccug

SEQ ID NO: 3397892 - RNA, 20 nt, Human
ccaugucuucucccuggaau

SEQ ID NO: 3397893 - RNA, 15 nt, Human
ccaugucuuucucca

SEQ ID NO: 3397894 - RNA, 22 nt, Human
cccaauuucggauuuuuuccaa

SEQ ID NO: 3397895 - RNA, 14 nt, Human
cccacaaaggagag

SEQ ID NO: 3397896 - RNA, 13 nt, Human
cccacaagccuga

SEQ ID NO: 3397897 - RNA, 21 nt, Human
cccacaagugcccuccaggcu

SEQ ID NO: 3397898 - RNA, 20 nt, Human
cccacaaguggugguaaccc

SEQ ID NO: 3397899 - RNA, 23 nt, Human
cccacaaguggugguaacccugg

SEQ ID NO: 3397900 - RNA, 22 nt, Human
cccacaaucuuaaggggcagcu

SEQ ID NO: 3397901 - RNA, 14 nt, Human
cccacacacacaca

SEQ ID NO: 3397902 - RNA, 18 nt, Human
cccacacacacacacaug

SEQ ID NO: 3397903 - RNA, 19 nt, Human
cccacacacacacacaugc

SEQ ID NO: 3397904 - RNA, 11 nt, Human
cccacacacag

SEQ ID NO: 3397905 - RNA, 13 nt, Human
cccacacacagau

SEQ ID NO: 3397906 - RNA, 13 nt, Human
cccacacacaggu

SEQ ID NO: 3397907 - RNA, 13 nt, Human
cccacacacccca

SEQ ID NO: 3397908 - RNA, 13 nt, Human
cccacacacucgc

SEQ ID NO: 3397909 - RNA, 14 nt, Human
cccacacccagcua

SEQ ID NO: 3397910 - RNA, 13 nt, Human
cccacaccucagu

SEQ ID NO: 3397911 - RNA, 18 nt, Human
cccacaccuccucucacu

SEQ ID NO: 3397912 - RNA, 16 nt, Human
cccacaccuccugggg

SEQ ID NO: 3397913 - RNA, 22 nt, Human
cccacacucagauccuccucau

SEQ ID NO: 3397914 - RNA, 16 nt, Human
cccacagaaagagagc

SEQ ID NO: 3397915 - RNA, 23 nt, Human
cccacagacaaaagcgcuuuucc

SEQ ID NO: 3397916 - RNA, 14 nt, Human
cccacagcccgcau

SEQ ID NO: 3397917 - RNA, 14 nt, Human
cccacagccucugc

SEQ ID NO: 3397918 - RNA, 13 nt, Human
cccacagcgcugg

SEQ ID NO: 3397919 - RNA, 16 nt, Human
cccacagcgcuggccg

SEQ ID NO: 3397920 - RNA, 18 nt, Human
cccacagcgucccuggcg

SEQ ID NO: 3397921 - RNA, 12 nt, Human
cccacagcuccc

SEQ ID NO: 3397922 - RNA, 14 nt, Human
cccacagcucccac

SEQ ID NO: 3397923 - RNA, 17 nt, Human
cccacagcucccacccc

SEQ ID NO: 3397924 - RNA, 20 nt, Human
cccacaggacauuucucuaa

SEQ ID NO: 3397925 - RNA, 16 nt, Human
cccacaggaggcaagc

SEQ ID NO: 3397926 - RNA, 12 nt, Human
cccacaggcagc

SEQ ID NO: 3397927 - RNA, 23 nt, Human
cccacaguauauuuuauuucaau

SEQ ID NO: 3397928 - RNA, 22 nt, Human
cccacagugacucgggcuccug

SEQ ID NO: 3397929 - RNA, 19 nt, Human
cccacauagugaugguucc

SEQ ID NO: 3397930 - RNA, 16 nt, Human
cccacaucccaggcuu

SEQ ID NO: 3397931 - RNA, 15 nt, Human
cccacaucccugggc

SEQ ID NO: 3397932 - RNA, 16 nt, Human
cccacaucccugggcc

SEQ ID NO: 3397933 - RNA, 18 nt, Human
cccacaucccugggccug

SEQ ID NO: 3397934 - RNA, 22 nt, Human
cccacauccggggccagcuccg

SEQ ID NO: 3397935 - RNA, 18 nt, Human
cccacaugccaggggccu

SEQ ID NO: 3397936 - RNA, 19 nt, Human
cccacaugugacacauaug

SEQ ID NO: 3397937 - RNA, 21 nt, Human
cccacauuugugccgacacug

SEQ ID NO: 3397938 - RNA, 22 nt, Human
cccacauuugugccgacacugu

SEQ ID NO: 3397939 - RNA, 16 nt, Human
cccaccaacccucagg

SEQ ID NO: 3397940 - RNA, 13 nt, Human
cccaccacacaac

SEQ ID NO: 3397941 - RNA, 15 nt, Human
cccaccacacauccc

SEQ ID NO: 3397942 - RNA, 17 nt, Human
cccaccacacaucccag

SEQ ID NO: 3397943 - RNA, 17 nt, Human
cccaccacacccucccu

SEQ ID NO: 3397944 - RNA, 21 nt, Human
cccaccaccuaggccacuccu

SEQ ID NO: 3397945 - RNA, 22 nt, Human
cccaccaccuaggccacuccuc

SEQ ID NO: 3397946 - RNA, 21 nt, Human
cccaccacggccacuggccau

SEQ ID NO: 3397947 - RNA, 23 nt, Human
cccaccacuaggacucugaggcu

SEQ ID NO: 3397948 - RNA, 16 nt, Human
cccaccagaugcugaa

SEQ ID NO: 3397949 - RNA, 17 nt, Human
cccaccaggcugcucag

SEQ ID NO: 3397950 - RNA, 15 nt, Human
cccaccagugccucu

SEQ ID NO: 3397951 - RNA, 16 nt, Human
cccaccauaugaauug

SEQ ID NO: 3397952 - RNA, 13 nt, Human
cccaccaucugcu

SEQ ID NO: 3397953 - RNA, 22 nt, Human
cccacccaagcuuggcagccga

SEQ ID NO: 3397954 - RNA, 15 nt, Human
cccacccaagggccu

SEQ ID NO: 3397955 - RNA, 16 nt, Human
cccacccacuucugca

SEQ ID NO: 3397956 - RNA, 21 nt, Human
cccacccagcacccagcaacu

SEQ ID NO: 3397957 - RNA, 22 nt, Human
cccacccaggaguauccucuug

SEQ ID NO: 3397958 - RNA, 15 nt, Human
cccacccaggccagg

SEQ ID NO: 3397959 - RNA, 13 nt, Human
cccaccccacacu

SEQ ID NO: 3397960 - RNA, 15 nt, Human
cccaccccagggcag

SEQ ID NO: 3397961 - RNA, 15 nt, Human
cccacccccaccccc

SEQ ID NO: 3397962 - RNA, 18 nt, Human
cccacccccacccccacc

SEQ ID NO: 3397963 - RNA, 12 nt, Human
cccacccccauc

SEQ ID NO: 3397964 - RNA, 13 nt, Human
cccaccccccuca

SEQ ID NO: 3397965 - RNA, 13 nt, Human
cccacccccucaa

SEQ ID NO: 3397966 - RNA, 13 nt, Human
cccacccccugcc

SEQ ID NO: 3397967 - RNA, 21 nt, Human
cccaccccggggacccuguga

SEQ ID NO: 3397968 - RNA, 12 nt, Human
cccaccccugcc

SEQ ID NO: 3397969 - RNA, 12 nt, Human
cccaccccuggg

SEQ ID NO: 3397970 - RNA, 15 nt, Human
cccaccccugugcuc

SEQ ID NO: 3397971 - RNA, 21 nt, Human
cccaccccugugcuccgugcc

SEQ ID NO: 3397972 - RNA, 12 nt, Human
cccaccccuucc

SEQ ID NO: 3397973 - RNA, 14 nt, Human
cccacccgaugcug

SEQ ID NO: 3397974 - RNA, 13 nt, Human
cccacccgguggg

SEQ ID NO: 3397975 - RNA, 13 nt, Human
cccacccucagca

SEQ ID NO: 3397976 - RNA, 15 nt, Human
cccacccucccugga

SEQ ID NO: 3397977 - RNA, 16 nt, Human
cccacccucccuggag

SEQ ID NO: 3397978 - RNA, 14 nt, Human
cccacccuccuggc

SEQ ID NO: 3397979 - RNA, 19 nt, Human
cccacccuccugucuuccc

SEQ ID NO: 3397980 - RNA, 20 nt, Human
cccacccugcuuggcccagg

SEQ ID NO: 3397981 - RNA, 14 nt, Human
cccacccuguuccu

SEQ ID NO: 3397982 - RNA, 15 nt, Human
cccacccuguuccug

SEQ ID NO: 3397983 - RNA, 21 nt, Human
cccacccuguuuggauuuuua

SEQ ID NO: 3397984 - RNA, 18 nt, Human
cccaccgcagacaggacc

SEQ ID NO: 3397985 - RNA, 20 nt, Human
cccaccgcaugcccccucgu

SEQ ID NO: 3397986 - RNA, 17 nt, Human
cccaccgguccagcugg

SEQ ID NO: 3397987 - RNA, 21 nt, Human
cccaccgguccagcuggccug

SEQ ID NO: 3397988 - RNA, 18 nt, Human
cccaccgguugcuucugg

SEQ ID NO: 3397989 - RNA, 20 nt, Human
cccaccgguugcuucuggga

SEQ ID NO: 3397990 - RNA, 23 nt, Human
cccaccgguugcuucugggaagg

SEQ ID NO: 3397991 - RNA, 17 nt, Human
cccaccgugggcaggga

SEQ ID NO: 3397992 - RNA, 19 nt, Human
cccaccgugggcagggagc

SEQ ID NO: 3397993 - RNA, 20 nt, Human
cccaccguugucucaugcca

SEQ ID NO: 3397994 - RNA, 13 nt, Human
cccaccucacccc

SEQ ID NO: 3397995 - RNA, 18 nt, Human
cccaccucagccucccaa

SEQ ID NO: 3397996 - RNA, 11 nt, Human
cccaccuccac

SEQ ID NO: 3397997 - RNA, 14 nt, Human
cccaccuccccacg

SEQ ID NO: 3397998 - RNA, 17 nt, Human
cccaccuccccacgccc

SEQ ID NO: 3397999 - RNA, 12 nt, Human
cccaccucccug

SEQ ID NO: 3398000 - RNA, 18 nt, Human
cccaccucccugcccagg

SEQ ID NO: 3398001 - RNA, 19 nt, Human
cccaccucccugcccaggc

SEQ ID NO: 3398002 - RNA, 15 nt, Human
cccaccucccugccu

SEQ ID NO: 3398003 - RNA, 16 nt, Human
cccaccucccugccuc

SEQ ID NO: 3398004 - RNA, 17 nt, Human
cccaccucccugccucc

SEQ ID NO: 3398005 - RNA, 13 nt, Human
cccaccuccugca

SEQ ID NO: 3398006 - RNA, 22 nt, Human
cccaccucuccccaccuuaccc

SEQ ID NO: 3398007 - RNA, 22 nt, Human
cccaccucucucacuccuugaa

SEQ ID NO: 3398008 - RNA, 12 nt, Human
cccaccucuucu

SEQ ID NO: 3398009 - RNA, 18 nt, Human
cccaccugacacaccagg

SEQ ID NO: 3398010 - RNA, 12 nt, Human
cccaccugagcu

SEQ ID NO: 3398011 - RNA, 12 nt, Human
cccaccugcagg

SEQ ID NO: 3398012 - RNA, 20 nt, Human
cccaccugcccaucacaggg

SEQ ID NO: 3398013 - RNA, 23 nt, Human
cccaccugcccaucacaggguug

SEQ ID NO: 3398014 - RNA, 13 nt, Human
cccaccugccggc

SEQ ID NO: 3398015 - RNA, 14 nt, Human
cccaccugccggcc

SEQ ID NO: 3398016 - RNA, 13 nt, Human
cccaccugcugag

SEQ ID NO: 3398017 - RNA, 16 nt, Human
cccaccuggccaccug

SEQ ID NO: 3398018 - RNA, 17 nt, Human
cccaccuggccaccuga

SEQ ID NO: 3398019 - RNA, 20 nt, Human
cccaccuggccaccugaggu

SEQ ID NO: 3398020 - RNA, 13 nt, Human
cccaccuggcccu

SEQ ID NO: 3398021 - RNA, 12 nt, Human
cccaccuggccu

SEQ ID NO: 3398022 - RNA, 13 nt, Human
cccaccugggacc

SEQ ID NO: 3398023 - RNA, 20 nt, Human
cccaccugguggccucugcc

SEQ ID NO: 3398024 - RNA, 12 nt, Human
cccaccugucuu

SEQ ID NO: 3398025 - RNA, 15 nt, Human
cccaccuuggcucaa

SEQ ID NO: 3398026 - RNA, 14 nt, Human
cccaccuuggcugc

SEQ ID NO: 3398027 - RNA, 15 nt, Human
cccaccuuggcugca

SEQ ID NO: 3398028 - RNA, 16 nt, Human
cccaccuuggcugcag

SEQ ID NO: 3398029 - RNA, 17 nt, Human
cccaccuuguuggagcc

SEQ ID NO: 3398030 - RNA, 21 nt, Human
cccaccuuguuggagccugca

SEQ ID NO: 3398031 - RNA, 22 nt, Human
cccacgauuuucuccagcucag

SEQ ID NO: 3398032 - RNA, 13 nt, Human
cccacgcccccac

SEQ ID NO: 3398033 - RNA, 14 nt, Human
cccacgcccccacu

SEQ ID NO: 3398034 - RNA, 15 nt, Human
cccacgcccccacug

SEQ ID NO: 3398035 - RNA, 17 nt, Human
cccacgcccuccccucc

SEQ ID NO: 3398036 - RNA, 16 nt, Human
cccacgccgggaacca

SEQ ID NO: 3398037 - RNA, 14 nt, Human
cccacgcuggagug

SEQ ID NO: 3398038 - RNA, 20 nt, Human
cccacggagucguggggugu

SEQ ID NO: 3398039 - RNA, 22 nt, Human
cccacguccugucagugccgcc

SEQ ID NO: 3398040 - RNA, 19 nt, Human
cccacgugucuuccacuuu

SEQ ID NO: 3398041 - RNA, 20 nt, Human
ccccuuuacccucuuugcug

SEQ ID NO: 3398042 - RNA, 19 nt, Human
ccccuuucacaggcagcca

SEQ ID NO: 3398043 - RNA, 13 nt, Human
ccccuuucccacc

SEQ ID NO: 3398044 - RNA, 14 nt, Human
ccccuuucccaccc

SEQ ID NO: 3398045 - RNA, 22 nt, Human
ccccuuuccuggacacucagac

SEQ ID NO: 3398046 - RNA, 23 nt, Human
ccccuuuccuggacacucagacc

SEQ ID NO: 3398047 - RNA, 14 nt, Human
ccccuuucuuccuc

SEQ ID NO: 3398048 - RNA, 18 nt, Human
ccccuuugcugacccucc

SEQ ID NO: 3398049 - RNA, 16 nt, Human
ccccuuugggcccagg

SEQ ID NO: 3398050 - RNA, 17 nt, Human
ccccuuugggcccaggg

SEQ ID NO: 3398051 - RNA, 20 nt, Human
ccccuuugggcccugcaugu

SEQ ID NO: 3398052 - RNA, 22 nt, Human
ccccuuuucggccccauguauc

SEQ ID NO: 3398053 - RNA, 12 nt, Human
ccccuuuugcau

SEQ ID NO: 3398054 - RNA, 19 nt, Human
ccccuuuuuacuccccuug

SEQ ID NO: 3398055 - RNA, 20 nt, Human
ccccuuuuuugucccccaac

SEQ ID NO: 3398056 - RNA, 23 nt, Human
cccgaauacaaacaccuggacuu

SEQ ID NO: 3398057 - RNA, 17 nt, Human
cccgacaccggccagug

SEQ ID NO: 3398058 - RNA, 12 nt, Human
cccgacagaggg

SEQ ID NO: 3398059 - RNA, 14 nt, Human
cccgacagccuggc

SEQ ID NO: 3398060 - RNA, 12 nt, Human
cccgacauggcu

SEQ ID NO: 3398061 - RNA, 12 nt, Human
cccgacuccagu

SEQ ID NO: 3398062 - RNA, 14 nt, Human
cccgacuccucaaa

SEQ ID NO: 3398063 - RNA, 17 nt, Human
cccgacuggggcagggu

SEQ ID NO: 3398064 - RNA, 21 nt, Human
cccgagaacauggccuaaggg

SEQ ID NO: 3398065 - RNA, 21 nt, Human
cccgagcagcugagcagggcc

SEQ ID NO: 3398066 - RNA, 17 nt, Human
cccgagcuccucuucca

SEQ ID NO: 3398067 - RNA, 12 nt, Human
cccgagcuggug

SEQ ID NO: 3398068 - RNA, 17 nt, Human
cccgaggacccagaccc

SEQ ID NO: 3398069 - RNA, 16 nt, Human
cccgaggcccugcaug

SEQ ID NO: 3398070 - RNA, 20 nt, Human
cccgagggaugaugccacac

SEQ ID NO: 3398071 - RNA, 17 nt, Human
cccgaggguugauuaag

SEQ ID NO: 3398072 - RNA, 17 nt, Human
cccgagguggcugccug

SEQ ID NO: 3398073 - RNA, 22 nt, Human
cccgagguggcugccuggagcc

SEQ ID NO: 3398074 - RNA, 14 nt, Human
cccgaguagcuggg

SEQ ID NO: 3398075 - RNA, 18 nt, Human
cccgagucugggacacaa

SEQ ID NO: 3398076 - RNA, 16 nt, Human
cccgaguuuccccaga

SEQ ID NO: 3398077 - RNA, 13 nt, Human
cccgaucuuucua

SEQ ID NO: 3398078 - RNA, 14 nt, Human
cccgaugcugcuuu

SEQ ID NO: 3398079 - RNA, 22 nt, Human
cccgaugcugcuuuccccugug

SEQ ID NO: 3398080 - RNA, 16 nt, Human
cccgauguggaccucu

SEQ ID NO: 3398081 - RNA, 16 nt, Human
cccgcaagcaccaucc

SEQ ID NO: 3398082 - RNA, 22 nt, Human
cccgcacacccucacucugcca

SEQ ID NO: 3398083 - RNA, 19 nt, Human
cccgcagaccuccccagcc

SEQ ID NO: 3398084 - RNA, 21 nt, Human
cccgcagaccuccccagcccc

SEQ ID NO: 3398085 - RNA, 23 nt, Human
cccgcagugggagcaaacugcau

SEQ ID NO: 3398086 - RNA, 22 nt, Human
cccgcagugugcacuaaggggc

SEQ ID NO: 3398087 - RNA, 14 nt, Human
cccgcauccccugc

SEQ ID NO: 3398088 - RNA, 15 nt, Human
cccgcauccccugcc

SEQ ID NO: 3398089 - RNA, 16 nt, Human
cccgcauccccugccu

SEQ ID NO: 3398090 - RNA, 17 nt, Human
cccgcauccccugccuc

SEQ ID NO: 3398091 - RNA, 19 nt, Human
cccgcauccccugccucca

SEQ ID NO: 3398092 - RNA, 19 nt, Human
cccgcaugcagcagcuugc

SEQ ID NO: 3398093 - RNA, 20 nt, Human
cccgcaugcagcagcuugcu

SEQ ID NO: 3398094 - RNA, 15 nt, Human
cccgcauuccaggcu

SEQ ID NO: 3398095 - RNA, 16 nt, Human
cccgcauuccaggcuc

SEQ ID NO: 3398096 - RNA, 23 nt, Human
cccgccaccuaucucgugggaga

SEQ ID NO: 3398097 - RNA, 18 nt, Human
cccgcccacuguccuggg

SEQ ID NO: 3398098 - RNA, 15 nt, Human
cccgcccaggcuggc

SEQ ID NO: 3398099 - RNA, 22 nt, Human
cccgcccaggcuuagucacuga

SEQ ID NO: 3398100 - RNA, 18 nt, Human
cccgccgccugguacuca

SEQ ID NO: 3398101 - RNA, 13 nt, Human
cccgccucagccu

SEQ ID NO: 3398102 - RNA, 19 nt, Human
cccgccuccaaccccucgc

SEQ ID NO: 3398103 - RNA, 11 nt, Human
cccgccugcca

SEQ ID NO: 3398104 - RNA, 16 nt, Human
cccgccugccaguccu

SEQ ID NO: 3398105 - RNA, 16 nt, Human
cccgccugcccaccug

SEQ ID NO: 3398106 - RNA, 17 nt, Human
cccgccugcccaccugc

SEQ ID NO: 3398107 - RNA, 20 nt, Human
cccgccugcccaccugccug

SEQ ID NO: 3398108 - RNA, 14 nt, Human
cccgccugcccuca

SEQ ID NO: 3398109 - RNA, 22 nt, Human
cccgccuggcagaacugagcuc

SEQ ID NO: 3398110 - RNA, 12 nt, Human
cccgccuggcca

SEQ ID NO: 3398111 - RNA, 16 nt, Human
cccgccuggccaggag

SEQ ID NO: 3398112 - RNA, 14 nt, Human
cccgccuguucccc

SEQ ID NO: 3398113 - RNA, 23 nt, Human
cccgccuuccgccccuucccuuc

SEQ ID NO: 3398114 - RNA, 15 nt, Human
cccgcgccuccuucc

SEQ ID NO: 3398115 - RNA, 13 nt, Human
cccgcuaagaggg

SEQ ID NO: 3398116 - RNA, 15 nt, Human
cccgcuaaggaagau

SEQ ID NO: 3398117 - RNA, 13 nt, Human
cccgcucagcccu

SEQ ID NO: 3398118 - RNA, 23 nt, Human
cccgcucagcccucccugccccu

SEQ ID NO: 3398119 - RNA, 12 nt, Human
cccgcucccagu

SEQ ID NO: 3398120 - RNA, 21 nt, Human
cccgcucuacaucuucugccu

SEQ ID NO: 3398121 - RNA, 22 nt, Human
cccgcucugcaugcggcccagc

SEQ ID NO: 3398122 - RNA, 12 nt, Human
cccgcucuggac

SEQ ID NO: 3398123 - RNA, 15 nt, Human
cccgcugcugcugcu

SEQ ID NO: 3398124 - RNA, 12 nt, Human
cccgcuggagga

SEQ ID NO: 3398125 - RNA, 23 nt, Human
cccgcuggaggaugugggcagcu

SEQ ID NO: 3398126 - RNA, 12 nt, Human
cccgcugggcug

SEQ ID NO: 3398127 - RNA, 15 nt, Human
cccgcuugccucggc

SEQ ID NO: 3398128 - RNA, 23 nt, Human
cccggaagccaaaccucugugag

SEQ ID NO: 3398129 - RNA, 19 nt, Human
cccggagauuggacggccu

SEQ ID NO: 3398130 - RNA, 14 nt, Human
cccggagcuggagg

SEQ ID NO: 3398131 - RNA, 14 nt, Human
cccggaggaaaucu

SEQ ID NO: 3398132 - RNA, 16 nt, Human
cccggaggaaaucugc

SEQ ID NO: 3398133 - RNA, 19 nt, Human
cccggaggcggugggccug

SEQ ID NO: 3398134 - RNA, 18 nt, Human
cccggagguugggugggc

SEQ ID NO: 3398135 - RNA, 15 nt, Human
cccggaucagagcag

SEQ ID NO: 3398136 - RNA, 20 nt, Human
cccggaucagagcaggaccu

SEQ ID NO: 3398137 - RNA, 22 nt, Human
cccggaucagagcaggaccucc

SEQ ID NO: 3398138 - RNA, 17 nt, Human
cccggcacccccugcag

SEQ ID NO: 3398139 - RNA, 19 nt, Human
cccggcacccccugcagcu

SEQ ID NO: 3398140 - RNA, 19 nt, Human
cccggcacccucuggccgc

SEQ ID NO: 3398141 - RNA, 13 nt, Human
cccggcagacgcc

SEQ ID NO: 3398142 - RNA, 16 nt, Human
cccggcaggguccuag

SEQ ID NO: 3398143 - RNA, 20 nt, Human
cccggccaccucugcggacc

SEQ ID NO: 3398144 - RNA, 19 nt, Human
cccggccauguccuuagca

SEQ ID NO: 3398145 - RNA, 14 nt, Human
cccggccccagcca

SEQ ID NO: 3398146 - RNA, 20 nt, Human
cccggccugcucccagcagc

SEQ ID NO: 3398147 - RNA, 14 nt, Human
cccggcgcgguggc

SEQ ID NO: 3398148 - RNA, 17 nt, Human
cccggcuaauuuuugua

SEQ ID NO: 3398149 - RNA, 20 nt, Human
cccggcuaauuuuuguauuu

SEQ ID NO: 3398150 - RNA, 15 nt, Human
cccggcuccaggcuc

SEQ ID NO: 3398151 - RNA, 16 nt, Human
cccggcuccaggcucc

SEQ ID NO: 3398152 - RNA, 18 nt, Human
cccggcucuacgggggcc

SEQ ID NO: 3398153 - RNA, 20 nt, Human
cccggcucuacgggggccgc

SEQ ID NO: 3398154 - RNA, 20 nt, Human
cccggcuuccuuucccaagc

SEQ ID NO: 3398155 - RNA, 12 nt, Human
cccgggaagggg

SEQ ID NO: 3398156 - RNA, 15 nt, Human
cccgggaagggggcu

SEQ ID NO: 3398157 - RNA, 18 nt, Human
cccgggacgcagcaggag

SEQ ID NO: 3398158 - RNA, 24 nt, Human
cccgggacucacuggcagccccag

SEQ ID NO: 3398159 - RNA, 12 nt, Human
cccgggagccua

SEQ ID NO: 3398160 - RNA, 13 nt, Human
cccgggaggcaga

SEQ ID NO: 3398161 - RNA, 23 nt, Human
cccgggaggcagagguugcagug

SEQ ID NO: 3398162 - RNA, 15 nt, Human
cccgggagggcggca

SEQ ID NO: 3398163 - RNA, 17 nt, Human
cccgggaggggcccgcu

SEQ ID NO: 3398164 - RNA, 21 nt, Human
cccgggcagggcucccacaga

SEQ ID NO: 3398165 - RNA, 22 nt, Human
cccgggcagggcucccacagag

SEQ ID NO: 3398166 - RNA, 14 nt, Human
cccgggccagggcu

SEQ ID NO: 3398167 - RNA, 16 nt, Human
cccgggcccagaggag

SEQ ID NO: 3398168 - RNA, 12 nt, Human
cccgggcugccu

SEQ ID NO: 3398169 - RNA, 16 nt, Human
cccgggcugccugggc

SEQ ID NO: 3398170 - RNA, 23 nt, Human
cccgggcugccugggcuguuggc

SEQ ID NO: 3398171 - RNA, 22 nt, Human
cccggggaaaggcaagguccgg

SEQ ID NO: 3398172 - RNA, 17 nt, Human
cccggggacccugugac

SEQ ID NO: 3398173 - RNA, 13 nt, Human
cccgggggugggg

SEQ ID NO: 3398174 - RNA, 20 nt, Human
cccggucccaccccucccuc

SEQ ID NO: 3398175 - RNA, 15 nt, Human
cccgguucuuccagu

SEQ ID NO: 3398176 - RNA, 18 nt, Human
cccgucaccaucucaggc

SEQ ID NO: 3398177 - RNA, 13 nt, Human
cccguccugccug

SEQ ID NO: 3398178 - RNA, 13 nt, Human
cccgucucagugu

SEQ ID NO: 3398179 - RNA, 15 nt, Human
cccgucucucuccca

SEQ ID NO: 3398180 - RNA, 20 nt, Human
cccgucugggguucagcccc

SEQ ID NO: 3398181 - RNA, 17 nt, Human
cccgucuucagccuagc

SEQ ID NO: 3398182 - RNA, 18 nt, Human
cccgucuucagccuagcc

SEQ ID NO: 3398183 - RNA, 18 nt, Human
cccgugcaaaacaugcua

SEQ ID NO: 3398184 - RNA, 15 nt, Human
cccgugcagacugga

SEQ ID NO: 3398185 - RNA, 13 nt, Human
cccguggaggcug

SEQ ID NO: 3398186 - RNA, 12 nt, Human
cccuccaccuuc

SEQ ID NO: 3398187 - RNA, 17 nt, Human
cccuccacucagcuguc

SEQ ID NO: 3398188 - RNA, 21 nt, Human
cccuccacucagcuguccugc

SEQ ID NO: 3398189 - RNA, 12 nt, Human
cccuccacuccu

SEQ ID NO: 3398190 - RNA, 19 nt, Human
cccuccagagccccacagc

SEQ ID NO: 3398191 - RNA, 16 nt, Human
cccuccagcacaaaca

SEQ ID NO: 3398192 - RNA, 22 nt, Human
cccuccaucccuggcccccucc

SEQ ID NO: 3398193 - RNA, 19 nt, Human
cccuccaucuaaacugccc

SEQ ID NO: 3398194 - RNA, 12 nt, Human
cccucccaccac

SEQ ID NO: 3398195 - RNA, 20 nt, Human
cccucccacccccagccccg

SEQ ID NO: 3398196 - RNA, 19 nt, Human
cccucccaccucugugacc

SEQ ID NO: 3398197 - RNA, 15 nt, Human
cccucccagcucuga

SEQ ID NO: 3398198 - RNA, 12 nt, Human
cccucccagcug

SEQ ID NO: 3398199 - RNA, 14 nt, Human
cccucccaggacuc

SEQ ID NO: 3398200 - RNA, 16 nt, Human
cccuccccagagcacu

SEQ ID NO: 3398201 - RNA, 12 nt, Human
cccuccccaggg

SEQ ID NO: 3398202 - RNA, 13 nt, Human
cccuccccagggg

SEQ ID NO: 3398203 - RNA, 14 nt, Human
cccuccccagggga

SEQ ID NO: 3398204 - RNA, 16 nt, Human
cccuccccaucccaug

SEQ ID NO: 3398205 - RNA, 16 nt, Human
cccucccccaaccccc

SEQ ID NO: 3398206 - RNA, 17 nt, Human
cccuccccgcccuuuuu

SEQ ID NO: 3398207 - RNA, 19 nt, Human
cccuccccggcccuaccag

SEQ ID NO: 3398208 - RNA, 22 nt, Human
cccuccccggcccuaccagcgc

SEQ ID NO: 3398209 - RNA, 16 nt, Human
cccuccccuccccugc

SEQ ID NO: 3398210 - RNA, 13 nt, Human
cccuccccugcca

SEQ ID NO: 3398211 - RNA, 14 nt, Human
cccuccccugcccu

SEQ ID NO: 3398212 - RNA, 13 nt, Human
cccuccccugcug

SEQ ID NO: 3398213 - RNA, 16 nt, Human
cccuccccugcugcag

SEQ ID NO: 3398214 - RNA, 14 nt, Human
cccuccccuugccu

SEQ ID NO: 3398215 - RNA, 14 nt, Human
cccucccgccccuu

SEQ ID NO: 3398216 - RNA, 15 nt, Human
cccucccgccccuuc

SEQ ID NO: 3398217 - RNA, 15 nt, Human
cccucccuacccuaa

SEQ ID NO: 3398218 - RNA, 13 nt, Human
cccucccucagcc

SEQ ID NO: 3398219 - RNA, 13 nt, Human
cccucccuccacc

SEQ ID NO: 3398220 - RNA, 20 nt, Human
cccucccuccaccucccugc

SEQ ID NO: 3398221 - RNA, 23 nt, Human
cccucccucuuucccucccuucc

SEQ ID NO: 3398222 - RNA, 12 nt, Human
cccucccugcca

SEQ ID NO: 3398223 - RNA, 14 nt, Human
cccucccugcuguc

SEQ ID NO: 3398224 - RNA, 17 nt, Human
cccucccugcugucccc

SEQ ID NO: 3398225 - RNA, 19 nt, Human
cccucccugcuguccccuc

SEQ ID NO: 3398226 - RNA, 14 nt, Human
cccucccugcuuca

SEQ ID NO: 3398227 - RNA, 12 nt, Human
cccucccuggag

SEQ ID NO: 3398228 - RNA, 14 nt, Human
cccucccuucaacc

SEQ ID NO: 3398229 - RNA, 19 nt, Human
cccucccuuggaaaccugc

SEQ ID NO: 3398230 - RNA, 21 nt, Human
cccuccgaccacuuccagggg

SEQ ID NO: 3398231 - RNA, 19 nt, Human
cccuccgcccugccacuca

SEQ ID NO: 3398232 - RNA, 13 nt, Human
cccuccgccucca

SEQ ID NO: 3398233 - RNA, 21 nt, Human
cccuccgccuucacuccggug

SEQ ID NO: 3398234 - RNA, 22 nt, Human
cccuccgccuucacuccggugu

SEQ ID NO: 3398235 - RNA, 19 nt, Human
cccuccgcggcgggcccug

SEQ ID NO: 3398236 - RNA, 18 nt, Human
cccuccguggcaucaccu

SEQ ID NO: 3398237 - RNA, 15 nt, Human
cccuccuaccccucc

SEQ ID NO: 3398238 - RNA, 14 nt, Human
cccuccucaccccg

SEQ ID NO: 3398239 - RNA, 12 nt, Human
cccuccucaccu

SEQ ID NO: 3398240 - RNA, 16 nt, Human
cccuccucaccucugg

SEQ ID NO: 3398241 - RNA, 17 nt, Human
cccuccucaccucugga

SEQ ID NO: 3398242 - RNA, 14 nt, Human
cccuccucacuggc

SEQ ID NO: 3398243 - RNA, 12 nt, Human
cccuccuccacu

SEQ ID NO: 3398244 - RNA, 18 nt, Human
cccuccuccagccccugu

SEQ ID NO: 3398245 - RNA, 21 nt, Human
cccuccuccagccccuguccc

SEQ ID NO: 3398246 - RNA, 12 nt, Human
cccuccucccau

SEQ ID NO: 3398247 - RNA, 18 nt, Human
cccuccuccuggacuccu

SEQ ID NO: 3398248 - RNA, 17 nt, Human
cccuccucuccaccauc

SEQ ID NO: 3398249 - RNA, 16 nt, Human
cccuccucucccaucc

SEQ ID NO: 3398250 - RNA, 17 nt, Human
cccuccucucccauccc

SEQ ID NO: 3398251 - RNA, 17 nt, Human
cccuccucugagaggcg

SEQ ID NO: 3398252 - RNA, 13 nt, Human
cccuccucugcuu

SEQ ID NO: 3398253 - RNA, 22 nt, Human
cccuccugaaccgcacagcuca

SEQ ID NO: 3398254 - RNA, 12 nt, Human
cccuccugaccc

SEQ ID NO: 3398255 - RNA, 13 nt, Human
cccuccugcugca

SEQ ID NO: 3398256 - RNA, 13 nt, Human
cccuccugcuuug

SEQ ID NO: 3398257 - RNA, 13 nt, Human
cccuccuggcucu

SEQ ID NO: 3398258 - RNA, 11 nt, Human
cccuccuggga

SEQ ID NO: 3398259 - RNA, 17 nt, Human
cccuccugggaucugcu

SEQ ID NO: 3398260 - RNA, 19 nt, Human
cccuccuggggccaggccg

SEQ ID NO: 3398261 - RNA, 19 nt, Human
cccuccuggugucacccca

SEQ ID NO: 3398262 - RNA, 16 nt, Human
cccuccugucuuccca

SEQ ID NO: 3398263 - RNA, 18 nt, Human
cccuccugucuucccagg

SEQ ID NO: 3398264 - RNA, 18 nt, Human
cccuccugugcucagccc

SEQ ID NO: 3398265 - RNA, 19 nt, Human
cccuccugugcucagcccu

SEQ ID NO: 3398266 - RNA, 20 nt, Human
cccuccugugcucagcccug

SEQ ID NO: 3398267 - RNA, 20 nt, Human
cccuccuguugggagagggc

SEQ ID NO: 3398268 - RNA, 12 nt, Human
cccuccuucaga

SEQ ID NO: 3398269 - RNA, 11 nt, Human
cccuccuucca

SEQ ID NO: 3398270 - RNA, 15 nt, Human
cccuccuucccagcu

SEQ ID NO: 3398271 - RNA, 17 nt, Human
cccuccuucccagcugc

SEQ ID NO: 3398272 - RNA, 19 nt, Human
cccuccuucccagcugccc

SEQ ID NO: 3398273 - RNA, 14 nt, Human
cccuccuuccuaaa

SEQ ID NO: 3398274 - RNA, 21 nt, Human
cccuccuuccuucuugcuucu

SEQ ID NO: 3398275 - RNA, 18 nt, Human
cccuccuuguccacccac

SEQ ID NO: 3398276 - RNA, 12 nt, Human
cccuccuugucu

SEQ ID NO: 3398277 - RNA, 14 nt, Human
cccuccuuucacca

SEQ ID NO: 3398278 - RNA, 20 nt, Human
cccuccuuucccaacacuuc

SEQ ID NO: 3398279 - RNA, 15 nt, Human
cccucgaagcgcgcc

SEQ ID NO: 3398280 - RNA, 21 nt, Human
cccucgaagcgcgccacucgc

SEQ ID NO: 3398281 - RNA, 22 nt, Human
cccucgaggcggaucuuuggac

SEQ ID NO: 3398282 - RNA, 12 nt, Human
cccucgcccagu

SEQ ID NO: 3398283 - RNA, 20 nt, Human
cccucgcccagucccagcag

SEQ ID NO: 3398284 - RNA, 23 nt, Human
cccucgccuguggagcucagccc

SEQ ID NO: 3398285 - RNA, 17 nt, Human
cccucgcuggcccccac

SEQ ID NO: 3398286 - RNA, 18 nt, Human
cccucgcuggcccccacu

SEQ ID NO: 3398287 - RNA, 20 nt, Human
cccucgcuggcccccacugg

SEQ ID NO: 3398288 - RNA, 21 nt, Human
cccucgcuuggacggcugggc

SEQ ID NO: 3398289 - RNA, 13 nt, Human
cccucggagaaga

SEQ ID NO: 3398290 - RNA, 14 nt, Human
cccucgggcccacc

SEQ ID NO: 3398291 - RNA, 19 nt, Human
cccucgggcccagccccca

SEQ ID NO: 3398292 - RNA, 22 nt, Human
cccucgggcccagcccccacag

SEQ ID NO: 3398293 - RNA, 18 nt, Human
cccucggggauguguccu

SEQ ID NO: 3398294 - RNA, 18 nt, Human
cccucgggucuccucacu

SEQ ID NO: 3398295 - RNA, 19 nt, Human
cccucgggucuccucacuc

SEQ ID NO: 3398296 - RNA, 15 nt, Human
cccucggucuucggc

SEQ ID NO: 3398297 - RNA, 13 nt, Human
cccucgucuuucc

SEQ ID NO: 3398298 - RNA, 14 nt, Human
cccucgugccaguc

SEQ ID NO: 3398299 - RNA, 23 nt, Human
cccucgugccagucgcgcugccu

SEQ ID NO: 3398300 - RNA, 17 nt, Human
cccucguggacaccugc

SEQ ID NO: 3398301 - RNA, 13 nt, Human
cccucguggccag

SEQ ID NO: 3398302 - RNA, 15 nt, Human
cccucguggccagcc

SEQ ID NO: 3398303 - RNA, 16 nt, Human
cccucguggccuuccc

SEQ ID NO: 3398304 - RNA, 23 nt, Human
cccucgugguccccaacagcgac

SEQ ID NO: 3398305 - RNA, 16 nt, Human
cccucuaaagcaauaa

SEQ ID NO: 3398306 - RNA, 19 nt, Human
cccucuaaccucgcccucu

SEQ ID NO: 3398307 - RNA, 18 nt, Human
cccucuacagagcuuccc

SEQ ID NO: 3398308 - RNA, 17 nt, Human
cccucuacugggagccu

SEQ ID NO: 3398309 - RNA, 19 nt, Human
cccucuaggcucugccuuc

SEQ ID NO: 3398310 - RNA, 23 nt, Human
cccucuaguuuuuucuuccuuuu

SEQ ID NO: 3398311 - RNA, 17 nt, Human
cccucucaacacccagu

SEQ ID NO: 3398312 - RNA, 12 nt, Human
cccucucagagc

SEQ ID NO: 3398313 - RNA, 16 nt, Human
cccucucaggcaugcc

SEQ ID NO: 3398314 - RNA, 15 nt, Human
cccucucaucucagg

SEQ ID NO: 3398315 - RNA, 16 nt, Human
cccucucaucucaggu

SEQ ID NO: 3398316 - RNA, 19 nt, Human
cccucucccacccucuucc

SEQ ID NO: 3398317 - RNA, 12 nt, Human
cccucucccagg

SEQ ID NO: 3398318 - RNA, 20 nt, Human
cccucucccaggccccauga

SEQ ID NO: 3398319 - RNA, 11 nt, Human
cccucucccug

SEQ ID NO: 3398320 - RNA, 13 nt, Human
cccucucccugca

SEQ ID NO: 3398321 - RNA, 18 nt, Human
cccucucccuucccuccu

SEQ ID NO: 3398322 - RNA, 12 nt, Human
cccucuccuggg

SEQ ID NO: 3398323 - RNA, 21 nt, Human
cccucuccugggcagcugccu

SEQ ID NO: 3398324 - RNA, 14 nt, Human
cccucuccuuccuu

SEQ ID NO: 3398325 - RNA, 15 nt, Human
cccucucucugacuc

SEQ ID NO: 3398326 - RNA, 18 nt, Human
cccucucucugacucuca

SEQ ID NO: 3398327 - RNA, 13 nt, Human
cccucucucuucu

SEQ ID NO: 3398328 - RNA, 15 nt, Human
cccucucucuucugc

SEQ ID NO: 3398329 - RNA, 18 nt, Human
cccucucucuucugcucc

SEQ ID NO: 3398330 - RNA, 23 nt, Human
cccucucucuucugcuccacccu

SEQ ID NO: 3398331 - RNA, 20 nt, Human
cccucucugcagacuuccca

SEQ ID NO: 3398332 - RNA, 15 nt, Human
cccucucugcucugc

SEQ ID NO: 3398333 - RNA, 15 nt, Human
cccuggcuaagaccc

SEQ ID NO: 3398334 - RNA, 16 nt, Human
cccuggcuccaggcca

SEQ ID NO: 3398335 - RNA, 17 nt, Human
cccuggcucccacaggc

SEQ ID NO: 3398336 - RNA, 13 nt, Human
cccuggcucccau

SEQ ID NO: 3398337 - RNA, 14 nt, Human
cccuggcucccaug

SEQ ID NO: 3398338 - RNA, 15 nt, Human
cccuggcucccuccu

SEQ ID NO: 3398339 - RNA, 13 nt, Human
cccuggcucugca

SEQ ID NO: 3398340 - RNA, 18 nt, Human
cccuggcugaaggacugu

SEQ ID NO: 3398341 - RNA, 19 nt, Human
cccuggcugaaggacugug

SEQ ID NO: 3398342 - RNA, 13 nt, Human
cccuggcugcccu

SEQ ID NO: 3398343 - RNA, 14 nt, Human
cccuggcugcccug

SEQ ID NO: 3398344 - RNA, 17 nt, Human
cccuggcugcccuggcc

SEQ ID NO: 3398345 - RNA, 20 nt, Human
cccuggcugcccuggcccug

SEQ ID NO: 3398346 - RNA, 13 nt, Human
cccuggcugcugc

SEQ ID NO: 3398347 - RNA, 23 nt, Human
cccuggcugggacguggcucagc

SEQ ID NO: 3398348 - RNA, 11 nt, Human
cccuggcuggu

SEQ ID NO: 3398349 - RNA, 23 nt, Human
cccuggcuuucauuuucucucag

SEQ ID NO: 3398350 - RNA, 21 nt, Human
cccugggaaggccucuuggag

SEQ ID NO: 3398351 - RNA, 18 nt, Human
cccugggaggcagugaug

SEQ ID NO: 3398352 - RNA, 18 nt, Human
cccugggaggcucuggag

SEQ ID NO: 3398353 - RNA, 17 nt, Human
cccugggccagggucug

SEQ ID NO: 3398354 - RNA, 14 nt, Human
cccugggccccacc

SEQ ID NO: 3398355 - RNA, 16 nt, Human
cccugggccccaccac

SEQ ID NO: 3398356 - RNA, 16 nt, Human
cccugggcccugggcu

SEQ ID NO: 3398357 - RNA, 18 nt, Human
cccugggcccugggcugg

SEQ ID NO: 3398358 - RNA, 13 nt, Human
cccugggccugcc

SEQ ID NO: 3398359 - RNA, 19 nt, Human
cccugggccugccucacca

SEQ ID NO: 3398360 - RNA, 20 nt, Human
cccugggccugcugcugaga

SEQ ID NO: 3398361 - RNA, 14 nt, Human
cccugggccuuggg

SEQ ID NO: 3398362 - RNA, 16 nt, Human
cccugggcucugcccc

SEQ ID NO: 3398363 - RNA, 13 nt, Human
cccugggcuggaa

SEQ ID NO: 3398364 - RNA, 18 nt, Human
cccugggcuuggccugcu

SEQ ID NO: 3398365 - RNA, 19 nt, Human
cccugggcuuggccugcug

SEQ ID NO: 3398366 - RNA, 17 nt, Human
cccuggggacagcaagg

SEQ ID NO: 3398367 - RNA, 13 nt, Human
cccuggggccugg

SEQ ID NO: 3398368 - RNA, 14 nt, Human
cccuggggccugga

SEQ ID NO: 3398369 - RNA, 18 nt, Human
cccuggggccuguacugc

SEQ ID NO: 3398370 - RNA, 21 nt, Human
cccuggggccuguacugccug

SEQ ID NO: 3398371 - RNA, 22 nt, Human
cccuggggccuguacugccugc

SEQ ID NO: 3398372 - RNA, 14 nt, Human
cccuggggcuggcu

SEQ ID NO: 3398373 - RNA, 16 nt, Human
cccuggggcuggcuuu

SEQ ID NO: 3398374 - RNA, 14 nt, Human
cccuggggcugggc

SEQ ID NO: 3398375 - RNA, 16 nt, Human
cccuggggcugggccc

SEQ ID NO: 3398376 - RNA, 22 nt, Human
cccuggggcugggccccccagc

SEQ ID NO: 3398377 - RNA, 19 nt, Human
cccuggggcuucuccugac

SEQ ID NO: 3398378 - RNA, 21 nt, Human
cccugggggcacaggaggcag

SEQ ID NO: 3398379 - RNA, 17 nt, Human
cccugggugggcucugu

SEQ ID NO: 3398380 - RNA, 20 nt, Human
cccuggguguccccgcugcu

SEQ ID NO: 3398381 - RNA, 22 nt, Human
cccuggguguccccgcugcugu

SEQ ID NO: 3398382 - RNA, 20 nt, Human
cccuggguuagacugccagc

SEQ ID NO: 3398383 - RNA, 23 nt, Human
cccuggguuagacugccagcucu

SEQ ID NO: 3398384 - RNA, 22 nt, Human
cccuggguucagaaaugcugcc

SEQ ID NO: 3398385 - RNA, 23 nt, Human
cccuggguucagaaaugcugccu

SEQ ID NO: 3398386 - RNA, 23 nt, Human
cccugguaauaaguacuguguac

SEQ ID NO: 3398387 - RNA, 19 nt, Human
cccugguaauagcuguaaa

SEQ ID NO: 3398388 - RNA, 14 nt, Human
cccugguccccucc

SEQ ID NO: 3398389 - RNA, 18 nt, Human
cccuggucccucugcagu

SEQ ID NO: 3398390 - RNA, 17 nt, Human
cccugguccuuccaggc

SEQ ID NO: 3398391 - RNA, 13 nt, Human
cccuggugcugcc

SEQ ID NO: 3398392 - RNA, 21 nt, Human
cccuggugcugccacacuuca

SEQ ID NO: 3398393 - RNA, 19 nt, Human
cccugguggacaguccugg

SEQ ID NO: 3398394 - RNA, 15 nt, Human
cccugguggcagcuc

SEQ ID NO: 3398395 - RNA, 22 nt, Human
cccugguggcagugggagcugc

SEQ ID NO: 3398396 - RNA, 23 nt, Human
cccuggugggccaacaaagaaca

SEQ ID NO: 3398397 - RNA, 16 nt, Human
cccuggugguugcugu

SEQ ID NO: 3398398 - RNA, 20 nt, Human
cccugguguuucuagcacug

SEQ ID NO: 3398399 - RNA, 22 nt, Human
cccugguguuucuagcacuggc

SEQ ID NO: 3398400 - RNA, 20 nt, Human
cccugguuucacuggcccaa

SEQ ID NO: 3398401 - RNA, 17 nt, Human
cccugguuuccugcccu

SEQ ID NO: 3398402 - RNA, 19 nt, Human
cccugguuuccugcccugg

SEQ ID NO: 3398403 - RNA, 11 nt, Human
cccuguaacuu

SEQ ID NO: 3398404 - RNA, 18 nt, Human
cccuguacaauauuuaaa

SEQ ID NO: 3398405 - RNA, 20 nt, Human
cccuguaccucaucccauga

SEQ ID NO: 3398406 - RNA, 14 nt, Human
cccuguaggccuca

SEQ ID NO: 3398407 - RNA, 18 nt, Human
cccuguauauagcccagc

SEQ ID NO: 3398408 - RNA, 20 nt, Human
cccuguauuuucuuucucua

SEQ ID NO: 3398409 - RNA, 22 nt, Human
cccugucaaauaucaguuaccc

SEQ ID NO: 3398410 - RNA, 15 nt, Human
cccugucagcaugaa

SEQ ID NO: 3398411 - RNA, 14 nt, Human
cccugucaggaggc

SEQ ID NO: 3398412 - RNA, 14 nt, Human
cccuguccaaacug

SEQ ID NO: 3398413 - RNA, 19 nt, Human
cccugucccacccccuucc

SEQ ID NO: 3398414 - RNA, 17 nt, Human
cccugucccaugcaggc

SEQ ID NO: 3398415 - RNA, 23 nt, Human
cccugucccaugcaggcccuuug

SEQ ID NO: 3398416 - RNA, 18 nt, Human
cccugucccccagcucug

SEQ ID NO: 3398417 - RNA, 13 nt, Human
cccuguccccuca

SEQ ID NO: 3398418 - RNA, 13 nt, Human
cccugucccuccc

SEQ ID NO: 3398419 - RNA, 15 nt, Human
cccugucccucccac

SEQ ID NO: 3398420 - RNA, 16 nt, Human
cccugucccucccacc

SEQ ID NO: 3398421 - RNA, 19 nt, Human
cccugucccucccaccucu

SEQ ID NO: 3398422 - RNA, 20 nt, Human
cccugucccucccaccucug

SEQ ID NO: 3398423 - RNA, 22 nt, Human
cccugucccucccaccucugug

SEQ ID NO: 3398424 - RNA, 24 nt, Human
cccugucccucccaccucugugac

SEQ ID NO: 3398425 - RNA, 22 nt, Human
cccuguccggaaugccacccac

SEQ ID NO: 3398426 - RNA, 13 nt, Human
cccuguccucacu

SEQ ID NO: 3398427 - RNA, 15 nt, Human
cccuguccucacugc

SEQ ID NO: 3398428 - RNA, 15 nt, Human
cccuguccuccucgg

SEQ ID NO: 3398429 - RNA, 15 nt, Human
cccuguccugccaug

SEQ ID NO: 3398430 - RNA, 15 nt, Human
cccugucgagacacu

SEQ ID NO: 3398431 - RNA, 21 nt, Human
cccugucgaguucggcucugg

SEQ ID NO: 3398432 - RNA, 17 nt, Human
cccugucgggcuuugug

SEQ ID NO: 3398433 - RNA, 21 nt, Human
cccugucgggcuuugugugaa

SEQ ID NO: 3398434 - RNA, 17 nt, Human
cccugucuagagaggga

SEQ ID NO: 3398435 - RNA, 23 nt, Human
cccugucucuacuaaaaaugcaa

SEQ ID NO: 3398436 - RNA, 20 nt, Human
cccugucuguagagggcccu

SEQ ID NO: 3398437 - RNA, 23 nt, Human
cccugucuuuccuaagaccuggg

SEQ ID NO: 3398438 - RNA, 19 nt, Human
cccugugacauggugccug

SEQ ID NO: 3398439 - RNA, 23 nt, Human
cccugugagauuuugcuuuucca

SEQ ID NO: 3398440 - RNA, 19 nt, Human
cccugugauggggcccugc

SEQ ID NO: 3398441 - RNA, 20 nt, Human
cccugugauggggcccugcc

SEQ ID NO: 3398442 - RNA, 13 nt, Human
cccugugccagcc

SEQ ID NO: 3398443 - RNA, 19 nt, Human
cccugugcccccagggucc

SEQ ID NO: 3398444 - RNA, 21 nt, Human
cccugugccuaacaccagcgu

SEQ ID NO: 3398445 - RNA, 19 nt, Human
cccugugccuccucccucc

SEQ ID NO: 3398446 - RNA, 18 nt, Human
cccugugcuccgugccuc

SEQ ID NO: 3398447 - RNA, 22 nt, Human
cccugugcuccgugccuccacc

SEQ ID NO: 3398448 - RNA, 12 nt, Human
cccugugcuggu

SEQ ID NO: 3398449 - RNA, 13 nt, Human
cccugugcuggug

SEQ ID NO: 3398450 - RNA, 16 nt, Human
cccugugcuggugucc

SEQ ID NO: 3398451 - RNA, 20 nt, Human
cccugugcugguguccugac

SEQ ID NO: 3398452 - RNA, 21 nt, Human
cccugugcugguguccugacc

SEQ ID NO: 3398453 - RNA, 16 nt, Human
cccugugggcccccaa

SEQ ID NO: 3398454 - RNA, 12 nt, Human
cccuguggggau

SEQ ID NO: 3398455 - RNA, 19 nt, Human
cccuguguauacagcccug

SEQ ID NO: 3398456 - RNA, 19 nt, Human
cccuguguccaccuguggg

SEQ ID NO: 3398457 - RNA, 16 nt, Human
cccuguguuaauuuaa

SEQ ID NO: 3398458 - RNA, 13 nt, Human
cccuguguugucu

SEQ ID NO: 3398459 - RNA, 16 nt, Human
cccuguguugucucua

SEQ ID NO: 3398460 - RNA, 19 nt, Human
cccuguucagcuacuccca

SEQ ID NO: 3398461 - RNA, 17 nt, Human
cccuguuccccagagaa

SEQ ID NO: 3398462 - RNA, 13 nt, Human
cccuguuccugcu

SEQ ID NO: 3398463 - RNA, 21 nt, Human
cccuguucuaagggggagggg

SEQ ID NO: 3398464 - RNA, 13 nt, Human
cccuguucuggca

SEQ ID NO: 3398465 - RNA, 16 nt, Human
cccuguucuuccucca

SEQ ID NO: 3398466 - RNA, 17 nt, Human
cccuguuucaaucacug

SEQ ID NO: 3398467 - RNA, 20 nt, Human
cccuguuugaagccugcccu

SEQ ID NO: 3398468 - RNA, 14 nt, Human
cccuguuuuauacu

SEQ ID NO: 3398469 - RNA, 23 nt, Human
cccuguuuucugagcccgggcug

SEQ ID NO: 3398470 - RNA, 20 nt, Human
cccuuaaacaguugcacagc

SEQ ID NO: 3398471 - RNA, 21 nt, Human
cccuuaaacaguugcacagca

SEQ ID NO: 3398472 - RNA, 20 nt, Human
cccuuaacccaaggagcaca

SEQ ID NO: 3398473 - RNA, 15 nt, Human
cccuuacacguaccu

SEQ ID NO: 3398474 - RNA, 17 nt, Human
cccuuagccucccugaa

SEQ ID NO: 3398475 - RNA, 22 nt, Human
cccuuauaguuugggcuucagc

SEQ ID NO: 3398476 - RNA, 15 nt, Human
cccuuaucaccagcu

SEQ ID NO: 3398477 - RNA, 14 nt, Human
cccuuauccaggac

SEQ ID NO: 3398478 - RNA, 14 nt, Human
cccuuauccucccu

SEQ ID NO: 3398479 - RNA, 17 nt, Human
cccuuaugacugccaag

SEQ ID NO: 3398480 - RNA, 16 nt, Human
cccuucacauuuuuua

SEQ ID NO: 3398481 - RNA, 22 nt, Human
cccuucagcccccagccccucc

SEQ ID NO: 3398482 - RNA, 20 nt, Human
cccuucaguacccucucagc

SEQ ID NO: 3398483 - RNA, 18 nt, Human
cccuucaucuccagggag

SEQ ID NO: 3398484 - RNA, 16 nt, Human
cccuucaucuggaacc

SEQ ID NO: 3398485 - RNA, 14 nt, Human
cccuucaucuuccu

SEQ ID NO: 3398486 - RNA, 16 nt, Human
cccuucaucuuccugu

SEQ ID NO: 3398487 - RNA, 15 nt, Human
cccuuccaaauaaua

SEQ ID NO: 3398488 - RNA, 17 nt, Human
cccuuccacacccccac

SEQ ID NO: 3398489 - RNA, 16 nt, Human
cccuuccaccugcucu

SEQ ID NO: 3398490 - RNA, 20 nt, Human
cccuuccacugccucugccu

SEQ ID NO: 3398491 - RNA, 13 nt, Human
cccuuccagacau

SEQ ID NO: 3398492 - RNA, 17 nt, Human
cccuuccaggccaucag

SEQ ID NO: 3398493 - RNA, 13 nt, Human
cccuuccaggggu

SEQ ID NO: 3398494 - RNA, 12 nt, Human
cccuuccaugga

SEQ ID NO: 3398495 - RNA, 18 nt, Human
cccuuccauuucugccuu

SEQ ID NO: 3398496 - RNA, 20 nt, Human
cccuuccauuucugccuuuu

SEQ ID NO: 3398497 - RNA, 18 nt, Human
cccuucccaaucagcacu

SEQ ID NO: 3398498 - RNA, 19 nt, Human
cccuucccaaucagcacug

SEQ ID NO: 3398499 - RNA, 13 nt, Human
cccuucccaccuc

SEQ ID NO: 3398500 - RNA, 18 nt, Human
cccuucccaucucuuccu

SEQ ID NO: 3398501 - RNA, 18 nt, Human
cccuuccccaugcuuccu

SEQ ID NO: 3398502 - RNA, 17 nt, Human
cccuuccccgagggaug

SEQ ID NO: 3398503 - RNA, 15 nt, Human
cccuuccccucccug

SEQ ID NO: 3398504 - RNA, 15 nt, Human
cccuuccccuuccuu

SEQ ID NO: 3398505 - RNA, 15 nt, Human
cccuucccugcaaac

SEQ ID NO: 3398506 - RNA, 16 nt, Human
cccuucccuguccuug

SEQ ID NO: 3398507 - RNA, 19 nt, Human
cccuucccuuccacugccu

SEQ ID NO: 3398508 - RNA, 17 nt, Human
cccuucccuugagcccu

SEQ ID NO: 3398509 - RNA, 16 nt, Human
cccuuccgacccucug

SEQ ID NO: 3398510 - RNA, 14 nt, Human
cccuuccuaauucc

SEQ ID NO: 3398511 - RNA, 21 nt, Human
cccuuccuaauuccacagcug

SEQ ID NO: 3398512 - RNA, 23 nt, Human
cccuuccuccuccaccaccgccc

SEQ ID NO: 3398513 - RNA, 15 nt, Human
cccuuccucuccacc

SEQ ID NO: 3398514 - RNA, 18 nt, Human
cccuuccucuccacccuc

SEQ ID NO: 3398515 - RNA, 21 nt, Human
cccuuccucuccacugccuuc

SEQ ID NO: 3398516 - RNA, 20 nt, Human
cccuuccucuugucugauuu

SEQ ID NO: 3398517 - RNA, 13 nt, Human
cccuuccuggaca

SEQ ID NO: 3398518 - RNA, 15 nt, Human
cccuuccuggacagc

SEQ ID NO: 3398519 - RNA, 18 nt, Human
cccuuccuggacagcugu

SEQ ID NO: 3398520 - RNA, 23 nt, Human
cccuuccuggacagcugugccuc

SEQ ID NO: 3398521 - RNA, 14 nt, Human
cccuuccuugcucu

SEQ ID NO: 3398522 - RNA, 17 nt, Human
cccuuccuuuucccugc

SEQ ID NO: 3398523 - RNA, 18 nt, Human
cccuuccuuuucccugcu

SEQ ID NO: 3398524 - RNA, 19 nt, Human
cccuuccuuuucccugcuu

SEQ ID NO: 3398525 - RNA, 17 nt, Human
cccuucgcguauuucag

SEQ ID NO: 3398526 - RNA, 15 nt, Human
cccuucgcuccugug

SEQ ID NO: 3398527 - RNA, 16 nt, Human
cccuucgcuccugugu

SEQ ID NO: 3398528 - RNA, 17 nt, Human
cccuucuaccugccacu

SEQ ID NO: 3398529 - RNA, 23 nt, Human
cccuucuaggguuauugcauuug

SEQ ID NO: 3398530 - RNA, 19 nt, Human
cccuucuauacccacccag

SEQ ID NO: 3398531 - RNA, 20 nt, Human
cccuucuauacccacccaga

SEQ ID NO: 3398532 - RNA, 23 nt, Human
cccuucuauuuggggcuugauga

SEQ ID NO: 3398533 - RNA, 15 nt, Human
cccuucucagaaucu

SEQ ID NO: 3398534 - RNA, 10 nt, Human
cccuucucca

SEQ ID NO: 3398535 - RNA, 15 nt, Human
cccuucucccacacu

SEQ ID NO: 3398536 - RNA, 14 nt, Human
cccuucucccugga

SEQ ID NO: 3398537 - RNA, 15 nt, Human
cccuucuccuuccaa

SEQ ID NO: 3398538 - RNA, 22 nt, Human
cccuucucuccagccccuggau

SEQ ID NO: 3398539 - RNA, 13 nt, Human
cccuucucugcuc

SEQ ID NO: 3398540 - RNA, 12 nt, Human
cccuucucugug

SEQ ID NO: 3398541 - RNA, 15 nt, Human
cccuucucuuaguua

SEQ ID NO: 3398542 - RNA, 12 nt, Human
cccuucucuucc

SEQ ID NO: 3398543 - RNA, 14 nt, Human
cccuucucuuccag

SEQ ID NO: 3398544 - RNA, 23 nt, Human
cccuucugacccaugcugcccug

SEQ ID NO: 3398545 - RNA, 23 nt, Human
cccuucugcucagcucugggcca

SEQ ID NO: 3398546 - RNA, 21 nt, Human
cccuucugggcaucuguucug

SEQ ID NO: 3398547 - RNA, 17 nt, Human
cccuucugucccucaca

SEQ ID NO: 3398548 - RNA, 14 nt, Human
cccuucugugccca

SEQ ID NO: 3398549 - RNA, 12 nt, Human
cccuucuucaug

SEQ ID NO: 3398550 - RNA, 20 nt, Human
cccuucuugcugcccugccc

SEQ ID NO: 3398551 - RNA, 11 nt, Human
cccuucuuuuu

SEQ ID NO: 3398552 - RNA, 18 nt, Human
cccuugaaacuuugggaa

SEQ ID NO: 3398553 - RNA, 21 nt, Human
cccuugaaagucaugaacaca

SEQ ID NO: 3398554 - RNA, 23 nt, Human
cccuugacgucaagucuccuucc

SEQ ID NO: 3398555 - RNA, 19 nt, Human
cccuugacuuugcuccuca

SEQ ID NO: 3398556 - RNA, 14 nt, Human
cccuugagaaaccu

SEQ ID NO: 3398557 - RNA, 22 nt, Human
cccuugagaaaccuuauuguac

SEQ ID NO: 3398558 - RNA, 15 nt, Human
cccuugagaccucag

SEQ ID NO: 3398559 - RNA, 15 nt, Human
cccuugagcccuccc

SEQ ID NO: 3398560 - RNA, 17 nt, Human
cccuugagggcugcagu

SEQ ID NO: 3398561 - RNA, 21 nt, Human
cccuugaucagccccacccug

SEQ ID NO: 3398562 - RNA, 20 nt, Human
cccuugauuuaaacacacag

SEQ ID NO: 3398563 - RNA, 16 nt, Human
cccuugccacuuugca

SEQ ID NO: 3398564 - RNA, 13 nt, Human
cccuugccagaca

SEQ ID NO: 3398565 - RNA, 20 nt, Human
cccuugccagcugcugagcc

SEQ ID NO: 3398566 - RNA, 19 nt, Human
cccuugcccagggcucagc

SEQ ID NO: 3398567 - RNA, 23 nt, Human
cccuugcccagggcucagccugg

SEQ ID NO: 3398568 - RNA, 18 nt, Human
cccuugccccccuggccu

SEQ ID NO: 3398569 - RNA, 16 nt, Human
cccuugcccuagauag

SEQ ID NO: 3398570 - RNA, 15 nt, Human
cccuugcccugaccu

SEQ ID NO: 3398571 - RNA, 13 nt, Human
cccuugccucccc

SEQ ID NO: 3398572 - RNA, 19 nt, Human
cccuugccugugccaggug

SEQ ID NO: 3398573 - RNA, 21 nt, Human
cccuugccuuucgaggccuga

SEQ ID NO: 3398574 - RNA, 15 nt, Human
cccuugcuggcccca

SEQ ID NO: 3398575 - RNA, 21 nt, Human
cccuugcuggccccagcccug

SEQ ID NO: 3398576 - RNA, 24 nt, Human
cccuugcuggccccagcccugcug

SEQ ID NO: 3398577 - RNA, 22 nt, Human
cccuuggaaaccugcccugccu

SEQ ID NO: 3398578 - RNA, 23 nt, Human
cccuuggaaaccugcccugccug

SEQ ID NO: 3398579 - RNA, 15 nt, Human
cccuuggacauuuua

SEQ ID NO: 3398580 - RNA, 12 nt, Human
cccuuggccugu

SEQ ID NO: 3398581 - RNA, 14 nt, Human
cccuuggcugugag

SEQ ID NO: 3398582 - RNA, 23 nt, Human
cccuuggcugugaggccccugga

SEQ ID NO: 3398583 - RNA, 18 nt, Human
cccuuggcuucugugaug

SEQ ID NO: 3398584 - RNA, 12 nt, Human
cccuugggccac

SEQ ID NO: 3398585 - RNA, 15 nt, Human
cccuugggccagaag

SEQ ID NO: 3398586 - RNA, 16 nt, Human
cccuugggccagaagu

SEQ ID NO: 3398587 - RNA, 15 nt, Human
cccuugggcccacac

SEQ ID NO: 3398588 - RNA, 12 nt, Human
cccuuggggguc

SEQ ID NO: 3398589 - RNA, 21 nt, Human
cccuuggggguccuccuccag

SEQ ID NO: 3398590 - RNA, 23 nt, Human
cccuuggggguccuccuccaggg

SEQ ID NO: 3398591 - RNA, 16 nt, Human
cccuuggguucugaua

SEQ ID NO: 3398592 - RNA, 17 nt, Human
cccuugguggcaagagc

SEQ ID NO: 3398593 - RNA, 22 nt, Human
cccuugguuaggcauuguggga

SEQ ID NO: 3398594 - RNA, 17 nt, Human
cccuuguagcuccuccc

SEQ ID NO: 3398595 - RNA, 23 nt, Human
cccuuguagcuccuccccuggag

SEQ ID NO: 3398596 - RNA, 15 nt, Human
cccuugucccacuca

SEQ ID NO: 3398597 - RNA, 13 nt, Human
cccuugucugaga

SEQ ID NO: 3398598 - RNA, 14 nt, Human
cccuugugguccca

SEQ ID NO: 3398599 - RNA, 23 nt, Human
cccuuuagcacguuuaaaguucu

SEQ ID NO: 3398600 - RNA, 21 nt, Human
cccuuuagccaaacccuuguc

SEQ ID NO: 3398601 - RNA, 17 nt, Human
cccuuuagcuguguuau

SEQ ID NO: 3398602 - RNA, 21 nt, Human
cccuuuauugaaaaaauaaaa

SEQ ID NO: 3398603 - RNA, 15 nt, Human
cccuuucacaggcag

SEQ ID NO: 3398604 - RNA, 19 nt, Human
cccuuucagaugucuucug

SEQ ID NO: 3398605 - RNA, 23 nt, Human
cccuuucccaccccaaccugcuc

SEQ ID NO: 3398606 - RNA, 17 nt, Human
cccuuuccuccucaggc

SEQ ID NO: 3398607 - RNA, 16 nt, Human
cccuuuccugaguccc

SEQ ID NO: 3398608 - RNA, 13 nt, Human
cccuuuccugcgg

SEQ ID NO: 3398609 - RNA, 14 nt, Human
cccuuuccuguccc

SEQ ID NO: 3398610 - RNA, 14 nt, Human
cccuuuccuuccua

SEQ ID NO: 3398611 - RNA, 14 nt, Human
cccuuucuccccug

SEQ ID NO: 3398612 - RNA, 22 nt, Human
cccuuucuccccugcccccagg

SEQ ID NO: 3398613 - RNA, 21 nt, Human
cccuuucucuuuuccccuuuc

SEQ ID NO: 3398614 - RNA, 13 nt, Human
cccuuucuuccuc

SEQ ID NO: 3398615 - RNA, 14 nt, Human
cccuuucuucuccc

SEQ ID NO: 3398616 - RNA, 21 nt, Human
cccuuucuucucccccauccu

SEQ ID NO: 3398617 - RNA, 15 nt, Human
cccuuugaagccuca

SEQ ID NO: 3398618 - RNA, 18 nt, Human
cccuuugaagccucagcu

SEQ ID NO: 3398619 - RNA, 14 nt, Human
cccuuugccuucau

SEQ ID NO: 3398620 - RNA, 13 nt, Human
cccuuugcuccac

SEQ ID NO: 3398621 - RNA, 15 nt, Human
cccuuugcugacccu

SEQ ID NO: 3398622 - RNA, 17 nt, Human
ccucguggccagcccgg

SEQ ID NO: 3398623 - RNA, 19 nt, Human
ccucguggccuuccccagc

SEQ ID NO: 3398624 - RNA, 23 nt, Human
ccucguggccuuccccagccucu

SEQ ID NO: 3398625 - RNA, 19 nt, Human
ccucgugguccccaacagc

SEQ ID NO: 3398626 - RNA, 14 nt, Human
ccucuaacagcacc

SEQ ID NO: 3398627 - RNA, 15 nt, Human
ccucuaacagcacca

SEQ ID NO: 3398628 - RNA, 21 nt, Human
ccucuaacaggggcugguggg

SEQ ID NO: 3398629 - RNA, 17 nt, Human
ccucuaaccccaggccc

SEQ ID NO: 3398630 - RNA, 19 nt, Human
ccucuaaccccaggccccg

SEQ ID NO: 3398631 - RNA, 20 nt, Human
ccucuaaccucgcccucucc

SEQ ID NO: 3398632 - RNA, 14 nt, Human
ccucuaaugagacu

SEQ ID NO: 3398633 - RNA, 15 nt, Human
ccucuaaugagacug

SEQ ID NO: 3398634 - RNA, 18 nt, Human
ccucuacagagcuucccu

SEQ ID NO: 3398635 - RNA, 11 nt, Human
ccucuacaggg

SEQ ID NO: 3398636 - RNA, 18 nt, Human
ccucuacauggacucaga

SEQ ID NO: 3398637 - RNA, 19 nt, Human
ccucuacccaaacccuagg

SEQ ID NO: 3398638 - RNA, 15 nt, Human
ccucuaccccaauuu

SEQ ID NO: 3398639 - RNA, 22 nt, Human
ccucuacugggaaggcuacuuc

SEQ ID NO: 3398640 - RNA, 19 nt, Human
ccucuagaaauuuuucaga

SEQ ID NO: 3398641 - RNA, 19 nt, Human
ccucuagaauuuuaagccu

SEQ ID NO: 3398642 - RNA, 14 nt, Human
ccucuagagcagac

SEQ ID NO: 3398643 - RNA, 21 nt, Human
ccucuagagccuucagccuua

SEQ ID NO: 3398644 - RNA, 12 nt, Human
ccucuagcugaa

SEQ ID NO: 3398645 - RNA, 16 nt, Human
ccucuaggaggucucu

SEQ ID NO: 3398646 - RNA, 16 nt, Human
ccucuaggcucugccu

SEQ ID NO: 3398647 - RNA, 17 nt, Human
ccucuaggcucugccuu

SEQ ID NO: 3398648 - RNA, 13 nt, Human
ccucuauacaucu

SEQ ID NO: 3398649 - RNA, 21 nt, Human
ccucuauacaucucuccccaa

SEQ ID NO: 3398650 - RNA, 22 nt, Human
ccucuaucauggugaaaagcuc

SEQ ID NO: 3398651 - RNA, 13 nt, Human
ccucuaucccaau

SEQ ID NO: 3398652 - RNA, 18 nt, Human
ccucuaucccggcuuugg

SEQ ID NO: 3398653 - RNA, 23 nt, Human
ccucuauugauguacagucuguc

SEQ ID NO: 3398654 - RNA, 16 nt, Human
ccucuauuuagcauga

SEQ ID NO: 3398655 - RNA, 15 nt, Human
ccucucaccucugug

SEQ ID NO: 3398656 - RNA, 14 nt, Human
ccucucacugccuc

SEQ ID NO: 3398657 - RNA, 14 nt, Human
ccucucagagcuac

SEQ ID NO: 3398658 - RNA, 22 nt, Human
ccucucagagcuacuugggcca

SEQ ID NO: 3398659 - RNA, 23 nt, Human
ccucucagagcuacuugggccau

SEQ ID NO: 3398660 - RNA, 13 nt, Human
ccucucagcucca

SEQ ID NO: 3398661 - RNA, 18 nt, Human
ccucucagcuccaggugg

SEQ ID NO: 3398662 - RNA, 15 nt, Human
ccucucaggauccaa

SEQ ID NO: 3398663 - RNA, 18 nt, Human
ccucucaggugaccaaaa

SEQ ID NO: 3398664 - RNA, 15 nt, Human
ccucucaguacuuug

SEQ ID NO: 3398665 - RNA, 23 nt, Human
ccucucaucaguguccucuugcu

SEQ ID NO: 3398666 - RNA, 15 nt, Human
ccucucaucucaggu

SEQ ID NO: 3398667 - RNA, 13 nt, Human
ccucuccacacag

SEQ ID NO: 3398668 - RNA, 17 nt, Human
ccucuccacacagugcu

SEQ ID NO: 3398669 - RNA, 15 nt, Human
ccucuccacccuccc

SEQ ID NO: 3398670 - RNA, 22 nt, Human
ccucuccacccucccagaccug

SEQ ID NO: 3398671 - RNA, 13 nt, Human
ccucuccacugcc

SEQ ID NO: 3398672 - RNA, 16 nt, Human
ccucuccacugccuuc

SEQ ID NO: 3398673 - RNA, 18 nt, Human
ccucuccacugccuucga

SEQ ID NO: 3398674 - RNA, 18 nt, Human
ccucuccagccucagccc

SEQ ID NO: 3398675 - RNA, 20 nt, Human
ccucuccagccucagccccc

SEQ ID NO: 3398676 - RNA, 22 nt, Human
ccucuccagccucagcccccug

SEQ ID NO: 3398677 - RNA, 12 nt, Human
ccucuccaggca

SEQ ID NO: 3398678 - RNA, 13 nt, Human
ccucuccaggcac

SEQ ID NO: 3398679 - RNA, 16 nt, Human
ccucuccauaacccca

SEQ ID NO: 3398680 - RNA, 18 nt, Human
ccucuccauaaccccacc

SEQ ID NO: 3398681 - RNA, 15 nt, Human
ccucucccaagucca

SEQ ID NO: 3398682 - RNA, 12 nt, Human
ccucucccagga

SEQ ID NO: 3398683 - RNA, 13 nt, Human
ccucucccaggac

SEQ ID NO: 3398684 - RNA, 19 nt, Human
ccucucccaggcaggggcc

SEQ ID NO: 3398685 - RNA, 12 nt, Human
ccucucccaguu

SEQ ID NO: 3398686 - RNA, 13 nt, Human
ccucucccaguug

SEQ ID NO: 3398687 - RNA, 18 nt, Human
ccucucccaucccccugc

SEQ ID NO: 3398688 - RNA, 19 nt, Human
ccucucccauugucccucu

SEQ ID NO: 3398689 - RNA, 13 nt, Human
ccucuccccaccc

SEQ ID NO: 3398690 - RNA, 20 nt, Human
ccucuccccagcccagagac

SEQ ID NO: 3398691 - RNA, 23 nt, Human
ccucuccccuaccacugucuucu

SEQ ID NO: 3398692 - RNA, 12 nt, Human
ccucuccccuca

SEQ ID NO: 3398693 - RNA, 13 nt, Human
ccucuccccucca

SEQ ID NO: 3398694 - RNA, 16 nt, Human
ccucuccccugccccc

SEQ ID NO: 3398695 - RNA, 22 nt, Human
ccucuccccugcccccugcagg

SEQ ID NO: 3398696 - RNA, 17 nt, Human
ccucucccucaacaagg

SEQ ID NO: 3398697 - RNA, 22 nt, Human
ccucucccucaacaagggagag

SEQ ID NO: 3398698 - RNA, 15 nt, Human
ccucucccuggcccu

SEQ ID NO: 3398699 - RNA, 19 nt, Human
ccucucccuguccccaccc

SEQ ID NO: 3398700 - RNA, 15 nt, Human
ccucucccuucccuc

SEQ ID NO: 3398701 - RNA, 17 nt, Human
ccucucccuucccuccu

SEQ ID NO: 3398702 - RNA, 13 nt, Human
ccucucccuugga

SEQ ID NO: 3398703 - RNA, 22 nt, Human
ccucucccuuggauuguccccg

SEQ ID NO: 3398704 - RNA, 13 nt, Human
ccucuccgagcug

SEQ ID NO: 3398705 - RNA, 18 nt, Human
ccucuccgccccugagcc

SEQ ID NO: 3398706 - RNA, 20 nt, Human
ccucuccgccccugagccca

SEQ ID NO: 3398707 - RNA, 23 nt, Human
ccucuccguuuauuauaaacugu

SEQ ID NO: 3398708 - RNA, 20 nt, Human
ccucuccuacucggcucugc

SEQ ID NO: 3398709 - RNA, 18 nt, Human
ccucuccucgguucaagg

SEQ ID NO: 3398710 - RNA, 11 nt, Human
ccucuccugcc

SEQ ID NO: 3398711 - RNA, 14 nt, Human
ccucuccugccuac

SEQ ID NO: 3398712 - RNA, 13 nt, Human
ccucuccuggagg

SEQ ID NO: 3398713 - RNA, 15 nt, Human
ccucuccuggaggau

SEQ ID NO: 3398714 - RNA, 21 nt, Human
ccucuccugggcagcugccuc

SEQ ID NO: 3398715 - RNA, 13 nt, Human
ccucuccuuccug

SEQ ID NO: 3398716 - RNA, 16 nt, Human
ccucucgagggcaggg

SEQ ID NO: 3398717 - RNA, 23 nt, Human
ccucucgcuccucaaccccuccc

SEQ ID NO: 3398718 - RNA, 23 nt, Human
ccucucgguugaaaccuguauaa

SEQ ID NO: 3398719 - RNA, 23 nt, Human
ccucucguaagauuuccuucuuu

SEQ ID NO: 3398720 - RNA, 16 nt, Human
ccucucuaaccuccuu

SEQ ID NO: 3398721 - RNA, 20 nt, Human
ccucucuacagucucgucuc

SEQ ID NO: 3398722 - RNA, 19 nt, Human
ccucucuauauuucggguc

SEQ ID NO: 3398723 - RNA, 20 nt, Human
ccucucuauccucucuuccu

SEQ ID NO: 3398724 - RNA, 21 nt, Human
ccucucuauccucucuuccuc

SEQ ID NO: 3398725 - RNA, 15 nt, Human
ccucucucacuccuu

SEQ ID NO: 3398726 - RNA, 17 nt, Human
ccucucucacuccuuga

SEQ ID NO: 3398727 - RNA, 12 nt, Human
ccucucucccag

SEQ ID NO: 3398728 - RNA, 17 nt, Human
ccucucucugacucuca

SEQ ID NO: 3398729 - RNA, 12 nt, Human
ccucucucuucu

SEQ ID NO: 3398730 - RNA, 18 nt, Human
ccucucucuucugcucca

SEQ ID NO: 3398731 - RNA, 19 nt, Human
ccucucucuucugcuccac

SEQ ID NO: 3398732 - RNA, 21 nt, Human
ccucucucuucugcuccaccc

SEQ ID NO: 3398733 - RNA, 12 nt, Human
ccucucugcacc

SEQ ID NO: 3398734 - RNA, 22 nt, Human
ccucucugcagacuucccagcu

SEQ ID NO: 3398735 - RNA, 18 nt, Human
ccucucugcaggucccua

SEQ ID NO: 3398736 - RNA, 21 nt, Human
ccucucugcaggucccuaaua

SEQ ID NO: 3398737 - RNA, 22 nt, Human
ccucucugcaggucccuaauaa

SEQ ID NO: 3398738 - RNA, 22 nt, Human
ccucucugccgcaauacaggaa

SEQ ID NO: 3398739 - RNA, 13 nt, Human
ccucucuggccuc

SEQ ID NO: 3398740 - RNA, 17 nt, Human
ccucucuggccucccac

SEQ ID NO: 3398741 - RNA, 10 nt, Human
ccucucuggu

SEQ ID NO: 3398742 - RNA, 11 nt, Human
ccucucuuccu

SEQ ID NO: 3398743 - RNA, 19 nt, Human
ccucucuuccuaucccauc

SEQ ID NO: 3398744 - RNA, 17 nt, Human
ccucucuucucaccuuu

SEQ ID NO: 3398745 - RNA, 17 nt, Human
ccucucuugcacccgcc

SEQ ID NO: 3398746 - RNA, 23 nt, Human
ccucucuugcacccgccucuccc

SEQ ID NO: 3398747 - RNA, 19 nt, Human
ccucucuuuguucucagcu

SEQ ID NO: 3398748 - RNA, 20 nt, Human
ccucugaaaacggcccucuu

SEQ ID NO: 3398749 - RNA, 18 nt, Human
ccucugaaaaguguguau

SEQ ID NO: 3398750 - RNA, 15 nt, Human
ccucugaaacagcug

SEQ ID NO: 3398751 - RNA, 22 nt, Human
ccucugaaacagcugccuuagc

SEQ ID NO: 3398752 - RNA, 23 nt, Human
ccucugaaacagcugccuuagcu

SEQ ID NO: 3398753 - RNA, 19 nt, Human
ccucugaaacccuggacca

SEQ ID NO: 3398754 - RNA, 18 nt, Human
ccucugaaaguuguacau

SEQ ID NO: 3398755 - RNA, 15 nt, Human
ccucugaacuugccu

SEQ ID NO: 3398756 - RNA, 14 nt, Human
ccucugacacacag

SEQ ID NO: 3398757 - RNA, 16 nt, Human
ccucugacacacagcu

SEQ ID NO: 3398758 - RNA, 17 nt, Human
ccucugacacacagcuc

SEQ ID NO: 3398759 - RNA, 19 nt, Human
ccucugacacacagcucug

SEQ ID NO: 3398760 - RNA, 21 nt, Human
ccucugacacacagcucuguc

SEQ ID NO: 3398761 - RNA, 14 nt, Human
ccucugacagcagc

SEQ ID NO: 3398762 - RNA, 15 nt, Human
ccucugacagcagca

SEQ ID NO: 3398763 - RNA, 20 nt, Human
ccucugacagcagcaucucu

SEQ ID NO: 3398764 - RNA, 17 nt, Human
ccucugaccaacaggcu

SEQ ID NO: 3398765 - RNA, 18 nt, Human
ccucugaccaacaggcug

SEQ ID NO: 3398766 - RNA, 22 nt, Human
ccucugaccccuccucacuggc

SEQ ID NO: 3398767 - RNA, 16 nt, Human
ccucugaccugcaggc

SEQ ID NO: 3398768 - RNA, 17 nt, Human
ccucugacucagggcuc

SEQ ID NO: 3398769 - RNA, 21 nt, Human
ccucugacucagggcuccugg

SEQ ID NO: 3398770 - RNA, 21 nt, Human
ccucugacucccaaagagcug

SEQ ID NO: 3398771 - RNA, 22 nt, Human
ccucugacuuaagcugccucaa

SEQ ID NO: 3398772 - RNA, 15 nt, Human
ccucugagacuccag

SEQ ID NO: 3398773 - RNA, 19 nt, Human
ccucugagacuccagaccu

SEQ ID NO: 3398774 - RNA, 12 nt, Human
ccucugagccuu

SEQ ID NO: 3398775 - RNA, 18 nt, Human
ccucugaggccagccugg

SEQ ID NO: 3398776 - RNA, 22 nt, Human
ccucugaggccagccuggccuc

SEQ ID NO: 3398777 - RNA, 13 nt, Human
ccucugaggcuga

SEQ ID NO: 3398778 - RNA, 17 nt, Human
ccucugaggcuguagga

SEQ ID NO: 3398779 - RNA, 21 nt, Human
ccucugagggaaagcccagaa

SEQ ID NO: 3398780 - RNA, 19 nt, Human
ccucugagucaccaucuua

SEQ ID NO: 3398781 - RNA, 17 nt, Human
ccucugcacaagcugca

SEQ ID NO: 3398782 - RNA, 16 nt, Human
ccucugcacccagaac

SEQ ID NO: 3398783 - RNA, 17 nt, Human
ccucugcacuccccugc

SEQ ID NO: 3398784 - RNA, 17 nt, Human
ccucugcagucucuaua

SEQ ID NO: 3398785 - RNA, 17 nt, Human
ccucugcagugccuugg

SEQ ID NO: 3398786 - RNA, 19 nt, Human
ccucugcauccucuggagc

SEQ ID NO: 3398787 - RNA, 13 nt, Human
ccucugccaccuc

SEQ ID NO: 3398788 - RNA, 16 nt, Human
ccucugccaccucccc

SEQ ID NO: 3398789 - RNA, 23 nt, Human
ccucugccagaagauccccucag

SEQ ID NO: 3398790 - RNA, 13 nt, Human
ccucugcccacuc

SEQ ID NO: 3398791 - RNA, 17 nt, Human
ccucugcccacucccug

SEQ ID NO: 3398792 - RNA, 20 nt, Human
ccucugcccacucccugcaa

SEQ ID NO: 3398793 - RNA, 11 nt, Human
ccucugcccag

SEQ ID NO: 3398794 - RNA, 14 nt, Human
ccucugcccagcuu

SEQ ID NO: 3398795 - RNA, 20 nt, Human
ccucugcccagcuugggccc

SEQ ID NO: 3398796 - RNA, 20 nt, Human
ccucugccccucccccagcc

SEQ ID NO: 3398797 - RNA, 22 nt, Human
ccucugcccgggagcucaggaa

SEQ ID NO: 3398798 - RNA, 13 nt, Human
ccucugcccugcg

SEQ ID NO: 3398799 - RNA, 12 nt, Human
ccucugccggcu

SEQ ID NO: 3398800 - RNA, 21 nt, Human
ccucugccucugacacacagc

SEQ ID NO: 3398801 - RNA, 19 nt, Human
ccucugccugaaccuucca

SEQ ID NO: 3398802 - RNA, 21 nt, Human
ccucugccugaaccuuccauc

SEQ ID NO: 3398803 - RNA, 11 nt, Human
ccucugccugc

SEQ ID NO: 3398804 - RNA, 12 nt, Human
ccucugccugcc

SEQ ID NO: 3398805 - RNA, 15 nt, Human
ccucugccugucccu

SEQ ID NO: 3398806 - RNA, 16 nt, Human
ccucugccugucccuc

SEQ ID NO: 3398807 - RNA, 17 nt, Human
ccucugccugucccucu

SEQ ID NO: 3398808 - RNA, 22 nt, Human
ccucugccugucccucucaggc

SEQ ID NO: 3398809 - RNA, 20 nt, Human
ccucugccugugcacggcca

SEQ ID NO: 3398810 - RNA, 18 nt, Human
ccucugccuuagaggagc

SEQ ID NO: 3398811 - RNA, 13 nt, Human
ccucugcggaccc

SEQ ID NO: 3398812 - RNA, 16 nt, Human
ccucugcggaccccag

SEQ ID NO: 3398813 - RNA, 17 nt, Human
ccucugcggaccccagc

SEQ ID NO: 3398814 - RNA, 18 nt, Human
ccucugcucaccgcccau

SEQ ID NO: 3398815 - RNA, 15 nt, Human
ccucugcucagccaa

SEQ ID NO: 3398816 - RNA, 14 nt, Human
ccucugcugcuggc

SEQ ID NO: 3398817 - RNA, 17 nt, Human
ccucugcugcuggcugg

SEQ ID NO: 3398818 - RNA, 19 nt, Human
ccucugcugcugucccucc

SEQ ID NO: 3398819 - RNA, 19 nt, Human
ccucugcuggccgggcaca

SEQ ID NO: 3398820 - RNA, 15 nt, Human
ccucugcuucucacg

SEQ ID NO: 3398821 - RNA, 20 nt, Human
ccucugcuugccaucccucc

SEQ ID NO: 3398822 - RNA, 21 nt, Human
ccucugcuugccaucccuccc

SEQ ID NO: 3398823 - RNA, 22 nt, Human
ccucugcuuucuccuuuaauug

SEQ ID NO: 3398824 - RNA, 14 nt, Human
ccucuggacuggcu

SEQ ID NO: 3398825 - RNA, 16 nt, Human
ccucuggacuggcuag

SEQ ID NO: 3398826 - RNA, 16 nt, Human
ccucuggagccagccg

SEQ ID NO: 3398827 - RNA, 17 nt, Human
ccucuggagcccuaacc

SEQ ID NO: 3398828 - RNA, 15 nt, Human
ccucuggaggccucu

SEQ ID NO: 3398829 - RNA, 18 nt, Human
ccucuggaggccucuggg

SEQ ID NO: 3398830 - RNA, 22 nt, Human
ccucuggagggguguggcuccu

SEQ ID NO: 3398831 - RNA, 13 nt, Human
ccucuggaguggc

SEQ ID NO: 3398832 - RNA, 14 nt, Human
ccucuggaguggcc

SEQ ID NO: 3398833 - RNA, 15 nt, Human
ccucuggaguggcca

SEQ ID NO: 3398834 - RNA, 21 nt, Human
ccucuggauggcaccagaggc

SEQ ID NO: 3398835 - RNA, 21 nt, Human
ccucuggcauuagaauuauuu

SEQ ID NO: 3398836 - RNA, 12 nt, Human
ccucuggcccug

SEQ ID NO: 3398837 - RNA, 13 nt, Human
ccucuggcccugc

SEQ ID NO: 3398838 - RNA, 18 nt, Human
ccucuggcccugccuucu

SEQ ID NO: 3398839 - RNA, 23 nt, Human
ccucuggcuagaggccagcccca

SEQ ID NO: 3398840 - RNA, 17 nt, Human
ccucuggcuccagcugg

SEQ ID NO: 3398841 - RNA, 23 nt, Human
ccucuggcuggcuaacuggaagc

SEQ ID NO: 3398842 - RNA, 22 nt, Human
ccucuggcuugggcagggucug

SEQ ID NO: 3398843 - RNA, 23 nt, Human
ccucugggaaccucccagagguc

SEQ ID NO: 3398844 - RNA, 17 nt, Human
ccucugggccuccucua

SEQ ID NO: 3398845 - RNA, 10 nt, Human
ccucugggcu

SEQ ID NO: 3398846 - RNA, 12 nt, Human
ccucugggcucu

SEQ ID NO: 3398847 - RNA, 18 nt, Human
ccucuggggcucuagggu

SEQ ID NO: 3398848 - RNA, 20 nt, Human
ccucuggucgcuccugccca

SEQ ID NO: 3398849 - RNA, 16 nt, Human
ccucuggucugggugc

SEQ ID NO: 3398850 - RNA, 19 nt, Human
ccucugguucuucauuuau

SEQ ID NO: 3398851 - RNA, 24 nt, Human
ccucugguuugccgguggugcagg

SEQ ID NO: 3398852 - RNA, 18 nt, Human
ccucugguuuggggcgag

SEQ ID NO: 3398853 - RNA, 16 nt, Human
ccucuguacagagccc

SEQ ID NO: 3398854 - RNA, 17 nt, Human
ccucugucacugcaggc

SEQ ID NO: 3398855 - RNA, 18 nt, Human
ccucugucaggccuucag

SEQ ID NO: 3398856 - RNA, 14 nt, Human
ccucugucauuugu

SEQ ID NO: 3398857 - RNA, 15 nt, Human
ccucugucauuuguu

SEQ ID NO: 3398858 - RNA, 19 nt, Human
ccucuguccaggcacugag

SEQ ID NO: 3398859 - RNA, 20 nt, Human
ccucuguccaggcacugaga

SEQ ID NO: 3398860 - RNA, 21 nt, Human
ccucuguccaggcacugagau

SEQ ID NO: 3398861 - RNA, 15 nt, Human
ccucuguccagggcc

SEQ ID NO: 3398862 - RNA, 20 nt, Human
ccucuguccagggcccugag

SEQ ID NO: 3398863 - RNA, 14 nt, Human
ccucuguccccuuc

SEQ ID NO: 3398864 - RNA, 18 nt, Human
ccucuguccccuucucuc

SEQ ID NO: 3398865 - RNA, 22 nt, Human
ccucuguccccuucucucaucu

SEQ ID NO: 3398866 - RNA, 22 nt, Human
ccucuguccugacuucaggggc

SEQ ID NO: 3398867 - RNA, 17 nt, Human
ccucugucuagcaugcc

SEQ ID NO: 3398868 - RNA, 12 nt, Human
ccucugucucau

SEQ ID NO: 3398869 - RNA, 14 nt, Human
ccucugucucaucc

SEQ ID NO: 3398870 - RNA, 24 nt, Human
ccucugucucauccuccuggaacc

SEQ ID NO: 3398871 - RNA, 23 nt, Human
ccucugucucgagcgcccugcag

SEQ ID NO: 3398872 - RNA, 14 nt, Human
ccucugucugcccu

SEQ ID NO: 3398873 - RNA, 15 nt, Human
ccucugucuucugga

SEQ ID NO: 3398874 - RNA, 18 nt, Human
ccucugugaccaaugucu

SEQ ID NO: 3398875 - RNA, 21 nt, Human
ccucugugaccaaugucuuga

SEQ ID NO: 3398876 - RNA, 16 nt, Human
ccucugugaccucagg

SEQ ID NO: 3398877 - RNA, 23 nt, Human
ccucugugaggaaagcacacagu

SEQ ID NO: 3398878 - RNA, 21 nt, Human
ccucugugccuucuuuugauu

SEQ ID NO: 3398879 - RNA, 16 nt, Human
ccucuguggugucugc

SEQ ID NO: 3398880 - RNA, 17 nt, Human
ccucuguggugucugcc

SEQ ID NO: 3398881 - RNA, 18 nt, Human
ccucuguguauuugcuuu

SEQ ID NO: 3398882 - RNA, 18 nt, Human
ccucugugucacuggcug

SEQ ID NO: 3398883 - RNA, 20 nt, Human
ccucuguguccuucccugca

SEQ ID NO: 3398884 - RNA, 22 nt, Human
ccucuguucaguguaaauaguu

SEQ ID NO: 3398885 - RNA, 16 nt, Human
ccucuguuugacaaac

SEQ ID NO: 3398886 - RNA, 17 nt, Human
ccucuuaaaaaauaaaa

SEQ ID NO: 3398887 - RNA, 20 nt, Human
ccucuuaaagcugccuguag

SEQ ID NO: 3398888 - RNA, 17 nt, Human
ccucuuaaauaaaccuu

SEQ ID NO: 3398889 - RNA, 18 nt, Human
ccucuuaaauaaaccuuu

SEQ ID NO: 3398890 - RNA, 20 nt, Human
ccucuuaccaguauuuaacu

SEQ ID NO: 3398891 - RNA, 14 nt, Human
ccucuuagaaaaac

SEQ ID NO: 3398892 - RNA, 17 nt, Human
ccucuuagaaaaaccac

SEQ ID NO: 3398893 - RNA, 21 nt, Human
ccucuuagaagaauauuguau

SEQ ID NO: 3398894 - RNA, 23 nt, Human
ccucuuagaagaauauuguauug

SEQ ID NO: 3398895 - RNA, 16 nt, Human
ccucuuaugggcuggg

SEQ ID NO: 3398896 - RNA, 17 nt, Human
ccucuucaccccccacu

SEQ ID NO: 3398897 - RNA, 14 nt, Human
ccucuucacucccc

SEQ ID NO: 3398898 - RNA, 18 nt, Human
ccucuucauggauggggg

SEQ ID NO: 3398899 - RNA, 21 nt, Human
ccucuuccccuugcccuugcc

SEQ ID NO: 3398900 - RNA, 20 nt, Human
ccucuuccggagauguagca

SEQ ID NO: 3398901 - RNA, 20 nt, Human
ccucuuccuacccugccucc

SEQ ID NO: 3398902 - RNA, 15 nt, Human
ccucuuccuacuggu

SEQ ID NO: 3398903 - RNA, 16 nt, Human
ccucuuccucccucau

SEQ ID NO: 3398904 - RNA, 13 nt, Human
ccucuuccuccug

SEQ ID NO: 3398905 - RNA, 16 nt, Human
ccucuuccuccugaca

SEQ ID NO: 3398906 - RNA, 14 nt, Human
ccucuuccucugag

SEQ ID NO: 3398907 - RNA, 15 nt, Human
ccucuuccucugagg

SEQ ID NO: 3398908 - RNA, 15 nt, Human
ccucuuccucuugac

SEQ ID NO: 3398909 - RNA, 16 nt, Human
ccucuuccucuugacc

SEQ ID NO: 3398910 - RNA, 17 nt, Human
ccucuuccucuugaccc

SEQ ID NO: 3398911 - RNA, 18 nt, Human
ccugcaaaaugagacccu

SEQ ID NO: 3398912 - RNA, 22 nt, Human
ccugcaaaauuugaugccagga

SEQ ID NO: 3398913 - RNA, 14 nt, Human
ccugcaaaauuuua

SEQ ID NO: 3398914 - RNA, 18 nt, Human
ccugcaaacagaacaggg

SEQ ID NO: 3398915 - RNA, 21 nt, Human
ccugcaaacagaacaggguca

SEQ ID NO: 3398916 - RNA, 15 nt, Human
ccugcaaacgcugcc

SEQ ID NO: 3398917 - RNA, 16 nt, Human
ccugcaaacgcugccu

SEQ ID NO: 3398918 - RNA, 20 nt, Human
ccugcaaacugggaaccccu

SEQ ID NO: 3398919 - RNA, 17 nt, Human
ccugcaaagcccagcuu

SEQ ID NO: 3398920 - RNA, 16 nt, Human
ccugcaaccugauugu

SEQ ID NO: 3398921 - RNA, 17 nt, Human
ccugcaagggcucccca

SEQ ID NO: 3398922 - RNA, 13 nt, Human
ccugcaaucccag

SEQ ID NO: 3398923 - RNA, 19 nt, Human
ccugcaauguaucccuucu

SEQ ID NO: 3398924 - RNA, 19 nt, Human
ccugcaauuucauaugcug

SEQ ID NO: 3398925 - RNA, 23 nt, Human
ccugcacaaagcccuuccauguc

SEQ ID NO: 3398926 - RNA, 20 nt, Human
ccugcacaauaaaaauguuu

SEQ ID NO: 3398927 - RNA, 10 nt, Human
ccugcacaca

SEQ ID NO: 3398928 - RNA, 11 nt, Human
ccugcacacaa

SEQ ID NO: 3398929 - RNA, 21 nt, Human
ccugcacacgcuccuuccucu

SEQ ID NO: 3398930 - RNA, 17 nt, Human
ccugcacagcaggcugc

SEQ ID NO: 3398931 - RNA, 20 nt, Human
ccugcacagcaggcugccag

SEQ ID NO: 3398932 - RNA, 17 nt, Human
ccugcacagugacuucu

SEQ ID NO: 3398933 - RNA, 18 nt, Human
ccugcacagugacuucug

SEQ ID NO: 3398934 - RNA, 22 nt, Human
ccugcacagugacuucugagau

SEQ ID NO: 3398935 - RNA, 19 nt, Human
ccugcaccaugcugcuggg

SEQ ID NO: 3398936 - RNA, 21 nt, Human
ccugcacggugaauggcuuug

SEQ ID NO: 3398937 - RNA, 20 nt, Human
ccugcacugacccacagccu

SEQ ID NO: 3398938 - RNA, 15 nt, Human
ccugcacugacucug

SEQ ID NO: 3398939 - RNA, 15 nt, Human
ccugcacuggagucc

SEQ ID NO: 3398940 - RNA, 23 nt, Human
ccugcacuggaguccagucucuu

SEQ ID NO: 3398941 - RNA, 14 nt, Human
ccugcacuggggag

SEQ ID NO: 3398942 - RNA, 12 nt, Human
ccugcacuguaa

SEQ ID NO: 3398943 - RNA, 13 nt, Human
ccugcacuguccu

SEQ ID NO: 3398944 - RNA, 15 nt, Human
ccugcacuguccugc

SEQ ID NO: 3398945 - RNA, 17 nt, Human
ccugcacuguccugcuc

SEQ ID NO: 3398946 - RNA, 23 nt, Human
ccugcacuguccugcuccacagu

SEQ ID NO: 3398947 - RNA, 17 nt, Human
ccugcacuuacuugcuu

SEQ ID NO: 3398948 - RNA, 19 nt, Human
ccugcacuugcagacucua

SEQ ID NO: 3398949 - RNA, 18 nt, Human
ccugcacuugggggcuca

SEQ ID NO: 3398950 - RNA, 20 nt, Human
ccugcacuugggggcucagc

SEQ ID NO: 3398951 - RNA, 23 nt, Human
ccugcagaaccggagagccagcu

SEQ ID NO: 3398952 - RNA, 22 nt, Human
ccugcagaaguaagccucauca

SEQ ID NO: 3398953 - RNA, 15 nt, Human
ccugcagacccugcc

SEQ ID NO: 3398954 - RNA, 17 nt, Human
ccugcagacccugcccu

SEQ ID NO: 3398955 - RNA, 12 nt, Human
ccugcagagggc

SEQ ID NO: 3398956 - RNA, 14 nt, Human
ccugcagagggcac

SEQ ID NO: 3398957 - RNA, 20 nt, Human
ccugcagaggucugugcuga

SEQ ID NO: 3398958 - RNA, 21 nt, Human
ccugcagaugccacccuagcc

SEQ ID NO: 3398959 - RNA, 18 nt, Human
ccugcagcaaacacucca

SEQ ID NO: 3398960 - RNA, 14 nt, Human
ccugcagcagagcc

SEQ ID NO: 3398961 - RNA, 15 nt, Human
ccugcagcagagccu

SEQ ID NO: 3398962 - RNA, 16 nt, Human
ccugcagcaugguccc

SEQ ID NO: 3398963 - RNA, 13 nt, Human
ccugcagcccugg

SEQ ID NO: 3398964 - RNA, 17 nt, Human
ccugcagcccuggccca

SEQ ID NO: 3398965 - RNA, 12 nt, Human
ccugcagccucc

SEQ ID NO: 3398966 - RNA, 14 nt, Human
ccugcagccucccu

SEQ ID NO: 3398967 - RNA, 15 nt, Human
ccugcagccuccucc

SEQ ID NO: 3398968 - RNA, 19 nt, Human
ccugcagccuccuccugac

SEQ ID NO: 3398969 - RNA, 19 nt, Human
ccugcagccugcaggaccu

SEQ ID NO: 3398970 - RNA, 12 nt, Human
ccugcagccugg

SEQ ID NO: 3398971 - RNA, 10 nt, Human
ccugcagcuc

SEQ ID NO: 3398972 - RNA, 17 nt, Human
ccugcagcuuguagcca

SEQ ID NO: 3398973 - RNA, 19 nt, Human
ccugcagcuuguagccagc

SEQ ID NO: 3398974 - RNA, 22 nt, Human
ccugcaggaaggagcugccugg

SEQ ID NO: 3398975 - RNA, 17 nt, Human
ccugcaggaccucgugc

SEQ ID NO: 3398976 - RNA, 17 nt, Human
ccugcaggaccugccug

SEQ ID NO: 3398977 - RNA, 18 nt, Human
ccugcaggaccugccugu

SEQ ID NO: 3398978 - RNA, 15 nt, Human
ccugcaggcagccag

SEQ ID NO: 3398979 - RNA, 19 nt, Human
ccugcaggcagccaggcca

SEQ ID NO: 3398980 - RNA, 23 nt, Human
ccugcaggcagccaggccacaag

SEQ ID NO: 3398981 - RNA, 22 nt, Human
ccugcaggcaggaacaaacagg

SEQ ID NO: 3398982 - RNA, 23 nt, Human
ccugcaggcaggaacaaacaggg

SEQ ID NO: 3398983 - RNA, 16 nt, Human
ccugcaggccaagagc

SEQ ID NO: 3398984 - RNA, 16 nt, Human
ccugcaggccaggcca

SEQ ID NO: 3398985 - RNA, 15 nt, Human
ccugcagggccaagc

SEQ ID NO: 3398986 - RNA, 19 nt, Human
ccugcagggccauggcuca

SEQ ID NO: 3398987 - RNA, 20 nt, Human
ccugcagggccauggcucag

SEQ ID NO: 3398988 - RNA, 13 nt, Human
ccugcagggcugc

SEQ ID NO: 3398989 - RNA, 21 nt, Human
ccugcaggguggugcugggac

SEQ ID NO: 3398990 - RNA, 17 nt, Human
ccugcaggugcugcugc

SEQ ID NO: 3398991 - RNA, 16 nt, Human
ccugcagguugggcca

SEQ ID NO: 3398992 - RNA, 15 nt, Human
ccugcagucacagcu

SEQ ID NO: 3398993 - RNA, 22 nt, Human
ccugcagucuggcugagcccug

SEQ ID NO: 3398994 - RNA, 19 nt, Human
ccugcaguguucgcuuggc

SEQ ID NO: 3398995 - RNA, 20 nt, Human
ccugcaguguucgcuuggcu

SEQ ID NO: 3398996 - RNA, 23 nt, Human
ccugcaucccaggaugcugggug

SEQ ID NO: 3398997 - RNA, 14 nt, Human
ccugcaucuggggc

SEQ ID NO: 3398998 - RNA, 19 nt, Human
ccugcauggcauccuccag

SEQ ID NO: 3398999 - RNA, 22 nt, Human
ccugcauguaaacacgccugca

SEQ ID NO: 3399000 - RNA, 23 nt, Human
ccugcauguaaacacgccugcaa

SEQ ID NO: 3399001 - RNA, 16 nt, Human
ccugcauucacccaga

SEQ ID NO: 3399002 - RNA, 19 nt, Human
ccugcauucacccagacag

SEQ ID NO: 3399003 - RNA, 12 nt, Human
ccugcauucuuu

SEQ ID NO: 3399004 - RNA, 18 nt, Human
ccugcauuggaacuggag

SEQ ID NO: 3399005 - RNA, 19 nt, Human
ccugcauuggaacuggagg

SEQ ID NO: 3399006 - RNA, 21 nt, Human
ccugcauuggaacuggaggca

SEQ ID NO: 3399007 - RNA, 13 nt, Human
ccugcauuuccuc

SEQ ID NO: 3399008 - RNA, 16 nt, Human
ccugcauuucugaguu

SEQ ID NO: 3399009 - RNA, 23 nt, Human
ccugcauuugugaaaugauggug

SEQ ID NO: 3399010 - RNA, 19 nt, Human
ccugccacauuagaacuuc

SEQ ID NO: 3399011 - RNA, 19 nt, Human
ccugccaccacgcccggcu

SEQ ID NO: 3399012 - RNA, 16 nt, Human
ccugccaccacuauaa

SEQ ID NO: 3399013 - RNA, 13 nt, Human
ccugccaccaggc

SEQ ID NO: 3399014 - RNA, 14 nt, Human
ccugccaccaggcc

SEQ ID NO: 3399015 - RNA, 18 nt, Human
ccugccacccagccccag

SEQ ID NO: 3399016 - RNA, 15 nt, Human
ccugccacccugggc

SEQ ID NO: 3399017 - RNA, 21 nt, Human
ccugccacccugggccuggca

SEQ ID NO: 3399018 - RNA, 22 nt, Human
ccugccacccuggggagaaagu

SEQ ID NO: 3399019 - RNA, 13 nt, Human
ccugccacccugu

SEQ ID NO: 3399020 - RNA, 16 nt, Human
ccugccacccuguagc

SEQ ID NO: 3399021 - RNA, 14 nt, Human
ccugccaccucccu

SEQ ID NO: 3399022 - RNA, 19 nt, Human
ccugccaccuccugccuca

SEQ ID NO: 3399023 - RNA, 15 nt, Human
ccugccaccugucug

SEQ ID NO: 3399024 - RNA, 21 nt, Human
ccugccacgaauuucugugcc

SEQ ID NO: 3399025 - RNA, 16 nt, Human
ccugccacucacacag

SEQ ID NO: 3399026 - RNA, 20 nt, Human
ccugccacucacacagccag

SEQ ID NO: 3399027 - RNA, 16 nt, Human
ccugccacucacuagg

SEQ ID NO: 3399028 - RNA, 18 nt, Human
ccugccacucacuaggcc

SEQ ID NO: 3399029 - RNA, 21 nt, Human
ccugccacucacuaggccccc

SEQ ID NO: 3399030 - RNA, 22 nt, Human
ccugccacucacuaggccccca

SEQ ID NO: 3399031 - RNA, 13 nt, Human
ccugccagccugg

SEQ ID NO: 3399032 - RNA, 16 nt, Human
ccugccagccuggcuu

SEQ ID NO: 3399033 - RNA, 13 nt, Human
ccugccagcugca

SEQ ID NO: 3399034 - RNA, 13 nt, Human
ccugccaggaagc

SEQ ID NO: 3399035 - RNA, 14 nt, Human
ccugccaggcacag

SEQ ID NO: 3399036 - RNA, 13 nt, Human
ccugccaggcagg

SEQ ID NO: 3399037 - RNA, 12 nt, Human
ccugccaggcau

SEQ ID NO: 3399038 - RNA, 16 nt, Human
ccugccaggcauggug

SEQ ID NO: 3399039 - RNA, 11 nt, Human
ccugccaggga

SEQ ID NO: 3399040 - RNA, 15 nt, Human
ccugccagggacaga

SEQ ID NO: 3399041 - RNA, 12 nt, Human
ccugccaguccu

SEQ ID NO: 3399042 - RNA, 14 nt, Human
ccugccaguccuag

SEQ ID NO: 3399043 - RNA, 13 nt, Human
ccugccagugccu

SEQ ID NO: 3399044 - RNA, 17 nt, Human
ccugccagugccuuacc

SEQ ID NO: 3399045 - RNA, 14 nt, Human
ccugccaucuuccc

SEQ ID NO: 3399046 - RNA, 17 nt, Human
ccugccaucuucccagc

SEQ ID NO: 3399047 - RNA, 15 nt, Human
ccugccaugccagga

SEQ ID NO: 3399048 - RNA, 23 nt, Human
ccugccauguaccuccccugccu

SEQ ID NO: 3399049 - RNA, 17 nt, Human
ccugccauuugcacccu

SEQ ID NO: 3399050 - RNA, 18 nt, Human
ccugcccacaccuccugg

SEQ ID NO: 3399051 - RNA, 12 nt, Human
ccugcccacccg

SEQ ID NO: 3399052 - RNA, 13 nt, Human
ccugcccaccugc

SEQ ID NO: 3399053 - RNA, 15 nt, Human
ccugcccaccugccu

SEQ ID NO: 3399054 - RNA, 16 nt, Human
ccugcccaccugccug

SEQ ID NO: 3399055 - RNA, 17 nt, Human
ccugcccaccugccugg

SEQ ID NO: 3399056 - RNA, 15 nt, Human
ccuugcgcuguugcg

SEQ ID NO: 3399057 - RNA, 21 nt, Human
ccuugcgcuuuugcuggucac

SEQ ID NO: 3399058 - RNA, 19 nt, Human
ccuugcggcuccucaggga

SEQ ID NO: 3399059 - RNA, 14 nt, Human
ccuugcuaccucaa

SEQ ID NO: 3399060 - RNA, 13 nt, Human
ccuugcucucccu

SEQ ID NO: 3399061 - RNA, 13 nt, Human
ccuugcucugcac

SEQ ID NO: 3399062 - RNA, 17 nt, Human
ccuugcuggaaaaccca

SEQ ID NO: 3399063 - RNA, 17 nt, Human
ccuugcuggccccagcc

SEQ ID NO: 3399064 - RNA, 20 nt, Human
ccuugcuggccccagcccug

SEQ ID NO: 3399065 - RNA, 20 nt, Human
ccuugcuguaugcugaucau

SEQ ID NO: 3399066 - RNA, 16 nt, Human
ccuugcuguccuaggc

SEQ ID NO: 3399067 - RNA, 16 nt, Human
ccuugcuguccugauc

SEQ ID NO: 3399068 - RNA, 12 nt, Human
ccuugcugugaa

SEQ ID NO: 3399069 - RNA, 19 nt, Human
ccuugcuguuuguccugag

SEQ ID NO: 3399070 - RNA, 21 nt, Human
ccuugcuguuuguccugagau

SEQ ID NO: 3399071 - RNA, 16 nt, Human
ccuugcuuaccucuca

SEQ ID NO: 3399072 - RNA, 17 nt, Human
ccuugcuuaccucucag

SEQ ID NO: 3399073 - RNA, 18 nt, Human
ccuugcuuaugacaucac

SEQ ID NO: 3399074 - RNA, 22 nt, Human
ccuugcuugcugccuucuggau

SEQ ID NO: 3399075 - RNA, 22 nt, Human
ccuugcuuggcugcuuggccuu

SEQ ID NO: 3399076 - RNA, 14 nt, Human
ccuugcuuguuaca

SEQ ID NO: 3399077 - RNA, 13 nt, Human
ccuugcuuuugcu

SEQ ID NO: 3399078 - RNA, 16 nt, Human
ccuugcuuuugcuucu

SEQ ID NO: 3399079 - RNA, 17 nt, Human
ccuugcuuuugcuucua

SEQ ID NO: 3399080 - RNA, 20 nt, Human
ccuuggaaaccugcccugcc

SEQ ID NO: 3399081 - RNA, 23 nt, Human
ccuuggaaaccugcccugccuga

SEQ ID NO: 3399082 - RNA, 16 nt, Human
ccuuggacauccuccu

SEQ ID NO: 3399083 - RNA, 16 nt, Human
ccuuggacauuuuaug

SEQ ID NO: 3399084 - RNA, 21 nt, Human
ccuuggacauuuuaugucuuu

SEQ ID NO: 3399085 - RNA, 15 nt, Human
ccuuggacucauuuu

SEQ ID NO: 3399086 - RNA, 16 nt, Human
ccuuggagagacacag

SEQ ID NO: 3399087 - RNA, 17 nt, Human
ccuuggagagacacagc

SEQ ID NO: 3399088 - RNA, 18 nt, Human
ccuuggaggcugucuucu

SEQ ID NO: 3399089 - RNA, 23 nt, Human
ccuuggagggucccaagcugggc

SEQ ID NO: 3399090 - RNA, 18 nt, Human
ccuuggauaaugcuguug

SEQ ID NO: 3399091 - RNA, 23 nt, Human
ccuuggauaaugcuguugccuca

SEQ ID NO: 3399092 - RNA, 20 nt, Human
ccuuggcaccaaagaugcag

SEQ ID NO: 3399093 - RNA, 23 nt, Human
ccuuggcaccagacacccaggac

SEQ ID NO: 3399094 - RNA, 17 nt, Human
ccuuggcaugccuucca

SEQ ID NO: 3399095 - RNA, 15 nt, Human
ccuuggccaugcaga

SEQ ID NO: 3399096 - RNA, 23 nt, Human
ccuuggccuagcccacccugcug

SEQ ID NO: 3399097 - RNA, 14 nt, Human
ccuuggccucagaa

SEQ ID NO: 3399098 - RNA, 16 nt, Human
ccuuggccucuuuccu

SEQ ID NO: 3399099 - RNA, 12 nt, Human
ccuuggccugga

SEQ ID NO: 3399100 - RNA, 14 nt, Human
ccuuggccuggagc

SEQ ID NO: 3399101 - RNA, 21 nt, Human
ccuuggccuggagcacaaaga

SEQ ID NO: 3399102 - RNA, 22 nt, Human
ccuuggccugucucauccccag

SEQ ID NO: 3399103 - RNA, 15 nt, Human
ccuuggcucagacau

SEQ ID NO: 3399104 - RNA, 19 nt, Human
ccuuggcucccauucacuc

SEQ ID NO: 3399105 - RNA, 16 nt, Human
ccuuggcugcagggag

SEQ ID NO: 3399106 - RNA, 13 nt, Human
ccuuggcuggugc

SEQ ID NO: 3399107 - RNA, 14 nt, Human
ccuuggcuggugca

SEQ ID NO: 3399108 - RNA, 17 nt, Human
ccuuggcuuaccugacc

SEQ ID NO: 3399109 - RNA, 20 nt, Human
ccuuggcuucaggggagucc

SEQ ID NO: 3399110 - RNA, 16 nt, Human
ccuuggcuugcccacg

SEQ ID NO: 3399111 - RNA, 18 nt, Human
ccuuggcuugcccacgug

SEQ ID NO: 3399112 - RNA, 17 nt, Human
ccuugggaggaagcaga

SEQ ID NO: 3399113 - RNA, 19 nt, Human
ccuugggaggaagcagaau

SEQ ID NO: 3399114 - RNA, 21 nt, Human
ccuugggaggaagcagaauaa

SEQ ID NO: 3399115 - RNA, 22 nt, Human
ccuugggaggaagcagaauaaa

SEQ ID NO: 3399116 - RNA, 19 nt, Human
ccuugggaggccccacugg

SEQ ID NO: 3399117 - RNA, 17 nt, Human
ccuugggcccucugguu

SEQ ID NO: 3399118 - RNA, 14 nt, Human
ccuugggcccuuug

SEQ ID NO: 3399119 - RNA, 17 nt, Human
ccuugggcggcugagag

SEQ ID NO: 3399120 - RNA, 23 nt, Human
ccuuggggaauuuccucuauuga

SEQ ID NO: 3399121 - RNA, 14 nt, Human
ccuuggggagcagg

SEQ ID NO: 3399122 - RNA, 18 nt, Human
ccuuggggauucuuccau

SEQ ID NO: 3399123 - RNA, 22 nt, Human
ccuuggggauucuuccaucuga

SEQ ID NO: 3399124 - RNA, 15 nt, Human
ccuuggggcaggcag

SEQ ID NO: 3399125 - RNA, 20 nt, Human
ccuuggggguccuccuccag

SEQ ID NO: 3399126 - RNA, 14 nt, Human
ccuuggucuaacuu

SEQ ID NO: 3399127 - RNA, 23 nt, Human
ccuuggucuaacuuuugugugaa

SEQ ID NO: 3399128 - RNA, 17 nt, Human
ccuuggucuuuguaucu

SEQ ID NO: 3399129 - RNA, 17 nt, Human
ccuuggugccucuugua

SEQ ID NO: 3399130 - RNA, 16 nt, Human
ccuugguguccaccug

SEQ ID NO: 3399131 - RNA, 17 nt, Human
ccuugguguccaccugg

SEQ ID NO: 3399132 - RNA, 19 nt, Human
ccuuggugucgggcaugac

SEQ ID NO: 3399133 - RNA, 20 nt, Human
ccuuggugucgggcaugaca

SEQ ID NO: 3399134 - RNA, 22 nt, Human
ccuuggugucgggcaugacacg

SEQ ID NO: 3399135 - RNA, 21 nt, Human
ccuugguuaggcauuguggga

SEQ ID NO: 3399136 - RNA, 12 nt, Human
ccuugguuccug

SEQ ID NO: 3399137 - RNA, 17 nt, Human
ccuugguuccuggggca

SEQ ID NO: 3399138 - RNA, 22 nt, Human
ccuugguucuugaggggaccag

SEQ ID NO: 3399139 - RNA, 14 nt, Human
ccuuguccacccac

SEQ ID NO: 3399140 - RNA, 16 nt, Human
ccuuguccacccaccu

SEQ ID NO: 3399141 - RNA, 15 nt, Human
ccuuguccccacacu

SEQ ID NO: 3399142 - RNA, 14 nt, Human
ccuuguccccauga

SEQ ID NO: 3399143 - RNA, 15 nt, Human
ccuugucggccccac

SEQ ID NO: 3399144 - RNA, 19 nt, Human
ccuugucuccuacuccuga

SEQ ID NO: 3399145 - RNA, 19 nt, Human
ccuugucuuauucccuucc

SEQ ID NO: 3399146 - RNA, 17 nt, Human
ccuugugaccuucucua

SEQ ID NO: 3399147 - RNA, 22 nt, Human
ccuugugaugucauacagagaa

SEQ ID NO: 3399148 - RNA, 23 nt, Human
ccuugugauguggcaauaaauuu

SEQ ID NO: 3399149 - RNA, 16 nt, Human
ccuugugccuggcuca

SEQ ID NO: 3399150 - RNA, 13 nt, Human
ccuugugccuggg

SEQ ID NO: 3399151 - RNA, 16 nt, Human
ccuuguggcagaggau

SEQ ID NO: 3399152 - RNA, 12 nt, Human
ccuuguggcuuc

SEQ ID NO: 3399153 - RNA, 15 nt, Human
ccuugugggccuggg

SEQ ID NO: 3399154 - RNA, 15 nt, Human
ccuuguguauauuug

SEQ ID NO: 3399155 - RNA, 15 nt, Human
ccuuguuacuucuga

SEQ ID NO: 3399156 - RNA, 18 nt, Human
ccuuguuacuucugaggu

SEQ ID NO: 3399157 - RNA, 15 nt, Human
ccuuguucacacucu

SEQ ID NO: 3399158 - RNA, 13 nt, Human
ccuuguuccaguu

SEQ ID NO: 3399159 - RNA, 11 nt, Human
ccuuguucugu

SEQ ID NO: 3399160 - RNA, 19 nt, Human
ccuuguuggagccugcagg

SEQ ID NO: 3399161 - RNA, 17 nt, Human
ccuuguuguuucuugcc

SEQ ID NO: 3399162 - RNA, 13 nt, Human
ccuuguuuaaugg

SEQ ID NO: 3399163 - RNA, 22 nt, Human
ccuuguuuaucagauacaucac

SEQ ID NO: 3399164 - RNA, 16 nt, Human
ccuuguuuggggcagg

SEQ ID NO: 3399165 - RNA, 17 nt, Human
ccuuguuuggggcagga

SEQ ID NO: 3399166 - RNA, 20 nt, Human
ccuuguuuugugacauuuuu

SEQ ID NO: 3399167 - RNA, 18 nt, Human
ccuuuaaagaaacauggu

SEQ ID NO: 3399168 - RNA, 19 nt, Human
ccuuuaacugacaagccau

SEQ ID NO: 3399169 - RNA, 14 nt, Human
ccuuuaccccaucc

SEQ ID NO: 3399170 - RNA, 15 nt, Human
ccuuuaccccauccc

SEQ ID NO: 3399171 - RNA, 15 nt, Human
ccuuuacguguuuaa

SEQ ID NO: 3399172 - RNA, 15 nt, Human
ccuuuacuugaccuc

SEQ ID NO: 3399173 - RNA, 23 nt, Human
ccuuuacuuucccuugcuuuucc

SEQ ID NO: 3399174 - RNA, 21 nt, Human
ccuuuagauagcagccuggcu

SEQ ID NO: 3399175 - RNA, 18 nt, Human
ccuuuagcacguuuaaag

SEQ ID NO: 3399176 - RNA, 21 nt, Human
ccuuuagcacguuuaaaguuc

SEQ ID NO: 3399177 - RNA, 14 nt, Human
ccuuuagcuguguu

SEQ ID NO: 3399178 - RNA, 20 nt, Human
ccuuuagggcagcuugcccc

SEQ ID NO: 3399179 - RNA, 13 nt, Human
ccuuuagguucuu

SEQ ID NO: 3399180 - RNA, 17 nt, Human
ccuuuaguaucaguguu

SEQ ID NO: 3399181 - RNA, 15 nt, Human
ccuuuaguuauaaag

SEQ ID NO: 3399182 - RNA, 22 nt, Human
ccuuuauaaugaggaugauuau

SEQ ID NO: 3399183 - RNA, 19 nt, Human
ccuuuauguggaaaacaga

SEQ ID NO: 3399184 - RNA, 14 nt, Human
ccuuuauuaaaauc

SEQ ID NO: 3399185 - RNA, 12 nt, Human
ccuuuauugugu

SEQ ID NO: 3399186 - RNA, 16 nt, Human
ccuuucaaagccauuu

SEQ ID NO: 3399187 - RNA, 15 nt, Human
ccuuucaauaggaaa

SEQ ID NO: 3399188 - RNA, 19 nt, Human
ccuuucaccccagggccug

SEQ ID NO: 3399189 - RNA, 15 nt, Human
ccuuucacuucuuuc

SEQ ID NO: 3399190 - RNA, 20 nt, Human
ccuuucagaugucuucugcc

SEQ ID NO: 3399191 - RNA, 16 nt, Human
ccuuucagcccacguc

SEQ ID NO: 3399192 - RNA, 14 nt, Human
ccuuucaggaucua

SEQ ID NO: 3399193 - RNA, 17 nt, Human
ccuuucaggaucuauuu

SEQ ID NO: 3399194 - RNA, 16 nt, Human
ccuuucauuuacugug

SEQ ID NO: 3399195 - RNA, 15 nt, Human
ccuuucauuuugcuu

SEQ ID NO: 3399196 - RNA, 14 nt, Human
ccuuuccccagcau

SEQ ID NO: 3399197 - RNA, 16 nt, Human
ccuuuccccagcauca

SEQ ID NO: 3399198 - RNA, 23 nt, Human
ccuuuccccagcaucacucccca

SEQ ID NO: 3399199 - RNA, 15 nt, Human
ccuuuccccagccca

SEQ ID NO: 3399200 - RNA, 16 nt, Human
ccuuuccccagcccag

SEQ ID NO: 3399201 - RNA, 18 nt, Human
ccuuucccccuucucuua

SEQ ID NO: 3399202 - RNA, 12 nt, Human
ccuuucccgggc

SEQ ID NO: 3399203 - RNA, 13 nt, Human
ccuuucccgggcu

SEQ ID NO: 3399204 - RNA, 12 nt, Human
ccuuucccucca

SEQ ID NO: 3399205 - RNA, 15 nt, Human
ccuuucccuuccucu

SEQ ID NO: 3399206 - RNA, 15 nt, Human
ccuuuccuccucuga

SEQ ID NO: 3399207 - RNA, 16 nt, Human
ccuuuccuuccauccc

SEQ ID NO: 3399208 - RNA, 18 nt, Human
ccuuuccuuccaucccua

SEQ ID NO: 3399209 - RNA, 13 nt, Human
ccuuuccuuccuu

SEQ ID NO: 3399210 - RNA, 18 nt, Human
ccuuucgaggccugaagc

SEQ ID NO: 3399211 - RNA, 19 nt, Human
ccuuucgcccacagucuga

SEQ ID NO: 3399212 - RNA, 16 nt, Human
ccuuucuacuuccaag

SEQ ID NO: 3399213 - RNA, 14 nt, Human
ccuuucuagagcac

SEQ ID NO: 3399214 - RNA, 10 nt, Human
ccuuucucac

SEQ ID NO: 3399215 - RNA, 14 nt, Human
ccuuucuccagcca

SEQ ID NO: 3399216 - RNA, 16 nt, Human
ccuuucuccagccagc

SEQ ID NO: 3399217 - RNA, 20 nt, Human
ccuuucuccagccagcaaug

SEQ ID NO: 3399218 - RNA, 22 nt, Human
ccuuucuccagccagcaaugau

SEQ ID NO: 3399219 - RNA, 12 nt, Human
ccuuucucuuuc

SEQ ID NO: 3399220 - RNA, 16 nt, Human
ccuuucucuuucguua

SEQ ID NO: 3399221 - RNA, 21 nt, Human
ccuuucucuuucucucuuccc

SEQ ID NO: 3399222 - RNA, 20 nt, Human
ccuuucucuuuuccccuuuc

SEQ ID NO: 3399223 - RNA, 22 nt, Human
ccuuucucuuuuccccuuuccu

SEQ ID NO: 3399224 - RNA, 11 nt, Human
ccuuucugugu

SEQ ID NO: 3399225 - RNA, 12 nt, Human
ccuuucuguguu

SEQ ID NO: 3399226 - RNA, 11 nt, Human
ccuuucuuccg

SEQ ID NO: 3399227 - RNA, 12 nt, Human
ccuuucuuccgg

SEQ ID NO: 3399228 - RNA, 13 nt, Human
ccuuucuuccuca

SEQ ID NO: 3399229 - RNA, 12 nt, Human
ccuuucuucucc

SEQ ID NO: 3399230 - RNA, 16 nt, Human
ccuuucuuuuucuucu

SEQ ID NO: 3399231 - RNA, 12 nt, Human
ccuuugaagagg

SEQ ID NO: 3399232 - RNA, 16 nt, Human
ccuuugaauccucucu

SEQ ID NO: 3399233 - RNA, 16 nt, Human
ccuuugaccugccucc

SEQ ID NO: 3399234 - RNA, 23 nt, Human
ccuuugacgccaucccagcccca

SEQ ID NO: 3399235 - RNA, 15 nt, Human
ccuuugagacaguuu

SEQ ID NO: 3399236 - RNA, 17 nt, Human
ccuuugagacaguuucu

SEQ ID NO: 3399237 - RNA, 22 nt, Human
ccuuugagugcaguccugauca

SEQ ID NO: 3399238 - RNA, 22 nt, Human
ccuuugaguuuccucaggcugc

SEQ ID NO: 3399239 - RNA, 14 nt, Human
ccuuugcacaggau

SEQ ID NO: 3399240 - RNA, 14 nt, Human
ccuuugcacugagg

SEQ ID NO: 3399241 - RNA, 16 nt, Human
ccuuugcacugagggc

SEQ ID NO: 3399242 - RNA, 19 nt, Human
ccuuugcacugagggccac

SEQ ID NO: 3399243 - RNA, 14 nt, Human
ccuuugcagggcag

SEQ ID NO: 3399244 - RNA, 16 nt, Human
ccuuugcagggcagcc

SEQ ID NO: 3399245 - RNA, 21 nt, Human
ccuuugccaccaacuggcccu

SEQ ID NO: 3399246 - RNA, 13 nt, Human
ccuuugccaggug

SEQ ID NO: 3399247 - RNA, 19 nt, Human
ccuuugcugaggccuccag

SEQ ID NO: 3399248 - RNA, 18 nt, Human
ccuuugcugucccauagu

SEQ ID NO: 3399249 - RNA, 17 nt, Human
ccuuugcugugaggcug

SEQ ID NO: 3399250 - RNA, 16 nt, Human
ccuuugcuugaaagaa

SEQ ID NO: 3399251 - RNA, 20 nt, Human
ccuuuggagaugcugagggu

SEQ ID NO: 3399252 - RNA, 19 nt, Human
ccuuuggaugaccagaaca

SEQ ID NO: 3399253 - RNA, 18 nt, Human
ccuuuggcaggugcagcc

SEQ ID NO: 3399254 - RNA, 16 nt, Human
ccuuuggcucuggaga

SEQ ID NO: 3399255 - RNA, 14 nt, Human
ccuuugggcccagg

SEQ ID NO: 3399256 - RNA, 16 nt, Human
ccuuugggcccaggga

SEQ ID NO: 3399257 - RNA, 17 nt, Human
ccuuugggcccagggac

SEQ ID NO: 3399258 - RNA, 17 nt, Human
ccuuugggcccugcaug

SEQ ID NO: 3399259 - RNA, 18 nt, Human
ccuuugggcccugcaugu

SEQ ID NO: 3399260 - RNA, 19 nt, Human
ccuuugggcuucagcugcc

SEQ ID NO: 3399261 - RNA, 18 nt, Human
ccuuuggggggggcccgc

SEQ ID NO: 3399262 - RNA, 12 nt, Human
ccuuuggggguu

SEQ ID NO: 3399263 - RNA, 20 nt, Human
ccuuugguucuggccagaau

SEQ ID NO: 3399264 - RNA, 23 nt, Human
ccuuuguaaauugucagaugcug

SEQ ID NO: 3399265 - RNA, 14 nt, Human
ccuuuguaagugca

SEQ ID NO: 3399266 - RNA, 16 nt, Human
ccuuuguaagugcagg

SEQ ID NO: 3399267 - RNA, 14 nt, Human
ccuuuguaaguuau

SEQ ID NO: 3399268 - RNA, 15 nt, Human
ccuuuguaaguuauu

SEQ ID NO: 3399269 - RNA, 15 nt, Human
ccuuuguauucucuc

SEQ ID NO: 3399270 - RNA, 22 nt, Human
ccuuuguauucucuccuguacc

SEQ ID NO: 3399271 - RNA, 22 nt, Human
ccuuuguauucugucuucaucc

SEQ ID NO: 3399272 - RNA, 14 nt, Human
ccuuugucccagaa

SEQ ID NO: 3399273 - RNA, 16 nt, Human
ccuuuguccuccugcu

SEQ ID NO: 3399274 - RNA, 13 nt, Human
ccuuugugaaaaa

SEQ ID NO: 3399275 - RNA, 22 nt, Human
ccuuugugguuuuauggagacc

SEQ ID NO: 3399276 - RNA, 19 nt, Human
ccuuuguguguacucacug

SEQ ID NO: 3399277 - RNA, 20 nt, Human
ccuuuguguguacucacuga

SEQ ID NO: 3399278 - RNA, 13 nt, Human
ccuuuguguuucu

SEQ ID NO: 3399279 - RNA, 18 nt, Human
ccuuuguuccccacugga

SEQ ID NO: 3399280 - RNA, 14 nt, Human
ccuuuguucccggc

SEQ ID NO: 3399281 - RNA, 23 nt, Human
ccuuuguuggagucaaaaagaac

SEQ ID NO: 3399282 - RNA, 13 nt, Human
ccuuuguuucuug

SEQ ID NO: 3399283 - RNA, 14 nt, Human
ccuuuguuucuugu

SEQ ID NO: 3399284 - RNA, 20 nt, Human
ccuuuguuuuuaugaagaaa

SEQ ID NO: 3399285 - RNA, 12 nt, Human
ccuuuuaaagaa

SEQ ID NO: 3399286 - RNA, 13 nt, Human
ccuuuuaacauuu

SEQ ID NO: 3399287 - RNA, 15 nt, Human
ccuuuuaacauuuug

SEQ ID NO: 3399288 - RNA, 16 nt, Human
ccuuuuaguuccugug

SEQ ID NO: 3399289 - RNA, 21 nt, Human
ccuuuuauaaaccucuaauuu

SEQ ID NO: 3399290 - RNA, 22 nt, Human
ccuuuuauaggugagaaaaaaa

SEQ ID NO: 3399291 - RNA, 15 nt, Human
ccuuuuauguuauuu

SEQ ID NO: 3399292 - RNA, 23 nt, Human
ccuuuuauuauaagucuuacaua

SEQ ID NO: 3399293 - RNA, 15 nt, Human
ccuuuuauugacaca

SEQ ID NO: 3399294 - RNA, 18 nt, Human
ccuuuuauuucuucacca

SEQ ID NO: 3399295 - RNA, 17 nt, Human
ccuuuucagcuucugcu

SEQ ID NO: 3399296 - RNA, 12 nt, Human
ccuuuucagggc

SEQ ID NO: 3399297 - RNA, 13 nt, Human
ccuuuucagggcu

SEQ ID NO: 3399298 - RNA, 18 nt, Human
ccuuuucagggcuggcuc

SEQ ID NO: 3399299 - RNA, 19 nt, Human
ccuuuucauaggucugaaa

SEQ ID NO: 3399300 - RNA, 16 nt, Human
ccuuuucaugauuuua

SEQ ID NO: 3399301 - RNA, 23 nt, Human
ccuuuucccaaaauguugaaaua

SEQ ID NO: 3399302 - RNA, 14 nt, Human
ccuuuucccugcuu

SEQ ID NO: 3399303 - RNA, 19 nt, Human
ccuuuucccugcuuccagg

SEQ ID NO: 3399304 - RNA, 12 nt, Human
ccuuuucuauuc

SEQ ID NO: 3399305 - RNA, 15 nt, Human
ccuuuucuccuaucu

SEQ ID NO: 3399306 - RNA, 12 nt, Human
ccuuuucugacc

SEQ ID NO: 3399307 - RNA, 13 nt, Human
ccuuuucugacca

SEQ ID NO: 3399308 - RNA, 18 nt, Human
ccuuuucugaccaaagag

SEQ ID NO: 3399309 - RNA, 22 nt, Human
ccuuuucugcauuuugcuauug

SEQ ID NO: 3399310 - RNA, 12 nt, Human
ccuuuucuuguu

SEQ ID NO: 3399311 - RNA, 21 nt, Human
ccuuuucuuguuuaucagcag

SEQ ID NO: 3399312 - RNA, 19 nt, Human
ccuuuucuuuguucaagau

SEQ ID NO: 3399313 - RNA, 13 nt, Human
ccuuuucuuuugu

SEQ ID NO: 3399314 - RNA, 16 nt, Human
ccuuuucuuuuguuac

SEQ ID NO: 3399315 - RNA, 17 nt, Human
ccuuuucuuuuguuacu

SEQ ID NO: 3399316 - RNA, 18 nt, Human
ccuuuucuuuuguuacug

SEQ ID NO: 3399317 - RNA, 20 nt, Human
ccuuuucuuuuguuacuguu

SEQ ID NO: 3399318 - RNA, 21 nt, Human
ccuuuugaaauuaaccucuca

SEQ ID NO: 3399319 - RNA, 23 nt, Human
ccuuuugaaguaguuuguauaac

SEQ ID NO: 3399320 - RNA, 15 nt, Human
ccuuuugacacugcu

SEQ ID NO: 3399321 - RNA, 16 nt, Human
ccuuuugaggagcccc

SEQ ID NO: 3399322 - RNA, 12 nt, Human
ccuuuugcaccc

SEQ ID NO: 3399323 - RNA, 16 nt, Human
ccuuuugcaccccucc

SEQ ID NO: 3399324 - RNA, 20 nt, Human
ccuuuugcaccugcucucuu

SEQ ID NO: 3399325 - RNA, 15 nt, Human
ccuuuugcaggcucc

SEQ ID NO: 3399326 - RNA, 13 nt, Human
ccuuuugcauucu

SEQ ID NO: 3399327 - RNA, 12 nt, Human
ccuuuuggggga

SEQ ID NO: 3399328 - RNA, 15 nt, Human
ccuuuuggguuucug

SEQ ID NO: 3399329 - RNA, 23 nt, Human
ccuuuuguauacauccuggguaa

SEQ ID NO: 3399330 - RNA, 12 nt, Human
ccuuuugucucu

SEQ ID NO: 3399331 - RNA, 13 nt, Human
ccuuuuguuuucu

SEQ ID NO: 3399332 - RNA, 18 nt, Human
ccuuuuuauuuauaugua

SEQ ID NO: 3399333 - RNA, 20 nt, Human
ccuuuuuauuuauauguaug

SEQ ID NO: 3399334 - RNA, 16 nt, Human
ccuuuuucaauaacug

SEQ ID NO: 3399335 - RNA, 15 nt, Human
ccuuuuucauuauuu

SEQ ID NO: 3399336 - RNA, 19 nt, Human
ccuuuuuccuagccuguuu

SEQ ID NO: 3399337 - RNA, 13 nt, Human
ccuuuuuccucuc

SEQ ID NO: 3399338 - RNA, 15 nt, Human
ccuuuuuccucucca

SEQ ID NO: 3399339 - RNA, 16 nt, Human
ccuuuuuccucuccac

SEQ ID NO: 3399340 - RNA, 13 nt, Human
ccuuuuuccuugu

SEQ ID NO: 3399341 - RNA, 17 nt, Human
ccuuuuuccuugucccc

SEQ ID NO: 3399342 - RNA, 21 nt, Human
ccuuuuucugcacuauaugca

SEQ ID NO: 3399343 - RNA, 20 nt, Human
ccuuuuucuuuauaaacuuu

SEQ ID NO: 3399344 - RNA, 12 nt, Human
ccuuuuugaagu

SEQ ID NO: 3399345 - RNA, 13 nt, Human
ccuuuuugaagug

SEQ ID NO: 3399346 - RNA, 22 nt, Human
ccuuuuugaaguguaggcagac

SEQ ID NO: 3399347 - RNA, 14 nt, Human
ccuuuuugacacug

SEQ ID NO: 3399348 - RNA, 19 nt, Human
cgcagaccucuggauuagg

SEQ ID NO: 3399349 - RNA, 14 nt, Human
cgcagagcuggccg

SEQ ID NO: 3399350 - RNA, 19 nt, Human
cgcagagggaauuuuuccc

SEQ ID NO: 3399351 - RNA, 20 nt, Human
cgcagaugugcagcagauug

SEQ ID NO: 3399352 - RNA, 17 nt, Human
cgcagcaggaggccagg

SEQ ID NO: 3399353 - RNA, 19 nt, Human
cgcagcauauucaggaagc

SEQ ID NO: 3399354 - RNA, 12 nt, Human
cgcagccacccu

SEQ ID NO: 3399355 - RNA, 12 nt, Human
cgcagccccauc

SEQ ID NO: 3399356 - RNA, 10 nt, Human
cgcagcccug

SEQ ID NO: 3399357 - RNA, 15 nt, Human
cgcagcccugcagag

SEQ ID NO: 3399358 - RNA, 19 nt, Human
cgcagcccugcagagggca

SEQ ID NO: 3399359 - RNA, 24 nt, Human
cgcagcccugcuuugggcugcccu

SEQ ID NO: 3399360 - RNA, 17 nt, Human
cgcagcucuugcccuuc

SEQ ID NO: 3399361 - RNA, 18 nt, Human
cgcagcucuugcccuucc

SEQ ID NO: 3399362 - RNA, 20 nt, Human
cgcagcucuugcccuucccu

SEQ ID NO: 3399363 - RNA, 12 nt, Human
cgcaggaagcug

SEQ ID NO: 3399364 - RNA, 17 nt, Human
cgcaggauucagccgga

SEQ ID NO: 3399365 - RNA, 13 nt, Human
cgcaggcuggccc

SEQ ID NO: 3399366 - RNA, 19 nt, Human
cgcaggcuggcccugcccu

SEQ ID NO: 3399367 - RNA, 16 nt, Human
cgcagggguugcagug

SEQ ID NO: 3399368 - RNA, 18 nt, Human
cgcaggugcacaggggga

SEQ ID NO: 3399369 - RNA, 17 nt, Human
cgcagucaggggcagcu

SEQ ID NO: 3399370 - RNA, 22 nt, Human
cgcaguccacuucugacagccu

SEQ ID NO: 3399371 - RNA, 16 nt, Human
cgcagucgucgcacag

SEQ ID NO: 3399372 - RNA, 17 nt, Human
cgcagugugcacuaagg

SEQ ID NO: 3399373 - RNA, 22 nt, Human
cgcagugugcacuaaggggccc

SEQ ID NO: 3399374 - RNA, 15 nt, Human
cgcaguguuugugug

SEQ ID NO: 3399375 - RNA, 16 nt, Human
cgcauaggccugcuuu

SEQ ID NO: 3399376 - RNA, 14 nt, Human
cgcaucaaaagaca

SEQ ID NO: 3399377 - RNA, 15 nt, Human
cgcaucaaaagacaa

SEQ ID NO: 3399378 - RNA, 22 nt, Human
cgcaucaaaagacaauucuuua

SEQ ID NO: 3399379 - RNA, 13 nt, Human
cgcaucagacaga

SEQ ID NO: 3399380 - RNA, 15 nt, Human
cgcaucagcugcuca

SEQ ID NO: 3399381 - RNA, 14 nt, Human
cgcauccagcaaga

SEQ ID NO: 3399382 - RNA, 16 nt, Human
cgcauccuagucucua

SEQ ID NO: 3399383 - RNA, 19 nt, Human
cgcaucuucccaaccccuu

SEQ ID NO: 3399384 - RNA, 15 nt, Human
cgcaucuucuccauc

SEQ ID NO: 3399385 - RNA, 16 nt, Human
cgcaucuucuccaucu

SEQ ID NO: 3399386 - RNA, 19 nt, Human
cgcaucuugccuccaggug

SEQ ID NO: 3399387 - RNA, 13 nt, Human
cgcaugcccccuc

SEQ ID NO: 3399388 - RNA, 15 nt, Human
cgcaugcccucaauc

SEQ ID NO: 3399389 - RNA, 14 nt, Human
cgcaugcggcccag

SEQ ID NO: 3399390 - RNA, 18 nt, Human
cgcauggaguguguauug

SEQ ID NO: 3399391 - RNA, 15 nt, Human
cgcauuccaggcucc

SEQ ID NO: 3399392 - RNA, 18 nt, Human
cgcauucuaaccuggagg

SEQ ID NO: 3399393 - RNA, 19 nt, Human
cgccaaauaaugucucugu

SEQ ID NO: 3399394 - RNA, 23 nt, Human
cgccaaggcugggggaagaagcu

SEQ ID NO: 3399395 - RNA, 21 nt, Human
cgccaagguagccaucccaug

SEQ ID NO: 3399396 - RNA, 23 nt, Human
cgccaauaaaccaaugaacgaag

SEQ ID NO: 3399397 - RNA, 17 nt, Human
cgccacagcccuuuugu

SEQ ID NO: 3399398 - RNA, 23 nt, Human
cgccacauccccgcuggcugggg

SEQ ID NO: 3399399 - RNA, 15 nt, Human
cgccaccacacccaa

SEQ ID NO: 3399400 - RNA, 11 nt, Human
cgccaccauuc

SEQ ID NO: 3399401 - RNA, 17 nt, Human
cgccaccccuccuuccu

SEQ ID NO: 3399402 - RNA, 18 nt, Human
cgccaccgccacccgcag

SEQ ID NO: 3399403 - RNA, 21 nt, Human
cgccaccuggcauuccuucug

SEQ ID NO: 3399404 - RNA, 21 nt, Human
cgccacugcacuccagccugg

SEQ ID NO: 3399405 - RNA, 17 nt, Human
cgccacuggggcucaga

SEQ ID NO: 3399406 - RNA, 18 nt, Human
cgccagauggggccucug

SEQ ID NO: 3399407 - RNA, 16 nt, Human
cgccagccuccucugg

SEQ ID NO: 3399408 - RNA, 18 nt, Human
cgccagccuccucuggac

SEQ ID NO: 3399409 - RNA, 22 nt, Human
cgccagcucaccccaucauccc

SEQ ID NO: 3399410 - RNA, 20 nt, Human
cgccagcucccgccagccgc

SEQ ID NO: 3399411 - RNA, 15 nt, Human
cgccagcugaugacu

SEQ ID NO: 3399412 - RNA, 17 nt, Human
cgccagcugaugacuca

SEQ ID NO: 3399413 - RNA, 20 nt, Human
cgccagcugaugacucaaga

SEQ ID NO: 3399414 - RNA, 18 nt, Human
cgccaggaccgccaaaga

SEQ ID NO: 3399415 - RNA, 23 nt, Human
cgccaggauggaacacggccaca

SEQ ID NO: 3399416 - RNA, 16 nt, Human
cgccaggcugaccaca

SEQ ID NO: 3399417 - RNA, 16 nt, Human
cgccagggaccccaga

SEQ ID NO: 3399418 - RNA, 11 nt, Human
cgccagggccc

SEQ ID NO: 3399419 - RNA, 15 nt, Human
cgccaguacuuguca

SEQ ID NO: 3399420 - RNA, 21 nt, Human
cgccaguguaaucccccagga

SEQ ID NO: 3399421 - RNA, 22 nt, Human
cgccaguguaaucccccaggag

SEQ ID NO: 3399422 - RNA, 14 nt, Human
cgccaucccagccc

SEQ ID NO: 3399423 - RNA, 23 nt, Human
cgccaugugauggacacuccagg

SEQ ID NO: 3399424 - RNA, 20 nt, Human
cgcccaaaggacgcacugag

SEQ ID NO: 3399425 - RNA, 14 nt, Human
cgcccaacccuucc

SEQ ID NO: 3399426 - RNA, 17 nt, Human
cgcccaaggccuucccc

SEQ ID NO: 3399427 - RNA, 21 nt, Human
cgcccacaggaagccugcagu

SEQ ID NO: 3399428 - RNA, 18 nt, Human
cgcccaccccgcucugca

SEQ ID NO: 3399429 - RNA, 19 nt, Human
cgcccaccccgcucugcau

SEQ ID NO: 3399430 - RNA, 16 nt, Human
cgcccaccgcaugccc

SEQ ID NO: 3399431 - RNA, 17 nt, Human
cgcccaccgcaugcccc

SEQ ID NO: 3399432 - RNA, 18 nt, Human
cgcccaccgcaugccccc

SEQ ID NO: 3399433 - RNA, 11 nt, Human
cgcccaccucc

SEQ ID NO: 3399434 - RNA, 12 nt, Human
cgcccaccuccc

SEQ ID NO: 3399435 - RNA, 14 nt, Human
cgcccacuguccug

SEQ ID NO: 3399436 - RNA, 20 nt, Human
cgcccacuguccugggcgcc

SEQ ID NO: 3399437 - RNA, 13 nt, Human
cgcccagcuccug

SEQ ID NO: 3399438 - RNA, 19 nt, Human
cgcccaggcuggagugcaa

SEQ ID NO: 3399439 - RNA, 20 nt, Human
cgcccaggcuggagugcagu

SEQ ID NO: 3399440 - RNA, 16 nt, Human
cgcccaggcuggccag

SEQ ID NO: 3399441 - RNA, 20 nt, Human
cgcccaggcuggccagcccc

SEQ ID NO: 3399442 - RNA, 15 nt, Human
cgcccagucccagca

SEQ ID NO: 3399443 - RNA, 19 nt, Human
cgcccagugcccuggggcu

SEQ ID NO: 3399444 - RNA, 22 nt, Human
cgcccaguuggguggaugccug

SEQ ID NO: 3399445 - RNA, 19 nt, Human
cgcccaugagagcgcagcc

SEQ ID NO: 3399446 - RNA, 21 nt, Human
cgcccaugagagcgcagcccg

SEQ ID NO: 3399447 - RNA, 18 nt, Human
cgcccaugcacuggggac

SEQ ID NO: 3399448 - RNA, 21 nt, Human
cgccccaaaguaaaagaaacc

SEQ ID NO: 3399449 - RNA, 22 nt, Human
cgcccccaguccccaccccugc

SEQ ID NO: 3399450 - RNA, 13 nt, Human
cgcccccagugug

SEQ ID NO: 3399451 - RNA, 21 nt, Human
cgccccccacacuucccuggc

SEQ ID NO: 3399452 - RNA, 15 nt, Human
cgccccccucccaga

SEQ ID NO: 3399453 - RNA, 19 nt, Human
cgcccccuccgcccugcca

SEQ ID NO: 3399454 - RNA, 12 nt, Human
cgcccccugccc

SEQ ID NO: 3399455 - RNA, 15 nt, Human
cgcccccugcccucc

SEQ ID NO: 3399456 - RNA, 18 nt, Human
cgcccccugucucucagg

SEQ ID NO: 3399457 - RNA, 21 nt, Human
cgccccucauuuaucccucaa

SEQ ID NO: 3399458 - RNA, 19 nt, Human
cgccccucccacagcgcug

SEQ ID NO: 3399459 - RNA, 21 nt, Human
cgccccucccacagcgcuggc

SEQ ID NO: 3399460 - RNA, 14 nt, Human
cgccccugccaccu

SEQ ID NO: 3399461 - RNA, 15 nt, Human
cgccccugccugcca

SEQ ID NO: 3399462 - RNA, 15 nt, Human
cgcccgagcuguuua

SEQ ID NO: 3399463 - RNA, 16 nt, Human
cgcccgcccacugucc

SEQ ID NO: 3399464 - RNA, 19 nt, Human
cgcccgcccacuguccugg

SEQ ID NO: 3399465 - RNA, 14 nt, Human
cgcccgccccugca

SEQ ID NO: 3399466 - RNA, 13 nt, Human
cgcccgcgcccgc

SEQ ID NO: 3399467 - RNA, 12 nt, Human
cgcccgcgcccu

SEQ ID NO: 3399468 - RNA, 14 nt, Human
cgcccguccugccu

SEQ ID NO: 3399469 - RNA, 17 nt, Human
cgcccguccugccugug

SEQ ID NO: 3399470 - RNA, 23 nt, Human
cgcccgucugugugugaccccuc

SEQ ID NO: 3399471 - RNA, 23 nt, Human
cgcccuaggccuggcauggcacc

SEQ ID NO: 3399472 - RNA, 19 nt, Human
cgcccucauuacggcuccu

SEQ ID NO: 3399473 - RNA, 14 nt, Human
cgcccuccccuccc

SEQ ID NO: 3399474 - RNA, 16 nt, Human
cgcccuccuuucugug

SEQ ID NO: 3399475 - RNA, 20 nt, Human
cgcccucuccuuuguucccg

SEQ ID NO: 3399476 - RNA, 13 nt, Human
cgcccucuucccc

SEQ ID NO: 3399477 - RNA, 15 nt, Human
cgcccucuuccugac

SEQ ID NO: 3399478 - RNA, 15 nt, Human
cgcccugcagacccu

SEQ ID NO: 3399479 - RNA, 16 nt, Human
cgcccugcagacccug

SEQ ID NO: 3399480 - RNA, 20 nt, Human
cgcccugcagacccugcccu

SEQ ID NO: 3399481 - RNA, 21 nt, Human
cgcccugcagacccugcccuu

SEQ ID NO: 3399482 - RNA, 11 nt, Human
cgcccugccac

SEQ ID NO: 3399483 - RNA, 12 nt, Human
cgcccugccacu

SEQ ID NO: 3399484 - RNA, 17 nt, Human
cgcccugcuccucccug

SEQ ID NO: 3399485 - RNA, 12 nt, Human
cgcccuggaagc

SEQ ID NO: 3399486 - RNA, 16 nt, Human
cgcccuggcaggcagg

SEQ ID NO: 3399487 - RNA, 14 nt, Human
cgcccuggccccca

SEQ ID NO: 3399488 - RNA, 21 nt, Human
cgcccugggcucgucuuugca

SEQ ID NO: 3399489 - RNA, 19 nt, Human
cgcccuuacuucuugcccu

SEQ ID NO: 3399490 - RNA, 12 nt, Human
cgcccuuccucu

SEQ ID NO: 3399491 - RNA, 17 nt, Human
cgcccuuggcuucugug

SEQ ID NO: 3399492 - RNA, 14 nt, Human
cgcccuuuuccccu

SEQ ID NO: 3399493 - RNA, 15 nt, Human
cggauaguugcuauu

SEQ ID NO: 3399494 - RNA, 17 nt, Human
cggauaguugcuauuuu

SEQ ID NO: 3399495 - RNA, 20 nt, Human
cggauaguugcuauuuuugu

SEQ ID NO: 3399496 - RNA, 18 nt, Human
cggaucaccgagaguagc

SEQ ID NO: 3399497 - RNA, 23 nt, Human
cggaucaccgagaguagccgaga

SEQ ID NO: 3399498 - RNA, 22 nt, Human
cggaucagagcaggaccucccu

SEQ ID NO: 3399499 - RNA, 18 nt, Human
cggauccagggaggcugg

SEQ ID NO: 3399500 - RNA, 14 nt, Human
cggauccccuuccu

SEQ ID NO: 3399501 - RNA, 17 nt, Human
cggauccuaagcaucua

SEQ ID NO: 3399502 - RNA, 15 nt, Human
cggaucuguugcaaa

SEQ ID NO: 3399503 - RNA, 13 nt, Human
cggaugauuucua

SEQ ID NO: 3399504 - RNA, 13 nt, Human
cggaugcugcuuc

SEQ ID NO: 3399505 - RNA, 13 nt, Human
cggaugugcuuuu

SEQ ID NO: 3399506 - RNA, 18 nt, Human
cggauuauuuuuucagac

SEQ ID NO: 3399507 - RNA, 19 nt, Human
cggauuauuuuuucagacc

SEQ ID NO: 3399508 - RNA, 15 nt, Human
cggauugcaaagcaa

SEQ ID NO: 3399509 - RNA, 23 nt, Human
cggauuggcuuguguguuucacu

SEQ ID NO: 3399510 - RNA, 16 nt, Human
cggauuuuuuccaaaa

SEQ ID NO: 3399511 - RNA, 17 nt, Human
cggauuuuuuccaaaau

SEQ ID NO: 3399512 - RNA, 12 nt, Human
cggcaacaucaa

SEQ ID NO: 3399513 - RNA, 20 nt, Human
cggcaaccccaguucugcuc

SEQ ID NO: 3399514 - RNA, 23 nt, Human
cggcaaccccaguucugcuccuc

SEQ ID NO: 3399515 - RNA, 21 nt, Human
cggcacagggucugcucuuuc

SEQ ID NO: 3399516 - RNA, 20 nt, Human
cggcacccacaagugccacu

SEQ ID NO: 3399517 - RNA, 15 nt, Human
cggcacccacccagc

SEQ ID NO: 3399518 - RNA, 16 nt, Human
cggcacccucuggccg

SEQ ID NO: 3399519 - RNA, 13 nt, Human
cggcaccugggcc

SEQ ID NO: 3399520 - RNA, 22 nt, Human
cggcaccugggcccuggggccu

SEQ ID NO: 3399521 - RNA, 23 nt, Human
cggcaccugggcccuggggccug

SEQ ID NO: 3399522 - RNA, 22 nt, Human
cggcagaaaggaaaaccugaag

SEQ ID NO: 3399523 - RNA, 13 nt, Human
cggcagcagcccc

SEQ ID NO: 3399524 - RNA, 20 nt, Human
cggcagcuucugcccccugc

SEQ ID NO: 3399525 - RNA, 22 nt, Human
cggcagcuucugcccccugcag

SEQ ID NO: 3399526 - RNA, 20 nt, Human
cggcaggcucacugccaggc

SEQ ID NO: 3399527 - RNA, 23 nt, Human
cggcaggcucacugccaggccag

SEQ ID NO: 3399528 - RNA, 17 nt, Human
cggcagguucacaggcg

SEQ ID NO: 3399529 - RNA, 21 nt, Human
cggcaguauugaagcucguga

SEQ ID NO: 3399530 - RNA, 23 nt, Human
cggcaugagacucagugcagaug

SEQ ID NO: 3399531 - RNA, 21 nt, Human
cggcauggacaauggaccgga

SEQ ID NO: 3399532 - RNA, 13 nt, Human
cggcauggcuggg

SEQ ID NO: 3399533 - RNA, 14 nt, Human
cggcauggcuggga

SEQ ID NO: 3399534 - RNA, 21 nt, Human
cggcaugggaaagccaccucu

SEQ ID NO: 3399535 - RNA, 23 nt, Human
cggcauugguucccuuugcucca

SEQ ID NO: 3399536 - RNA, 16 nt, Human
cggccacacagcugcc

SEQ ID NO: 3399537 - RNA, 14 nt, Human
cggccaccucugcg

SEQ ID NO: 3399538 - RNA, 11 nt, Human
cggccaccugc

SEQ ID NO: 3399539 - RNA, 10 nt, Human
cggccagcca

SEQ ID NO: 3399540 - RNA, 11 nt, Human
cggccaggcca

SEQ ID NO: 3399541 - RNA, 22 nt, Human
cggccaugaccacuuuccccgu

SEQ ID NO: 3399542 - RNA, 15 nt, Human
cggcccaagcccgac

SEQ ID NO: 3399543 - RNA, 17 nt, Human
cggcccacaauuaauuu

SEQ ID NO: 3399544 - RNA, 12 nt, Human
cggcccacagcu

SEQ ID NO: 3399545 - RNA, 22 nt, Human
cggcccacagcucccaccccac

SEQ ID NO: 3399546 - RNA, 20 nt, Human
cggcccauccccaggcaccu

SEQ ID NO: 3399547 - RNA, 21 nt, Human
cggccccaccagugccucucc

SEQ ID NO: 3399548 - RNA, 16 nt, Human
cggccccagccagagu

SEQ ID NO: 3399549 - RNA, 22 nt, Human
cggccccagccagaguuccugc

SEQ ID NO: 3399550 - RNA, 19 nt, Human
cggccccagcuucucagcu

SEQ ID NO: 3399551 - RNA, 20 nt, Human
cggcccccgcgcgcgucccc

SEQ ID NO: 3399552 - RNA, 15 nt, Human
cggcccccuggucuc

SEQ ID NO: 3399553 - RNA, 16 nt, Human
cggcccgaucuuucua

SEQ ID NO: 3399554 - RNA, 21 nt, Human
cggcccuaccagcgcccgcug

SEQ ID NO: 3399555 - RNA, 14 nt, Human
cggcccuaugcaug

SEQ ID NO: 3399556 - RNA, 20 nt, Human
cggcccuccuacccugcgcc

SEQ ID NO: 3399557 - RNA, 23 nt, Human
cggcccuccuacccugcgcccag

SEQ ID NO: 3399558 - RNA, 22 nt, Human
cggcccugcaauguaucccuuc

SEQ ID NO: 3399559 - RNA, 18 nt, Human
cggcccugggcucggagg

SEQ ID NO: 3399560 - RNA, 15 nt, Human
cggccgcuccaccag

SEQ ID NO: 3399561 - RNA, 23 nt, Human
cggccggccagccccuggcccca

SEQ ID NO: 3399562 - RNA, 18 nt, Human
cggccuaugacuugggca

SEQ ID NO: 3399563 - RNA, 14 nt, Human
cggccucagcaccc

SEQ ID NO: 3399564 - RNA, 14 nt, Human
cggccucccaaagu

SEQ ID NO: 3399565 - RNA, 15 nt, Human
cggccucccaaagug

SEQ ID NO: 3399566 - RNA, 12 nt, Human
cggccuccuucu

SEQ ID NO: 3399567 - RNA, 20 nt, Human
cggccuccuucugagcuccu

SEQ ID NO: 3399568 - RNA, 22 nt, Human
cggccuccuucugagcuccugu

SEQ ID NO: 3399569 - RNA, 15 nt, Human
cggccucuaacccca

SEQ ID NO: 3399570 - RNA, 19 nt, Human
cggccucuaaccccaggcc

SEQ ID NO: 3399571 - RNA, 20 nt, Human
cggccucuaaccccaggccc

SEQ ID NO: 3399572 - RNA, 15 nt, Human
cggccucucuggccu

SEQ ID NO: 3399573 - RNA, 20 nt, Human
cggccucucuggccucccac

SEQ ID NO: 3399574 - RNA, 17 nt, Human
cggccucugccuuugca

SEQ ID NO: 3399575 - RNA, 16 nt, Human
cggccugaugcucccu

SEQ ID NO: 3399576 - RNA, 17 nt, Human
cggccugaugcucccuc

SEQ ID NO: 3399577 - RNA, 15 nt, Human
cggccugccaggagg

SEQ ID NO: 3399578 - RNA, 20 nt, Human
cggccugcccccaccccauu

SEQ ID NO: 3399579 - RNA, 15 nt, Human
cggccugcucccagc

SEQ ID NO: 3399580 - RNA, 13 nt, Human
cggccuggcuccu

SEQ ID NO: 3399581 - RNA, 13 nt, Human
cggccuuucccac

SEQ ID NO: 3399582 - RNA, 15 nt, Human
cggcgcccccagugu

SEQ ID NO: 3399583 - RNA, 17 nt, Human
cggcgcccccagugugc

SEQ ID NO: 3399584 - RNA, 17 nt, Human
cggcgcccucuguccug

SEQ ID NO: 3399585 - RNA, 16 nt, Human
cggcgccuggccucca

SEQ ID NO: 3399586 - RNA, 17 nt, Human
cggcgccuggccuccag

SEQ ID NO: 3399587 - RNA, 22 nt, Human
cggcgcgcucuucgcgcccgcc

SEQ ID NO: 3399588 - RNA, 20 nt, Human
cggcgcgguggcucacgccu

SEQ ID NO: 3399589 - RNA, 19 nt, Human
cggcggagcuggccccgcc

SEQ ID NO: 3399590 - RNA, 15 nt, Human
cggcggccucagagu

SEQ ID NO: 3399591 - RNA, 15 nt, Human
cggcgucagccucca

SEQ ID NO: 3399592 - RNA, 16 nt, Human
cggcgucagccuccag

SEQ ID NO: 3399593 - RNA, 19 nt, Human
cggcgucagccuccagccu

SEQ ID NO: 3399594 - RNA, 20 nt, Human
cggcgucagccuccagccuc

SEQ ID NO: 3399595 - RNA, 22 nt, Human
cggcguggcccaaggcuggcag

SEQ ID NO: 3399596 - RNA, 12 nt, Human
cggcuacucagc

SEQ ID NO: 3399597 - RNA, 20 nt, Human
cggcuacucagcagcccucc

SEQ ID NO: 3399598 - RNA, 17 nt, Human
cggcucacugcagccuc

SEQ ID NO: 3399599 - RNA, 18 nt, Human
cggcucacugcagccuca

SEQ ID NO: 3399600 - RNA, 12 nt, Human
cggcuccaggcu

SEQ ID NO: 3399601 - RNA, 15 nt, Human
cggcucccagccuca

SEQ ID NO: 3399602 - RNA, 19 nt, Human
cggcucccagccucagcgc

SEQ ID NO: 3399603 - RNA, 21 nt, Human
cggcucccggggcagggcagc

SEQ ID NO: 3399604 - RNA, 22 nt, Human
cggcucccggggcagggcagcc

SEQ ID NO: 3399605 - RNA, 14 nt, Human
cggcucccuggagc

SEQ ID NO: 3399606 - RNA, 15 nt, Human
cggcuccugcugcac

SEQ ID NO: 3399607 - RNA, 17 nt, Human
cggcuccugcugcacca

SEQ ID NO: 3399608 - RNA, 13 nt, Human
cggcuccugguca

SEQ ID NO: 3399609 - RNA, 16 nt, Human
cggcucucaccuggcc

SEQ ID NO: 3399610 - RNA, 18 nt, Human
cggcucucaccuggcccu

SEQ ID NO: 3399611 - RNA, 14 nt, Human
cggcucugucccca

SEQ ID NO: 3399612 - RNA, 17 nt, Human
cggcucuguccccagcc

SEQ ID NO: 3399613 - RNA, 20 nt, Human
cggcucugugggugaugggg

SEQ ID NO: 3399614 - RNA, 18 nt, Human
cggcucuuuccuugcuca

SEQ ID NO: 3399615 - RNA, 16 nt, Human
cggcugagagccccag

SEQ ID NO: 3399616 - RNA, 20 nt, Human
cggcugagucaugaucuccc

SEQ ID NO: 3399617 - RNA, 22 nt, Human
cggcugagucaugaucucccug

SEQ ID NO: 3399618 - RNA, 11 nt, Human
cggcugcugag

SEQ ID NO: 3399619 - RNA, 20 nt, Human
cggcuggccauggagaaagc

SEQ ID NO: 3399620 - RNA, 21 nt, Human
cggcuggccauggagaaagcu

SEQ ID NO: 3399621 - RNA, 13 nt, Human
cggcuggccuggc

SEQ ID NO: 3399622 - RNA, 15 nt, Human
cggcuggccuggccc

SEQ ID NO: 3399623 - RNA, 18 nt, Human
cggcuggccuggccccuc

SEQ ID NO: 3399624 - RNA, 22 nt, Human
cggcuggccuggccccucaggg

SEQ ID NO: 3399625 - RNA, 23 nt, Human
cggcuggccuggccccucagggu

SEQ ID NO: 3399626 - RNA, 15 nt, Human
cggcuggcuccccug

SEQ ID NO: 3399627 - RNA, 16 nt, Human
cggcuggcuccccugc

SEQ ID NO: 3399628 - RNA, 19 nt, Human
cggcuggcuccccugcagc

SEQ ID NO: 3399629 - RNA, 18 nt, Human
cggcugggaggagggcag

SEQ ID NO: 3399630 - RNA, 14 nt, Human
cggcugggucugug

SEQ ID NO: 3399631 - RNA, 17 nt, Human
cggcugguuuuguaaga

SEQ ID NO: 3399632 - RNA, 22 nt, Human
cggcugguuuuguaagaugcug

SEQ ID NO: 3399633 - RNA, 16 nt, Human
cggcugucucagacuc

SEQ ID NO: 3399634 - RNA, 16 nt, Human
cggcugugcucagaga

SEQ ID NO: 3399635 - RNA, 13 nt, Human
cggcugugugugc

SEQ ID NO: 3399636 - RNA, 15 nt, Human
cgggaaaaagcccac

SEQ ID NO: 3399637 - RNA, 13 nt, Human
cuaccaucucccu

SEQ ID NO: 3399638 - RNA, 12 nt, Human
cuaccauuucag

SEQ ID NO: 3399639 - RNA, 16 nt, Human
cuacccaaacccuagg

SEQ ID NO: 3399640 - RNA, 16 nt, Human
cuacccacaccucugc

SEQ ID NO: 3399641 - RNA, 19 nt, Human
cuacccacaccucugccag

SEQ ID NO: 3399642 - RNA, 18 nt, Human
cuacccagagaagccccu

SEQ ID NO: 3399643 - RNA, 21 nt, Human
cuacccagagauugcuucuca

SEQ ID NO: 3399644 - RNA, 12 nt, Human
cuacccagccca

SEQ ID NO: 3399645 - RNA, 19 nt, Human
cuacccagcgagcccuggu

SEQ ID NO: 3399646 - RNA, 18 nt, Human
cuacccagcguggccucc

SEQ ID NO: 3399647 - RNA, 11 nt, Human
cuacccagggc

SEQ ID NO: 3399648 - RNA, 16 nt, Human
cuacccagggccugca

SEQ ID NO: 3399649 - RNA, 12 nt, Human
cuacccaggugc

SEQ ID NO: 3399650 - RNA, 23 nt, Human
cuacccaucgguguccauuuaua

SEQ ID NO: 3399651 - RNA, 12 nt, Human
cuaccccacacc

SEQ ID NO: 3399652 - RNA, 21 nt, Human
cuaccccacaccaggccgucc

SEQ ID NO: 3399653 - RNA, 13 nt, Human
cuaccccaccacg

SEQ ID NO: 3399654 - RNA, 14 nt, Human
cuaccccaccacga

SEQ ID NO: 3399655 - RNA, 19 nt, Human
cuacccccagcugugcuua

SEQ ID NO: 3399656 - RNA, 17 nt, Human
cuacccccuccucucug

SEQ ID NO: 3399657 - RNA, 20 nt, Human
cuaccccgcagacaccuugg

SEQ ID NO: 3399658 - RNA, 20 nt, Human
cuaccccugaucugacaucc

SEQ ID NO: 3399659 - RNA, 13 nt, Human
cuaccccuggcug

SEQ ID NO: 3399660 - RNA, 14 nt, Human
cuaccccuggcugu

SEQ ID NO: 3399661 - RNA, 21 nt, Human
cuacccgggaagggggcuggg

SEQ ID NO: 3399662 - RNA, 12 nt, Human
cuacccucccac

SEQ ID NO: 3399663 - RNA, 13 nt, Human
cuacccucccacc

SEQ ID NO: 3399664 - RNA, 19 nt, Human
cuacccucccacccccuuc

SEQ ID NO: 3399665 - RNA, 14 nt, Human
cuacccucccugcu

SEQ ID NO: 3399666 - RNA, 15 nt, Human
cuacccucccugcug

SEQ ID NO: 3399667 - RNA, 16 nt, Human
cuacccucccugcugu

SEQ ID NO: 3399668 - RNA, 23 nt, Human
cuacccucccugcuguccccucu

SEQ ID NO: 3399669 - RNA, 17 nt, Human
cuacccuccguuuuucu

SEQ ID NO: 3399670 - RNA, 15 nt, Human
cuacccucgggccca

SEQ ID NO: 3399671 - RNA, 16 nt, Human
cuacccucgggcccac

SEQ ID NO: 3399672 - RNA, 22 nt, Human
cuacccucgggcccaccuggcc

SEQ ID NO: 3399673 - RNA, 13 nt, Human
cuacccucuagag

SEQ ID NO: 3399674 - RNA, 17 nt, Human
cuacccugagcugaggc

SEQ ID NO: 3399675 - RNA, 14 nt, Human
cuacccugcauggc

SEQ ID NO: 3399676 - RNA, 19 nt, Human
cuacccuuuuucuccagcu

SEQ ID NO: 3399677 - RNA, 18 nt, Human
cuaccgaaaccuugccuu

SEQ ID NO: 3399678 - RNA, 21 nt, Human
cuaccgagucucuucuccacu

SEQ ID NO: 3399679 - RNA, 15 nt, Human
cuaccgcucuuggga

SEQ ID NO: 3399680 - RNA, 15 nt, Human
cuaccucaaccugua

SEQ ID NO: 3399681 - RNA, 17 nt, Human
cuaccucacuggggucc

SEQ ID NO: 3399682 - RNA, 13 nt, Human
cuaccucaggcag

SEQ ID NO: 3399683 - RNA, 18 nt, Human
cuaccucaggcagcucaa

SEQ ID NO: 3399684 - RNA, 12 nt, Human
cuaccucagguu

SEQ ID NO: 3399685 - RNA, 11 nt, Human
cuaccucccuc

SEQ ID NO: 3399686 - RNA, 15 nt, Human
cuaccucccuugccu

SEQ ID NO: 3399687 - RNA, 18 nt, Human
cuaccucuccagccucag

SEQ ID NO: 3399688 - RNA, 14 nt, Human
cuaccucucugucc

SEQ ID NO: 3399689 - RNA, 20 nt, Human
cuaccucucugucccuugcu

SEQ ID NO: 3399690 - RNA, 20 nt, Human
cuaccugacacucccuuggg

SEQ ID NO: 3399691 - RNA, 19 nt, Human
cuaccugaggggccucuua

SEQ ID NO: 3399692 - RNA, 16 nt, Human
cuaccugaucccacuc

SEQ ID NO: 3399693 - RNA, 17 nt, Human
cuaccugaucccacucc

SEQ ID NO: 3399694 - RNA, 14 nt, Human
cuaccugcccucaa

SEQ ID NO: 3399695 - RNA, 19 nt, Human
cuaccugcucagcccugca

SEQ ID NO: 3399696 - RNA, 14 nt, Human
cuaccuguaacuuu

SEQ ID NO: 3399697 - RNA, 12 nt, Human
cuaccugugccu

SEQ ID NO: 3399698 - RNA, 11 nt, Human
cuaccugugug

SEQ ID NO: 3399699 - RNA, 15 nt, Human
cuaccuucaaagcug

SEQ ID NO: 3399700 - RNA, 13 nt, Human
cuaccuucucccc

SEQ ID NO: 3399701 - RNA, 12 nt, Human
cuaccuucugua

SEQ ID NO: 3399702 - RNA, 14 nt, Human
cuaccuucuguagu

SEQ ID NO: 3399703 - RNA, 15 nt, Human
cuaccuucuguaguu

SEQ ID NO: 3399704 - RNA, 14 nt, Human
cuaccuugccccaa

SEQ ID NO: 3399705 - RNA, 19 nt, Human
cuaccuugcuuuugcuucu

SEQ ID NO: 3399706 - RNA, 14 nt, Human
cuaccuuuucucuu

SEQ ID NO: 3399707 - RNA, 21 nt, Human
cuacgcucuccuuucuuucua

SEQ ID NO: 3399708 - RNA, 19 nt, Human
cuacguuccuauugucauu

SEQ ID NO: 3399709 - RNA, 21 nt, Human
cuacguuuacucacagccagc

SEQ ID NO: 3399710 - RNA, 19 nt, Human
cuacuaaaaauacaaacaa

SEQ ID NO: 3399711 - RNA, 18 nt, Human
cuacuaauagaauaaagg

SEQ ID NO: 3399712 - RNA, 17 nt, Human
cuacuaccuguaaugac

SEQ ID NO: 3399713 - RNA, 16 nt, Human
cuacucaaagcaaaag

SEQ ID NO: 3399714 - RNA, 20 nt, Human
cuacucaagaggcugaggca

SEQ ID NO: 3399715 - RNA, 18 nt, Human
cuacucaaguagcauuua

SEQ ID NO: 3399716 - RNA, 15 nt, Human
cuacucacacaggca

SEQ ID NO: 3399717 - RNA, 23 nt, Human
cuacucacacaggcauuuccugg

SEQ ID NO: 3399718 - RNA, 17 nt, Human
cuacucacagucucuuu

SEQ ID NO: 3399719 - RNA, 14 nt, Human
cuacucacuuuucc

SEQ ID NO: 3399720 - RNA, 15 nt, Human
cuacucacuuuuccc

SEQ ID NO: 3399721 - RNA, 19 nt, Human
cuacucacuuuucccacuc

SEQ ID NO: 3399722 - RNA, 21 nt, Human
cuacucacuuuucccacucca

SEQ ID NO: 3399723 - RNA, 16 nt, Human
cuacucagaagccuga

SEQ ID NO: 3399724 - RNA, 18 nt, Human
cuacucagcagcccuccu

SEQ ID NO: 3399725 - RNA, 20 nt, Human
cuacucagcagcccuccuca

SEQ ID NO: 3399726 - RNA, 22 nt, Human
cuacucagcagcccuccucacc

SEQ ID NO: 3399727 - RNA, 11 nt, Human
cuacucagcau

SEQ ID NO: 3399728 - RNA, 20 nt, Human
cuacucaggaggcugaggca

SEQ ID NO: 3399729 - RNA, 23 nt, Human
cuacucaggaggcugaggcagaa

SEQ ID NO: 3399730 - RNA, 21 nt, Human
cuacucauacuuaagcaaaag

SEQ ID NO: 3399731 - RNA, 12 nt, Human
cuacucauuuua

SEQ ID NO: 3399732 - RNA, 14 nt, Human
cuacucccugcaga

SEQ ID NO: 3399733 - RNA, 17 nt, Human
cuacucccugcagaugc

SEQ ID NO: 3399734 - RNA, 22 nt, Human
cuacucccugcagaugccaccc

SEQ ID NO: 3399735 - RNA, 21 nt, Human
cuacuccucugcagugccuug

SEQ ID NO: 3399736 - RNA, 18 nt, Human
cuacuccuguaauuccua

SEQ ID NO: 3399737 - RNA, 20 nt, Human
cuacuccugucuucugcuuu

SEQ ID NO: 3399738 - RNA, 16 nt, Human
cuacucgggaagcuga

SEQ ID NO: 3399739 - RNA, 23 nt, Human
cuacucucacacugguucucaau

SEQ ID NO: 3399740 - RNA, 21 nt, Human
cuacucuccccacgagggcug

SEQ ID NO: 3399741 - RNA, 22 nt, Human
cuacucuccccacgagggcugg

SEQ ID NO: 3399742 - RNA, 17 nt, Human
cuacucuccucaucucu

SEQ ID NO: 3399743 - RNA, 13 nt, Human
cuacucugugcca

SEQ ID NO: 3399744 - RNA, 17 nt, Human
cuacucugugccagagc

SEQ ID NO: 3399745 - RNA, 20 nt, Human
cuacucugugccagagccug

SEQ ID NO: 3399746 - RNA, 21 nt, Human
cuacucugugccagagccugg

SEQ ID NO: 3399747 - RNA, 22 nt, Human
cuacucugugccagagccuggg

SEQ ID NO: 3399748 - RNA, 13 nt, Human
cuacucuguguca

SEQ ID NO: 3399749 - RNA, 16 nt, Human
cuacucugugucaggu

SEQ ID NO: 3399750 - RNA, 16 nt, Human
cuacucuuaagccauc

SEQ ID NO: 3399751 - RNA, 13 nt, Human
cuacugaaacaga

SEQ ID NO: 3399752 - RNA, 15 nt, Human
cuacugacauguggg

SEQ ID NO: 3399753 - RNA, 14 nt, Human
cuacugaggugcua

SEQ ID NO: 3399754 - RNA, 14 nt, Human
cuacugccaaccuc

SEQ ID NO: 3399755 - RNA, 23 nt, Human
cuacugccaaccucgcuccaacu

SEQ ID NO: 3399756 - RNA, 14 nt, Human
cuacugccauccug

SEQ ID NO: 3399757 - RNA, 21 nt, Human
cuacugccgucagugcugugc

SEQ ID NO: 3399758 - RNA, 14 nt, Human
cuacuggauucuua

SEQ ID NO: 3399759 - RNA, 16 nt, Human
cuacugggugucauuu

SEQ ID NO: 3399760 - RNA, 18 nt, Human
cuacugggugucauuuca

SEQ ID NO: 3399761 - RNA, 19 nt, Human
cuacugguccucuuaacug

SEQ ID NO: 3399762 - RNA, 13 nt, Human
cuacuggucucuc

SEQ ID NO: 3399763 - RNA, 15 nt, Human
cuacuggucucucua

SEQ ID NO: 3399764 - RNA, 20 nt, Human
cuacuggucucucuaugccu

SEQ ID NO: 3399765 - RNA, 21 nt, Human
cuacuguaaggcaaucauggu

SEQ ID NO: 3399766 - RNA, 16 nt, Human
cuacuguaauuuuaua

SEQ ID NO: 3399767 - RNA, 18 nt, Human
cuacugucaaaugaugug

SEQ ID NO: 3399768 - RNA, 19 nt, Human
cuacuguccuacccacccu

SEQ ID NO: 3399769 - RNA, 20 nt, Human
cuacugucucacugaaacau

SEQ ID NO: 3399770 - RNA, 17 nt, Human
cuacugucuuuggaaaa

SEQ ID NO: 3399771 - RNA, 22 nt, Human
cuacuguggaaaaauauuuaag

SEQ ID NO: 3399772 - RNA, 17 nt, Human
cuacugugugugugaau

SEQ ID NO: 3399773 - RNA, 15 nt, Human
cuacuguguuccugg

SEQ ID NO: 3399774 - RNA, 20 nt, Human
cuacuguguuccuggcaaua

SEQ ID NO: 3399775 - RNA, 23 nt, Human
cuacuguucagcuuuuauuccug

SEQ ID NO: 3399776 - RNA, 14 nt, Human
cuacuguucuaaag

SEQ ID NO: 3399777 - RNA, 22 nt, Human
cuacuguuguaagaauucugau

SEQ ID NO: 3399778 - RNA, 22 nt, Human
cuacuuacaugcauuacugcau

SEQ ID NO: 3399779 - RNA, 20 nt, Human
cuacuuacccaggugggucc

SEQ ID NO: 3399780 - RNA, 20 nt, Human
cuacuuagcauccuaagaaa

SEQ ID NO: 3399781 - RNA, 19 nt, Human
cuacuuaugaaaugugcac

SEQ ID NO: 3399782 - RNA, 20 nt, Human
cuaggcucagagaugugcac

SEQ ID NO: 3399783 - RNA, 13 nt, Human
cuaggcuccuuca

SEQ ID NO: 3399784 - RNA, 18 nt, Human
cuaggcucgccuucccuc

SEQ ID NO: 3399785 - RNA, 20 nt, Human
cuaggcucgccuucccuccu

SEQ ID NO: 3399786 - RNA, 17 nt, Human
cuaggcuggagcccagg

SEQ ID NO: 3399787 - RNA, 20 nt, Human
cuaggcuggagcccagggag

SEQ ID NO: 3399788 - RNA, 11 nt, Human
cuaggcugggg

SEQ ID NO: 3399789 - RNA, 13 nt, Human
cuaggcugggugc

SEQ ID NO: 3399790 - RNA, 21 nt, Human
cuaggcugggugcccacagcc

SEQ ID NO: 3399791 - RNA, 21 nt, Human
cuaggcuucagcauauuuaua

SEQ ID NO: 3399792 - RNA, 16 nt, Human
cuagggaaggccaccu

SEQ ID NO: 3399793 - RNA, 18 nt, Human
cuagggaaggccaccugc

SEQ ID NO: 3399794 - RNA, 18 nt, Human
cuagggaccuggggaagc

SEQ ID NO: 3399795 - RNA, 14 nt, Human
cuagggagccaugu

SEQ ID NO: 3399796 - RNA, 14 nt, Human
cuagggaggaccuu

SEQ ID NO: 3399797 - RNA, 23 nt, Human
cuagggaggaccuuaucugugcg

SEQ ID NO: 3399798 - RNA, 22 nt, Human
cuagggaggcauggucugcccu

SEQ ID NO: 3399799 - RNA, 13 nt, Human
cuagggaucccuc

SEQ ID NO: 3399800 - RNA, 17 nt, Human
cuagggaucccucaucu

SEQ ID NO: 3399801 - RNA, 19 nt, Human
cuagggauguucuggcccu

SEQ ID NO: 3399802 - RNA, 17 nt, Human
cuagggccaagcccagc

SEQ ID NO: 3399803 - RNA, 15 nt, Human
cuagggccacugaag

SEQ ID NO: 3399804 - RNA, 20 nt, Human
cuagggcugggaaacacucc

SEQ ID NO: 3399805 - RNA, 14 nt, Human
cuagggcugggugu

SEQ ID NO: 3399806 - RNA, 19 nt, Human
cuaggggacacuucccucu

SEQ ID NO: 3399807 - RNA, 14 nt, Human
cuagggggaaguga

SEQ ID NO: 3399808 - RNA, 15 nt, Human
cuaggggucacugua

SEQ ID NO: 3399809 - RNA, 18 nt, Human
cuaggggucaggcuccau

SEQ ID NO: 3399810 - RNA, 21 nt, Human
cuaggguacauggugcuggga

SEQ ID NO: 3399811 - RNA, 15 nt, Human
cuaggguccugggga

SEQ ID NO: 3399812 - RNA, 17 nt, Human
cuaggguggcccuugca

SEQ ID NO: 3399813 - RNA, 15 nt, Human
cuagguagaaaaagg

SEQ ID NO: 3399814 - RNA, 17 nt, Human
cuagguagaaaaagggu

SEQ ID NO: 3399815 - RNA, 19 nt, Human
cuagguagcccccucuucc

SEQ ID NO: 3399816 - RNA, 22 nt, Human
cuaggucaaggccugucccugg

SEQ ID NO: 3399817 - RNA, 13 nt, Human
cuaggucuccagu

SEQ ID NO: 3399818 - RNA, 24 nt, Human
cuaggugacagagugagacucugu

SEQ ID NO: 3399819 - RNA, 18 nt, Human
cuaggugcccuuggaggc

SEQ ID NO: 3399820 - RNA, 23 nt, Human
cuagguggcaaggcugugcuccc

SEQ ID NO: 3399821 - RNA, 17 nt, Human
cuaggugggccagcccc

SEQ ID NO: 3399822 - RNA, 14 nt, Human
cuagguguuuuguu

SEQ ID NO: 3399823 - RNA, 20 nt, Human
cuagguucccggucccgagu

SEQ ID NO: 3399824 - RNA, 16 nt, Human
cuagguucccuguucu

SEQ ID NO: 3399825 - RNA, 15 nt, Human
cuagguuuaacucag

SEQ ID NO: 3399826 - RNA, 16 nt, Human
cuagguuuaacucaga

SEQ ID NO: 3399827 - RNA, 13 nt, Human
cuagguuucaaag

SEQ ID NO: 3399828 - RNA, 16 nt, Human
cuaguaaaaauacaaa

SEQ ID NO: 3399829 - RNA, 13 nt, Human
cuaguaagaagac

SEQ ID NO: 3399830 - RNA, 18 nt, Human
cuaguaagugccuuccau

SEQ ID NO: 3399831 - RNA, 12 nt, Human
cuaguaauauau

SEQ ID NO: 3399832 - RNA, 16 nt, Human
cuaguaauuggaaagg

SEQ ID NO: 3399833 - RNA, 12 nt, Human
cuaguacaaauu

SEQ ID NO: 3399834 - RNA, 13 nt, Human
cuaguacacuuuu

SEQ ID NO: 3399835 - RNA, 15 nt, Human
cuaguacacuuuuau

SEQ ID NO: 3399836 - RNA, 15 nt, Human
cuaguacuagaaacu

SEQ ID NO: 3399837 - RNA, 14 nt, Human
cuaguacugugaau

SEQ ID NO: 3399838 - RNA, 20 nt, Human
cuaguagggguaccacugaa

SEQ ID NO: 3399839 - RNA, 16 nt, Human
cuaguaguucucuugg

SEQ ID NO: 3399840 - RNA, 16 nt, Human
cuaguaugaaauuaua

SEQ ID NO: 3399841 - RNA, 15 nt, Human
cuaguauugacaaaa

SEQ ID NO: 3399842 - RNA, 18 nt, Human
cuaguauugacaaaaugu

SEQ ID NO: 3399843 - RNA, 19 nt, Human
cuaguauugacaaaauguu

SEQ ID NO: 3399844 - RNA, 12 nt, Human
cuaguauuugaa

SEQ ID NO: 3399845 - RNA, 21 nt, Human
cuagucaacaguacccugguu

SEQ ID NO: 3399846 - RNA, 15 nt, Human
cuagucaagcuccuc

SEQ ID NO: 3399847 - RNA, 19 nt, Human
cuagucaagcuccuccucc

SEQ ID NO: 3399848 - RNA, 22 nt, Human
cuagucaagcuccuccucccug

SEQ ID NO: 3399849 - RNA, 16 nt, Human
cuagucaaucaagucu

SEQ ID NO: 3399850 - RNA, 20 nt, Human
cuagucaaucaagucuguuu

SEQ ID NO: 3399851 - RNA, 18 nt, Human
cuagucaaugacaugaau

SEQ ID NO: 3399852 - RNA, 20 nt, Human
cuagucaaugacaugaauuu

SEQ ID NO: 3399853 - RNA, 21 nt, Human
cuagucacgcaugcaguguug

SEQ ID NO: 3399854 - RNA, 15 nt, Human
cuagucccuuccccu

SEQ ID NO: 3399855 - RNA, 12 nt, Human
cuaguccuuguu

SEQ ID NO: 3399856 - RNA, 21 nt, Human
cuagucuccuuugcacugagg

SEQ ID NO: 3399857 - RNA, 21 nt, Human
cuagucucuaucauuaaaguu

SEQ ID NO: 3399858 - RNA, 14 nt, Human
cuagucugugugcu

SEQ ID NO: 3399859 - RNA, 13 nt, Human
cuagucuuaagaa

SEQ ID NO: 3399860 - RNA, 13 nt, Human
cuagucuuuugcu

SEQ ID NO: 3399861 - RNA, 14 nt, Human
cuagucuuuugcuu

SEQ ID NO: 3399862 - RNA, 16 nt, Human
cuagucuuuugcuuuu

SEQ ID NO: 3399863 - RNA, 20 nt, Human
cuagugaaacucguuaauuu

SEQ ID NO: 3399864 - RNA, 12 nt, Human
cuagugaaacuu

SEQ ID NO: 3399865 - RNA, 16 nt, Human
cuagugaaacuuuucu

SEQ ID NO: 3399866 - RNA, 19 nt, Human
cuagugaaagaggcagcuu

SEQ ID NO: 3399867 - RNA, 17 nt, Human
cuagugaaggcuucucu

SEQ ID NO: 3399868 - RNA, 21 nt, Human
cuagugaaggcuucucucugu

SEQ ID NO: 3399869 - RNA, 19 nt, Human
cuagugaauguaggcuggc

SEQ ID NO: 3399870 - RNA, 16 nt, Human
cuagugacccacaugc

SEQ ID NO: 3399871 - RNA, 19 nt, Human
cuagugacccacaugccau

SEQ ID NO: 3399872 - RNA, 19 nt, Human
cuagugaccccuucccugu

SEQ ID NO: 3399873 - RNA, 18 nt, Human
cuagugacccggaggcca

SEQ ID NO: 3399874 - RNA, 14 nt, Human
cuagugagcugggc

SEQ ID NO: 3399875 - RNA, 17 nt, Human
cuagugagcugggcaug

SEQ ID NO: 3399876 - RNA, 23 nt, Human
cuagugauuucuggggccccacc

SEQ ID NO: 3399877 - RNA, 13 nt, Human
cuagugcaaauca

SEQ ID NO: 3399878 - RNA, 13 nt, Human
cuagugcagcuga

SEQ ID NO: 3399879 - RNA, 14 nt, Human
cuagugcagcugaa

SEQ ID NO: 3399880 - RNA, 20 nt, Human
cuagugcagcugauuuuaac

SEQ ID NO: 3399881 - RNA, 21 nt, Human
cuagugcagcugauuuuaaca

SEQ ID NO: 3399882 - RNA, 22 nt, Human
cuagugcagcugauuuuaacaa

SEQ ID NO: 3399883 - RNA, 23 nt, Human
cuagugcccuccacagccgcagc

SEQ ID NO: 3399884 - RNA, 12 nt, Human
cuagugcugaag

SEQ ID NO: 3399885 - RNA, 12 nt, Human
cuagugcugcug

SEQ ID NO: 3399886 - RNA, 17 nt, Human
cuagugcugugaaaaaa

SEQ ID NO: 3399887 - RNA, 22 nt, Human
cuagugcugugaaaaaaaaaau

SEQ ID NO: 3399888 - RNA, 21 nt, Human
cuagugcuuuccuuuuuuaaa

SEQ ID NO: 3399889 - RNA, 19 nt, Human
cuaguggcuguccagugcc

SEQ ID NO: 3399890 - RNA, 22 nt, Human
cuagugggacagcccagagccu

SEQ ID NO: 3399891 - RNA, 17 nt, Human
cuagugggguuuccugg

SEQ ID NO: 3399892 - RNA, 18 nt, Human
cuagugggguuuccuggc

SEQ ID NO: 3399893 - RNA, 17 nt, Human
cuaguggucuuuguaag

SEQ ID NO: 3399894 - RNA, 18 nt, Human
cuaguggucuuuguaaga

SEQ ID NO: 3399895 - RNA, 22 nt, Human
cuaguggucuuuguaagagugu

SEQ ID NO: 3399896 - RNA, 21 nt, Human
cuaguguaccuccucucagug

SEQ ID NO: 3399897 - RNA, 23 nt, Human
cuaguguaccuccucucaguguu

SEQ ID NO: 3399898 - RNA, 15 nt, Human
cuaguguaucaaaau

SEQ ID NO: 3399899 - RNA, 21 nt, Human
cuagugugguguuuccuggca

SEQ ID NO: 3399900 - RNA, 15 nt, Human
cuaguguuugauugu

SEQ ID NO: 3399901 - RNA, 16 nt, Human
cuaguuauacuuauuu

SEQ ID NO: 3399902 - RNA, 22 nt, Human
cuaguuauuacccagaguuuuu

SEQ ID NO: 3399903 - RNA, 20 nt, Human
cuaguucagacacuuuggaa

SEQ ID NO: 3399904 - RNA, 22 nt, Human
cuaguucauccaauccucacug

SEQ ID NO: 3399905 - RNA, 17 nt, Human
cuaguucaucccuucuc

SEQ ID NO: 3399906 - RNA, 19 nt, Human
cuaguucaucccuucucuu

SEQ ID NO: 3399907 - RNA, 18 nt, Human
cuaguuccaccaucaagc

SEQ ID NO: 3399908 - RNA, 20 nt, Human
cuaguuccaccaucaagcca

SEQ ID NO: 3399909 - RNA, 16 nt, Human
cuaguuccccuguuua

SEQ ID NO: 3399910 - RNA, 16 nt, Human
cuaguucuaacaguga

SEQ ID NO: 3399911 - RNA, 14 nt, Human
cuaguucuguagaa

SEQ ID NO: 3399912 - RNA, 15 nt, Human
cuaguucuguagaaa

SEQ ID NO: 3399913 - RNA, 16 nt, Human
cuaguucuguagaaau

SEQ ID NO: 3399914 - RNA, 15 nt, Human
cuaguugaauacuug

SEQ ID NO: 3399915 - RNA, 15 nt, Human
cuaguugaggaguuu

SEQ ID NO: 3399916 - RNA, 23 nt, Human
cuaguugaucagcuuauugucua

SEQ ID NO: 3399917 - RNA, 15 nt, Human
cuaguuguuaucaau

SEQ ID NO: 3399918 - RNA, 22 nt, Human
cuaguuguuugauucagacagc

SEQ ID NO: 3399919 - RNA, 17 nt, Human
cuaguuugauuaaauuc

SEQ ID NO: 3399920 - RNA, 20 nt, Human
cuaguuugauuaaauucuug

SEQ ID NO: 3399921 - RNA, 19 nt, Human
cuaguuuucaguuuguaua

SEQ ID NO: 3399922 - RNA, 16 nt, Human
cuaguuuucuccuccc

SEQ ID NO: 3399923 - RNA, 19 nt, Human
cuaguuuucuccucccagg

SEQ ID NO: 3399924 - RNA, 20 nt, Human
cuaguuuucuccucccagga

SEQ ID NO: 3399925 - RNA, 13 nt, Human
cuaguuuuguuua

SEQ ID NO: 3399926 - RNA, 15 nt, Human
cuauaaaacucugca

SEQ ID NO: 3399927 - RNA, 22 nt, Human
cuauuauuuucacuguagaaug

SEQ ID NO: 3399928 - RNA, 18 nt, Human
cuauuauuuuuauaauug

SEQ ID NO: 3399929 - RNA, 19 nt, Human
cuauuauuuuuauaauugu

SEQ ID NO: 3399930 - RNA, 16 nt, Human
cuauucaaacagucuc

SEQ ID NO: 3399931 - RNA, 22 nt, Human
cuauucaagaggaaaugucaca

SEQ ID NO: 3399932 - RNA, 23 nt, Human
cuauucaagaggaaaugucacag

SEQ ID NO: 3399933 - RNA, 11 nt, Human
cuauucacaac

SEQ ID NO: 3399934 - RNA, 17 nt, Human
cuauucacaauuauucc

SEQ ID NO: 3399935 - RNA, 15 nt, Human
cuauucagacaagca

SEQ ID NO: 3399936 - RNA, 14 nt, Human
cuauucaguugugu

SEQ ID NO: 3399937 - RNA, 19 nt, Human
cuauucccacaccuccaca

SEQ ID NO: 3399938 - RNA, 22 nt, Human
cuauucccacaccuccacaguu

SEQ ID NO: 3399939 - RNA, 17 nt, Human
cuauuccccagcagggu

SEQ ID NO: 3399940 - RNA, 14 nt, Human
cuauuccugaacua

SEQ ID NO: 3399941 - RNA, 17 nt, Human
cuauuccugagagcugc

SEQ ID NO: 3399942 - RNA, 16 nt, Human
cuauuccuucuggccu

SEQ ID NO: 3399943 - RNA, 22 nt, Human
cuauuccuuucccuuccucuuc

SEQ ID NO: 3399944 - RNA, 14 nt, Human
cuauucuauugcag

SEQ ID NO: 3399945 - RNA, 19 nt, Human
cuauucucaaaguuuccua

SEQ ID NO: 3399946 - RNA, 21 nt, Human
cuauucucaaaguuuccuaau

SEQ ID NO: 3399947 - RNA, 16 nt, Human
cuauucucaccaggaa

SEQ ID NO: 3399948 - RNA, 15 nt, Human
cuauucuccagcuga

SEQ ID NO: 3399949 - RNA, 19 nt, Human
cuauucucuccucagacug

SEQ ID NO: 3399950 - RNA, 18 nt, Human
cuauucugagaugacuau

SEQ ID NO: 3399951 - RNA, 18 nt, Human
cuauucugccacuccuga

SEQ ID NO: 3399952 - RNA, 12 nt, Human
cuauucuguccc

SEQ ID NO: 3399953 - RNA, 15 nt, Human
cuauucugucccuag

SEQ ID NO: 3399954 - RNA, 16 nt, Human
cuauucugucccuagg

SEQ ID NO: 3399955 - RNA, 20 nt, Human
cuauucugucccuagguguu

SEQ ID NO: 3399956 - RNA, 19 nt, Human
cuauucuguguugcauuau

SEQ ID NO: 3399957 - RNA, 19 nt, Human
cuauucuugauguaaaauc

SEQ ID NO: 3399958 - RNA, 16 nt, Human
cuauugacaagucauu

SEQ ID NO: 3399959 - RNA, 15 nt, Human
cuauugacaauaaaa

SEQ ID NO: 3399960 - RNA, 13 nt, Human
cuauugacuucaa

SEQ ID NO: 3399961 - RNA, 19 nt, Human
cuauugauguacagucugu

SEQ ID NO: 3399962 - RNA, 17 nt, Human
cuauugcauuuauaugu

SEQ ID NO: 3399963 - RNA, 15 nt, Human
cuauugccaaccagu

SEQ ID NO: 3399964 - RNA, 19 nt, Human
cuauugccuucuuugaaga

SEQ ID NO: 3399965 - RNA, 20 nt, Human
cuauugccuucuuugaagaa

SEQ ID NO: 3399966 - RNA, 18 nt, Human
cuauugcuagagcuccuc

SEQ ID NO: 3399967 - RNA, 16 nt, Human
cuauugcugcuugagg

SEQ ID NO: 3399968 - RNA, 16 nt, Human
cuauuggaaaaaccac

SEQ ID NO: 3399969 - RNA, 21 nt, Human
cuauuggaggaucaguuuuuu

SEQ ID NO: 3399970 - RNA, 11 nt, Human
cuauugguaaa

SEQ ID NO: 3399971 - RNA, 12 nt, Human
cuauuguaagau

SEQ ID NO: 3399972 - RNA, 18 nt, Human
cuauuguaagauaaaaaa

SEQ ID NO: 3399973 - RNA, 12 nt, Human
cuauuguacaga

SEQ ID NO: 3399974 - RNA, 14 nt, Human
cuauugucauuaaa

SEQ ID NO: 3399975 - RNA, 14 nt, Human
cuauugugauuuga

SEQ ID NO: 3399976 - RNA, 20 nt, Human
cuauugugauuugacuguuu

SEQ ID NO: 3399977 - RNA, 23 nt, Human
cuauugugauuugacuguuuuua

SEQ ID NO: 3399978 - RNA, 22 nt, Human
cuauugugcaauguaaauauuu

SEQ ID NO: 3399979 - RNA, 20 nt, Human
cuauuuaaacuuauaaauca

SEQ ID NO: 3399980 - RNA, 15 nt, Human
cuauuuaaagccucc

SEQ ID NO: 3399981 - RNA, 10 nt, Human
cuauuuaaga

SEQ ID NO: 3399982 - RNA, 11 nt, Human
cuauuuaagau

SEQ ID NO: 3399983 - RNA, 15 nt, Human
cuauuuagacaugua

SEQ ID NO: 3399984 - RNA, 23 nt, Human
cuauuuagcaugacaagccccag

SEQ ID NO: 3399985 - RNA, 22 nt, Human
cuauuuaguuuuuguaauuuau

SEQ ID NO: 3399986 - RNA, 19 nt, Human
cuauuuaucuguguuuuug

SEQ ID NO: 3399987 - RNA, 22 nt, Human
cuauuuaucuguguuuuugaaa

SEQ ID NO: 3399988 - RNA, 11 nt, Human
cuauuuaugaa

SEQ ID NO: 3399989 - RNA, 14 nt, Human
cuauuuaugccuug

SEQ ID NO: 3399990 - RNA, 21 nt, Human
cuauuuaugccuugaugauuu

SEQ ID NO: 3399991 - RNA, 14 nt, Human
cuauuuauuaauau

SEQ ID NO: 3399992 - RNA, 15 nt, Human
cuauuuauuaauauu

SEQ ID NO: 3399993 - RNA, 20 nt, Human
cuauuuauuaauauuuaaca

SEQ ID NO: 3399994 - RNA, 16 nt, Human
cuauuuauuuacaaau

SEQ ID NO: 3399995 - RNA, 14 nt, Human
cuauuuauuuacug

SEQ ID NO: 3399996 - RNA, 18 nt, Human
cuauuucaacuucaggaa

SEQ ID NO: 3399997 - RNA, 13 nt, Human
cuauuucacugga

SEQ ID NO: 3399998 - RNA, 15 nt, Human
cuauuucacuggagc

SEQ ID NO: 3399999 - RNA, 14 nt, Human
cuauuucaguacuu

SEQ ID NO: 3400000 - RNA, 21 nt, Human
cuauuucaguguuaccugugu

SEQ ID NO: 3400001 - RNA, 15 nt, Human
cuauuucauguuuuu

SEQ ID NO: 3400002 - RNA, 17 nt, Human
cuauuucccaagcugga

SEQ ID NO: 3400003 - RNA, 12 nt, Human
cuauuucuaguu

SEQ ID NO: 3400004 - RNA, 20 nt, Human
cuauuucuauauuuucauuc

SEQ ID NO: 3400005 - RNA, 17 nt, Human
cuauuucucuuucuuua

SEQ ID NO: 3400006 - RNA, 23 nt, Human
cuauuucugagaagguccuuaau

SEQ ID NO: 3400007 - RNA, 13 nt, Human
cuauuucugcuga

SEQ ID NO: 3400008 - RNA, 21 nt, Human
cuauuucugggucuuuugcua

SEQ ID NO: 3400009 - RNA, 16 nt, Human
cuauuucuuaaacacu

SEQ ID NO: 3400010 - RNA, 18 nt, Human
cuauuucuuaaacacuug

SEQ ID NO: 3400011 - RNA, 21 nt, Human
cuauuucuuuauauuuaucca

SEQ ID NO: 3400012 - RNA, 11 nt, Human
cuauuugcaau

SEQ ID NO: 3400013 - RNA, 21 nt, Human
cuauuugcaauuccugcuccu

SEQ ID NO: 3400014 - RNA, 19 nt, Human
cuauuugcuuauuuaauaa

SEQ ID NO: 3400015 - RNA, 21 nt, Human
cuauuuguaaaucugccacaa

SEQ ID NO: 3400016 - RNA, 20 nt, Human
cuauuuuaaaauaaauuagu

SEQ ID NO: 3400017 - RNA, 23 nt, Human
cuauuuuaagacugauuuuaaua

SEQ ID NO: 3400018 - RNA, 18 nt, Human
cuauuuuaauaaacacuc

SEQ ID NO: 3400019 - RNA, 14 nt, Human
cuauuuuacugucu

SEQ ID NO: 3400020 - RNA, 16 nt, Human
cuauuuucagaaucug

SEQ ID NO: 3400021 - RNA, 12 nt, Human
cuauuuucagau

SEQ ID NO: 3400022 - RNA, 16 nt, Human
cuauuuucauuuucug

SEQ ID NO: 3400023 - RNA, 19 nt, Human
cuauuuuccaggcuucugc

SEQ ID NO: 3400024 - RNA, 15 nt, Human
cuauuuucuaaagac

SEQ ID NO: 3400025 - RNA, 14 nt, Human
cuauuuucuacaau

SEQ ID NO: 3400026 - RNA, 13 nt, Human
cuauuuucucuga

SEQ ID NO: 3400027 - RNA, 14 nt, Human
cuauuuugaugcag

SEQ ID NO: 3400028 - RNA, 21 nt, Human
cuauuuugaugcagcauuuga

SEQ ID NO: 3400029 - RNA, 17 nt, Human
cuauuuuggauuguaua

SEQ ID NO: 3400030 - RNA, 12 nt, Human
cuauuuuguaaa

SEQ ID NO: 3400031 - RNA, 12 nt, Human
cuauuuuuacug

SEQ ID NO: 3400032 - RNA, 17 nt, Human
cuauuuuuacugccacu

SEQ ID NO: 3400033 - RNA, 14 nt, Human
cuauuuuuaucuga

SEQ ID NO: 3400034 - RNA, 20 nt, Human
cuauuuuucucuccuguccu

SEQ ID NO: 3400035 - RNA, 20 nt, Human
cuauuuuuggagguuuauua

SEQ ID NO: 3400036 - RNA, 21 nt, Human
cuauuuuuggcagucugaauu

SEQ ID NO: 3400037 - RNA, 15 nt, Human
cuauuuuuguaaacu

SEQ ID NO: 3400038 - RNA, 12 nt, Human
cuauuuuuguag

SEQ ID NO: 3400039 - RNA, 13 nt, Human
cuauuuuuguaga

SEQ ID NO: 3400040 - RNA, 22 nt, Human
cuauuuuugucuuauauauauu

SEQ ID NO: 3400041 - RNA, 21 nt, Human
cuauuuuuuuaaaaucacuaa

SEQ ID NO: 3400042 - RNA, 18 nt, Human
cuauuuuuuuuuuuuugu

SEQ ID NO: 3400043 - RNA, 21 nt, Human
cucaaaaaaaaaaaaaugcac

SEQ ID NO: 3400044 - RNA, 18 nt, Human
cucaaaaaaagaaaaaga

SEQ ID NO: 3400045 - RNA, 17 nt, Human
cucaaaacugcacuguc

SEQ ID NO: 3400046 - RNA, 20 nt, Human
cucaaaacuuaacauauuua

SEQ ID NO: 3400047 - RNA, 12 nt, Human
cucaaaagaacu

SEQ ID NO: 3400048 - RNA, 12 nt, Human
cucaaaagcauu

SEQ ID NO: 3400049 - RNA, 22 nt, Human
cucaaaagcauuuaucauucuu

SEQ ID NO: 3400050 - RNA, 18 nt, Human
cucaaaagcugggcaggu

SEQ ID NO: 3400051 - RNA, 13 nt, Human
cucaaaaugucua

SEQ ID NO: 3400052 - RNA, 11 nt, Human
cucaaaauuau

SEQ ID NO: 3400053 - RNA, 20 nt, Human
cucaaacaaugacaaagcag

SEQ ID NO: 3400054 - RNA, 13 nt, Human
cucaaacaauuga

SEQ ID NO: 3400055 - RNA, 18 nt, Human
cucaaaccaaaucacuga

SEQ ID NO: 3400056 - RNA, 18 nt, Human
cucaaaccuguuuaaaua

SEQ ID NO: 3400057 - RNA, 21 nt, Human
cucaaaccuguuuaaauauuu

SEQ ID NO: 3400058 - RNA, 12 nt, Human
cucaaacuauga

SEQ ID NO: 3400059 - RNA, 14 nt, Human
cucaaacuccugac

SEQ ID NO: 3400060 - RNA, 19 nt, Human
cucaaacugaggaauuuca

SEQ ID NO: 3400061 - RNA, 16 nt, Human
cucaaacuucuggcuc

SEQ ID NO: 3400062 - RNA, 12 nt, Human
cucaaagcaaaa

SEQ ID NO: 3400063 - RNA, 15 nt, Human
cucaaagcaaaagug

SEQ ID NO: 3400064 - RNA, 22 nt, Human
cucaaagcacuguugagaagga

SEQ ID NO: 3400065 - RNA, 22 nt, Human
cucaaaggccagguugcuaaga

SEQ ID NO: 3400066 - RNA, 18 nt, Human
cucaaagguuuggaagga

SEQ ID NO: 3400067 - RNA, 17 nt, Human
cucaaaguuaaccuacc

SEQ ID NO: 3400068 - RNA, 21 nt, Human
cucaaaguuugacaggaaccu

SEQ ID NO: 3400069 - RNA, 15 nt, Human
cucaaaguuuugaaa

SEQ ID NO: 3400070 - RNA, 21 nt, Human
cucaaauaauauuuuuuuccu

SEQ ID NO: 3400071 - RNA, 18 nt, Human
cucaaauacacauuugcu

SEQ ID NO: 3400072 - RNA, 20 nt, Human
cucaaauaggcuauuaaaaa

SEQ ID NO: 3400073 - RNA, 18 nt, Human
cucccgaguagcugggac

SEQ ID NO: 3400074 - RNA, 20 nt, Human
cucccgaguagcugggacua

SEQ ID NO: 3400075 - RNA, 22 nt, Human
cucccgaguagcugggauuaca

SEQ ID NO: 3400076 - RNA, 21 nt, Human
cucccgccagacuguuagaaa

SEQ ID NO: 3400077 - RNA, 16 nt, Human
cucccgccuccaaccc

SEQ ID NO: 3400078 - RNA, 19 nt, Human
cucccggagguuggguggg

SEQ ID NO: 3400079 - RNA, 15 nt, Human
cucccggcccugccu

SEQ ID NO: 3400080 - RNA, 12 nt, Human
cucccggcgugg

SEQ ID NO: 3400081 - RNA, 21 nt, Human
cucccgggacucacuggcagc

SEQ ID NO: 3400082 - RNA, 15 nt, Human
cucccgggacucugc

SEQ ID NO: 3400083 - RNA, 15 nt, Human
cucccgggcccuccc

SEQ ID NO: 3400084 - RNA, 20 nt, Human
cucccgggcccucccuugga

SEQ ID NO: 3400085 - RNA, 21 nt, Human
cucccgucagggcccaagucc

SEQ ID NO: 3400086 - RNA, 21 nt, Human
cucccguguaucuggacacug

SEQ ID NO: 3400087 - RNA, 13 nt, Human
cucccuacccuaa

SEQ ID NO: 3400088 - RNA, 11 nt, Human
cucccuaccuc

SEQ ID NO: 3400089 - RNA, 18 nt, Human
cucccuaccucaaccugu

SEQ ID NO: 3400090 - RNA, 22 nt, Human
cucccuaccucaaccuguaaau

SEQ ID NO: 3400091 - RNA, 21 nt, Human
cucccuagccagcacuuguau

SEQ ID NO: 3400092 - RNA, 17 nt, Human
cucccuauuuuuuuucu

SEQ ID NO: 3400093 - RNA, 20 nt, Human
cucccuauuuuuuuucuguu

SEQ ID NO: 3400094 - RNA, 17 nt, Human
cucccucaauucccccu

SEQ ID NO: 3400095 - RNA, 19 nt, Human
cucccucacccccuccuuc

SEQ ID NO: 3400096 - RNA, 15 nt, Human
cucccucacccugag

SEQ ID NO: 3400097 - RNA, 18 nt, Human
cucccucacccugagccc

SEQ ID NO: 3400098 - RNA, 15 nt, Human
cucccucacucucag

SEQ ID NO: 3400099 - RNA, 12 nt, Human
cucccucagccc

SEQ ID NO: 3400100 - RNA, 13 nt, Human
cucccucagcccc

SEQ ID NO: 3400101 - RNA, 16 nt, Human
cucccucagccccucu

SEQ ID NO: 3400102 - RNA, 18 nt, Human
cucccucagccccucuug

SEQ ID NO: 3400103 - RNA, 14 nt, Human
cucccucagugccc

SEQ ID NO: 3400104 - RNA, 23 nt, Human
cucccucaucaaggacacgggcc

SEQ ID NO: 3400105 - RNA, 22 nt, Human
cucccucauuucaggagcagcc

SEQ ID NO: 3400106 - RNA, 15 nt, Human
cucccuccaccccag

SEQ ID NO: 3400107 - RNA, 18 nt, Human
cucccuccaccccaggac

SEQ ID NO: 3400108 - RNA, 19 nt, Human
cucccuccaccccaggacg

SEQ ID NO: 3400109 - RNA, 14 nt, Human
cucccuccagcaca

SEQ ID NO: 3400110 - RNA, 15 nt, Human
cucccuccagcacaa

SEQ ID NO: 3400111 - RNA, 12 nt, Human
cucccucccaca

SEQ ID NO: 3400112 - RNA, 11 nt, Human
cucccucccag

SEQ ID NO: 3400113 - RNA, 14 nt, Human
cucccucccaggac

SEQ ID NO: 3400114 - RNA, 18 nt, Human
cucccuccccugcccugg

SEQ ID NO: 3400115 - RNA, 23 nt, Human
cucccuccccugcccugguccag

SEQ ID NO: 3400116 - RNA, 17 nt, Human
cucccuccccuugccug

SEQ ID NO: 3400117 - RNA, 15 nt, Human
cucccuccgccccca

SEQ ID NO: 3400118 - RNA, 17 nt, Human
cucccuccggcuugacc

SEQ ID NO: 3400119 - RNA, 20 nt, Human
cucccuccgggucuuccuac

SEQ ID NO: 3400120 - RNA, 19 nt, Human
cucccuccuaaccuagaga

SEQ ID NO: 3400121 - RNA, 19 nt, Human
cucccuccucaccucugga

SEQ ID NO: 3400122 - RNA, 14 nt, Human
cucccuccuccagg

SEQ ID NO: 3400123 - RNA, 15 nt, Human
cucccuccuccaggc

SEQ ID NO: 3400124 - RNA, 13 nt, Human
cucccuccucugc

SEQ ID NO: 3400125 - RNA, 20 nt, Human
cucccucgaacccacacugc

SEQ ID NO: 3400126 - RNA, 20 nt, Human
cucccucuacugggagccua

SEQ ID NO: 3400127 - RNA, 20 nt, Human
cucccucuaggcucugccuu

SEQ ID NO: 3400128 - RNA, 14 nt, Human
cucccucuauuuau

SEQ ID NO: 3400129 - RNA, 16 nt, Human
cucccucucacugucu

SEQ ID NO: 3400130 - RNA, 11 nt, Human
cucccucuccg

SEQ ID NO: 3400131 - RNA, 20 nt, Human
cucccucucucuucugcucc

SEQ ID NO: 3400132 - RNA, 17 nt, Human
cucccucugaccugcag

SEQ ID NO: 3400133 - RNA, 17 nt, Human
cucccucugaggcugua

SEQ ID NO: 3400134 - RNA, 14 nt, Human
cucccucuggcccu

SEQ ID NO: 3400135 - RNA, 17 nt, Human
cucccucuggcccugcc

SEQ ID NO: 3400136 - RNA, 19 nt, Human
cucccucuggcccugccuu

SEQ ID NO: 3400137 - RNA, 20 nt, Human
cucccucuggcccugccuuc

SEQ ID NO: 3400138 - RNA, 14 nt, Human
cucccucugguccc

SEQ ID NO: 3400139 - RNA, 20 nt, Human
cucccucuucucaagugccu

SEQ ID NO: 3400140 - RNA, 13 nt, Human
cucccucuucuuu

SEQ ID NO: 3400141 - RNA, 11 nt, Human
cucccucuugu

SEQ ID NO: 3400142 - RNA, 21 nt, Human
cucccugaaaauguuuuucug

SEQ ID NO: 3400143 - RNA, 13 nt, Human
cucccugaagcca

SEQ ID NO: 3400144 - RNA, 18 nt, Human
cucccugaagccagccuu

SEQ ID NO: 3400145 - RNA, 12 nt, Human
cucccugacccu

SEQ ID NO: 3400146 - RNA, 16 nt, Human
cucccugacuuuucug

SEQ ID NO: 3400147 - RNA, 15 nt, Human
cucccugauguacag

SEQ ID NO: 3400148 - RNA, 19 nt, Human
cucccugcacaagccaggg

SEQ ID NO: 3400149 - RNA, 16 nt, Human
cucccugcagaugcca

SEQ ID NO: 3400150 - RNA, 22 nt, Human
cucccugcaucugaccagcagc

SEQ ID NO: 3400151 - RNA, 14 nt, Human
cucccugcauggca

SEQ ID NO: 3400152 - RNA, 22 nt, Human
cucccugcauggcauccuccag

SEQ ID NO: 3400153 - RNA, 13 nt, Human
cucccugccagag

SEQ ID NO: 3400154 - RNA, 14 nt, Human
cucccugcccaggc

SEQ ID NO: 3400155 - RNA, 15 nt, Human
cucccugccccaaau

SEQ ID NO: 3400156 - RNA, 13 nt, Human
cucccugccccuc

SEQ ID NO: 3400157 - RNA, 21 nt, Human
cucccugccccucccuucaac

SEQ ID NO: 3400158 - RNA, 15 nt, Human
cucccugccuccagg

SEQ ID NO: 3400159 - RNA, 12 nt, Human
cucccugccugg

SEQ ID NO: 3400160 - RNA, 13 nt, Human
cucccugccuggc

SEQ ID NO: 3400161 - RNA, 18 nt, Human
cucccugcuguccccucu

SEQ ID NO: 3400162 - RNA, 11 nt, Human
cucccuggagu

SEQ ID NO: 3400163 - RNA, 12 nt, Human
cucccuggagug

SEQ ID NO: 3400164 - RNA, 16 nt, Human
cucccuggccuguucu

SEQ ID NO: 3400165 - RNA, 12 nt, Human
cucccuggcucc

SEQ ID NO: 3400166 - RNA, 15 nt, Human
cucccuggcucccau

SEQ ID NO: 3400167 - RNA, 15 nt, Human
cucccuggcucucag

SEQ ID NO: 3400168 - RNA, 18 nt, Human
cucccuggcucucagaag

SEQ ID NO: 3400169 - RNA, 15 nt, Human
cucccuggcugcccu

SEQ ID NO: 3400170 - RNA, 15 nt, Human
cucccuggcuucugu

SEQ ID NO: 3400171 - RNA, 18 nt, Human
cucccuggcuucuguggg

SEQ ID NO: 3400172 - RNA, 12 nt, Human
cucccuggugcu

SEQ ID NO: 3400173 - RNA, 13 nt, Human
cucccuggugcuu

SEQ ID NO: 3400174 - RNA, 18 nt, Human
cucccugguucugaugau

SEQ ID NO: 3400175 - RNA, 18 nt, Human
cucccuguacaguguuac

SEQ ID NO: 3400176 - RNA, 15 nt, Human
cucccuguccuccuc

SEQ ID NO: 3400177 - RNA, 13 nt, Human
cucccugugcccc

SEQ ID NO: 3400178 - RNA, 13 nt, Human
cucccugugucca

SEQ ID NO: 3400179 - RNA, 21 nt, Human
cucccuguguccaccuguggg

SEQ ID NO: 3400180 - RNA, 16 nt, Human
cucccuguuccccaga

SEQ ID NO: 3400181 - RNA, 17 nt, Human
cucccuguuccccagag

SEQ ID NO: 3400182 - RNA, 17 nt, Human
cucccuguucuugggua

SEQ ID NO: 3400183 - RNA, 17 nt, Human
cucccuuagcucccugu

SEQ ID NO: 3400184 - RNA, 19 nt, Human
cucccuucaaccauucccc

SEQ ID NO: 3400185 - RNA, 16 nt, Human
cucccuucagccccca

SEQ ID NO: 3400186 - RNA, 15 nt, Human
cucccuucccaccuc

SEQ ID NO: 3400187 - RNA, 17 nt, Human
cucccuucccauaagcu

SEQ ID NO: 3400188 - RNA, 14 nt, Human
cucccuucccuccu

SEQ ID NO: 3400189 - RNA, 19 nt, Human
cucccuuccgacccucugg

SEQ ID NO: 3400190 - RNA, 20 nt, Human
cucccuuccgacccucuggg

SEQ ID NO: 3400191 - RNA, 10 nt, Human
cucccuuccu

SEQ ID NO: 3400192 - RNA, 14 nt, Human
cucccuuccuccca

SEQ ID NO: 3400193 - RNA, 17 nt, Human
cucccuucgguggaaga

SEQ ID NO: 3400194 - RNA, 14 nt, Human
cucccuucucccug

SEQ ID NO: 3400195 - RNA, 17 nt, Human
cucccuucucccuggau

SEQ ID NO: 3400196 - RNA, 21 nt, Human
cucccuucucuacacucuugu

SEQ ID NO: 3400197 - RNA, 14 nt, Human
cucccuucugcuac

SEQ ID NO: 3400198 - RNA, 21 nt, Human
cucccuugccuuucgaggccu

SEQ ID NO: 3400199 - RNA, 14 nt, Human
cucccuugcuggcc

SEQ ID NO: 3400200 - RNA, 17 nt, Human
cucccuugcuggcccca

SEQ ID NO: 3400201 - RNA, 18 nt, Human
cucccuugcuggccccag

SEQ ID NO: 3400202 - RNA, 19 nt, Human
cucccuuggaaaccugccc

SEQ ID NO: 3400203 - RNA, 21 nt, Human
cucccuuggaaaccugcccug

SEQ ID NO: 3400204 - RNA, 16 nt, Human
cucccuugggcucuga

SEQ ID NO: 3400205 - RNA, 20 nt, Human
cucccuugggcucugaugaa

SEQ ID NO: 3400206 - RNA, 21 nt, Human
cucccuugguggcaagagccc

SEQ ID NO: 3400207 - RNA, 13 nt, Human
cucccuuucaaca

SEQ ID NO: 3400208 - RNA, 15 nt, Human
cucccuuucacuaaa

SEQ ID NO: 3400209 - RNA, 15 nt, Human
cucccuuucccuucu

SEQ ID NO: 3400210 - RNA, 19 nt, Human
cucccuuucuaucguucuc

SEQ ID NO: 3400211 - RNA, 14 nt, Human
cucccuuucucccc

SEQ ID NO: 3400212 - RNA, 17 nt, Human
cucccuuucuucccuac

SEQ ID NO: 3400213 - RNA, 14 nt, Human
cucccuuugaaaug

SEQ ID NO: 3400214 - RNA, 16 nt, Human
cuccgagagggagaga

SEQ ID NO: 3400215 - RNA, 17 nt, Human
cuccgagaggugggcca

SEQ ID NO: 3400216 - RNA, 19 nt, Human
cuccgagugaacuggucuu

SEQ ID NO: 3400217 - RNA, 22 nt, Human
cuccgcaggacuuccccggagg

SEQ ID NO: 3400218 - RNA, 14 nt, Human
cuccgccagccucc

SEQ ID NO: 3400219 - RNA, 15 nt, Human
cuccgccagccuccu

SEQ ID NO: 3400220 - RNA, 21 nt, Human
cuccucgagggcagggacuuu

SEQ ID NO: 3400221 - RNA, 19 nt, Human
cuccucggaaccgcucacc

SEQ ID NO: 3400222 - RNA, 20 nt, Human
cuccucggcccccuccaucg

SEQ ID NO: 3400223 - RNA, 15 nt, Human
cuccucggcuggcug

SEQ ID NO: 3400224 - RNA, 20 nt, Human
cuccucgugaaagugcauuu

SEQ ID NO: 3400225 - RNA, 19 nt, Human
cuccucguuccuuucuccu

SEQ ID NO: 3400226 - RNA, 18 nt, Human
cuccucuagcuguggggg

SEQ ID NO: 3400227 - RNA, 17 nt, Human
cuccucuauccugggcu

SEQ ID NO: 3400228 - RNA, 14 nt, Human
cuccucucacuccc

SEQ ID NO: 3400229 - RNA, 22 nt, Human
cuccucucacuccccagccugg

SEQ ID NO: 3400230 - RNA, 13 nt, Human
cuccucucagccc

SEQ ID NO: 3400231 - RNA, 15 nt, Human
cuccucucaguguuu

SEQ ID NO: 3400232 - RNA, 13 nt, Human
cuccucuccacca

SEQ ID NO: 3400233 - RNA, 13 nt, Human
cuccucuccaggc

SEQ ID NO: 3400234 - RNA, 15 nt, Human
cuccucuccaggcac

SEQ ID NO: 3400235 - RNA, 23 nt, Human
cuccucucccaucccccugcccu

SEQ ID NO: 3400236 - RNA, 21 nt, Human
cuccucucccauugucccucu

SEQ ID NO: 3400237 - RNA, 13 nt, Human
cuccucuccccag

SEQ ID NO: 3400238 - RNA, 22 nt, Human
cuccucuccccagcaagugaga

SEQ ID NO: 3400239 - RNA, 15 nt, Human
cuccucuccccagcc

SEQ ID NO: 3400240 - RNA, 19 nt, Human
cuccucuccccagcccaga

SEQ ID NO: 3400241 - RNA, 21 nt, Human
cuccucuccccagcccagaga

SEQ ID NO: 3400242 - RNA, 14 nt, Human
cuccucuccccucu

SEQ ID NO: 3400243 - RNA, 15 nt, Human
cuccucuccccucua

SEQ ID NO: 3400244 - RNA, 21 nt, Human
cuccucuccugacaauacugu

SEQ ID NO: 3400245 - RNA, 13 nt, Human
cuccucuccugga

SEQ ID NO: 3400246 - RNA, 15 nt, Human
cuccucuccuggagg

SEQ ID NO: 3400247 - RNA, 18 nt, Human
cuccucucuaaccuccuu

SEQ ID NO: 3400248 - RNA, 13 nt, Human
cuccucugaaaca

SEQ ID NO: 3400249 - RNA, 15 nt, Human
cuccucugaaacagc

SEQ ID NO: 3400250 - RNA, 22 nt, Human
cuccucugaaacagcugccuua

SEQ ID NO: 3400251 - RNA, 13 nt, Human
cuccucugacuca

SEQ ID NO: 3400252 - RNA, 11 nt, Human
cuccucugcca

SEQ ID NO: 3400253 - RNA, 24 nt, Human
cuccucugcccgggagcucaggaa

SEQ ID NO: 3400254 - RNA, 12 nt, Human
cuccucugcuga

SEQ ID NO: 3400255 - RNA, 20 nt, Human
cuccucugcugaccugcuga

SEQ ID NO: 3400256 - RNA, 21 nt, Human
cuccucugcugaccugcugac

SEQ ID NO: 3400257 - RNA, 13 nt, Human
cuccucugcugcu

SEQ ID NO: 3400258 - RNA, 12 nt, Human
cuccucugcuug

SEQ ID NO: 3400259 - RNA, 20 nt, Human
cuccucugcuugccaucccu

SEQ ID NO: 3400260 - RNA, 22 nt, Human
cuccucugcuugccaucccucc

SEQ ID NO: 3400261 - RNA, 21 nt, Human
cuccucuggacggcaggcuca

SEQ ID NO: 3400262 - RNA, 18 nt, Human
cuccucuguccagggccc

SEQ ID NO: 3400263 - RNA, 13 nt, Human
cuccucugucccu

SEQ ID NO: 3400264 - RNA, 16 nt, Human
cuccucugucugcccu

SEQ ID NO: 3400265 - RNA, 23 nt, Human
cuccucugugaccaaugucuuga

SEQ ID NO: 3400266 - RNA, 18 nt, Human
cuccucuguggugucugc

SEQ ID NO: 3400267 - RNA, 19 nt, Human
cuccucuguggugucugcc

SEQ ID NO: 3400268 - RNA, 20 nt, Human
cuccucuucaccccggcagg

SEQ ID NO: 3400269 - RNA, 22 nt, Human
cuccucuucaccccggcaggcc

SEQ ID NO: 3400270 - RNA, 13 nt, Human
cuccucuucccca

SEQ ID NO: 3400271 - RNA, 19 nt, Human
cuccucuucccccuuccaa

SEQ ID NO: 3400272 - RNA, 14 nt, Human
cuccucuuguaaau

SEQ ID NO: 3400273 - RNA, 21 nt, Human
cuccucuuguaaauaaagccc

SEQ ID NO: 3400274 - RNA, 19 nt, Human
cuccucuuuaaaacaaaac

SEQ ID NO: 3400275 - RNA, 15 nt, Human
cuccucuuuccucuc

SEQ ID NO: 3400276 - RNA, 12 nt, Human
cuccucuuucuc

SEQ ID NO: 3400277 - RNA, 14 nt, Human
cuccucuuucucuc

SEQ ID NO: 3400278 - RNA, 15 nt, Human
cuccucuuucucucc

SEQ ID NO: 3400279 - RNA, 20 nt, Human
cuccucuuuguuuuguuuua

SEQ ID NO: 3400280 - RNA, 22 nt, Human
cuccugaaaagguuuaugaaaa

SEQ ID NO: 3400281 - RNA, 18 nt, Human
cuccugaaccgcacagcu

SEQ ID NO: 3400282 - RNA, 17 nt, Human
cuccugacacccuucuc

SEQ ID NO: 3400283 - RNA, 22 nt, Human
cuccugacacccuucucccacu

SEQ ID NO: 3400284 - RNA, 18 nt, Human
cuccugacagaaggugcc

SEQ ID NO: 3400285 - RNA, 12 nt, Human
cuccugaccagu

SEQ ID NO: 3400286 - RNA, 16 nt, Human
cuccugacccaguccc

SEQ ID NO: 3400287 - RNA, 23 nt, Human
cuccugacccaguccccgugccc

SEQ ID NO: 3400288 - RNA, 16 nt, Human
cuccugaccucaggca

SEQ ID NO: 3400289 - RNA, 16 nt, Human
cuccugaccugucacc

SEQ ID NO: 3400290 - RNA, 15 nt, Human
cuccugacuguaaca

SEQ ID NO: 3400291 - RNA, 20 nt, Human
cuccugagaaaaaagguucc

SEQ ID NO: 3400292 - RNA, 16 nt, Human
cuccugagaaauguua

SEQ ID NO: 3400293 - RNA, 23 nt, Human
cuccugagaccccuggccuccgg

SEQ ID NO: 3400294 - RNA, 11 nt, Human
cuccugagccc

SEQ ID NO: 3400295 - RNA, 14 nt, Human
cuccugagccccca

SEQ ID NO: 3400296 - RNA, 18 nt, Human
cuccugaggacagcuguc

SEQ ID NO: 3400297 - RNA, 19 nt, Human
cuccugaggauguguccca

SEQ ID NO: 3400298 - RNA, 20 nt, Human
cuccugaggggcaucugccc

SEQ ID NO: 3400299 - RNA, 21 nt, Human
cuccugaggggcaucugcccc

SEQ ID NO: 3400300 - RNA, 22 nt, Human
cuccugaggggcaucugccccu

SEQ ID NO: 3400301 - RNA, 16 nt, Human
cuccugagugcuugcu

SEQ ID NO: 3400302 - RNA, 17 nt, Human
cuccugcacuuacuugc

SEQ ID NO: 3400303 - RNA, 18 nt, Human
cuccugcacuuacuugcu

SEQ ID NO: 3400304 - RNA, 14 nt, Human
cuccugcagaccac

SEQ ID NO: 3400305 - RNA, 19 nt, Human
cuccugcagcauggucccu

SEQ ID NO: 3400306 - RNA, 11 nt, Human
cuccugcaggc

SEQ ID NO: 3400307 - RNA, 15 nt, Human
cuccugcaggcagcc

SEQ ID NO: 3400308 - RNA, 17 nt, Human
cuccugcaggcagccag

SEQ ID NO: 3400309 - RNA, 14 nt, Human
cuccugccaaggag

SEQ ID NO: 3400310 - RNA, 13 nt, Human
cuccugccacauu

SEQ ID NO: 3400311 - RNA, 11 nt, Human
cuccugccacc

SEQ ID NO: 3400312 - RNA, 21 nt, Human
cuccugccaccacgcccggcu

SEQ ID NO: 3400313 - RNA, 18 nt, Human
cuccugccaguguggaac

SEQ ID NO: 3400314 - RNA, 12 nt, Human
cuccugcccagg

SEQ ID NO: 3400315 - RNA, 16 nt, Human
cuccugcccaggagag

SEQ ID NO: 3400316 - RNA, 17 nt, Human
cuccugcccaggagagc

SEQ ID NO: 3400317 - RNA, 22 nt, Human
cuccugcccaggagagccagcc

SEQ ID NO: 3400318 - RNA, 13 nt, Human
cuccugcccaguc

SEQ ID NO: 3400319 - RNA, 17 nt, Human
cuccugcccccacaccu

SEQ ID NO: 3400320 - RNA, 20 nt, Human
cuccugcccccacaccuggc

SEQ ID NO: 3400321 - RNA, 21 nt, Human
cuccugcccgcagaccucugg

SEQ ID NO: 3400322 - RNA, 19 nt, Human
cuccugcccgccacacaga

SEQ ID NO: 3400323 - RNA, 12 nt, Human
cuccugcccugu

SEQ ID NO: 3400324 - RNA, 13 nt, Human
cuccugcccuguu

SEQ ID NO: 3400325 - RNA, 15 nt, Human
cuccugccgacuccu

SEQ ID NO: 3400326 - RNA, 23 nt, Human
cuccugccuagcugccuagcaag

SEQ ID NO: 3400327 - RNA, 12 nt, Human
cuccugccucag

SEQ ID NO: 3400328 - RNA, 14 nt, Human
cuccugccucagcc

SEQ ID NO: 3400329 - RNA, 21 nt, Human
cuccugccucgaacuggcugc

SEQ ID NO: 3400330 - RNA, 17 nt, Human
cuccugccugccccucu

SEQ ID NO: 3400331 - RNA, 18 nt, Human
cuccugccugugcuguga

SEQ ID NO: 3400332 - RNA, 16 nt, Human
cuccugccuuccuccu

SEQ ID NO: 3400333 - RNA, 14 nt, Human
cuccugccuugaaa

SEQ ID NO: 3400334 - RNA, 12 nt, Human
cuccugccuuug

SEQ ID NO: 3400335 - RNA, 16 nt, Human
cuccugccuuugccuc

SEQ ID NO: 3400336 - RNA, 17 nt, Human
cuccugcgcgcaugugc

SEQ ID NO: 3400337 - RNA, 18 nt, Human
cuccugcuacucuguucc

SEQ ID NO: 3400338 - RNA, 15 nt, Human
cuccugcucugcucg

SEQ ID NO: 3400339 - RNA, 21 nt, Human
cuccugcugcaccaacccagc

SEQ ID NO: 3400340 - RNA, 18 nt, Human
cuccuggacauuuuuuca

SEQ ID NO: 3400341 - RNA, 15 nt, Human
cuccuggaguugcau

SEQ ID NO: 3400342 - RNA, 14 nt, Human
cuccuggcccagcc

SEQ ID NO: 3400343 - RNA, 14 nt, Human
cuccuggcuuccca

SEQ ID NO: 3400344 - RNA, 17 nt, Human
cuccugggaucugcucg

SEQ ID NO: 3400345 - RNA, 15 nt, Human
cuccugggcagcugc

SEQ ID NO: 3400346 - RNA, 16 nt, Human
cuccugggcagcugcc

SEQ ID NO: 3400347 - RNA, 22 nt, Human
cuccugggccccucccuaccuc

SEQ ID NO: 3400348 - RNA, 12 nt, Human
cuccugggcccu

SEQ ID NO: 3400349 - RNA, 14 nt, Human
cuccugggcucaag

SEQ ID NO: 3400350 - RNA, 15 nt, Human
cuccugggcucaagc

SEQ ID NO: 3400351 - RNA, 14 nt, Human
cuccuggggccagg

SEQ ID NO: 3400352 - RNA, 15 nt, Human
cuccuggggccaggc

SEQ ID NO: 3400353 - RNA, 13 nt, Human
cuccuggggcgcg

SEQ ID NO: 3400354 - RNA, 22 nt, Human
cuccuggggcgcgugaggcccg

SEQ ID NO: 3400355 - RNA, 23 nt, Human
cuccuggggcgcgugaggcccgu

SEQ ID NO: 3400356 - RNA, 16 nt, Human
cuccuggggcguccag

SEQ ID NO: 3400357 - RNA, 14 nt, Human
cuccuggggguucu

SEQ ID NO: 3400358 - RNA, 22 nt, Human
cuccuggggguucuuucuuccu

SEQ ID NO: 3400359 - RNA, 15 nt, Human
cuccuggguugagcu

SEQ ID NO: 3400360 - RNA, 21 nt, Human
cuccuggguuuuguauucucu

SEQ ID NO: 3400361 - RNA, 22 nt, Human
cuccugguauggguuucuccca

SEQ ID NO: 3400362 - RNA, 17 nt, Human
cuccuggucaccuagga

SEQ ID NO: 3400363 - RNA, 20 nt, Human
cuccuggugucaccccagag

SEQ ID NO: 3400364 - RNA, 14 nt, Human
cuccuguccccugc

SEQ ID NO: 3400365 - RNA, 15 nt, Human
cuccuguccccugcu

SEQ ID NO: 3400366 - RNA, 16 nt, Human
cucuacagaggccaug

SEQ ID NO: 3400367 - RNA, 21 nt, Human
cucuacagcuaaucagcauuc

SEQ ID NO: 3400368 - RNA, 20 nt, Human
cucuaccagugcaggcuggc

SEQ ID NO: 3400369 - RNA, 17 nt, Human
cucuacccaaacccuag

SEQ ID NO: 3400370 - RNA, 18 nt, Human
cucuacccaaacccuagg

SEQ ID NO: 3400371 - RNA, 14 nt, Human
cucuacccagccca

SEQ ID NO: 3400372 - RNA, 14 nt, Human
cucuacccagggcc

SEQ ID NO: 3400373 - RNA, 18 nt, Human
cucuacccagggccugca

SEQ ID NO: 3400374 - RNA, 16 nt, Human
cucuacccauauuaca

SEQ ID NO: 3400375 - RNA, 17 nt, Human
cucuacccucccacccc

SEQ ID NO: 3400376 - RNA, 22 nt, Human
cucuacccucccacccccuucu

SEQ ID NO: 3400377 - RNA, 22 nt, Human
cucuaccugacacucccuuggg

SEQ ID NO: 3400378 - RNA, 16 nt, Human
cucuacuaaaaaugca

SEQ ID NO: 3400379 - RNA, 21 nt, Human
cucuacuaacaaucagcuccu

SEQ ID NO: 3400380 - RNA, 16 nt, Human
cucuacuccuaccuca

SEQ ID NO: 3400381 - RNA, 12 nt, Human
cucuacucugcu

SEQ ID NO: 3400382 - RNA, 13 nt, Human
cucuacucugcuu

SEQ ID NO: 3400383 - RNA, 20 nt, Human
cucuacugaaugucauugaa

SEQ ID NO: 3400384 - RNA, 18 nt, Human
cucuacugggagccuacc

SEQ ID NO: 3400385 - RNA, 13 nt, Human
cucuacuguguaa

SEQ ID NO: 3400386 - RNA, 18 nt, Human
cucuacuuaauccaaugg

SEQ ID NO: 3400387 - RNA, 17 nt, Human
cucuacuuagcaugucc

SEQ ID NO: 3400388 - RNA, 19 nt, Human
cucuacuuagcaugucccu

SEQ ID NO: 3400389 - RNA, 17 nt, Human
cucuacuuuccaggcua

SEQ ID NO: 3400390 - RNA, 22 nt, Human
cucuagaaaggggauuacaguu

SEQ ID NO: 3400391 - RNA, 12 nt, Human
cucuagaaauuu

SEQ ID NO: 3400392 - RNA, 18 nt, Human
cucuagaagccaagggaa

SEQ ID NO: 3400393 - RNA, 21 nt, Human
cucuagagaaauaagaucuuu

SEQ ID NO: 3400394 - RNA, 18 nt, Human
cucuagagaaguggacug

SEQ ID NO: 3400395 - RNA, 15 nt, Human
cucuagaguccaagg

SEQ ID NO: 3400396 - RNA, 23 nt, Human
cucuagaugagcugggccggagg

SEQ ID NO: 3400397 - RNA, 17 nt, Human
cucuagauuuuguuuug

SEQ ID NO: 3400398 - RNA, 19 nt, Human
cucuagauuuuguuuugcu

SEQ ID NO: 3400399 - RNA, 14 nt, Human
cucuagccugggca

SEQ ID NO: 3400400 - RNA, 12 nt, Human
cucuagcugaau

SEQ ID NO: 3400401 - RNA, 20 nt, Human
cucuagcugggggugggcca

SEQ ID NO: 3400402 - RNA, 17 nt, Human
cucuaggccucuccagu

SEQ ID NO: 3400403 - RNA, 12 nt, Human
cucuaggcucug

SEQ ID NO: 3400404 - RNA, 15 nt, Human
cucuaggcucugccu

SEQ ID NO: 3400405 - RNA, 14 nt, Human
cucuaggcugggga

SEQ ID NO: 3400406 - RNA, 23 nt, Human
cucuagggaaggccaccugcagg

SEQ ID NO: 3400407 - RNA, 14 nt, Human
cucuagggaccccu

SEQ ID NO: 3400408 - RNA, 18 nt, Human
cucuagggaccccuccuc

SEQ ID NO: 3400409 - RNA, 20 nt, Human
cucuagggaccccuccuccc

SEQ ID NO: 3400410 - RNA, 21 nt, Human
cucuaggguacauggugcugg

SEQ ID NO: 3400411 - RNA, 14 nt, Human
cucuaggguugcug

SEQ ID NO: 3400412 - RNA, 23 nt, Human
cucuagguacgaugacaguguuc

SEQ ID NO: 3400413 - RNA, 22 nt, Human
cucuaggugcccuuggaggcca

SEQ ID NO: 3400414 - RNA, 15 nt, Human
cucuaguauuccaga

SEQ ID NO: 3400415 - RNA, 18 nt, Human
cucuagucaaugacauga

SEQ ID NO: 3400416 - RNA, 22 nt, Human
cucuagucaaugacaugaauuu

SEQ ID NO: 3400417 - RNA, 14 nt, Human
cucuagugcccucc

SEQ ID NO: 3400418 - RNA, 14 nt, Human
cucuagugccuucu

SEQ ID NO: 3400419 - RNA, 17 nt, Human
cucuagugcgguuuacu

SEQ ID NO: 3400420 - RNA, 14 nt, Human
cucuagugcuguga

SEQ ID NO: 3400421 - RNA, 16 nt, Human
cucuagugcugugaaa

SEQ ID NO: 3400422 - RNA, 17 nt, Human
cucuagugcugugaaaa

SEQ ID NO: 3400423 - RNA, 18 nt, Human
cucuagugcugugaaaaa

SEQ ID NO: 3400424 - RNA, 20 nt, Human
cucuagugcugugaaaaaaa

SEQ ID NO: 3400425 - RNA, 23 nt, Human
cucuagugggacagcccagagcc

SEQ ID NO: 3400426 - RNA, 19 nt, Human
cucuaguuugauuaaauuc

SEQ ID NO: 3400427 - RNA, 20 nt, Human
cucuaguuugauuaaauucu

SEQ ID NO: 3400428 - RNA, 16 nt, Human
cucuauaaggcagccu

SEQ ID NO: 3400429 - RNA, 15 nt, Human
cucuauaccaauaaa

SEQ ID NO: 3400430 - RNA, 16 nt, Human
cucuauaccaauaaag

SEQ ID NO: 3400431 - RNA, 17 nt, Human
cucuauaccaauaaagu

SEQ ID NO: 3400432 - RNA, 18 nt, Human
cucuauaccaauaaagug

SEQ ID NO: 3400433 - RNA, 18 nt, Human
cucuauacugcccugagu

SEQ ID NO: 3400434 - RNA, 21 nt, Human
cucuauacugcccugaguugg

SEQ ID NO: 3400435 - RNA, 21 nt, Human
cucuauauaccaaagcacauu

SEQ ID NO: 3400436 - RNA, 19 nt, Human
cucuauauuuagauuguua

SEQ ID NO: 3400437 - RNA, 15 nt, Human
cucuaucaccaagga

SEQ ID NO: 3400438 - RNA, 21 nt, Human
cucuaucauggugaaaagcuc

SEQ ID NO: 3400439 - RNA, 15 nt, Human
cucuaucauuaaagu

SEQ ID NO: 3400440 - RNA, 16 nt, Human
cucuaucauuaaaguu

SEQ ID NO: 3400441 - RNA, 18 nt, Human
cucuaucauuaaaguucu

SEQ ID NO: 3400442 - RNA, 14 nt, Human
cucuaucauuuaau

SEQ ID NO: 3400443 - RNA, 15 nt, Human
cucuaucauuuaaua

SEQ ID NO: 3400444 - RNA, 14 nt, Human
cucuaucucacagc

SEQ ID NO: 3400445 - RNA, 18 nt, Human
cucuaucucacagcacac

SEQ ID NO: 3400446 - RNA, 14 nt, Human
cucuaucugggccu

SEQ ID NO: 3400447 - RNA, 20 nt, Human
cucuaugaacucuguuuucu

SEQ ID NO: 3400448 - RNA, 14 nt, Human
cucuaugagucuag

SEQ ID NO: 3400449 - RNA, 15 nt, Human
cucuaugagucuaga

SEQ ID NO: 3400450 - RNA, 19 nt, Human
cucuaugccccaaauauag

SEQ ID NO: 3400451 - RNA, 19 nt, Human
cucuauggggcauccucuu

SEQ ID NO: 3400452 - RNA, 20 nt, Human
cucuauguuuacaaauggac

SEQ ID NO: 3400453 - RNA, 14 nt, Human
cucuauuaaaaugc

SEQ ID NO: 3400454 - RNA, 20 nt, Human
cucuauuaagauuuccaagu

SEQ ID NO: 3400455 - RNA, 15 nt, Human
cucuauuaugaaugu

SEQ ID NO: 3400456 - RNA, 22 nt, Human
cucuauuaugaaugugaagccu

SEQ ID NO: 3400457 - RNA, 21 nt, Human
cucuauucucaaaguuuccua

SEQ ID NO: 3400458 - RNA, 23 nt, Human
cucuauugauguacagucuguca

SEQ ID NO: 3400459 - RNA, 10 nt, Human
cucuauuuaa

SEQ ID NO: 3400460 - RNA, 15 nt, Human
cucuauuuaaauucu

SEQ ID NO: 3400461 - RNA, 16 nt, Human
cucuauuuaaauucuu

SEQ ID NO: 3400462 - RNA, 23 nt, Human
cucuauuuagaugcauauuacug

SEQ ID NO: 3400463 - RNA, 13 nt, Human
cucuauuuagcau

SEQ ID NO: 3400464 - RNA, 15 nt, Human
cucuauuucauuuuu

SEQ ID NO: 3400465 - RNA, 22 nt, Human
cucuauuucccccuuucuuccu

SEQ ID NO: 3400466 - RNA, 14 nt, Human
cucuauuugagaau

SEQ ID NO: 3400467 - RNA, 23 nt, Human
cucucaaaacuugguauuuuuca

SEQ ID NO: 3400468 - RNA, 23 nt, Human
cucucaaaagagaaaaacaaaac

SEQ ID NO: 3400469 - RNA, 23 nt, Human
cucucaaacuaaaagacauuugu

SEQ ID NO: 3400470 - RNA, 15 nt, Human
cucucaacaccauga

SEQ ID NO: 3400471 - RNA, 17 nt, Human
cucucaauaaaauuaua

SEQ ID NO: 3400472 - RNA, 10 nt, Human
cucucaauau

SEQ ID NO: 3400473 - RNA, 19 nt, Human
cucucaaugcuguuugggu

SEQ ID NO: 3400474 - RNA, 19 nt, Human
cucucaauuuuugguugaa

SEQ ID NO: 3400475 - RNA, 17 nt, Human
cucucacagacaggacc

SEQ ID NO: 3400476 - RNA, 23 nt, Human
cucucaccauuuggauccugugu

SEQ ID NO: 3400477 - RNA, 12 nt, Human
cucucaccuccu

SEQ ID NO: 3400478 - RNA, 16 nt, Human
cucucaccuguacucu

SEQ ID NO: 3400479 - RNA, 15 nt, Human
cucucacucccuccc

SEQ ID NO: 3400480 - RNA, 15 nt, Human
cucucacuccuugaa

SEQ ID NO: 3400481 - RNA, 14 nt, Human
cucucacugccucc

SEQ ID NO: 3400482 - RNA, 15 nt, Human
cucucacuguguccc

SEQ ID NO: 3400483 - RNA, 14 nt, Human
cucucagaagggag

SEQ ID NO: 3400484 - RNA, 20 nt, Human
cucucagagcuacuugggcc

SEQ ID NO: 3400485 - RNA, 22 nt, Human
cucucagagcuacuugggccau

SEQ ID NO: 3400486 - RNA, 11 nt, Human
cucucagccaa

SEQ ID NO: 3400487 - RNA, 14 nt, Human
cucucagcccagaa

SEQ ID NO: 3400488 - RNA, 21 nt, Human
cucucagccccugauccugug

SEQ ID NO: 3400489 - RNA, 19 nt, Human
cucucagccuuacauuugu

SEQ ID NO: 3400490 - RNA, 19 nt, Human
cucucaggaaaugcugacc

SEQ ID NO: 3400491 - RNA, 20 nt, Human
cucucaggaaaugcugaccc

SEQ ID NO: 3400492 - RNA, 13 nt, Human
cucucaggagcac

SEQ ID NO: 3400493 - RNA, 17 nt, Human
cucucaggagcacaggc

SEQ ID NO: 3400494 - RNA, 19 nt, Human
cucucaggagcacaggcag

SEQ ID NO: 3400495 - RNA, 14 nt, Human
cucucaggauccaa

SEQ ID NO: 3400496 - RNA, 19 nt, Human
cucucaggcaugccugugu

SEQ ID NO: 3400497 - RNA, 20 nt, Human
cucucaggccaaacucaccu

SEQ ID NO: 3400498 - RNA, 19 nt, Human
cucucagggccaggccucu

SEQ ID NO: 3400499 - RNA, 15 nt, Human
cucucaggugaccaa

SEQ ID NO: 3400500 - RNA, 19 nt, Human
cucucaguacuuuggaggc

SEQ ID NO: 3400501 - RNA, 20 nt, Human
cucucagugcccuccagccc

SEQ ID NO: 3400502 - RNA, 13 nt, Human
cucucaguguuuu

SEQ ID NO: 3400503 - RNA, 18 nt, Human
cucucaguguuuuggacu

SEQ ID NO: 3400504 - RNA, 21 nt, Human
cucucaguuccgauuucccag

SEQ ID NO: 3400505 - RNA, 19 nt, Human
cucucaguugcagcccugc

SEQ ID NO: 3400506 - RNA, 12 nt, Human
cucucaguuuuu

SEQ ID NO: 3400507 - RNA, 15 nt, Human
cucucauacccuccc

SEQ ID NO: 3400508 - RNA, 22 nt, Human
cucucauauauagacagcuuug

SEQ ID NO: 3400509 - RNA, 19 nt, Human
cucucauccuuuucuccua

SEQ ID NO: 3400510 - RNA, 13 nt, Human
cucucaucucagg

SEQ ID NO: 3400511 - RNA, 12 nt, Human
cucucucaggcc

SEQ ID NO: 3400512 - RNA, 21 nt, Human
cucucucauacccucccuccc

SEQ ID NO: 3400513 - RNA, 12 nt, Human
cucucuccagga

SEQ ID NO: 3400514 - RNA, 12 nt, Human
cucucucccucu

SEQ ID NO: 3400515 - RNA, 13 nt, Human
cucucucccuuuu

SEQ ID NO: 3400516 - RNA, 19 nt, Human
cucucuccuguccaaccua

SEQ ID NO: 3400517 - RNA, 15 nt, Human
cucucucucuccccu

SEQ ID NO: 3400518 - RNA, 15 nt, Human
cucucucucuuuccu

SEQ ID NO: 3400519 - RNA, 17 nt, Human
cucucugaaggaggcca

SEQ ID NO: 3400520 - RNA, 20 nt, Human
cucucugaaggaggccaccu

SEQ ID NO: 3400521 - RNA, 17 nt, Human
cucucugaguauuuccu

SEQ ID NO: 3400522 - RNA, 18 nt, Human
cucucugaguccuggccc

SEQ ID NO: 3400523 - RNA, 21 nt, Human
cucucugcagccagcccagcc

SEQ ID NO: 3400524 - RNA, 13 nt, Human
cucucugcagcug

SEQ ID NO: 3400525 - RNA, 16 nt, Human
cucucugcagcugccg

SEQ ID NO: 3400526 - RNA, 13 nt, Human
cucucugcagguc

SEQ ID NO: 3400527 - RNA, 14 nt, Human
cucucugcaggucc

SEQ ID NO: 3400528 - RNA, 22 nt, Human
cucucugcaggucccuaauaaa

SEQ ID NO: 3400529 - RNA, 12 nt, Human
cucucugcccua

SEQ ID NO: 3400530 - RNA, 14 nt, Human
cucucugcccugug

SEQ ID NO: 3400531 - RNA, 16 nt, Human
cucucugcccugugua

SEQ ID NO: 3400532 - RNA, 14 nt, Human
cucucugccuguga

SEQ ID NO: 3400533 - RNA, 15 nt, Human
cucucugccugugag

SEQ ID NO: 3400534 - RNA, 22 nt, Human
cucucugccugugagccagucu

SEQ ID NO: 3400535 - RNA, 14 nt, Human
cucucugcucugcg

SEQ ID NO: 3400536 - RNA, 16 nt, Human
cucucuggaaaggagg

SEQ ID NO: 3400537 - RNA, 11 nt, Human
cucucuggccu

SEQ ID NO: 3400538 - RNA, 19 nt, Human
cucucuggccucccacccg

SEQ ID NO: 3400539 - RNA, 12 nt, Human
cucucuggccuu

SEQ ID NO: 3400540 - RNA, 13 nt, Human
cucucuggccuuc

SEQ ID NO: 3400541 - RNA, 17 nt, Human
cucucuggccuucggcc

SEQ ID NO: 3400542 - RNA, 22 nt, Human
cucucuggccuucggccuccau

SEQ ID NO: 3400543 - RNA, 15 nt, Human
cucucuggcugggga

SEQ ID NO: 3400544 - RNA, 17 nt, Human
cucucugggcugacugg

SEQ ID NO: 3400545 - RNA, 18 nt, Human
cucucuggggccacacag

SEQ ID NO: 3400546 - RNA, 17 nt, Human
cucucuggggcuguguu

SEQ ID NO: 3400547 - RNA, 13 nt, Human
cucucuguauaaa

SEQ ID NO: 3400548 - RNA, 15 nt, Human
cucucuguauaaaca

SEQ ID NO: 3400549 - RNA, 20 nt, Human
cucucuguauaaacauuaaa

SEQ ID NO: 3400550 - RNA, 16 nt, Human
cucucugugucugaga

SEQ ID NO: 3400551 - RNA, 18 nt, Human
cucucuuacccuucugug

SEQ ID NO: 3400552 - RNA, 22 nt, Human
cucucuuacccuucugugccca

SEQ ID NO: 3400553 - RNA, 23 nt, Human
cucucuuacccuucugugcccag

SEQ ID NO: 3400554 - RNA, 19 nt, Human
cucucuuauagaauauuua

SEQ ID NO: 3400555 - RNA, 21 nt, Human
cucucuuauagaauauuuauu

SEQ ID NO: 3400556 - RNA, 22 nt, Human
cucucuucccuuuccccagcau

SEQ ID NO: 3400557 - RNA, 23 nt, Human
cucucuucccuuuccccagcauc

SEQ ID NO: 3400558 - RNA, 21 nt, Human
cucucuuccuaucccauccca

SEQ ID NO: 3400559 - RNA, 21 nt, Human
cucucuuccugccccucuuuc

SEQ ID NO: 3400560 - RNA, 20 nt, Human
cucucuugauuaagaucuca

SEQ ID NO: 3400561 - RNA, 15 nt, Human
cucucuuuccuucuu

SEQ ID NO: 3400562 - RNA, 15 nt, Human
cucucuuuggacucu

SEQ ID NO: 3400563 - RNA, 16 nt, Human
cucucuuuggacucuc

SEQ ID NO: 3400564 - RNA, 19 nt, Human
cucucuuuguucucagcuc

SEQ ID NO: 3400565 - RNA, 22 nt, Human
cucucuuuguucucagcucccc

SEQ ID NO: 3400566 - RNA, 13 nt, Human
cucucuuuuccug

SEQ ID NO: 3400567 - RNA, 14 nt, Human
cucucuuuucugua

SEQ ID NO: 3400568 - RNA, 17 nt, Human
cucugaaaacggcccuc

SEQ ID NO: 3400569 - RNA, 13 nt, Human
cucugaaacagcu

SEQ ID NO: 3400570 - RNA, 16 nt, Human
cucugaaacagcugcc

SEQ ID NO: 3400571 - RNA, 12 nt, Human
cucugaaaccag

SEQ ID NO: 3400572 - RNA, 17 nt, Human
cucugaaaccaguguua

SEQ ID NO: 3400573 - RNA, 16 nt, Human
cucugaaagagaaaca

SEQ ID NO: 3400574 - RNA, 18 nt, Human
cucugaaaguuguacaug

SEQ ID NO: 3400575 - RNA, 22 nt, Human
cucugaaaguuguacaugaaau

SEQ ID NO: 3400576 - RNA, 11 nt, Human
cucugaaauac

SEQ ID NO: 3400577 - RNA, 15 nt, Human
cucugaacacaggca

SEQ ID NO: 3400578 - RNA, 19 nt, Human
cucugaacacaggcagcuu

SEQ ID NO: 3400579 - RNA, 20 nt, Human
cucugaacacaggcagcuuu

SEQ ID NO: 3400580 - RNA, 12 nt, Human
cucugaacacau

SEQ ID NO: 3400581 - RNA, 19 nt, Human
cucugaacuucagcuagag

SEQ ID NO: 3400582 - RNA, 14 nt, Human
cucugaacuuugga

SEQ ID NO: 3400583 - RNA, 19 nt, Human
cucugaagaacucucugga

SEQ ID NO: 3400584 - RNA, 18 nt, Human
cucugaagaugaucauuu

SEQ ID NO: 3400585 - RNA, 18 nt, Human
cucugaagcaaggcggug

SEQ ID NO: 3400586 - RNA, 18 nt, Human
cucugaagcgugauuuua

SEQ ID NO: 3400587 - RNA, 17 nt, Human
cucugaaggaggccacc

SEQ ID NO: 3400588 - RNA, 23 nt, Human
cucugaagggcaucaugcaucuu

SEQ ID NO: 3400589 - RNA, 17 nt, Human
cucugaaguuggacagc

SEQ ID NO: 3400590 - RNA, 17 nt, Human
cucugaaugccccauaa

SEQ ID NO: 3400591 - RNA, 19 nt, Human
cucugaauuugagauacaa

SEQ ID NO: 3400592 - RNA, 16 nt, Human
cucugacaacagacuu

SEQ ID NO: 3400593 - RNA, 20 nt, Human
cucugacaagggcugaccug

SEQ ID NO: 3400594 - RNA, 14 nt, Human
cucugacacacagc

SEQ ID NO: 3400595 - RNA, 15 nt, Human
cucugacacacagcu

SEQ ID NO: 3400596 - RNA, 19 nt, Human
cucugacacacagcucugu

SEQ ID NO: 3400597 - RNA, 23 nt, Human
cucugacagaagaaccccagggu

SEQ ID NO: 3400598 - RNA, 13 nt, Human
cucugacagcagc

SEQ ID NO: 3400599 - RNA, 20 nt, Human
cucugaccccagcauucuca

SEQ ID NO: 3400600 - RNA, 12 nt, Human
cucugaccccuc

SEQ ID NO: 3400601 - RNA, 13 nt, Human
cucugaccccucc

SEQ ID NO: 3400602 - RNA, 14 nt, Human
cucugaccccuccu

SEQ ID NO: 3400603 - RNA, 16 nt, Human
cucugaccccuccuca

SEQ ID NO: 3400604 - RNA, 21 nt, Human
cucugaccccuccucacuggc

SEQ ID NO: 3400605 - RNA, 23 nt, Human
cucugaccuacucgagggacuua

SEQ ID NO: 3400606 - RNA, 17 nt, Human
cucugaccucuuggcca

SEQ ID NO: 3400607 - RNA, 14 nt, Human
cucugaccugcacu

SEQ ID NO: 3400608 - RNA, 14 nt, Human
cucugaccugcagg

SEQ ID NO: 3400609 - RNA, 15 nt, Human
cucugaccugcaggc

SEQ ID NO: 3400610 - RNA, 14 nt, Human
cucugacucagggc

SEQ ID NO: 3400611 - RNA, 21 nt, Human
cucugacucagggcuccuggg

SEQ ID NO: 3400612 - RNA, 18 nt, Human
cucugacucccaaagagc

SEQ ID NO: 3400613 - RNA, 22 nt, Human
cucugacucccaaagagcugcc

SEQ ID NO: 3400614 - RNA, 18 nt, Human
cucugacucucaaaucuu

SEQ ID NO: 3400615 - RNA, 16 nt, Human
cucugacuucugccug

SEQ ID NO: 3400616 - RNA, 15 nt, Human
cucugagaagaggag

SEQ ID NO: 3400617 - RNA, 16 nt, Human
cucugagaagaggagc

SEQ ID NO: 3400618 - RNA, 19 nt, Human
cucugagaauuccaaggag

SEQ ID NO: 3400619 - RNA, 21 nt, Human
cucugagaauuccaaggaguu

SEQ ID NO: 3400620 - RNA, 20 nt, Human
cucugagaauuguugagaua

SEQ ID NO: 3400621 - RNA, 23 nt, Human
cucugagaauuguugagauacuu

SEQ ID NO: 3400622 - RNA, 17 nt, Human
cucugagaggcccugga

SEQ ID NO: 3400623 - RNA, 15 nt, Human
cucugagagucuaga

SEQ ID NO: 3400624 - RNA, 17 nt, Human
cucugagagucuagauu

SEQ ID NO: 3400625 - RNA, 22 nt, Human
cucugagagucuagauucucug

SEQ ID NO: 3400626 - RNA, 22 nt, Human
cucugagaucuaaggaugucac

SEQ ID NO: 3400627 - RNA, 16 nt, Human
cucugagccacagugg

SEQ ID NO: 3400628 - RNA, 18 nt, Human
cucugagccacaguggga

SEQ ID NO: 3400629 - RNA, 13 nt, Human
cucugagcccaug

SEQ ID NO: 3400630 - RNA, 21 nt, Human
cucugagcccauguucugccc

SEQ ID NO: 3400631 - RNA, 15 nt, Human
cucugagccuuggga

SEQ ID NO: 3400632 - RNA, 15 nt, Human
cucugagcugucaac

SEQ ID NO: 3400633 - RNA, 17 nt, Human
cucugagcuuugcaugu

SEQ ID NO: 3400634 - RNA, 14 nt, Human
cucugaggacacua

SEQ ID NO: 3400635 - RNA, 13 nt, Human
cucugaggccagc

SEQ ID NO: 3400636 - RNA, 19 nt, Human
cucugaggccagccuggcc

SEQ ID NO: 3400637 - RNA, 20 nt, Human
cucugaggcucuuucugggc

SEQ ID NO: 3400638 - RNA, 13 nt, Human
cucugaggcugua

SEQ ID NO: 3400639 - RNA, 18 nt, Human
cucugaggcuuccagaga

SEQ ID NO: 3400640 - RNA, 15 nt, Human
cucugaggugccugu

SEQ ID NO: 3400641 - RNA, 16 nt, Human
cucugaguccuggccc

SEQ ID NO: 3400642 - RNA, 19 nt, Human
cucugaguguuuuaugaga

SEQ ID NO: 3400643 - RNA, 19 nt, Human
cucugaguuccggcaccag

SEQ ID NO: 3400644 - RNA, 21 nt, Human
cucugaguuccggcaccagua

SEQ ID NO: 3400645 - RNA, 17 nt, Human
cucugaguuuaccauuu

SEQ ID NO: 3400646 - RNA, 20 nt, Human
cucugaguuuaccauuugua

SEQ ID NO: 3400647 - RNA, 15 nt, Human
cucugauacagaaaa

SEQ ID NO: 3400648 - RNA, 20 nt, Human
cucugauacuuuuuugaaau

SEQ ID NO: 3400649 - RNA, 22 nt, Human
cucugauacuuuuuugaaauca

SEQ ID NO: 3400650 - RNA, 17 nt, Human
cucugauaugggacuga

SEQ ID NO: 3400651 - RNA, 21 nt, Human
cucugauaugggacugagccu

SEQ ID NO: 3400652 - RNA, 23 nt, Human
cucugauauuccaugaauguauc

SEQ ID NO: 3400653 - RNA, 21 nt, Human
cucugaucccucuacagagcu

SEQ ID NO: 3400654 - RNA, 14 nt, Human
cucugaugaaaaau

SEQ ID NO: 3400655 - RNA, 23 nt, Human
cucugaugaaaaauugcugacug

SEQ ID NO: 3400656 - RNA, 21 nt, Human
cugagggcaguucgcagccac

SEQ ID NO: 3400657 - RNA, 15 nt, Human
cugagggccacacua

SEQ ID NO: 3400658 - RNA, 16 nt, Human
cugagggccacacuau

SEQ ID NO: 3400659 - RNA, 18 nt, Human
cugagggccccucugccc

SEQ ID NO: 3400660 - RNA, 21 nt, Human
cugagggccccucugcccagc

SEQ ID NO: 3400661 - RNA, 19 nt, Human
cugagggccugcuggaggc

SEQ ID NO: 3400662 - RNA, 17 nt, Human
cugagggcuuguaguuc

SEQ ID NO: 3400663 - RNA, 22 nt, Human
cugaggggaggaucacuggagc

SEQ ID NO: 3400664 - RNA, 18 nt, Human
cugaggggcagccugccu

SEQ ID NO: 3400665 - RNA, 17 nt, Human
cugaggggcaucugccc

SEQ ID NO: 3400666 - RNA, 19 nt, Human
cugaggggcaucugccccu

SEQ ID NO: 3400667 - RNA, 18 nt, Human
cugagggggccuggaugc

SEQ ID NO: 3400668 - RNA, 16 nt, Human
cugagggucugggcgg

SEQ ID NO: 3400669 - RNA, 14 nt, Human
cugagggucuguag

SEQ ID NO: 3400670 - RNA, 16 nt, Human
cugagggucuguaggu

SEQ ID NO: 3400671 - RNA, 19 nt, Human
cugaggguguuucuuccug

SEQ ID NO: 3400672 - RNA, 14 nt, Human
cugagguccugagc

SEQ ID NO: 3400673 - RNA, 21 nt, Human
cugagguccugagcacugcca

SEQ ID NO: 3400674 - RNA, 19 nt, Human
cugaggucucuugagggag

SEQ ID NO: 3400675 - RNA, 13 nt, Human
cugaggucuggcu

SEQ ID NO: 3400676 - RNA, 13 nt, Human
cugaggugcccag

SEQ ID NO: 3400677 - RNA, 14 nt, Human
cugaggugcccagg

SEQ ID NO: 3400678 - RNA, 17 nt, Human
cugaggugcccaggaga

SEQ ID NO: 3400679 - RNA, 17 nt, Human
cugaggugccuguccca

SEQ ID NO: 3400680 - RNA, 21 nt, Human
cugaggugggagauguggaaa

SEQ ID NO: 3400681 - RNA, 14 nt, Human
cugaggugggccca

SEQ ID NO: 3400682 - RNA, 14 nt, Human
cugagguguggggg

SEQ ID NO: 3400683 - RNA, 19 nt, Human
cugaggugugggggcugca

SEQ ID NO: 3400684 - RNA, 16 nt, Human
cugagguuccucugcc

SEQ ID NO: 3400685 - RNA, 21 nt, Human
cugagguuccucugccugccc

SEQ ID NO: 3400686 - RNA, 17 nt, Human
cugaguaccccugcuuu

SEQ ID NO: 3400687 - RNA, 19 nt, Human
cugaguacuccacacugca

SEQ ID NO: 3400688 - RNA, 14 nt, Human
cugaguagaaaggc

SEQ ID NO: 3400689 - RNA, 17 nt, Human
cugaguagcucuccuga

SEQ ID NO: 3400690 - RNA, 19 nt, Human
cugaguagcucuccugacu

SEQ ID NO: 3400691 - RNA, 14 nt, Human
cugaguagcuggga

SEQ ID NO: 3400692 - RNA, 18 nt, Human
cugaguauguggaaggca

SEQ ID NO: 3400693 - RNA, 21 nt, Human
cugaguauuaaaauguaugca

SEQ ID NO: 3400694 - RNA, 14 nt, Human
cugagucagagcca

SEQ ID NO: 3400695 - RNA, 18 nt, Human
cugagucagagccauguc

SEQ ID NO: 3400696 - RNA, 16 nt, Human
cugagucagggcccag

SEQ ID NO: 3400697 - RNA, 17 nt, Human
cugagucaucuguuagg

SEQ ID NO: 3400698 - RNA, 19 nt, Human
cugagucaugaucucccug

SEQ ID NO: 3400699 - RNA, 22 nt, Human
cugagucaugaucucccugccg

SEQ ID NO: 3400700 - RNA, 21 nt, Human
cugaguccaagaggguccuuu

SEQ ID NO: 3400701 - RNA, 16 nt, Human
cugagucccaggagcu

SEQ ID NO: 3400702 - RNA, 15 nt, Human
cugaguccuggccca

SEQ ID NO: 3400703 - RNA, 15 nt, Human
cugaguccuuaaaca

SEQ ID NO: 3400704 - RNA, 21 nt, Human
cugaguccuuaaacagggcau

SEQ ID NO: 3400705 - RNA, 21 nt, Human
cugagucguacagaaagcugc

SEQ ID NO: 3400706 - RNA, 17 nt, Human
cugagucgugaccugcu

SEQ ID NO: 3400707 - RNA, 20 nt, Human
cugagucgugaccugcuagg

SEQ ID NO: 3400708 - RNA, 21 nt, Human
cugagucgugaccugcuaggc

SEQ ID NO: 3400709 - RNA, 16 nt, Human
cugagucugaaggcug

SEQ ID NO: 3400710 - RNA, 21 nt, Human
cugagucugcuauauuuucau

SEQ ID NO: 3400711 - RNA, 21 nt, Human
cugagugaaaaaucuguggaa

SEQ ID NO: 3400712 - RNA, 17 nt, Human
cugagugaaccuguaua

SEQ ID NO: 3400713 - RNA, 15 nt, Human
cugagugagagggga

SEQ ID NO: 3400714 - RNA, 20 nt, Human
cugagugagaggggaggcca

SEQ ID NO: 3400715 - RNA, 19 nt, Human
cugagugcagccguuugag

SEQ ID NO: 3400716 - RNA, 17 nt, Human
cugagugcaggcccacc

SEQ ID NO: 3400717 - RNA, 14 nt, Human
cugagugccuggcc

SEQ ID NO: 3400718 - RNA, 13 nt, Human
cugagugccuucu

SEQ ID NO: 3400719 - RNA, 14 nt, Human
cugagugccuuuug

SEQ ID NO: 3400720 - RNA, 16 nt, Human
cugaguggcaggggac

SEQ ID NO: 3400721 - RNA, 21 nt, Human
cugaguggcuucacuccugcu

SEQ ID NO: 3400722 - RNA, 13 nt, Human
cugaguuaugaug

SEQ ID NO: 3400723 - RNA, 19 nt, Human
cugaguuccggcaccagua

SEQ ID NO: 3400724 - RNA, 16 nt, Human
cugaguuccuagccac

SEQ ID NO: 3400725 - RNA, 16 nt, Human
cugaguuccugcaugc

SEQ ID NO: 3400726 - RNA, 19 nt, Human
cugaguucuggucaaagaa

SEQ ID NO: 3400727 - RNA, 17 nt, Human
cugaguugaagagggga

SEQ ID NO: 3400728 - RNA, 20 nt, Human
cugaguugccaagacaaauc

SEQ ID NO: 3400729 - RNA, 15 nt, Human
cugaguugcuuuuca

SEQ ID NO: 3400730 - RNA, 16 nt, Human
cugaguuguuacccca

SEQ ID NO: 3400731 - RNA, 17 nt, Human
cugaguuguuaccccaa

SEQ ID NO: 3400732 - RNA, 19 nt, Human
cugaguuuaccauuuguaa

SEQ ID NO: 3400733 - RNA, 22 nt, Human
cugaguuuaccauuuguaauaa

SEQ ID NO: 3400734 - RNA, 19 nt, Human
cugaguuucauucuccugc

SEQ ID NO: 3400735 - RNA, 21 nt, Human
cugaguuucauucuccugccu

SEQ ID NO: 3400736 - RNA, 13 nt, Human
cugaguuuuacca

SEQ ID NO: 3400737 - RNA, 21 nt, Human
cugaguuuucucuuugugggg

SEQ ID NO: 3400738 - RNA, 14 nt, Human
cugaguuuuguguu

SEQ ID NO: 3400739 - RNA, 20 nt, Human
cugaguuuuguguuuguugu

SEQ ID NO: 3400740 - RNA, 21 nt, Human
cugaguuuuguguuuguugua

SEQ ID NO: 3400741 - RNA, 22 nt, Human
cugaguuuuuaaaaauggacaa

SEQ ID NO: 3400742 - RNA, 23 nt, Human
cugauaaaaccauguagaaaauu

SEQ ID NO: 3400743 - RNA, 18 nt, Human
cugauaaaagauggccau

SEQ ID NO: 3400744 - RNA, 14 nt, Human
cugauaaagaaaga

SEQ ID NO: 3400745 - RNA, 13 nt, Human
cugauaaagauga

SEQ ID NO: 3400746 - RNA, 21 nt, Human
cugauaaagaugagugagcau

SEQ ID NO: 3400747 - RNA, 16 nt, Human
cugauaacaaccugga

SEQ ID NO: 3400748 - RNA, 22 nt, Human
cugauaacaaccuggagaccag

SEQ ID NO: 3400749 - RNA, 18 nt, Human
cugauaacuagauggugc

SEQ ID NO: 3400750 - RNA, 15 nt, Human
cugauaauuccagug

SEQ ID NO: 3400751 - RNA, 15 nt, Human
cugauaauuuuaaau

SEQ ID NO: 3400752 - RNA, 19 nt, Human
cugauacauaacuaaauuu

SEQ ID NO: 3400753 - RNA, 14 nt, Human
cugauacccagagc

SEQ ID NO: 3400754 - RNA, 15 nt, Human
cugauacuuuuuuga

SEQ ID NO: 3400755 - RNA, 15 nt, Human
cugauagcucuuugg

SEQ ID NO: 3400756 - RNA, 22 nt, Human
cugauagcucuuuggcagucua

SEQ ID NO: 3400757 - RNA, 17 nt, Human
cugauaggccaaguuug

SEQ ID NO: 3400758 - RNA, 18 nt, Human
cugauaguuacuguugug

SEQ ID NO: 3400759 - RNA, 14 nt, Human
cugauauaaauucu

SEQ ID NO: 3400760 - RNA, 22 nt, Human
cugauauagaucacauaacaga

SEQ ID NO: 3400761 - RNA, 22 nt, Human
cugauauauguguuuuucacau

SEQ ID NO: 3400762 - RNA, 21 nt, Human
cugauaugauuuaaaacaugu

SEQ ID NO: 3400763 - RNA, 22 nt, Human
cugauaugauuuaaaacaugua

SEQ ID NO: 3400764 - RNA, 15 nt, Human
cugauaugggacuga

SEQ ID NO: 3400765 - RNA, 13 nt, Human
cugauauguuugu

SEQ ID NO: 3400766 - RNA, 20 nt, Human
cugauauucaaauggacaaa

SEQ ID NO: 3400767 - RNA, 18 nt, Human
cugauauuccaugaaugu

SEQ ID NO: 3400768 - RNA, 22 nt, Human
cugauauugccgcacuagggga

SEQ ID NO: 3400769 - RNA, 22 nt, Human
cugauauuucccuccccugggg

SEQ ID NO: 3400770 - RNA, 14 nt, Human
cugauauuuucucu

SEQ ID NO: 3400771 - RNA, 18 nt, Human
cugauauuuucucuagga

SEQ ID NO: 3400772 - RNA, 14 nt, Human
cugaucaaugacag

SEQ ID NO: 3400773 - RNA, 15 nt, Human
cugaucaaugacaga

SEQ ID NO: 3400774 - RNA, 14 nt, Human
cugaucagagccgu

SEQ ID NO: 3400775 - RNA, 13 nt, Human
cugaucagucuaa

SEQ ID NO: 3400776 - RNA, 22 nt, Human
cugaucagugggccuccaagga

SEQ ID NO: 3400777 - RNA, 15 nt, Human
cugaucaugcauugu

SEQ ID NO: 3400778 - RNA, 21 nt, Human
cugauccagagcacagaucug

SEQ ID NO: 3400779 - RNA, 20 nt, Human
cugauccagcccugaguucc

SEQ ID NO: 3400780 - RNA, 15 nt, Human
cugaucccucuacag

SEQ ID NO: 3400781 - RNA, 20 nt, Human
cugaucccugaucccuucca

SEQ ID NO: 3400782 - RNA, 21 nt, Human
cugauccuaguuccaccauca

SEQ ID NO: 3400783 - RNA, 14 nt, Human
cugaucgcuucucc

SEQ ID NO: 3400784 - RNA, 22 nt, Human
cugaucgugacgcugaauaaau

SEQ ID NO: 3400785 - RNA, 15 nt, Human
cugaucgugcuaaau

SEQ ID NO: 3400786 - RNA, 17 nt, Human
cugaucgugcuaaauuu

SEQ ID NO: 3400787 - RNA, 12 nt, Human
cugaucucaggg

SEQ ID NO: 3400788 - RNA, 21 nt, Human
cugaucucagggaagcccagc

SEQ ID NO: 3400789 - RNA, 14 nt, Human
cugaucucucguga

SEQ ID NO: 3400790 - RNA, 14 nt, Human
cugaucucuuccug

SEQ ID NO: 3400791 - RNA, 16 nt, Human
cugaucucuuccuguu

SEQ ID NO: 3400792 - RNA, 21 nt, Human
cugaucugcccaucgugaaga

SEQ ID NO: 3400793 - RNA, 13 nt, Human
cugaucugugcuu

SEQ ID NO: 3400794 - RNA, 17 nt, Human
cugaucugugcuuucca

SEQ ID NO: 3400795 - RNA, 13 nt, Human
cugaucuguuaua

SEQ ID NO: 3400796 - RNA, 18 nt, Human
cugaucuuuguauauuac

SEQ ID NO: 3400797 - RNA, 12 nt, Human
cugaugaaaaua

SEQ ID NO: 3400798 - RNA, 16 nt, Human
cugaugaaucacuguu

SEQ ID NO: 3400799 - RNA, 11 nt, Human
cugaugacaau

SEQ ID NO: 3400800 - RNA, 14 nt, Human
cugcagccagcuca

SEQ ID NO: 3400801 - RNA, 15 nt, Human
cugcagccaggccac

SEQ ID NO: 3400802 - RNA, 16 nt, Human
cugcagcccagggacc

SEQ ID NO: 3400803 - RNA, 20 nt, Human
cugcagccucaaccuccugg

SEQ ID NO: 3400804 - RNA, 14 nt, Human
cugcagccucagga

SEQ ID NO: 3400805 - RNA, 19 nt, Human
cugcagccuccgcuucccu

SEQ ID NO: 3400806 - RNA, 23 nt, Human
cugcagccucgaacuccugggcu

SEQ ID NO: 3400807 - RNA, 17 nt, Human
cugcagccuugaacucu

SEQ ID NO: 3400808 - RNA, 21 nt, Human
cugcagcuaguccuagugaac

SEQ ID NO: 3400809 - RNA, 19 nt, Human
cugcagcucccucaaagag

SEQ ID NO: 3400810 - RNA, 23 nt, Human
cugcagcucccucaaagaggcag

SEQ ID NO: 3400811 - RNA, 15 nt, Human
cugcagcucccuggc

SEQ ID NO: 3400812 - RNA, 17 nt, Human
cugcagcucucaugcug

SEQ ID NO: 3400813 - RNA, 14 nt, Human
cugcagcugaccuc

SEQ ID NO: 3400814 - RNA, 11 nt, Human
cugcagcugcc

SEQ ID NO: 3400815 - RNA, 13 nt, Human
cugcagcugccgg

SEQ ID NO: 3400816 - RNA, 13 nt, Human
cugcagcuuccug

SEQ ID NO: 3400817 - RNA, 12 nt, Human
cugcagcuuggg

SEQ ID NO: 3400818 - RNA, 11 nt, Human
cugcagcuugu

SEQ ID NO: 3400819 - RNA, 20 nt, Human
cugcagcuuguagccagccg

SEQ ID NO: 3400820 - RNA, 22 nt, Human
cugcagcuuguagccagccggg

SEQ ID NO: 3400821 - RNA, 14 nt, Human
cugcagcuuuacau

SEQ ID NO: 3400822 - RNA, 16 nt, Human
cugcaggaaggagcug

SEQ ID NO: 3400823 - RNA, 19 nt, Human
cugcaggaaggagcugccu

SEQ ID NO: 3400824 - RNA, 14 nt, Human
cugcaggaaucuuu

SEQ ID NO: 3400825 - RNA, 14 nt, Human
cugcaggaccugcc

SEQ ID NO: 3400826 - RNA, 21 nt, Human
cugcaggaccugccuguagcc

SEQ ID NO: 3400827 - RNA, 19 nt, Human
cugcaggacuugagaagac

SEQ ID NO: 3400828 - RNA, 16 nt, Human
cugcaggaguuaaaaa

SEQ ID NO: 3400829 - RNA, 19 nt, Human
cugcaggauucucaccagc

SEQ ID NO: 3400830 - RNA, 20 nt, Human
cugcaggauucucaccagcu

SEQ ID NO: 3400831 - RNA, 21 nt, Human
cugcaggauugauuaugcaga

SEQ ID NO: 3400832 - RNA, 17 nt, Human
cugcaggcagccaggcc

SEQ ID NO: 3400833 - RNA, 19 nt, Human
cugcaggcagccaggccac

SEQ ID NO: 3400834 - RNA, 20 nt, Human
cugcaggcagccaggccaca

SEQ ID NO: 3400835 - RNA, 22 nt, Human
cugcaggcaggaacaaacaggg

SEQ ID NO: 3400836 - RNA, 15 nt, Human
cugcaggccaagagc

SEQ ID NO: 3400837 - RNA, 22 nt, Human
cugcaggccccgcuuguccagc

SEQ ID NO: 3400838 - RNA, 13 nt, Human
cugcaggcccugg

SEQ ID NO: 3400839 - RNA, 16 nt, Human
cugcaggcugagccac

SEQ ID NO: 3400840 - RNA, 23 nt, Human
cugcaggcuuaauaaaaaugaca

SEQ ID NO: 3400841 - RNA, 23 nt, Human
cugcagggaaaauuauuugcaua

SEQ ID NO: 3400842 - RNA, 15 nt, Human
cugcagggacugcca

SEQ ID NO: 3400843 - RNA, 22 nt, Human
cugcagggaguccgaaagggac

SEQ ID NO: 3400844 - RNA, 11 nt, Human
cugcagggcca

SEQ ID NO: 3400845 - RNA, 13 nt, Human
cugcagggccagg

SEQ ID NO: 3400846 - RNA, 21 nt, Human
cugcagggccauggcucaggg

SEQ ID NO: 3400847 - RNA, 14 nt, Human
cugcaggggcucug

SEQ ID NO: 3400848 - RNA, 20 nt, Human
cugcagggggugugucugcu

SEQ ID NO: 3400849 - RNA, 20 nt, Human
cugcaggguggugcugggac

SEQ ID NO: 3400850 - RNA, 11 nt, Human
cugcagguccc

SEQ ID NO: 3400851 - RNA, 12 nt, Human
cugcaggucccu

SEQ ID NO: 3400852 - RNA, 13 nt, Human
cugcaggucccua

SEQ ID NO: 3400853 - RNA, 16 nt, Human
cugcaggucccuaaua

SEQ ID NO: 3400854 - RNA, 17 nt, Human
cugcaggucccuaauaa

SEQ ID NO: 3400855 - RNA, 22 nt, Human
cugcaggucccuaauaaagcug

SEQ ID NO: 3400856 - RNA, 21 nt, Human
cugcagguucuucuuccugaa

SEQ ID NO: 3400857 - RNA, 16 nt, Human
cugcagguuggacccc

SEQ ID NO: 3400858 - RNA, 18 nt, Human
cugcagguuggaccccag

SEQ ID NO: 3400859 - RNA, 14 nt, Human
cugcaguaaaucuu

SEQ ID NO: 3400860 - RNA, 13 nt, Human
cugcagucacagc

SEQ ID NO: 3400861 - RNA, 22 nt, Human
cugcagucacuucgugggaucu

SEQ ID NO: 3400862 - RNA, 22 nt, Human
cugcagucaucuugaccaagca

SEQ ID NO: 3400863 - RNA, 23 nt, Human
cugcaguccguguggauccaaug

SEQ ID NO: 3400864 - RNA, 19 nt, Human
cugcaguccuccgguugca

SEQ ID NO: 3400865 - RNA, 23 nt, Human
cugcagucucuauaccaauaaag

SEQ ID NO: 3400866 - RNA, 14 nt, Human
cugcagugugcccc

SEQ ID NO: 3400867 - RNA, 20 nt, Human
cugcaguguucgcuuggcuc

SEQ ID NO: 3400868 - RNA, 22 nt, Human
cugcaguguucgcuuggcucca

SEQ ID NO: 3400869 - RNA, 13 nt, Human
cugcaguuaauua

SEQ ID NO: 3400870 - RNA, 16 nt, Human
cugcaguuaauuagca

SEQ ID NO: 3400871 - RNA, 21 nt, Human
cugcaguuccccuggaagcag

SEQ ID NO: 3400872 - RNA, 21 nt, Human
cugcaguucgacucugugcug

SEQ ID NO: 3400873 - RNA, 17 nt, Human
cugcaguugccagucac

SEQ ID NO: 3400874 - RNA, 19 nt, Human
cugcaguugccagucaccc

SEQ ID NO: 3400875 - RNA, 22 nt, Human
cugcaguugccagucaccccgg

SEQ ID NO: 3400876 - RNA, 21 nt, Human
cugcaguuugagacaggagac

SEQ ID NO: 3400877 - RNA, 15 nt, Human
cugcaguuuugcuau

SEQ ID NO: 3400878 - RNA, 20 nt, Human
cugcaguuuuuuuccuucaa

SEQ ID NO: 3400879 - RNA, 23 nt, Human
cugcaguuuuuuuccuucaagaa

SEQ ID NO: 3400880 - RNA, 22 nt, Human
cugcauaaaaaggucuuuaaaa

SEQ ID NO: 3400881 - RNA, 23 nt, Human
cugcauaauucugaaguuauauu

SEQ ID NO: 3400882 - RNA, 17 nt, Human
cugcauacccgggcagg

SEQ ID NO: 3400883 - RNA, 16 nt, Human
cugcauagaaggagga

SEQ ID NO: 3400884 - RNA, 20 nt, Human
cugcauagaaggaggagagg

SEQ ID NO: 3400885 - RNA, 14 nt, Human
cugcauaucuucau

SEQ ID NO: 3400886 - RNA, 14 nt, Human
cugcauauguugaa

SEQ ID NO: 3400887 - RNA, 20 nt, Human
cugcaucaagaugugacaug

SEQ ID NO: 3400888 - RNA, 18 nt, Human
cugcaucaucuguagaua

SEQ ID NO: 3400889 - RNA, 21 nt, Human
cugcauccagagauucauuuu

SEQ ID NO: 3400890 - RNA, 13 nt, Human
cugcauccagccu

SEQ ID NO: 3400891 - RNA, 19 nt, Human
cugcauccauucuccugag

SEQ ID NO: 3400892 - RNA, 17 nt, Human
cugcaucccagcaccug

SEQ ID NO: 3400893 - RNA, 18 nt, Human
cugcaucccagcaccugc

SEQ ID NO: 3400894 - RNA, 16 nt, Human
cugcauccccuuggcu

SEQ ID NO: 3400895 - RNA, 19 nt, Human
cugcauccguaguucccug

SEQ ID NO: 3400896 - RNA, 16 nt, Human
cugcauccucuggagc

SEQ ID NO: 3400897 - RNA, 17 nt, Human
cugcaucuaagcccaug

SEQ ID NO: 3400898 - RNA, 17 nt, Human
cugcaucuacucaggcc

SEQ ID NO: 3400899 - RNA, 17 nt, Human
cugcaucuacucccaag

SEQ ID NO: 3400900 - RNA, 19 nt, Human
cugcaucugaccagcagcg

SEQ ID NO: 3400901 - RNA, 22 nt, Human
cugcaucugaccagcagcgccu

SEQ ID NO: 3400902 - RNA, 14 nt, Human
cugcaucuggggcc

SEQ ID NO: 3400903 - RNA, 18 nt, Human
cugcaucuugguuauuuc

SEQ ID NO: 3400904 - RNA, 17 nt, Human
cugcaucuuuagugcuu

SEQ ID NO: 3400905 - RNA, 13 nt, Human
cugcaugauguuu

SEQ ID NO: 3400906 - RNA, 15 nt, Human
cugcaugauguuugc

SEQ ID NO: 3400907 - RNA, 12 nt, Human
cugcaugcccag

SEQ ID NO: 3400908 - RNA, 15 nt, Human
cugcaugcccucuca

SEQ ID NO: 3400909 - RNA, 17 nt, Human
cugcaugcccucucagg

SEQ ID NO: 3400910 - RNA, 18 nt, Human
cugcaugcccucucaggc

SEQ ID NO: 3400911 - RNA, 21 nt, Human
cugcaugcccucucaggccgg

SEQ ID NO: 3400912 - RNA, 17 nt, Human
cugcaugcggcccagcc

SEQ ID NO: 3400913 - RNA, 18 nt, Human
cugcaugcgggcuuccuc

SEQ ID NO: 3400914 - RNA, 15 nt, Human
cugcaugcugcugga

SEQ ID NO: 3400915 - RNA, 21 nt, Human
cugcaugcuggguucugcaca

SEQ ID NO: 3400916 - RNA, 12 nt, Human
cugcauggaccu

SEQ ID NO: 3400917 - RNA, 13 nt, Human
cugcauggaccua

SEQ ID NO: 3400918 - RNA, 18 nt, Human
cugcauggaccuaacauu

SEQ ID NO: 3400919 - RNA, 22 nt, Human
cugcauggaccuaacauucgau

SEQ ID NO: 3400920 - RNA, 14 nt, Human
cugcauggcagggg

SEQ ID NO: 3400921 - RNA, 16 nt, Human
cugcauggcauccucc

SEQ ID NO: 3400922 - RNA, 17 nt, Human
cugcaugggccagcccc

SEQ ID NO: 3400923 - RNA, 19 nt, Human
cugcaugggccagccccuc

SEQ ID NO: 3400924 - RNA, 17 nt, Human
cugcaugguaauuuaua

SEQ ID NO: 3400925 - RNA, 21 nt, Human
cugcauguaaacacgccugca

SEQ ID NO: 3400926 - RNA, 13 nt, Human
cugcauguuacau

SEQ ID NO: 3400927 - RNA, 15 nt, Human
cugcauguuaccauc

SEQ ID NO: 3400928 - RNA, 15 nt, Human
cugcauguuugugau

SEQ ID NO: 3400929 - RNA, 12 nt, Human
cugcauuagaaa

SEQ ID NO: 3400930 - RNA, 15 nt, Human
cugcauuagaaauua

SEQ ID NO: 3400931 - RNA, 18 nt, Human
cugcauuauucucuuuua

SEQ ID NO: 3400932 - RNA, 19 nt, Human
cugcauucugccgugugcc

SEQ ID NO: 3400933 - RNA, 22 nt, Human
cugcauucuucugagcacuguu

SEQ ID NO: 3400934 - RNA, 22 nt, Human
cugcauugaaaagagcugaagg

SEQ ID NO: 3400935 - RNA, 17 nt, Human
cugcauugagaacugca

SEQ ID NO: 3400936 - RNA, 23 nt, Human
cugcauugccugcggucaaggcc

SEQ ID NO: 3400937 - RNA, 17 nt, Human
cugcauugcuagauaaa

SEQ ID NO: 3400938 - RNA, 16 nt, Human
cugcauuggaacugga

SEQ ID NO: 3400939 - RNA, 19 nt, Human
cugcauuggaacuggaggc

SEQ ID NO: 3400940 - RNA, 13 nt, Human
cugcauuuagcac

SEQ ID NO: 3400941 - RNA, 15 nt, Human
cugcauuuagcacaa

SEQ ID NO: 3400942 - RNA, 17 nt, Human
cugcauuuccucgcagc

SEQ ID NO: 3400943 - RNA, 13 nt, Human
cugcauuucugag

SEQ ID NO: 3400944 - RNA, 15 nt, Human
cugcccaucacaggg

SEQ ID NO: 3400945 - RNA, 19 nt, Human
cugcccauccugccccuga

SEQ ID NO: 3400946 - RNA, 22 nt, Human
cugcccaucgugaagaagccug

SEQ ID NO: 3400947 - RNA, 18 nt, Human
cugcccaugccaccgcuu

SEQ ID NO: 3400948 - RNA, 20 nt, Human
cugcccauggacaggcuggc

SEQ ID NO: 3400949 - RNA, 22 nt, Human
cugcccaugucgcgcucagcau

SEQ ID NO: 3400950 - RNA, 22 nt, Human
cugcccauuucgugagccccau

SEQ ID NO: 3400951 - RNA, 21 nt, Human
cugccccaaacaaauaugcaa

SEQ ID NO: 3400952 - RNA, 19 nt, Human
cugccccaaaggaagcuuu

SEQ ID NO: 3400953 - RNA, 12 nt, Human
cugccccaacuc

SEQ ID NO: 3400954 - RNA, 18 nt, Human
cugccccaacuccuggaa

SEQ ID NO: 3400955 - RNA, 20 nt, Human
cugccccaacuccuuccagc

SEQ ID NO: 3400956 - RNA, 22 nt, Human
cugccccaacuccuuccagcua

SEQ ID NO: 3400957 - RNA, 13 nt, Human
cugccccaacucu

SEQ ID NO: 3400958 - RNA, 13 nt, Human
cugccccaaguug

SEQ ID NO: 3400959 - RNA, 20 nt, Human
cugccccacaccuccucuca

SEQ ID NO: 3400960 - RNA, 13 nt, Human
cugccccagccag

SEQ ID NO: 3400961 - RNA, 14 nt, Human
cugccccagccaga

SEQ ID NO: 3400962 - RNA, 17 nt, Human
cugccccagcccaaguc

SEQ ID NO: 3400963 - RNA, 19 nt, Human
cugccccagcccaagucca

SEQ ID NO: 3400964 - RNA, 15 nt, Human
cugccccagcccaga

SEQ ID NO: 3400965 - RNA, 16 nt, Human
cugccccagcccagau

SEQ ID NO: 3400966 - RNA, 12 nt, Human
cugccccaggcc

SEQ ID NO: 3400967 - RNA, 12 nt, Human
cugccccauccc

SEQ ID NO: 3400968 - RNA, 17 nt, Human
cugccccauccuccagc

SEQ ID NO: 3400969 - RNA, 19 nt, Human
cugccccaucuccccucag

SEQ ID NO: 3400970 - RNA, 21 nt, Human
cugccccaucuccccucagcu

SEQ ID NO: 3400971 - RNA, 22 nt, Human
cugccccaucuccccucagcuc

SEQ ID NO: 3400972 - RNA, 16 nt, Human
cugccccaucugggga

SEQ ID NO: 3400973 - RNA, 16 nt, Human
cugccccaugaagcca

SEQ ID NO: 3400974 - RNA, 17 nt, Human
cugcccccacaccuggc

SEQ ID NO: 3400975 - RNA, 19 nt, Human
cugcccccacaccuggccc

SEQ ID NO: 3400976 - RNA, 19 nt, Human
cugcccccaccacggccac

SEQ ID NO: 3400977 - RNA, 13 nt, Human
cugcccccaggac

SEQ ID NO: 3400978 - RNA, 15 nt, Human
cugcccccaggacug

SEQ ID NO: 3400979 - RNA, 16 nt, Human
cugcccccaggacugg

SEQ ID NO: 3400980 - RNA, 21 nt, Human
cugccccccagccucuggcau

SEQ ID NO: 3400981 - RNA, 20 nt, Human
cugcccccgcauccccugcc

SEQ ID NO: 3400982 - RNA, 21 nt, Human
cugcccccgcauccccugccu

SEQ ID NO: 3400983 - RNA, 23 nt, Human
cugcccccgcauccccugccucc

SEQ ID NO: 3400984 - RNA, 16 nt, Human
cugcccccggcccccu

SEQ ID NO: 3400985 - RNA, 14 nt, Human
cugcccccuccuga

SEQ ID NO: 3400986 - RNA, 14 nt, Human
cugcccccucugcc

SEQ ID NO: 3400987 - RNA, 16 nt, Human
cugcccccucugcccu

SEQ ID NO: 3400988 - RNA, 16 nt, Human
cugcccccugaaacuu

SEQ ID NO: 3400989 - RNA, 13 nt, Human
cugcccccugcag

SEQ ID NO: 3400990 - RNA, 15 nt, Human
cugcccccugcagaa

SEQ ID NO: 3400991 - RNA, 14 nt, Human
cugcccccugcagg

SEQ ID NO: 3400992 - RNA, 15 nt, Human
cugcccccugcagga

SEQ ID NO: 3400993 - RNA, 16 nt, Human
cugcccccugcaggaa

SEQ ID NO: 3400994 - RNA, 14 nt, Human
cugcccccugcugg

SEQ ID NO: 3400995 - RNA, 15 nt, Human
cugcccccugcuggc

SEQ ID NO: 3400996 - RNA, 17 nt, Human
cugcccccugcuggcuc

SEQ ID NO: 3400997 - RNA, 19 nt, Human
cugcccccugcuggcucuu

SEQ ID NO: 3400998 - RNA, 14 nt, Human
cugccccgccccca

SEQ ID NO: 3400999 - RNA, 17 nt, Human
cugccccgcccccaguc

SEQ ID NO: 3401000 - RNA, 23 nt, Human
cugccccgcccccaguccccacc

SEQ ID NO: 3401001 - RNA, 14 nt, Human
cugccccgcccuca

SEQ ID NO: 3401002 - RNA, 19 nt, Human
cugccccggagcuggagga

SEQ ID NO: 3401003 - RNA, 23 nt, Human
cugccccggggaggggcgcucgc

SEQ ID NO: 3401004 - RNA, 21 nt, Human
cugccccgucaccaucucagg

SEQ ID NO: 3401005 - RNA, 23 nt, Human
cugccccgucaccaucucaggcc

SEQ ID NO: 3401006 - RNA, 17 nt, Human
cugccccuacccuggac

SEQ ID NO: 3401007 - RNA, 14 nt, Human
cugccccucaacuc

SEQ ID NO: 3401008 - RNA, 14 nt, Human
cugccccucccaga

SEQ ID NO: 3401009 - RNA, 13 nt, Human
cugccccuccccc

SEQ ID NO: 3401010 - RNA, 16 nt, Human
cugccccucccccagc

SEQ ID NO: 3401011 - RNA, 22 nt, Human
cugccccucccugccagcaccc

SEQ ID NO: 3401012 - RNA, 15 nt, Human
cugccccucccugcu

SEQ ID NO: 3401013 - RNA, 17 nt, Human
cugccccucccuucaac

SEQ ID NO: 3401014 - RNA, 17 nt, Human
cugccccuccucucugc

SEQ ID NO: 3401015 - RNA, 19 nt, Human
cugccccuccucucugccc

SEQ ID NO: 3401016 - RNA, 13 nt, Human
cugccccucucug

SEQ ID NO: 3401017 - RNA, 14 nt, Human
cugccccucucugg

SEQ ID NO: 3401018 - RNA, 15 nt, Human
cugccccucucuggg

SEQ ID NO: 3401019 - RNA, 22 nt, Human
cugccccucucugggccucaga

SEQ ID NO: 3401020 - RNA, 12 nt, Human
cugccccucuuu

SEQ ID NO: 3401021 - RNA, 19 nt, Human
cugccccugcacagcaggc

SEQ ID NO: 3401022 - RNA, 14 nt, Human
cugccccugccccg

SEQ ID NO: 3401023 - RNA, 17 nt, Human
cugccccugccccguca

SEQ ID NO: 3401024 - RNA, 22 nt, Human
cugccccugccuuggggucagg

SEQ ID NO: 3401025 - RNA, 11 nt, Human
cugccccuggc

SEQ ID NO: 3401026 - RNA, 16 nt, Human
cugccccuggcagccc

SEQ ID NO: 3401027 - RNA, 18 nt, Human
cugccccuggcagccccu

SEQ ID NO: 3401028 - RNA, 23 nt, Human
cugccccuucuacacucuccugg

SEQ ID NO: 3401029 - RNA, 14 nt, Human
cugcccgagcuggu

SEQ ID NO: 3401030 - RNA, 16 nt, Human
cugcccgagcuggugc

SEQ ID NO: 3401031 - RNA, 20 nt, Human
cugcccgcacagcagccugc

SEQ ID NO: 3401032 - RNA, 19 nt, Human
cugcccgcagaccucugga

SEQ ID NO: 3401033 - RNA, 13 nt, Human
cugcccgccugcc

SEQ ID NO: 3401034 - RNA, 16 nt, Human
cugcccgccugcccac

SEQ ID NO: 3401035 - RNA, 19 nt, Human
cugcccgccugcccaccug

SEQ ID NO: 3401036 - RNA, 13 nt, Human
cugcccgcuccca

SEQ ID NO: 3401037 - RNA, 21 nt, Human
cugcccgggaaggucaccagc

SEQ ID NO: 3401038 - RNA, 19 nt, Human
cugcccgggagcucaggaa

SEQ ID NO: 3401039 - RNA, 20 nt, Human
cugcccggggcagcugccag

SEQ ID NO: 3401040 - RNA, 23 nt, Human
cugcccggggcagcugccagaga

SEQ ID NO: 3401041 - RNA, 23 nt, Human
cugcccggugggggggcagagcc

SEQ ID NO: 3401042 - RNA, 21 nt, Human
cugcccguaaacacgccugca

SEQ ID NO: 3401043 - RNA, 19 nt, Human
cugcccgucucucucccau

SEQ ID NO: 3401044 - RNA, 21 nt, Human
cugcccgucuucagccuagcc

SEQ ID NO: 3401045 - RNA, 15 nt, Human
cugcccguguacaua

SEQ ID NO: 3401046 - RNA, 22 nt, Human
cugcccuaaugcgcaggcuggc

SEQ ID NO: 3401047 - RNA, 18 nt, Human
cugcccuacagaggucuc

SEQ ID NO: 3401048 - RNA, 18 nt, Human
cugcccuaggcuccguca

SEQ ID NO: 3401049 - RNA, 16 nt, Human
cugcccucaagagcaa

SEQ ID NO: 3401050 - RNA, 23 nt, Human
cugcccucauuacugggccuuag

SEQ ID NO: 3401051 - RNA, 17 nt, Human
cugcccuccccagagca

SEQ ID NO: 3401052 - RNA, 16 nt, Human
cugcccuccugugcuc

SEQ ID NO: 3401053 - RNA, 22 nt, Human
cugcccuccugugcucagcccu

SEQ ID NO: 3401054 - RNA, 22 nt, Human
cugcccucgcacggccccgaag

SEQ ID NO: 3401055 - RNA, 16 nt, Human
cugcccucguggccag

SEQ ID NO: 3401056 - RNA, 17 nt, Human
cugcccucguggccagc

SEQ ID NO: 3401057 - RNA, 19 nt, Human
cugcccucguggccagccc

SEQ ID NO: 3401058 - RNA, 23 nt, Human
cugcccucguggccagcccggcu

SEQ ID NO: 3401059 - RNA, 16 nt, Human
cugcccucuccugggc

SEQ ID NO: 3401060 - RNA, 18 nt, Human
cugcccucuccugggcag

SEQ ID NO: 3401061 - RNA, 18 nt, Human
cugcccucuccuuccuua

SEQ ID NO: 3401062 - RNA, 17 nt, Human
cugcccucugcauccuc

SEQ ID NO: 3401063 - RNA, 17 nt, Human
cugcccugcacgucaug

SEQ ID NO: 3401064 - RNA, 11 nt, Human
cugcccugccc

SEQ ID NO: 3401065 - RNA, 13 nt, Human
cugcccugcccac

SEQ ID NO: 3401066 - RNA, 14 nt, Human
cugcccugcccacc

SEQ ID NO: 3401067 - RNA, 17 nt, Human
cugcccugccccaaguu

SEQ ID NO: 3401068 - RNA, 15 nt, Human
cugcccugcccugcc

SEQ ID NO: 3401069 - RNA, 12 nt, Human
cugcccugccug

SEQ ID NO: 3401070 - RNA, 16 nt, Human
cugcccugccugaggg

SEQ ID NO: 3401071 - RNA, 20 nt, Human
cugcccugcgggucacagga

SEQ ID NO: 3401072 - RNA, 11 nt, Human
cugcccugcug

SEQ ID NO: 3401073 - RNA, 17 nt, Human
cugcccuggcaggguca

SEQ ID NO: 3401074 - RNA, 12 nt, Human
cugcccuggccc

SEQ ID NO: 3401075 - RNA, 13 nt, Human
cugcccuggcccu

SEQ ID NO: 3401076 - RNA, 15 nt, Human
cugcccuggcccuga

SEQ ID NO: 3401077 - RNA, 23 nt, Human
cugcccuggcccugagguguggg

SEQ ID NO: 3401078 - RNA, 14 nt, Human
cugcccuggcugcu

SEQ ID NO: 3401079 - RNA, 20 nt, Human
cugcccuggcugcugccccc

SEQ ID NO: 3401080 - RNA, 15 nt, Human
cugcccugguccagg

SEQ ID NO: 3401081 - RNA, 23 nt, Human
cugcccugguccagggaagcugg

SEQ ID NO: 3401082 - RNA, 13 nt, Human
cugcccuggugcu

SEQ ID NO: 3401083 - RNA, 16 nt, Human
cugcccuggugcugcc

SEQ ID NO: 3401084 - RNA, 20 nt, Human
cugcccuggugcugccacac

SEQ ID NO: 3401085 - RNA, 21 nt, Human
cugcccuggugcugccacacu

SEQ ID NO: 3401086 - RNA, 23 nt, Human
cugcccuggugcugccacacuuc

SEQ ID NO: 3401087 - RNA, 18 nt, Human
cugcccugguggcccucu

SEQ ID NO: 3401088 - RNA, 18 nt, Human
cugcccugguuuccugcc

SEQ ID NO: 3401089 - RNA, 12 nt, Human
cugggcauugcu

SEQ ID NO: 3401090 - RNA, 14 nt, Human
cugggcauugcuuu

SEQ ID NO: 3401091 - RNA, 19 nt, Human
cugggccaagccagggaug

SEQ ID NO: 3401092 - RNA, 15 nt, Human
cugggccaaguuccu

SEQ ID NO: 3401093 - RNA, 20 nt, Human
cugggccaauucaauacaaa

SEQ ID NO: 3401094 - RNA, 19 nt, Human
cugggccagggucugugug

SEQ ID NO: 3401095 - RNA, 20 nt, Human
cugggccauucuccacagca

SEQ ID NO: 3401096 - RNA, 21 nt, Human
cugggccauucuccacagcaa

SEQ ID NO: 3401097 - RNA, 17 nt, Human
cugggcccacaaaggca

SEQ ID NO: 3401098 - RNA, 15 nt, Human
cugggcccagaggca

SEQ ID NO: 3401099 - RNA, 14 nt, Human
cugggccccagccc

SEQ ID NO: 3401100 - RNA, 16 nt, Human
cugggccccagcccac

SEQ ID NO: 3401101 - RNA, 18 nt, Human
cugggccccccagcucag

SEQ ID NO: 3401102 - RNA, 20 nt, Human
cugggccccccagcucaggg

SEQ ID NO: 3401103 - RNA, 12 nt, Human
cugggccccucc

SEQ ID NO: 3401104 - RNA, 16 nt, Human
cugggccccucccuac

SEQ ID NO: 3401105 - RNA, 17 nt, Human
cugggccccugccucuc

SEQ ID NO: 3401106 - RNA, 19 nt, Human
cugggccccugccucucug

SEQ ID NO: 3401107 - RNA, 20 nt, Human
cugggcccgacauggcuccg

SEQ ID NO: 3401108 - RNA, 14 nt, Human
cugggcccucucug

SEQ ID NO: 3401109 - RNA, 15 nt, Human
cugggcccucucugc

SEQ ID NO: 3401110 - RNA, 15 nt, Human
cugggcccucucuuc

SEQ ID NO: 3401111 - RNA, 11 nt, Human
cugggcccuga

SEQ ID NO: 3401112 - RNA, 22 nt, Human
cugggcccugagucugggcagc

SEQ ID NO: 3401113 - RNA, 16 nt, Human
cugggcccugggcugg

SEQ ID NO: 3401114 - RNA, 18 nt, Human
cugggcccugggcuggaa

SEQ ID NO: 3401115 - RNA, 18 nt, Human
cugggcccuggggccugu

SEQ ID NO: 3401116 - RNA, 17 nt, Human
cugggccggagggucag

SEQ ID NO: 3401117 - RNA, 20 nt, Human
cugggccgggacccagggcc

SEQ ID NO: 3401118 - RNA, 18 nt, Human
cugggccguaucuccggc

SEQ ID NO: 3401119 - RNA, 23 nt, Human
cugggccuauggagagcccuggg

SEQ ID NO: 3401120 - RNA, 14 nt, Human
cugggccugccuca

SEQ ID NO: 3401121 - RNA, 15 nt, Human
cugggccugccucac

SEQ ID NO: 3401122 - RNA, 19 nt, Human
cugggccugcugcugagaa

SEQ ID NO: 3401123 - RNA, 20 nt, Human
cugggccuggcagcucagcu

SEQ ID NO: 3401124 - RNA, 11 nt, Human
cugggccuggg

SEQ ID NO: 3401125 - RNA, 11 nt, Human
cugggccuggu

SEQ ID NO: 3401126 - RNA, 13 nt, Human
cugggccuggucu

SEQ ID NO: 3401127 - RNA, 14 nt, Human
cugggccuggucuc

SEQ ID NO: 3401128 - RNA, 16 nt, Human
cugggccuggucucac

SEQ ID NO: 3401129 - RNA, 23 nt, Human
cugggccuggucucacccuggag

SEQ ID NO: 3401130 - RNA, 19 nt, Human
cugggccuuggccuggagc

SEQ ID NO: 3401131 - RNA, 20 nt, Human
cugggccuuggccuggagca

SEQ ID NO: 3401132 - RNA, 15 nt, Human
cugggccuugggcuc

SEQ ID NO: 3401133 - RNA, 13 nt, Human
cugggcgacagag

SEQ ID NO: 3401134 - RNA, 14 nt, Human
cugggcgcuggucc

SEQ ID NO: 3401135 - RNA, 23 nt, Human
cugggcguaguggcucacaccug

SEQ ID NO: 3401136 - RNA, 15 nt, Human
cugggcuaggggaca

SEQ ID NO: 3401137 - RNA, 20 nt, Human
cugggcuaggggacaucaga

SEQ ID NO: 3401138 - RNA, 22 nt, Human
cugggcuagguagaaaaagggu

SEQ ID NO: 3401139 - RNA, 12 nt, Human
cugggcucagug

SEQ ID NO: 3401140 - RNA, 16 nt, Human
cugggcucggaggcug

SEQ ID NO: 3401141 - RNA, 17 nt, Human
cugggcucgucuuugca

SEQ ID NO: 3401142 - RNA, 13 nt, Human
cugggcucuccac

SEQ ID NO: 3401143 - RNA, 16 nt, Human
cugggcucuccaccuc

SEQ ID NO: 3401144 - RNA, 21 nt, Human
cugggcucuccaccucagccu

SEQ ID NO: 3401145 - RNA, 20 nt, Human
cugggcucugccacccuacc

SEQ ID NO: 3401146 - RNA, 23 nt, Human
cugggcucugccccagcucuggc

SEQ ID NO: 3401147 - RNA, 15 nt, Human
cugggcucugggagc

SEQ ID NO: 3401148 - RNA, 14 nt, Human
cugggcucugguuu

SEQ ID NO: 3401149 - RNA, 14 nt, Human
cugggcucuguggg

SEQ ID NO: 3401150 - RNA, 22 nt, Human
cugggcucugugggcugcacuc

SEQ ID NO: 3401151 - RNA, 18 nt, Human
cugggcugaacacuccaa

SEQ ID NO: 3401152 - RNA, 19 nt, Human
cugggcugacugggccagg

SEQ ID NO: 3401153 - RNA, 18 nt, Human
cugggcugagccccuacc

SEQ ID NO: 3401154 - RNA, 19 nt, Human
cugggcugagccccuaccc

SEQ ID NO: 3401155 - RNA, 19 nt, Human
cugggcugagggagccugg

SEQ ID NO: 3401156 - RNA, 15 nt, Human
cugggcugcuggagg

SEQ ID NO: 3401157 - RNA, 18 nt, Human
cugggcuggaugagcucc

SEQ ID NO: 3401158 - RNA, 15 nt, Human
cugggcuggccaguu

SEQ ID NO: 3401159 - RNA, 18 nt, Human
cugggcuggcucccucuu

SEQ ID NO: 3401160 - RNA, 12 nt, Human
cugggcugggaa

SEQ ID NO: 3401161 - RNA, 13 nt, Human
cugggcugggcac

SEQ ID NO: 3401162 - RNA, 18 nt, Human
cugggcuggggaggaccu

SEQ ID NO: 3401163 - RNA, 21 nt, Human
cugggcugguggcucccggag

SEQ ID NO: 3401164 - RNA, 13 nt, Human
cugggcugugcua

SEQ ID NO: 3401165 - RNA, 15 nt, Human
cugggcugugggcaa

SEQ ID NO: 3401166 - RNA, 12 nt, Human
cugggcugugug

SEQ ID NO: 3401167 - RNA, 20 nt, Human
cugggcuuauaucuggccuc

SEQ ID NO: 3401168 - RNA, 15 nt, Human
cugggcuucaguggc

SEQ ID NO: 3401169 - RNA, 20 nt, Human
cugggcuucaguggcagcug

SEQ ID NO: 3401170 - RNA, 12 nt, Human
cugggcuuccug

SEQ ID NO: 3401171 - RNA, 16 nt, Human
cugggcuuccuggagc

SEQ ID NO: 3401172 - RNA, 13 nt, Human
cugggcuuggccu

SEQ ID NO: 3401173 - RNA, 14 nt, Human
cugggcuuggccug

SEQ ID NO: 3401174 - RNA, 16 nt, Human
cugggcuuggccugcu

SEQ ID NO: 3401175 - RNA, 13 nt, Human
cugggcuugggga

SEQ ID NO: 3401176 - RNA, 17 nt, Human
cugggcuuggggaccag

SEQ ID NO: 3401177 - RNA, 20 nt, Human
cugggcuuggggcuuccuaa

SEQ ID NO: 3401178 - RNA, 20 nt, Human
cugggcuuugauuccaucuc

SEQ ID NO: 3401179 - RNA, 21 nt, Human
cugggcuuuuguuuugcuuuu

SEQ ID NO: 3401180 - RNA, 23 nt, Human
cugggcuuuuuuuuucucuuucu

SEQ ID NO: 3401181 - RNA, 20 nt, Human
cuggggaaaacuccaccuuc

SEQ ID NO: 3401182 - RNA, 20 nt, Human
cuggggaaacaacauuuaua

SEQ ID NO: 3401183 - RNA, 17 nt, Human
cuggggaaacuggccau

SEQ ID NO: 3401184 - RNA, 19 nt, Human
cuggggaaacuggccaugg

SEQ ID NO: 3401185 - RNA, 16 nt, Human
cuggggaagacagugg

SEQ ID NO: 3401186 - RNA, 19 nt, Human
cuggggacagguccucagu

SEQ ID NO: 3401187 - RNA, 22 nt, Human
cuggggaccagcuuggcucagg

SEQ ID NO: 3401188 - RNA, 18 nt, Human
cuggggacuuggccucuc

SEQ ID NO: 3401189 - RNA, 17 nt, Human
cuggggacuugugucug

SEQ ID NO: 3401190 - RNA, 18 nt, Human
cuggggacuugugucugc

SEQ ID NO: 3401191 - RNA, 15 nt, Human
cuggggagcaggcag

SEQ ID NO: 3401192 - RNA, 21 nt, Human
cuggggagcaggcagccagca

SEQ ID NO: 3401193 - RNA, 15 nt, Human
cuggggagcccgucu

SEQ ID NO: 3401194 - RNA, 12 nt, Human
cuggggaggagc

SEQ ID NO: 3401195 - RNA, 20 nt, Human
cuggggauccccgccuggcc

SEQ ID NO: 3401196 - RNA, 22 nt, Human
cuggggauccccgccuggccag

SEQ ID NO: 3401197 - RNA, 22 nt, Human
cuggggaugucucucaugacca

SEQ ID NO: 3401198 - RNA, 15 nt, Human
cuggggaugugggag

SEQ ID NO: 3401199 - RNA, 22 nt, Human
cuggggauugggccccugccag

SEQ ID NO: 3401200 - RNA, 16 nt, Human
cuggggcaagucccug

SEQ ID NO: 3401201 - RNA, 21 nt, Human
cuggggcacaguccaggaaca

SEQ ID NO: 3401202 - RNA, 22 nt, Human
cuggggcagcacccuauaaauc

SEQ ID NO: 3401203 - RNA, 14 nt, Human
cuggggcaggcugc

SEQ ID NO: 3401204 - RNA, 14 nt, Human
cuggggcaggcugg

SEQ ID NO: 3401205 - RNA, 15 nt, Human
cuggggcaggcuggg

SEQ ID NO: 3401206 - RNA, 18 nt, Human
cuggggcaggcugggcca

SEQ ID NO: 3401207 - RNA, 21 nt, Human
cuggggcaggcugggccaugu

SEQ ID NO: 3401208 - RNA, 15 nt, Human
cuggggcagucaccu

SEQ ID NO: 3401209 - RNA, 17 nt, Human
cuggggcauggaaggca

SEQ ID NO: 3401210 - RNA, 14 nt, Human
cuggggccaggccg

SEQ ID NO: 3401211 - RNA, 15 nt, Human
cuggggccaggcugg

SEQ ID NO: 3401212 - RNA, 22 nt, Human
cuggggccaggcugggucgccc

SEQ ID NO: 3401213 - RNA, 13 nt, Human
cuggggccccacc

SEQ ID NO: 3401214 - RNA, 12 nt, Human
cuggggccccuu

SEQ ID NO: 3401215 - RNA, 16 nt, Human
cuggggccgaaagaac

SEQ ID NO: 3401216 - RNA, 22 nt, Human
cuggggccuaucagugugcccc

SEQ ID NO: 3401217 - RNA, 23 nt, Human
cuggggccucggagccucauccg

SEQ ID NO: 3401218 - RNA, 12 nt, Human
cuggggccucuu

SEQ ID NO: 3401219 - RNA, 13 nt, Human
cuggggccugaga

SEQ ID NO: 3401220 - RNA, 15 nt, Human
cuggggccugagaga

SEQ ID NO: 3401221 - RNA, 16 nt, Human
cuggggccugagagaa

SEQ ID NO: 3401222 - RNA, 17 nt, Human
cuggggccugagagaau

SEQ ID NO: 3401223 - RNA, 16 nt, Human
cuggggccuggaccug

SEQ ID NO: 3401224 - RNA, 17 nt, Human
cuggggccuggaccugc

SEQ ID NO: 3401225 - RNA, 18 nt, Human
cuggggccuggaccugcc

SEQ ID NO: 3401226 - RNA, 19 nt, Human
cuggggccuggaccugccu

SEQ ID NO: 3401227 - RNA, 13 nt, Human
cuggggccuggca

SEQ ID NO: 3401228 - RNA, 18 nt, Human
cuggggccuggcagggag

SEQ ID NO: 3401229 - RNA, 12 nt, Human
cuggggccuggg

SEQ ID NO: 3401230 - RNA, 13 nt, Human
cuggggccuggga

SEQ ID NO: 3401231 - RNA, 15 nt, Human
cuggggccugggaca

SEQ ID NO: 3401232 - RNA, 14 nt, Human
cuggggcgugggga

SEQ ID NO: 3401233 - RNA, 18 nt, Human
cuggggcuagggggagcc

SEQ ID NO: 3401234 - RNA, 16 nt, Human
cuggggcucagagccg

SEQ ID NO: 3401235 - RNA, 15 nt, Human
cugguauuaaaugcc

SEQ ID NO: 3401236 - RNA, 15 nt, Human
cugguauuccugccu

SEQ ID NO: 3401237 - RNA, 19 nt, Human
cugguauucuguucuggag

SEQ ID NO: 3401238 - RNA, 12 nt, Human
cugguauuuccu

SEQ ID NO: 3401239 - RNA, 18 nt, Human
cuggucaaacaaacucuc

SEQ ID NO: 3401240 - RNA, 13 nt, Human
cuggucaaagaaa

SEQ ID NO: 3401241 - RNA, 20 nt, Human
cuggucaacuugagcauguu

SEQ ID NO: 3401242 - RNA, 16 nt, Human
cuggucacagccuccu

SEQ ID NO: 3401243 - RNA, 19 nt, Human
cuggucacagccuccucug

SEQ ID NO: 3401244 - RNA, 23 nt, Human
cuggucacaggacucugccuccu

SEQ ID NO: 3401245 - RNA, 23 nt, Human
cuggucacagggcaugccccggc

SEQ ID NO: 3401246 - RNA, 16 nt, Human
cuggucaccuaggaag

SEQ ID NO: 3401247 - RNA, 22 nt, Human
cuggucacugccauggaggcac

SEQ ID NO: 3401248 - RNA, 12 nt, Human
cuggucagccca

SEQ ID NO: 3401249 - RNA, 13 nt, Human
cuggucagcccaa

SEQ ID NO: 3401250 - RNA, 15 nt, Human
cugguccaaaagauu

SEQ ID NO: 3401251 - RNA, 22 nt, Human
cugguccaaaagauugcugaaa

SEQ ID NO: 3401252 - RNA, 16 nt, Human
cugguccacagggcac

SEQ ID NO: 3401253 - RNA, 14 nt, Human
cugguccagggcua

SEQ ID NO: 3401254 - RNA, 18 nt, Human
cugguccauagagagcaa

SEQ ID NO: 3401255 - RNA, 17 nt, Human
cugguccaucugguuuu

SEQ ID NO: 3401256 - RNA, 17 nt, Human
cugguccaugauggagu

SEQ ID NO: 3401257 - RNA, 14 nt, Human
cuggucccacucag

SEQ ID NO: 3401258 - RNA, 18 nt, Human
cuggucccacucagucca

SEQ ID NO: 3401259 - RNA, 17 nt, Human
cugguccccuccuuccc

SEQ ID NO: 3401260 - RNA, 20 nt, Human
cuggucccggggccagcacu

SEQ ID NO: 3401261 - RNA, 15 nt, Human
cuggucccugggagg

SEQ ID NO: 3401262 - RNA, 21 nt, Human
cuggucccuugcagcuaguuu

SEQ ID NO: 3401263 - RNA, 22 nt, Human
cuggucccuuguauccccugca

SEQ ID NO: 3401264 - RNA, 24 nt, Human
cuggucccuuguauccccugcagg

SEQ ID NO: 3401265 - RNA, 22 nt, Human
cugguccggacacuccuagaga

SEQ ID NO: 3401266 - RNA, 15 nt, Human
cugguccgugggacg

SEQ ID NO: 3401267 - RNA, 16 nt, Human
cugguccgugggacgg

SEQ ID NO: 3401268 - RNA, 21 nt, Human
cugguccgugggacggugccc

SEQ ID NO: 3401269 - RNA, 16 nt, Human
cugguccuacccaucc

SEQ ID NO: 3401270 - RNA, 21 nt, Human
cugguccuauggccucauguu

SEQ ID NO: 3401271 - RNA, 16 nt, Human
cugguccugagggucc

SEQ ID NO: 3401272 - RNA, 14 nt, Human
cuggucgcuccugc

SEQ ID NO: 3401273 - RNA, 15 nt, Human
cuggucgcuccugcc

SEQ ID NO: 3401274 - RNA, 16 nt, Human
cuggucgcuccugccc

SEQ ID NO: 3401275 - RNA, 18 nt, Human
cuggucgcuccugcccac

SEQ ID NO: 3401276 - RNA, 19 nt, Human
cuggucuauaccuuaagaa

SEQ ID NO: 3401277 - RNA, 17 nt, Human
cuggucucacccuggag

SEQ ID NO: 3401278 - RNA, 17 nt, Human
cuggucuccucagccuc

SEQ ID NO: 3401279 - RNA, 17 nt, Human
cuggucucuaggcuggg

SEQ ID NO: 3401280 - RNA, 21 nt, Human
cuggucugguugggcagccag

SEQ ID NO: 3401281 - RNA, 21 nt, Human
cuggucuugaaguccuggcuu

SEQ ID NO: 3401282 - RNA, 15 nt, Human
cuggucuuguaagag

SEQ ID NO: 3401283 - RNA, 15 nt, Human
cuggucuuuccucug

SEQ ID NO: 3401284 - RNA, 15 nt, Human
cuggugaagcucacu

SEQ ID NO: 3401285 - RNA, 16 nt, Human
cuggugaauauuuuca

SEQ ID NO: 3401286 - RNA, 15 nt, Human
cuggugacaccagcc

SEQ ID NO: 3401287 - RNA, 23 nt, Human
cuggugaccccuuuucagcuucu

SEQ ID NO: 3401288 - RNA, 22 nt, Human
cuggugaccuuccaagagccug

SEQ ID NO: 3401289 - RNA, 21 nt, Human
cuggugacugcgaucuucaga

SEQ ID NO: 3401290 - RNA, 15 nt, Human
cuggugacuuuccuc

SEQ ID NO: 3401291 - RNA, 23 nt, Human
cuggugacuuuccucuuuggucu

SEQ ID NO: 3401292 - RNA, 13 nt, Human
cuggugagcauua

SEQ ID NO: 3401293 - RNA, 19 nt, Human
cuggugaggaagcuccagu

SEQ ID NO: 3401294 - RNA, 14 nt, Human
cuggugaggagcac

SEQ ID NO: 3401295 - RNA, 23 nt, Human
cuggugagucuuggcggcagcag

SEQ ID NO: 3401296 - RNA, 21 nt, Human
cuggugaucacguggucacgg

SEQ ID NO: 3401297 - RNA, 19 nt, Human
cuggugaugcgcaguugcu

SEQ ID NO: 3401298 - RNA, 14 nt, Human
cuggugcagggccu

SEQ ID NO: 3401299 - RNA, 20 nt, Human
cuggugccaauuucaaguuc

SEQ ID NO: 3401300 - RNA, 23 nt, Human
cuggugcccuaaccucugaguca

SEQ ID NO: 3401301 - RNA, 21 nt, Human
cuggugcccugcuuucagaua

SEQ ID NO: 3401302 - RNA, 23 nt, Human
cuggugcccugcuuucagauacu

SEQ ID NO: 3401303 - RNA, 21 nt, Human
cuggugcccuggaugcccagg

SEQ ID NO: 3401304 - RNA, 12 nt, Human
cuggugccucac

SEQ ID NO: 3401305 - RNA, 16 nt, Human
cuggugcgaauggacu

SEQ ID NO: 3401306 - RNA, 15 nt, Human
cuggugcggcuggcc

SEQ ID NO: 3401307 - RNA, 16 nt, Human
cuggugcucucugcca

SEQ ID NO: 3401308 - RNA, 14 nt, Human
cuggugcugccucu

SEQ ID NO: 3401309 - RNA, 12 nt, Human
cuggugcugcug

SEQ ID NO: 3401310 - RNA, 14 nt, Human
cuggugcugcugcu

SEQ ID NO: 3401311 - RNA, 16 nt, Human
cuggugcuguggccag

SEQ ID NO: 3401312 - RNA, 18 nt, Human
cuggugcuguggccaggg

SEQ ID NO: 3401313 - RNA, 19 nt, Human
cuggugcuguggccagggu

SEQ ID NO: 3401314 - RNA, 19 nt, Human
cuggugcuuaugcucuuaa

SEQ ID NO: 3401315 - RNA, 21 nt, Human
cuggugcuucuccucuccuag

SEQ ID NO: 3401316 - RNA, 15 nt, Human
cugguggacaguccu

SEQ ID NO: 3401317 - RNA, 18 nt, Human
cugguggacaguccuggg

SEQ ID NO: 3401318 - RNA, 14 nt, Human
cugguggcacagga

SEQ ID NO: 3401319 - RNA, 13 nt, Human
cugguggcagcuc

SEQ ID NO: 3401320 - RNA, 14 nt, Human
cugguggcagcuca

SEQ ID NO: 3401321 - RNA, 18 nt, Human
cugguggcagcucaccuc

SEQ ID NO: 3401322 - RNA, 20 nt, Human
cugguggcagcucaccucuc

SEQ ID NO: 3401323 - RNA, 21 nt, Human
cugguggcagcucaccucucc

SEQ ID NO: 3401324 - RNA, 23 nt, Human
cugguggcagcucaccucucccu

SEQ ID NO: 3401325 - RNA, 14 nt, Human
cugguggcagcugc

SEQ ID NO: 3401326 - RNA, 16 nt, Human
cugguggcaggggcuu

SEQ ID NO: 3401327 - RNA, 15 nt, Human
cugguggccccugcc

SEQ ID NO: 3401328 - RNA, 22 nt, Human
cugguggcccucuccccugccc

SEQ ID NO: 3401329 - RNA, 22 nt, Human
cuggugggcaccaagagccaau

SEQ ID NO: 3401330 - RNA, 13 nt, Human
cuggugggccaac

SEQ ID NO: 3401331 - RNA, 20 nt, Human
cugguggggcagcuccucug

SEQ ID NO: 3401332 - RNA, 22 nt, Human
cugguggguccaggggccccuc

SEQ ID NO: 3401333 - RNA, 20 nt, Human
cuggugggugaaagaaauca

SEQ ID NO: 3401334 - RNA, 18 nt, Human
cugguggucuguuggcag

SEQ ID NO: 3401335 - RNA, 23 nt, Human
cuggugguucacucuuggagccu

SEQ ID NO: 3401336 - RNA, 15 nt, Human
cuggugguugcuguu

SEQ ID NO: 3401337 - RNA, 16 nt, Human
cuggugguuucacggu

SEQ ID NO: 3401338 - RNA, 15 nt, Human
cugguguagcuacag

SEQ ID NO: 3401339 - RNA, 18 nt, Human
cugguguagcuacagaga

SEQ ID NO: 3401340 - RNA, 16 nt, Human
cugguguccagcugag

SEQ ID NO: 3401341 - RNA, 13 nt, Human
cugguguccugac

SEQ ID NO: 3401342 - RNA, 18 nt, Human
cugguguccugaccaccc

SEQ ID NO: 3401343 - RNA, 16 nt, Human
cuggugugguacagag

SEQ ID NO: 3401344 - RNA, 15 nt, Human
cugguguuaacagaa

SEQ ID NO: 3401345 - RNA, 17 nt, Human
cugguguuaacagaagg

SEQ ID NO: 3401346 - RNA, 22 nt, Human
cugguguuucuagcacuggccu

SEQ ID NO: 3401347 - RNA, 19 nt, Human
cugguuaaauaaggcaggg

SEQ ID NO: 3401348 - RNA, 20 nt, Human
cugguuaacuuguuuggccu

SEQ ID NO: 3401349 - RNA, 23 nt, Human
cugguuaauauuuauaggucacu

SEQ ID NO: 3401350 - RNA, 14 nt, Human
cugguuagaaaugc

SEQ ID NO: 3401351 - RNA, 21 nt, Human
cugguuagagguucccuuuga

SEQ ID NO: 3401352 - RNA, 22 nt, Human
cugguuagagguucccuuugac

SEQ ID NO: 3401353 - RNA, 14 nt, Human
cugguuagcucagc

SEQ ID NO: 3401354 - RNA, 21 nt, Human
cugguuagcucagccccagcc

SEQ ID NO: 3401355 - RNA, 16 nt, Human
cugguuaggauggcag

SEQ ID NO: 3401356 - RNA, 16 nt, Human
cugguuauaagcagca

SEQ ID NO: 3401357 - RNA, 20 nt, Human
cugguuauugauguggcccu

SEQ ID NO: 3401358 - RNA, 17 nt, Human
cugguuauuuaaaaugu

SEQ ID NO: 3401359 - RNA, 20 nt, Human
cugguucauucuucagauau

SEQ ID NO: 3401360 - RNA, 17 nt, Human
cugguuccggaauccug

SEQ ID NO: 3401361 - RNA, 18 nt, Human
cugguuccggaauccugu

SEQ ID NO: 3401362 - RNA, 18 nt, Human
cugguuccugcuagaaau

SEQ ID NO: 3401363 - RNA, 17 nt, Human
cugguucuauuuaaugg

SEQ ID NO: 3401364 - RNA, 13 nt, Human
cugguucucaaug

SEQ ID NO: 3401365 - RNA, 18 nt, Human
cugguucucaaugaaaaa

SEQ ID NO: 3401366 - RNA, 15 nt, Human
cugguucucaucuuu

SEQ ID NO: 3401367 - RNA, 22 nt, Human
cugguucuucauuuauugagca

SEQ ID NO: 3401368 - RNA, 22 nt, Human
cugguugcauggaaaucagcca

SEQ ID NO: 3401369 - RNA, 23 nt, Human
cugguuggagagcuagaaccugg

SEQ ID NO: 3401370 - RNA, 13 nt, Human
cugguugggcagc

SEQ ID NO: 3401371 - RNA, 20 nt, Human
cugguugguguugcagaagg

SEQ ID NO: 3401372 - RNA, 19 nt, Human
cugguuguuucuguuccaa

SEQ ID NO: 3401373 - RNA, 14 nt, Human
cugguuuaauguuu

SEQ ID NO: 3401374 - RNA, 17 nt, Human
cugguuuacaggcccug

SEQ ID NO: 3401375 - RNA, 21 nt, Human
cugguuuacaggcccugcucc

SEQ ID NO: 3401376 - RNA, 22 nt, Human
cugguuuacaggcccugcuccu

SEQ ID NO: 3401377 - RNA, 17 nt, Human
cugguuucacuggccca

SEQ ID NO: 3401378 - RNA, 18 nt, Human
cugguuuccugcccuggg

SEQ ID NO: 3401379 - RNA, 19 nt, Human
cugucacuuugcucugggu

SEQ ID NO: 3401380 - RNA, 17 nt, Human
cugucagaaugcuauug

SEQ ID NO: 3401381 - RNA, 18 nt, Human
cugucagauccaggagcu

SEQ ID NO: 3401382 - RNA, 18 nt, Human
cugucagaugagaacaaa

SEQ ID NO: 3401383 - RNA, 21 nt, Human
cugucagaugggaagacauga

SEQ ID NO: 3401384 - RNA, 12 nt, Human
cugucagcauga

SEQ ID NO: 3401385 - RNA, 15 nt, Human
cugucagcaugaauu

SEQ ID NO: 3401386 - RNA, 18 nt, Human
cugucagccauuccuguu

SEQ ID NO: 3401387 - RNA, 13 nt, Human
cugucagccgggc

SEQ ID NO: 3401388 - RNA, 23 nt, Human
cugucagcuccccucggagaaga

SEQ ID NO: 3401389 - RNA, 13 nt, Human
cugucaggaagaa

SEQ ID NO: 3401390 - RNA, 16 nt, Human
cugucaggagagcagc

SEQ ID NO: 3401391 - RNA, 19 nt, Human
cugucaggcugaaaacaau

SEQ ID NO: 3401392 - RNA, 16 nt, Human
cugucaguaugacauu

SEQ ID NO: 3401393 - RNA, 15 nt, Human
cugucagucacagcc

SEQ ID NO: 3401394 - RNA, 18 nt, Human
cugucagucacagccacc

SEQ ID NO: 3401395 - RNA, 14 nt, Human
cugucagugccgcc

SEQ ID NO: 3401396 - RNA, 19 nt, Human
cugucauaagaaugaauaa

SEQ ID NO: 3401397 - RNA, 23 nt, Human
cugucaucaauuaaaggcaaagg

SEQ ID NO: 3401398 - RNA, 21 nt, Human
cugucaucaucauggccagcu

SEQ ID NO: 3401399 - RNA, 20 nt, Human
cugucauccucaaagaaagu

SEQ ID NO: 3401400 - RNA, 21 nt, Human
cugucaucuaccuuuucucuu

SEQ ID NO: 3401401 - RNA, 16 nt, Human
cugucaucugagaaug

SEQ ID NO: 3401402 - RNA, 19 nt, Human
cugucaucugagaaugaac

SEQ ID NO: 3401403 - RNA, 20 nt, Human
cugucaugaaaucagcaaga

SEQ ID NO: 3401404 - RNA, 15 nt, Human
cugucaugaacaugu

SEQ ID NO: 3401405 - RNA, 14 nt, Human
cugucaugcuucau

SEQ ID NO: 3401406 - RNA, 22 nt, Human
cugucaugguguccagacagag

SEQ ID NO: 3401407 - RNA, 14 nt, Human
cugucauucaaaug

SEQ ID NO: 3401408 - RNA, 17 nt, Human
cugucauucaaaugggu

SEQ ID NO: 3401409 - RNA, 14 nt, Human
cugucauugcuucu

SEQ ID NO: 3401410 - RNA, 20 nt, Human
cuguccaaaggaggcuggca

SEQ ID NO: 3401411 - RNA, 21 nt, Human
cuguccaaaggaggcuggcag

SEQ ID NO: 3401412 - RNA, 11 nt, Human
cuguccaagga

SEQ ID NO: 3401413 - RNA, 20 nt, Human
cuguccacacccagcucagc

SEQ ID NO: 3401414 - RNA, 17 nt, Human
cuguccacaggcuucug

SEQ ID NO: 3401415 - RNA, 17 nt, Human
cuguccagacagccugu

SEQ ID NO: 3401416 - RNA, 17 nt, Human
cuguccaggcacugcug

SEQ ID NO: 3401417 - RNA, 22 nt, Human
cuguccaggcacugcugcccag

SEQ ID NO: 3401418 - RNA, 13 nt, Human
cuguccaggcucg

SEQ ID NO: 3401419 - RNA, 18 nt, Human
cuguccagggcccugagc

SEQ ID NO: 3401420 - RNA, 19 nt, Human
cuguccagggcccugagcu

SEQ ID NO: 3401421 - RNA, 22 nt, Human
cuguccagggcccugagcucgg

SEQ ID NO: 3401422 - RNA, 23 nt, Human
cuguccagggcccugagcucggu

SEQ ID NO: 3401423 - RNA, 15 nt, Human
cuguccagugcccau

SEQ ID NO: 3401424 - RNA, 14 nt, Human
cuguccaguuccca

SEQ ID NO: 3401425 - RNA, 19 nt, Human
cuguccaguucccagaagg

SEQ ID NO: 3401426 - RNA, 21 nt, Human
cuguccaguucccagaaggca

SEQ ID NO: 3401427 - RNA, 20 nt, Human
cuguccaguuccuuuagaaa

SEQ ID NO: 3401428 - RNA, 13 nt, Human
cuguccaucugcc

SEQ ID NO: 3401429 - RNA, 17 nt, Human
cuguccaucugcccgcc

SEQ ID NO: 3401430 - RNA, 17 nt, Human
cuguccauuuuuauuca

SEQ ID NO: 3401431 - RNA, 13 nt, Human
cugucccaccuca

SEQ ID NO: 3401432 - RNA, 13 nt, Human
cugucccaccucu

SEQ ID NO: 3401433 - RNA, 14 nt, Human
cugucccaccucuu

SEQ ID NO: 3401434 - RNA, 23 nt, Human
cugucccaccucuucucuuccug

SEQ ID NO: 3401435 - RNA, 19 nt, Human
cugucccagguuaucuggg

SEQ ID NO: 3401436 - RNA, 22 nt, Human
cugucccagguuaucugggcau

SEQ ID NO: 3401437 - RNA, 14 nt, Human
cugucccauucccu

SEQ ID NO: 3401438 - RNA, 12 nt, Human
cuguccccagcc

SEQ ID NO: 3401439 - RNA, 18 nt, Human
cugucccccagcucuggu

SEQ ID NO: 3401440 - RNA, 13 nt, Human
cuguccccccacu

SEQ ID NO: 3401441 - RNA, 16 nt, Human
cuguccccccacuccc

SEQ ID NO: 3401442 - RNA, 21 nt, Human
cuguccccccacucccucaca

SEQ ID NO: 3401443 - RNA, 13 nt, Human
cugucccccugac

SEQ ID NO: 3401444 - RNA, 14 nt, Human
cugucccccugaca

SEQ ID NO: 3401445 - RNA, 20 nt, Human
cuguccccucagcuccagac

SEQ ID NO: 3401446 - RNA, 17 nt, Human
cuguccccucuugcccc

SEQ ID NO: 3401447 - RNA, 22 nt, Human
cuguccccuggggucucugcug

SEQ ID NO: 3401448 - RNA, 23 nt, Human
cuguccccuucucucaucucuua

SEQ ID NO: 3401449 - RNA, 15 nt, Human
cuguccccuuggcag

SEQ ID NO: 3401450 - RNA, 18 nt, Human
cugucccgggguccugug

SEQ ID NO: 3401451 - RNA, 21 nt, Human
cugucccuaguaaaaauacaa

SEQ ID NO: 3401452 - RNA, 16 nt, Human
cugucccucacagcac

SEQ ID NO: 3401453 - RNA, 12 nt, Human
cugucccucacu

SEQ ID NO: 3401454 - RNA, 13 nt, Human
cugucccucacug

SEQ ID NO: 3401455 - RNA, 16 nt, Human
cugucccucccaccuc

SEQ ID NO: 3401456 - RNA, 19 nt, Human
cugucccucccaccucugu

SEQ ID NO: 3401457 - RNA, 21 nt, Human
cugucccucccaccucuguga

SEQ ID NO: 3401458 - RNA, 17 nt, Human
cugucccuccgggaccu

SEQ ID NO: 3401459 - RNA, 14 nt, Human
cugucccuccuggu

SEQ ID NO: 3401460 - RNA, 19 nt, Human
cugucccuccuggugucac

SEQ ID NO: 3401461 - RNA, 18 nt, Human
cugucccugcgccuuucc

SEQ ID NO: 3401462 - RNA, 20 nt, Human
cugucccuuacgugaguccu

SEQ ID NO: 3401463 - RNA, 19 nt, Human
cugucccuucccccauaag

SEQ ID NO: 3401464 - RNA, 14 nt, Human
cugucccuugcugu

SEQ ID NO: 3401465 - RNA, 23 nt, Human
cugucccuugcuugccugcaggg

SEQ ID NO: 3401466 - RNA, 22 nt, Human
cugucccuuggagcuguaaacc

SEQ ID NO: 3401467 - RNA, 17 nt, Human
cuguccgcccucuuccc

SEQ ID NO: 3401468 - RNA, 20 nt, Human
cuguccggaaugccacccac

SEQ ID NO: 3401469 - RNA, 22 nt, Human
cuguccguaguaucagagaugu

SEQ ID NO: 3401470 - RNA, 18 nt, Human
cuguccguuuacuccaag

SEQ ID NO: 3401471 - RNA, 14 nt, Human
cuguccuacccacc

SEQ ID NO: 3401472 - RNA, 18 nt, Human
cuguccuacucuguguca

SEQ ID NO: 3401473 - RNA, 13 nt, Human
cuguccucagccu

SEQ ID NO: 3401474 - RNA, 15 nt, Human
cuguccucagguggc

SEQ ID NO: 3401475 - RNA, 23 nt, Human
cuguccuccaacaccaagcacag

SEQ ID NO: 3401476 - RNA, 21 nt, Human
cuguccucccauccccuggac

SEQ ID NO: 3401477 - RNA, 12 nt, Human
cuguccuccucg

SEQ ID NO: 3401478 - RNA, 23 nt, Human
cuguccuccucggaucaccgaga

SEQ ID NO: 3401479 - RNA, 16 nt, Human
cuguccuccugguggg

SEQ ID NO: 3401480 - RNA, 20 nt, Human
cuguccucuccccuccagcc

SEQ ID NO: 3401481 - RNA, 13 nt, Human
cuguccucuuuca

SEQ ID NO: 3401482 - RNA, 19 nt, Human
cuguccucuuucagaaaac

SEQ ID NO: 3401483 - RNA, 19 nt, Human
cuguccucuuucagcuccu

SEQ ID NO: 3401484 - RNA, 15 nt, Human
cuguccugaaggccu

SEQ ID NO: 3401485 - RNA, 19 nt, Human
cuguccugaaggccugagg

SEQ ID NO: 3401486 - RNA, 20 nt, Human
cuguccugaaggccugaggu

SEQ ID NO: 3401487 - RNA, 16 nt, Human
cuguccugaucuguga

SEQ ID NO: 3401488 - RNA, 17 nt, Human
cuguccugauggucagc

SEQ ID NO: 3401489 - RNA, 19 nt, Human
cuguccugauggucagcuc

SEQ ID NO: 3401490 - RNA, 21 nt, Human
cuguccugauggucagcuccc

SEQ ID NO: 3401491 - RNA, 14 nt, Human
cuguccugcagcaa

SEQ ID NO: 3401492 - RNA, 23 nt, Human
cuguccugccacccagccccagc

SEQ ID NO: 3401493 - RNA, 12 nt, Human
cuguccugccua

SEQ ID NO: 3401494 - RNA, 13 nt, Human
cuguccugccugu

SEQ ID NO: 3401495 - RNA, 22 nt, Human
cuguccugcucauuaugccacu

SEQ ID NO: 3401496 - RNA, 17 nt, Human
cuguccugcuccacagu

SEQ ID NO: 3401497 - RNA, 13 nt, Human
cuguccugggagu

SEQ ID NO: 3401498 - RNA, 20 nt, Human
cuguccugggagugagcugg

SEQ ID NO: 3401499 - RNA, 13 nt, Human
cuguccugggccu

SEQ ID NO: 3401500 - RNA, 12 nt, Human
cuguccugggcg

SEQ ID NO: 3401501 - RNA, 19 nt, Human
cuguccuggugguauuuuc

SEQ ID NO: 3401502 - RNA, 21 nt, Human
cuguccuggugguauuuucaa

SEQ ID NO: 3401503 - RNA, 17 nt, Human
cuguccuggugucacuu

SEQ ID NO: 3401504 - RNA, 14 nt, Human
cuguccugucauca

SEQ ID NO: 3401505 - RNA, 14 nt, Human
cuguccugugaggu

SEQ ID NO: 3401506 - RNA, 16 nt, Human
cuguccugugagguuu

SEQ ID NO: 3401507 - RNA, 21 nt, Human
cuguccugugagguuucccaa

SEQ ID NO: 3401508 - RNA, 16 nt, Human
cuguccuucagaugga

SEQ ID NO: 3401509 - RNA, 23 nt, Human
cuguccuucucucaccuccuaaa

SEQ ID NO: 3401510 - RNA, 17 nt, Human
cuguccuuuuuccucuc

SEQ ID NO: 3401511 - RNA, 20 nt, Human
cuguccuuuuuccucuccac

SEQ ID NO: 3401512 - RNA, 14 nt, Human
cugucgagacacuu

SEQ ID NO: 3401513 - RNA, 18 nt, Human
cugucgagacacuugccu

SEQ ID NO: 3401514 - RNA, 16 nt, Human
cugucgcccaggcugg

SEQ ID NO: 3401515 - RNA, 17 nt, Human
cugucggagcccugucu

SEQ ID NO: 3401516 - RNA, 15 nt, Human
cugucgugauggggc

SEQ ID NO: 3401517 - RNA, 13 nt, Human
cugucuacaaaua

SEQ ID NO: 3401518 - RNA, 20 nt, Human
cugucuacacuaagagagaa

SEQ ID NO: 3401519 - RNA, 17 nt, Human
cugucuaccaucucccu

SEQ ID NO: 3401520 - RNA, 14 nt, Human
cugucuaccugguc

SEQ ID NO: 3401521 - RNA, 14 nt, Human
cugucuagagaggg

SEQ ID NO: 3401522 - RNA, 12 nt, Human
cugucuagagua

SEQ ID NO: 3401523 - RNA, 18 nt, Human
cugucuagcacuuccuug

SEQ ID NO: 3401524 - RNA, 17 nt, Human
cuucaacagcuccccau

SEQ ID NO: 3401525 - RNA, 16 nt, Human
cuucaacauccugcca

SEQ ID NO: 3401526 - RNA, 14 nt, Human
cuucaaccagggau

SEQ ID NO: 3401527 - RNA, 22 nt, Human
cuucaaccagggauuguuucug

SEQ ID NO: 3401528 - RNA, 16 nt, Human
cuucaacguuucuuca

SEQ ID NO: 3401529 - RNA, 19 nt, Human
cuucaacguuucuucacuu

SEQ ID NO: 3401530 - RNA, 16 nt, Human
cuucaacucccugccc

SEQ ID NO: 3401531 - RNA, 20 nt, Human
cuucaacugaccagccucca

SEQ ID NO: 3401532 - RNA, 18 nt, Human
cuucaagaacucugggcu

SEQ ID NO: 3401533 - RNA, 14 nt, Human
cuucaagaaugcag

SEQ ID NO: 3401534 - RNA, 13 nt, Human
cuucaaggauccu

SEQ ID NO: 3401535 - RNA, 15 nt, Human
cuucaaggauccuga

SEQ ID NO: 3401536 - RNA, 16 nt, Human
cuucaaggauccugag

SEQ ID NO: 3401537 - RNA, 18 nt, Human
cuucaaggauccugagcc

SEQ ID NO: 3401538 - RNA, 19 nt, Human
cuucaaggauccugagcca

SEQ ID NO: 3401539 - RNA, 20 nt, Human
cuucaaggauccugagccag

SEQ ID NO: 3401540 - RNA, 16 nt, Human
cuucaaggcuuccacu

SEQ ID NO: 3401541 - RNA, 16 nt, Human
cuucaagucugugccu

SEQ ID NO: 3401542 - RNA, 18 nt, Human
cuucaagucugugccugg

SEQ ID NO: 3401543 - RNA, 22 nt, Human
cuucaagugcaugcucucugca

SEQ ID NO: 3401544 - RNA, 18 nt, Human
cuucaaguuagcucagga

SEQ ID NO: 3401545 - RNA, 19 nt, Human
cuucaaguuagcucaggag

SEQ ID NO: 3401546 - RNA, 22 nt, Human
cuucaauacccaaauccucucc

SEQ ID NO: 3401547 - RNA, 19 nt, Human
cuucaauaguucaaggaac

SEQ ID NO: 3401548 - RNA, 13 nt, Human
cuucaaucccagc

SEQ ID NO: 3401549 - RNA, 15 nt, Human
cuucaauuaauaaaa

SEQ ID NO: 3401550 - RNA, 16 nt, Human
cuucaauuccugggcc

SEQ ID NO: 3401551 - RNA, 21 nt, Human
cuucaauuuauaccucaauuu

SEQ ID NO: 3401552 - RNA, 15 nt, Human
cuucacaaagcccaa

SEQ ID NO: 3401553 - RNA, 17 nt, Human
cuucacaaagcccaagg

SEQ ID NO: 3401554 - RNA, 16 nt, Human
cuucacacacaggcaa

SEQ ID NO: 3401555 - RNA, 19 nt, Human
cuucacacagaccccucgc

SEQ ID NO: 3401556 - RNA, 12 nt, Human
cuucacacugca

SEQ ID NO: 3401557 - RNA, 21 nt, Human
cuucacacugcaagagccuug

SEQ ID NO: 3401558 - RNA, 11 nt, Human
cuucacagagu

SEQ ID NO: 3401559 - RNA, 22 nt, Human
cuucacagagugugcuggagga

SEQ ID NO: 3401560 - RNA, 19 nt, Human
cuucacaguagagccagcu

SEQ ID NO: 3401561 - RNA, 23 nt, Human
cuucacagugaucgaugauucag

SEQ ID NO: 3401562 - RNA, 20 nt, Human
cuucaccaucaauccugauu

SEQ ID NO: 3401563 - RNA, 15 nt, Human
cuucacccaggccua

SEQ ID NO: 3401564 - RNA, 15 nt, Human
cuucaccccggcagg

SEQ ID NO: 3401565 - RNA, 19 nt, Human
cuucaccccggcaggcccu

SEQ ID NO: 3401566 - RNA, 22 nt, Human
cuucaccccggcaggcccugca

SEQ ID NO: 3401567 - RNA, 20 nt, Human
cuucaccuaagucucuguga

SEQ ID NO: 3401568 - RNA, 14 nt, Human
cuucaccuccucgc

SEQ ID NO: 3401569 - RNA, 14 nt, Human
cuucaccucugcua

SEQ ID NO: 3401570 - RNA, 20 nt, Human
cuucacgaaguguugcaugg

SEQ ID NO: 3401571 - RNA, 20 nt, Human
cuucacuccagccuggguga

SEQ ID NO: 3401572 - RNA, 24 nt, Human
cuucacuccggugugccugcagcc

SEQ ID NO: 3401573 - RNA, 15 nt, Human
cuucacucucugaag

SEQ ID NO: 3401574 - RNA, 19 nt, Human
cuucacugccuuugcuccu

SEQ ID NO: 3401575 - RNA, 13 nt, Human
cuucacugugcug

SEQ ID NO: 3401576 - RNA, 15 nt, Human
cuucacuguugaaaa

SEQ ID NO: 3401577 - RNA, 20 nt, Human
cuucacuucugacucuuccc

SEQ ID NO: 3401578 - RNA, 21 nt, Human
cuucagaauuccauaucuugc

SEQ ID NO: 3401579 - RNA, 18 nt, Human
cuucagacuuugcuuccc

SEQ ID NO: 3401580 - RNA, 17 nt, Human
cuucagagacuccugca

SEQ ID NO: 3401581 - RNA, 23 nt, Human
cuucagagacuccugcaggcagc

SEQ ID NO: 3401582 - RNA, 18 nt, Human
cuucagagagcagugcuu

SEQ ID NO: 3401583 - RNA, 14 nt, Human
cuucagagagcugg

SEQ ID NO: 3401584 - RNA, 15 nt, Human
cuucagagagcuggu

SEQ ID NO: 3401585 - RNA, 21 nt, Human
cuucagaggcccucgcugcca

SEQ ID NO: 3401586 - RNA, 16 nt, Human
cuucagaggcugaggu

SEQ ID NO: 3401587 - RNA, 18 nt, Human
cuucagauauuauugcuu

SEQ ID NO: 3401588 - RNA, 17 nt, Human
cuucagaucagugcuug

SEQ ID NO: 3401589 - RNA, 15 nt, Human
cuucagauccuaccc

SEQ ID NO: 3401590 - RNA, 16 nt, Human
cuucagauccuacccc

SEQ ID NO: 3401591 - RNA, 23 nt, Human
cuucagaugggaggaaagagagc

SEQ ID NO: 3401592 - RNA, 22 nt, Human
cuucagauguggagccaggcgu

SEQ ID NO: 3401593 - RNA, 14 nt, Human
cuucagcaagagag

SEQ ID NO: 3401594 - RNA, 20 nt, Human
cuucagcaagagagaaccua

SEQ ID NO: 3401595 - RNA, 15 nt, Human
cuucagcacuuuaga

SEQ ID NO: 3401596 - RNA, 15 nt, Human
cuucagcauucccuc

SEQ ID NO: 3401597 - RNA, 15 nt, Human
cuucagccaggagcu

SEQ ID NO: 3401598 - RNA, 21 nt, Human
cuucagcccccagccccuccc

SEQ ID NO: 3401599 - RNA, 17 nt, Human
cuucagcccucaccccu

SEQ ID NO: 3401600 - RNA, 22 nt, Human
cuucagccuagccgaccucagc

SEQ ID NO: 3401601 - RNA, 19 nt, Human
cuucagccuaguggcuugu

SEQ ID NO: 3401602 - RNA, 20 nt, Human
cuucagccucccgaguagcu

SEQ ID NO: 3401603 - RNA, 16 nt, Human
cuucagccugaggcug

SEQ ID NO: 3401604 - RNA, 17 nt, Human
cuucagcguaaaauggu

SEQ ID NO: 3401605 - RNA, 20 nt, Human
cuucagcuagcuuuuaggaa

SEQ ID NO: 3401606 - RNA, 20 nt, Human
cuucagcucacgcuucacag

SEQ ID NO: 3401607 - RNA, 15 nt, Human
cuucagcuccagccc

SEQ ID NO: 3401608 - RNA, 23 nt, Human
cuucagcuccagggaauccaagc

SEQ ID NO: 3401609 - RNA, 13 nt, Human
cuucagcucugaa

SEQ ID NO: 3401610 - RNA, 14 nt, Human
cuucagcucugaaa

SEQ ID NO: 3401611 - RNA, 12 nt, Human
cuucagcucugu

SEQ ID NO: 3401612 - RNA, 15 nt, Human
cuucagcucuuuuug

SEQ ID NO: 3401613 - RNA, 14 nt, Human
cuucagcugccagu

SEQ ID NO: 3401614 - RNA, 13 nt, Human
cuucagcuucuuc

SEQ ID NO: 3401615 - RNA, 14 nt, Human
cuucagcuugcuuc

SEQ ID NO: 3401616 - RNA, 23 nt, Human
cuucaggaacacccccaugacau

SEQ ID NO: 3401617 - RNA, 16 nt, Human
cuucaggacacucacu

SEQ ID NO: 3401618 - RNA, 17 nt, Human
cuucaggaucaaguccu

SEQ ID NO: 3401619 - RNA, 12 nt, Human
cuucaggccucc

SEQ ID NO: 3401620 - RNA, 15 nt, Human
cuucaggccucccuc

SEQ ID NO: 3401621 - RNA, 15 nt, Human
cuucaggcucuucuc

SEQ ID NO: 3401622 - RNA, 15 nt, Human
cuucagggcagauuu

SEQ ID NO: 3401623 - RNA, 17 nt, Human
cuucagggcagauuuua

SEQ ID NO: 3401624 - RNA, 16 nt, Human
cuucagggcagggcuc

SEQ ID NO: 3401625 - RNA, 19 nt, Human
cuucagggcagggcucuga

SEQ ID NO: 3401626 - RNA, 14 nt, Human
cuucagggcaggug

SEQ ID NO: 3401627 - RNA, 13 nt, Human
cuucagggccugg

SEQ ID NO: 3401628 - RNA, 15 nt, Human
cuucagggccugguu

SEQ ID NO: 3401629 - RNA, 21 nt, Human
cuucaggggagucccgucagg

SEQ ID NO: 3401630 - RNA, 19 nt, Human
cuucaggggcacuucauug

SEQ ID NO: 3401631 - RNA, 14 nt, Human
cuucaggguucucc

SEQ ID NO: 3401632 - RNA, 18 nt, Human
cuucaggguucuccucuc

SEQ ID NO: 3401633 - RNA, 23 nt, Human
cuucaggguucuccucuccccuc

SEQ ID NO: 3401634 - RNA, 17 nt, Human
cuucagguccaggcugu

SEQ ID NO: 3401635 - RNA, 15 nt, Human
cuucagguucuuagu

SEQ ID NO: 3401636 - RNA, 19 nt, Human
cuucagguucuuaguguca

SEQ ID NO: 3401637 - RNA, 16 nt, Human
cuucaguaagccguga

SEQ ID NO: 3401638 - RNA, 19 nt, Human
cuucaguauguugucaaag

SEQ ID NO: 3401639 - RNA, 13 nt, Human
cuucagucauuaa

SEQ ID NO: 3401640 - RNA, 15 nt, Human
cuucagucauuaaau

SEQ ID NO: 3401641 - RNA, 22 nt, Human
cuucagucccuuccccaugcuu

SEQ ID NO: 3401642 - RNA, 11 nt, Human
cuucaguccug

SEQ ID NO: 3401643 - RNA, 12 nt, Human
cuucaguccugc

SEQ ID NO: 3401644 - RNA, 17 nt, Human
cuucaguccugcuccag

SEQ ID NO: 3401645 - RNA, 15 nt, Human
cuucaguccugggag

SEQ ID NO: 3401646 - RNA, 13 nt, Human
cuucagucucuau

SEQ ID NO: 3401647 - RNA, 17 nt, Human
cuucagucucuauacca

SEQ ID NO: 3401648 - RNA, 22 nt, Human
cuucagucucuauaccaauaaa

SEQ ID NO: 3401649 - RNA, 11 nt, Human
cuucagugccu

SEQ ID NO: 3401650 - RNA, 12 nt, Human
cuucagugccuu

SEQ ID NO: 3401651 - RNA, 14 nt, Human
cuucaguggcagcu

SEQ ID NO: 3401652 - RNA, 15 nt, Human
cuucaguggcagcug

SEQ ID NO: 3401653 - RNA, 17 nt, Human
cuucaguggcagcugcu

SEQ ID NO: 3401654 - RNA, 13 nt, Human
cuucagugggaga

SEQ ID NO: 3401655 - RNA, 18 nt, Human
cuucagugggagaaaaca

SEQ ID NO: 3401656 - RNA, 19 nt, Human
cuucaguuauugguggaau

SEQ ID NO: 3401657 - RNA, 17 nt, Human
cuucaguugucucugau

SEQ ID NO: 3401658 - RNA, 20 nt, Human
cuucaguugucucugaugca

SEQ ID NO: 3401659 - RNA, 17 nt, Human
cuucaguuuccuggucu

SEQ ID NO: 3401660 - RNA, 16 nt, Human
cuucaguuugcagagu

SEQ ID NO: 3401661 - RNA, 16 nt, Human
cuucaguuuuuguguu

SEQ ID NO: 3401662 - RNA, 19 nt, Human
cuucauaacaauuuuagga

SEQ ID NO: 3401663 - RNA, 12 nt, Human
cuucauaaucca

SEQ ID NO: 3401664 - RNA, 10 nt, Human
cuucauacac

SEQ ID NO: 3401665 - RNA, 16 nt, Human
cuucauacuugaacgu

SEQ ID NO: 3401666 - RNA, 19 nt, Human
cuucauagagacuugggaa

SEQ ID NO: 3401667 - RNA, 21 nt, Human
cuucauaucauccacacauga

SEQ ID NO: 3401668 - RNA, 17 nt, Human
cuucaucauucccucuc

SEQ ID NO: 3401669 - RNA, 18 nt, Human
cuucaucauucccucuca

SEQ ID NO: 3401670 - RNA, 16 nt, Human
cuuccauggcccucau

SEQ ID NO: 3401671 - RNA, 19 nt, Human
cuuccauggcccucauuaa

SEQ ID NO: 3401672 - RNA, 15 nt, Human
cuuccauuccacaca

SEQ ID NO: 3401673 - RNA, 15 nt, Human
cuuccauuucugccu

SEQ ID NO: 3401674 - RNA, 20 nt, Human
cuuccauuucugccuuuugu

SEQ ID NO: 3401675 - RNA, 17 nt, Human
cuucccaacuugccuuu

SEQ ID NO: 3401676 - RNA, 23 nt, Human
cuucccaaguaagaggcuggagu

SEQ ID NO: 3401677 - RNA, 23 nt, Human
cuucccaagugagucucucuggg

SEQ ID NO: 3401678 - RNA, 15 nt, Human
cuucccaaucagcac

SEQ ID NO: 3401679 - RNA, 18 nt, Human
cuucccacaaagaauaua

SEQ ID NO: 3401680 - RNA, 21 nt, Human
cuucccacccaucgcugugug

SEQ ID NO: 3401681 - RNA, 16 nt, Human
cuucccaccucccugc

SEQ ID NO: 3401682 - RNA, 17 nt, Human
cuucccaccucccugcc

SEQ ID NO: 3401683 - RNA, 19 nt, Human
cuucccaccucccugccca

SEQ ID NO: 3401684 - RNA, 18 nt, Human
cuucccagaggggccugc

SEQ ID NO: 3401685 - RNA, 22 nt, Human
cuucccagaggggccugccacc

SEQ ID NO: 3401686 - RNA, 16 nt, Human
cuucccagcuaggaag

SEQ ID NO: 3401687 - RNA, 15 nt, Human
cuucccagcucuccc

SEQ ID NO: 3401688 - RNA, 22 nt, Human
cuucccagcucucccucuggcc

SEQ ID NO: 3401689 - RNA, 15 nt, Human
cuucccagcugcccc

SEQ ID NO: 3401690 - RNA, 16 nt, Human
cuucccagcugccccu

SEQ ID NO: 3401691 - RNA, 18 nt, Human
cuucccagcugccccucc

SEQ ID NO: 3401692 - RNA, 21 nt, Human
cuucccagcugccccucccug

SEQ ID NO: 3401693 - RNA, 22 nt, Human
cuucccagcugccccucccugc

SEQ ID NO: 3401694 - RNA, 22 nt, Human
cuucccaggcuggggcugaccu

SEQ ID NO: 3401695 - RNA, 12 nt, Human
cuucccagggca

SEQ ID NO: 3401696 - RNA, 21 nt, Human
cuucccagguaagcaggagga

SEQ ID NO: 3401697 - RNA, 20 nt, Human
cuucccauaccacccaaugc

SEQ ID NO: 3401698 - RNA, 17 nt, Human
cuucccaucacuggagc

SEQ ID NO: 3401699 - RNA, 18 nt, Human
cuucccaucacuggagca

SEQ ID NO: 3401700 - RNA, 15 nt, Human
cuucccauccccagc

SEQ ID NO: 3401701 - RNA, 21 nt, Human
cuucccaugacccaggcuggg

SEQ ID NO: 3401702 - RNA, 21 nt, Human
cuucccaugucuuucuccaaa

SEQ ID NO: 3401703 - RNA, 12 nt, Human
cuucccauucca

SEQ ID NO: 3401704 - RNA, 15 nt, Human
cuucccauuguggcu

SEQ ID NO: 3401705 - RNA, 16 nt, Human
cuuccccaaauaauau

SEQ ID NO: 3401706 - RNA, 18 nt, Human
cuuccccaacacgcagga

SEQ ID NO: 3401707 - RNA, 23 nt, Human
cuuccccacugcacacaccucag

SEQ ID NO: 3401708 - RNA, 16 nt, Human
cuuccccacugccugc

SEQ ID NO: 3401709 - RNA, 18 nt, Human
cuuccccagacgccuggc

SEQ ID NO: 3401710 - RNA, 21 nt, Human
cuuccccagacgccuggcugc

SEQ ID NO: 3401711 - RNA, 11 nt, Human
cuuccccauac

SEQ ID NO: 3401712 - RNA, 16 nt, Human
cuuccccauacaaaua

SEQ ID NO: 3401713 - RNA, 18 nt, Human
cuuccccaucuucuaaac

SEQ ID NO: 3401714 - RNA, 19 nt, Human
cuuccccauggcccugagc

SEQ ID NO: 3401715 - RNA, 15 nt, Human
cuucccccaccacca

SEQ ID NO: 3401716 - RNA, 14 nt, Human
cuucccccauagcc

SEQ ID NO: 3401717 - RNA, 12 nt, Human
cuucccccucca

SEQ ID NO: 3401718 - RNA, 16 nt, Human
cuucccccucccaggg

SEQ ID NO: 3401719 - RNA, 17 nt, Human
cuucccccucucccagu

SEQ ID NO: 3401720 - RNA, 18 nt, Human
cuucccccugcuuccacc

SEQ ID NO: 3401721 - RNA, 14 nt, Human
cuuccccucccugg

SEQ ID NO: 3401722 - RNA, 20 nt, Human
cuuccccucccuggcuccca

SEQ ID NO: 3401723 - RNA, 22 nt, Human
cuuccccuccuaccccucccag

SEQ ID NO: 3401724 - RNA, 23 nt, Human
cuuccccuccuaccccucccagc

SEQ ID NO: 3401725 - RNA, 18 nt, Human
cuuccccuuauccucccu

SEQ ID NO: 3401726 - RNA, 20 nt, Human
cuuccccuuauccucccugu

SEQ ID NO: 3401727 - RNA, 13 nt, Human
cuuccccuugccc

SEQ ID NO: 3401728 - RNA, 19 nt, Human
cuuccccuugcccagggcu

SEQ ID NO: 3401729 - RNA, 23 nt, Human
cuuccccuugcccagggcucagc

SEQ ID NO: 3401730 - RNA, 14 nt, Human
cuuccccuugcccu

SEQ ID NO: 3401731 - RNA, 13 nt, Human
cuuccccuuuccc

SEQ ID NO: 3401732 - RNA, 19 nt, Human
cuucccgccagagggcuug

SEQ ID NO: 3401733 - RNA, 20 nt, Human
cuucccgccgcccagcccac

SEQ ID NO: 3401734 - RNA, 17 nt, Human
cuucccgcucagcccuc

SEQ ID NO: 3401735 - RNA, 17 nt, Human
cuucccgggccagggcu

SEQ ID NO: 3401736 - RNA, 16 nt, Human
cuucccuaacacuuac

SEQ ID NO: 3401737 - RNA, 17 nt, Human
cuucccuaccucaggca

SEQ ID NO: 3401738 - RNA, 23 nt, Human
cuucccuagaggguuccuguaga

SEQ ID NO: 3401739 - RNA, 16 nt, Human
cuucccuagggcuggg

SEQ ID NO: 3401740 - RNA, 18 nt, Human
cuucccuagggcugggug

SEQ ID NO: 3401741 - RNA, 19 nt, Human
cuucccuccccucuaguuu

SEQ ID NO: 3401742 - RNA, 15 nt, Human
cuucccucccuaucu

SEQ ID NO: 3401743 - RNA, 18 nt, Human
cuucccucccugcuguca

SEQ ID NO: 3401744 - RNA, 16 nt, Human
cuucccuccucccaug

SEQ ID NO: 3401745 - RNA, 17 nt, Human
cuucccuccucccaugu

SEQ ID NO: 3401746 - RNA, 16 nt, Human
cuucccucucuggaga

SEQ ID NO: 3401747 - RNA, 21 nt, Human
cuucccucuguuucucuuucc

SEQ ID NO: 3401748 - RNA, 13 nt, Human
cuucccugaagcu

SEQ ID NO: 3401749 - RNA, 18 nt, Human
cuucccugaagcucccac

SEQ ID NO: 3401750 - RNA, 18 nt, Human
cuucccugauugaccugc

SEQ ID NO: 3401751 - RNA, 11 nt, Human
cuucccuggcg

SEQ ID NO: 3401752 - RNA, 11 nt, Human
cuucccuggcu

SEQ ID NO: 3401753 - RNA, 13 nt, Human
cuucccugggcug

SEQ ID NO: 3401754 - RNA, 17 nt, Human
cuucccugggcugugcu

SEQ ID NO: 3401755 - RNA, 13 nt, Human
cuucccugguuca

SEQ ID NO: 3401756 - RNA, 22 nt, Human
cuucccuguaugauuccuugau

SEQ ID NO: 3401757 - RNA, 13 nt, Human
cuucccugucccu

SEQ ID NO: 3401758 - RNA, 14 nt, Human
cuucccugucccuc

SEQ ID NO: 3401759 - RNA, 15 nt, Human
cuucccugucccucu

SEQ ID NO: 3401760 - RNA, 21 nt, Human
cuucccugugccuccucccuc

SEQ ID NO: 3401761 - RNA, 16 nt, Human
cuucccuuaaaauuua

SEQ ID NO: 3401762 - RNA, 16 nt, Human
cuucccuuccacugcc

SEQ ID NO: 3401763 - RNA, 14 nt, Human
cuucccuugccacu

SEQ ID NO: 3401764 - RNA, 17 nt, Human
cuucccuugccacuuug

SEQ ID NO: 3401765 - RNA, 20 nt, Human
cuucccuugccacuuugcac

SEQ ID NO: 3401766 - RNA, 21 nt, Human
cuucccuugcuaccacggccu

SEQ ID NO: 3401767 - RNA, 16 nt, Human
cuucccuuuccccagc

SEQ ID NO: 3401768 - RNA, 16 nt, Human
cuucccuuuucuguuc

SEQ ID NO: 3401769 - RNA, 23 nt, Human
cuuccgaaaaauccucuuccucu

SEQ ID NO: 3401770 - RNA, 13 nt, Human
cuuccgacccucu

SEQ ID NO: 3401771 - RNA, 15 nt, Human
cuuccgacccucugg

SEQ ID NO: 3401772 - RNA, 19 nt, Human
cuuccgacccucugggaac

SEQ ID NO: 3401773 - RNA, 21 nt, Human
cuuccgacccucugggaaccu

SEQ ID NO: 3401774 - RNA, 22 nt, Human
cuuccgauggaugaaucuccca

SEQ ID NO: 3401775 - RNA, 21 nt, Human
cuuccgcaguguggccaggcu

SEQ ID NO: 3401776 - RNA, 17 nt, Human
cuuccgcauccuagucu

SEQ ID NO: 3401777 - RNA, 16 nt, Human
cuuccgccacuggggc

SEQ ID NO: 3401778 - RNA, 14 nt, Human
cuuccggagaugua

SEQ ID NO: 3401779 - RNA, 20 nt, Human
cuuccgguagggaggcagcc

SEQ ID NO: 3401780 - RNA, 22 nt, Human
cuuccgguagggaggcagccuc

SEQ ID NO: 3401781 - RNA, 13 nt, Human
cuuccgucucccc

SEQ ID NO: 3401782 - RNA, 16 nt, Human
cuuccgucucccccgu

SEQ ID NO: 3401783 - RNA, 18 nt, Human
cuuccuaagccuguggcu

SEQ ID NO: 3401784 - RNA, 13 nt, Human
cuuccuaauucca

SEQ ID NO: 3401785 - RNA, 17 nt, Human
cuuccuaauuccacagc

SEQ ID NO: 3401786 - RNA, 22 nt, Human
cuuccuaauuucccuucuugca

SEQ ID NO: 3401787 - RNA, 23 nt, Human
cuuccuaauuucccuucuugcau

SEQ ID NO: 3401788 - RNA, 22 nt, Human
cuuccuacaagagcagccugug

SEQ ID NO: 3401789 - RNA, 24 nt, Human
cuuccuacaagagcagccuguggc

SEQ ID NO: 3401790 - RNA, 17 nt, Human
cuuccuaccaagucaaa

SEQ ID NO: 3401791 - RNA, 23 nt, Human
cuuccuaccacccgguccccacu

SEQ ID NO: 3401792 - RNA, 18 nt, Human
cuuccuacccacaccucu

SEQ ID NO: 3401793 - RNA, 15 nt, Human
cuuccuacucuucuc

SEQ ID NO: 3401794 - RNA, 21 nt, Human
cuuccuacucuucucucugcu

SEQ ID NO: 3401795 - RNA, 21 nt, Human
cuuccuagaaguuacugaaug

SEQ ID NO: 3401796 - RNA, 16 nt, Human
cuuccuaguucauccc

SEQ ID NO: 3401797 - RNA, 15 nt, Human
cuuccuaguuuucuc

SEQ ID NO: 3401798 - RNA, 15 nt, Human
cuuccuauaacuuga

SEQ ID NO: 3401799 - RNA, 17 nt, Human
cuuccuauaacuugaug

SEQ ID NO: 3401800 - RNA, 19 nt, Human
cuuccuauaacuugaugca

SEQ ID NO: 3401801 - RNA, 14 nt, Human
cuuccuaucccauc

SEQ ID NO: 3401802 - RNA, 16 nt, Human
cuuccuaucccauccc

SEQ ID NO: 3401803 - RNA, 17 nt, Human
cuuccuaucccauccca

SEQ ID NO: 3401804 - RNA, 18 nt, Human
cuuccuaucccaucccau

SEQ ID NO: 3401805 - RNA, 16 nt, Human
cuuccuauuucagaag

SEQ ID NO: 3401806 - RNA, 23 nt, Human
cuuccuauuucuagggcugggaa

SEQ ID NO: 3401807 - RNA, 13 nt, Human
cuuccucacugcc

SEQ ID NO: 3401808 - RNA, 14 nt, Human
cuuccucagagggc

SEQ ID NO: 3401809 - RNA, 18 nt, Human
cuuccucauccaccccau

SEQ ID NO: 3401810 - RNA, 22 nt, Human
cuuccucauccaccccaucccu

SEQ ID NO: 3401811 - RNA, 13 nt, Human
cuuccuccagcug

SEQ ID NO: 3401812 - RNA, 15 nt, Human
cuuccuccagcugca

SEQ ID NO: 3401813 - RNA, 14 nt, Human
cuuccuccauccuc

SEQ ID NO: 3401814 - RNA, 19 nt, Human
cuucugcuuuucugcccug

SEQ ID NO: 3401815 - RNA, 14 nt, Human
cuucuggaaacugu

SEQ ID NO: 3401816 - RNA, 18 nt, Human
cuucuggaauuuguucaa

SEQ ID NO: 3401817 - RNA, 21 nt, Human
cuucuggacaggcucugcuuc

SEQ ID NO: 3401818 - RNA, 11 nt, Human
cuucuggagcc

SEQ ID NO: 3401819 - RNA, 13 nt, Human
cuucuggagcccu

SEQ ID NO: 3401820 - RNA, 15 nt, Human
cuucuggauauagcu

SEQ ID NO: 3401821 - RNA, 16 nt, Human
cuucuggauggauuuu

SEQ ID NO: 3401822 - RNA, 18 nt, Human
cuucuggauucuuggccc

SEQ ID NO: 3401823 - RNA, 17 nt, Human
cuucuggcacuuggaga

SEQ ID NO: 3401824 - RNA, 12 nt, Human
cuucuggccagg

SEQ ID NO: 3401825 - RNA, 13 nt, Human
cuucuggccagga

SEQ ID NO: 3401826 - RNA, 15 nt, Human
cuucuggccaggaag

SEQ ID NO: 3401827 - RNA, 14 nt, Human
cuucuggccuccca

SEQ ID NO: 3401828 - RNA, 19 nt, Human
cuucuggccucccacagac

SEQ ID NO: 3401829 - RNA, 15 nt, Human
cuucuggccuuuccu

SEQ ID NO: 3401830 - RNA, 22 nt, Human
cuucuggccuuuccucucuccu

SEQ ID NO: 3401831 - RNA, 12 nt, Human
cuucuggcucaa

SEQ ID NO: 3401832 - RNA, 20 nt, Human
cuucuggcuuccuucucuca

SEQ ID NO: 3401833 - RNA, 21 nt, Human
cuucugggaagacaacuagga

SEQ ID NO: 3401834 - RNA, 23 nt, Human
cuucugggagggcagcagggcua

SEQ ID NO: 3401835 - RNA, 21 nt, Human
cuucugggcaucuguucuggu

SEQ ID NO: 3401836 - RNA, 19 nt, Human
cuucuggggcaggcugggc

SEQ ID NO: 3401837 - RNA, 20 nt, Human
cuucuggggcaggcugggcc

SEQ ID NO: 3401838 - RNA, 16 nt, Human
cuucugggguccccag

SEQ ID NO: 3401839 - RNA, 20 nt, Human
cuucugggguccccagggcu

SEQ ID NO: 3401840 - RNA, 23 nt, Human
cuucuggguuccuuccucugagc

SEQ ID NO: 3401841 - RNA, 18 nt, Human
cuucugguacucuccuag

SEQ ID NO: 3401842 - RNA, 20 nt, Human
cuucugguacucuccuagag

SEQ ID NO: 3401843 - RNA, 15 nt, Human
cuucuguaauugugu

SEQ ID NO: 3401844 - RNA, 15 nt, Human
cuucuguacgucuga

SEQ ID NO: 3401845 - RNA, 15 nt, Human
cuucuguaguacucc

SEQ ID NO: 3401846 - RNA, 18 nt, Human
cuucuguaguacuccuua

SEQ ID NO: 3401847 - RNA, 14 nt, Human
cuucuguaguuuua

SEQ ID NO: 3401848 - RNA, 18 nt, Human
cuucuguauacuguggag

SEQ ID NO: 3401849 - RNA, 21 nt, Human
cuucuguauauaaaugggaac

SEQ ID NO: 3401850 - RNA, 14 nt, Human
cuucugucccucac

SEQ ID NO: 3401851 - RNA, 19 nt, Human
cuucuguccuacucugugu

SEQ ID NO: 3401852 - RNA, 22 nt, Human
cuucugucuucacaacagauua

SEQ ID NO: 3401853 - RNA, 14 nt, Human
cuucugugaaagua

SEQ ID NO: 3401854 - RNA, 22 nt, Human
cuucugugagacccccacaccu

SEQ ID NO: 3401855 - RNA, 15 nt, Human
cuucugugaugagcu

SEQ ID NO: 3401856 - RNA, 12 nt, Human
cuucugugccca

SEQ ID NO: 3401857 - RNA, 21 nt, Human
cuucugugcccagaauacuga

SEQ ID NO: 3401858 - RNA, 22 nt, Human
cuucuguggcucacagaacccu

SEQ ID NO: 3401859 - RNA, 14 nt, Human
cuucuguggguuuc

SEQ ID NO: 3401860 - RNA, 14 nt, Human
cuucuguucugccu

SEQ ID NO: 3401861 - RNA, 18 nt, Human
cuucuguugcugccucau

SEQ ID NO: 3401862 - RNA, 19 nt, Human
cuucuguugcugccucaug

SEQ ID NO: 3401863 - RNA, 12 nt, Human
cuucuguuucua

SEQ ID NO: 3401864 - RNA, 13 nt, Human
cuucuguuuucaa

SEQ ID NO: 3401865 - RNA, 18 nt, Human
cuucuuaaauaucuuuua

SEQ ID NO: 3401866 - RNA, 22 nt, Human
cuucuuaaauaucuuuuauguu

SEQ ID NO: 3401867 - RNA, 16 nt, Human
cuucuuaaaugagaag

SEQ ID NO: 3401868 - RNA, 16 nt, Human
cuucuuaaucuuuuca

SEQ ID NO: 3401869 - RNA, 22 nt, Human
cuucuuaaucuuuucacaaaua

SEQ ID NO: 3401870 - RNA, 23 nt, Human
cuucuuaaucuuuucacaaauaa

SEQ ID NO: 3401871 - RNA, 16 nt, Human
cuucuuaauguacaua

SEQ ID NO: 3401872 - RNA, 18 nt, Human
cuucuuaauguacauagu

SEQ ID NO: 3401873 - RNA, 21 nt, Human
cuucuuaauuaauuugauuaa

SEQ ID NO: 3401874 - RNA, 22 nt, Human
cuucuuaauuaauuugauuaac

SEQ ID NO: 3401875 - RNA, 16 nt, Human
cuucuuacgcaaugcu

SEQ ID NO: 3401876 - RNA, 23 nt, Human
cuucuuauggaauugauuugcau

SEQ ID NO: 3401877 - RNA, 20 nt, Human
cuucuuauucucacuccacc

SEQ ID NO: 3401878 - RNA, 18 nt, Human
cuucuucacccagcuaau

SEQ ID NO: 3401879 - RNA, 20 nt, Human
cuucuucagagacuccugca

SEQ ID NO: 3401880 - RNA, 17 nt, Human
cuucuucagccaccucu

SEQ ID NO: 3401881 - RNA, 15 nt, Human
cuucuucagggccug

SEQ ID NO: 3401882 - RNA, 16 nt, Human
cuucuucagggccugg

SEQ ID NO: 3401883 - RNA, 13 nt, Human
cuucuucauguuc

SEQ ID NO: 3401884 - RNA, 21 nt, Human
cuucuucccacaaagaauaua

SEQ ID NO: 3401885 - RNA, 20 nt, Human
cuucuuccccuucccugacu

SEQ ID NO: 3401886 - RNA, 15 nt, Human
cuucuuccugaagcu

SEQ ID NO: 3401887 - RNA, 21 nt, Human
cuucuucuacuucagucuucu

SEQ ID NO: 3401888 - RNA, 12 nt, Human
cuucuucuccau

SEQ ID NO: 3401889 - RNA, 13 nt, Human
cuucuucuccccc

SEQ ID NO: 3401890 - RNA, 13 nt, Human
cuucuucuguaau

SEQ ID NO: 3401891 - RNA, 17 nt, Human
cuucuucuguaauauuu

SEQ ID NO: 3401892 - RNA, 21 nt, Human
cuucuucuguccaagcagauu

SEQ ID NO: 3401893 - RNA, 13 nt, Human
cuucuucuucaga

SEQ ID NO: 3401894 - RNA, 15 nt, Human
cuucuucuuucuaca

SEQ ID NO: 3401895 - RNA, 12 nt, Human
cuucuugaaggu

SEQ ID NO: 3401896 - RNA, 13 nt, Human
cuucuugcauccu

SEQ ID NO: 3401897 - RNA, 12 nt, Human
cuucuugcccug

SEQ ID NO: 3401898 - RNA, 14 nt, Human
cuucuugcccuggg

SEQ ID NO: 3401899 - RNA, 13 nt, Human
cuucuugcugccc

SEQ ID NO: 3401900 - RNA, 13 nt, Human
cuucuugcuucuc

SEQ ID NO: 3401901 - RNA, 16 nt, Human
cuucuuggccauggga

SEQ ID NO: 3401902 - RNA, 18 nt, Human
cuucuuggccaugggagg

SEQ ID NO: 3401903 - RNA, 11 nt, Human
cuucuugggau

SEQ ID NO: 3401904 - RNA, 19 nt, Human
cuucuugucagacauaaag

SEQ ID NO: 3401905 - RNA, 21 nt, Human
cuucuugucagacauaaagcc

SEQ ID NO: 3401906 - RNA, 22 nt, Human
cuucuugucagacauaaagcca

SEQ ID NO: 3401907 - RNA, 13 nt, Human
cuucuuguucccc

SEQ ID NO: 3401908 - RNA, 15 nt, Human
cuucuuguucugaga

SEQ ID NO: 3401909 - RNA, 21 nt, Human
cuucuuguucugagauucaau

SEQ ID NO: 3401910 - RNA, 15 nt, Human
cuucuuguuuccuug

SEQ ID NO: 3401911 - RNA, 15 nt, Human
cuucuuuaauuuugg

SEQ ID NO: 3401912 - RNA, 17 nt, Human
cuucuuuaauuuuggaa

SEQ ID NO: 3401913 - RNA, 13 nt, Human
cuucuuuccacag

SEQ ID NO: 3401914 - RNA, 12 nt, Human
cuucuuuccauu

SEQ ID NO: 3401915 - RNA, 14 nt, Human
cuucuuucccuucc

SEQ ID NO: 3401916 - RNA, 16 nt, Human
cuucuuucccuuccuc

SEQ ID NO: 3401917 - RNA, 17 nt, Human
cuucuuugauaauguua

SEQ ID NO: 3401918 - RNA, 19 nt, Human
cuucuuugcuuugcccagc

SEQ ID NO: 3401919 - RNA, 19 nt, Human
cuucuuuuaaaccauuuuc

SEQ ID NO: 3401920 - RNA, 23 nt, Human
cuucuuuuaagaugugucuucaa

SEQ ID NO: 3401921 - RNA, 23 nt, Human
cuucuuuuagcaguaaaauagcu

SEQ ID NO: 3401922 - RNA, 20 nt, Human
cuucuuuucacauucuuaua

SEQ ID NO: 3401923 - RNA, 14 nt, Human
cuucuuuuucugga

SEQ ID NO: 3401924 - RNA, 21 nt, Human
cuucuuuuucuggacucugga

SEQ ID NO: 3401925 - RNA, 14 nt, Human
cuucuuuuugcugu

SEQ ID NO: 3401926 - RNA, 15 nt, Human
cuucuuuuugcuguu

SEQ ID NO: 3401927 - RNA, 16 nt, Human
cuugaaaaaaaacagu

SEQ ID NO: 3401928 - RNA, 18 nt, Human
cuugaaaaaaaacagugg

SEQ ID NO: 3401929 - RNA, 12 nt, Human
cuugaaaaauac

SEQ ID NO: 3401930 - RNA, 20 nt, Human
cuugaaaaauacuuuuccuu

SEQ ID NO: 3401931 - RNA, 21 nt, Human
cuugaaaaauacuuuuccuua

SEQ ID NO: 3401932 - RNA, 13 nt, Human
cuugaaaaaugug

SEQ ID NO: 3401933 - RNA, 22 nt, Human
cuugaaaaaugugcaaaacagc

SEQ ID NO: 3401934 - RNA, 21 nt, Human
cuugaaaagagacaggcaggu

SEQ ID NO: 3401935 - RNA, 15 nt, Human
cuugaaaaggguguu

SEQ ID NO: 3401936 - RNA, 20 nt, Human
cuugaaaauauaugauggcu

SEQ ID NO: 3401937 - RNA, 17 nt, Human
cuugaaagaaaggggca

SEQ ID NO: 3401938 - RNA, 23 nt, Human
cuugaaagaaaggggcaggagcu

SEQ ID NO: 3401939 - RNA, 13 nt, Human
cuugaaagaaaug

SEQ ID NO: 3401940 - RNA, 20 nt, Human
cuugaaagcauccaugugug

SEQ ID NO: 3401941 - RNA, 20 nt, Human
cuugaaagucaugaacacau

SEQ ID NO: 3401942 - RNA, 17 nt, Human
cuugaaauaccagugaa

SEQ ID NO: 3401943 - RNA, 22 nt, Human
cuugaaaugaaaguauaacuga

SEQ ID NO: 3401944 - RNA, 24 nt, Human
cuugaaauuauaucuguggucuuc

SEQ ID NO: 3401945 - RNA, 15 nt, Human
cuugaaauuuuaacc

SEQ ID NO: 3401946 - RNA, 11 nt, Human
cuugaacaaaa

SEQ ID NO: 3401947 - RNA, 14 nt, Human
cuugaacaaaaggg

SEQ ID NO: 3401948 - RNA, 18 nt, Human
cuugaacaaaaucuguug

SEQ ID NO: 3401949 - RNA, 20 nt, Human
cuugaacaaaaucuguugcc

SEQ ID NO: 3401950 - RNA, 15 nt, Human
cuugaacacuggggg

SEQ ID NO: 3401951 - RNA, 16 nt, Human
cuugaacacuggggga

SEQ ID NO: 3401952 - RNA, 16 nt, Human
cuugaacauuaaucca

SEQ ID NO: 3401953 - RNA, 15 nt, Human
cuugaaccacuuccc

SEQ ID NO: 3401954 - RNA, 17 nt, Human
cuugaaccauaaaaugu

SEQ ID NO: 3401955 - RNA, 19 nt, Human
cuugaacccgggaggcaga

SEQ ID NO: 3401956 - RNA, 18 nt, Human
cuugaaccuaugaagcaa

SEQ ID NO: 3401957 - RNA, 15 nt, Human
cuugaaccugggagg

SEQ ID NO: 3401958 - RNA, 16 nt, Human
cuugaaccugugagua

SEQ ID NO: 3401959 - RNA, 18 nt, Human
cuuuuaaggauaaaucau

SEQ ID NO: 3401960 - RNA, 16 nt, Human
cuuuuaaguaaggucc

SEQ ID NO: 3401961 - RNA, 19 nt, Human
cuuuuaaugcuccaaaugc

SEQ ID NO: 3401962 - RNA, 17 nt, Human
cuuuuaaugcuucauuc

SEQ ID NO: 3401963 - RNA, 20 nt, Human
cuuuuaauuaaauaaaagcu

SEQ ID NO: 3401964 - RNA, 20 nt, Human
cuuuuaauuaaaugcucauc

SEQ ID NO: 3401965 - RNA, 22 nt, Human
cuuuuaauuaaugaaauaucug

SEQ ID NO: 3401966 - RNA, 19 nt, Human
cuuuuaauuguuucagaau

SEQ ID NO: 3401967 - RNA, 14 nt, Human
cuuuuacauacugc

SEQ ID NO: 3401968 - RNA, 17 nt, Human
cuuuuacauacugcugu

SEQ ID NO: 3401969 - RNA, 21 nt, Human
cuuuuaccagcuuuuaaccau

SEQ ID NO: 3401970 - RNA, 14 nt, Human
cuuuuaccaugccc

SEQ ID NO: 3401971 - RNA, 20 nt, Human
cuuuuacguccaucucuugu

SEQ ID NO: 3401972 - RNA, 20 nt, Human
cuuuuacugaagccuuucuu

SEQ ID NO: 3401973 - RNA, 17 nt, Human
cuuuuacugguugcaug

SEQ ID NO: 3401974 - RNA, 18 nt, Human
cuuuuacugguugcaugg

SEQ ID NO: 3401975 - RNA, 12 nt, Human
cuuuuacuguga

SEQ ID NO: 3401976 - RNA, 16 nt, Human
cuuuuacuuuucuucu

SEQ ID NO: 3401977 - RNA, 15 nt, Human
cuuuuagaaauacug

SEQ ID NO: 3401978 - RNA, 18 nt, Human
cuuuuaggccaaaaaaau

SEQ ID NO: 3401979 - RNA, 21 nt, Human
cuuuuagggagagucauauuu

SEQ ID NO: 3401980 - RNA, 20 nt, Human
cuuuuagggagcuggucuga

SEQ ID NO: 3401981 - RNA, 22 nt, Human
cuuuuaguacccaccugagcuu

SEQ ID NO: 3401982 - RNA, 15 nt, Human
cuuuuaguuccugug

SEQ ID NO: 3401983 - RNA, 20 nt, Human
cuuuuaguuguaucucuuuu

SEQ ID NO: 3401984 - RNA, 23 nt, Human
cuuuuauaaaaaaaaugaaaugu

SEQ ID NO: 3401985 - RNA, 14 nt, Human
cuuuuauaaacuuu

SEQ ID NO: 3401986 - RNA, 20 nt, Human
cuuuuauaaacuuuaccuuu

SEQ ID NO: 3401987 - RNA, 21 nt, Human
cuuuuauaaacuuuaccuuuu

SEQ ID NO: 3401988 - RNA, 16 nt, Human
cuuuuauaaagcaugu

SEQ ID NO: 3401989 - RNA, 11 nt, Human
cuuuuauaaau

SEQ ID NO: 3401990 - RNA, 14 nt, Human
cuuuuauaaauuaa

SEQ ID NO: 3401991 - RNA, 15 nt, Human
cuuuuauaaauuaaa

SEQ ID NO: 3401992 - RNA, 19 nt, Human
cuuuuauacucuuucugua

SEQ ID NO: 3401993 - RNA, 20 nt, Human
cuuuuauacucuuucuguau

SEQ ID NO: 3401994 - RNA, 16 nt, Human
cuuuuauagaugguca

SEQ ID NO: 3401995 - RNA, 17 nt, Human
cuuuuauagcuauuacu

SEQ ID NO: 3401996 - RNA, 12 nt, Human
cuuuuauagugg

SEQ ID NO: 3401997 - RNA, 13 nt, Human
cuuuuauauuugu

SEQ ID NO: 3401998 - RNA, 23 nt, Human
cuuuuaucuauucugagaaaaca

SEQ ID NO: 3401999 - RNA, 21 nt, Human
cuuuuaugagcucauguagca

SEQ ID NO: 3402000 - RNA, 13 nt, Human
cuuuuauguagca

SEQ ID NO: 3402001 - RNA, 14 nt, Human
cuuuuauguagcac

SEQ ID NO: 3402002 - RNA, 18 nt, Human
cuuuuauguaguaauuga

SEQ ID NO: 3402003 - RNA, 19 nt, Human
cuuuuaugugaaacauguu

SEQ ID NO: 3402004 - RNA, 18 nt, Human
cuuuuauucauuagcugu

SEQ ID NO: 3402005 - RNA, 22 nt, Human
cuuuuauuccugcccugcuguu

SEQ ID NO: 3402006 - RNA, 17 nt, Human
cuuuuauugacacagaa

SEQ ID NO: 3402007 - RNA, 19 nt, Human
cuuuuauuuagcaccaggg

SEQ ID NO: 3402008 - RNA, 21 nt, Human
cuuuuauuugcaacauuuaca

SEQ ID NO: 3402009 - RNA, 12 nt, Human
cuuuuauuuuga

SEQ ID NO: 3402010 - RNA, 18 nt, Human
cuuuuauuuuuuucuaau

SEQ ID NO: 3402011 - RNA, 14 nt, Human
cuuuucacaaauaa

SEQ ID NO: 3402012 - RNA, 20 nt, Human
cuuuucacauagcugucuag

SEQ ID NO: 3402013 - RNA, 20 nt, Human
cuuuucacauucuuauaaau

SEQ ID NO: 3402014 - RNA, 14 nt, Human
cuuuucacccuucu

SEQ ID NO: 3402015 - RNA, 16 nt, Human
cuuuucaccuccuuca

SEQ ID NO: 3402016 - RNA, 18 nt, Human
cuuuucaccuccuucaau

SEQ ID NO: 3402017 - RNA, 21 nt, Human
cuuuucaccuuuacuuuagaa

SEQ ID NO: 3402018 - RNA, 12 nt, Human
cuuuucacugcu

SEQ ID NO: 3402019 - RNA, 18 nt, Human
cuuuucacugcuggcugc

SEQ ID NO: 3402020 - RNA, 20 nt, Human
cuuuucacugcuggcugccu

SEQ ID NO: 3402021 - RNA, 18 nt, Human
cuuuucacugcuguuaua

SEQ ID NO: 3402022 - RNA, 22 nt, Human
cuuuucacuucgggcuguguaa

SEQ ID NO: 3402023 - RNA, 19 nt, Human
cuuuucagaagugagcuuu

SEQ ID NO: 3402024 - RNA, 21 nt, Human
cuuuucagaagugagcuuugc

SEQ ID NO: 3402025 - RNA, 17 nt, Human
cuuuucagcuucugcug

SEQ ID NO: 3402026 - RNA, 14 nt, Human
cuuuucaggaaaau

SEQ ID NO: 3402027 - RNA, 17 nt, Human
cuuuucagggcuggcuc

SEQ ID NO: 3402028 - RNA, 22 nt, Human
cuuuucauaaccuagccuuaga

SEQ ID NO: 3402029 - RNA, 14 nt, Human
cuuuucauaucauu

SEQ ID NO: 3402030 - RNA, 15 nt, Human
cuuuucauaucauuu

SEQ ID NO: 3402031 - RNA, 16 nt, Human
cuuuucaucugggaaa

SEQ ID NO: 3402032 - RNA, 14 nt, Human
cuuuucaugcaaac

SEQ ID NO: 3402033 - RNA, 20 nt, Human
cuuuucaugcaaacucuuug

SEQ ID NO: 3402034 - RNA, 17 nt, Human
cuuuucauucucuuuua

SEQ ID NO: 3402035 - RNA, 22 nt, Human
cuuuucauuuaggugaggaagc

SEQ ID NO: 3402036 - RNA, 23 nt, Human
cuuuuccaacccucaucaccaac

SEQ ID NO: 3402037 - RNA, 14 nt, Human
cuuuuccagagcau

SEQ ID NO: 3402038 - RNA, 21 nt, Human
cuuuuccagagcauuccaguc

SEQ ID NO: 3402039 - RNA, 18 nt, Human
cuuuuccaguauuuuagu

SEQ ID NO: 3402040 - RNA, 18 nt, Human
cuuuucccaaaauguuga

SEQ ID NO: 3402041 - RNA, 22 nt, Human
cuuuucccaaaauguugaaaua

SEQ ID NO: 3402042 - RNA, 14 nt, Human
cuuuucccaaccau

SEQ ID NO: 3402043 - RNA, 17 nt, Human
cuuuuccccuuuccugu

SEQ ID NO: 3402044 - RNA, 22 nt, Human
cuuuucccucggaguucuucuu

SEQ ID NO: 3402045 - RNA, 12 nt, Human
cuuuucccucuu

SEQ ID NO: 3402046 - RNA, 13 nt, Human
cuuuucccucuuu

SEQ ID NO: 3402047 - RNA, 15 nt, Human
cuuuucccuugcuuc

SEQ ID NO: 3402048 - RNA, 16 nt, Human
cuuuuccuauuuguuu

SEQ ID NO: 3402049 - RNA, 19 nt, Human
cuuuuccuauuuucagccc

SEQ ID NO: 3402050 - RNA, 19 nt, Human
cuuuuccucgcuucuuuca

SEQ ID NO: 3402051 - RNA, 20 nt, Human
cuuuuccucgcuucuuucaa

SEQ ID NO: 3402052 - RNA, 18 nt, Human
cuuuuccucucucccgga

SEQ ID NO: 3402053 - RNA, 15 nt, Human
cuuuuccucuuagaa

SEQ ID NO: 3402054 - RNA, 19 nt, Human
cuuuuccucuuagaagaau

SEQ ID NO: 3402055 - RNA, 19 nt, Human
cuuuuccugauaaagcaca

SEQ ID NO: 3402056 - RNA, 20 nt, Human
cuuuuccuucccuuuucugu

SEQ ID NO: 3402057 - RNA, 22 nt, Human
cuuuuccuucccuuuucuguuc

SEQ ID NO: 3402058 - RNA, 15 nt, Human
cuuuuccuuggcauu

SEQ ID NO: 3402059 - RNA, 21 nt, Human
cuuuuccuuggggcaggcagu

SEQ ID NO: 3402060 - RNA, 16 nt, Human
cuuuucgccguggcug

SEQ ID NO: 3402061 - RNA, 14 nt, Human
cuuuucgccuuucc

SEQ ID NO: 3402062 - RNA, 22 nt, Human
cuuuucuaaacuaggcuccuuc

SEQ ID NO: 3402063 - RNA, 16 nt, Human
cuuuucuaacagaaag

SEQ ID NO: 3402064 - RNA, 13 nt, Human
cuuuucuacagca

SEQ ID NO: 3402065 - RNA, 14 nt, Human
cuuuucuacagcaa

SEQ ID NO: 3402066 - RNA, 15 nt, Human
cuuuucuacagcaaa

SEQ ID NO: 3402067 - RNA, 16 nt, Human
cuuuucuacccuagcc

SEQ ID NO: 3402068 - RNA, 21 nt, Human
cuuuucuagcccgaauacaaa

SEQ ID NO: 3402069 - RNA, 13 nt, Human
cuuuucuauuuuc

SEQ ID NO: 3402070 - RNA, 14 nt, Human
cuuuucuauuuucc

SEQ ID NO: 3402071 - RNA, 21 nt, Human
cuuuucuccaauaucagugcu

SEQ ID NO: 3402072 - RNA, 14 nt, Human
cuuuucugauagag

SEQ ID NO: 3402073 - RNA, 16 nt, Human
cuuuucugauccaguu

SEQ ID NO: 3402074 - RNA, 14 nt, Human
cuuuucugcauuuu

SEQ ID NO: 3402075 - RNA, 15 nt, Human
cuuuucugcccuggc

SEQ ID NO: 3402076 - RNA, 18 nt, Human
cuuuucuggaauguaauc

SEQ ID NO: 3402077 - RNA, 12 nt, Human
cuuuucuggcac

SEQ ID NO: 3402078 - RNA, 23 nt, Human
cuuuucuggggaaagacacugcc

SEQ ID NO: 3402079 - RNA, 15 nt, Human
cuuuucuguaauuca

SEQ ID NO: 3402080 - RNA, 18 nt, Human
cuuuucuguccgagcuuu

SEQ ID NO: 3402081 - RNA, 16 nt, Human
cuuuucugucucugcc

SEQ ID NO: 3402082 - RNA, 17 nt, Human
cuuuucugucucugccu

SEQ ID NO: 3402083 - RNA, 18 nt, Human
cuuuucugucucugccuc

SEQ ID NO: 3402084 - RNA, 17 nt, Human
cuuuucuguucuaguuu

SEQ ID NO: 3402085 - RNA, 19 nt, Human
cuuuucuuacuccuccucu

SEQ ID NO: 3402086 - RNA, 18 nt, Human
cuuuucuugcaugaggcu

SEQ ID NO: 3402087 - RNA, 11 nt, Human
cuuuucuuggc

SEQ ID NO: 3402088 - RNA, 21 nt, Human
cuuuucuuggcaaaagccuug

SEQ ID NO: 3402089 - RNA, 23 nt, Human
cuuuucuuggcaaaagccuugug

SEQ ID NO: 3402090 - RNA, 11 nt, Human
cuuuucuugua

SEQ ID NO: 3402091 - RNA, 21 nt, Human
cuuuucuuguuuaucagcagu

SEQ ID NO: 3402092 - RNA, 15 nt, Human
cuuuucuuuaacuuu

SEQ ID NO: 3402093 - RNA, 20 nt, Human
cuuuucuuuagagaacugaa

SEQ ID NO: 3402094 - RNA, 15 nt, Human
cuuuucuuuguuaua

SEQ ID NO: 3402095 - RNA, 13 nt, Human
cuuuucuuuucuu

SEQ ID NO: 3402096 - RNA, 15 nt, Human
cuuuucuuuuguuac

SEQ ID NO: 3402097 - RNA, 21 nt, Human
cuuuucuuuuguuacuguucu

SEQ ID NO: 3402098 - RNA, 14 nt, Human
cuuuucuuuuuaca

SEQ ID NO: 3402099 - RNA, 15 nt, Human
cuuuucuuuuuacau

SEQ ID NO: 3402100 - RNA, 13 nt, Human
cuuuugaacccag

SEQ ID NO: 3402101 - RNA, 22 nt, Human
cuuuugaacuggcaauugucua

SEQ ID NO: 3402102 - RNA, 17 nt, Human
cuuuugacacugcucua

SEQ ID NO: 3402103 - RNA, 14 nt, Human
cuuuugacaugugg

SEQ ID NO: 3402104 - RNA, 22 nt, Human
cuuuuuucccauaagacaauga

SEQ ID NO: 3402105 - RNA, 19 nt, Human
cuuuuuucugccuccuuua

SEQ ID NO: 3402106 - RNA, 15 nt, Human
cuuuuuugaaaucag

SEQ ID NO: 3402107 - RNA, 17 nt, Human
cuuuuuugauaaaguuu

SEQ ID NO: 3402108 - RNA, 17 nt, Human
cuuuuuuggcugcugaa

SEQ ID NO: 3402109 - RNA, 10 nt, Human
cuuuuuuguc

SEQ ID NO: 3402110 - RNA, 20 nt, Human
cuuuuuuguguuuuuaaaag

SEQ ID NO: 3402111 - RNA, 17 nt, Human
cuuuuuuguuuguuucu

SEQ ID NO: 3402112 - RNA, 18 nt, Human
cuuuuuuguuuguuucuu

SEQ ID NO: 3402113 - RNA, 16 nt, Human
cuuuuuuuagagaagu

SEQ ID NO: 3402114 - RNA, 14 nt, Human
cuuuuuuucaaugu

SEQ ID NO: 3402115 - RNA, 13 nt, Human
cuuuuuuuccuuu

SEQ ID NO: 3402116 - RNA, 14 nt, Human
cuuuuuuucuguac

SEQ ID NO: 3402117 - RNA, 21 nt, Human
cuuuuuuuguguguauuugcu

SEQ ID NO: 3402118 - RNA, 22 nt, Human
cuuuuuuuguguguauuugcua

SEQ ID NO: 3402119 - RNA, 14 nt, Human
cuuuuuuuuaaguu

SEQ ID NO: 3402120 - RNA, 15 nt, Human
cuuuuuuuuccuucu

SEQ ID NO: 3402121 - RNA, 17 nt, Human
cuuuuuuuucuauuuca

SEQ ID NO: 3402122 - RNA, 14 nt, Human
cuuuuuuuucuuua

SEQ ID NO: 3402123 - RNA, 16 nt, Human
cuuuuuuuuuccaaaa

SEQ ID NO: 3402124 - RNA, 15 nt, Human
cuuuuuuuuucucuu

SEQ ID NO: 3402125 - RNA, 18 nt, Human
cuuuuuuuuucucuuucu

SEQ ID NO: 3402126 - RNA, 15 nt, Human
cuuuuuuuuuuaagu

SEQ ID NO: 3402127 - RNA, 21 nt, Human
cuuuuuuuuuuaagugaaauu

SEQ ID NO: 3402128 - RNA, 14 nt, Human
cuuuuuuuuuucau

SEQ ID NO: 3402129 - RNA, 23 nt, Human
cuuuuuuuuuuuuuaaagacaga

SEQ ID NO: 3402130 - RNA, 19 nt, Human
cuuuuuuuuuuuuuuggua

SEQ ID NO: 3402131 - RNA, 22 nt, Human
cuuuuuuuuuuuuuuuuugguc

SEQ ID NO: 3402132 - RNA, 18 nt, Human
gaaaaaaaaaaaagagga

SEQ ID NO: 3402133 - RNA, 15 nt, Human
gaaaaaaaaaaaagc

SEQ ID NO: 3402134 - RNA, 17 nt, Human
gaaaaaaaaaagaagaa

SEQ ID NO: 3402135 - RNA, 19 nt, Human
gaaaaaaaaaaugcugaac

SEQ ID NO: 3402136 - RNA, 13 nt, Human
gaaaaaaaaaugc

SEQ ID NO: 3402137 - RNA, 21 nt, Human
gaaaaaaaaaugccauaauac

SEQ ID NO: 3402138 - RNA, 14 nt, Human
gaaaaaaaacacac

SEQ ID NO: 3402139 - RNA, 11 nt, Human
gaaaaaaaaga

SEQ ID NO: 3402140 - RNA, 16 nt, Human
gaaaaaaaagaaaaaa

SEQ ID NO: 3402141 - RNA, 13 nt, Human
gaaaaaaaauuag

SEQ ID NO: 3402142 - RNA, 21 nt, Human
gaaaaaaaccacacaaagaca

SEQ ID NO: 3402143 - RNA, 17 nt, Human
gaaaaaaacgaaaacag

SEQ ID NO: 3402144 - RNA, 14 nt, Human
gaaaaaaacuucau

SEQ ID NO: 3402145 - RNA, 13 nt, Human
gaaaaaaacuuuu

SEQ ID NO: 3402146 - RNA, 14 nt, Human
gaaaaaaacuuuua

SEQ ID NO: 3402147 - RNA, 10 nt, Human
gaaaaaaaga

SEQ ID NO: 3402148 - RNA, 17 nt, Human
gaaaaaaauaaauaaaa

SEQ ID NO: 3402149 - RNA, 18 nt, Human
gaaaaaaauaauuuuaaa

SEQ ID NO: 3402150 - RNA, 23 nt, Human
gaaaaaaauaauuuuaugaacug

SEQ ID NO: 3402151 - RNA, 20 nt, Human
gaaaaaaauacuauuuaaga

SEQ ID NO: 3402152 - RNA, 13 nt, Human
gaaaaaaaucauc

SEQ ID NO: 3402153 - RNA, 19 nt, Human
gaaaaaaaucguccaggga

SEQ ID NO: 3402154 - RNA, 13 nt, Human
gaaaaaaaucuuc

SEQ ID NO: 3402155 - RNA, 13 nt, Human
gaaaaaaaugacu

SEQ ID NO: 3402156 - RNA, 16 nt, Human
gaaaaaaaugacuaaa

SEQ ID NO: 3402157 - RNA, 15 nt, Human
gaaaaaaauguauuu

SEQ ID NO: 3402158 - RNA, 22 nt, Human
gaaaaaaaugucaaaaguagaa

SEQ ID NO: 3402159 - RNA, 16 nt, Human
gaaaaaaauugaaaug

SEQ ID NO: 3402160 - RNA, 16 nt, Human
gaaaaaaauuggcauu

SEQ ID NO: 3402161 - RNA, 22 nt, Human
gaaaaaaccguguuugucucuu

SEQ ID NO: 3402162 - RNA, 22 nt, Human
gaaaaaaguuguaggcgaauca

SEQ ID NO: 3402163 - RNA, 17 nt, Human
gaaaaaauaacacacau

SEQ ID NO: 3402164 - RNA, 21 nt, Human
gaaaaaauaauugauuucaag

SEQ ID NO: 3402165 - RNA, 13 nt, Human
gaaaaaauacauu

SEQ ID NO: 3402166 - RNA, 14 nt, Human
gaaaaaauacauuu

SEQ ID NO: 3402167 - RNA, 14 nt, Human
gaaaaaauauauau

SEQ ID NO: 3402168 - RNA, 21 nt, Human
gaaaaaauauauguauauaca

SEQ ID NO: 3402169 - RNA, 19 nt, Human
gaaaaaauauuuuccugcc

SEQ ID NO: 3402170 - RNA, 18 nt, Human
gaaaaaauguuggauuua

SEQ ID NO: 3402171 - RNA, 21 nt, Human
gaaaaacaaacucguuuuuua

SEQ ID NO: 3402172 - RNA, 14 nt, Human
gaaaaacacaagca

SEQ ID NO: 3402173 - RNA, 17 nt, Human
gaaaaacacaagcaaaa

SEQ ID NO: 3402174 - RNA, 11 nt, Human
gaaaaacaggu

SEQ ID NO: 3402175 - RNA, 20 nt, Human
gaaaaaccacucccaguccc

SEQ ID NO: 3402176 - RNA, 14 nt, Human
gaaaaacugauuuu

SEQ ID NO: 3402177 - RNA, 21 nt, Human
gaaaaacuuuggaaccagacu

SEQ ID NO: 3402178 - RNA, 14 nt, Human
gaaaaagaaaugca

SEQ ID NO: 3402179 - RNA, 19 nt, Human
gaaaaagaacaugcaguuu

SEQ ID NO: 3402180 - RNA, 21 nt, Human
gaaaaagaacaugcaguuuga

SEQ ID NO: 3402181 - RNA, 23 nt, Human
gaaaaagaacuuccccauacaaa

SEQ ID NO: 3402182 - RNA, 14 nt, Human
gaaaaagaagaauc

SEQ ID NO: 3402183 - RNA, 22 nt, Human
gaaaaagcaguaacugacaacu

SEQ ID NO: 3402184 - RNA, 18 nt, Human
gaaaaagcauguacagug

SEQ ID NO: 3402185 - RNA, 20 nt, Human
gaaaaagcuccaugugccuc

SEQ ID NO: 3402186 - RNA, 15 nt, Human
gaaaaaggacaggca

SEQ ID NO: 3402187 - RNA, 18 nt, Human
gaaaaaggacaggcagaa

SEQ ID NO: 3402188 - RNA, 12 nt, Human
gaaaaaggguca

SEQ ID NO: 3402189 - RNA, 18 nt, Human
gaaaaaguaucauggaaa

SEQ ID NO: 3402190 - RNA, 22 nt, Human
gaaaaaguaucauggaaauauu

SEQ ID NO: 3402191 - RNA, 18 nt, Human
gaaaaagucauccaaucu

SEQ ID NO: 3402192 - RNA, 21 nt, Human
gaaaaagucauccaaucuaac

SEQ ID NO: 3402193 - RNA, 19 nt, Human
gaaaaaguuaaacauugaa

SEQ ID NO: 3402194 - RNA, 18 nt, Human
gaaaaaguuaaugcuuaa

SEQ ID NO: 3402195 - RNA, 17 nt, Human
gaaaaauaaagaaaaga

SEQ ID NO: 3402196 - RNA, 19 nt, Human
gaaaaauaaagaaaagaug

SEQ ID NO: 3402197 - RNA, 22 nt, Human
gaaaaauaaagacaccugguug

SEQ ID NO: 3402198 - RNA, 16 nt, Human
gaaaaauagcaacuug

SEQ ID NO: 3402199 - RNA, 17 nt, Human
gaaaaauagcaacuugu

SEQ ID NO: 3402200 - RNA, 20 nt, Human
gaaaaauaucuguaagagug

SEQ ID NO: 3402201 - RNA, 15 nt, Human
gaaaaauaugauauu

SEQ ID NO: 3402202 - RNA, 10 nt, Human
gaaaaauauu

SEQ ID NO: 3402203 - RNA, 13 nt, Human
gaaaaauauuuaa

SEQ ID NO: 3402204 - RNA, 14 nt, Human
gaaaaauauuuaag

SEQ ID NO: 3402205 - RNA, 16 nt, Human
gaaaaauauuuauuca

SEQ ID NO: 3402206 - RNA, 20 nt, Human
gaaaaaucaaguauuauaaa

SEQ ID NO: 3402207 - RNA, 13 nt, Human
gaaaaauccucuu

SEQ ID NO: 3402208 - RNA, 14 nt, Human
gaaaaaucuugugc

SEQ ID NO: 3402209 - RNA, 20 nt, Human
gaaaaaugcccuuaaaucau

SEQ ID NO: 3402210 - RNA, 16 nt, Human
gaaaaaugcuccccac

SEQ ID NO: 3402211 - RNA, 16 nt, Human
gaaaaauggagcaaag

SEQ ID NO: 3402212 - RNA, 13 nt, Human
gaaaaauguguaa

SEQ ID NO: 3402213 - RNA, 14 nt, Human
gaaaaauguguaau

SEQ ID NO: 3402214 - RNA, 12 nt, Human
gaaaaauguuug

SEQ ID NO: 3402215 - RNA, 20 nt, Human
gaaaaauucaauaguaauau

SEQ ID NO: 3402216 - RNA, 20 nt, Human
gaaaaauuccuauugugauu

SEQ ID NO: 3402217 - RNA, 22 nt, Human
gaaaaauugcugacuguagcuu

SEQ ID NO: 3402218 - RNA, 17 nt, Human
gaaaaauuuaagcauug

SEQ ID NO: 3402219 - RNA, 19 nt, Human
gaaaaauuuaagcauuguu

SEQ ID NO: 3402220 - RNA, 14 nt, Human
gaaaaauuucacga

SEQ ID NO: 3402221 - RNA, 19 nt, Human
gaaaacaaaaccaaaaguu

SEQ ID NO: 3402222 - RNA, 22 nt, Human
gaaaacaaaaccaaaaguuauu

SEQ ID NO: 3402223 - RNA, 19 nt, Human
gaaaacaaaauuuuauuuu

SEQ ID NO: 3402224 - RNA, 15 nt, Human
gaaaacaacaaaaaa

SEQ ID NO: 3402225 - RNA, 19 nt, Human
gaaaacaaugcaaaaccuu

SEQ ID NO: 3402226 - RNA, 14 nt, Human
gaaaacacauuuuu

SEQ ID NO: 3402227 - RNA, 19 nt, Human
gaaaacacauuuuucuuag

SEQ ID NO: 3402228 - RNA, 15 nt, Human
gaaaacacuguuauc

SEQ ID NO: 3402229 - RNA, 22 nt, Human
gaaaacacuguuaucauuuuuu

SEQ ID NO: 3402230 - RNA, 19 nt, Human
gaaaacacuguucucugcc

SEQ ID NO: 3402231 - RNA, 12 nt, Human
gaaaacauaaaa

SEQ ID NO: 3402232 - RNA, 19 nt, Human
gaaaacaucacugaaaugc

SEQ ID NO: 3402233 - RNA, 12 nt, Human
gaaaacaucugg

SEQ ID NO: 3402234 - RNA, 16 nt, Human
gaaaacauggaacagu

SEQ ID NO: 3402235 - RNA, 13 nt, Human
gaaaacauuccau

SEQ ID NO: 3402236 - RNA, 17 nt, Human
gaaaacauuccauccuu

SEQ ID NO: 3402237 - RNA, 20 nt, Human
gaaaacauucugauuuggaa

SEQ ID NO: 3402238 - RNA, 12 nt, Human
gaaaacauuguu

SEQ ID NO: 3402239 - RNA, 18 nt, Human
gaaaacauuguuccagau

SEQ ID NO: 3402240 - RNA, 17 nt, Human
gaaaaccaaaaugacau

SEQ ID NO: 3402241 - RNA, 18 nt, Human
gaaaaccaucuggccugg

SEQ ID NO: 3402242 - RNA, 20 nt, Human
gaaaaccaucuggccuggcc

SEQ ID NO: 3402243 - RNA, 14 nt, Human
gaaaaccccagcau

SEQ ID NO: 3402244 - RNA, 13 nt, Human
gaaaaccuagaaa

SEQ ID NO: 3402245 - RNA, 15 nt, Human
gaaaaccuagaaaac

SEQ ID NO: 3402246 - RNA, 15 nt, Human
gaaaaccuuucuuca

SEQ ID NO: 3402247 - RNA, 15 nt, Human
gaaaacguggcugcu

SEQ ID NO: 3402248 - RNA, 16 nt, Human
gaaaacguggcugcuu

SEQ ID NO: 3402249 - RNA, 18 nt, Human
gaaaacguggcugcuuca

SEQ ID NO: 3402250 - RNA, 18 nt, Human
gaaaauguuuuguaagaa

SEQ ID NO: 3402251 - RNA, 19 nt, Human
gaaaauguuuuguaagaaa

SEQ ID NO: 3402252 - RNA, 13 nt, Human
gaaaauuaacacu

SEQ ID NO: 3402253 - RNA, 18 nt, Human
gaaaauuaggauuucaug

SEQ ID NO: 3402254 - RNA, 22 nt, Human
gaaaauuaggauuucaugauuu

SEQ ID NO: 3402255 - RNA, 16 nt, Human
gaaaauuauucuauaa

SEQ ID NO: 3402256 - RNA, 22 nt, Human
gaaaauuauuuuguucauacau

SEQ ID NO: 3402257 - RNA, 21 nt, Human
gaaaauucaaaaaguguuuau

SEQ ID NO: 3402258 - RNA, 21 nt, Human
gaaaauucauaguaagauuga

SEQ ID NO: 3402259 - RNA, 13 nt, Human
gaaaauucauuuu

SEQ ID NO: 3402260 - RNA, 20 nt, Human
gaaaauucugugccuuguuu

SEQ ID NO: 3402261 - RNA, 22 nt, Human
gaaaauucugugccuuguuuuu

SEQ ID NO: 3402262 - RNA, 16 nt, Human
gaaaauugaauuuaac

SEQ ID NO: 3402263 - RNA, 19 nt, Human
gaaaauugaauuuaacaau

SEQ ID NO: 3402264 - RNA, 17 nt, Human
gaaaauugccuuucugu

SEQ ID NO: 3402265 - RNA, 15 nt, Human
gaaaauuggacauua

SEQ ID NO: 3402266 - RNA, 14 nt, Human
gaaaauuguuuagu

SEQ ID NO: 3402267 - RNA, 17 nt, Human
gaaaauuuguuauuuug

SEQ ID NO: 3402268 - RNA, 13 nt, Human
gaaaauuuuugua

SEQ ID NO: 3402269 - RNA, 16 nt, Human
gaaaauuuuuguagua

SEQ ID NO: 3402270 - RNA, 17 nt, Human
gaaaauuuuuguuuaua

SEQ ID NO: 3402271 - RNA, 14 nt, Human
gaaacaaaaacacu

SEQ ID NO: 3402272 - RNA, 23 nt, Human
gaaacaaacaaaagcugaacaca

SEQ ID NO: 3402273 - RNA, 12 nt, Human
gaaacaaagaag

SEQ ID NO: 3402274 - RNA, 13 nt, Human
gaaacaaagaagg

SEQ ID NO: 3402275 - RNA, 19 nt, Human
gaaacaaaguggaaggaaa

SEQ ID NO: 3402276 - RNA, 17 nt, Human
gaaacaaauaaucacau

SEQ ID NO: 3402277 - RNA, 14 nt, Human
gaaacaacacugua

SEQ ID NO: 3402278 - RNA, 15 nt, Human
gaaacaacacuguag

SEQ ID NO: 3402279 - RNA, 17 nt, Human
gaaacaacacuguagua

SEQ ID NO: 3402280 - RNA, 22 nt, Human
gaaacaauacucauaaugugaa

SEQ ID NO: 3402281 - RNA, 14 nt, Human
gaaacaauuucugu

SEQ ID NO: 3402282 - RNA, 16 nt, Human
gaaacacaacuauauu

SEQ ID NO: 3402283 - RNA, 23 nt, Human
gaaacacaccaggcugugggccu

SEQ ID NO: 3402284 - RNA, 20 nt, Human
gaaacacacugaggcaggga

SEQ ID NO: 3402285 - RNA, 13 nt, Human
gaaacacagaaac

SEQ ID NO: 3402286 - RNA, 14 nt, Human
gaaacacagaaacc

SEQ ID NO: 3402287 - RNA, 23 nt, Human
gaaacacagcuguucuucuguuc

SEQ ID NO: 3402288 - RNA, 15 nt, Human
gaaacacauaauuaa

SEQ ID NO: 3402289 - RNA, 21 nt, Human
gaaacaccuucucuggagcca

SEQ ID NO: 3402290 - RNA, 15 nt, Human
gaaacacgaaacuug

SEQ ID NO: 3402291 - RNA, 18 nt, Human
gaaacacgaaacuuguua

SEQ ID NO: 3402292 - RNA, 18 nt, Human
gaaacacuaaauguuaaa

SEQ ID NO: 3402293 - RNA, 17 nt, Human
gaaacacuccuugcauc

SEQ ID NO: 3402294 - RNA, 16 nt, Human
gaaacacugaaaagaa

SEQ ID NO: 3402295 - RNA, 11 nt, Human
gaaacacugcc

SEQ ID NO: 3402296 - RNA, 13 nt, Human
gaaacacugccuu

SEQ ID NO: 3402297 - RNA, 14 nt, Human
gaaacacugccuuu

SEQ ID NO: 3402298 - RNA, 18 nt, Human
gaaacacuuugccuccug

SEQ ID NO: 3402299 - RNA, 20 nt, Human
gaaacacuuugccuccugug

SEQ ID NO: 3402300 - RNA, 16 nt, Human
gaaacagagacaggcc

SEQ ID NO: 3402301 - RNA, 17 nt, Human
gaaacagagacaggccc

SEQ ID NO: 3402302 - RNA, 19 nt, Human
gaaacagaggagaguccca

SEQ ID NO: 3402303 - RNA, 20 nt, Human
gaaacagaucuccuggcaaa

SEQ ID NO: 3402304 - RNA, 16 nt, Human
gaaacagauuucauac

SEQ ID NO: 3402305 - RNA, 13 nt, Human
gaaacagcaucuc

SEQ ID NO: 3402306 - RNA, 22 nt, Human
gaaacagcugccuuagcuucag

SEQ ID NO: 3402307 - RNA, 22 nt, Human
gaaacaggaccacaaaaaugaa

SEQ ID NO: 3402308 - RNA, 13 nt, Human
gaaacaggagaga

SEQ ID NO: 3402309 - RNA, 21 nt, Human
gaaacagguugggaugggaua

SEQ ID NO: 3402310 - RNA, 22 nt, Human
gaaacagguugggaugggauag

SEQ ID NO: 3402311 - RNA, 20 nt, Human
gaaacaguugguaacuuuug

SEQ ID NO: 3402312 - RNA, 21 nt, Human
gaaacaguugguaacuuuugu

SEQ ID NO: 3402313 - RNA, 13 nt, Human
gaaacauaaauaa

SEQ ID NO: 3402314 - RNA, 15 nt, Human
gaaacauaaauaaaa

SEQ ID NO: 3402315 - RNA, 17 nt, Human
gaaacaucucaauaaag

SEQ ID NO: 3402316 - RNA, 16 nt, Human
gaaacaugacacugac

SEQ ID NO: 3402317 - RNA, 17 nt, Human
gaaacaugacacugacc

SEQ ID NO: 3402318 - RNA, 20 nt, Human
gaaacaugacucguauaugu

SEQ ID NO: 3402319 - RNA, 23 nt, Human
gaaacauguugccaaaauggugg

SEQ ID NO: 3402320 - RNA, 18 nt, Human
gaaacauuggaagcaggu

SEQ ID NO: 3402321 - RNA, 11 nt, Human
gaaacauuugg

SEQ ID NO: 3402322 - RNA, 18 nt, Human
gaaaccacagcugcugga

SEQ ID NO: 3402323 - RNA, 20 nt, Human
gaaaccacagcugcuggaga

SEQ ID NO: 3402324 - RNA, 21 nt, Human
gaaaccauuaugaagaagaga

SEQ ID NO: 3402325 - RNA, 13 nt, Human
gaaacccagcucu

SEQ ID NO: 3402326 - RNA, 23 nt, Human
gaaacccagcucugguccauaga

SEQ ID NO: 3402327 - RNA, 22 nt, Human
gaaacccauaggcccacacaca

SEQ ID NO: 3402328 - RNA, 23 nt, Human
gaaacccauaggcccacacacag

SEQ ID NO: 3402329 - RNA, 17 nt, Human
gaaaccccaucucuacu

SEQ ID NO: 3402330 - RNA, 14 nt, Human
gaaacccucuguca

SEQ ID NO: 3402331 - RNA, 21 nt, Human
gaaaccuacacacugucaugc

SEQ ID NO: 3402332 - RNA, 16 nt, Human
gaaaccucuacauauu

SEQ ID NO: 3402333 - RNA, 20 nt, Human
gaaaccucuacuaaaaagaa

SEQ ID NO: 3402334 - RNA, 12 nt, Human
gaaaccugcccu

SEQ ID NO: 3402335 - RNA, 23 nt, Human
gaaaccuguaucuuucuaugcug

SEQ ID NO: 3402336 - RNA, 19 nt, Human
gaaaccuuauuguaccucu

SEQ ID NO: 3402337 - RNA, 13 nt, Human
gaaaccuuauuuu

SEQ ID NO: 3402338 - RNA, 17 nt, Human
gaaaccuuccacccagu

SEQ ID NO: 3402339 - RNA, 17 nt, Human
gaaaccuugguguaguu

SEQ ID NO: 3402340 - RNA, 22 nt, Human
gaaaccuugguguaguugaacu

SEQ ID NO: 3402341 - RNA, 14 nt, Human
gaaaccuuuuuuaa

SEQ ID NO: 3402342 - RNA, 17 nt, Human
gaaaccuuuuuuaagau

SEQ ID NO: 3402343 - RNA, 14 nt, Human
gaaacgcuaccucu

SEQ ID NO: 3402344 - RNA, 21 nt, Human
gaaacgcuaccucucuguccc

SEQ ID NO: 3402345 - RNA, 23 nt, Human
gaaacgcuaccucucugucccuu

SEQ ID NO: 3402346 - RNA, 16 nt, Human
gaaacgucuucuaaac

SEQ ID NO: 3402347 - RNA, 20 nt, Human
gaaacuaauugacuuuagaa

SEQ ID NO: 3402348 - RNA, 20 nt, Human
gaaacuacugccuuuagaaa

SEQ ID NO: 3402349 - RNA, 22 nt, Human
gaaacuacugccuuuagaaaau

SEQ ID NO: 3402350 - RNA, 21 nt, Human
gaaacuagaaagcagagauuu

SEQ ID NO: 3402351 - RNA, 14 nt, Human
gaaacuagaaaugu

SEQ ID NO: 3402352 - RNA, 21 nt, Human
gaaacuagcuguuuaaaguuu

SEQ ID NO: 3402353 - RNA, 18 nt, Human
gaaacuaggucugauauu

SEQ ID NO: 3402354 - RNA, 19 nt, Human
gaaacuaggugcauauuua

SEQ ID NO: 3402355 - RNA, 15 nt, Human
gaaacuaguguacau

SEQ ID NO: 3402356 - RNA, 13 nt, Human
gaaacuauguguu

SEQ ID NO: 3402357 - RNA, 14 nt, Human
gaaacuauguguuu

SEQ ID NO: 3402358 - RNA, 18 nt, Human
gaaacuauguguuuuucu

SEQ ID NO: 3402359 - RNA, 20 nt, Human
gaaacucaccauguaaaaga

SEQ ID NO: 3402360 - RNA, 20 nt, Human
gaaacucaccugcuggcccc

SEQ ID NO: 3402361 - RNA, 22 nt, Human
gaaacucaccugcuggccccuc

SEQ ID NO: 3402362 - RNA, 16 nt, Human
gaaacuccacaucugc

SEQ ID NO: 3402363 - RNA, 17 nt, Human
gaaacuccacaucugcc

SEQ ID NO: 3402364 - RNA, 18 nt, Human
gaaacuccacaucugccu

SEQ ID NO: 3402365 - RNA, 20 nt, Human
gaaacuccacaucugccuua

SEQ ID NO: 3402366 - RNA, 18 nt, Human
gaaacuccgucuuagaag

SEQ ID NO: 3402367 - RNA, 23 nt, Human
gaaacucguuaauuuguaguguu

SEQ ID NO: 3402368 - RNA, 15 nt, Human
gaaacucuuaucuca

SEQ ID NO: 3402369 - RNA, 16 nt, Human
gaaacucuuaucucag

SEQ ID NO: 3402370 - RNA, 20 nt, Human
gaaacucuuaucucagucau

SEQ ID NO: 3402371 - RNA, 19 nt, Human
gaaacugacaugcccuccc

SEQ ID NO: 3402372 - RNA, 22 nt, Human
gaaacugaggaauuuucuuugu

SEQ ID NO: 3402373 - RNA, 13 nt, Human
gaaacugccagca

SEQ ID NO: 3402374 - RNA, 15 nt, Human
gaaacugccagcaac

SEQ ID NO: 3402375 - RNA, 16 nt, Human
gaaacuggcaaagcag

SEQ ID NO: 3402376 - RNA, 21 nt, Human
gaaacuggccauggccugcaa

SEQ ID NO: 3402377 - RNA, 18 nt, Human
gaaacuguagucucagga

SEQ ID NO: 3402378 - RNA, 21 nt, Human
gaaacuguugccagagaugga

SEQ ID NO: 3402379 - RNA, 23 nt, Human
gaaacuguugccagagauggagg

SEQ ID NO: 3402380 - RNA, 19 nt, Human
gaaacuuaaauguuauuau

SEQ ID NO: 3402381 - RNA, 16 nt, Human
gaaacuuaucuuacaa

SEQ ID NO: 3402382 - RNA, 19 nt, Human
gaaacuuaucuuacaaagu

SEQ ID NO: 3402383 - RNA, 11 nt, Human
gaaacuuauuu

SEQ ID NO: 3402384 - RNA, 12 nt, Human
gaaacuuauuuu

SEQ ID NO: 3402385 - RNA, 17 nt, Human
gaaacuuauuuuuuucu

SEQ ID NO: 3402386 - RNA, 17 nt, Human
gaaacuugucacuugca

SEQ ID NO: 3402387 - RNA, 19 nt, Human
gaaacuugucacuugcaug

SEQ ID NO: 3402388 - RNA, 14 nt, Human
gaaacuuguguaaa

SEQ ID NO: 3402389 - RNA, 20 nt, Human
gaaacuuguuagaaaugcaa

SEQ ID NO: 3402390 - RNA, 17 nt, Human
gaaacuuguuauuguga

SEQ ID NO: 3402391 - RNA, 19 nt, Human
gaaacuuguuauugugaau

SEQ ID NO: 3402392 - RNA, 22 nt, Human
gaaacuuguucuuccaaagcag

SEQ ID NO: 3402393 - RNA, 18 nt, Human
gaaacuuguuucacugaa

SEQ ID NO: 3402394 - RNA, 17 nt, Human
gaaauggaauacugaag

SEQ ID NO: 3402395 - RNA, 20 nt, Human
gaaauggacugguuugagau

SEQ ID NO: 3402396 - RNA, 16 nt, Human
gaaauggauacuacau

SEQ ID NO: 3402397 - RNA, 16 nt, Human
gaaauggcuuugugau

SEQ ID NO: 3402398 - RNA, 17 nt, Human
gaaaugggacuuaacuc

SEQ ID NO: 3402399 - RNA, 16 nt, Human
gaaaugggcagagcag

SEQ ID NO: 3402400 - RNA, 17 nt, Human
gaaaugggcagagcaga

SEQ ID NO: 3402401 - RNA, 17 nt, Human
gaaaugguaugagcuga

SEQ ID NO: 3402402 - RNA, 21 nt, Human
gaaaugguaugagcugagggg

SEQ ID NO: 3402403 - RNA, 13 nt, Human
gaaaugguuguau

SEQ ID NO: 3402404 - RNA, 17 nt, Human
gaaaugguuguauuaga

SEQ ID NO: 3402405 - RNA, 14 nt, Human
gaaauguaaggcug

SEQ ID NO: 3402406 - RNA, 12 nt, Human
gaaauguaaugc

SEQ ID NO: 3402407 - RNA, 17 nt, Human
gaaauguacagcaagga

SEQ ID NO: 3402408 - RNA, 20 nt, Human
gaaaugucccuuucuucucc

SEQ ID NO: 3402409 - RNA, 13 nt, Human
gaaauguguguga

SEQ ID NO: 3402410 - RNA, 18 nt, Human
gaaaugugugugauguga

SEQ ID NO: 3402411 - RNA, 19 nt, Human
gaaaugugugugaugugac

SEQ ID NO: 3402412 - RNA, 21 nt, Human
gaaaugugugugaugugacau

SEQ ID NO: 3402413 - RNA, 13 nt, Human
gaaauguguuucu

SEQ ID NO: 3402414 - RNA, 14 nt, Human
gaaauguuuuguaa

SEQ ID NO: 3402415 - RNA, 19 nt, Human
gaaauguuuuuaauaaaag

SEQ ID NO: 3402416 - RNA, 20 nt, Human
gaaauuaaaacuauucaugc

SEQ ID NO: 3402417 - RNA, 13 nt, Human
gaaauuaaaguuu

SEQ ID NO: 3402418 - RNA, 22 nt, Human
gaaauuaagaaggcaaaaaugu

SEQ ID NO: 3402419 - RNA, 17 nt, Human
gaaauuaccaaaauguc

SEQ ID NO: 3402420 - RNA, 20 nt, Human
gaaauuacuaauuuuacuuc

SEQ ID NO: 3402421 - RNA, 19 nt, Human
gaaauuagcugugugaaau

SEQ ID NO: 3402422 - RNA, 14 nt, Human
gaaauuaggaugua

SEQ ID NO: 3402423 - RNA, 18 nt, Human
gaaauuauguauguuuac

SEQ ID NO: 3402424 - RNA, 17 nt, Human
gaaauuauuuaauaaaa

SEQ ID NO: 3402425 - RNA, 22 nt, Human
gaaauucccuucaucuggaacc

SEQ ID NO: 3402426 - RNA, 19 nt, Human
gaaauuccuguagcaucuu

SEQ ID NO: 3402427 - RNA, 15 nt, Human
gaaauucguguguuu

SEQ ID NO: 3402428 - RNA, 15 nt, Human
gaaauucuccuggag

SEQ ID NO: 3402429 - RNA, 15 nt, Human
gaaauucugaauuug

SEQ ID NO: 3402430 - RNA, 19 nt, Human
gaaauucugaauuugcaaa

SEQ ID NO: 3402431 - RNA, 11 nt, Human
gaaauucuguu

SEQ ID NO: 3402432 - RNA, 15 nt, Human
gaaauucuguuaaaa

SEQ ID NO: 3402433 - RNA, 18 nt, Human
gaaauucuguuaaaaucu

SEQ ID NO: 3402434 - RNA, 24 nt, Human
gaaauucuguuaaaaucuauucug

SEQ ID NO: 3402435 - RNA, 16 nt, Human
gaaauucuguuuuuaa

SEQ ID NO: 3402436 - RNA, 22 nt, Human
gaaauucuuguuaugguagaaa

SEQ ID NO: 3402437 - RNA, 23 nt, Human
gaaauucuuucccagucugucga

SEQ ID NO: 3402438 - RNA, 16 nt, Human
gaaauugaauacuuug

SEQ ID NO: 3402439 - RNA, 17 nt, Human
gaaauugaauacuuuga

SEQ ID NO: 3402440 - RNA, 18 nt, Human
gaaauugaauacuuugaa

SEQ ID NO: 3402441 - RNA, 20 nt, Human
gaaauugaauacuuugaaug

SEQ ID NO: 3402442 - RNA, 22 nt, Human
gaaauugaauacuuugaaugug

SEQ ID NO: 3402443 - RNA, 21 nt, Human
gaaauugacacaaguggaccu

SEQ ID NO: 3402444 - RNA, 12 nt, Human
gaaauugacaga

SEQ ID NO: 3402445 - RNA, 23 nt, Human
gaaauugagcugcuuuuuuugaa

SEQ ID NO: 3402446 - RNA, 15 nt, Human
gaaauugauuuugaa

SEQ ID NO: 3402447 - RNA, 13 nt, Human
gaaauugcauacu

SEQ ID NO: 3402448 - RNA, 19 nt, Human
gaaauugcauuuccugaca

SEQ ID NO: 3402449 - RNA, 15 nt, Human
gaaauuggcuggaug

SEQ ID NO: 3402450 - RNA, 16 nt, Human
gaaauugguaccuugc

SEQ ID NO: 3402451 - RNA, 20 nt, Human
gaaauugguaccuugcacac

SEQ ID NO: 3402452 - RNA, 18 nt, Human
gaaauuguacauauuugu

SEQ ID NO: 3402453 - RNA, 13 nt, Human
gaaauugugaacu

SEQ ID NO: 3402454 - RNA, 18 nt, Human
gaaauugugaacucauug

SEQ ID NO: 3402455 - RNA, 15 nt, Human
gaaauuuaaacauua

SEQ ID NO: 3402456 - RNA, 20 nt, Human
gaaauuuaaacuauaagcaa

SEQ ID NO: 3402457 - RNA, 14 nt, Human
gaaauuuaaagcag

SEQ ID NO: 3402458 - RNA, 13 nt, Human
gaaauuuacuaua

SEQ ID NO: 3402459 - RNA, 18 nt, Human
gaaauuuagcauuguagu

SEQ ID NO: 3402460 - RNA, 18 nt, Human
gaaauuucacauagccca

SEQ ID NO: 3402461 - RNA, 20 nt, Human
gaaauuucacgucauaggaa

SEQ ID NO: 3402462 - RNA, 21 nt, Human
gaaauuucagauucccagagc

SEQ ID NO: 3402463 - RNA, 23 nt, Human
gaaauuucagauucccagagcaa

SEQ ID NO: 3402464 - RNA, 20 nt, Human
gaaauuuccuaauuuauucu

SEQ ID NO: 3402465 - RNA, 11 nt, Human
gaaauuugaau

SEQ ID NO: 3402466 - RNA, 13 nt, Human
gaaauuugaauuu

SEQ ID NO: 3402467 - RNA, 13 nt, Human
gaaauuuuaccaa

SEQ ID NO: 3402468 - RNA, 18 nt, Human
gaaauuuucuagacuuuc

SEQ ID NO: 3402469 - RNA, 21 nt, Human
gaaauuuucuagacuuucugu

SEQ ID NO: 3402470 - RNA, 19 nt, Human
gaaauuuugcaaauauaaa

SEQ ID NO: 3402471 - RNA, 22 nt, Human
gaaauuuugcaaauauaaacau

SEQ ID NO: 3402472 - RNA, 13 nt, Human
gaaauuuugcuau

SEQ ID NO: 3402473 - RNA, 15 nt, Human
gaaauuuuguaagaa

SEQ ID NO: 3402474 - RNA, 20 nt, Human
gaaauuuuguaagaaggcaa

SEQ ID NO: 3402475 - RNA, 22 nt, Human
gaaauuuuucagaugcuucugg

SEQ ID NO: 3402476 - RNA, 13 nt, Human
gaaauuuuucaua

SEQ ID NO: 3402477 - RNA, 15 nt, Human
gaaauuuuucauauu

SEQ ID NO: 3402478 - RNA, 14 nt, Human
gaaauuuuuguaaa

SEQ ID NO: 3402479 - RNA, 15 nt, Human
gaaauuuuuguaaau

SEQ ID NO: 3402480 - RNA, 21 nt, Human
gaaauuuuuguaaaucacauc

SEQ ID NO: 3402481 - RNA, 14 nt, Human
gaacaaaaaaacca

SEQ ID NO: 3402482 - RNA, 19 nt, Human
gaacaaaaaaaccacaaag

SEQ ID NO: 3402483 - RNA, 21 nt, Human
gaacaaaaaaaucugcagaag

SEQ ID NO: 3402484 - RNA, 23 nt, Human
gaacaaaacacacgcgcgcacac

SEQ ID NO: 3402485 - RNA, 15 nt, Human
gaacaaaauaaauug

SEQ ID NO: 3402486 - RNA, 15 nt, Human
gaacaaagcagccac

SEQ ID NO: 3402487 - RNA, 13 nt, Human
gaacaaagcuguu

SEQ ID NO: 3402488 - RNA, 18 nt, Human
gaacaaagcuguuaaacu

SEQ ID NO: 3402489 - RNA, 20 nt, Human
gaacaaagcuguuaaacugu

SEQ ID NO: 3402490 - RNA, 22 nt, Human
gaacaaaggacagaguaugaac

SEQ ID NO: 3402491 - RNA, 17 nt, Human
gaacaaagugaaggaca

SEQ ID NO: 3402492 - RNA, 15 nt, Human
gaacaaauggccuuu

SEQ ID NO: 3402493 - RNA, 23 nt, Human
gaacaaauguuuauuaagcauca

SEQ ID NO: 3402494 - RNA, 14 nt, Human
gaacaaauuauuuu

SEQ ID NO: 3402495 - RNA, 18 nt, Human
gaacaaauuuacagagac

SEQ ID NO: 3402496 - RNA, 17 nt, Human
gaacaagagaagcauuc

SEQ ID NO: 3402497 - RNA, 16 nt, Human
gaacaagaugguucua

SEQ ID NO: 3402498 - RNA, 16 nt, Human
gaacaagcauucuccu

SEQ ID NO: 3402499 - RNA, 18 nt, Human
gaacaagcuucaguaagu

SEQ ID NO: 3402500 - RNA, 14 nt, Human
gaacaaggcaaggc

SEQ ID NO: 3402501 - RNA, 13 nt, Human
gaacaagugaaca

SEQ ID NO: 3402502 - RNA, 17 nt, Human
gaacaagugaacacauu

SEQ ID NO: 3402503 - RNA, 12 nt, Human
gaacaaguuuua

SEQ ID NO: 3402504 - RNA, 12 nt, Human
gaacaaugaagu

SEQ ID NO: 3402505 - RNA, 13 nt, Human
gaacaauugaagu

SEQ ID NO: 3402506 - RNA, 20 nt, Human
gaacaauugaaguaaacuuu

SEQ ID NO: 3402507 - RNA, 20 nt, Human
gaacaauuuggcaauuuugu

SEQ ID NO: 3402508 - RNA, 20 nt, Human
gaacacaaacacauuguuau

SEQ ID NO: 3402509 - RNA, 17 nt, Human
gaacacaaacuguaaau

SEQ ID NO: 3402510 - RNA, 22 nt, Human
gaacacaaagcggggggagggu

SEQ ID NO: 3402511 - RNA, 16 nt, Human
gaacacacacauauac

SEQ ID NO: 3402512 - RNA, 17 nt, Human
gaacacacacauauaca

SEQ ID NO: 3402513 - RNA, 11 nt, Human
gaacacaggca

SEQ ID NO: 3402514 - RNA, 17 nt, Human
gaacacaggcaaaaucc

SEQ ID NO: 3402515 - RNA, 12 nt, Human
gaacacaggcag

SEQ ID NO: 3402516 - RNA, 19 nt, Human
gaacacaggcagcuuucua

SEQ ID NO: 3402517 - RNA, 22 nt, Human
gaacaccacgcuugacaggaca

SEQ ID NO: 3402518 - RNA, 20 nt, Human
gaacaccauagguagaaugu

SEQ ID NO: 3402519 - RNA, 16 nt, Human
gaacaccauugaaggc

SEQ ID NO: 3402520 - RNA, 21 nt, Human
gaacacccgacuccucaaaag

SEQ ID NO: 3402521 - RNA, 23 nt, Human
gaacacccuuagaaaaugugucc

SEQ ID NO: 3402522 - RNA, 22 nt, Human
gaacacuaaccugaccgugggc

SEQ ID NO: 3402523 - RNA, 22 nt, Human
gaacacuaacucaccagcccca

SEQ ID NO: 3402524 - RNA, 15 nt, Human
gaacacuaauucaua

SEQ ID NO: 3402525 - RNA, 18 nt, Human
gaacacuagacaagccag

SEQ ID NO: 3402526 - RNA, 13 nt, Human
gaacacuagccag

SEQ ID NO: 3402527 - RNA, 13 nt, Human
gaacacuauuuuc

SEQ ID NO: 3402528 - RNA, 17 nt, Human
gaacacuauuuucagaa

SEQ ID NO: 3402529 - RNA, 21 nt, Human
gaacacuauuuucagaaucug

SEQ ID NO: 3402530 - RNA, 18 nt, Human
gaacacuccaauuaagga

SEQ ID NO: 3402531 - RNA, 13 nt, Human
gaacacucugaga

SEQ ID NO: 3402532 - RNA, 15 nt, Human
gaacacucugagacu

SEQ ID NO: 3402533 - RNA, 16 nt, Human
gaacacucuuuugcuu

SEQ ID NO: 3402534 - RNA, 18 nt, Human
gaacacucuuuugcuuua

SEQ ID NO: 3402535 - RNA, 13 nt, Human
gaacacugcccuc

SEQ ID NO: 3402536 - RNA, 22 nt, Human
gaacacuggcagacuguguaaa

SEQ ID NO: 3402537 - RNA, 18 nt, Human
gaacacugggggagggga

SEQ ID NO: 3402538 - RNA, 16 nt, Human
gaacacuuauugcuuu

SEQ ID NO: 3402539 - RNA, 21 nt, Human
gacaauaauauuguuguauaa

SEQ ID NO: 3402540 - RNA, 14 nt, Human
gacaauagaacauu

SEQ ID NO: 3402541 - RNA, 17 nt, Human
gacaaucaacucuaaua

SEQ ID NO: 3402542 - RNA, 20 nt, Human
gacaaucaguccccucccau

SEQ ID NO: 3402543 - RNA, 13 nt, Human
gacaaucaugugu

SEQ ID NO: 3402544 - RNA, 17 nt, Human
gacaaucauuguuuuga

SEQ ID NO: 3402545 - RNA, 13 nt, Human
gacaaucuucugu

SEQ ID NO: 3402546 - RNA, 20 nt, Human
gacaaugacuuacuguacau

SEQ ID NO: 3402547 - RNA, 12 nt, Human
gacaaugcaaac

SEQ ID NO: 3402548 - RNA, 16 nt, Human
gacaaugcaaaccauc

SEQ ID NO: 3402549 - RNA, 20 nt, Human
gacaaugcagaugccagagc

SEQ ID NO: 3402550 - RNA, 20 nt, Human
gacaauggacccuuuuuguu

SEQ ID NO: 3402551 - RNA, 17 nt, Human
gacaaugucugcagccc

SEQ ID NO: 3402552 - RNA, 20 nt, Human
gacaaugugaaaagaaaaau

SEQ ID NO: 3402553 - RNA, 13 nt, Human
gacaauucaugaa

SEQ ID NO: 3402554 - RNA, 23 nt, Human
gacaauuccuagauaaaaagaug

SEQ ID NO: 3402555 - RNA, 13 nt, Human
gacaauucuguuu

SEQ ID NO: 3402556 - RNA, 12 nt, Human
gacaauuuauua

SEQ ID NO: 3402557 - RNA, 13 nt, Human
gacacaaaaaaag

SEQ ID NO: 3402558 - RNA, 18 nt, Human
gacacaaaacuccgcccc

SEQ ID NO: 3402559 - RNA, 23 nt, Human
gacacaaaacuccgcccccagcc

SEQ ID NO: 3402560 - RNA, 23 nt, Human
gacacaaacaaacaagcuaggug

SEQ ID NO: 3402561 - RNA, 19 nt, Human
gacacaaacacacacaaaa

SEQ ID NO: 3402562 - RNA, 18 nt, Human
gacacaaaccugccuggg

SEQ ID NO: 3402563 - RNA, 22 nt, Human
gacacaagccuucggcgccuua

SEQ ID NO: 3402564 - RNA, 14 nt, Human
gacacacaaagcag

SEQ ID NO: 3402565 - RNA, 22 nt, Human
gacacacacacgcacgcacaca

SEQ ID NO: 3402566 - RNA, 23 nt, Human
gacacacacacgcacgcacacac

SEQ ID NO: 3402567 - RNA, 16 nt, Human
gacacacuacaccaca

SEQ ID NO: 3402568 - RNA, 20 nt, Human
gacacacuacaccacacaca

SEQ ID NO: 3402569 - RNA, 12 nt, Human
gacacagacuca

SEQ ID NO: 3402570 - RNA, 11 nt, Human
gacacagcagc

SEQ ID NO: 3402571 - RNA, 20 nt, Human
gacacagcagcuucaccaga

SEQ ID NO: 3402572 - RNA, 22 nt, Human
gacacagcagcuucaccagagc

SEQ ID NO: 3402573 - RNA, 20 nt, Human
gacacagcucuucuccaggc

SEQ ID NO: 3402574 - RNA, 23 nt, Human
gacacagcucuucuccaggcugu

SEQ ID NO: 3402575 - RNA, 20 nt, Human
gacacaggaugaaggcaaug

SEQ ID NO: 3402576 - RNA, 12 nt, Human
gacacaggcccg

SEQ ID NO: 3402577 - RNA, 20 nt, Human
gacacaggcccggcuccagg

SEQ ID NO: 3402578 - RNA, 21 nt, Human
gacacaggcccggcuccaggc

SEQ ID NO: 3402579 - RNA, 14 nt, Human
gacacaggccugug

SEQ ID NO: 3402580 - RNA, 17 nt, Human
gacacaggccuguguag

SEQ ID NO: 3402581 - RNA, 16 nt, Human
gacacagggacuugaa

SEQ ID NO: 3402582 - RNA, 18 nt, Human
gacacagggacuugaagu

SEQ ID NO: 3402583 - RNA, 20 nt, Human
gacacagggacuugaaguug

SEQ ID NO: 3402584 - RNA, 16 nt, Human
gacacaggucuuuccu

SEQ ID NO: 3402585 - RNA, 13 nt, Human
gacacaguuccug

SEQ ID NO: 3402586 - RNA, 23 nt, Human
gacacauccgccuuuuguauaca

SEQ ID NO: 3402587 - RNA, 19 nt, Human
gacacaugaagguaaauaa

SEQ ID NO: 3402588 - RNA, 14 nt, Human
gacacaugcaaggu

SEQ ID NO: 3402589 - RNA, 19 nt, Human
gacacaugcaaggucauuu

SEQ ID NO: 3402590 - RNA, 14 nt, Human
gacaccaaaguucu

SEQ ID NO: 3402591 - RNA, 13 nt, Human
gacaccagagcag

SEQ ID NO: 3402592 - RNA, 18 nt, Human
gacaccagagcagaugca

SEQ ID NO: 3402593 - RNA, 15 nt, Human
gacaccagccaggcu

SEQ ID NO: 3402594 - RNA, 23 nt, Human
gacaccagccaggcucugugcug

SEQ ID NO: 3402595 - RNA, 19 nt, Human
gacaccaggagucccuggu

SEQ ID NO: 3402596 - RNA, 20 nt, Human
gacaccaggagucccuggua

SEQ ID NO: 3402597 - RNA, 22 nt, Human
gacaccaucuuuugugagaugu

SEQ ID NO: 3402598 - RNA, 15 nt, Human
gacaccccacuuagc

SEQ ID NO: 3402599 - RNA, 18 nt, Human
gacaccccuuauccagga

SEQ ID NO: 3402600 - RNA, 12 nt, Human
gacacccuguga

SEQ ID NO: 3402601 - RNA, 16 nt, Human
gacaccgccacauggc

SEQ ID NO: 3402602 - RNA, 20 nt, Human
gacaccgggguggugggaac

SEQ ID NO: 3402603 - RNA, 18 nt, Human
gacaccuaacucuucuuu

SEQ ID NO: 3402604 - RNA, 17 nt, Human
gacaccugaacccucca

SEQ ID NO: 3402605 - RNA, 13 nt, Human
gacaccugcaccu

SEQ ID NO: 3402606 - RNA, 20 nt, Human
gacaccugcaccucccccca

SEQ ID NO: 3402607 - RNA, 12 nt, Human
gacaccugcccu

SEQ ID NO: 3402608 - RNA, 13 nt, Human
gacaccugcccug

SEQ ID NO: 3402609 - RNA, 16 nt, Human
gacaccugcccugccc

SEQ ID NO: 3402610 - RNA, 18 nt, Human
gacaccuugacagggcac

SEQ ID NO: 3402611 - RNA, 20 nt, Human
gacaccuuucagucucuuuu

SEQ ID NO: 3402612 - RNA, 12 nt, Human
gacaccuuucau

SEQ ID NO: 3402613 - RNA, 17 nt, Human
gacaccuuugcaggcau

SEQ ID NO: 3402614 - RNA, 19 nt, Human
gacaccuuuuuucaacagu

SEQ ID NO: 3402615 - RNA, 19 nt, Human
gacacgaauauugcugaug

SEQ ID NO: 3402616 - RNA, 19 nt, Human
gacacgcacggcagccaca

SEQ ID NO: 3402617 - RNA, 17 nt, Human
gacacgccuuccccuca

SEQ ID NO: 3402618 - RNA, 21 nt, Human
gacacgccuuccccucagcca

SEQ ID NO: 3402619 - RNA, 21 nt, Human
gacacgcgccccccucccaga

SEQ ID NO: 3402620 - RNA, 23 nt, Human
gacacgcucccucccccugcccc

SEQ ID NO: 3402621 - RNA, 15 nt, Human
gacacggagcccagc

SEQ ID NO: 3402622 - RNA, 18 nt, Human
gacacgggccuguccaca

SEQ ID NO: 3402623 - RNA, 19 nt, Human
gacacggucggggcaucug

SEQ ID NO: 3402624 - RNA, 20 nt, Human
gacacgugggcuccccucuu

SEQ ID NO: 3402625 - RNA, 23 nt, Human
gacacgugggcuccccucuuccu

SEQ ID NO: 3402626 - RNA, 18 nt, Human
gacacuaaccacgcugga

SEQ ID NO: 3402627 - RNA, 18 nt, Human
gacacuaaguuauaguau

SEQ ID NO: 3402628 - RNA, 13 nt, Human
gacacuagaagau

SEQ ID NO: 3402629 - RNA, 18 nt, Human
gacacuagcccaaugaaa

SEQ ID NO: 3402630 - RNA, 19 nt, Human
gacacucagaccagagaag

SEQ ID NO: 3402631 - RNA, 15 nt, Human
gacacuccagggaca

SEQ ID NO: 3402632 - RNA, 13 nt, Human
gacacucccaccc

SEQ ID NO: 3402633 - RNA, 23 nt, Human
gacacucccacccagucucugcu

SEQ ID NO: 3402634 - RNA, 14 nt, Human
gacacuccuagaga

SEQ ID NO: 3402635 - RNA, 21 nt, Human
gacacucgaggucgggcagca

SEQ ID NO: 3402636 - RNA, 20 nt, Human
gacacucuauaagauuccaa

SEQ ID NO: 3402637 - RNA, 15 nt, Human
gacacucuccuugca

SEQ ID NO: 3402638 - RNA, 19 nt, Human
gacacucuccuugcaguuc

SEQ ID NO: 3402639 - RNA, 13 nt, Human
gacacucugcucu

SEQ ID NO: 3402640 - RNA, 20 nt, Human
gacacugaaaguuuuguaaa

SEQ ID NO: 3402641 - RNA, 13 nt, Human
gacacugaaauaa

SEQ ID NO: 3402642 - RNA, 12 nt, Human
gacacugaaaug

SEQ ID NO: 3402643 - RNA, 15 nt, Human
gacacugaugggcaa

SEQ ID NO: 3402644 - RNA, 21 nt, Human
gacacugcucuaacagcccuc

SEQ ID NO: 3402645 - RNA, 16 nt, Human
gacacugggaggccag

SEQ ID NO: 3402646 - RNA, 20 nt, Human
gacacuggugccaugucagc

SEQ ID NO: 3402647 - RNA, 19 nt, Human
gacacugguuuacacuuua

SEQ ID NO: 3402648 - RNA, 16 nt, Human
gacacugguuugaaga

SEQ ID NO: 3402649 - RNA, 12 nt, Human
gacacuguucuu

SEQ ID NO: 3402650 - RNA, 17 nt, Human
gacacuguugauaaaaa

SEQ ID NO: 3402651 - RNA, 19 nt, Human
gacacuguuuacaagaaaa

SEQ ID NO: 3402652 - RNA, 16 nt, Human
gacacuuaaaaauggu

SEQ ID NO: 3402653 - RNA, 21 nt, Human
gacacuucaaggugacagaag

SEQ ID NO: 3402654 - RNA, 19 nt, Human
gacacuucccucuguuucu

SEQ ID NO: 3402655 - RNA, 21 nt, Human
gacacuucccucuguuucucu

SEQ ID NO: 3402656 - RNA, 13 nt, Human
gacacuuccugcc

SEQ ID NO: 3402657 - RNA, 15 nt, Human
gacacuuccugccua

SEQ ID NO: 3402658 - RNA, 15 nt, Human
gacacuugccuucuu

SEQ ID NO: 3402659 - RNA, 20 nt, Human
gacacuuugaaauguguuuc

SEQ ID NO: 3402660 - RNA, 21 nt, Human
gacacuuugaaauguguuucu

SEQ ID NO: 3402661 - RNA, 17 nt, Human
gacacuuuucauaucau

SEQ ID NO: 3402662 - RNA, 21 nt, Human
gacagaaaggagaguggccau

SEQ ID NO: 3402663 - RNA, 14 nt, Human
gacagaacacuguc

SEQ ID NO: 3402664 - RNA, 13 nt, Human
gacagaagcaggc

SEQ ID NO: 3402665 - RNA, 19 nt, Human
gacagaaggcuccugcccc

SEQ ID NO: 3402666 - RNA, 20 nt, Human
gacagaaggcuccugccccc

SEQ ID NO: 3402667 - RNA, 17 nt, Human
gacagaagucuccucaa

SEQ ID NO: 3402668 - RNA, 15 nt, Human
gacagaaguuugcac

SEQ ID NO: 3402669 - RNA, 18 nt, Human
gacagaauuuuuuuuguu

SEQ ID NO: 3402670 - RNA, 15 nt, Human
gacagacacacacac

SEQ ID NO: 3402671 - RNA, 12 nt, Human
gacagacacagg

SEQ ID NO: 3402672 - RNA, 14 nt, Human
gacagacacaggcc

SEQ ID NO: 3402673 - RNA, 15 nt, Human
gacagacagcccucc

SEQ ID NO: 3402674 - RNA, 19 nt, Human
gacagacuccugaggacag

SEQ ID NO: 3402675 - RNA, 23 nt, Human
gacagacuccugaggacagcugu

SEQ ID NO: 3402676 - RNA, 18 nt, Human
gacagacuugagaacuug

SEQ ID NO: 3402677 - RNA, 22 nt, Human
gacagagaauaugucugcuccu

SEQ ID NO: 3402678 - RNA, 22 nt, Human
gacagagacaccugcaccuccc

SEQ ID NO: 3402679 - RNA, 14 nt, Human
gacagagagagaga

SEQ ID NO: 3402680 - RNA, 16 nt, Human
gacagagaggacugua

SEQ ID NO: 3402681 - RNA, 20 nt, Human
gacagagcaaccccuggacc

SEQ ID NO: 3402682 - RNA, 13 nt, Human
gacagagccagga

SEQ ID NO: 3402683 - RNA, 16 nt, Human
gacagagccaggagaa

SEQ ID NO: 3402684 - RNA, 13 nt, Human
gacagagccaugc

SEQ ID NO: 3402685 - RNA, 18 nt, Human
gacagagcgacagagcag

SEQ ID NO: 3402686 - RNA, 20 nt, Human
gacagagcugguugggaaga

SEQ ID NO: 3402687 - RNA, 17 nt, Human
gacagaggcagccccau

SEQ ID NO: 3402688 - RNA, 19 nt, Human
gacagaggccccagccucc

SEQ ID NO: 3402689 - RNA, 12 nt, Human
gacagaggccug

SEQ ID NO: 3402690 - RNA, 13 nt, Human
gacagaggccugc

SEQ ID NO: 3402691 - RNA, 13 nt, Human
gacagagggaaga

SEQ ID NO: 3402692 - RNA, 19 nt, Human
gacagagggaagaaaagag

SEQ ID NO: 3402693 - RNA, 15 nt, Human
gacagaggggacucu

SEQ ID NO: 3402694 - RNA, 21 nt, Human
gacagaggggguggccuccca

SEQ ID NO: 3402695 - RNA, 21 nt, Human
gacagagucucacuguugccc

SEQ ID NO: 3402696 - RNA, 15 nt, Human
gacagagucugggug

SEQ ID NO: 3402697 - RNA, 19 nt, Human
gacagagugagacucuguc

SEQ ID NO: 3402698 - RNA, 19 nt, Human
gacagaucaagcugugaga

SEQ ID NO: 3402699 - RNA, 23 nt, Human
gacagauccccguuccugacauc

SEQ ID NO: 3402700 - RNA, 20 nt, Human
gacagaugaggcuuuccaug

SEQ ID NO: 3402701 - RNA, 14 nt, Human
gacagaugccuccu

SEQ ID NO: 3402702 - RNA, 17 nt, Human
gacagauucagucuugc

SEQ ID NO: 3402703 - RNA, 19 nt, Human
gacagcaaaaccauugcuu

SEQ ID NO: 3402704 - RNA, 20 nt, Human
gacagcaaaaccauugcuuc

SEQ ID NO: 3402705 - RNA, 18 nt, Human
gacagcaaccuguagagu

SEQ ID NO: 3402706 - RNA, 19 nt, Human
gacagcaacggggaggcca

SEQ ID NO: 3402707 - RNA, 14 nt, Human
gacagcagaacugc

SEQ ID NO: 3402708 - RNA, 14 nt, Human
gacagcagcaucuc

SEQ ID NO: 3402709 - RNA, 16 nt, Human
gacagcagcaucucua

SEQ ID NO: 3402710 - RNA, 13 nt, Human
gacagcagcucag

SEQ ID NO: 3402711 - RNA, 16 nt, Human
gacagcagcucaggca

SEQ ID NO: 3402712 - RNA, 20 nt, Human
gacagcagcucaggcacacu

SEQ ID NO: 3402713 - RNA, 14 nt, Human
gacagcaggcagcg

SEQ ID NO: 3402714 - RNA, 16 nt, Human
gacagcaggugggaaa

SEQ ID NO: 3402715 - RNA, 12 nt, Human
gacagcaugaga

SEQ ID NO: 3402716 - RNA, 13 nt, Human
gacagcauggugc

SEQ ID NO: 3402717 - RNA, 20 nt, Human
gacagcaugugcccuccuga

SEQ ID NO: 3402718 - RNA, 16 nt, Human
gacagcauuuuccucu

SEQ ID NO: 3402719 - RNA, 20 nt, Human
gacagcauuuuccucugcuu

SEQ ID NO: 3402720 - RNA, 23 nt, Human
gacagcauuuuccucugcuuuga

SEQ ID NO: 3402721 - RNA, 16 nt, Human
gacagccaaaggcugg

SEQ ID NO: 3402722 - RNA, 13 nt, Human
gacagccacggcc

SEQ ID NO: 3402723 - RNA, 17 nt, Human
gacagccacggccaggc

SEQ ID NO: 3402724 - RNA, 22 nt, Human
gacagcccaggauacuggcaca

SEQ ID NO: 3402725 - RNA, 14 nt, Human
gacagccccagagc

SEQ ID NO: 3402726 - RNA, 16 nt, Human
gacagccccagagcag

SEQ ID NO: 3402727 - RNA, 17 nt, Human
gacagccccagagcagg

SEQ ID NO: 3402728 - RNA, 17 nt, Human
gacagcccgggcucugc

SEQ ID NO: 3402729 - RNA, 20 nt, Human
gacagcccgggcucugccuc

SEQ ID NO: 3402730 - RNA, 16 nt, Human
gacagccucccacccc

SEQ ID NO: 3402731 - RNA, 18 nt, Human
gacagccucccccugucc

SEQ ID NO: 3402732 - RNA, 23 nt, Human
gacagccuguggcggugccuggg

SEQ ID NO: 3402733 - RNA, 12 nt, Human
gacagcuccacc

SEQ ID NO: 3402734 - RNA, 18 nt, Human
gacagcuccacccuggcc

SEQ ID NO: 3402735 - RNA, 16 nt, Human
gacagcucccucugcc

SEQ ID NO: 3402736 - RNA, 17 nt, Human
gacagcucccucugccu

SEQ ID NO: 3402737 - RNA, 17 nt, Human
gacagcuccuucugucc

SEQ ID NO: 3402738 - RNA, 16 nt, Human
gacagcugccugggau

SEQ ID NO: 3402739 - RNA, 18 nt, Human
gacagcugccugggaucc

SEQ ID NO: 3402740 - RNA, 11 nt, Human
gacagcugcuc

SEQ ID NO: 3402741 - RNA, 14 nt, Human
gacagcugcuccua

SEQ ID NO: 3402742 - RNA, 20 nt, Human
gacagcugcuccuagaggga

SEQ ID NO: 3402743 - RNA, 21 nt, Human
gacagcugcuccuagagggag

SEQ ID NO: 3402744 - RNA, 19 nt, Human
gacagcugucccugucacc

SEQ ID NO: 3402745 - RNA, 19 nt, Human
gacagcugugccucgcucc

SEQ ID NO: 3402746 - RNA, 17 nt, Human
gacagcuuagaauuauu

SEQ ID NO: 3402747 - RNA, 22 nt, Human
gacagcuucucauccugcaggc

SEQ ID NO: 3402748 - RNA, 15 nt, Human
gacagcuugagccgg

SEQ ID NO: 3402749 - RNA, 12 nt, Human
gacagcuuugcu

SEQ ID NO: 3402750 - RNA, 19 nt, Human
gacaggaaaauccucuggc

SEQ ID NO: 3402751 - RNA, 22 nt, Human
gacaggaaccuuaaguaaucau

SEQ ID NO: 3402752 - RNA, 22 nt, Human
gacaggacagugcuucagccug

SEQ ID NO: 3402753 - RNA, 14 nt, Human
gacaggaccaggga

SEQ ID NO: 3402754 - RNA, 21 nt, Human
gacaggaccccugcaguuccc

SEQ ID NO: 3402755 - RNA, 13 nt, Human
gacaggaccugac

SEQ ID NO: 3402756 - RNA, 21 nt, Human
gacaggacuaacacucagaag

SEQ ID NO: 3402757 - RNA, 20 nt, Human
gacaggagaaacacuugaac

SEQ ID NO: 3402758 - RNA, 12 nt, Human
gacaggagaaau

SEQ ID NO: 3402759 - RNA, 18 nt, Human
gacaggauccaggccggc

SEQ ID NO: 3402760 - RNA, 23 nt, Human
gacaggaugguucccuugaugaa

SEQ ID NO: 3402761 - RNA, 19 nt, Human
gacaggauguguuugcuuu

SEQ ID NO: 3402762 - RNA, 20 nt, Human
gacaggcaagcaccuccugc

SEQ ID NO: 3402763 - RNA, 18 nt, Human
gacaggcaaugcuggcug

SEQ ID NO: 3402764 - RNA, 14 nt, Human
gacaggcagaaaga

SEQ ID NO: 3402765 - RNA, 14 nt, Human
gacaggcagagcug

SEQ ID NO: 3402766 - RNA, 13 nt, Human
gacaggcagcaga

SEQ ID NO: 3402767 - RNA, 15 nt, Human
gacaggccucaccuc

SEQ ID NO: 3402768 - RNA, 17 nt, Human
gacaggcgaaagaaaac

SEQ ID NO: 3402769 - RNA, 17 nt, Human
gacaggcucuuagcagc

SEQ ID NO: 3402770 - RNA, 19 nt, Human
gacaggcucuuagcagcuu

SEQ ID NO: 3402771 - RNA, 22 nt, Human
gacaggcugcggccccuccccc

SEQ ID NO: 3402772 - RNA, 12 nt, Human
gacaggcuggcu

SEQ ID NO: 3402773 - RNA, 14 nt, Human
gacagggaagcuac

SEQ ID NO: 3402774 - RNA, 17 nt, Human
gacagggaagcuacagg

SEQ ID NO: 3402775 - RNA, 24 nt, Human
gacagggcacaccgggcacucaga

SEQ ID NO: 3402776 - RNA, 18 nt, Human
gacagggccagugcaguu

SEQ ID NO: 3402777 - RNA, 20 nt, Human
gacagggccaguggggccug

SEQ ID NO: 3402778 - RNA, 21 nt, Human
gacagggccaguggggccugu

SEQ ID NO: 3402779 - RNA, 22 nt, Human
gacagggccaguggggccugug

SEQ ID NO: 3402780 - RNA, 17 nt, Human
gacagggcggggguggc

SEQ ID NO: 3402781 - RNA, 19 nt, Human
gacagggcggggguggcgg

SEQ ID NO: 3402782 - RNA, 15 nt, Human
gacagggcuggccca

SEQ ID NO: 3402783 - RNA, 21 nt, Human
gacagggcuggcccagcccug

SEQ ID NO: 3402784 - RNA, 18 nt, Human
gacaggggcaggaggaag

SEQ ID NO: 3402785 - RNA, 21 nt, Human
gacagggguuccuucugggca

SEQ ID NO: 3402786 - RNA, 13 nt, Human
gacaggguccugc

SEQ ID NO: 3402787 - RNA, 20 nt, Human
gacaggguuuggcugugucu

SEQ ID NO: 3402788 - RNA, 22 nt, Human
gacagguuugggaccccuggug

SEQ ID NO: 3402789 - RNA, 15 nt, Human
gacaguaacuugguu

SEQ ID NO: 3402790 - RNA, 20 nt, Human
gacaguaauuguguuuacau

SEQ ID NO: 3402791 - RNA, 22 nt, Human
gacaguaauuguguuuacauuu

SEQ ID NO: 3402792 - RNA, 15 nt, Human
gacaguauacagucc

SEQ ID NO: 3402793 - RNA, 15 nt, Human
gacaguaucccacau

SEQ ID NO: 3402794 - RNA, 22 nt, Human
gacaguaugagucaaugugcag

SEQ ID NO: 3402795 - RNA, 20 nt, Human
gacaguauggcagcuuuccu

SEQ ID NO: 3402796 - RNA, 15 nt, Human
gacaguauuuguggg

SEQ ID NO: 3402797 - RNA, 15 nt, Human
gacagucaaaaccaa

SEQ ID NO: 3402798 - RNA, 23 nt, Human
gacagucacugccacuuugcaca

SEQ ID NO: 3402799 - RNA, 18 nt, Human
gacagucaucaucagggc

SEQ ID NO: 3402800 - RNA, 22 nt, Human
gacagucaucaucagggccugg

SEQ ID NO: 3402801 - RNA, 23 nt, Human
gacagucaucaucagggccuggg

SEQ ID NO: 3402802 - RNA, 14 nt, Human
gacagucccugcca

SEQ ID NO: 3402803 - RNA, 15 nt, Human
gacagucccugccaa

SEQ ID NO: 3402804 - RNA, 21 nt, Human
gacaguccgucaaaacagauu

SEQ ID NO: 3402805 - RNA, 13 nt, Human
gacaguccuggga

SEQ ID NO: 3402806 - RNA, 23 nt, Human
gacagucugcucuagaugagcug

SEQ ID NO: 3402807 - RNA, 16 nt, Human
gacagugaucuccaua

SEQ ID NO: 3402808 - RNA, 15 nt, Human
gacagugcacaugaa

SEQ ID NO: 3402809 - RNA, 16 nt, Human
gacagugcacaugaac

SEQ ID NO: 3402810 - RNA, 16 nt, Human
gacagugccuauacug

SEQ ID NO: 3402811 - RNA, 13 nt, Human
gacagugccuggg

SEQ ID NO: 3402812 - RNA, 22 nt, Human
gacagugccugggaauguauua

SEQ ID NO: 3402813 - RNA, 21 nt, Human
gacagugcugcagcucccugg

SEQ ID NO: 3402814 - RNA, 19 nt, Human
gacagugcuucagccugag

SEQ ID NO: 3402815 - RNA, 20 nt, Human
gacaguggauugcauuucuu

SEQ ID NO: 3402816 - RNA, 13 nt, Human
gacagugggaaau

SEQ ID NO: 3402817 - RNA, 20 nt, Human
gacaguguuccccgauacca

SEQ ID NO: 3402818 - RNA, 17 nt, Human
gacaguucacacccugc

SEQ ID NO: 3402819 - RNA, 19 nt, Human
gacaguucauucagggccg

SEQ ID NO: 3402820 - RNA, 19 nt, Human
gacaguugggugagaacaa

SEQ ID NO: 3402821 - RNA, 13 nt, Human
gacaguuggguuu

SEQ ID NO: 3402822 - RNA, 17 nt, Human
gacaguuggguuuuuua

SEQ ID NO: 3402823 - RNA, 21 nt, Human
gacaguuuaccaguugccuuu

SEQ ID NO: 3402824 - RNA, 17 nt, Human
gacaguuuaucaugaag

SEQ ID NO: 3402825 - RNA, 21 nt, Human
gacaguuuaucaugaagccug

SEQ ID NO: 3402826 - RNA, 12 nt, Human
gacaguuucuua

SEQ ID NO: 3402827 - RNA, 16 nt, Human
gacccaugggcaggag

SEQ ID NO: 3402828 - RNA, 20 nt, Human
gacccaugggcaggagacug

SEQ ID NO: 3402829 - RNA, 22 nt, Human
gacccauguaaauaccagacug

SEQ ID NO: 3402830 - RNA, 16 nt, Human
gacccauuccuuccca

SEQ ID NO: 3402831 - RNA, 13 nt, Human
gacccauugcugu

SEQ ID NO: 3402832 - RNA, 23 nt, Human
gaccccaaacaccuuccagcucc

SEQ ID NO: 3402833 - RNA, 19 nt, Human
gaccccaaagagccuggag

SEQ ID NO: 3402834 - RNA, 21 nt, Human
gaccccaaagagccuggagaa

SEQ ID NO: 3402835 - RNA, 19 nt, Human
gaccccacccaagcuuggc

SEQ ID NO: 3402836 - RNA, 20 nt, Human
gaccccacccaagcuuggca

SEQ ID NO: 3402837 - RNA, 12 nt, Human
gaccccagagga

SEQ ID NO: 3402838 - RNA, 15 nt, Human
gaccccagccaucca

SEQ ID NO: 3402839 - RNA, 12 nt, Human
gaccccagccuc

SEQ ID NO: 3402840 - RNA, 19 nt, Human
gaccccagcggcugaguca

SEQ ID NO: 3402841 - RNA, 12 nt, Human
gaccccagcucu

SEQ ID NO: 3402842 - RNA, 15 nt, Human
gaccccagcugggag

SEQ ID NO: 3402843 - RNA, 18 nt, Human
gaccccaggcccacucag

SEQ ID NO: 3402844 - RNA, 19 nt, Human
gaccccaggcccacucagg

SEQ ID NO: 3402845 - RNA, 17 nt, Human
gaccccaggcuggacau

SEQ ID NO: 3402846 - RNA, 14 nt, Human
gaccccagggcaca

SEQ ID NO: 3402847 - RNA, 21 nt, Human
gaccccagggcacaggagcua

SEQ ID NO: 3402848 - RNA, 15 nt, Human
gaccccaucugccca

SEQ ID NO: 3402849 - RNA, 16 nt, Human
gaccccaucugugaau

SEQ ID NO: 3402850 - RNA, 15 nt, Human
gacccccaccccuuc

SEQ ID NO: 3402851 - RNA, 18 nt, Human
gacccccaccccuucccc

SEQ ID NO: 3402852 - RNA, 20 nt, Human
gacccccagcaacccuccua

SEQ ID NO: 3402853 - RNA, 16 nt, Human
gacccccaucccaugg

SEQ ID NO: 3402854 - RNA, 15 nt, Human
gaccccccuuucaca

SEQ ID NO: 3402855 - RNA, 19 nt, Human
gaccccccuuucacaggca

SEQ ID NO: 3402856 - RNA, 20 nt, Human
gaccccccuuucacaggcag

SEQ ID NO: 3402857 - RNA, 19 nt, Human
gacccccgcccccugcccu

SEQ ID NO: 3402858 - RNA, 20 nt, Human
gaccccgagccuggcuccaa

SEQ ID NO: 3402859 - RNA, 22 nt, Human
gaccccgguggcggccccagca

SEQ ID NO: 3402860 - RNA, 18 nt, Human
gaccccuaguucccucug

SEQ ID NO: 3402861 - RNA, 14 nt, Human
gaccccucaccuug

SEQ ID NO: 3402862 - RNA, 17 nt, Human
gaccccuccucacuggc

SEQ ID NO: 3402863 - RNA, 23 nt, Human
gaccccuccucacuggccauccc

SEQ ID NO: 3402864 - RNA, 12 nt, Human
gaccccuccugg

SEQ ID NO: 3402865 - RNA, 13 nt, Human
gaccccuccuggg

SEQ ID NO: 3402866 - RNA, 15 nt, Human
gaccccucuggccag

SEQ ID NO: 3402867 - RNA, 11 nt, Human
gaccccugcau

SEQ ID NO: 3402868 - RNA, 13 nt, Human
gaccccuggcuuu

SEQ ID NO: 3402869 - RNA, 11 nt, Human
gacccggaggc

SEQ ID NO: 3402870 - RNA, 13 nt, Human
gacccggaggcca

SEQ ID NO: 3402871 - RNA, 14 nt, Human
gacccggaggccac

SEQ ID NO: 3402872 - RNA, 17 nt, Human
gacccggaggccacaug

SEQ ID NO: 3402873 - RNA, 23 nt, Human
gacccggaggccacaugaguccc

SEQ ID NO: 3402874 - RNA, 18 nt, Human
gacccggaggccgaggcc

SEQ ID NO: 3402875 - RNA, 19 nt, Human
gacccggcacccccugcag

SEQ ID NO: 3402876 - RNA, 18 nt, Human
gacccgucuccagcugcu

SEQ ID NO: 3402877 - RNA, 19 nt, Human
gacccguucaugggggagg

SEQ ID NO: 3402878 - RNA, 15 nt, Human
gacccuaaaucugag

SEQ ID NO: 3402879 - RNA, 18 nt, Human
gacccuaagaccggcggc

SEQ ID NO: 3402880 - RNA, 22 nt, Human
gacccuacucccuugcccuaga

SEQ ID NO: 3402881 - RNA, 21 nt, Human
gacccuacuuccugcacugac

SEQ ID NO: 3402882 - RNA, 12 nt, Human
gacccucaugcu

SEQ ID NO: 3402883 - RNA, 17 nt, Human
gacccucaugcugccaa

SEQ ID NO: 3402884 - RNA, 18 nt, Human
gacccucaugcugccaau

SEQ ID NO: 3402885 - RNA, 20 nt, Human
gacccuccaaggccaggccu

SEQ ID NO: 3402886 - RNA, 22 nt, Human
gacccuccaaggccaggccuug

SEQ ID NO: 3402887 - RNA, 20 nt, Human
gacccuccuguugcacccag

SEQ ID NO: 3402888 - RNA, 21 nt, Human
gacccuccuguugcacccagc

SEQ ID NO: 3402889 - RNA, 22 nt, Human
gacccuccuguugcacccagcc

SEQ ID NO: 3402890 - RNA, 15 nt, Human
gacccucgcuggccc

SEQ ID NO: 3402891 - RNA, 15 nt, Human
gacccucguggccuu

SEQ ID NO: 3402892 - RNA, 20 nt, Human
gacccucugaaugguccagg

SEQ ID NO: 3402893 - RNA, 20 nt, Human
gacccucugccaccagagac

SEQ ID NO: 3402894 - RNA, 16 nt, Human
gacccucugcugaaga

SEQ ID NO: 3402895 - RNA, 17 nt, Human
gacccucugcugaagac

SEQ ID NO: 3402896 - RNA, 17 nt, Human
gacccucuugcccaucc

SEQ ID NO: 3402897 - RNA, 20 nt, Human
gacccugaaaugugugugau

SEQ ID NO: 3402898 - RNA, 10 nt, Human
gacccugagg

SEQ ID NO: 3402899 - RNA, 12 nt, Human
gacccugaggcc

SEQ ID NO: 3402900 - RNA, 16 nt, Human
gacccugaggcccaga

SEQ ID NO: 3402901 - RNA, 20 nt, Human
gacccugaggcccagagggc

SEQ ID NO: 3402902 - RNA, 22 nt, Human
gacccugaggcccagagggccu

SEQ ID NO: 3402903 - RNA, 18 nt, Human
gacccugcaaacagaaca

SEQ ID NO: 3402904 - RNA, 19 nt, Human
gacccugcaaacagaacag

SEQ ID NO: 3402905 - RNA, 15 nt, Human
gacccugcagagaug

SEQ ID NO: 3402906 - RNA, 18 nt, Human
gacccugccaggcacagg

SEQ ID NO: 3402907 - RNA, 11 nt, Human
gacccugcccu

SEQ ID NO: 3402908 - RNA, 15 nt, Human
gacccugcccugugg

SEQ ID NO: 3402909 - RNA, 20 nt, Human
gacccugcccugugggcccc

SEQ ID NO: 3402910 - RNA, 15 nt, Human
gacccugcccuuguu

SEQ ID NO: 3402911 - RNA, 22 nt, Human
gacccugcgaaggggcccuggu

SEQ ID NO: 3402912 - RNA, 17 nt, Human
gacccugggcagggacu

SEQ ID NO: 3402913 - RNA, 16 nt, Human
gacccuggggcuggcu

SEQ ID NO: 3402914 - RNA, 21 nt, Human
gacccugggggcacaggaggc

SEQ ID NO: 3402915 - RNA, 22 nt, Human
gacccugggugggcucugugca

SEQ ID NO: 3402916 - RNA, 17 nt, Human
gacccuggugccuggcu

SEQ ID NO: 3402917 - RNA, 12 nt, Human
gacccugucucu

SEQ ID NO: 3402918 - RNA, 16 nt, Human
gacccuuauugcuguc

SEQ ID NO: 3402919 - RNA, 20 nt, Human
gacccuuauugcuguccugg

SEQ ID NO: 3402920 - RNA, 15 nt, Human
gacccuuccagacau

SEQ ID NO: 3402921 - RNA, 22 nt, Human
gacccuucccaaucagcacuga

SEQ ID NO: 3402922 - RNA, 20 nt, Human
gacccuugccgucuaccuga

SEQ ID NO: 3402923 - RNA, 23 nt, Human
gacccuuuagccaaacccuuguc

SEQ ID NO: 3402924 - RNA, 21 nt, Human
gacccuuuccuuccuucccug

SEQ ID NO: 3402925 - RNA, 12 nt, Human
gacccuuugggg

SEQ ID NO: 3402926 - RNA, 19 nt, Human
gaccgaacuguuguauaaa

SEQ ID NO: 3402927 - RNA, 17 nt, Human
gaccgaggcuggagcug

SEQ ID NO: 3402928 - RNA, 12 nt, Human
gaccgcccccuc

SEQ ID NO: 3402929 - RNA, 18 nt, Human
gaccgcccuuuuccccua

SEQ ID NO: 3402930 - RNA, 16 nt, Human
gaccggaagcuccugg

SEQ ID NO: 3402931 - RNA, 17 nt, Human
gaccggagagugggggu

SEQ ID NO: 3402932 - RNA, 21 nt, Human
gaccggaggcaaaaggcagug

SEQ ID NO: 3402933 - RNA, 12 nt, Human
gaccgucuuccu

SEQ ID NO: 3402934 - RNA, 16 nt, Human
gaccgugaggccagag

SEQ ID NO: 3402935 - RNA, 17 nt, Human
gaccgugaggccagaga

SEQ ID NO: 3402936 - RNA, 19 nt, Human
gaccgugaggccagagaca

SEQ ID NO: 3402937 - RNA, 17 nt, Human
gaccguggcccugcccu

SEQ ID NO: 3402938 - RNA, 17 nt, Human
gaccuaaaaauuggugu

SEQ ID NO: 3402939 - RNA, 22 nt, Human
gaccuaaaauuugcccucccau

SEQ ID NO: 3402940 - RNA, 20 nt, Human
gaccuaaauggccucaugug

SEQ ID NO: 3402941 - RNA, 17 nt, Human
gaccuaacauucgaucu

SEQ ID NO: 3402942 - RNA, 13 nt, Human
gaccuacaggggg

SEQ ID NO: 3402943 - RNA, 12 nt, Human
gaccuaccucag

SEQ ID NO: 3402944 - RNA, 15 nt, Human
gaccuaccucagguu

SEQ ID NO: 3402945 - RNA, 16 nt, Human
gaccuaccucagguug

SEQ ID NO: 3402946 - RNA, 19 nt, Human
gaccuaccucagguugcug

SEQ ID NO: 3402947 - RNA, 23 nt, Human
gaccuagggauguucuggcccuc

SEQ ID NO: 3402948 - RNA, 17 nt, Human
gaccuauaacugcccag

SEQ ID NO: 3402949 - RNA, 16 nt, Human
gaccuauaccuguguu

SEQ ID NO: 3402950 - RNA, 20 nt, Human
gaccuauaccuguguuucuu

SEQ ID NO: 3402951 - RNA, 16 nt, Human
gaccuauuccuccugg

SEQ ID NO: 3402952 - RNA, 17 nt, Human
gaccuauuccuccuggg

SEQ ID NO: 3402953 - RNA, 22 nt, Human
gaccucaaaugaugugccugcu

SEQ ID NO: 3402954 - RNA, 17 nt, Human
gaccucaagugaucugc

SEQ ID NO: 3402955 - RNA, 16 nt, Human
gaccucacagugaccc

SEQ ID NO: 3402956 - RNA, 18 nt, Human
gaccucacagugacccuu

SEQ ID NO: 3402957 - RNA, 19 nt, Human
gaccucagaguccaggccc

SEQ ID NO: 3402958 - RNA, 21 nt, Human
gaccucagaguccaggcccca

SEQ ID NO: 3402959 - RNA, 10 nt, Human
gaccucagcc

SEQ ID NO: 3402960 - RNA, 12 nt, Human
gaccucagccug

SEQ ID NO: 3402961 - RNA, 13 nt, Human
gaccucagccugu

SEQ ID NO: 3402962 - RNA, 14 nt, Human
gaccucagccugug

SEQ ID NO: 3402963 - RNA, 16 nt, Human
gaccucagcugcuucu

SEQ ID NO: 3402964 - RNA, 17 nt, Human
gaccucagcugcuucuc

SEQ ID NO: 3402965 - RNA, 19 nt, Human
gaccucaggcacuagccuu

SEQ ID NO: 3402966 - RNA, 11 nt, Human
gaccucaggcc

SEQ ID NO: 3402967 - RNA, 12 nt, Human
gaccucaggccu

SEQ ID NO: 3402968 - RNA, 22 nt, Human
gaccucagguaaucgaccugcc

SEQ ID NO: 3402969 - RNA, 18 nt, Human
gaccucaggugagaagca

SEQ ID NO: 3402970 - RNA, 13 nt, Human
gaccucaggugau

SEQ ID NO: 3402971 - RNA, 19 nt, Human
gaccucaggugauccaccc

SEQ ID NO: 3402972 - RNA, 16 nt, Human
gagcucugagaggccc

SEQ ID NO: 3402973 - RNA, 22 nt, Human
gagcucugagaggcccuggauc

SEQ ID NO: 3402974 - RNA, 23 nt, Human
gagcucugagaggcccuggauca

SEQ ID NO: 3402975 - RNA, 20 nt, Human
gagcucuggugauaaggaca

SEQ ID NO: 3402976 - RNA, 15 nt, Human
gagcucugucugucc

SEQ ID NO: 3402977 - RNA, 17 nt, Human
gagcucuucauguuuca

SEQ ID NO: 3402978 - RNA, 21 nt, Human
gagcucuuccuaucccucucc

SEQ ID NO: 3402979 - RNA, 21 nt, Human
gagcucuuggaggugucugua

SEQ ID NO: 3402980 - RNA, 22 nt, Human
gagcugaacccauuuugaguga

SEQ ID NO: 3402981 - RNA, 20 nt, Human
gagcugaagguuguggccuu

SEQ ID NO: 3402982 - RNA, 16 nt, Human
gagcugacacaggaug

SEQ ID NO: 3402983 - RNA, 12 nt, Human
gagcugagaaga

SEQ ID NO: 3402984 - RNA, 15 nt, Human
gagcugagaauagaa

SEQ ID NO: 3402985 - RNA, 10 nt, Human
gagcugagau

SEQ ID NO: 3402986 - RNA, 21 nt, Human
gagcugagaucgugcuacugc

SEQ ID NO: 3402987 - RNA, 17 nt, Human
gagcugaggcaauucua

SEQ ID NO: 3402988 - RNA, 23 nt, Human
gagcugaggggggccgugcccag

SEQ ID NO: 3402989 - RNA, 16 nt, Human
gagcugaucgcuucuc

SEQ ID NO: 3402990 - RNA, 16 nt, Human
gagcugauggagaagg

SEQ ID NO: 3402991 - RNA, 12 nt, Human
gagcugccaaga

SEQ ID NO: 3402992 - RNA, 17 nt, Human
gagcugcccacagcagg

SEQ ID NO: 3402993 - RNA, 19 nt, Human
gagcugccccucucugggc

SEQ ID NO: 3402994 - RNA, 17 nt, Human
gagcugcccucuccugg

SEQ ID NO: 3402995 - RNA, 18 nt, Human
gagcugcccucuccuggg

SEQ ID NO: 3402996 - RNA, 21 nt, Human
gagcugcccucuccugggcag

SEQ ID NO: 3402997 - RNA, 23 nt, Human
gagcugcccucuccugggcagcu

SEQ ID NO: 3402998 - RNA, 14 nt, Human
gagcugccuggacc

SEQ ID NO: 3402999 - RNA, 11 nt, Human
gagcugccuuc

SEQ ID NO: 3403000 - RNA, 22 nt, Human
gagcugccuuggcucagacaug

SEQ ID NO: 3403001 - RNA, 21 nt, Human
gagcugcuauagccuggggug

SEQ ID NO: 3403002 - RNA, 14 nt, Human
gagcugcugcccug

SEQ ID NO: 3403003 - RNA, 16 nt, Human
gagcugcuuuuuuuga

SEQ ID NO: 3403004 - RNA, 22 nt, Human
gagcuggagaugaggccagacc

SEQ ID NO: 3403005 - RNA, 15 nt, Human
gagcuggagccuggu

SEQ ID NO: 3403006 - RNA, 23 nt, Human
gagcuggccgcgccaaauaaugu

SEQ ID NO: 3403007 - RNA, 14 nt, Human
gagcugggagccgg

SEQ ID NO: 3403008 - RNA, 16 nt, Human
gagcugggagccgggc

SEQ ID NO: 3403009 - RNA, 18 nt, Human
gagcugggaggcauggcc

SEQ ID NO: 3403010 - RNA, 17 nt, Human
gagcugggcagaaggcc

SEQ ID NO: 3403011 - RNA, 14 nt, Human
gagcugggcauggu

SEQ ID NO: 3403012 - RNA, 13 nt, Human
gagcugggcccga

SEQ ID NO: 3403013 - RNA, 20 nt, Human
gagcugggcccgacauggcu

SEQ ID NO: 3403014 - RNA, 13 nt, Human
gagcugggccugg

SEQ ID NO: 3403015 - RNA, 14 nt, Human
gagcugggccuggu

SEQ ID NO: 3403016 - RNA, 13 nt, Human
gagcuggggaccu

SEQ ID NO: 3403017 - RNA, 18 nt, Human
gagcugggggccaugagc

SEQ ID NO: 3403018 - RNA, 18 nt, Human
gagcugguugggaagaca

SEQ ID NO: 3403019 - RNA, 18 nt, Human
gagcuguauuaagccacu

SEQ ID NO: 3403020 - RNA, 16 nt, Human
gagcugucaccaagga

SEQ ID NO: 3403021 - RNA, 18 nt, Human
gagcugucaccaaggaaa

SEQ ID NO: 3403022 - RNA, 21 nt, Human
gagcugugaguucucccugua

SEQ ID NO: 3403023 - RNA, 22 nt, Human
gagcugugggcaaaagagugua

SEQ ID NO: 3403024 - RNA, 16 nt, Human
gagcuguuaccauuca

SEQ ID NO: 3403025 - RNA, 22 nt, Human
gagcuguucaacaucacugaaa

SEQ ID NO: 3403026 - RNA, 18 nt, Human
gagcuguugaugggauga

SEQ ID NO: 3403027 - RNA, 16 nt, Human
gagcuguugccucagu

SEQ ID NO: 3403028 - RNA, 16 nt, Human
gagcuguuuauggccu

SEQ ID NO: 3403029 - RNA, 20 nt, Human
gagcuguuuauggccucagc

SEQ ID NO: 3403030 - RNA, 22 nt, Human
gagcuguuuauggccucagcug

SEQ ID NO: 3403031 - RNA, 15 nt, Human
gagcuuaagccacug

SEQ ID NO: 3403032 - RNA, 22 nt, Human
gagcuuaaucuuugaaagguua

SEQ ID NO: 3403033 - RNA, 20 nt, Human
gagcuucaagucugugccug

SEQ ID NO: 3403034 - RNA, 13 nt, Human
gagcuucccugac

SEQ ID NO: 3403035 - RNA, 17 nt, Human
gagcuucccugacucau

SEQ ID NO: 3403036 - RNA, 10 nt, Human
gagcuucucu

SEQ ID NO: 3403037 - RNA, 16 nt, Human
gagcuucucugugaac

SEQ ID NO: 3403038 - RNA, 23 nt, Human
gagcuucucuuuaacucaggacu

SEQ ID NO: 3403039 - RNA, 11 nt, Human
gagcuucuggg

SEQ ID NO: 3403040 - RNA, 22 nt, Human
gagcuucugggaagacaacuag

SEQ ID NO: 3403041 - RNA, 18 nt, Human
gagcuucuggggucccca

SEQ ID NO: 3403042 - RNA, 19 nt, Human
gagcuucugggguccccag

SEQ ID NO: 3403043 - RNA, 21 nt, Human
gagcuucugggguccccaggg

SEQ ID NO: 3403044 - RNA, 22 nt, Human
gagcuucuuccaggugcccagc

SEQ ID NO: 3403045 - RNA, 12 nt, Human
gagcuuggggca

SEQ ID NO: 3403046 - RNA, 19 nt, Human
gagcuuuacaaaaagacac

SEQ ID NO: 3403047 - RNA, 17 nt, Human
gagcuuuccauguugcu

SEQ ID NO: 3403048 - RNA, 21 nt, Human
gagcuuuccauguugcugcca

SEQ ID NO: 3403049 - RNA, 19 nt, Human
gagcuuucugaacagcugg

SEQ ID NO: 3403050 - RNA, 20 nt, Human
gagcuuucugaacagcuggu

SEQ ID NO: 3403051 - RNA, 23 nt, Human
gagcuuucugaacagcuggugua

SEQ ID NO: 3403052 - RNA, 21 nt, Human
gagcuuugacucaggagccug

SEQ ID NO: 3403053 - RNA, 19 nt, Human
gagcuuugcauguuccacu

SEQ ID NO: 3403054 - RNA, 13 nt, Human
gagcuuugcugcu

SEQ ID NO: 3403055 - RNA, 23 nt, Human
gaggaaaaccaagccguggcuuc

SEQ ID NO: 3403056 - RNA, 22 nt, Human
gaggaaaaguaaccaucacugg

SEQ ID NO: 3403057 - RNA, 21 nt, Human
gaggaaaaguaaggugcaguu

SEQ ID NO: 3403058 - RNA, 22 nt, Human
gaggaaacucaccugcuggccc

SEQ ID NO: 3403059 - RNA, 17 nt, Human
gaggaaagacaacacaa

SEQ ID NO: 3403060 - RNA, 13 nt, Human
gaggaaagagagc

SEQ ID NO: 3403061 - RNA, 16 nt, Human
gaggaaagagucuuca

SEQ ID NO: 3403062 - RNA, 16 nt, Human
gaggaaagcaaaggag

SEQ ID NO: 3403063 - RNA, 17 nt, Human
gaggaaagcaaaggaga

SEQ ID NO: 3403064 - RNA, 19 nt, Human
gaggaaagcacagaggccu

SEQ ID NO: 3403065 - RNA, 20 nt, Human
gaggaaagcacagaggccuc

SEQ ID NO: 3403066 - RNA, 22 nt, Human
gaggaaagcacagaggccuccu

SEQ ID NO: 3403067 - RNA, 21 nt, Human
gaggaaagggaggaguggagg

SEQ ID NO: 3403068 - RNA, 20 nt, Human
gaggaaagucauuggcuuua

SEQ ID NO: 3403069 - RNA, 12 nt, Human
gaggaaaucaaa

SEQ ID NO: 3403070 - RNA, 13 nt, Human
gaggaaaucccuu

SEQ ID NO: 3403071 - RNA, 14 nt, Human
gaggaaccagagcc

SEQ ID NO: 3403072 - RNA, 15 nt, Human
gaggaaccagagcca

SEQ ID NO: 3403073 - RNA, 18 nt, Human
gaggaaccucugauuuau

SEQ ID NO: 3403074 - RNA, 15 nt, Human
gaggaacuguccaga

SEQ ID NO: 3403075 - RNA, 17 nt, Human
gaggaacuguccagaga

SEQ ID NO: 3403076 - RNA, 14 nt, Human
gaggaagaauaggg

SEQ ID NO: 3403077 - RNA, 19 nt, Human
gaggaagagcaggcacaug

SEQ ID NO: 3403078 - RNA, 21 nt, Human
gaggaagaugggggcaagaag

SEQ ID NO: 3403079 - RNA, 15 nt, Human
gaggaagcagaauaa

SEQ ID NO: 3403080 - RNA, 19 nt, Human
gaggaagcagaauaaagca

SEQ ID NO: 3403081 - RNA, 22 nt, Human
gaggaagccagguccacggucu

SEQ ID NO: 3403082 - RNA, 17 nt, Human
gaggaagccgcuggggc

SEQ ID NO: 3403083 - RNA, 19 nt, Human
gaggaagcuccaguccugc

SEQ ID NO: 3403084 - RNA, 21 nt, Human
gaggaagcuccaguccugcuc

SEQ ID NO: 3403085 - RNA, 13 nt, Human
gaggaaggaaacc

SEQ ID NO: 3403086 - RNA, 16 nt, Human
gaggaaggacuucccu

SEQ ID NO: 3403087 - RNA, 16 nt, Human
gaggaaggaggaccca

SEQ ID NO: 3403088 - RNA, 21 nt, Human
gaggaaggaggacccaggaca

SEQ ID NO: 3403089 - RNA, 17 nt, Human
gaggaaggaugcaaagu

SEQ ID NO: 3403090 - RNA, 17 nt, Human
gaggaaguucagaucuu

SEQ ID NO: 3403091 - RNA, 22 nt, Human
gaggaauaagaauggagcagua

SEQ ID NO: 3403092 - RNA, 21 nt, Human
gaggaauaagcucccagggcc

SEQ ID NO: 3403093 - RNA, 21 nt, Human
gaggaauaauuauuuauuuaa

SEQ ID NO: 3403094 - RNA, 17 nt, Human
gaggaauacugaacauc

SEQ ID NO: 3403095 - RNA, 23 nt, Human
gaggaauaugacggaagaacaua

SEQ ID NO: 3403096 - RNA, 20 nt, Human
gaggaaucaugucaggccug

SEQ ID NO: 3403097 - RNA, 21 nt, Human
gaggaaucaugucaggccugu

SEQ ID NO: 3403098 - RNA, 20 nt, Human
gaggaaucgaggaaccagag

SEQ ID NO: 3403099 - RNA, 15 nt, Human
gaggaaugcuccccc

SEQ ID NO: 3403100 - RNA, 14 nt, Human
gaggaauggacaga

SEQ ID NO: 3403101 - RNA, 22 nt, Human
gaggacaaaacuucuugucaga

SEQ ID NO: 3403102 - RNA, 19 nt, Human
gaggacaauucaugaacuu

SEQ ID NO: 3403103 - RNA, 13 nt, Human
gaggacacagaga

SEQ ID NO: 3403104 - RNA, 11 nt, Human
gaggacacaug

SEQ ID NO: 3403105 - RNA, 13 nt, Human
gaggacacauguc

SEQ ID NO: 3403106 - RNA, 16 nt, Human
gaggacagaugccucc

SEQ ID NO: 3403107 - RNA, 22 nt, Human
gaggacagaugccuccuuccuc

SEQ ID NO: 3403108 - RNA, 20 nt, Human
gaggacaggcgggaggaggu

SEQ ID NO: 3403109 - RNA, 16 nt, Human
gaggacauggcuucug

SEQ ID NO: 3403110 - RNA, 21 nt, Human
gaggacauguuuuuguuuucu

SEQ ID NO: 3403111 - RNA, 13 nt, Human
gaggaccacuccu

SEQ ID NO: 3403112 - RNA, 14 nt, Human
gaggaccagcacac

SEQ ID NO: 3403113 - RNA, 13 nt, Human
gaggacccagacc

SEQ ID NO: 3403114 - RNA, 20 nt, Human
gaggacccuggaaauggacu

SEQ ID NO: 3403115 - RNA, 20 nt, Human
gaggaccugacccuacuccc

SEQ ID NO: 3403116 - RNA, 16 nt, Human
gaggaccuggggcaca

SEQ ID NO: 3403117 - RNA, 17 nt, Human
gaggaccuguauuuaag

SEQ ID NO: 3403118 - RNA, 15 nt, Human
gaggaccuuaucugu

SEQ ID NO: 3403119 - RNA, 21 nt, Human
gaggacgcucucuggccuucg

SEQ ID NO: 3403120 - RNA, 17 nt, Human
gaggacggugcaaccca

SEQ ID NO: 3403121 - RNA, 20 nt, Human
gaggacggugcaacccaagg

SEQ ID NO: 3403122 - RNA, 15 nt, Human
gaggacgugggcggc

SEQ ID NO: 3403123 - RNA, 18 nt, Human
gaggacgugggcggcaga

SEQ ID NO: 3403124 - RNA, 20 nt, Human
gaggacgugggcggcagaga

SEQ ID NO: 3403125 - RNA, 22 nt, Human
gaggacgugggcggcagagagg

SEQ ID NO: 3403126 - RNA, 16 nt, Human
gaggacuagaaccugg

SEQ ID NO: 3403127 - RNA, 18 nt, Human
gaggacuccaggcagcag

SEQ ID NO: 3403128 - RNA, 17 nt, Human
gaggacucccaacccug

SEQ ID NO: 3403129 - RNA, 19 nt, Human
gaggacucgcuuguaaaua

SEQ ID NO: 3403130 - RNA, 21 nt, Human
gaggacucgcuuguaaauacc

SEQ ID NO: 3403131 - RNA, 22 nt, Human
gaggacucgcuuguaaauacca

SEQ ID NO: 3403132 - RNA, 20 nt, Human
gaggacuuuucuuuguggcu

SEQ ID NO: 3403133 - RNA, 13 nt, Human
gaggagaaacaca

SEQ ID NO: 3403134 - RNA, 12 nt, Human
gaggagaaacug

SEQ ID NO: 3403135 - RNA, 18 nt, Human
gaggagaacuugcugccu

SEQ ID NO: 3403136 - RNA, 22 nt, Human
gaggagaagaauuuucagaccc

SEQ ID NO: 3403137 - RNA, 22 nt, Human
gaggagacuagauuuaugaaua

SEQ ID NO: 3403138 - RNA, 12 nt, Human
gaggagagaaga

SEQ ID NO: 3403139 - RNA, 21 nt, Human
gaggagagagcagcuucugcc

SEQ ID NO: 3403140 - RNA, 14 nt, Human
gaggagagaggacc

SEQ ID NO: 3403141 - RNA, 15 nt, Human
gaggagagaggaccc

SEQ ID NO: 3403142 - RNA, 13 nt, Human
gaggagagaggca

SEQ ID NO: 3403143 - RNA, 14 nt, Human
gaggagagaggcag

SEQ ID NO: 3403144 - RNA, 14 nt, Human
gaggagagucccag

SEQ ID NO: 3403145 - RNA, 20 nt, Human
gaggagcagcaggagggggg

SEQ ID NO: 3403146 - RNA, 17 nt, Human
gaggagcagugcaggca

SEQ ID NO: 3403147 - RNA, 14 nt, Human
gaggagcauguuuu

SEQ ID NO: 3403148 - RNA, 12 nt, Human
gaggagcccagg

SEQ ID NO: 3403149 - RNA, 13 nt, Human
gaggagcccaggc

SEQ ID NO: 3403150 - RNA, 18 nt, Human
gaggagcccaggccagga

SEQ ID NO: 3403151 - RNA, 15 nt, Human
gaggagccccagcua

SEQ ID NO: 3403152 - RNA, 13 nt, Human
gaggagccccauc

SEQ ID NO: 3403153 - RNA, 16 nt, Human
gaggagcccugccucu

SEQ ID NO: 3403154 - RNA, 18 nt, Human
gaggagcccugccucucc

SEQ ID NO: 3403155 - RNA, 12 nt, Human
gaggagccuguc

SEQ ID NO: 3403156 - RNA, 16 nt, Human
gaggagccuguccugc

SEQ ID NO: 3403157 - RNA, 22 nt, Human
gaggagccuguccugccugugg

SEQ ID NO: 3403158 - RNA, 13 nt, Human
gaggagccuuuuu

SEQ ID NO: 3403159 - RNA, 12 nt, Human
gaggagcugcug

SEQ ID NO: 3403160 - RNA, 15 nt, Human
gaggagcuuggggga

SEQ ID NO: 3403161 - RNA, 19 nt, Human
gaggaggaaaucccuucau

SEQ ID NO: 3403162 - RNA, 19 nt, Human
gaggaggaaggagagaagg

SEQ ID NO: 3403163 - RNA, 19 nt, Human
gaggaggaugucccugggc

SEQ ID NO: 3403164 - RNA, 22 nt, Human
gaggaggaugucccugggccag

SEQ ID NO: 3403165 - RNA, 16 nt, Human
gaggaggcagagaaga

SEQ ID NO: 3403166 - RNA, 20 nt, Human
gaggaggcagagaagaaaga

SEQ ID NO: 3403167 - RNA, 14 nt, Human
gaggaggcagcagg

SEQ ID NO: 3403168 - RNA, 12 nt, Human
gaggaggccacc

SEQ ID NO: 3403169 - RNA, 14 nt, Human
gaggaggccaccuc

SEQ ID NO: 3403170 - RNA, 16 nt, Human
gaggaggccaccucuc

SEQ ID NO: 3403171 - RNA, 13 nt, Human
gaggaggggaggg

SEQ ID NO: 3403172 - RNA, 19 nt, Human
gaggaggggccccccugcc

SEQ ID NO: 3403173 - RNA, 22 nt, Human
gaggaggggccccccugcccug

SEQ ID NO: 3403174 - RNA, 21 nt, Human
gaggagggucggugccuucaa

SEQ ID NO: 3403175 - RNA, 15 nt, Human
gaggaggguggggga

SEQ ID NO: 3403176 - RNA, 19 nt, Human
gaggagguaaugaauuaaa

SEQ ID NO: 3403177 - RNA, 15 nt, Human
gaggagguggcagcc

SEQ ID NO: 3403178 - RNA, 21 nt, Human
gaggaggugucucaggcugcc

SEQ ID NO: 3403179 - RNA, 14 nt, Human
gaggaguaaaauuc

SEQ ID NO: 3403180 - RNA, 21 nt, Human
gaggagucugagguccugagc

SEQ ID NO: 3403181 - RNA, 22 nt, Human
gaggagucugagguccugagca

SEQ ID NO: 3403182 - RNA, 14 nt, Human
gaggagucuugugu

SEQ ID NO: 3403183 - RNA, 15 nt, Human
gaggaguucaaugau

SEQ ID NO: 3403184 - RNA, 16 nt, Human
gaggaguucaaugauc

SEQ ID NO: 3403185 - RNA, 17 nt, Human
gaggaguucaaugaucu

SEQ ID NO: 3403186 - RNA, 19 nt, Human
gaggaguucaaugaucuag

SEQ ID NO: 3403187 - RNA, 12 nt, Human
gaggaguuuccu

SEQ ID NO: 3403188 - RNA, 19 nt, Human
gaggaucacuggagcccag

SEQ ID NO: 3403189 - RNA, 20 nt, Human
gaggaucacuggagcccagg

SEQ ID NO: 3403190 - RNA, 14 nt, Human
gaggaucagaaagu

SEQ ID NO: 3403191 - RNA, 13 nt, Human
gaggaucuggaga

SEQ ID NO: 3403192 - RNA, 21 nt, Human
gaggaugaauguaugugcacu

SEQ ID NO: 3403193 - RNA, 15 nt, Human
gaggauggccagugu

SEQ ID NO: 3403194 - RNA, 20 nt, Human
gaggauggccucugcuaagc

SEQ ID NO: 3403195 - RNA, 17 nt, Human
gaggaugggucagagcu

SEQ ID NO: 3403196 - RNA, 13 nt, Human
gaggaugucccug

SEQ ID NO: 3403197 - RNA, 15 nt, Human
gaggaugugggcagc

SEQ ID NO: 3403198 - RNA, 14 nt, Human
gaggauuaguuuag

SEQ ID NO: 3403199 - RNA, 14 nt, Human
gaggauuauugaua

SEQ ID NO: 3403200 - RNA, 16 nt, Human
gaggauucuaugaggc

SEQ ID NO: 3403201 - RNA, 17 nt, Human
gaggauucuaugaggca

SEQ ID NO: 3403202 - RNA, 20 nt, Human
gaggauuuaagggauggaaa

SEQ ID NO: 3403203 - RNA, 22 nt, Human
gaggauuuagaagugucauguu

SEQ ID NO: 3403204 - RNA, 23 nt, Human
gaggcaaaaggcaguggggcugg

SEQ ID NO: 3403205 - RNA, 23 nt, Human
gaggcaaccugauuguaaacuuc

SEQ ID NO: 3403206 - RNA, 13 nt, Human
gaggcaagagaau

SEQ ID NO: 3403207 - RNA, 15 nt, Human
gaggcaagcaagcuc

SEQ ID NO: 3403208 - RNA, 17 nt, Human
gaggcaagcugaaauuu

SEQ ID NO: 3403209 - RNA, 19 nt, Human
gaggcaaugucaggaacag

SEQ ID NO: 3403210 - RNA, 19 nt, Human
gaggcaccaguguccuccc

SEQ ID NO: 3403211 - RNA, 18 nt, Human
gaggcaccauucaggaac

SEQ ID NO: 3403212 - RNA, 16 nt, Human
gaggcagaaaauugca

SEQ ID NO: 3403213 - RNA, 19 nt, Human
gaggcagaaagcagaggcu

SEQ ID NO: 3403214 - RNA, 12 nt, Human
gaggcagacagc

SEQ ID NO: 3403215 - RNA, 22 nt, Human
gaggcagacuucccugaaugua

SEQ ID NO: 3403216 - RNA, 19 nt, Human
gaggcagagaaagaagaga

SEQ ID NO: 3403217 - RNA, 16 nt, Human
gaggcagagaagaaag

SEQ ID NO: 3403218 - RNA, 14 nt, Human
gaggcagagugccc

SEQ ID NO: 3403219 - RNA, 12 nt, Human
gaggcagaguuu

SEQ ID NO: 3403220 - RNA, 13 nt, Human
gaggcagcagugu

SEQ ID NO: 3403221 - RNA, 20 nt, Human
gaggcagcagugugaggcca

SEQ ID NO: 3403222 - RNA, 22 nt, Human
gaggcagcagugugaggccagg

SEQ ID NO: 3403223 - RNA, 12 nt, Human
gaggcagccagg

SEQ ID NO: 3403224 - RNA, 12 nt, Human
gaggcagcccag

SEQ ID NO: 3403225 - RNA, 21 nt, Human
gaggcagccccauucugccug

SEQ ID NO: 3403226 - RNA, 16 nt, Human
gaggcaggagacuggc

SEQ ID NO: 3403227 - RNA, 23 nt, Human
gaggcaggaggauugcuugagcc

SEQ ID NO: 3403228 - RNA, 20 nt, Human
gaggcaggcauggcccuggg

SEQ ID NO: 3403229 - RNA, 22 nt, Human
gaggcagggaaguccccaggcc

SEQ ID NO: 3403230 - RNA, 16 nt, Human
gaggcagggaggcagc

SEQ ID NO: 3403231 - RNA, 18 nt, Human
gaggcagggaggcagccg

SEQ ID NO: 3403232 - RNA, 14 nt, Human
gaggcaggggcgga

SEQ ID NO: 3403233 - RNA, 20 nt, Human
gaggcaggggcuuccuggug

SEQ ID NO: 3403234 - RNA, 15 nt, Human
gaggcagggucucac

SEQ ID NO: 3403235 - RNA, 19 nt, Human
gaggcagggucucacucug

SEQ ID NO: 3403236 - RNA, 13 nt, Human
gaggcaggucccc

SEQ ID NO: 3403237 - RNA, 19 nt, Human
gaggcagugggucccacuu

SEQ ID NO: 3403238 - RNA, 21 nt, Human
gaggcaguucgaccagccagg

SEQ ID NO: 3403239 - RNA, 15 nt, Human
gaggcaguugcccag

SEQ ID NO: 3403240 - RNA, 18 nt, Human
gaggcaguugcccagccu

SEQ ID NO: 3403241 - RNA, 15 nt, Human
gaggcauggcccugg

SEQ ID NO: 3403242 - RNA, 19 nt, Human
gaggcauggucugcccucu

SEQ ID NO: 3403243 - RNA, 21 nt, Human
gaggcaugugaugagaggaaa

SEQ ID NO: 3403244 - RNA, 22 nt, Human
gaggcaugugaugagaggaaau

SEQ ID NO: 3403245 - RNA, 19 nt, Human
gaggcauuuguuugaacug

SEQ ID NO: 3403246 - RNA, 18 nt, Human
gaggccaaaggcuggugg

SEQ ID NO: 3403247 - RNA, 17 nt, Human
gaggccaacacuguggg

SEQ ID NO: 3403248 - RNA, 20 nt, Human
gaggccaagaguggccccac

SEQ ID NO: 3403249 - RNA, 22 nt, Human
gaggccaagaguggccccaccu

SEQ ID NO: 3403250 - RNA, 12 nt, Human
gaggccaaggug

SEQ ID NO: 3403251 - RNA, 17 nt, Human
gaggccacaugaguccc

SEQ ID NO: 3403252 - RNA, 22 nt, Human
gaggccacaugagucccagugg

SEQ ID NO: 3403253 - RNA, 11 nt, Human
gaggccaccuc

SEQ ID NO: 3403254 - RNA, 12 nt, Human
gaggccaccucu

SEQ ID NO: 3403255 - RNA, 20 nt, Human
gaggccaccucuccaagggc

SEQ ID NO: 3403256 - RNA, 12 nt, Human
gaggccagacca

SEQ ID NO: 3403257 - RNA, 18 nt, Human
gaggccagaccauggaca

SEQ ID NO: 3403258 - RNA, 14 nt, Human
gaggccagagacac

SEQ ID NO: 3403259 - RNA, 20 nt, Human
gaggccagagacacaagccu

SEQ ID NO: 3403260 - RNA, 14 nt, Human
gaggccagccccac

SEQ ID NO: 3403261 - RNA, 15 nt, Human
gagggguaggggcug

SEQ ID NO: 3403262 - RNA, 21 nt, Human
gaggggucgacuucgggcugg

SEQ ID NO: 3403263 - RNA, 19 nt, Human
gaggggugcagaggcugug

SEQ ID NO: 3403264 - RNA, 15 nt, Human
gaggggugggcuggu

SEQ ID NO: 3403265 - RNA, 18 nt, Human
gagggguguggcaguggu

SEQ ID NO: 3403266 - RNA, 23 nt, Human
gagggguuccuccccuccagcuc

SEQ ID NO: 3403267 - RNA, 17 nt, Human
gagggguugccacaggc

SEQ ID NO: 3403268 - RNA, 18 nt, Human
gagggguugccacaggcc

SEQ ID NO: 3403269 - RNA, 13 nt, Human
gaggguaaggcug

SEQ ID NO: 3403270 - RNA, 21 nt, Human
gaggguaggagggugggaagg

SEQ ID NO: 3403271 - RNA, 13 nt, Human
gaggguaggcagg

SEQ ID NO: 3403272 - RNA, 22 nt, Human
gaggguaggcaggauuggggaa

SEQ ID NO: 3403273 - RNA, 14 nt, Human
gagggucagccagg

SEQ ID NO: 3403274 - RNA, 15 nt, Human
gagggucagccaggg

SEQ ID NO: 3403275 - RNA, 16 nt, Human
gagggucaggaaggau

SEQ ID NO: 3403276 - RNA, 18 nt, Human
gagggucccaagcugggc

SEQ ID NO: 3403277 - RNA, 19 nt, Human
gagggucccaagcugggcc

SEQ ID NO: 3403278 - RNA, 23 nt, Human
gagggucccaagcugggccccag

SEQ ID NO: 3403279 - RNA, 17 nt, Human
gagggucuauggggaga

SEQ ID NO: 3403280 - RNA, 24 nt, Human
gagggucuggagaagcagugagcc

SEQ ID NO: 3403281 - RNA, 13 nt, Human
gagggugaagccu

SEQ ID NO: 3403282 - RNA, 19 nt, Human
gagggugaguccuccagaa

SEQ ID NO: 3403283 - RNA, 16 nt, Human
gagggugaguuggcuu

SEQ ID NO: 3403284 - RNA, 13 nt, Human
gagggugcugccc

SEQ ID NO: 3403285 - RNA, 12 nt, Human
gaggguggaaua

SEQ ID NO: 3403286 - RNA, 20 nt, Human
gaggguggagacuaagcccu

SEQ ID NO: 3403287 - RNA, 13 nt, Human
gagggugggaagg

SEQ ID NO: 3403288 - RNA, 19 nt, Human
gagggugggagagcccagc

SEQ ID NO: 3403289 - RNA, 15 nt, Human
gagggugggaguggg

SEQ ID NO: 3403290 - RNA, 15 nt, Human
gagggugggggaggg

SEQ ID NO: 3403291 - RNA, 15 nt, Human
gaggguugggcuggu

SEQ ID NO: 3403292 - RNA, 17 nt, Human
gaggguuggggaggggc

SEQ ID NO: 3403293 - RNA, 20 nt, Human
gaggguuggguucaucugag

SEQ ID NO: 3403294 - RNA, 22 nt, Human
gaggguuucauugucugugaag

SEQ ID NO: 3403295 - RNA, 21 nt, Human
gaggguuuccaugggguagga

SEQ ID NO: 3403296 - RNA, 14 nt, Human
gagguaacagaaca

SEQ ID NO: 3403297 - RNA, 16 nt, Human
gagguaacagaacagc

SEQ ID NO: 3403298 - RNA, 12 nt, Human
gagguaaguuuu

SEQ ID NO: 3403299 - RNA, 17 nt, Human
gagguacuagaaugcuu

SEQ ID NO: 3403300 - RNA, 15 nt, Human
gagguagaaugacuc

SEQ ID NO: 3403301 - RNA, 20 nt, Human
gagguagaccaggauuucua

SEQ ID NO: 3403302 - RNA, 18 nt, Human
gagguagaguuugaagga

SEQ ID NO: 3403303 - RNA, 14 nt, Human
gagguauuaaaacu

SEQ ID NO: 3403304 - RNA, 19 nt, Human
gagguauuuaucuuuacuu

SEQ ID NO: 3403305 - RNA, 17 nt, Human
gaggucaagcccaggag

SEQ ID NO: 3403306 - RNA, 15 nt, Human
gaggucacuggaaag

SEQ ID NO: 3403307 - RNA, 21 nt, Human
gaggucacuggaaaggggaga

SEQ ID NO: 3403308 - RNA, 13 nt, Human
gaggucagagccu

SEQ ID NO: 3403309 - RNA, 20 nt, Human
gaggucagagccugcaguua

SEQ ID NO: 3403310 - RNA, 21 nt, Human
gaggucagcacaucucaacag

SEQ ID NO: 3403311 - RNA, 22 nt, Human
gaggucagggagugcuggcuca

SEQ ID NO: 3403312 - RNA, 23 nt, Human
gaggucagggagugcuggcucac

SEQ ID NO: 3403313 - RNA, 13 nt, Human
gagguccagccca

SEQ ID NO: 3403314 - RNA, 17 nt, Human
gagguccagcccuggcu

SEQ ID NO: 3403315 - RNA, 20 nt, Human
gagguccagcccuggcugaa

SEQ ID NO: 3403316 - RNA, 17 nt, Human
gagguccugagcacugc

SEQ ID NO: 3403317 - RNA, 14 nt, Human
gagguccugggggc

SEQ ID NO: 3403318 - RNA, 21 nt, Human
gagguccugggggccugaccu

SEQ ID NO: 3403319 - RNA, 22 nt, Human
gaggucgguagguucagccaag

SEQ ID NO: 3403320 - RNA, 13 nt, Human
gaggucucagccc

SEQ ID NO: 3403321 - RNA, 22 nt, Human
gaggucucgcugaugcugggcu

SEQ ID NO: 3403322 - RNA, 14 nt, Human
gaggucuguuccuu

SEQ ID NO: 3403323 - RNA, 14 nt, Human
gaggucuguucuuu

SEQ ID NO: 3403324 - RNA, 13 nt, Human
gaggucuguuuaa

SEQ ID NO: 3403325 - RNA, 12 nt, Human
gaggucuugcua

SEQ ID NO: 3403326 - RNA, 22 nt, Human
gaggucuuuugacauguggaaa

SEQ ID NO: 3403327 - RNA, 16 nt, Human
gaggugaaagggagcu

SEQ ID NO: 3403328 - RNA, 23 nt, Human
gaggugaacaagcaaacccagac

SEQ ID NO: 3403329 - RNA, 23 nt, Human
gaggugaacuguuuccacauuca

SEQ ID NO: 3403330 - RNA, 18 nt, Human
gaggugaccccagggcac

SEQ ID NO: 3403331 - RNA, 21 nt, Human
gaggugaccccagggcacagg

SEQ ID NO: 3403332 - RNA, 22 nt, Human
gaggugaccccagggcacagga

SEQ ID NO: 3403333 - RNA, 23 nt, Human
gaggugaccccagggcacaggag

SEQ ID NO: 3403334 - RNA, 16 nt, Human
gaggugagaccaccuc

SEQ ID NO: 3403335 - RNA, 16 nt, Human
gaggugaggagcagag

SEQ ID NO: 3403336 - RNA, 13 nt, Human
gaggugauuccag

SEQ ID NO: 3403337 - RNA, 18 nt, Human
gaggugcacugggaggcu

SEQ ID NO: 3403338 - RNA, 18 nt, Human
gaggugcagagugcccag

SEQ ID NO: 3403339 - RNA, 13 nt, Human
gaggugccagcaa

SEQ ID NO: 3403340 - RNA, 16 nt, Human
gaggugccagcaaagc

SEQ ID NO: 3403341 - RNA, 20 nt, Human
gaggugccagcaaagcccca

SEQ ID NO: 3403342 - RNA, 22 nt, Human
gaggugccagcaacugaauaaa

SEQ ID NO: 3403343 - RNA, 14 nt, Human
gaggugcccaggag

SEQ ID NO: 3403344 - RNA, 15 nt, Human
gaggugcccaggaga

SEQ ID NO: 3403345 - RNA, 12 nt, Human
gaggugccugga

SEQ ID NO: 3403346 - RNA, 21 nt, Human
gaggugccugucccaccccca

SEQ ID NO: 3403347 - RNA, 23 nt, Human
gaggugccuucuucagggccugg

SEQ ID NO: 3403348 - RNA, 22 nt, Human
gaggugcuuaagcagaagcauu

SEQ ID NO: 3403349 - RNA, 22 nt, Human
gaggugcuucuaguucugccag

SEQ ID NO: 3403350 - RNA, 23 nt, Human
gaggugcuucuaguucugccagg

SEQ ID NO: 3403351 - RNA, 13 nt, Human
gagguggaagaag

SEQ ID NO: 3403352 - RNA, 17 nt, Human
gagguggaagagggcug

SEQ ID NO: 3403353 - RNA, 20 nt, Human
gagguggaagagggcugcaa

SEQ ID NO: 3403354 - RNA, 19 nt, Human
gagguggagguugcaguga

SEQ ID NO: 3403355 - RNA, 20 nt, Human
gagguggagguugcagugag

SEQ ID NO: 3403356 - RNA, 17 nt, Human
gagguggaucacagagg

SEQ ID NO: 3403357 - RNA, 21 nt, Human
gagguggauuccgagugguga

SEQ ID NO: 3403358 - RNA, 24 nt, Human
gagguggauuccgaguggugacag

SEQ ID NO: 3403359 - RNA, 16 nt, Human
gagguggcagcccugu

SEQ ID NO: 3403360 - RNA, 18 nt, Human
gagguggccuccuugcuu

SEQ ID NO: 3403361 - RNA, 11 nt, Human
gaggugggagg

SEQ ID NO: 3403362 - RNA, 20 nt, Human
gaggugggaggaucuuuuga

SEQ ID NO: 3403363 - RNA, 13 nt, Human
gaggugggagggc

SEQ ID NO: 3403364 - RNA, 18 nt, Human
gaggugggagguggaaga

SEQ ID NO: 3403365 - RNA, 15 nt, Human
gaggugggauccucc

SEQ ID NO: 3403366 - RNA, 16 nt, Human
gaggugggauccucca

SEQ ID NO: 3403367 - RNA, 22 nt, Human
gaggugggauccuccaggugca

SEQ ID NO: 3403368 - RNA, 14 nt, Human
gaggugggcaggug

SEQ ID NO: 3403369 - RNA, 22 nt, Human
gaggugggcccaggaccagcug

SEQ ID NO: 3403370 - RNA, 23 nt, Human
gaggugggcccaggaccagcugg

SEQ ID NO: 3403371 - RNA, 14 nt, Human
gaggugggccgugg

SEQ ID NO: 3403372 - RNA, 18 nt, Human
gagguggggcgaggcagg

SEQ ID NO: 3403373 - RNA, 17 nt, Human
gagguggucugaauguu

SEQ ID NO: 3403374 - RNA, 15 nt, Human
gaggugucaggcugc

SEQ ID NO: 3403375 - RNA, 19 nt, Human
gaggugucucaggcugccu

SEQ ID NO: 3403376 - RNA, 17 nt, Human
gaggugugggggcugca

SEQ ID NO: 3403377 - RNA, 16 nt, Human
gagguuaaaaagaaaa

SEQ ID NO: 3403378 - RNA, 22 nt, Human
gagguuaggaguucgagaccag

SEQ ID NO: 3403379 - RNA, 13 nt, Human
gagguuauagguc

SEQ ID NO: 3403380 - RNA, 16 nt, Human
gagguuccucugccug

SEQ ID NO: 3403381 - RNA, 18 nt, Human
gagguugaaaaacaaaau

SEQ ID NO: 3403382 - RNA, 13 nt, Human
gagguugcagugu

SEQ ID NO: 3403383 - RNA, 17 nt, Human
gagguugggguguacua

SEQ ID NO: 3403384 - RNA, 22 nt, Human
gagguugguuuaaugcaauaga

SEQ ID NO: 3403385 - RNA, 19 nt, Human
gagguuuaggucaagaaga

SEQ ID NO: 3403386 - RNA, 16 nt, Human
gagguuuuauuucauu

SEQ ID NO: 3403387 - RNA, 21 nt, Human
gagguuuuauuucauuuuuca

SEQ ID NO: 3403388 - RNA, 15 nt, Human
gagguuuucuccccc

SEQ ID NO: 3403389 - RNA, 23 nt, Human
gagguuuuuuugucaacauugug

SEQ ID NO: 3403390 - RNA, 21 nt, Human
gaguaaaaaaaaaaacaauua

SEQ ID NO: 3403391 - RNA, 23 nt, Human
gaguaaaauaaauauugucuuuu

SEQ ID NO: 3403392 - RNA, 10 nt, Human
gaguaaagcu

SEQ ID NO: 3403393 - RNA, 17 nt, Human
gaguaaagcuccuaucu

SEQ ID NO: 3403394 - RNA, 13 nt, Human
gaguaacauuugc

SEQ ID NO: 3403395 - RNA, 18 nt, Human
gaguaagaaauuucaggu

SEQ ID NO: 3403396 - RNA, 23 nt, Human
gaguaaugcauacagaaauauaa

SEQ ID NO: 3403397 - RNA, 14 nt, Human
gaguaaugguguag

SEQ ID NO: 3403398 - RNA, 17 nt, Human
gaguaaugguguagaac

SEQ ID NO: 3403399 - RNA, 19 nt, Human
gaguaaugguguagaacac

SEQ ID NO: 3403400 - RNA, 18 nt, Human
gaguaauugcauuugcuu

SEQ ID NO: 3403401 - RNA, 16 nt, Human
gaguaauuuauuguuu

SEQ ID NO: 3403402 - RNA, 23 nt, Human
gaguacaaaugccuuaaaaugga

SEQ ID NO: 3403403 - RNA, 20 nt, Human
gaguacguugugcauuuggu

SEQ ID NO: 3403404 - RNA, 19 nt, Human
gaguacuacaguccuccca

SEQ ID NO: 3403405 - RNA, 13 nt, Human
gauuuccuaauac

SEQ ID NO: 3403406 - RNA, 11 nt, Human
gauuuccugug

SEQ ID NO: 3403407 - RNA, 13 nt, Human
gauuuccuguguc

SEQ ID NO: 3403408 - RNA, 17 nt, Human
gauuuccuugaaugugg

SEQ ID NO: 3403409 - RNA, 15 nt, Human
gauuuccuugugcaa

SEQ ID NO: 3403410 - RNA, 19 nt, Human
gauuucgugggucuguuuu

SEQ ID NO: 3403411 - RNA, 16 nt, Human
gauuucuaaucaaaag

SEQ ID NO: 3403412 - RNA, 15 nt, Human
gauuucuaguuauuu

SEQ ID NO: 3403413 - RNA, 15 nt, Human
gauuucucauugacu

SEQ ID NO: 3403414 - RNA, 13 nt, Human
gauuucugccuuc

SEQ ID NO: 3403415 - RNA, 22 nt, Human
gauuucuguuuagauaauacac

SEQ ID NO: 3403416 - RNA, 11 nt, Human
gauuucuuagg

SEQ ID NO: 3403417 - RNA, 19 nt, Human
gauuucuuugcuguaagau

SEQ ID NO: 3403418 - RNA, 23 nt, Human
gauuucuuuuguaauaaacuauu

SEQ ID NO: 3403419 - RNA, 16 nt, Human
gauuugaaaaauauaa

SEQ ID NO: 3403420 - RNA, 21 nt, Human
gauuugaaaaauauaaaauua

SEQ ID NO: 3403421 - RNA, 19 nt, Human
gauuugaagaacaugugag

SEQ ID NO: 3403422 - RNA, 12 nt, Human
gauuugacuguu

SEQ ID NO: 3403423 - RNA, 18 nt, Human
gauuugaugcuguuugac

SEQ ID NO: 3403424 - RNA, 21 nt, Human
gauuugauuuuuuuuuuuaau

SEQ ID NO: 3403425 - RNA, 14 nt, Human
gauuugcaaaaaaa

SEQ ID NO: 3403426 - RNA, 17 nt, Human
gauuugcauugaacaca

SEQ ID NO: 3403427 - RNA, 20 nt, Human
gauuuggcuugacaaaggca

SEQ ID NO: 3403428 - RNA, 20 nt, Human
gauuugucuuuggugaacau

SEQ ID NO: 3403429 - RNA, 22 nt, Human
gauuugucuuuggugaacauug

SEQ ID NO: 3403430 - RNA, 22 nt, Human
gauuugugucugugacuuuugu

SEQ ID NO: 3403431 - RNA, 16 nt, Human
gauuuguuuuuaaacu

SEQ ID NO: 3403432 - RNA, 21 nt, Human
gauuuguuuuuaaacuguaca

SEQ ID NO: 3403433 - RNA, 23 nt, Human
gauuuguuuuuaaacuguacagu

SEQ ID NO: 3403434 - RNA, 13 nt, Human
gauuuuaaacuag

SEQ ID NO: 3403435 - RNA, 15 nt, Human
gauuuuaaacuagau

SEQ ID NO: 3403436 - RNA, 17 nt, Human
gauuuuaaacuagauga

SEQ ID NO: 3403437 - RNA, 14 nt, Human
gauuuuaaaugugu

SEQ ID NO: 3403438 - RNA, 15 nt, Human
gauuuuaaaugugug

SEQ ID NO: 3403439 - RNA, 16 nt, Human
gauuuuaaauguguga

SEQ ID NO: 3403440 - RNA, 12 nt, Human
gauuuuaacaau

SEQ ID NO: 3403441 - RNA, 23 nt, Human
gauuuuaacaauaacuacugugu

SEQ ID NO: 3403442 - RNA, 16 nt, Human
gauuuuaauugucaug

SEQ ID NO: 3403443 - RNA, 13 nt, Human
gauuuuaauuuug

SEQ ID NO: 3403444 - RNA, 15 nt, Human
gauuuuaauuuugaa

SEQ ID NO: 3403445 - RNA, 16 nt, Human
gauuuuacaaaagaug

SEQ ID NO: 3403446 - RNA, 17 nt, Human
gauuuuacaaaagaugu

SEQ ID NO: 3403447 - RNA, 17 nt, Human
gauuuuacagagcgcac

SEQ ID NO: 3403448 - RNA, 13 nt, Human
gauuuuacaugaa

SEQ ID NO: 3403449 - RNA, 18 nt, Human
gauuuuacauguggccca

SEQ ID NO: 3403450 - RNA, 20 nt, Human
gauuuuagcuaggauuugaa

SEQ ID NO: 3403451 - RNA, 21 nt, Human
gauuuuaggagcuaaggcucu

SEQ ID NO: 3403452 - RNA, 22 nt, Human
gauuuuaucuuucgcacagcag

SEQ ID NO: 3403453 - RNA, 20 nt, Human
gauuuuauguugacauuugu

SEQ ID NO: 3403454 - RNA, 13 nt, Human
gauuuuauuaugu

SEQ ID NO: 3403455 - RNA, 23 nt, Human
gauuuuauuauguaaaucccauu

SEQ ID NO: 3403456 - RNA, 15 nt, Human
gauuuuauuugacaa

SEQ ID NO: 3403457 - RNA, 15 nt, Human
gauuuuccugaaaac

SEQ ID NO: 3403458 - RNA, 18 nt, Human
gauuuuccuuuuuuauac

SEQ ID NO: 3403459 - RNA, 21 nt, Human
gauuuuccuuuuuuauacaca

SEQ ID NO: 3403460 - RNA, 23 nt, Human
gauuuucuacaaguauucugccu

SEQ ID NO: 3403461 - RNA, 17 nt, Human
gauuuucuauuguuacu

SEQ ID NO: 3403462 - RNA, 18 nt, Human
gauuuucuauuguuacuc

SEQ ID NO: 3403463 - RNA, 15 nt, Human
gauuuucuccagcuc

SEQ ID NO: 3403464 - RNA, 13 nt, Human
gauuuucuuuaaa

SEQ ID NO: 3403465 - RNA, 12 nt, Human
gauuuugaaaac

SEQ ID NO: 3403466 - RNA, 21 nt, Human
gauuuugaaaccaugaagaga

SEQ ID NO: 3403467 - RNA, 23 nt, Human
gauuuugaaccugaugaaaauaa

SEQ ID NO: 3403468 - RNA, 14 nt, Human
gauuuugaguaucu

SEQ ID NO: 3403469 - RNA, 18 nt, Human
gauuuugauagcaaagcg

SEQ ID NO: 3403470 - RNA, 19 nt, Human
gauuuugauccaagcuggu

SEQ ID NO: 3403471 - RNA, 12 nt, Human
gauuuugaucuc

SEQ ID NO: 3403472 - RNA, 21 nt, Human
gauuuugguauuacacuguau

SEQ ID NO: 3403473 - RNA, 19 nt, Human
gauuuugguuuuguucccc

SEQ ID NO: 3403474 - RNA, 22 nt, Human
gauuuugguuuuguuccccucc

SEQ ID NO: 3403475 - RNA, 23 nt, Human
gauuuuguaucugcaggcagaca

SEQ ID NO: 3403476 - RNA, 14 nt, Human
gauuuuguuuugcu

SEQ ID NO: 3403477 - RNA, 14 nt, Human
gauuuuuacacaug

SEQ ID NO: 3403478 - RNA, 16 nt, Human
gauuuuuacuguguuu

SEQ ID NO: 3403479 - RNA, 13 nt, Human
gauuuuuauccaa

SEQ ID NO: 3403480 - RNA, 13 nt, Human
gauuuuucucaaa

SEQ ID NO: 3403481 - RNA, 18 nt, Human
gauuuuucucaaaguuuu

SEQ ID NO: 3403482 - RNA, 12 nt, Human
gauuuuucuuua

SEQ ID NO: 3403483 - RNA, 20 nt, Human
gauuuuucuuuacaaaacaa

SEQ ID NO: 3403484 - RNA, 22 nt, Human
gauuuuuguuuuguuuuuacaa

SEQ ID NO: 3403485 - RNA, 16 nt, Human
gauuuuuuaauaauuu

SEQ ID NO: 3403486 - RNA, 17 nt, Human
gauuuuuuaauaauuua

SEQ ID NO: 3403487 - RNA, 16 nt, Human
gauuuuuuauugcuag

SEQ ID NO: 3403488 - RNA, 14 nt, Human
gauuuuuuccaaaa

SEQ ID NO: 3403489 - RNA, 18 nt, Human
gauuuuuuccuucaaagu

SEQ ID NO: 3403490 - RNA, 19 nt, Human
gauuuuuugcauuccugac

SEQ ID NO: 3403491 - RNA, 14 nt, Human
gauuuuuuucugag

SEQ ID NO: 3403492 - RNA, 21 nt, Human
gauuuuuuuguuguuuguuua

SEQ ID NO: 3403493 - RNA, 15 nt, Human
gauuuuuuuuucaua

SEQ ID NO: 3403494 - RNA, 17 nt, Human
gauuuuuuuuuccuuca

SEQ ID NO: 3403495 - RNA, 22 nt, Human
gauuuuuuuuuccuucagugcc

SEQ ID NO: 3403496 - RNA, 23 nt, Human
gauuuuuuuuuccuucagugccu

SEQ ID NO: 3403497 - RNA, 16 nt, Human
gauuuuuuuuuuuucu

SEQ ID NO: 3403498 - RNA, 13 nt, Human
gcaaaaaaaauua

SEQ ID NO: 3403499 - RNA, 16 nt, Human
gcaaaaaaaauuagcc

SEQ ID NO: 3403500 - RNA, 17 nt, Human
gcaaaaaaaguuguaug

SEQ ID NO: 3403501 - RNA, 18 nt, Human
gcaaaaaaaguuguauga

SEQ ID NO: 3403502 - RNA, 12 nt, Human
gcaaaaaaauua

SEQ ID NO: 3403503 - RNA, 17 nt, Human
gcaaaaaagaaaaccuu

SEQ ID NO: 3403504 - RNA, 18 nt, Human
gcaaaaaagaaaaccuuu

SEQ ID NO: 3403505 - RNA, 21 nt, Human
gcaaaaaaguccaauuuuaau

SEQ ID NO: 3403506 - RNA, 15 nt, Human
gcaaaaaauaaugac

SEQ ID NO: 3403507 - RNA, 11 nt, Human
gcaaaaaauac

SEQ ID NO: 3403508 - RNA, 22 nt, Human
gcaaaaaaucuuaauacuguua

SEQ ID NO: 3403509 - RNA, 17 nt, Human
gcaaaaaauguuuuugg

SEQ ID NO: 3403510 - RNA, 22 nt, Human
gcaaaaacauguaugugcauuu

SEQ ID NO: 3403511 - RNA, 14 nt, Human
gcaaaaaggcagga

SEQ ID NO: 3403512 - RNA, 13 nt, Human
gcaaaaauaauca

SEQ ID NO: 3403513 - RNA, 23 nt, Human
gcaaaaauaguuuggauauguaa

SEQ ID NO: 3403514 - RNA, 14 nt, Human
gcaaaaauauaaaa

SEQ ID NO: 3403515 - RNA, 16 nt, Human
gcaaaaauauuuuaug

SEQ ID NO: 3403516 - RNA, 15 nt, Human
gcaaaaaugcuaaua

SEQ ID NO: 3403517 - RNA, 11 nt, Human
gcaaaaauuuu

SEQ ID NO: 3403518 - RNA, 12 nt, Human
gcaaaaccagaa

SEQ ID NO: 3403519 - RNA, 21 nt, Human
gcaaaaccagguuuuguuccg

SEQ ID NO: 3403520 - RNA, 17 nt, Human
gcaaaaccauugcuuca

SEQ ID NO: 3403521 - RNA, 17 nt, Human
gcaaaaccuuuuacugg

SEQ ID NO: 3403522 - RNA, 17 nt, Human
gcaaaacucuacuuaau

SEQ ID NO: 3403523 - RNA, 17 nt, Human
gcaaaacuuuuaaacua

SEQ ID NO: 3403524 - RNA, 15 nt, Human
gcaaaagaagaaguu

SEQ ID NO: 3403525 - RNA, 22 nt, Human
gcaaaagaugcuucucacugcc

SEQ ID NO: 3403526 - RNA, 14 nt, Human
gcaaaagccuugug

SEQ ID NO: 3403527 - RNA, 11 nt, Human
gcaaaaggaaa

SEQ ID NO: 3403528 - RNA, 21 nt, Human
gcaaaaggagagacucccaug

SEQ ID NO: 3403529 - RNA, 23 nt, Human
gcaaaaggccucuuguaaagacu

SEQ ID NO: 3403530 - RNA, 15 nt, Human
gcaaaauaaaaacua

SEQ ID NO: 3403531 - RNA, 21 nt, Human
gcaaaauaaaacauagcaaau

SEQ ID NO: 3403532 - RNA, 18 nt, Human
gcaaaauacaugaugauu

SEQ ID NO: 3403533 - RNA, 10 nt, Human
gcaaaauaug

SEQ ID NO: 3403534 - RNA, 19 nt, Human
gcaaaaucaagcaagccuc

SEQ ID NO: 3403535 - RNA, 20 nt, Human
gcaaaaucauggaaugguua

SEQ ID NO: 3403536 - RNA, 23 nt, Human
gcaaaaucauuuuauaugucaaa

SEQ ID NO: 3403537 - RNA, 18 nt, Human
gcaaaauuauagaaguuu

SEQ ID NO: 3403538 - RNA, 16 nt, Human
gcaaaauucccaggga

SEQ ID NO: 3403539 - RNA, 13 nt, Human
gcaaaauuccuga

SEQ ID NO: 3403540 - RNA, 17 nt, Human
gcaaaauugauguguuu

SEQ ID NO: 3403541 - RNA, 10 nt, Human
gcaaaauuuc

SEQ ID NO: 3403542 - RNA, 17 nt, Human
gcaaacacacaaaggua

SEQ ID NO: 3403543 - RNA, 15 nt, Human
gcaaacaccugcuga

SEQ ID NO: 3403544 - RNA, 15 nt, Human
gcaaacacuccaccc

SEQ ID NO: 3403545 - RNA, 21 nt, Human
gcaaacaggaucaguuaacua

SEQ ID NO: 3403546 - RNA, 16 nt, Human
gcaaacagggccucug

SEQ ID NO: 3403547 - RNA, 17 nt, Human
gcaaacagggccucugc

SEQ ID NO: 3403548 - RNA, 21 nt, Human
gcaaacaugggguuggcuggg

SEQ ID NO: 3403549 - RNA, 15 nt, Human
gcaaacauuuucucu

SEQ ID NO: 3403550 - RNA, 16 nt, Human
gcaaaccaagagauug

SEQ ID NO: 3403551 - RNA, 19 nt, Human
gcaagaggcaagcugaaau

SEQ ID NO: 3403552 - RNA, 20 nt, Human
gcaagaggccguggcugcug

SEQ ID NO: 3403553 - RNA, 18 nt, Human
gcaagauaaacauuauua

SEQ ID NO: 3403554 - RNA, 17 nt, Human
gcaagauggcacagggc

SEQ ID NO: 3403555 - RNA, 13 nt, Human
gcaagaugugaau

SEQ ID NO: 3403556 - RNA, 14 nt, Human
gcaagaugugaauu

SEQ ID NO: 3403557 - RNA, 17 nt, Human
gcaagaugugaauuauu

SEQ ID NO: 3403558 - RNA, 16 nt, Human
gcaagaugugggcagu

SEQ ID NO: 3403559 - RNA, 13 nt, Human
gcaagauugcuua

SEQ ID NO: 3403560 - RNA, 14 nt, Human
gcaagauugcuuaa

SEQ ID NO: 3403561 - RNA, 19 nt, Human
gcaagcaacacagaggaau

SEQ ID NO: 3403562 - RNA, 18 nt, Human
gcaagcaagaaacacugg

SEQ ID NO: 3403563 - RNA, 15 nt, Human
gcaagcaagaggccg

SEQ ID NO: 3403564 - RNA, 15 nt, Human
gcaagcacagcccuu

SEQ ID NO: 3403565 - RNA, 18 nt, Human
gcaagcaccauccccucc

SEQ ID NO: 3403566 - RNA, 20 nt, Human
gcaagcaccuccugccucga

SEQ ID NO: 3403567 - RNA, 14 nt, Human
gcaagcagaggacc

SEQ ID NO: 3403568 - RNA, 15 nt, Human
gcaagcaugcuugug

SEQ ID NO: 3403569 - RNA, 22 nt, Human
gcaagcauguaacuuauauuaa

SEQ ID NO: 3403570 - RNA, 17 nt, Human
gcaagcauucagaagaa

SEQ ID NO: 3403571 - RNA, 15 nt, Human
gcaagcccuacagag

SEQ ID NO: 3403572 - RNA, 11 nt, Human
gcaagccugcg

SEQ ID NO: 3403573 - RNA, 19 nt, Human
gcaagccuguaaucccagc

SEQ ID NO: 3403574 - RNA, 16 nt, Human
gcaagcuaauucuuug

SEQ ID NO: 3403575 - RNA, 22 nt, Human
gcaagcuaauucuuugaccugu

SEQ ID NO: 3403576 - RNA, 19 nt, Human
gcaagcucuuuuauaugcu

SEQ ID NO: 3403577 - RNA, 14 nt, Human
gcaagcugaaauuu

SEQ ID NO: 3403578 - RNA, 17 nt, Human
gcaagcuuggcuguaga

SEQ ID NO: 3403579 - RNA, 14 nt, Human
gcaaggaaggaaag

SEQ ID NO: 3403580 - RNA, 15 nt, Human
gcaaggaaggaaaga

SEQ ID NO: 3403581 - RNA, 14 nt, Human
gcaaggaccaggac

SEQ ID NO: 3403582 - RNA, 15 nt, Human
gcaaggaccaggacu

SEQ ID NO: 3403583 - RNA, 20 nt, Human
gcaaggaccaggacucccuc

SEQ ID NO: 3403584 - RNA, 14 nt, Human
gcaaggaggcuggc

SEQ ID NO: 3403585 - RNA, 16 nt, Human
gcaaggaggcuggcug

SEQ ID NO: 3403586 - RNA, 18 nt, Human
gcaaggcaggugccucca

SEQ ID NO: 3403587 - RNA, 22 nt, Human
gcaaggccaccucuuccuggcc

SEQ ID NO: 3403588 - RNA, 23 nt, Human
gcaaggcccgagcagcugagcag

SEQ ID NO: 3403589 - RNA, 24 nt, Human
gcaaggcccgagcagcugagcagg

SEQ ID NO: 3403590 - RNA, 14 nt, Human
gcaaggcccugcug

SEQ ID NO: 3403591 - RNA, 18 nt, Human
gcaaggcgcuaacuugcu

SEQ ID NO: 3403592 - RNA, 12 nt, Human
gcaaggcugugc

SEQ ID NO: 3403593 - RNA, 21 nt, Human
gcaagggaauuucuucaacuc

SEQ ID NO: 3403594 - RNA, 12 nt, Human
gcaagggacugu

SEQ ID NO: 3403595 - RNA, 15 nt, Human
gcaagggaggcccag

SEQ ID NO: 3403596 - RNA, 21 nt, Human
gcaagggcagggacagggccg

SEQ ID NO: 3403597 - RNA, 19 nt, Human
gcaagggccaugcugaagg

SEQ ID NO: 3403598 - RNA, 22 nt, Human
gcaagggguucccuugagggcu

SEQ ID NO: 3403599 - RNA, 14 nt, Human
gcaagggugauggg

SEQ ID NO: 3403600 - RNA, 18 nt, Human
gcaaggguuaaggccuga

SEQ ID NO: 3403601 - RNA, 16 nt, Human
gcaaggguucccucaa

SEQ ID NO: 3403602 - RNA, 18 nt, Human
gcaaggguucccucaaga

SEQ ID NO: 3403603 - RNA, 15 nt, Human
gcaaggucauuucuu

SEQ ID NO: 3403604 - RNA, 19 nt, Human
gcaaggucuggccucaggu

SEQ ID NO: 3403605 - RNA, 20 nt, Human
gcaagguggcuccagcacca

SEQ ID NO: 3403606 - RNA, 14 nt, Human
gcaagguuccacag

SEQ ID NO: 3403607 - RNA, 19 nt, Human
gcaagguuuaaguuauuaa

SEQ ID NO: 3403608 - RNA, 24 nt, Human
gcaagguuuaggcugguggcccag

SEQ ID NO: 3403609 - RNA, 15 nt, Human
gcaaguaaaaauaua

SEQ ID NO: 3403610 - RNA, 23 nt, Human
gcaaguauguuuuagcauguguu

SEQ ID NO: 3403611 - RNA, 16 nt, Human
gcaagucacaaaggaa

SEQ ID NO: 3403612 - RNA, 20 nt, Human
gcaagucacaaaggaaugga

SEQ ID NO: 3403613 - RNA, 19 nt, Human
gcaagucagaggauggcca

SEQ ID NO: 3403614 - RNA, 24 nt, Human
gcaagucagaggauggccaguguc

SEQ ID NO: 3403615 - RNA, 13 nt, Human
gcaagucaggguu

SEQ ID NO: 3403616 - RNA, 17 nt, Human
gcaagucauggcugugc

SEQ ID NO: 3403617 - RNA, 12 nt, Human
gcaagucaugua

SEQ ID NO: 3403618 - RNA, 15 nt, Human
gcaagucauguaaau

SEQ ID NO: 3403619 - RNA, 22 nt, Human
gcaagucccugacucucuguga

SEQ ID NO: 3403620 - RNA, 17 nt, Human
gcaaguccuuuuguaaa

SEQ ID NO: 3403621 - RNA, 18 nt, Human
gcaaguccuuuuguaaag

SEQ ID NO: 3403622 - RNA, 20 nt, Human
gcaagucugcaggugcacca

SEQ ID NO: 3403623 - RNA, 21 nt, Human
gcaagucuuuaggucuuugua

SEQ ID NO: 3403624 - RNA, 13 nt, Human
gcaagugaagaaa

SEQ ID NO: 3403625 - RNA, 18 nt, Human
gcaagugagagcugggug

SEQ ID NO: 3403626 - RNA, 21 nt, Human
gcaagugagcaaaccugcccc

SEQ ID NO: 3403627 - RNA, 19 nt, Human
gcaagugauugggacagag

SEQ ID NO: 3403628 - RNA, 12 nt, Human
gcaagugcugga

SEQ ID NO: 3403629 - RNA, 16 nt, Human
gcaagugucugugugc

SEQ ID NO: 3403630 - RNA, 19 nt, Human
gcaagugugugcaugugug

SEQ ID NO: 3403631 - RNA, 16 nt, Human
gcaaguuaagagaaac

SEQ ID NO: 3403632 - RNA, 21 nt, Human
gcaaguucuagagaagaggcu

SEQ ID NO: 3403633 - RNA, 12 nt, Human
gcaauaaaaauc

SEQ ID NO: 3403634 - RNA, 22 nt, Human
gcaauaaaagcccaggagccca

SEQ ID NO: 3403635 - RNA, 14 nt, Human
gcaauaaaauuuaa

SEQ ID NO: 3403636 - RNA, 15 nt, Human
gcaauaaauuuugaa

SEQ ID NO: 3403637 - RNA, 18 nt, Human
gcaauaaauuuugaaaag

SEQ ID NO: 3403638 - RNA, 12 nt, Human
gcaauaacuucu

SEQ ID NO: 3403639 - RNA, 12 nt, Human
gcaauaaugcag

SEQ ID NO: 3403640 - RNA, 19 nt, Human
gcaauaauggucccaucca

SEQ ID NO: 3403641 - RNA, 23 nt, Human
gcaauaauggucccauccaggca

SEQ ID NO: 3403642 - RNA, 13 nt, Human
gcaauacauacca

SEQ ID NO: 3403643 - RNA, 10 nt, Human
gcaauagaaa

SEQ ID NO: 3403644 - RNA, 17 nt, Human
gcaauagagacuguaga

SEQ ID NO: 3403645 - RNA, 21 nt, Human
gcaauauauuaccagcaagaa

SEQ ID NO: 3403646 - RNA, 14 nt, Human
gcaauauauuuugu

SEQ ID NO: 3403647 - RNA, 13 nt, Human
gcaauaugaaguu

SEQ ID NO: 3403648 - RNA, 14 nt, Human
gcaauauguaaaua

SEQ ID NO: 3403649 - RNA, 21 nt, Human
gcaauauuaaugccuuuaaag

SEQ ID NO: 3403650 - RNA, 22 nt, Human
gcaauauuccuuagucaaauca

SEQ ID NO: 3403651 - RNA, 14 nt, Human
gcaauauucucugu

SEQ ID NO: 3403652 - RNA, 14 nt, Human
gcaauauuugaauu

SEQ ID NO: 3403653 - RNA, 18 nt, Human
gcaaucaaaucugcuuuu

SEQ ID NO: 3403654 - RNA, 18 nt, Human
gcaauccacaaucugaca

SEQ ID NO: 3403655 - RNA, 13 nt, Human
gcaauccauguua

SEQ ID NO: 3403656 - RNA, 20 nt, Human
gcaauccucccacuucagcc

SEQ ID NO: 3403657 - RNA, 14 nt, Human
gcaauccugucuuu

SEQ ID NO: 3403658 - RNA, 19 nt, Human
gcaauccuuacaaaugauu

SEQ ID NO: 3403659 - RNA, 21 nt, Human
gcaaucuauuaauagcugccu

SEQ ID NO: 3403660 - RNA, 21 nt, Human
gcaaucuccccuugauuuaaa

SEQ ID NO: 3403661 - RNA, 23 nt, Human
gcaaucuccccuugauuuaaaca

SEQ ID NO: 3403662 - RNA, 13 nt, Human
gcaaucuuugaaa

SEQ ID NO: 3403663 - RNA, 16 nt, Human
gcaaugaaaaauucuc

SEQ ID NO: 3403664 - RNA, 18 nt, Human
gcaaugaaagguacuaua

SEQ ID NO: 3403665 - RNA, 16 nt, Human
gcaaugacaucuucaa

SEQ ID NO: 3403666 - RNA, 13 nt, Human
gcaaugaccuuuc

SEQ ID NO: 3403667 - RNA, 17 nt, Human
gcaaugaccuuucaaua

SEQ ID NO: 3403668 - RNA, 22 nt, Human
gcaaugaccuuucaauaggaaa

SEQ ID NO: 3403669 - RNA, 21 nt, Human
gcaaugccacagcccugucag

SEQ ID NO: 3403670 - RNA, 22 nt, Human
gcaaugccacagcccugucagc

SEQ ID NO: 3403671 - RNA, 23 nt, Human
gcaaugccauccucaaacacugc

SEQ ID NO: 3403672 - RNA, 22 nt, Human
gcaaugcuggcuguuggcuggg

SEQ ID NO: 3403673 - RNA, 12 nt, Human
gcaauggcagcc

SEQ ID NO: 3403674 - RNA, 16 nt, Human
gcaaugggcacuggga

SEQ ID NO: 3403675 - RNA, 22 nt, Human
gcaauggugucaguauccaggc

SEQ ID NO: 3403676 - RNA, 23 nt, Human
gcaauggugucaguauccaggcu

SEQ ID NO: 3403677 - RNA, 23 nt, Human
gcaaugguguugcccugagugga

SEQ ID NO: 3403678 - RNA, 19 nt, Human
gcaauguaaauauuuuaaa

SEQ ID NO: 3403679 - RNA, 22 nt, Human
gcaaugucaggaacagaaggau

SEQ ID NO: 3403680 - RNA, 14 nt, Human
gcaauguguguaua

SEQ ID NO: 3403681 - RNA, 18 nt, Human
gcaauguguguauaugga

SEQ ID NO: 3403682 - RNA, 14 nt, Human
gcaauguuaucuug

SEQ ID NO: 3403683 - RNA, 14 nt, Human
gcaauguuuuccuu

SEQ ID NO: 3403684 - RNA, 19 nt, Human
gcaauuaauuccuucagca

SEQ ID NO: 3403685 - RNA, 12 nt, Human
gcaauuaugaaa

SEQ ID NO: 3403686 - RNA, 19 nt, Human
gcaauuaugaaaauaaucu

SEQ ID NO: 3403687 - RNA, 16 nt, Human
gcaauucaaaaguucc

SEQ ID NO: 3403688 - RNA, 14 nt, Human
gcaauucaucccag

SEQ ID NO: 3403689 - RNA, 21 nt, Human
gcaauuccccucugcugcugu

SEQ ID NO: 3403690 - RNA, 15 nt, Human
gcaauuccgcauuua

SEQ ID NO: 3403691 - RNA, 17 nt, Human
gcaauuccgcauuuaau

SEQ ID NO: 3403692 - RNA, 14 nt, Human
gcaauucuccugcc

SEQ ID NO: 3403693 - RNA, 17 nt, Human
gcaauucuccugccuca

SEQ ID NO: 3403694 - RNA, 15 nt, Human
gcaauugaaaugcau

SEQ ID NO: 3403695 - RNA, 18 nt, Human
gcaauuuaaauguuauga

SEQ ID NO: 3403696 - RNA, 15 nt, Human
gcacaggucccaccu

SEQ ID NO: 3403697 - RNA, 17 nt, Human
gcacaggucccaccucc

SEQ ID NO: 3403698 - RNA, 21 nt, Human
gcacaggucccaccuccagcc

SEQ ID NO: 3403699 - RNA, 21 nt, Human
gcacaggugggcuucccagug

SEQ ID NO: 3403700 - RNA, 15 nt, Human
gcacaguauuuguaa

SEQ ID NO: 3403701 - RNA, 14 nt, Human
gcacagucagguug

SEQ ID NO: 3403702 - RNA, 13 nt, Human
gcacaguccagga

SEQ ID NO: 3403703 - RNA, 16 nt, Human
gcacagugacuucuga

SEQ ID NO: 3403704 - RNA, 19 nt, Human
gcacagugacuucugagau

SEQ ID NO: 3403705 - RNA, 15 nt, Human
gcacagugcaucuca

SEQ ID NO: 3403706 - RNA, 20 nt, Human
gcacagugcaucucagccca

SEQ ID NO: 3403707 - RNA, 16 nt, Human
gcacagugguggcagg

SEQ ID NO: 3403708 - RNA, 16 nt, Human
gcacagugucccccag

SEQ ID NO: 3403709 - RNA, 17 nt, Human
gcacagugucugggcug

SEQ ID NO: 3403710 - RNA, 18 nt, Human
gcacagugucugggcuga

SEQ ID NO: 3403711 - RNA, 13 nt, Human
gcacaguuugaac

SEQ ID NO: 3403712 - RNA, 14 nt, Human
gcacauaaacuuug

SEQ ID NO: 3403713 - RNA, 14 nt, Human
gcacauagagaggg

SEQ ID NO: 3403714 - RNA, 16 nt, Human
gcacauauacacacac

SEQ ID NO: 3403715 - RNA, 22 nt, Human
gcacauauuagugcagccaagu

SEQ ID NO: 3403716 - RNA, 22 nt, Human
gcacaucagcacgauuucuguu

SEQ ID NO: 3403717 - RNA, 23 nt, Human
gcacauccauucccaagaaaugc

SEQ ID NO: 3403718 - RNA, 13 nt, Human
gcacaucucugcu

SEQ ID NO: 3403719 - RNA, 21 nt, Human
gcacaucuguaaaucuacaca

SEQ ID NO: 3403720 - RNA, 18 nt, Human
gcacaucugugucuuguu

SEQ ID NO: 3403721 - RNA, 19 nt, Human
gcacaugacaacuuugcca

SEQ ID NO: 3403722 - RNA, 21 nt, Human
gcacaugagcuggcgggauug

SEQ ID NO: 3403723 - RNA, 14 nt, Human
gcacaugauuucac

SEQ ID NO: 3403724 - RNA, 15 nt, Human
gcacaugauuucaca

SEQ ID NO: 3403725 - RNA, 19 nt, Human
gcacaugcugagucuccca

SEQ ID NO: 3403726 - RNA, 14 nt, Human
gcacaugcuggcca

SEQ ID NO: 3403727 - RNA, 15 nt, Human
gcacaugcuggccag

SEQ ID NO: 3403728 - RNA, 18 nt, Human
gcacaugcuggccagccu

SEQ ID NO: 3403729 - RNA, 19 nt, Human
gcacaugcuggccagccug

SEQ ID NO: 3403730 - RNA, 21 nt, Human
gcacaugcuggccagccuggg

SEQ ID NO: 3403731 - RNA, 23 nt, Human
gcacaugcuggccagccuggggc

SEQ ID NO: 3403732 - RNA, 20 nt, Human
gcacaugucuuaaugaaguu

SEQ ID NO: 3403733 - RNA, 21 nt, Human
gcacaugucuuaaugaaguuu

SEQ ID NO: 3403734 - RNA, 12 nt, Human
gcacauguuucc

SEQ ID NO: 3403735 - RNA, 12 nt, Human
gcacauuaaaug

SEQ ID NO: 3403736 - RNA, 21 nt, Human
gcacauuuaagagacagucac

SEQ ID NO: 3403737 - RNA, 16 nt, Human
gcacauuuccccagac

SEQ ID NO: 3403738 - RNA, 18 nt, Human
gcaccaaaagaaguaaaa

SEQ ID NO: 3403739 - RNA, 18 nt, Human
gcaccaaaauaagaaaag

SEQ ID NO: 3403740 - RNA, 20 nt, Human
gcaccaaaucaaaaucucuc

SEQ ID NO: 3403741 - RNA, 15 nt, Human
gcaccaacccagccg

SEQ ID NO: 3403742 - RNA, 14 nt, Human
gcaccaagcccaca

SEQ ID NO: 3403743 - RNA, 14 nt, Human
gcaccacaaaauau

SEQ ID NO: 3403744 - RNA, 15 nt, Human
gcaccacacucagcc

SEQ ID NO: 3403745 - RNA, 20 nt, Human
gcaccaccaggucucccggg

SEQ ID NO: 3403746 - RNA, 20 nt, Human
gcaccacccuagucccuucc

SEQ ID NO: 3403747 - RNA, 15 nt, Human
gcaccacccuccuuc

SEQ ID NO: 3403748 - RNA, 20 nt, Human
gcaccacugcacuccagccu

SEQ ID NO: 3403749 - RNA, 16 nt, Human
gcaccagaauguauau

SEQ ID NO: 3403750 - RNA, 19 nt, Human
gcaccagacacccaggacu

SEQ ID NO: 3403751 - RNA, 20 nt, Human
gcaccagacacccaggacuu

SEQ ID NO: 3403752 - RNA, 21 nt, Human
gcaccagacacccaggacuua

SEQ ID NO: 3403753 - RNA, 18 nt, Human
gcaccagagcaaccucuc

SEQ ID NO: 3403754 - RNA, 13 nt, Human
gcaccagcagccu

SEQ ID NO: 3403755 - RNA, 16 nt, Human
gcaccagcagccugga

SEQ ID NO: 3403756 - RNA, 11 nt, Human
gcaccagccag

SEQ ID NO: 3403757 - RNA, 12 nt, Human
gcaccagccagc

SEQ ID NO: 3403758 - RNA, 17 nt, Human
gcaccagccggggaaga

SEQ ID NO: 3403759 - RNA, 19 nt, Human
gcaccagcuucuccaggcu

SEQ ID NO: 3403760 - RNA, 18 nt, Human
gcaccaggaagccguccu

SEQ ID NO: 3403761 - RNA, 12 nt, Human
gcaccaggagac

SEQ ID NO: 3403762 - RNA, 16 nt, Human
gcaccagggguuucuc

SEQ ID NO: 3403763 - RNA, 20 nt, Human
gcaccaguguccuccccuca

SEQ ID NO: 3403764 - RNA, 13 nt, Human
gcaccauacucau

SEQ ID NO: 3403765 - RNA, 14 nt, Human
gcaccaucccuuuu

SEQ ID NO: 3403766 - RNA, 22 nt, Human
gcaccaucccuuuuugaagugu

SEQ ID NO: 3403767 - RNA, 17 nt, Human
gcaccauccgccagggc

SEQ ID NO: 3403768 - RNA, 14 nt, Human
gcaccaucucuccu

SEQ ID NO: 3403769 - RNA, 15 nt, Human
gcaccaucucuccuc

SEQ ID NO: 3403770 - RNA, 17 nt, Human
gcaccaucucuccuccu

SEQ ID NO: 3403771 - RNA, 20 nt, Human
gcaccaucucugauuuucaa

SEQ ID NO: 3403772 - RNA, 15 nt, Human
gcaccauucugacuc

SEQ ID NO: 3403773 - RNA, 23 nt, Human
gcaccauucugacucgguuucuc

SEQ ID NO: 3403774 - RNA, 17 nt, Human
gcacccaagaccucagg

SEQ ID NO: 3403775 - RNA, 22 nt, Human
gcacccacaaauaaaugacaag

SEQ ID NO: 3403776 - RNA, 19 nt, Human
gcacccacaagugccacug

SEQ ID NO: 3403777 - RNA, 11 nt, Human
gcacccagaac

SEQ ID NO: 3403778 - RNA, 14 nt, Human
gcacccagaacagu

SEQ ID NO: 3403779 - RNA, 19 nt, Human
gcacccagccucuagggac

SEQ ID NO: 3403780 - RNA, 21 nt, Human
gcacccagccucuagggaccc

SEQ ID NO: 3403781 - RNA, 21 nt, Human
gcacccagugagcacucccaa

SEQ ID NO: 3403782 - RNA, 23 nt, Human
gcacccagugagcacucccaagu

SEQ ID NO: 3403783 - RNA, 16 nt, Human
gcacccauccaccguc

SEQ ID NO: 3403784 - RNA, 23 nt, Human
gcacccauccaccguccccuccc

SEQ ID NO: 3403785 - RNA, 21 nt, Human
gcacccaucugucugccaacc

SEQ ID NO: 3403786 - RNA, 13 nt, Human
gcaccccaaggcu

SEQ ID NO: 3403787 - RNA, 15 nt, Human
gcaccccaaguccag

SEQ ID NO: 3403788 - RNA, 20 nt, Human
gcaccccagcuggggccagg

SEQ ID NO: 3403789 - RNA, 15 nt, Human
gcaccccaugcuguu

SEQ ID NO: 3403790 - RNA, 14 nt, Human
gcacccccagccug

SEQ ID NO: 3403791 - RNA, 16 nt, Human
gcacccccagccuggg

SEQ ID NO: 3403792 - RNA, 19 nt, Human
gcacccccagccugggccu

SEQ ID NO: 3403793 - RNA, 14 nt, Human
gcaccccccaagcu

SEQ ID NO: 3403794 - RNA, 18 nt, Human
gcacccccuccugcugca

SEQ ID NO: 3403795 - RNA, 24 nt, Human
gcacccccugcagcuuguagccag

SEQ ID NO: 3403796 - RNA, 23 nt, Human
gcaccccgauguggaccucuacu

SEQ ID NO: 3403797 - RNA, 15 nt, Human
gcaccccucugcccu

SEQ ID NO: 3403798 - RNA, 13 nt, Human
gcaccccugucuc

SEQ ID NO: 3403799 - RNA, 21 nt, Human
gcaccccuucucuccucccca

SEQ ID NO: 3403800 - RNA, 15 nt, Human
gcacccgccucuccc

SEQ ID NO: 3403801 - RNA, 14 nt, Human
gcacccggccccug

SEQ ID NO: 3403802 - RNA, 19 nt, Human
gcacccggccccugcuggu

SEQ ID NO: 3403803 - RNA, 17 nt, Human
gcacccgggcucaggga

SEQ ID NO: 3403804 - RNA, 21 nt, Human
gcacccgggcucagggaccac

SEQ ID NO: 3403805 - RNA, 18 nt, Human
gcacccucaggcaggugg

SEQ ID NO: 3403806 - RNA, 17 nt, Human
gcacccucauacacaga

SEQ ID NO: 3403807 - RNA, 15 nt, Human
gcacccuccacccug

SEQ ID NO: 3403808 - RNA, 18 nt, Human
gcacccuccacccugucc

SEQ ID NO: 3403809 - RNA, 17 nt, Human
gcacccuccccucccgu

SEQ ID NO: 3403810 - RNA, 13 nt, Human
gcacccucccucc

SEQ ID NO: 3403811 - RNA, 16 nt, Human
gcacccuccgccuuca

SEQ ID NO: 3403812 - RNA, 19 nt, Human
gcacccucgaugaagccca

SEQ ID NO: 3403813 - RNA, 21 nt, Human
gcacccuggggccuggaccug

SEQ ID NO: 3403814 - RNA, 17 nt, Human
gcacccuguggcccugg

SEQ ID NO: 3403815 - RNA, 18 nt, Human
gcacccuguggcccuggc

SEQ ID NO: 3403816 - RNA, 16 nt, Human
gcacccuucuuuccuc

SEQ ID NO: 3403817 - RNA, 19 nt, Human
gcacccuucuuuccucuuc

SEQ ID NO: 3403818 - RNA, 19 nt, Human
gcaccgacuagacacacaa

SEQ ID NO: 3403819 - RNA, 13 nt, Human
gcaccgccuucuc

SEQ ID NO: 3403820 - RNA, 20 nt, Human
gcaccgcuuuuguucucgca

SEQ ID NO: 3403821 - RNA, 15 nt, Human
gcaccggaccagccu

SEQ ID NO: 3403822 - RNA, 16 nt, Human
gcaccggaccagccug

SEQ ID NO: 3403823 - RNA, 17 nt, Human
gcaccggaccagccugg

SEQ ID NO: 3403824 - RNA, 21 nt, Human
gcaccggaccagccuggccca

SEQ ID NO: 3403825 - RNA, 21 nt, Human
gcaccggcuggccuggccccu

SEQ ID NO: 3403826 - RNA, 18 nt, Human
gcaccgggccacagagaa

SEQ ID NO: 3403827 - RNA, 23 nt, Human
gcaccgggccacagagaaaguac

SEQ ID NO: 3403828 - RNA, 14 nt, Human
gcaccggggccugg

SEQ ID NO: 3403829 - RNA, 14 nt, Human
gcaccguacugugg

SEQ ID NO: 3403830 - RNA, 14 nt, Human
gcaccguucugugc

SEQ ID NO: 3403831 - RNA, 14 nt, Human
gcaccuaaaacuua

SEQ ID NO: 3403832 - RNA, 21 nt, Human
gcaccuaaaccaccagugccc

SEQ ID NO: 3403833 - RNA, 23 nt, Human
gcaccuaaaccaccagugcccaa

SEQ ID NO: 3403834 - RNA, 16 nt, Human
gcaccuaaagcagcca

SEQ ID NO: 3403835 - RNA, 16 nt, Human
gcaccuaauccaggca

SEQ ID NO: 3403836 - RNA, 17 nt, Human
gcaccuaauccaggcag

SEQ ID NO: 3403837 - RNA, 22 nt, Human
gcaccuaccaccacgcccggcu

SEQ ID NO: 3403838 - RNA, 19 nt, Human
gcaccuaccaucagggaca

SEQ ID NO: 3403839 - RNA, 18 nt, Human
gcaccuauagucccagcu

SEQ ID NO: 3403840 - RNA, 13 nt, Human
gcaccucagccug

SEQ ID NO: 3403841 - RNA, 13 nt, Human
gcagacagacaau

SEQ ID NO: 3403842 - RNA, 12 nt, Human
gcagacagagcc

SEQ ID NO: 3403843 - RNA, 22 nt, Human
gcagacagagccaggagaagcu

SEQ ID NO: 3403844 - RNA, 17 nt, Human
gcagacagcagcucagg

SEQ ID NO: 3403845 - RNA, 21 nt, Human
gcagacagcagcucaggcaca

SEQ ID NO: 3403846 - RNA, 15 nt, Human
gcagacagcaggcag

SEQ ID NO: 3403847 - RNA, 18 nt, Human
gcagacagcaggcagcgc

SEQ ID NO: 3403848 - RNA, 12 nt, Human
gcagacaggacc

SEQ ID NO: 3403849 - RNA, 14 nt, Human
gcagacaggaggaa

SEQ ID NO: 3403850 - RNA, 12 nt, Human
gcagacaggcaa

SEQ ID NO: 3403851 - RNA, 14 nt, Human
gcagacaggcaagc

SEQ ID NO: 3403852 - RNA, 20 nt, Human
gcagacaggccccgugaggc

SEQ ID NO: 3403853 - RNA, 17 nt, Human
gcagacaguuaagagaa

SEQ ID NO: 3403854 - RNA, 20 nt, Human
gcagacaugguggggucucc

SEQ ID NO: 3403855 - RNA, 17 nt, Human
gcagaccaccccgccug

SEQ ID NO: 3403856 - RNA, 21 nt, Human
gcagaccaccccgccugcccu

SEQ ID NO: 3403857 - RNA, 23 nt, Human
gcagaccacgcccguccugccug

SEQ ID NO: 3403858 - RNA, 22 nt, Human
gcagaccauuggggcucccagc

SEQ ID NO: 3403859 - RNA, 14 nt, Human
gcagacccugcccu

SEQ ID NO: 3403860 - RNA, 16 nt, Human
gcagaccuguccuccu

SEQ ID NO: 3403861 - RNA, 17 nt, Human
gcagaccuuuuuuagga

SEQ ID NO: 3403862 - RNA, 15 nt, Human
gcagacuacacagga

SEQ ID NO: 3403863 - RNA, 13 nt, Human
gcagacuggaggg

SEQ ID NO: 3403864 - RNA, 20 nt, Human
gcagacuggggcauccugug

SEQ ID NO: 3403865 - RNA, 13 nt, Human
gcagacugguggg

SEQ ID NO: 3403866 - RNA, 16 nt, Human
gcagacuucccagcua

SEQ ID NO: 3403867 - RNA, 18 nt, Human
gcagacuucccagcuagg

SEQ ID NO: 3403868 - RNA, 19 nt, Human
gcagacuuuuaaagacuug

SEQ ID NO: 3403869 - RNA, 21 nt, Human
gcagagaaacuuaagcaaagg

SEQ ID NO: 3403870 - RNA, 15 nt, Human
gcagagaaagaagag

SEQ ID NO: 3403871 - RNA, 18 nt, Human
gcagagaaagaagagaca

SEQ ID NO: 3403872 - RNA, 22 nt, Human
gcagagaaagaagagacaggag

SEQ ID NO: 3403873 - RNA, 20 nt, Human
gcagagaaagggacaaugau

SEQ ID NO: 3403874 - RNA, 17 nt, Human
gcagagaagcucucggg

SEQ ID NO: 3403875 - RNA, 21 nt, Human
gcagagaagugacgguuccua

SEQ ID NO: 3403876 - RNA, 12 nt, Human
gcagagaauaua

SEQ ID NO: 3403877 - RNA, 20 nt, Human
gcagagaaucauacuuagca

SEQ ID NO: 3403878 - RNA, 20 nt, Human
gcagagaaugaaagggccca

SEQ ID NO: 3403879 - RNA, 21 nt, Human
gcagagaaugaaagggcccag

SEQ ID NO: 3403880 - RNA, 23 nt, Human
gcagagaaugaaagggcccagag

SEQ ID NO: 3403881 - RNA, 14 nt, Human
gcagagaccauccc

SEQ ID NO: 3403882 - RNA, 19 nt, Human
gcagagaccaucccugaag

SEQ ID NO: 3403883 - RNA, 12 nt, Human
gcagagacuugg

SEQ ID NO: 3403884 - RNA, 12 nt, Human
gcagagagaagc

SEQ ID NO: 3403885 - RNA, 14 nt, Human
gcagagagaagccu

SEQ ID NO: 3403886 - RNA, 19 nt, Human
gcagagagccauuuuguga

SEQ ID NO: 3403887 - RNA, 21 nt, Human
gcagagagccauuuugugaau

SEQ ID NO: 3403888 - RNA, 19 nt, Human
gcagagagcggucucaggc

SEQ ID NO: 3403889 - RNA, 14 nt, Human
gcagagaggcugug

SEQ ID NO: 3403890 - RNA, 16 nt, Human
gcagagaugccucccu

SEQ ID NO: 3403891 - RNA, 18 nt, Human
gcagagcaagucugcagg

SEQ ID NO: 3403892 - RNA, 12 nt, Human
gcagagcagaga

SEQ ID NO: 3403893 - RNA, 14 nt, Human
gcagagcagagacc

SEQ ID NO: 3403894 - RNA, 20 nt, Human
gcagagcagagaccaucccu

SEQ ID NO: 3403895 - RNA, 20 nt, Human
gcagagcaggggcaggguga

SEQ ID NO: 3403896 - RNA, 17 nt, Human
gcagagcccccaggaag

SEQ ID NO: 3403897 - RNA, 15 nt, Human
gcagagcccugcucc

SEQ ID NO: 3403898 - RNA, 16 nt, Human
gcagagcccugcuccc

SEQ ID NO: 3403899 - RNA, 14 nt, Human
gcagagccuucuca

SEQ ID NO: 3403900 - RNA, 16 nt, Human
gcagagccuucucaga

SEQ ID NO: 3403901 - RNA, 23 nt, Human
gcagagcgccgugaguucucagg

SEQ ID NO: 3403902 - RNA, 23 nt, Human
gcagagcugauggagaaggaagg

SEQ ID NO: 3403903 - RNA, 22 nt, Human
gcagagcuucuuccaggugccc

SEQ ID NO: 3403904 - RNA, 14 nt, Human
gcagaggaaagcaa

SEQ ID NO: 3403905 - RNA, 21 nt, Human
gcagaggagaacuugcugccu

SEQ ID NO: 3403906 - RNA, 12 nt, Human
gcagaggccaga

SEQ ID NO: 3403907 - RNA, 15 nt, Human
gcagaggccagaggc

SEQ ID NO: 3403908 - RNA, 14 nt, Human
gcagaggcccacau

SEQ ID NO: 3403909 - RNA, 14 nt, Human
gcagaggcuggccu

SEQ ID NO: 3403910 - RNA, 19 nt, Human
gcagaggcuggccucagac

SEQ ID NO: 3403911 - RNA, 19 nt, Human
gcagaggcuguggcuggug

SEQ ID NO: 3403912 - RNA, 19 nt, Human
gcagagggcagaggcugga

SEQ ID NO: 3403913 - RNA, 13 nt, Human
gcagagggcugga

SEQ ID NO: 3403914 - RNA, 18 nt, Human
gcagagggcuggaggccc

SEQ ID NO: 3403915 - RNA, 20 nt, Human
gcagagggcuggaggcccag

SEQ ID NO: 3403916 - RNA, 15 nt, Human
gcagaggggcagagg

SEQ ID NO: 3403917 - RNA, 19 nt, Human
gcagaggggcagauggaaa

SEQ ID NO: 3403918 - RNA, 13 nt, Human
gcagaggggcagg

SEQ ID NO: 3403919 - RNA, 20 nt, Human
gcagaggggcuuucuggaga

SEQ ID NO: 3403920 - RNA, 13 nt, Human
gcagagguaaaag

SEQ ID NO: 3403921 - RNA, 20 nt, Human
gcagagguaaaagugugagc

SEQ ID NO: 3403922 - RNA, 18 nt, Human
gcagagguacccugggug

SEQ ID NO: 3403923 - RNA, 19 nt, Human
gcagagguacccugggugu

SEQ ID NO: 3403924 - RNA, 14 nt, Human
gcagaggucagacu

SEQ ID NO: 3403925 - RNA, 15 nt, Human
gcagaggucugugcu

SEQ ID NO: 3403926 - RNA, 15 nt, Human
gcagagguggccaga

SEQ ID NO: 3403927 - RNA, 23 nt, Human
gcagagguggccagagcugggag

SEQ ID NO: 3403928 - RNA, 23 nt, Human
gcagagguugcagugagccgaga

SEQ ID NO: 3403929 - RNA, 21 nt, Human
gcagagguugcagugagcuga

SEQ ID NO: 3403930 - RNA, 13 nt, Human
gcagagucacacg

SEQ ID NO: 3403931 - RNA, 16 nt, Human
gcagagugcacagcug

SEQ ID NO: 3403932 - RNA, 23 nt, Human
gcagagugcccagaacuggacuc

SEQ ID NO: 3403933 - RNA, 14 nt, Human
gcagagugccccac

SEQ ID NO: 3403934 - RNA, 21 nt, Human
gcagagugccccaccugccac

SEQ ID NO: 3403935 - RNA, 13 nt, Human
gcagaguuaaauc

SEQ ID NO: 3403936 - RNA, 20 nt, Human
gcagaguuacaguucugugg

SEQ ID NO: 3403937 - RNA, 16 nt, Human
gcagaguugaagacag

SEQ ID NO: 3403938 - RNA, 17 nt, Human
gcagaguugaagacaga

SEQ ID NO: 3403939 - RNA, 13 nt, Human
gcagaguuguaaa

SEQ ID NO: 3403940 - RNA, 20 nt, Human
gcagaguuguaaauauauaa

SEQ ID NO: 3403941 - RNA, 12 nt, Human
gcagaguuuuca

SEQ ID NO: 3403942 - RNA, 14 nt, Human
gcagaguuuucauu

SEQ ID NO: 3403943 - RNA, 19 nt, Human
gcagaguuuucauuaaauc

SEQ ID NO: 3403944 - RNA, 18 nt, Human
gcagauaaucagccucuu

SEQ ID NO: 3403945 - RNA, 19 nt, Human
gcagauaaucagccucuua

SEQ ID NO: 3403946 - RNA, 17 nt, Human
gcagauacuacugacca

SEQ ID NO: 3403947 - RNA, 24 nt, Human
gcagauacuacugaccagacaagc

SEQ ID NO: 3403948 - RNA, 15 nt, Human
gcagauacugucucu

SEQ ID NO: 3403949 - RNA, 12 nt, Human
gcagauauuuug

SEQ ID NO: 3403950 - RNA, 16 nt, Human
gcagaucaccugaggu

SEQ ID NO: 3403951 - RNA, 20 nt, Human
gcagaucugugccccaugcc

SEQ ID NO: 3403952 - RNA, 22 nt, Human
gcagaucugugccccaugccug

SEQ ID NO: 3403953 - RNA, 13 nt, Human
gcagaugauccau

SEQ ID NO: 3403954 - RNA, 14 nt, Human
gcagaugauccaug

SEQ ID NO: 3403955 - RNA, 19 nt, Human
gcagaugcaaugacucagg

SEQ ID NO: 3403956 - RNA, 18 nt, Human
gcagaugcagagagccau

SEQ ID NO: 3403957 - RNA, 16 nt, Human
gcagaugccacccuag

SEQ ID NO: 3403958 - RNA, 18 nt, Human
gcagaugccacccuagcc

SEQ ID NO: 3403959 - RNA, 20 nt, Human
gcagaugcuagcacaugccc

SEQ ID NO: 3403960 - RNA, 17 nt, Human
gcagauggaaaggagcc

SEQ ID NO: 3403961 - RNA, 22 nt, Human
gcagauguaaaguuauucuuga

SEQ ID NO: 3403962 - RNA, 13 nt, Human
gcagauguaggag

SEQ ID NO: 3403963 - RNA, 14 nt, Human
gcagauguaggagg

SEQ ID NO: 3403964 - RNA, 17 nt, Human
gcagauguaggagggac

SEQ ID NO: 3403965 - RNA, 19 nt, Human
gcagauguaggagggacug

SEQ ID NO: 3403966 - RNA, 18 nt, Human
gcagauguccuugaugcu

SEQ ID NO: 3403967 - RNA, 20 nt, Human
gcagauguuagauauuuuuc

SEQ ID NO: 3403968 - RNA, 13 nt, Human
gcagauuagcagg

SEQ ID NO: 3403969 - RNA, 16 nt, Human
gcagauuagcaggcca

SEQ ID NO: 3403970 - RNA, 18 nt, Human
gcagauuauucacugauu

SEQ ID NO: 3403971 - RNA, 21 nt, Human
gcagauucucccuugcucugc

SEQ ID NO: 3403972 - RNA, 17 nt, Human
gcagauugaaaaggaca

SEQ ID NO: 3403973 - RNA, 20 nt, Human
gcagauuggaaggagacaca

SEQ ID NO: 3403974 - RNA, 23 nt, Human
gcagauuuagugaaagcuagaga

SEQ ID NO: 3403975 - RNA, 16 nt, Human
gcagauuugggcugga

SEQ ID NO: 3403976 - RNA, 21 nt, Human
gcagauuuucagcaaacucuu

SEQ ID NO: 3403977 - RNA, 16 nt, Human
gcagauuuuggccaug

SEQ ID NO: 3403978 - RNA, 22 nt, Human
gcagcaaacacuccacccucca

SEQ ID NO: 3403979 - RNA, 14 nt, Human
gcagcaaauuuuca

SEQ ID NO: 3403980 - RNA, 11 nt, Human
gcagcaacaau

SEQ ID NO: 3403981 - RNA, 16 nt, Human
gcagcaaccagagcac

SEQ ID NO: 3403982 - RNA, 19 nt, Human
gcagcaacuuguccuagca

SEQ ID NO: 3403983 - RNA, 16 nt, Human
gcagcaaggcccgagc

SEQ ID NO: 3403984 - RNA, 16 nt, Human
gcagcaaggcccugcu

SEQ ID NO: 3403985 - RNA, 17 nt, Human
gcagcaaggucuugcuc

SEQ ID NO: 3403986 - RNA, 16 nt, Human
gccaggcgggcucaag

SEQ ID NO: 3403987 - RNA, 18 nt, Human
gccaggcucaggccaugg

SEQ ID NO: 3403988 - RNA, 18 nt, Human
gccaggcuccuuccuguc

SEQ ID NO: 3403989 - RNA, 15 nt, Human
gccaggcugaccaca

SEQ ID NO: 3403990 - RNA, 19 nt, Human
gccaggcugaccacagcac

SEQ ID NO: 3403991 - RNA, 16 nt, Human
gccaggcuggagugca

SEQ ID NO: 3403992 - RNA, 16 nt, Human
gccaggcugggucgcc

SEQ ID NO: 3403993 - RNA, 17 nt, Human
gccaggcuggucuaaaa

SEQ ID NO: 3403994 - RNA, 15 nt, Human
gccaggcuggucuca

SEQ ID NO: 3403995 - RNA, 16 nt, Human
gccagggacagagggg

SEQ ID NO: 3403996 - RNA, 14 nt, Human
gccagggagaagcu

SEQ ID NO: 3403997 - RNA, 19 nt, Human
gccagggagaccuggacac

SEQ ID NO: 3403998 - RNA, 15 nt, Human
gccagggagagccca

SEQ ID NO: 3403999 - RNA, 16 nt, Human
gccagggagagcccag

SEQ ID NO: 3404000 - RNA, 17 nt, Human
gccagggagagcccagg

SEQ ID NO: 3404001 - RNA, 21 nt, Human
gccagggagagcccaggagcu

SEQ ID NO: 3404002 - RNA, 20 nt, Human
gccagggauggggccacagc

SEQ ID NO: 3404003 - RNA, 15 nt, Human
gccagggcagugcua

SEQ ID NO: 3404004 - RNA, 18 nt, Human
gccagggcagugcuagug

SEQ ID NO: 3404005 - RNA, 19 nt, Human
gccagggccacgcuccagc

SEQ ID NO: 3404006 - RNA, 13 nt, Human
gccagggccaggg

SEQ ID NO: 3404007 - RNA, 13 nt, Human
gccagggccccuc

SEQ ID NO: 3404008 - RNA, 15 nt, Human
gccagggccccucuc

SEQ ID NO: 3404009 - RNA, 16 nt, Human
gccagggcccugcaga

SEQ ID NO: 3404010 - RNA, 15 nt, Human
gccagggccuggaag

SEQ ID NO: 3404011 - RNA, 22 nt, Human
gccagggcuauagcucaggacc

SEQ ID NO: 3404012 - RNA, 18 nt, Human
gccagggcugcccugaga

SEQ ID NO: 3404013 - RNA, 17 nt, Human
gccaggggaaaaucagc

SEQ ID NO: 3404014 - RNA, 19 nt, Human
gccagggggacuagccccu

SEQ ID NO: 3404015 - RNA, 20 nt, Human
gccaggggggugaggagcug

SEQ ID NO: 3404016 - RNA, 18 nt, Human
gccaggggucucccugga

SEQ ID NO: 3404017 - RNA, 19 nt, Human
gccagggucuccagaaagc

SEQ ID NO: 3404018 - RNA, 16 nt, Human
gccagggucucucccu

SEQ ID NO: 3404019 - RNA, 23 nt, Human
gccagggugagagcugcucugga

SEQ ID NO: 3404020 - RNA, 23 nt, Human
gccaggguguggcccugccaucu

SEQ ID NO: 3404021 - RNA, 15 nt, Human
gccagguaaugugaa

SEQ ID NO: 3404022 - RNA, 16 nt, Human
gccagguauggcucug

SEQ ID NO: 3404023 - RNA, 22 nt, Human
gccaggucacccuuugcuguga

SEQ ID NO: 3404024 - RNA, 16 nt, Human
gccagguccuugcccu

SEQ ID NO: 3404025 - RNA, 21 nt, Human
gccaggugacugucuggggag

SEQ ID NO: 3404026 - RNA, 13 nt, Human
gccaggugcagug

SEQ ID NO: 3404027 - RNA, 16 nt, Human
gccaggugccuccuga

SEQ ID NO: 3404028 - RNA, 12 nt, Human
gccaggugccuu

SEQ ID NO: 3404029 - RNA, 19 nt, Human
gccagguucuauuuggaau

SEQ ID NO: 3404030 - RNA, 20 nt, Human
gccagguucuauuuggaauu

SEQ ID NO: 3404031 - RNA, 12 nt, Human
gccaguaaaugg

SEQ ID NO: 3404032 - RNA, 23 nt, Human
gccaguaaaugggggugcauuug

SEQ ID NO: 3404033 - RNA, 15 nt, Human
gccaguaacaggcuc

SEQ ID NO: 3404034 - RNA, 21 nt, Human
gccaguaacgcgucuuccuga

SEQ ID NO: 3404035 - RNA, 16 nt, Human
gccaguaauugguccg

SEQ ID NO: 3404036 - RNA, 23 nt, Human
gccaguaucuauauauguguaug

SEQ ID NO: 3404037 - RNA, 12 nt, Human
gccaguauuuua

SEQ ID NO: 3404038 - RNA, 15 nt, Human
gccaguauuuuaaaa

SEQ ID NO: 3404039 - RNA, 17 nt, Human
gccaguauuuuuaaagg

SEQ ID NO: 3404040 - RNA, 17 nt, Human
gccagucaagaagaaaa

SEQ ID NO: 3404041 - RNA, 18 nt, Human
gccagucaagaagaaaaa

SEQ ID NO: 3404042 - RNA, 17 nt, Human
gccagucaccccggcca

SEQ ID NO: 3404043 - RNA, 22 nt, Human
gccagucccugaggcagguccc

SEQ ID NO: 3404044 - RNA, 14 nt, Human
gccaguccugccug

SEQ ID NO: 3404045 - RNA, 18 nt, Human
gccaguccugccuggcca

SEQ ID NO: 3404046 - RNA, 19 nt, Human
gccaguccugccuggccag

SEQ ID NO: 3404047 - RNA, 20 nt, Human
gccaguccugccuggccagg

SEQ ID NO: 3404048 - RNA, 15 nt, Human
gccaguccugcuacc

SEQ ID NO: 3404049 - RNA, 14 nt, Human
gccaguccuguccu

SEQ ID NO: 3404050 - RNA, 19 nt, Human
gccagucgcgcugccugug

SEQ ID NO: 3404051 - RNA, 13 nt, Human
gccagucugggcu

SEQ ID NO: 3404052 - RNA, 14 nt, Human
gccagucugggcug

SEQ ID NO: 3404053 - RNA, 20 nt, Human
gccagucuugacgaguguga

SEQ ID NO: 3404054 - RNA, 13 nt, Human
gccagugacagac

SEQ ID NO: 3404055 - RNA, 17 nt, Human
gccagugaccugaggaa

SEQ ID NO: 3404056 - RNA, 13 nt, Human
gccagugacucca

SEQ ID NO: 3404057 - RNA, 21 nt, Human
gccagugacuccaggagagga

SEQ ID NO: 3404058 - RNA, 15 nt, Human
gccagugagccacuc

SEQ ID NO: 3404059 - RNA, 13 nt, Human
gccagugccuggg

SEQ ID NO: 3404060 - RNA, 19 nt, Human
gccagugccuuaccuccug

SEQ ID NO: 3404061 - RNA, 21 nt, Human
gccagugccuuaccuccugcc

SEQ ID NO: 3404062 - RNA, 14 nt, Human
gccaguggcuggau

SEQ ID NO: 3404063 - RNA, 14 nt, Human
gccaguggggccug

SEQ ID NO: 3404064 - RNA, 16 nt, Human
gccaguggggccugug

SEQ ID NO: 3404065 - RNA, 17 nt, Human
gccaguggggccugugg

SEQ ID NO: 3404066 - RNA, 20 nt, Human
gccaguguaaucccccagga

SEQ ID NO: 3404067 - RNA, 18 nt, Human
gccagugugcugaugggc

SEQ ID NO: 3404068 - RNA, 16 nt, Human
gccaguguugccuaag

SEQ ID NO: 3404069 - RNA, 22 nt, Human
gccaguuauggcuauaggugcu

SEQ ID NO: 3404070 - RNA, 15 nt, Human
gccaguucaguaccu

SEQ ID NO: 3404071 - RNA, 18 nt, Human
gccaguugaauuuaugga

SEQ ID NO: 3404072 - RNA, 14 nt, Human
gccaguuggaacca

SEQ ID NO: 3404073 - RNA, 22 nt, Human
gccaguuggucccccuuccaug

SEQ ID NO: 3404074 - RNA, 16 nt, Human
gccaguuguccuccuu

SEQ ID NO: 3404075 - RNA, 21 nt, Human
gccauaaaacauuaagaaaau

SEQ ID NO: 3404076 - RNA, 21 nt, Human
gccauaagcaacaauuuucag

SEQ ID NO: 3404077 - RNA, 21 nt, Human
gccauaauacaaaaggcucca

SEQ ID NO: 3404078 - RNA, 19 nt, Human
gccauacuggccucgccug

SEQ ID NO: 3404079 - RNA, 22 nt, Human
gccauacuggccucgccuggcc

SEQ ID NO: 3404080 - RNA, 18 nt, Human
gccauacuuaucucucug

SEQ ID NO: 3404081 - RNA, 21 nt, Human
gccauacuuaucucucugugc

SEQ ID NO: 3404082 - RNA, 18 nt, Human
gccauagaguacacugcc

SEQ ID NO: 3404083 - RNA, 18 nt, Human
gccauauaaguuugaagg

SEQ ID NO: 3404084 - RNA, 20 nt, Human
gccauauuuaccucagccug

SEQ ID NO: 3404085 - RNA, 22 nt, Human
gccauauuuaccucagccuggg

SEQ ID NO: 3404086 - RNA, 18 nt, Human
gccauauuuguaaaauga

SEQ ID NO: 3404087 - RNA, 14 nt, Human
gccaucaaaaugcu

SEQ ID NO: 3404088 - RNA, 16 nt, Human
gccaucaaaaugcuuu

SEQ ID NO: 3404089 - RNA, 19 nt, Human
gccaucaaaaugcuuuuua

SEQ ID NO: 3404090 - RNA, 15 nt, Human
gccaucaacuaaagu

SEQ ID NO: 3404091 - RNA, 22 nt, Human
gccaucacaugaucuguuuuuc

SEQ ID NO: 3404092 - RNA, 19 nt, Human
gccaucaccucagauggca

SEQ ID NO: 3404093 - RNA, 22 nt, Human
gccaucaccuuagaccaccaag

SEQ ID NO: 3404094 - RNA, 21 nt, Human
gccauccaaauaagaaaccua

SEQ ID NO: 3404095 - RNA, 14 nt, Human
gccauccagguuca

SEQ ID NO: 3404096 - RNA, 14 nt, Human
gccaucccagcccc

SEQ ID NO: 3404097 - RNA, 17 nt, Human
gccaucccgucuucucc

SEQ ID NO: 3404098 - RNA, 18 nt, Human
gccaucccucccuccacc

SEQ ID NO: 3404099 - RNA, 23 nt, Human
gccaucccucccuccaccucccu

SEQ ID NO: 3404100 - RNA, 19 nt, Human
gccauccucaaacacugca

SEQ ID NO: 3404101 - RNA, 19 nt, Human
gccauccuggcccagggca

SEQ ID NO: 3404102 - RNA, 12 nt, Human
gccauccugucc

SEQ ID NO: 3404103 - RNA, 18 nt, Human
gccaucgccgggacucca

SEQ ID NO: 3404104 - RNA, 17 nt, Human
gccaucgguccugucuc

SEQ ID NO: 3404105 - RNA, 18 nt, Human
gccaucgguccugucucc

SEQ ID NO: 3404106 - RNA, 20 nt, Human
gccaucucaccuccugcugg

SEQ ID NO: 3404107 - RNA, 12 nt, Human
gccaucucugga

SEQ ID NO: 3404108 - RNA, 16 nt, Human
gccaucucuggaugcc

SEQ ID NO: 3404109 - RNA, 13 nt, Human
gccaucuggagag

SEQ ID NO: 3404110 - RNA, 21 nt, Human
gccaucugggcuccuccaggg

SEQ ID NO: 3404111 - RNA, 20 nt, Human
gccaugaacuggaggccagg

SEQ ID NO: 3404112 - RNA, 16 nt, Human
gccaugaagggacccu

SEQ ID NO: 3404113 - RNA, 11 nt, Human
gccaugaauua

SEQ ID NO: 3404114 - RNA, 16 nt, Human
gccaugacccugccuc

SEQ ID NO: 3404115 - RNA, 22 nt, Human
gccaugacccugccucucccag

SEQ ID NO: 3404116 - RNA, 23 nt, Human
gccaugagaugauacauccaaag

SEQ ID NO: 3404117 - RNA, 19 nt, Human
gccaugagccgcccaaggc

SEQ ID NO: 3404118 - RNA, 17 nt, Human
gccaugagcuccagacc

SEQ ID NO: 3404119 - RNA, 22 nt, Human
gccaugagcuccagacccccag

SEQ ID NO: 3404120 - RNA, 23 nt, Human
gccaugagcuccagacccccagc

SEQ ID NO: 3404121 - RNA, 18 nt, Human
gccaugaggaacaaggca

SEQ ID NO: 3404122 - RNA, 15 nt, Human
gccaugaugccucug

SEQ ID NO: 3404123 - RNA, 18 nt, Human
gccaugaugccucugucu

SEQ ID NO: 3404124 - RNA, 19 nt, Human
gccaugaugccucugucuu

SEQ ID NO: 3404125 - RNA, 19 nt, Human
gccaugauggcaacagauc

SEQ ID NO: 3404126 - RNA, 15 nt, Human
gccaugauguggagu

SEQ ID NO: 3404127 - RNA, 14 nt, Human
gccaugcaagaacu

SEQ ID NO: 3404128 - RNA, 14 nt, Human
gccaugcaauucau

SEQ ID NO: 3404129 - RNA, 20 nt, Human
gccaugcgcccccuccgccc

SEQ ID NO: 3404130 - RNA, 21 nt, Human
gccaugcuccucuuccccaga

SEQ ID NO: 3404131 - RNA, 13 nt, Human
gccaugcugaggc

SEQ ID NO: 3404132 - RNA, 14 nt, Human
gccaugcugaggcc

SEQ ID NO: 3404133 - RNA, 21 nt, Human
gccaugcugaggccugggccg

SEQ ID NO: 3404134 - RNA, 16 nt, Human
gccaugcugggaagac

SEQ ID NO: 3404135 - RNA, 22 nt, Human
gccauggaagaggcuacagggc

SEQ ID NO: 3404136 - RNA, 18 nt, Human
gccauggacagaagaagg

SEQ ID NO: 3404137 - RNA, 18 nt, Human
gccauggacucuacacug

SEQ ID NO: 3404138 - RNA, 23 nt, Human
gccauggacucuacacugugaac

SEQ ID NO: 3404139 - RNA, 16 nt, Human
gccauggacucugucc

SEQ ID NO: 3404140 - RNA, 22 nt, Human
gccauggagaaagcugacuugg

SEQ ID NO: 3404141 - RNA, 16 nt, Human
gccauggagagcugga

SEQ ID NO: 3404142 - RNA, 20 nt, Human
gccauggagagcuggagccu

SEQ ID NO: 3404143 - RNA, 16 nt, Human
gccauggaggcacaca

SEQ ID NO: 3404144 - RNA, 13 nt, Human
gccauggaguugu

SEQ ID NO: 3404145 - RNA, 23 nt, Human
gccauggauggaaaacgcucucu

SEQ ID NO: 3404146 - RNA, 17 nt, Human
gccauggccugcaaacu

SEQ ID NO: 3404147 - RNA, 22 nt, Human
gccauggcgugucccucucgga

SEQ ID NO: 3404148 - RNA, 20 nt, Human
gccauggcugucucaaacca

SEQ ID NO: 3404149 - RNA, 19 nt, Human
gccauggcuuccaaggugg

SEQ ID NO: 3404150 - RNA, 14 nt, Human
gccaugggacaggg

SEQ ID NO: 3404151 - RNA, 12 nt, Human
gccaugggacca

SEQ ID NO: 3404152 - RNA, 13 nt, Human
gccaugggaccaa

SEQ ID NO: 3404153 - RNA, 17 nt, Human
gccaugggaccaaaccu

SEQ ID NO: 3404154 - RNA, 21 nt, Human
gccaugggaccaaaccuagcc

SEQ ID NO: 3404155 - RNA, 17 nt, Human
gccauggguagccuggg

SEQ ID NO: 3404156 - RNA, 19 nt, Human
gccauggguagccugggug

SEQ ID NO: 3404157 - RNA, 19 nt, Human
gccaugguacccccuucug

SEQ ID NO: 3404158 - RNA, 16 nt, Human
gccauguaccuccccu

SEQ ID NO: 3404159 - RNA, 21 nt, Human
gccauguaccuccccugccuu

SEQ ID NO: 3404160 - RNA, 15 nt, Human
gccauguacuaguuu

SEQ ID NO: 3404161 - RNA, 16 nt, Human
gccaugucagacacag

SEQ ID NO: 3404162 - RNA, 15 nt, Human
gccauguccaaagag

SEQ ID NO: 3404163 - RNA, 18 nt, Human
gccauguccaaagaggcu

SEQ ID NO: 3404164 - RNA, 19 nt, Human
gccauguccaaagaggcug

SEQ ID NO: 3404165 - RNA, 22 nt, Human
gccauguccaaagaggcugccc

SEQ ID NO: 3404166 - RNA, 12 nt, Human
gccaugucuaca

SEQ ID NO: 3404167 - RNA, 22 nt, Human
gccaugucugcagugugccccc

SEQ ID NO: 3404168 - RNA, 14 nt, Human
gccaugucuucucc

SEQ ID NO: 3404169 - RNA, 15 nt, Human
gccauguguuccaag

SEQ ID NO: 3404170 - RNA, 16 nt, Human
gccauguguuccaagg

SEQ ID NO: 3404171 - RNA, 17 nt, Human
gccauguuaacaugaca

SEQ ID NO: 3404172 - RNA, 18 nt, Human
gccauguuccaauaaaca

SEQ ID NO: 3404173 - RNA, 16 nt, Human
gccauguuggccaggc

SEQ ID NO: 3404174 - RNA, 22 nt, Human
gccauguuggccaggcuggucu

SEQ ID NO: 3404175 - RNA, 24 nt, Human
gccauguuggccaggcuggucuca

SEQ ID NO: 3404176 - RNA, 14 nt, Human
gccauguuuaagau

SEQ ID NO: 3404177 - RNA, 17 nt, Human
gccauguuuaagauuua

SEQ ID NO: 3404178 - RNA, 11 nt, Human
gccauguuuau

SEQ ID NO: 3404179 - RNA, 18 nt, Human
gccauguuuauuacagua

SEQ ID NO: 3404180 - RNA, 16 nt, Human
gccauuaccauggaga

SEQ ID NO: 3404181 - RNA, 18 nt, Human
gccauuaccauggagaca

SEQ ID NO: 3404182 - RNA, 18 nt, Human
gccauuacccagcuaaau

SEQ ID NO: 3404183 - RNA, 12 nt, Human
gccauuauuuuc

SEQ ID NO: 3404184 - RNA, 19 nt, Human
gccauuauuuucugucaga

SEQ ID NO: 3404185 - RNA, 18 nt, Human
gccauucacugcccccag

SEQ ID NO: 3404186 - RNA, 22 nt, Human
gccauucacuucauaauccagu

SEQ ID NO: 3404187 - RNA, 17 nt, Human
gccauuccccgucucug

SEQ ID NO: 3404188 - RNA, 18 nt, Human
gccauucucaagcccugc

SEQ ID NO: 3404189 - RNA, 14 nt, Human
gccauugcacucca

SEQ ID NO: 3404190 - RNA, 15 nt, Human
gccauugcacuccag

SEQ ID NO: 3404191 - RNA, 19 nt, Human
gccauugcacuccagccug

SEQ ID NO: 3404192 - RNA, 15 nt, Human
gccauugcuuaccuu

SEQ ID NO: 3404193 - RNA, 21 nt, Human
gccauugucuucggaaaccuu

SEQ ID NO: 3404194 - RNA, 14 nt, Human
gccauugucuuuau

SEQ ID NO: 3404195 - RNA, 15 nt, Human
gccauugucuuuaua

SEQ ID NO: 3404196 - RNA, 18 nt, Human
gccauugucuuuauauga

SEQ ID NO: 3404197 - RNA, 12 nt, Human
gccauugugaac

SEQ ID NO: 3404198 - RNA, 18 nt, Human
gccauuuaaaaaguugua

SEQ ID NO: 3404199 - RNA, 22 nt, Human
gccauuuaaagcuuauuaaaac

SEQ ID NO: 3404200 - RNA, 17 nt, Human
gccauuugcaauaacag

SEQ ID NO: 3404201 - RNA, 23 nt, Human
gccauuugcacccuccgccuuca

SEQ ID NO: 3404202 - RNA, 14 nt, Human
gccauuugucccaa

SEQ ID NO: 3404203 - RNA, 13 nt, Human
gccauuuugcauu

SEQ ID NO: 3404204 - RNA, 15 nt, Human
gcccaaaggacgcac

SEQ ID NO: 3404205 - RNA, 22 nt, Human
gcccaaauuaucaagcuaauaa

SEQ ID NO: 3404206 - RNA, 23 nt, Human
gcccaaauuaucaagcuaauaaa

SEQ ID NO: 3404207 - RNA, 14 nt, Human
gcccaaauuuuucu

SEQ ID NO: 3404208 - RNA, 23 nt, Human
gcccaacagacaccaucuuuugu

SEQ ID NO: 3404209 - RNA, 22 nt, Human
gcccaacaggggcuccaugcca

SEQ ID NO: 3404210 - RNA, 13 nt, Human
gcccaaccacacu

SEQ ID NO: 3404211 - RNA, 15 nt, Human
gcccaacccugucug

SEQ ID NO: 3404212 - RNA, 16 nt, Human
gcccaacccuucccuc

SEQ ID NO: 3404213 - RNA, 23 nt, Human
gcccaaccggggagcccccgccc

SEQ ID NO: 3404214 - RNA, 14 nt, Human
gcccaaccucagca

SEQ ID NO: 3404215 - RNA, 13 nt, Human
gcccaaccuccug

SEQ ID NO: 3404216 - RNA, 15 nt, Human
gcccaaccucuuccu

SEQ ID NO: 3404217 - RNA, 24 nt, Human
gcccaaccugcucuccucuugcca

SEQ ID NO: 3404218 - RNA, 15 nt, Human
gcccaacuguguagc

SEQ ID NO: 3404219 - RNA, 21 nt, Human
gcccaagaauagaugcugacu

SEQ ID NO: 3404220 - RNA, 21 nt, Human
gcccaagacagaugccccaga

SEQ ID NO: 3404221 - RNA, 23 nt, Human
gcccaagacagaugccccagagc

SEQ ID NO: 3404222 - RNA, 17 nt, Human
gcccaagccagaggcug

SEQ ID NO: 3404223 - RNA, 20 nt, Human
gcccaagcccgacuugcugu

SEQ ID NO: 3404224 - RNA, 14 nt, Human
gcccaagcuucccu

SEQ ID NO: 3404225 - RNA, 20 nt, Human
gcccaagcuucccuccaucc

SEQ ID NO: 3404226 - RNA, 16 nt, Human
gcccaaggcggccccu

SEQ ID NO: 3404227 - RNA, 15 nt, Human
gcccaagggaucugg

SEQ ID NO: 3404228 - RNA, 16 nt, Human
gcccaaguccaaaugu

SEQ ID NO: 3404229 - RNA, 19 nt, Human
gcccaaguccaaauguuua

SEQ ID NO: 3404230 - RNA, 20 nt, Human
gcccaaguucaugcagcugu

SEQ ID NO: 3404231 - RNA, 22 nt, Human
gcccacaaucccuuucuaagga

SEQ ID NO: 3404232 - RNA, 11 nt, Human
gcccacacaca

SEQ ID NO: 3404233 - RNA, 13 nt, Human
gcccacacacagg

SEQ ID NO: 3404234 - RNA, 13 nt, Human
gcccacacacccc

SEQ ID NO: 3404235 - RNA, 13 nt, Human
gcccacacccccu

SEQ ID NO: 3404236 - RNA, 13 nt, Human
gcccacacuugag

SEQ ID NO: 3404237 - RNA, 14 nt, Human
gcccacagcaggcc

SEQ ID NO: 3404238 - RNA, 14 nt, Human
gcccacagcccgca

SEQ ID NO: 3404239 - RNA, 16 nt, Human
gcccacagcuguauga

SEQ ID NO: 3404240 - RNA, 16 nt, Human
gcccacaggaggcaag

SEQ ID NO: 3404241 - RNA, 18 nt, Human
gcccacagguguccccag

SEQ ID NO: 3404242 - RNA, 17 nt, Human
gcccacaguauauuuua

SEQ ID NO: 3404243 - RNA, 20 nt, Human
gcccacauagugaugguucc

SEQ ID NO: 3404244 - RNA, 23 nt, Human
gcccacauccggggccagcuccg

SEQ ID NO: 3404245 - RNA, 22 nt, Human
gcccacauguguccaucccagc

SEQ ID NO: 3404246 - RNA, 16 nt, Human
gcccacauuggaccca

SEQ ID NO: 3404247 - RNA, 17 nt, Human
gcccacauuuagucucu

SEQ ID NO: 3404248 - RNA, 21 nt, Human
gcccaccaacaucccauugcc

SEQ ID NO: 3404249 - RNA, 21 nt, Human
gcccaccaggccccccuguca

SEQ ID NO: 3404250 - RNA, 13 nt, Human
gcccaccccaccc

SEQ ID NO: 3404251 - RNA, 16 nt, Human
gcccaccccauggccg

SEQ ID NO: 3404252 - RNA, 14 nt, Human
gcccaccccccuca

SEQ ID NO: 3404253 - RNA, 20 nt, Human
gcccacccccggcagcagcc

SEQ ID NO: 3404254 - RNA, 16 nt, Human
gcccacccccugcccu

SEQ ID NO: 3404255 - RNA, 17 nt, Human
gcccacccccugcccug

SEQ ID NO: 3404256 - RNA, 19 nt, Human
gcccacccccugcccugca

SEQ ID NO: 3404257 - RNA, 18 nt, Human
gcccacccggugggaccc

SEQ ID NO: 3404258 - RNA, 20 nt, Human
gcccacccgguucaguguuu

SEQ ID NO: 3404259 - RNA, 15 nt, Human
gcccacccugcugcc

SEQ ID NO: 3404260 - RNA, 20 nt, Human
gcccacccugcugcuggugc

SEQ ID NO: 3404261 - RNA, 20 nt, Human
gcccacccugcuuggcccag

SEQ ID NO: 3404262 - RNA, 23 nt, Human
gcccacccugcuuggcccagggg

SEQ ID NO: 3404263 - RNA, 14 nt, Human
gcccaccgcaugcc

SEQ ID NO: 3404264 - RNA, 20 nt, Human
gcccaccgcaugcccccucg

SEQ ID NO: 3404265 - RNA, 11 nt, Human
gcccaccugcc

SEQ ID NO: 3404266 - RNA, 20 nt, Human
gcccaccugcccaucacagg

SEQ ID NO: 3404267 - RNA, 12 nt, Human
gcccaccugccu

SEQ ID NO: 3404268 - RNA, 13 nt, Human
gcccaccugccug

SEQ ID NO: 3404269 - RNA, 15 nt, Human
gcccaccugccuggc

SEQ ID NO: 3404270 - RNA, 16 nt, Human
gcccaccugccuggcc

SEQ ID NO: 3404271 - RNA, 16 nt, Human
gcccaccuggccaccu

SEQ ID NO: 3404272 - RNA, 17 nt, Human
gcccaccuggccaccug

SEQ ID NO: 3404273 - RNA, 18 nt, Human
gcccaccuggccaccuga

SEQ ID NO: 3404274 - RNA, 24 nt, Human
gcccaccuggccucugcacucccc

SEQ ID NO: 3404275 - RNA, 22 nt, Human
gccccacccugggcccugggcu

SEQ ID NO: 3404276 - RNA, 20 nt, Human
gccccaccugccacuaggcu

SEQ ID NO: 3404277 - RNA, 15 nt, Human
gccccaccuuuauua

SEQ ID NO: 3404278 - RNA, 23 nt, Human
gccccaccuuuauuaaaaucuua

SEQ ID NO: 3404279 - RNA, 13 nt, Human
gccccacuccucu

SEQ ID NO: 3404280 - RNA, 20 nt, Human
gccccacuccucugcugacc

SEQ ID NO: 3404281 - RNA, 12 nt, Human
gccccacucuca

SEQ ID NO: 3404282 - RNA, 14 nt, Human
gccccacugccagc

SEQ ID NO: 3404283 - RNA, 12 nt, Human
gccccacugccc

SEQ ID NO: 3404284 - RNA, 17 nt, Human
gccccacuuguccuuag

SEQ ID NO: 3404285 - RNA, 18 nt, Human
gccccacuuguccuuagc

SEQ ID NO: 3404286 - RNA, 18 nt, Human
gccccagaaggcagggaa

SEQ ID NO: 3404287 - RNA, 13 nt, Human
gccccagagcugu

SEQ ID NO: 3404288 - RNA, 22 nt, Human
gccccagagcuguuuauggccu

SEQ ID NO: 3404289 - RNA, 20 nt, Human
gccccagauaccagccccug

SEQ ID NO: 3404290 - RNA, 19 nt, Human
gccccagcaccaccagguc

SEQ ID NO: 3404291 - RNA, 11 nt, Human
gccccagccag

SEQ ID NO: 3404292 - RNA, 14 nt, Human
gccccagccagagu

SEQ ID NO: 3404293 - RNA, 18 nt, Human
gccccagcccacccuccu

SEQ ID NO: 3404294 - RNA, 17 nt, Human
gccccagcccccuuugg

SEQ ID NO: 3404295 - RNA, 14 nt, Human
gccccagcccugcu

SEQ ID NO: 3404296 - RNA, 13 nt, Human
gccccagccugcu

SEQ ID NO: 3404297 - RNA, 22 nt, Human
gccccagccugcuagcuagcuc

SEQ ID NO: 3404298 - RNA, 15 nt, Human
gccccagccuggccc

SEQ ID NO: 3404299 - RNA, 20 nt, Human
gccccagccuggcccagcuc

SEQ ID NO: 3404300 - RNA, 22 nt, Human
gccccagccuggcccagcuccc

SEQ ID NO: 3404301 - RNA, 14 nt, Human
gccccagcgcugac

SEQ ID NO: 3404302 - RNA, 14 nt, Human
gccccaggaagccg

SEQ ID NO: 3404303 - RNA, 23 nt, Human
gccccaggaccagcucaggacag

SEQ ID NO: 3404304 - RNA, 12 nt, Human
gccccaggcagg

SEQ ID NO: 3404305 - RNA, 19 nt, Human
gccccaggcucguggacug

SEQ ID NO: 3404306 - RNA, 17 nt, Human
gccccaggcugcggcuu

SEQ ID NO: 3404307 - RNA, 14 nt, Human
gccccagucagccu

SEQ ID NO: 3404308 - RNA, 20 nt, Human
gccccagucagccucucucc

SEQ ID NO: 3404309 - RNA, 14 nt, Human
gccccagugccaag

SEQ ID NO: 3404310 - RNA, 15 nt, Human
gccccagugcccaca

SEQ ID NO: 3404311 - RNA, 14 nt, Human
gccccaucagugcu

SEQ ID NO: 3404312 - RNA, 19 nt, Human
gccccaucggucaccuugu

SEQ ID NO: 3404313 - RNA, 19 nt, Human
gccccaucuccccucagcu

SEQ ID NO: 3404314 - RNA, 14 nt, Human
gccccaugaagcca

SEQ ID NO: 3404315 - RNA, 19 nt, Human
gccccaugaagccacagcc

SEQ ID NO: 3404316 - RNA, 15 nt, Human
gccccaugaccucca

SEQ ID NO: 3404317 - RNA, 14 nt, Human
gccccaugccuguc

SEQ ID NO: 3404318 - RNA, 17 nt, Human
gccccaugccuguccag

SEQ ID NO: 3404319 - RNA, 16 nt, Human
gccccaugcuggagcc

SEQ ID NO: 3404320 - RNA, 17 nt, Human
gccccaugcuggagccu

SEQ ID NO: 3404321 - RNA, 21 nt, Human
gccccaugcuggagccugugu

SEQ ID NO: 3404322 - RNA, 18 nt, Human
gccccaugucucucagaa

SEQ ID NO: 3404323 - RNA, 13 nt, Human
gccccauuaacug

SEQ ID NO: 3404324 - RNA, 15 nt, Human
gccccauuccuggga

SEQ ID NO: 3404325 - RNA, 22 nt, Human
gccccauucugccugcccaggc

SEQ ID NO: 3404326 - RNA, 20 nt, Human
gccccauucuuuuguaauuu

SEQ ID NO: 3404327 - RNA, 23 nt, Human
gccccauucuuuuguaauuuaaa

SEQ ID NO: 3404328 - RNA, 20 nt, Human
gcccccaaagauagacaggu

SEQ ID NO: 3404329 - RNA, 24 nt, Human
gcccccaaagauagacagguccug

SEQ ID NO: 3404330 - RNA, 23 nt, Human
gcccccaacagcacccucuccag

SEQ ID NO: 3404331 - RNA, 17 nt, Human
gcccccaaccucagggc

SEQ ID NO: 3404332 - RNA, 16 nt, Human
gcccccacaccuggcc

SEQ ID NO: 3404333 - RNA, 22 nt, Human
gcccccacauuugugccgacac

SEQ ID NO: 3404334 - RNA, 13 nt, Human
gcccccaccacac

SEQ ID NO: 3404335 - RNA, 22 nt, Human
gcccccaccacggccacuggcc

SEQ ID NO: 3404336 - RNA, 14 nt, Human
gcccccaccccauu

SEQ ID NO: 3404337 - RNA, 17 nt, Human
gcccccaccccggggac

SEQ ID NO: 3404338 - RNA, 18 nt, Human
gcccccaccgugggcagg

SEQ ID NO: 3404339 - RNA, 16 nt, Human
gcccccaccuccaccc

SEQ ID NO: 3404340 - RNA, 19 nt, Human
gcccccacugccuuugacc

SEQ ID NO: 3404341 - RNA, 16 nt, Human
gcccccacuugccucu

SEQ ID NO: 3404342 - RNA, 17 nt, Human
gcccccacuugccucuu

SEQ ID NO: 3404343 - RNA, 17 nt, Human
gcccccagagcccaggc

SEQ ID NO: 3404344 - RNA, 19 nt, Human
gcccccagagcccaggcuc

SEQ ID NO: 3404345 - RNA, 18 nt, Human
gcccccagagcgccccuc

SEQ ID NO: 3404346 - RNA, 15 nt, Human
gcccccagcccaaag

SEQ ID NO: 3404347 - RNA, 17 nt, Human
gcccccagcccagggcu

SEQ ID NO: 3404348 - RNA, 22 nt, Human
gcccccagcccagggcuccugc

SEQ ID NO: 3404349 - RNA, 15 nt, Human
gcccccagccccucc

SEQ ID NO: 3404350 - RNA, 19 nt, Human
gcccccagccccuccccca

SEQ ID NO: 3404351 - RNA, 14 nt, Human
gcccccagccuaug

SEQ ID NO: 3404352 - RNA, 23 nt, Human
gcccccagccuaugagcauccug

SEQ ID NO: 3404353 - RNA, 12 nt, Human
gcccccagccug

SEQ ID NO: 3404354 - RNA, 16 nt, Human
gcccccagccugucag

SEQ ID NO: 3404355 - RNA, 21 nt, Human
gcccccagcuaagaaccugga

SEQ ID NO: 3404356 - RNA, 12 nt, Human
gcccccagcuuc

SEQ ID NO: 3404357 - RNA, 13 nt, Human
gcccccaggacug

SEQ ID NO: 3404358 - RNA, 14 nt, Human
gcccccaggacugg

SEQ ID NO: 3404359 - RNA, 16 nt, Human
gcccccaggugccagu

SEQ ID NO: 3404360 - RNA, 20 nt, Human
gcccccaguccccaccccug

SEQ ID NO: 3404361 - RNA, 21 nt, Human
gcccccaguccccaccccugc

SEQ ID NO: 3404362 - RNA, 22 nt, Human
gcccccaguccccaccccugcc

SEQ ID NO: 3404363 - RNA, 18 nt, Human
gcccccaucucaugcccc

SEQ ID NO: 3404364 - RNA, 16 nt, Human
gccccccacacuuccc

SEQ ID NO: 3404365 - RNA, 20 nt, Human
gccccccacacuucccuggc

SEQ ID NO: 3404366 - RNA, 19 nt, Human
gccccccaccccuggaaga

SEQ ID NO: 3404367 - RNA, 21 nt, Human
gccccccaccccuggaagagc

SEQ ID NO: 3404368 - RNA, 13 nt, Human
gcccccccuucca

SEQ ID NO: 3404369 - RNA, 15 nt, Human
gccccccucccagag

SEQ ID NO: 3404370 - RNA, 16 nt, Human
gccccccucccagagg

SEQ ID NO: 3404371 - RNA, 14 nt, Human
gccccccugcccug

SEQ ID NO: 3404372 - RNA, 13 nt, Human
gccccccuggccu

SEQ ID NO: 3404373 - RNA, 19 nt, Human
gccccccuggccuccccca

SEQ ID NO: 3404374 - RNA, 20 nt, Human
gccccccugguccccuccuu

SEQ ID NO: 3404375 - RNA, 14 nt, Human
gcccccgagcuggg

SEQ ID NO: 3404376 - RNA, 16 nt, Human
gcccccgcauccccug

SEQ ID NO: 3404377 - RNA, 16 nt, Human
gcccccgcccccggcg

SEQ ID NO: 3404378 - RNA, 15 nt, Human
gcccccgcucauggg

SEQ ID NO: 3404379 - RNA, 16 nt, Human
gcccccgcucaugggc

SEQ ID NO: 3404380 - RNA, 23 nt, Human
gcccccuccccggcacccucugg

SEQ ID NO: 3404381 - RNA, 16 nt, Human
gcccccucccuggaug

SEQ ID NO: 3404382 - RNA, 22 nt, Human
gcccccuccgcccugccacuca

SEQ ID NO: 3404383 - RNA, 21 nt, Human
gcccccuccucuagcuguggg

SEQ ID NO: 3404384 - RNA, 21 nt, Human
gcccccuccucucccaucccc

SEQ ID NO: 3404385 - RNA, 12 nt, Human
gcccccuccuga

SEQ ID NO: 3404386 - RNA, 12 nt, Human
gcccccucgugc

SEQ ID NO: 3404387 - RNA, 16 nt, Human
gcccccucgugccagu

SEQ ID NO: 3404388 - RNA, 14 nt, Human
gcccccucugcccu

SEQ ID NO: 3404389 - RNA, 20 nt, Human
gcccccugaccacucagaga

SEQ ID NO: 3404390 - RNA, 24 nt, Human
gcccccugcaggaaggagcugccu

SEQ ID NO: 3404391 - RNA, 19 nt, Human
gcccccugcccguguacau

SEQ ID NO: 3404392 - RNA, 15 nt, Human
gcccccugcuggcuc

SEQ ID NO: 3404393 - RNA, 18 nt, Human
gcccccugcuucaguccc

SEQ ID NO: 3404394 - RNA, 17 nt, Human
gcccccuggccucugug

SEQ ID NO: 3404395 - RNA, 16 nt, Human
gcccccugucucucag

SEQ ID NO: 3404396 - RNA, 16 nt, Human
gcccccuucucccaca

SEQ ID NO: 3404397 - RNA, 18 nt, Human
gcccccuucucccacacu

SEQ ID NO: 3404398 - RNA, 17 nt, Human
gcccccuuucccgggcu

SEQ ID NO: 3404399 - RNA, 23 nt, Human
gcccccuuucccgggcuguccac

SEQ ID NO: 3404400 - RNA, 18 nt, Human
gcccccuuugggcccagg

SEQ ID NO: 3404401 - RNA, 17 nt, Human
gccccgaagggccccca

SEQ ID NO: 3404402 - RNA, 12 nt, Human
gccccgacucca

SEQ ID NO: 3404403 - RNA, 15 nt, Human
gccccgacuccagcc

SEQ ID NO: 3404404 - RNA, 18 nt, Human
gccccgaggccuucucug

SEQ ID NO: 3404405 - RNA, 13 nt, Human
gccccgccccaca

SEQ ID NO: 3404406 - RNA, 22 nt, Human
gccccgccccacauuccgacaa

SEQ ID NO: 3404407 - RNA, 15 nt, Human
gccccgcccucuucc

SEQ ID NO: 3404408 - RNA, 16 nt, Human
gccccgcccucuuccu

SEQ ID NO: 3404409 - RNA, 17 nt, Human
gccccgcgccuccuucc

SEQ ID NO: 3404410 - RNA, 22 nt, Human
gccccgcuuggcuucuucuuua

SEQ ID NO: 3404411 - RNA, 20 nt, Human
gccccgcuuguccagcgccu

SEQ ID NO: 3404412 - RNA, 16 nt, Human
gccccggaucagagca

SEQ ID NO: 3404413 - RNA, 21 nt, Human
gccccggaucagagcaggacc

SEQ ID NO: 3404414 - RNA, 23 nt, Human
gccccggaucagagcaggaccuc

SEQ ID NO: 3404415 - RNA, 17 nt, Human
gccccggccaccucugc

SEQ ID NO: 3404416 - RNA, 16 nt, Human
gccccggccccagcca

SEQ ID NO: 3404417 - RNA, 13 nt, Human
gccccggccccgg

SEQ ID NO: 3404418 - RNA, 14 nt, Human
gccccggcccuggg

SEQ ID NO: 3404419 - RNA, 18 nt, Human
gccccgguggcugggcag

SEQ ID NO: 3404420 - RNA, 16 nt, Human
gccccggugugcggug

SEQ ID NO: 3404421 - RNA, 22 nt, Human
gccccgucaccaucucaggcca

SEQ ID NO: 3404422 - RNA, 23 nt, Human
gccccgucaccaucucaggccac

SEQ ID NO: 3404423 - RNA, 13 nt, Human
gccccgucucagg

SEQ ID NO: 3404424 - RNA, 19 nt, Human
gccccgugcagacuggagg

SEQ ID NO: 3404425 - RNA, 20 nt, Human
gccccgugcagacuggaggg

SEQ ID NO: 3404426 - RNA, 13 nt, Human
gccccuacugcug

SEQ ID NO: 3404427 - RNA, 14 nt, Human
gccccuacugcugu

SEQ ID NO: 3404428 - RNA, 19 nt, Human
gccccuagaaacccaagcu

SEQ ID NO: 3404429 - RNA, 13 nt, Human
gccccuagcccag

SEQ ID NO: 3404430 - RNA, 20 nt, Human
gccccuagcccaggagagag

SEQ ID NO: 3404431 - RNA, 21 nt, Human
gccccuagcccaggagagaga

SEQ ID NO: 3404432 - RNA, 19 nt, Human
gccccuagccgguuccugu

SEQ ID NO: 3404433 - RNA, 14 nt, Human
gccccucaccuacu

SEQ ID NO: 3404434 - RNA, 14 nt, Human
gccccucaccuggg

SEQ ID NO: 3404435 - RNA, 14 nt, Human
gccccucagggucc

SEQ ID NO: 3404436 - RNA, 13 nt, Human
gccccuccagcuu

SEQ ID NO: 3404437 - RNA, 14 nt, Human
gccccuccagcuug

SEQ ID NO: 3404438 - RNA, 12 nt, Human
gccccuccccca

SEQ ID NO: 3404439 - RNA, 16 nt, Human
gccccucccccugcca

SEQ ID NO: 3404440 - RNA, 16 nt, Human
gccccucccgccccuu

SEQ ID NO: 3404441 - RNA, 16 nt, Human
gccccucccucccaga

SEQ ID NO: 3404442 - RNA, 20 nt, Human
gccccucccucccagagcac

SEQ ID NO: 3404443 - RNA, 17 nt, Human
gccccucccuccucuga

SEQ ID NO: 3404444 - RNA, 23 nt, Human
gccccucccucuccagcaggccc

SEQ ID NO: 3404445 - RNA, 13 nt, Human
gccccuccuccag

SEQ ID NO: 3404446 - RNA, 20 nt, Human
gccccuccuccagccccugu

SEQ ID NO: 3404447 - RNA, 12 nt, Human
gccccuccucug

SEQ ID NO: 3404448 - RNA, 14 nt, Human
gccccuccucugcc

SEQ ID NO: 3404449 - RNA, 15 nt, Human
gccccuccucugcca

SEQ ID NO: 3404450 - RNA, 16 nt, Human
gccccuccucugccac

SEQ ID NO: 3404451 - RNA, 15 nt, Human
gccccucgccugugg

SEQ ID NO: 3404452 - RNA, 15 nt, Human
gccccucucagcccu

SEQ ID NO: 3404453 - RNA, 20 nt, Human
gccccucuccccgcaguguu

SEQ ID NO: 3404454 - RNA, 12 nt, Human
gccccucucccu

SEQ ID NO: 3404455 - RNA, 21 nt, Human
gccccucucccuugggcucug

SEQ ID NO: 3404456 - RNA, 14 nt, Human
gccccucucugggc

SEQ ID NO: 3404457 - RNA, 11 nt, Human
gccccucugcc

SEQ ID NO: 3404458 - RNA, 12 nt, Human
gccccucugccc

SEQ ID NO: 3404459 - RNA, 14 nt, Human
gccccucugcccag

SEQ ID NO: 3404460 - RNA, 20 nt, Human
gccccucugcccagcuuggg

SEQ ID NO: 3404461 - RNA, 14 nt, Human
gccccucuucccca

SEQ ID NO: 3404462 - RNA, 23 nt, Human
gccccucuuggagaagucucagc

SEQ ID NO: 3404463 - RNA, 14 nt, Human
gccccucuuucucu

SEQ ID NO: 3404464 - RNA, 16 nt, Human
gccccugaacaagaau

SEQ ID NO: 3404465 - RNA, 16 nt, Human
gccccugagaucucug

SEQ ID NO: 3404466 - RNA, 20 nt, Human
gccccugagaucucugcagg

SEQ ID NO: 3404467 - RNA, 16 nt, Human
gccccugagcccacug

SEQ ID NO: 3404468 - RNA, 22 nt, Human
gccccugcacagcaggcugcca

SEQ ID NO: 3404469 - RNA, 23 nt, Human
gccccugcauccccuuggcugug

SEQ ID NO: 3404470 - RNA, 13 nt, Human
gccccugccaccc

SEQ ID NO: 3404471 - RNA, 15 nt, Human
gccccugccacccug

SEQ ID NO: 3404472 - RNA, 23 nt, Human
gccccugccaccuccugccucag

SEQ ID NO: 3404473 - RNA, 20 nt, Human
gccccugccccagcccaagu

SEQ ID NO: 3404474 - RNA, 12 nt, Human
gccccugccccg

SEQ ID NO: 3404475 - RNA, 16 nt, Human
gccccugccccgucac

SEQ ID NO: 3404476 - RNA, 14 nt, Human
gccccugccccuca

SEQ ID NO: 3404477 - RNA, 15 nt, Human
gccccugccccugcc

SEQ ID NO: 3404478 - RNA, 17 nt, Human
gccccugccucucugca

SEQ ID NO: 3404479 - RNA, 12 nt, Human
gccccugccugc

SEQ ID NO: 3404480 - RNA, 13 nt, Human
gccccugccugcc

SEQ ID NO: 3404481 - RNA, 14 nt, Human
gccccugccugcca

SEQ ID NO: 3404482 - RNA, 15 nt, Human
gccccugcucuggug

SEQ ID NO: 3404483 - RNA, 17 nt, Human
gccccugcugccucccc

SEQ ID NO: 3404484 - RNA, 20 nt, Human
gccccugcugccuccccaac

SEQ ID NO: 3404485 - RNA, 20 nt, Human
gccccugcugcugucaccuc

SEQ ID NO: 3404486 - RNA, 20 nt, Human
gccccugcuucuccagccug

SEQ ID NO: 3404487 - RNA, 15 nt, Human
gccccuggagccaga

SEQ ID NO: 3404488 - RNA, 20 nt, Human
gccccuggaggcugccuccc

SEQ ID NO: 3404489 - RNA, 21 nt, Human
gccccuggaggcugccuccca

SEQ ID NO: 3404490 - RNA, 18 nt, Human
gccccuggaugcagccuc

SEQ ID NO: 3404491 - RNA, 12 nt, Human
gccccuggcacu

SEQ ID NO: 3404492 - RNA, 17 nt, Human
gccccuggcacucuugu

SEQ ID NO: 3404493 - RNA, 21 nt, Human
gccccuggcagagaugccucc

SEQ ID NO: 3404494 - RNA, 23 nt, Human
gccccuggcagccccuguucugg

SEQ ID NO: 3404495 - RNA, 13 nt, Human
gccccuggcccag

SEQ ID NO: 3404496 - RNA, 16 nt, Human
gccccuggcccagcgg

SEQ ID NO: 3404497 - RNA, 17 nt, Human
gccccuggcccagcggc

SEQ ID NO: 3404498 - RNA, 18 nt, Human
gccccuggcccagcggcc

SEQ ID NO: 3404499 - RNA, 23 nt, Human
gccccuggcccagcggccccucc

SEQ ID NO: 3404500 - RNA, 14 nt, Human
gccccuggccccag

SEQ ID NO: 3404501 - RNA, 19 nt, Human
gccccuggccgcgcuccgg

SEQ ID NO: 3404502 - RNA, 21 nt, Human
gccccuggccgcgcuccgggc

SEQ ID NO: 3404503 - RNA, 11 nt, Human
gccccugggcu

SEQ ID NO: 3404504 - RNA, 23 nt, Human
gccccugggcuuggccugcugug

SEQ ID NO: 3404505 - RNA, 17 nt, Human
gccccuggggccuagac

SEQ ID NO: 3404506 - RNA, 15 nt, Human
gccccugggguggcc

SEQ ID NO: 3404507 - RNA, 21 nt, Human
gccccuggguggguggugggg

SEQ ID NO: 3404508 - RNA, 20 nt, Human
gccccuggucccucugcagu

SEQ ID NO: 3404509 - RNA, 17 nt, Human
gccccuguucuggcaga

SEQ ID NO: 3404510 - RNA, 16 nt, Human
gccccuuagacagagg

SEQ ID NO: 3404511 - RNA, 17 nt, Human
gccccuuagcccccacc

SEQ ID NO: 3404512 - RNA, 23 nt, Human
gccccuucauugauuuccugugu

SEQ ID NO: 3404513 - RNA, 19 nt, Human
gccccuucccacucacccc

SEQ ID NO: 3404514 - RNA, 13 nt, Human
gccccuucccuuc

SEQ ID NO: 3404515 - RNA, 17 nt, Human
gccccuucucagaaucu

SEQ ID NO: 3404516 - RNA, 18 nt, Human
gccccuucucagaaucua

SEQ ID NO: 3404517 - RNA, 17 nt, Human
gccccuucucucccugc

SEQ ID NO: 3404518 - RNA, 19 nt, Human
gccccuucugacccaugcu

SEQ ID NO: 3404519 - RNA, 15 nt, Human
gccccuucugcucag

SEQ ID NO: 3404520 - RNA, 19 nt, Human
gccccuucugcucagcucu

SEQ ID NO: 3404521 - RNA, 19 nt, Human
gccccuugacaacuggcag

SEQ ID NO: 3404522 - RNA, 21 nt, Human
gccccuuucccuuguagcucc

SEQ ID NO: 3404523 - RNA, 19 nt, Human
gccccuuuuuacuccccuu

SEQ ID NO: 3404524 - RNA, 21 nt, Human
gcccgaauacaaacaccugga

SEQ ID NO: 3404525 - RNA, 17 nt, Human
gcccgacagccuggcac

SEQ ID NO: 3404526 - RNA, 16 nt, Human
gcccgacauggcuccg

SEQ ID NO: 3404527 - RNA, 18 nt, Human
gcccgacuugcuguuuug

SEQ ID NO: 3404528 - RNA, 13 nt, Human
gcccgagcagcug

SEQ ID NO: 3404529 - RNA, 12 nt, Human
gcccgagcuggu

SEQ ID NO: 3404530 - RNA, 14 nt, Human
gcccgagcuggugc

SEQ ID NO: 3404531 - RNA, 22 nt, Human
gcccgagcuggugcauuacaga

SEQ ID NO: 3404532 - RNA, 22 nt, Human
gcccgagcuguuuauguuuuua

SEQ ID NO: 3404533 - RNA, 23 nt, Human
gcccgaggaggugucucaggcug

SEQ ID NO: 3404534 - RNA, 15 nt, Human
gcccgaggcaccagu

SEQ ID NO: 3404535 - RNA, 18 nt, Human
gcccgagguggcugccug

SEQ ID NO: 3404536 - RNA, 14 nt, Human
gcccgauccucccc

SEQ ID NO: 3404537 - RNA, 20 nt, Human
gcccgauccuccccuggacu

SEQ ID NO: 3404538 - RNA, 22 nt, Human
gcccgcacacccucacucugcc

SEQ ID NO: 3404539 - RNA, 23 nt, Human
gcccgcacacccucacucugcca

SEQ ID NO: 3404540 - RNA, 13 nt, Human
gcccgcacaccug

SEQ ID NO: 3404541 - RNA, 14 nt, Human
gcccgcacagagcu

SEQ ID NO: 3404542 - RNA, 13 nt, Human
gcccgcacagcag

SEQ ID NO: 3404543 - RNA, 14 nt, Human
gcccgcacagcagc

SEQ ID NO: 3404544 - RNA, 15 nt, Human
gcccgcacagcagcc

SEQ ID NO: 3404545 - RNA, 16 nt, Human
gcccgcacccccaccc

SEQ ID NO: 3404546 - RNA, 19 nt, Human
gcccgcacccccacccuuu

SEQ ID NO: 3404547 - RNA, 15 nt, Human
gcccgcagaccucug

SEQ ID NO: 3404548 - RNA, 13 nt, Human
gcccgcaucagcu

SEQ ID NO: 3404549 - RNA, 19 nt, Human
gcccgcaucagcugcucag

SEQ ID NO: 3404550 - RNA, 20 nt, Human
gcccgcaucagcugcucaga

SEQ ID NO: 3404551 - RNA, 14 nt, Human
gcccgcaugcagca

SEQ ID NO: 3404552 - RNA, 17 nt, Human
gcccgcaugcagcagcu

SEQ ID NO: 3404553 - RNA, 19 nt, Human
gcccgcaugcagcagcuug

SEQ ID NO: 3404554 - RNA, 19 nt, Human
gcccgcaugcggcccagga

SEQ ID NO: 3404555 - RNA, 15 nt, Human
gcccgccacacagac

SEQ ID NO: 3404556 - RNA, 12 nt, Human
gcccgccaccac

SEQ ID NO: 3404557 - RNA, 13 nt, Human
gcccgcccacugu

SEQ ID NO: 3404558 - RNA, 15 nt, Human
gcccgcccacugucc

SEQ ID NO: 3404559 - RNA, 14 nt, Human
gcccgccccugcag

SEQ ID NO: 3404560 - RNA, 16 nt, Human
gcccgccccugcagca

SEQ ID NO: 3404561 - RNA, 13 nt, Human
gcccgccugccag

SEQ ID NO: 3404562 - RNA, 14 nt, Human
gcccgccugccagu

SEQ ID NO: 3404563 - RNA, 15 nt, Human
gcccgccugccaguc

SEQ ID NO: 3404564 - RNA, 16 nt, Human
gcccgccugccagucc

SEQ ID NO: 3404565 - RNA, 18 nt, Human
gcccgccugccaguccua

SEQ ID NO: 3404566 - RNA, 22 nt, Human
gcgccaggcugaccacagcaca

SEQ ID NO: 3404567 - RNA, 13 nt, Human
gcgccaguccugc

SEQ ID NO: 3404568 - RNA, 17 nt, Human
gcgcccaccuccccacg

SEQ ID NO: 3404569 - RNA, 17 nt, Human
gcgcccaguccuuccac

SEQ ID NO: 3404570 - RNA, 22 nt, Human
gcgcccaguccuuccaccucga

SEQ ID NO: 3404571 - RNA, 23 nt, Human
gcgcccaguuggguggaugccug

SEQ ID NO: 3404572 - RNA, 19 nt, Human
gcgccccccccuccccaug

SEQ ID NO: 3404573 - RNA, 13 nt, Human
gcgccccuagccg

SEQ ID NO: 3404574 - RNA, 22 nt, Human
gcgccccuagccgguuccuguc

SEQ ID NO: 3404575 - RNA, 16 nt, Human
gcgcccgccccugcag

SEQ ID NO: 3404576 - RNA, 14 nt, Human
gcgcccgcugggcu

SEQ ID NO: 3404577 - RNA, 13 nt, Human
gcgcccucugucc

SEQ ID NO: 3404578 - RNA, 14 nt, Human
gcgcccucuguccu

SEQ ID NO: 3404579 - RNA, 15 nt, Human
gcgcccucuguccug

SEQ ID NO: 3404580 - RNA, 14 nt, Human
gcgcccugcagacc

SEQ ID NO: 3404581 - RNA, 16 nt, Human
gcgcccugcagacccu

SEQ ID NO: 3404582 - RNA, 13 nt, Human
gcgcccuggcccc

SEQ ID NO: 3404583 - RNA, 16 nt, Human
gcgcccuggcccccac

SEQ ID NO: 3404584 - RNA, 16 nt, Human
gcgcccuuccucucca

SEQ ID NO: 3404585 - RNA, 18 nt, Human
gcgcccuuccucuccacc

SEQ ID NO: 3404586 - RNA, 17 nt, Human
gcgccgagucugucucu

SEQ ID NO: 3404587 - RNA, 17 nt, Human
gcgccgcaaaccacacu

SEQ ID NO: 3404588 - RNA, 18 nt, Human
gcgccggcgggcgggccg

SEQ ID NO: 3404589 - RNA, 22 nt, Human
gcgccgucuccaggggcugcuu

SEQ ID NO: 3404590 - RNA, 15 nt, Human
gcgccgugcugggca

SEQ ID NO: 3404591 - RNA, 18 nt, Human
gcgccgugcugggcagcc

SEQ ID NO: 3404592 - RNA, 15 nt, Human
gcgccuacaggagug

SEQ ID NO: 3404593 - RNA, 20 nt, Human
gcgccuaguggggucucccu

SEQ ID NO: 3404594 - RNA, 21 nt, Human
gcgccuaguggggucucccuc

SEQ ID NO: 3404595 - RNA, 18 nt, Human
gcgccuccaacccuagca

SEQ ID NO: 3404596 - RNA, 19 nt, Human
gcgccuccauccaaggcca

SEQ ID NO: 3404597 - RNA, 17 nt, Human
gcgccucccuccacccc

SEQ ID NO: 3404598 - RNA, 18 nt, Human
gcgccugccccucccaga

SEQ ID NO: 3404599 - RNA, 16 nt, Human
gcgccuguagucccag

SEQ ID NO: 3404600 - RNA, 13 nt, Human
gcgccuucucccc

SEQ ID NO: 3404601 - RNA, 23 nt, Human
gcgccuugucuccuacuccugac

SEQ ID NO: 3404602 - RNA, 14 nt, Human
gcgccuuucccaac

SEQ ID NO: 3404603 - RNA, 15 nt, Human
gcgccuuucccaacu

SEQ ID NO: 3404604 - RNA, 21 nt, Human
gcgcgaucccacacaggcugg

SEQ ID NO: 3404605 - RNA, 15 nt, Human
gcgcgaucucagcuc

SEQ ID NO: 3404606 - RNA, 16 nt, Human
gcgcgaucucagcuca

SEQ ID NO: 3404607 - RNA, 18 nt, Human
gcgcgcacacacacacau

SEQ ID NO: 3404608 - RNA, 19 nt, Human
gcgcgcacacacacacaua

SEQ ID NO: 3404609 - RNA, 15 nt, Human
gcgcgccccuagccg

SEQ ID NO: 3404610 - RNA, 17 nt, Human
gcgcggacgugcugggc

SEQ ID NO: 3404611 - RNA, 16 nt, Human
gcgcggccagccccgg

SEQ ID NO: 3404612 - RNA, 21 nt, Human
gcgcggccagccccggcccug

SEQ ID NO: 3404613 - RNA, 23 nt, Human
gcgcggccagccccggcccuggg

SEQ ID NO: 3404614 - RNA, 19 nt, Human
gcgcgggccccggcgcccc

SEQ ID NO: 3404615 - RNA, 15 nt, Human
gcgcgucccccugcc

SEQ ID NO: 3404616 - RNA, 20 nt, Human
gcgcuaacuugcuuaaaugu

SEQ ID NO: 3404617 - RNA, 21 nt, Human
gcgcuaacuugcuuaaaugug

SEQ ID NO: 3404618 - RNA, 16 nt, Human
gcgcuacccacuucua

SEQ ID NO: 3404619 - RNA, 13 nt, Human
gcgcuagaggcca

SEQ ID NO: 3404620 - RNA, 17 nt, Human
gcgcucaauaggaccag

SEQ ID NO: 3404621 - RNA, 19 nt, Human
gcgcucagaacaguaucuu

SEQ ID NO: 3404622 - RNA, 22 nt, Human
gcgcucagggccaugcugaggc

SEQ ID NO: 3404623 - RNA, 19 nt, Human
gcgcucccuugaccugcug

SEQ ID NO: 3404624 - RNA, 23 nt, Human
gcgcucgaaguugaucuccccag

SEQ ID NO: 3404625 - RNA, 16 nt, Human
gcgcucucuuugcaac

SEQ ID NO: 3404626 - RNA, 20 nt, Human
gcgcucugccucaccgcuuc

SEQ ID NO: 3404627 - RNA, 19 nt, Human
gcgcugcccaccugccggc

SEQ ID NO: 3404628 - RNA, 23 nt, Human
gcgcugccccaucuccccucagc

SEQ ID NO: 3404629 - RNA, 14 nt, Human
gcgcugccccuggc

SEQ ID NO: 3404630 - RNA, 17 nt, Human
gcgcugccccuggcagc

SEQ ID NO: 3404631 - RNA, 16 nt, Human
gcgcugccgcacccca

SEQ ID NO: 3404632 - RNA, 15 nt, Human
gcgcugccugugugg

SEQ ID NO: 3404633 - RNA, 23 nt, Human
gcgcugcucuuaugccauuuguu

SEQ ID NO: 3404634 - RNA, 14 nt, Human
gcgcuggccgggac

SEQ ID NO: 3404635 - RNA, 16 nt, Human
gcgcugggcacuuccc

SEQ ID NO: 3404636 - RNA, 18 nt, Human
gcgcugggcacuucccug

SEQ ID NO: 3404637 - RNA, 19 nt, Human
gcgcugggcacuucccugc

SEQ ID NO: 3404638 - RNA, 22 nt, Human
gcgcugggcacuucccugcugc

SEQ ID NO: 3404639 - RNA, 17 nt, Human
gcgcuggguauuggaaa

SEQ ID NO: 3404640 - RNA, 18 nt, Human
gcgcuguuuuuguugugu

SEQ ID NO: 3404641 - RNA, 21 nt, Human
gcgcuguuuuuguugugugug

SEQ ID NO: 3404642 - RNA, 20 nt, Human
gcggaacaaggagucagaca

SEQ ID NO: 3404643 - RNA, 19 nt, Human
gcggaaugaaccacaucuu

SEQ ID NO: 3404644 - RNA, 20 nt, Human
gcggacauccccugcuggcc

SEQ ID NO: 3404645 - RNA, 22 nt, Human
gcggacauccccugcuggccgg

SEQ ID NO: 3404646 - RNA, 17 nt, Human
gcggaccacccucacug

SEQ ID NO: 3404647 - RNA, 14 nt, Human
gcggaccccagcug

SEQ ID NO: 3404648 - RNA, 17 nt, Human
gcggacuccuccuuucu

SEQ ID NO: 3404649 - RNA, 16 nt, Human
gcggagaaaggaaggg

SEQ ID NO: 3404650 - RNA, 19 nt, Human
gcggagaaccuugugccug

SEQ ID NO: 3404651 - RNA, 23 nt, Human
gcggagaaccuugugccuggcuc

SEQ ID NO: 3404652 - RNA, 20 nt, Human
gcggagaguacagugagcca

SEQ ID NO: 3404653 - RNA, 16 nt, Human
gcggagcuugcaguga

SEQ ID NO: 3404654 - RNA, 16 nt, Human
gcggaggagagagagg

SEQ ID NO: 3404655 - RNA, 17 nt, Human
gcggaggggacagagcg

SEQ ID NO: 3404656 - RNA, 15 nt, Human
gcggagguugcaggg

SEQ ID NO: 3404657 - RNA, 19 nt, Human
gcggagguugcagugagcu

SEQ ID NO: 3404658 - RNA, 18 nt, Human
gcggagugaagaggggca

SEQ ID NO: 3404659 - RNA, 21 nt, Human
gcggagugaagaggggcagcc

SEQ ID NO: 3404660 - RNA, 21 nt, Human
gcggauggauggaagguugga

SEQ ID NO: 3404661 - RNA, 12 nt, Human
gcggcacagccu

SEQ ID NO: 3404662 - RNA, 14 nt, Human
gcggcagcagccau

SEQ ID NO: 3404663 - RNA, 17 nt, Human
gcggcagcagccaucau

SEQ ID NO: 3404664 - RNA, 14 nt, Human
gcggcaggagggag

SEQ ID NO: 3404665 - RNA, 13 nt, Human
gcggcagggaaga

SEQ ID NO: 3404666 - RNA, 15 nt, Human
gcggcaggggccugg

SEQ ID NO: 3404667 - RNA, 13 nt, Human
gcggcaucaggcu

SEQ ID NO: 3404668 - RNA, 11 nt, Human
gcggccagccc

SEQ ID NO: 3404669 - RNA, 13 nt, Human
gcggccagccccg

SEQ ID NO: 3404670 - RNA, 18 nt, Human
gcggccagccccggcccu

SEQ ID NO: 3404671 - RNA, 20 nt, Human
gcggccagccccggcccugg

SEQ ID NO: 3404672 - RNA, 19 nt, Human
gcggccaguauuagacugg

SEQ ID NO: 3404673 - RNA, 22 nt, Human
gcggcccaagcccgacuugcug

SEQ ID NO: 3404674 - RNA, 14 nt, Human
gcggccccuccccc

SEQ ID NO: 3404675 - RNA, 17 nt, Human
gcggccccucccccguc

SEQ ID NO: 3404676 - RNA, 13 nt, Human
gcggcccucagua

SEQ ID NO: 3404677 - RNA, 14 nt, Human
gcggcccugucauc

SEQ ID NO: 3404678 - RNA, 15 nt, Human
gcggccgcauucccu

SEQ ID NO: 3404679 - RNA, 16 nt, Human
gcggccgcauucccug

SEQ ID NO: 3404680 - RNA, 19 nt, Human
gcggccgcauucccugagu

SEQ ID NO: 3404681 - RNA, 13 nt, Human
gcggccucagagu

SEQ ID NO: 3404682 - RNA, 14 nt, Human
gcggccuccuucug

SEQ ID NO: 3404683 - RNA, 15 nt, Human
gcggccuccuucuga

SEQ ID NO: 3404684 - RNA, 19 nt, Human
gcggccuccuucugagcuc

SEQ ID NO: 3404685 - RNA, 19 nt, Human
gcggccucuucucucagac

SEQ ID NO: 3404686 - RNA, 16 nt, Human
gcggcguacaggcugg

SEQ ID NO: 3404687 - RNA, 19 nt, Human
gcggcuacucagcagcccu

SEQ ID NO: 3404688 - RNA, 20 nt, Human
gcggcuacucagcagcccuc

SEQ ID NO: 3404689 - RNA, 12 nt, Human
gcggcuccucag

SEQ ID NO: 3404690 - RNA, 22 nt, Human
gcggcugagagccccagcugac

SEQ ID NO: 3404691 - RNA, 21 nt, Human
gcggcuggacuuggagguagc

SEQ ID NO: 3404692 - RNA, 13 nt, Human
gcggcugggagga

SEQ ID NO: 3404693 - RNA, 18 nt, Human
gcggcugggaggagggca

SEQ ID NO: 3404694 - RNA, 19 nt, Human
gcggcugggaggagggcag

SEQ ID NO: 3404695 - RNA, 17 nt, Human
gcggcuggggucccagc

SEQ ID NO: 3404696 - RNA, 22 nt, Human
gcggcuggggucccagcagcug

SEQ ID NO: 3404697 - RNA, 14 nt, Human
gcgggaaaagcagc

SEQ ID NO: 3404698 - RNA, 23 nt, Human
gcgggaaaagcagcccuuggcca

SEQ ID NO: 3404699 - RNA, 13 nt, Human
gcgggaaggaggg

SEQ ID NO: 3404700 - RNA, 16 nt, Human
gcgggacagaguagcc

SEQ ID NO: 3404701 - RNA, 19 nt, Human
gcgggaccgguacagaaag

SEQ ID NO: 3404702 - RNA, 23 nt, Human
gcgggacgagacccuacaggaga

SEQ ID NO: 3404703 - RNA, 21 nt, Human
gcgggacgucccugcccaugu

SEQ ID NO: 3404704 - RNA, 20 nt, Human
gcgggaggauguucugggac

SEQ ID NO: 3404705 - RNA, 14 nt, Human
gcgggaugggccac

SEQ ID NO: 3404706 - RNA, 15 nt, Human
gcgggaugggccacc

SEQ ID NO: 3404707 - RNA, 16 nt, Human
gcgggaugggccaccg

SEQ ID NO: 3404708 - RNA, 15 nt, Human
gcgggaugguccugg

SEQ ID NO: 3404709 - RNA, 15 nt, Human
gcgggcacaauaaau

SEQ ID NO: 3404710 - RNA, 16 nt, Human
gcgggcagcacagcaa

SEQ ID NO: 3404711 - RNA, 21 nt, Human
gcuaggcgagugccaggacuc

SEQ ID NO: 3404712 - RNA, 17 nt, Human
gcuagggaaacuucccg

SEQ ID NO: 3404713 - RNA, 14 nt, Human
gcuaggggagcagg

SEQ ID NO: 3404714 - RNA, 14 nt, Human
gcuaggguggcccu

SEQ ID NO: 3404715 - RNA, 17 nt, Human
gcuaggguggggagaga

SEQ ID NO: 3404716 - RNA, 17 nt, Human
gcuaggugggccagccc

SEQ ID NO: 3404717 - RNA, 18 nt, Human
gcuagguuaaaugguugg

SEQ ID NO: 3404718 - RNA, 18 nt, Human
gcuagucagagagagugu

SEQ ID NO: 3404719 - RNA, 18 nt, Human
gcuaguccuagugaaccu

SEQ ID NO: 3404720 - RNA, 15 nt, Human
gcuagucuuuugcuu

SEQ ID NO: 3404721 - RNA, 17 nt, Human
gcuagucuuuugcuuuu

SEQ ID NO: 3404722 - RNA, 21 nt, Human
gcuagugacuugugucccaug

SEQ ID NO: 3404723 - RNA, 13 nt, Human
gcuagugagcugg

SEQ ID NO: 3404724 - RNA, 17 nt, Human
gcuaguguaccuccucu

SEQ ID NO: 3404725 - RNA, 15 nt, Human
gcuaguugaauacuu

SEQ ID NO: 3404726 - RNA, 17 nt, Human
gcuauaaacaauuacau

SEQ ID NO: 3404727 - RNA, 23 nt, Human
gcuauaaauuccucuuugcuuug

SEQ ID NO: 3404728 - RNA, 18 nt, Human
gcuauaaugagcauguuu

SEQ ID NO: 3404729 - RNA, 16 nt, Human
gcuauaccugugccuc

SEQ ID NO: 3404730 - RNA, 23 nt, Human
gcuauagcuuuagccgugucacg

SEQ ID NO: 3404731 - RNA, 20 nt, Human
gcuauaguauuugauucaaa

SEQ ID NO: 3404732 - RNA, 15 nt, Human
gcuauauauauaaau

SEQ ID NO: 3404733 - RNA, 22 nt, Human
gcuaucaaaauaaauugaaaua

SEQ ID NO: 3404734 - RNA, 20 nt, Human
gcuaucaagaggcugagaca

SEQ ID NO: 3404735 - RNA, 13 nt, Human
gcuaucacacagu

SEQ ID NO: 3404736 - RNA, 18 nt, Human
gcuauccccaucucccug

SEQ ID NO: 3404737 - RNA, 21 nt, Human
gcuauccccaucucccugccu

SEQ ID NO: 3404738 - RNA, 20 nt, Human
gcuauccugccaaaaucauu

SEQ ID NO: 3404739 - RNA, 14 nt, Human
gcuaucuaaaguuu

SEQ ID NO: 3404740 - RNA, 14 nt, Human
gcuaucucccccag

SEQ ID NO: 3404741 - RNA, 19 nt, Human
gcuaucucccccagcccca

SEQ ID NO: 3404742 - RNA, 21 nt, Human
gcuaucucccccagccccauc

SEQ ID NO: 3404743 - RNA, 20 nt, Human
gcuaucucugugugcacaaa

SEQ ID NO: 3404744 - RNA, 16 nt, Human
gcuaucuuaauuuugg

SEQ ID NO: 3404745 - RNA, 14 nt, Human
gcuaucuucaugua

SEQ ID NO: 3404746 - RNA, 18 nt, Human
gcuaucuucauguaaauu

SEQ ID NO: 3404747 - RNA, 19 nt, Human
gcuaucuucauguaaauug

SEQ ID NO: 3404748 - RNA, 12 nt, Human
gcuaugaauuuu

SEQ ID NO: 3404749 - RNA, 11 nt, Human
gcuauggacac

SEQ ID NO: 3404750 - RNA, 16 nt, Human
gcuauggacacagggu

SEQ ID NO: 3404751 - RNA, 18 nt, Human
gcuauggauggcuucuaa

SEQ ID NO: 3404752 - RNA, 15 nt, Human
gcuauggccugugcg

SEQ ID NO: 3404753 - RNA, 18 nt, Human
gcuaugggagccccaggg

SEQ ID NO: 3404754 - RNA, 21 nt, Human
gcuaugggagccccagggucu

SEQ ID NO: 3404755 - RNA, 18 nt, Human
gcuauggggagaaaagac

SEQ ID NO: 3404756 - RNA, 15 nt, Human
gcuauggugagaugc

SEQ ID NO: 3404757 - RNA, 14 nt, Human
gcuauggugggaga

SEQ ID NO: 3404758 - RNA, 18 nt, Human
gcuaugucccaggaauca

SEQ ID NO: 3404759 - RNA, 17 nt, Human
gcuauguuacuauuuuc

SEQ ID NO: 3404760 - RNA, 16 nt, Human
gcuauguuuuuaaugu

SEQ ID NO: 3404761 - RNA, 20 nt, Human
gcuauuaaaacucagccugg

SEQ ID NO: 3404762 - RNA, 12 nt, Human
gcuauuacaaau

SEQ ID NO: 3404763 - RNA, 13 nt, Human
gcuauuacaaaua

SEQ ID NO: 3404764 - RNA, 13 nt, Human
gcuauuagccagg

SEQ ID NO: 3404765 - RNA, 17 nt, Human
gcuauuagccaggauca

SEQ ID NO: 3404766 - RNA, 18 nt, Human
gcuauuagccaggaucau

SEQ ID NO: 3404767 - RNA, 18 nt, Human
gcuauuauuuucacugua

SEQ ID NO: 3404768 - RNA, 21 nt, Human
gcuauucaguugguaagcuuc

SEQ ID NO: 3404769 - RNA, 14 nt, Human
gcuauuccuuuccc

SEQ ID NO: 3404770 - RNA, 16 nt, Human
gcuauuccuuucccuu

SEQ ID NO: 3404771 - RNA, 22 nt, Human
gcuauuguuucuuuaagaaagu

SEQ ID NO: 3404772 - RNA, 22 nt, Human
gcuauuuaaaaaaaaaagagga

SEQ ID NO: 3404773 - RNA, 14 nt, Human
gcuauuuaaaacuu

SEQ ID NO: 3404774 - RNA, 17 nt, Human
gcuauuuaugggccccu

SEQ ID NO: 3404775 - RNA, 19 nt, Human
gcuauuuaugggccccugg

SEQ ID NO: 3404776 - RNA, 22 nt, Human
gcuauuuaugggccccuggcac

SEQ ID NO: 3404777 - RNA, 16 nt, Human
gcuauuuauuuuccua

SEQ ID NO: 3404778 - RNA, 20 nt, Human
gcuauuuauuuuccuaaaga

SEQ ID NO: 3404779 - RNA, 22 nt, Human
gcuauuucuauauuuucauucu

SEQ ID NO: 3404780 - RNA, 15 nt, Human
gcuauuuguaaaucu

SEQ ID NO: 3404781 - RNA, 17 nt, Human
gcuauuuuacugucuua

SEQ ID NO: 3404782 - RNA, 18 nt, Human
gcuauuuuauauuacacu

SEQ ID NO: 3404783 - RNA, 13 nt, Human
gcuauuuuccagg

SEQ ID NO: 3404784 - RNA, 15 nt, Human
gcuauuuuccaggcu

SEQ ID NO: 3404785 - RNA, 13 nt, Human
gcuauuuuucuaa

SEQ ID NO: 3404786 - RNA, 12 nt, Human
gcuauuuuugua

SEQ ID NO: 3404787 - RNA, 20 nt, Human
gcucaaaauuugaagaauga

SEQ ID NO: 3404788 - RNA, 23 nt, Human
gcucaaaauuugaagaaugaaca

SEQ ID NO: 3404789 - RNA, 22 nt, Human
gcucaaacaaugacaaagcaga

SEQ ID NO: 3404790 - RNA, 23 nt, Human
gcucaaagguuuggaaggagcag

SEQ ID NO: 3404791 - RNA, 22 nt, Human
gcucaaaucuauucagacaagc

SEQ ID NO: 3404792 - RNA, 12 nt, Human
gcucaaccuaac

SEQ ID NO: 3404793 - RNA, 21 nt, Human
gcucaagaagacauggagacu

SEQ ID NO: 3404794 - RNA, 18 nt, Human
gcucaagcaauccuccug

SEQ ID NO: 3404795 - RNA, 19 nt, Human
gcucaaggaaaggccugaa

SEQ ID NO: 3404796 - RNA, 20 nt, Human
gcucaaggaaaggccugaaa

SEQ ID NO: 3404797 - RNA, 20 nt, Human
gcucaagucuucccugauca

SEQ ID NO: 3404798 - RNA, 12 nt, Human
gcucaaguucau

SEQ ID NO: 3404799 - RNA, 22 nt, Human
gcucaauauuccugaaugaaau

SEQ ID NO: 3404800 - RNA, 16 nt, Human
gcucaaucaagaaaau

SEQ ID NO: 3404801 - RNA, 16 nt, Human
gcucaaucccugagga

SEQ ID NO: 3404802 - RNA, 14 nt, Human
gcucaaugagcaug

SEQ ID NO: 3404803 - RNA, 19 nt, Human
gcucaaugagcauguuuag

SEQ ID NO: 3404804 - RNA, 17 nt, Human
gcucaauggacuggaag

SEQ ID NO: 3404805 - RNA, 14 nt, Human
gcucacaaggcagc

SEQ ID NO: 3404806 - RNA, 19 nt, Human
gcucacaaggcagcaaggc

SEQ ID NO: 3404807 - RNA, 23 nt, Human
gcucacaauaaaaauggcucaga

SEQ ID NO: 3404808 - RNA, 14 nt, Human
gcucacaccuguaa

SEQ ID NO: 3404809 - RNA, 13 nt, Human
gcucacagcugug

SEQ ID NO: 3404810 - RNA, 20 nt, Human
gcucacaguacagcaugugc

SEQ ID NO: 3404811 - RNA, 13 nt, Human
gcucacaguuccu

SEQ ID NO: 3404812 - RNA, 22 nt, Human
gcucacaguuccucgcccuggg

SEQ ID NO: 3404813 - RNA, 14 nt, Human
gcucaccagcccca

SEQ ID NO: 3404814 - RNA, 15 nt, Human
gcucaccagccccag

SEQ ID NO: 3404815 - RNA, 19 nt, Human
gcucaccagccccagugcc

SEQ ID NO: 3404816 - RNA, 20 nt, Human
gcucacccaauaaacauuaa

SEQ ID NO: 3404817 - RNA, 13 nt, Human
gcucacccagugc

SEQ ID NO: 3404818 - RNA, 19 nt, Human
gcucacccagugcccucuc

SEQ ID NO: 3404819 - RNA, 19 nt, Human
gcucaccccaucaucccuu

SEQ ID NO: 3404820 - RNA, 16 nt, Human
gcucacccccuucucc

SEQ ID NO: 3404821 - RNA, 22 nt, Human
gcucacccccuucuccauccac

SEQ ID NO: 3404822 - RNA, 15 nt, Human
gcucaccccuggagg

SEQ ID NO: 3404823 - RNA, 16 nt, Human
gcucaccgcccaucag

SEQ ID NO: 3404824 - RNA, 18 nt, Human
gcucaccuagagccagac

SEQ ID NO: 3404825 - RNA, 17 nt, Human
gcucaccucucccuugg

SEQ ID NO: 3404826 - RNA, 13 nt, Human
gcucaccuggggu

SEQ ID NO: 3404827 - RNA, 20 nt, Human
gcucaccuguugcuuacaau

SEQ ID NO: 3404828 - RNA, 21 nt, Human
gcucaccuguugcuuacaauu

SEQ ID NO: 3404829 - RNA, 21 nt, Human
gcucacgccuaugaucccagc

SEQ ID NO: 3404830 - RNA, 23 nt, Human
gcucacgccuguaaucccagcac

SEQ ID NO: 3404831 - RNA, 18 nt, Human
gcucacgcuucacaguga

SEQ ID NO: 3404832 - RNA, 16 nt, Human
gcucacuauggugcca

SEQ ID NO: 3404833 - RNA, 18 nt, Human
gcucacuauggugccaau

SEQ ID NO: 3404834 - RNA, 18 nt, Human
gcucacucacagagucaa

SEQ ID NO: 3404835 - RNA, 20 nt, Human
gcucacucagccacccugag

SEQ ID NO: 3404836 - RNA, 16 nt, Human
gcucacucggcacccu

SEQ ID NO: 3404837 - RNA, 11 nt, Human
gcucacugcag

SEQ ID NO: 3404838 - RNA, 12 nt, Human
gcucacugcagc

SEQ ID NO: 3404839 - RNA, 17 nt, Human
gcucacugcagccuccg

SEQ ID NO: 3404840 - RNA, 16 nt, Human
gcucacugcauccucc

SEQ ID NO: 3404841 - RNA, 22 nt, Human
gcucacugccaggccagccucc

SEQ ID NO: 3404842 - RNA, 12 nt, Human
gcucagaacaca

SEQ ID NO: 3404843 - RNA, 15 nt, Human
gcucagaaccacagc

SEQ ID NO: 3404844 - RNA, 17 nt, Human
gcucagaaccacagcaa

SEQ ID NO: 3404845 - RNA, 14 nt, Human
gcucagaacccagg

SEQ ID NO: 3404846 - RNA, 16 nt, Human
gcucagaacccagggc

SEQ ID NO: 3404847 - RNA, 17 nt, Human
gcucagaacccagggcu

SEQ ID NO: 3404848 - RNA, 22 nt, Human
gcucagaacccagggcucugcc

SEQ ID NO: 3404849 - RNA, 16 nt, Human
gcucagaacuugcugc

SEQ ID NO: 3404850 - RNA, 17 nt, Human
gcucagaacuugcugcu

SEQ ID NO: 3404851 - RNA, 20 nt, Human
gcucagaacuugcugcuguc

SEQ ID NO: 3404852 - RNA, 15 nt, Human
gcucagaagugacca

SEQ ID NO: 3404853 - RNA, 15 nt, Human
gcucagaauaaggca

SEQ ID NO: 3404854 - RNA, 15 nt, Human
gcucagaauccaagu

SEQ ID NO: 3404855 - RNA, 18 nt, Human
gcucagagagggugggag

SEQ ID NO: 3404856 - RNA, 22 nt, Human
gcucccacagucccaucugcuu

SEQ ID NO: 3404857 - RNA, 21 nt, Human
gcucccaccccacccccuuca

SEQ ID NO: 3404858 - RNA, 15 nt, Human
gcucccaccuccuga

SEQ ID NO: 3404859 - RNA, 16 nt, Human
gcucccaccuccugac

SEQ ID NO: 3404860 - RNA, 14 nt, Human
gcucccaccuggcu

SEQ ID NO: 3404861 - RNA, 16 nt, Human
gcucccaccuggcucu

SEQ ID NO: 3404862 - RNA, 15 nt, Human
gcucccagccaggcc

SEQ ID NO: 3404863 - RNA, 12 nt, Human
gcucccagccuc

SEQ ID NO: 3404864 - RNA, 13 nt, Human
gcucccagccuca

SEQ ID NO: 3404865 - RNA, 13 nt, Human
gcucccaggacac

SEQ ID NO: 3404866 - RNA, 21 nt, Human
gcucccaggagccugcccagc

SEQ ID NO: 3404867 - RNA, 17 nt, Human
gcucccaggcauucccc

SEQ ID NO: 3404868 - RNA, 19 nt, Human
gcucccaggcauuccccag

SEQ ID NO: 3404869 - RNA, 22 nt, Human
gcucccaggcauuccccaggag

SEQ ID NO: 3404870 - RNA, 23 nt, Human
gcucccaggcauuccccaggagg

SEQ ID NO: 3404871 - RNA, 11 nt, Human
gcucccaggcc

SEQ ID NO: 3404872 - RNA, 11 nt, Human
gcucccagggc

SEQ ID NO: 3404873 - RNA, 14 nt, Human
gcucccagggccau

SEQ ID NO: 3404874 - RNA, 20 nt, Human
gcucccaggggucucccugg

SEQ ID NO: 3404875 - RNA, 20 nt, Human
gcucccaggugcagccagag

SEQ ID NO: 3404876 - RNA, 20 nt, Human
gcucccagugucuuccugug

SEQ ID NO: 3404877 - RNA, 22 nt, Human
gcucccagugucuuccuguggg

SEQ ID NO: 3404878 - RNA, 22 nt, Human
gcuccccagcccuggcucugca

SEQ ID NO: 3404879 - RNA, 14 nt, Human
gcuccccauguguc

SEQ ID NO: 3404880 - RNA, 15 nt, Human
gcucccccacccccu

SEQ ID NO: 3404881 - RNA, 22 nt, Human
gcucccccacccccuccccagg

SEQ ID NO: 3404882 - RNA, 14 nt, Human
gcucccccagcucc

SEQ ID NO: 3404883 - RNA, 14 nt, Human
gcucccccauccuc

SEQ ID NO: 3404884 - RNA, 21 nt, Human
gcucccccgggaggggcccgc

SEQ ID NO: 3404885 - RNA, 18 nt, Human
gcucccccuguccccuca

SEQ ID NO: 3404886 - RNA, 17 nt, Human
gcucccccuuuucccuc

SEQ ID NO: 3404887 - RNA, 22 nt, Human
gcuccccgccuguucccccgcc

SEQ ID NO: 3404888 - RNA, 19 nt, Human
gcuccccuaaagccucaaa

SEQ ID NO: 3404889 - RNA, 13 nt, Human
gcuccccuccucu

SEQ ID NO: 3404890 - RNA, 18 nt, Human
gcuccccucggagaagag

SEQ ID NO: 3404891 - RNA, 20 nt, Human
gcuccccucugcacggacca

SEQ ID NO: 3404892 - RNA, 13 nt, Human
gcuccccucuucc

SEQ ID NO: 3404893 - RNA, 12 nt, Human
gcuccccugagg

SEQ ID NO: 3404894 - RNA, 15 nt, Human
gcuccccugcagccc

SEQ ID NO: 3404895 - RNA, 15 nt, Human
gcuccccuggggagu

SEQ ID NO: 3404896 - RNA, 18 nt, Human
gcuccccuuucgcccaca

SEQ ID NO: 3404897 - RNA, 13 nt, Human
gcucccgccucca

SEQ ID NO: 3404898 - RNA, 20 nt, Human
gcucccggggcagggcagcc

SEQ ID NO: 3404899 - RNA, 18 nt, Human
gcucccggguccuuggcc

SEQ ID NO: 3404900 - RNA, 18 nt, Human
gcucccuaagccagccug

SEQ ID NO: 3404901 - RNA, 16 nt, Human
gcucccuaccaccucc

SEQ ID NO: 3404902 - RNA, 16 nt, Human
gcucccucaaagaggc

SEQ ID NO: 3404903 - RNA, 17 nt, Human
gcucccucaaagaggca

SEQ ID NO: 3404904 - RNA, 15 nt, Human
gcucccucacucuca

SEQ ID NO: 3404905 - RNA, 18 nt, Human
gcucccucacucucagga

SEQ ID NO: 3404906 - RNA, 11 nt, Human
gcucccucaga

SEQ ID NO: 3404907 - RNA, 22 nt, Human
gcucccucagacuggggcaaug

SEQ ID NO: 3404908 - RNA, 15 nt, Human
gcucccucccaggac

SEQ ID NO: 3404909 - RNA, 18 nt, Human
gcucccucccaggacucu

SEQ ID NO: 3404910 - RNA, 21 nt, Human
gcucccucccaggacucugac

SEQ ID NO: 3404911 - RNA, 16 nt, Human
gcucccucccaucccu

SEQ ID NO: 3404912 - RNA, 14 nt, Human
gcucccuccuccag

SEQ ID NO: 3404913 - RNA, 17 nt, Human
gcucccucuuggucuuc

SEQ ID NO: 3404914 - RNA, 16 nt, Human
gcucccugaagccagc

SEQ ID NO: 3404915 - RNA, 13 nt, Human
gcucccugcccca

SEQ ID NO: 3404916 - RNA, 18 nt, Human
gcucccuggcuucugugg

SEQ ID NO: 3404917 - RNA, 17 nt, Human
gcucccuguagggucca

SEQ ID NO: 3404918 - RNA, 21 nt, Human
gcucccuguguccaccugugg

SEQ ID NO: 3404919 - RNA, 14 nt, Human
gcucccuucagccc

SEQ ID NO: 3404920 - RNA, 18 nt, Human
gcucccuuccaccuguca

SEQ ID NO: 3404921 - RNA, 15 nt, Human
gcucccuucccaccu

SEQ ID NO: 3404922 - RNA, 19 nt, Human
gcucccuucccaccucucu

SEQ ID NO: 3404923 - RNA, 14 nt, Human
gcucccuuccuccc

SEQ ID NO: 3404924 - RNA, 15 nt, Human
gcucccuucucugua

SEQ ID NO: 3404925 - RNA, 15 nt, Human
gcucccuugugcgug

SEQ ID NO: 3404926 - RNA, 14 nt, Human
gcuccgcaggacuu

SEQ ID NO: 3404927 - RNA, 16 nt, Human
gcuccgcccuuagucc

SEQ ID NO: 3404928 - RNA, 17 nt, Human
gcuccgccuggccuggc

SEQ ID NO: 3404929 - RNA, 14 nt, Human
gcuccgcugcuccu

SEQ ID NO: 3404930 - RNA, 22 nt, Human
gcuccgcuuucuacccagcgag

SEQ ID NO: 3404931 - RNA, 23 nt, Human
gcuccgcuuucuacccagcgagc

SEQ ID NO: 3404932 - RNA, 18 nt, Human
gcuccgucuccugcgggc

SEQ ID NO: 3404933 - RNA, 22 nt, Human
gcuccgugagugaaccaucauu

SEQ ID NO: 3404934 - RNA, 14 nt, Human
gcuccgugccucca

SEQ ID NO: 3404935 - RNA, 16 nt, Human
gcuccgugccuccacc

SEQ ID NO: 3404936 - RNA, 22 nt, Human
gcuccuaacccuuaucaccagc

SEQ ID NO: 3404937 - RNA, 21 nt, Human
gcuccuacccaccgcccuugc

SEQ ID NO: 3404938 - RNA, 21 nt, Human
gcuccuauucaacacacacau

SEQ ID NO: 3404939 - RNA, 18 nt, Human
gcuccucaacucaccuaa

SEQ ID NO: 3404940 - RNA, 20 nt, Human
gcuccucagggacucaggug

SEQ ID NO: 3404941 - RNA, 21 nt, Human
gcuccucauccagggcucuga

SEQ ID NO: 3404942 - RNA, 14 nt, Human
gcuccuccagggcc

SEQ ID NO: 3404943 - RNA, 15 nt, Human
gcuccuccagggcca

SEQ ID NO: 3404944 - RNA, 22 nt, Human
gcuccuccagggccacgugcca

SEQ ID NO: 3404945 - RNA, 22 nt, Human
gcuccuccaggguggcagcaac

SEQ ID NO: 3404946 - RNA, 15 nt, Human
gcuccuccccuuccu

SEQ ID NO: 3404947 - RNA, 16 nt, Human
gcuccucccggugccc

SEQ ID NO: 3404948 - RNA, 19 nt, Human
gcuccucccucugaggcug

SEQ ID NO: 3404949 - RNA, 20 nt, Human
gcuccucccucugaggcugu

SEQ ID NO: 3404950 - RNA, 15 nt, Human
gcuccucccuggcug

SEQ ID NO: 3404951 - RNA, 16 nt, Human
gcuccucccuggcugc

SEQ ID NO: 3404952 - RNA, 17 nt, Human
gcuccucccuggcugcc

SEQ ID NO: 3404953 - RNA, 18 nt, Human
gcuccucccuggcugccc

SEQ ID NO: 3404954 - RNA, 20 nt, Human
gcuccucccuggcugcccug

SEQ ID NO: 3404955 - RNA, 16 nt, Human
gcuccuccucccugca

SEQ ID NO: 3404956 - RNA, 18 nt, Human
gcuccuccucccugcauc

SEQ ID NO: 3404957 - RNA, 18 nt, Human
gcuccucgagaucccaac

SEQ ID NO: 3404958 - RNA, 15 nt, Human
gcuccucuccaggca

SEQ ID NO: 3404959 - RNA, 16 nt, Human
gcuccucuccaggcac

SEQ ID NO: 3404960 - RNA, 17 nt, Human
gcuccucuccaggcacc

SEQ ID NO: 3404961 - RNA, 11 nt, Human
gcuccucuggg

SEQ ID NO: 3404962 - RNA, 12 nt, Human
gcuccucugggc

SEQ ID NO: 3404963 - RNA, 13 nt, Human
gcuccucugggca

SEQ ID NO: 3404964 - RNA, 17 nt, Human
gcuccucuguccugcuu

SEQ ID NO: 3404965 - RNA, 20 nt, Human
gcuccucuguccugcuucug

SEQ ID NO: 3404966 - RNA, 19 nt, Human
gcuccucuguggugucugc

SEQ ID NO: 3404967 - RNA, 22 nt, Human
gcuccucuuccaugcugugcgc

SEQ ID NO: 3404968 - RNA, 16 nt, Human
gcuccucuuccccaga

SEQ ID NO: 3404969 - RNA, 23 nt, Human
gcuccucuuccccagacgccugg

SEQ ID NO: 3404970 - RNA, 19 nt, Human
gcuccugacacugcuggag

SEQ ID NO: 3404971 - RNA, 12 nt, Human
gcuccugagccc

SEQ ID NO: 3404972 - RNA, 17 nt, Human
gcuccugagggagcucc

SEQ ID NO: 3404973 - RNA, 19 nt, Human
gcuccugagggagcuccaa

SEQ ID NO: 3404974 - RNA, 12 nt, Human
gcuccugcacuu

SEQ ID NO: 3404975 - RNA, 14 nt, Human
gcuccugcagcaug

SEQ ID NO: 3404976 - RNA, 21 nt, Human
gcuccugcagcauggucccug

SEQ ID NO: 3404977 - RNA, 12 nt, Human
gcuccugccacc

SEQ ID NO: 3404978 - RNA, 21 nt, Human
gcuccugccaccacgcccggc

SEQ ID NO: 3404979 - RNA, 19 nt, Human
gcuccugccaguguggaac

SEQ ID NO: 3404980 - RNA, 15 nt, Human
gcuccugccuucugu

SEQ ID NO: 3404981 - RNA, 17 nt, Human
gcuccugccuucugucc

SEQ ID NO: 3404982 - RNA, 19 nt, Human
gcuccugccuucuguccug

SEQ ID NO: 3404983 - RNA, 22 nt, Human
gcuccugcuaacggugcucagg

SEQ ID NO: 3404984 - RNA, 17 nt, Human
gcuccugcuccacagcc

SEQ ID NO: 3404985 - RNA, 20 nt, Human
gcuccugcuccacagccauc

SEQ ID NO: 3404986 - RNA, 11 nt, Human
gcuccugcugc

SEQ ID NO: 3404987 - RNA, 15 nt, Human
gcuccugcugcacca

SEQ ID NO: 3404988 - RNA, 18 nt, Human
gcuccugcugcaccaacc

SEQ ID NO: 3404989 - RNA, 22 nt, Human
gcuccugcugcaccaacccagc

SEQ ID NO: 3404990 - RNA, 23 nt, Human
gcuccuggaaaggcucagucuca

SEQ ID NO: 3404991 - RNA, 19 nt, Human
gcuccuggaccccccuuuc

SEQ ID NO: 3404992 - RNA, 19 nt, Human
gcuccuggagccuuugaau

SEQ ID NO: 3404993 - RNA, 14 nt, Human
gcuccuggcccacu

SEQ ID NO: 3404994 - RNA, 15 nt, Human
gcuccuggcccagcc

SEQ ID NO: 3404995 - RNA, 16 nt, Human
gcuccuggcccagccu

SEQ ID NO: 3404996 - RNA, 22 nt, Human
gcuccugggaaggcuacucacc

SEQ ID NO: 3404997 - RNA, 23 nt, Human
gcuccuggggguucuuucuuccu

SEQ ID NO: 3404998 - RNA, 21 nt, Human
gcuccuggucaccuaggaagc

SEQ ID NO: 3404999 - RNA, 21 nt, Human
gcuccugucugccagccagca

SEQ ID NO: 3405000 - RNA, 14 nt, Human
gcuccugugcuuuc

SEQ ID NO: 3405001 - RNA, 22 nt, Human
gcuucucugugaacgauuuaga

SEQ ID NO: 3405002 - RNA, 19 nt, Human
gcuucucugugacugaugu

SEQ ID NO: 3405003 - RNA, 17 nt, Human
gcuucugaaugugcuga

SEQ ID NO: 3405004 - RNA, 23 nt, Human
gcuucugagcagcgagccugcua

SEQ ID NO: 3405005 - RNA, 15 nt, Human
gcuucugaugaaucu

SEQ ID NO: 3405006 - RNA, 20 nt, Human
gcuucugaugaaucuugcgu

SEQ ID NO: 3405007 - RNA, 12 nt, Human
gcuucugccacu

SEQ ID NO: 3405008 - RNA, 13 nt, Human
gcuucugccacuu

SEQ ID NO: 3405009 - RNA, 14 nt, Human
gcuucugccacuuc

SEQ ID NO: 3405010 - RNA, 21 nt, Human
gcuucugccacuucccaggua

SEQ ID NO: 3405011 - RNA, 17 nt, Human
gcuucugcugggcuggg

SEQ ID NO: 3405012 - RNA, 20 nt, Human
gcuucugcuggggccuggga

SEQ ID NO: 3405013 - RNA, 15 nt, Human
gcuucugcuuuucug

SEQ ID NO: 3405014 - RNA, 21 nt, Human
gcuucugcuuuucugcccugg

SEQ ID NO: 3405015 - RNA, 17 nt, Human
gcuucuggaauuuguuc

SEQ ID NO: 3405016 - RNA, 18 nt, Human
gcuucuggagcccuuggg

SEQ ID NO: 3405017 - RNA, 15 nt, Human
gcuucuggccaggaa

SEQ ID NO: 3405018 - RNA, 12 nt, Human
gcuucugggguc

SEQ ID NO: 3405019 - RNA, 13 nt, Human
gcuucugucucca

SEQ ID NO: 3405020 - RNA, 18 nt, Human
gcuucugugaugagcuga

SEQ ID NO: 3405021 - RNA, 18 nt, Human
gcuucugugcaccugggc

SEQ ID NO: 3405022 - RNA, 21 nt, Human
gcuucugugcccagaauacug

SEQ ID NO: 3405023 - RNA, 18 nt, Human
gcuucuguugcugccuca

SEQ ID NO: 3405024 - RNA, 17 nt, Human
gcuucuguugucaccuu

SEQ ID NO: 3405025 - RNA, 15 nt, Human
gcuucuuaaagaguu

SEQ ID NO: 3405026 - RNA, 21 nt, Human
gcuucuuaaucuuuucacaaa

SEQ ID NO: 3405027 - RNA, 22 nt, Human
gcuucuuaaucuuuucacaaau

SEQ ID NO: 3405028 - RNA, 13 nt, Human
gcuucuuaauuaa

SEQ ID NO: 3405029 - RNA, 12 nt, Human
gcuucuucagag

SEQ ID NO: 3405030 - RNA, 22 nt, Human
gcuucuucagagacuccugcag

SEQ ID NO: 3405031 - RNA, 16 nt, Human
gcuucuucagaucagu

SEQ ID NO: 3405032 - RNA, 20 nt, Human
gcuucuucccuuaaaauuua

SEQ ID NO: 3405033 - RNA, 20 nt, Human
gcuucuucuccuauguguaa

SEQ ID NO: 3405034 - RNA, 19 nt, Human
gcuucuugccucugugcug

SEQ ID NO: 3405035 - RNA, 14 nt, Human
gcuucuugugaagg

SEQ ID NO: 3405036 - RNA, 20 nt, Human
gcuucuugugaaggccauga

SEQ ID NO: 3405037 - RNA, 16 nt, Human
gcuucuuguuuccuug

SEQ ID NO: 3405038 - RNA, 12 nt, Human
gcuucuuucuag

SEQ ID NO: 3405039 - RNA, 15 nt, Human
gcuucuuucuagaaa

SEQ ID NO: 3405040 - RNA, 12 nt, Human
gcuucuuucuuu

SEQ ID NO: 3405041 - RNA, 20 nt, Human
gcuucuuuucuuuguaucau

SEQ ID NO: 3405042 - RNA, 16 nt, Human
gcuugaacacaguauu

SEQ ID NO: 3405043 - RNA, 23 nt, Human
gcuugaacacaguauuuucccaa

SEQ ID NO: 3405044 - RNA, 23 nt, Human
gcuugaaccugggaggcagaggu

SEQ ID NO: 3405045 - RNA, 19 nt, Human
gcuugaacuaggcugagca

SEQ ID NO: 3405046 - RNA, 20 nt, Human
gcuugaacuaggcugagcaa

SEQ ID NO: 3405047 - RNA, 18 nt, Human
gcuugaagcaaacaguug

SEQ ID NO: 3405048 - RNA, 12 nt, Human
gcuugaagccaa

SEQ ID NO: 3405049 - RNA, 15 nt, Human
gcuugaagccaaaga

SEQ ID NO: 3405050 - RNA, 16 nt, Human
gcuugaagccaaagaa

SEQ ID NO: 3405051 - RNA, 15 nt, Human
gcuugaaggcccugc

SEQ ID NO: 3405052 - RNA, 20 nt, Human
gcuugaaggcccugcugagu

SEQ ID NO: 3405053 - RNA, 16 nt, Human
gcuugacaggacagca

SEQ ID NO: 3405054 - RNA, 20 nt, Human
gcuugaccaggcuuggccuu

SEQ ID NO: 3405055 - RNA, 20 nt, Human
gcuugaccgugaggccagag

SEQ ID NO: 3405056 - RNA, 14 nt, Human
gcuugaccugaggc

SEQ ID NO: 3405057 - RNA, 21 nt, Human
gcuugagagcccugaggccua

SEQ ID NO: 3405058 - RNA, 12 nt, Human
gcuugagcccag

SEQ ID NO: 3405059 - RNA, 15 nt, Human
gcuugagcccaggag

SEQ ID NO: 3405060 - RNA, 17 nt, Human
gcuugagccgggccccu

SEQ ID NO: 3405061 - RNA, 14 nt, Human
gcuugagcucagga

SEQ ID NO: 3405062 - RNA, 20 nt, Human
gcuugaggguugggcuggug

SEQ ID NO: 3405063 - RNA, 14 nt, Human
gcuugaugaagcaa

SEQ ID NO: 3405064 - RNA, 19 nt, Human
gcuugaugaagcaaggaag

SEQ ID NO: 3405065 - RNA, 22 nt, Human
gcuugaugggauucuggacagg

SEQ ID NO: 3405066 - RNA, 13 nt, Human
gcuugauuaaauc

SEQ ID NO: 3405067 - RNA, 14 nt, Human
gcuugcacucucuu

SEQ ID NO: 3405068 - RNA, 15 nt, Human
gcuugcauaauaagc

SEQ ID NO: 3405069 - RNA, 23 nt, Human
gcuugcauaauaagcuaaagagg

SEQ ID NO: 3405070 - RNA, 17 nt, Human
gcuugcauauauuucau

SEQ ID NO: 3405071 - RNA, 14 nt, Human
gcuugccaaaguac

SEQ ID NO: 3405072 - RNA, 15 nt, Human
gcuugccacagcucu

SEQ ID NO: 3405073 - RNA, 22 nt, Human
gcuugcccaguacauuuaaauu

SEQ ID NO: 3405074 - RNA, 16 nt, Human
gcuugcccuaagcaga

SEQ ID NO: 3405075 - RNA, 19 nt, Human
gcuugcccuaagcagaaag

SEQ ID NO: 3405076 - RNA, 20 nt, Human
gcuugcccuaagcagaaagu

SEQ ID NO: 3405077 - RNA, 21 nt, Human
gcuugcccuaagcagaaagug

SEQ ID NO: 3405078 - RNA, 17 nt, Human
gcuugcccuggugccuc

SEQ ID NO: 3405079 - RNA, 20 nt, Human
gcuugccgaaacuggaaguu

SEQ ID NO: 3405080 - RNA, 15 nt, Human
gcuugccucggcucc

SEQ ID NO: 3405081 - RNA, 12 nt, Human
gcuugccuggag

SEQ ID NO: 3405082 - RNA, 16 nt, Human
gcuugcgaacuagaga

SEQ ID NO: 3405083 - RNA, 16 nt, Human
gcuugcguaugucugu

SEQ ID NO: 3405084 - RNA, 14 nt, Human
gcuugcuauucugu

SEQ ID NO: 3405085 - RNA, 13 nt, Human
gcuugcugagagg

SEQ ID NO: 3405086 - RNA, 21 nt, Human
gcuugcuuuucaugcaaacuc

SEQ ID NO: 3405087 - RNA, 12 nt, Human
gcuugcuuuucu

SEQ ID NO: 3405088 - RNA, 21 nt, Human
gcuuggaaagcaucaccucag

SEQ ID NO: 3405089 - RNA, 18 nt, Human
gcuuggaagagccugcag

SEQ ID NO: 3405090 - RNA, 16 nt, Human
gcuuggacggcugggc

SEQ ID NO: 3405091 - RNA, 12 nt, Human
gcuuggacugga

SEQ ID NO: 3405092 - RNA, 14 nt, Human
gcuuggagcugagc

SEQ ID NO: 3405093 - RNA, 14 nt, Human
gcuuggaggaagga

SEQ ID NO: 3405094 - RNA, 13 nt, Human
gcuuggcagccga

SEQ ID NO: 3405095 - RNA, 15 nt, Human
gcuuggcccuuuccu

SEQ ID NO: 3405096 - RNA, 14 nt, Human
gcuuggcugcuugg

SEQ ID NO: 3405097 - RNA, 19 nt, Human
gcuugggaccgccagaugg

SEQ ID NO: 3405098 - RNA, 20 nt, Human
gcuugggagagccccugggg

SEQ ID NO: 3405099 - RNA, 17 nt, Human
gcuugggauuugcugug

SEQ ID NO: 3405100 - RNA, 17 nt, Human
gcuugggcccagcuggg

SEQ ID NO: 3405101 - RNA, 19 nt, Human
gcuugggcuucauccuccu

SEQ ID NO: 3405102 - RNA, 23 nt, Human
gcuugggcuucauccuccucaga

SEQ ID NO: 3405103 - RNA, 18 nt, Human
gcuuggggaccagagcug

SEQ ID NO: 3405104 - RNA, 22 nt, Human
gcuuggggaccagagcugccac

SEQ ID NO: 3405105 - RNA, 22 nt, Human
gcuuggggccaccaaagcugcc

SEQ ID NO: 3405106 - RNA, 13 nt, Human
gcuuggggccagg

SEQ ID NO: 3405107 - RNA, 16 nt, Human
gcuuggggcuuccuaa

SEQ ID NO: 3405108 - RNA, 22 nt, Human
gcuuggggggugaugagggcag

SEQ ID NO: 3405109 - RNA, 14 nt, Human
gcuuggguggagaa

SEQ ID NO: 3405110 - RNA, 16 nt, Human
gcuuggguggagaagc

SEQ ID NO: 3405111 - RNA, 17 nt, Human
gcuuggguggagaagcc

SEQ ID NO: 3405112 - RNA, 22 nt, Human
gcuuggguguaacaggucuccu

SEQ ID NO: 3405113 - RNA, 23 nt, Human
gcuuggguguaacaggucuccuc

SEQ ID NO: 3405114 - RNA, 13 nt, Human
gcuuggucuguuu

SEQ ID NO: 3405115 - RNA, 15 nt, Human
gcuuggucuguuuga

SEQ ID NO: 3405116 - RNA, 18 nt, Human
gcuuguaaauagcucagg

SEQ ID NO: 3405117 - RNA, 20 nt, Human
gcuuguaaauagcucaggug

SEQ ID NO: 3405118 - RNA, 22 nt, Human
gcuuguaacuaaaauaauuuug

SEQ ID NO: 3405119 - RNA, 22 nt, Human
gcuuguaacuccaccaacccau

SEQ ID NO: 3405120 - RNA, 16 nt, Human
gcuuguacacucauuc

SEQ ID NO: 3405121 - RNA, 12 nt, Human
gcuuguacauaa

SEQ ID NO: 3405122 - RNA, 17 nt, Human
gcuuguaccucuggcug

SEQ ID NO: 3405123 - RNA, 18 nt, Human
gcuuguaccucuggcuga

SEQ ID NO: 3405124 - RNA, 23 nt, Human
gcuuguagaacucacucugggcu

SEQ ID NO: 3405125 - RNA, 14 nt, Human
gcuuguagccagcc

SEQ ID NO: 3405126 - RNA, 16 nt, Human
gcuuguagccagccgg

SEQ ID NO: 3405127 - RNA, 22 nt, Human
gcuuguaggagcugagguuuca

SEQ ID NO: 3405128 - RNA, 13 nt, Human
gcuuguaguucuu

SEQ ID NO: 3405129 - RNA, 14 nt, Human
gcuuguauagugua

SEQ ID NO: 3405130 - RNA, 16 nt, Human
gcuugucagagcuggg

SEQ ID NO: 3405131 - RNA, 17 nt, Human
gcuugucagagcuggga

SEQ ID NO: 3405132 - RNA, 18 nt, Human
gcuugucagagcugggag

SEQ ID NO: 3405133 - RNA, 21 nt, Human
gcuuguccaacccgaggcccg

SEQ ID NO: 3405134 - RNA, 18 nt, Human
gcuugugcagaaaacauu

SEQ ID NO: 3405135 - RNA, 19 nt, Human
gcuuguggcuccacacaca

SEQ ID NO: 3405136 - RNA, 22 nt, Human
gcuuguggcuccacacacacaa

SEQ ID NO: 3405137 - RNA, 13 nt, Human
gcuuguuaaugcu

SEQ ID NO: 3405138 - RNA, 18 nt, Human
gcuuguuccaaugccaca

SEQ ID NO: 3405139 - RNA, 16 nt, Human
gcuuguugugcuuuua

SEQ ID NO: 3405140 - RNA, 11 nt, Human
gcuuguuuaca

SEQ ID NO: 3405141 - RNA, 15 nt, Human
gcuuguuuccuagca

SEQ ID NO: 3405142 - RNA, 20 nt, Human
gcuuuaaaauucucuuccaa

SEQ ID NO: 3405143 - RNA, 22 nt, Human
gcuuuaaacauugguucuugua

SEQ ID NO: 3405144 - RNA, 16 nt, Human
gcuuuaaacucaggga

SEQ ID NO: 3405145 - RNA, 18 nt, Human
gcuuuaaacucagggaca

SEQ ID NO: 3405146 - RNA, 17 nt, Human
ggaaaugucaacaagua

SEQ ID NO: 3405147 - RNA, 18 nt, Human
ggaaauguuuuguaaaca

SEQ ID NO: 3405148 - RNA, 19 nt, Human
ggaaauucccuucaucugg

SEQ ID NO: 3405149 - RNA, 20 nt, Human
ggaaauucccuucaucugga

SEQ ID NO: 3405150 - RNA, 16 nt, Human
ggaaauuccuguacug

SEQ ID NO: 3405151 - RNA, 16 nt, Human
ggaaauucugcucaga

SEQ ID NO: 3405152 - RNA, 23 nt, Human
ggaaauuuuacaagggcauaaag

SEQ ID NO: 3405153 - RNA, 21 nt, Human
ggaacaaggcaaggcugucaa

SEQ ID NO: 3405154 - RNA, 15 nt, Human
ggaacaauugaagua

SEQ ID NO: 3405155 - RNA, 21 nt, Human
ggaacaauugaaguaaacuuu

SEQ ID NO: 3405156 - RNA, 14 nt, Human
ggaacacacuugga

SEQ ID NO: 3405157 - RNA, 17 nt, Human
ggaacaccauaggucac

SEQ ID NO: 3405158 - RNA, 13 nt, Human
ggaacaccuccuc

SEQ ID NO: 3405159 - RNA, 13 nt, Human
ggaacacugcccu

SEQ ID NO: 3405160 - RNA, 21 nt, Human
ggaacacuggggacuuggccu

SEQ ID NO: 3405161 - RNA, 19 nt, Human
ggaacagaaggaugaauga

SEQ ID NO: 3405162 - RNA, 13 nt, Human
ggaacagacagga

SEQ ID NO: 3405163 - RNA, 11 nt, Human
ggaacagcaga

SEQ ID NO: 3405164 - RNA, 19 nt, Human
ggaacagugugcaaggcag

SEQ ID NO: 3405165 - RNA, 13 nt, Human
ggaacauaaaaag

SEQ ID NO: 3405166 - RNA, 22 nt, Human
ggaacaucaucaaggcacugcc

SEQ ID NO: 3405167 - RNA, 18 nt, Human
ggaacauuuauuuuauga

SEQ ID NO: 3405168 - RNA, 22 nt, Human
ggaacauuucuguaaauaccau

SEQ ID NO: 3405169 - RNA, 21 nt, Human
ggaaccaaagcgaauuuuaaa

SEQ ID NO: 3405170 - RNA, 19 nt, Human
ggaaccagacucuugccug

SEQ ID NO: 3405171 - RNA, 15 nt, Human
ggaacccagacucag

SEQ ID NO: 3405172 - RNA, 20 nt, Human
ggaacccagcaguucuguua

SEQ ID NO: 3405173 - RNA, 15 nt, Human
ggaaccgaaaggcca

SEQ ID NO: 3405174 - RNA, 16 nt, Human
ggaaccgcaggaagcu

SEQ ID NO: 3405175 - RNA, 18 nt, Human
ggaaccgcaggaagcugc

SEQ ID NO: 3405176 - RNA, 19 nt, Human
ggaaccgcucaccuagagc

SEQ ID NO: 3405177 - RNA, 21 nt, Human
ggaaccgcucaccuagagcca

SEQ ID NO: 3405178 - RNA, 21 nt, Human
ggaaccguaggacccaagcag

SEQ ID NO: 3405179 - RNA, 21 nt, Human
ggaaccgugguaugucugcca

SEQ ID NO: 3405180 - RNA, 21 nt, Human
ggaaccucacucuugccaacc

SEQ ID NO: 3405181 - RNA, 13 nt, Human
ggaaccucagccu

SEQ ID NO: 3405182 - RNA, 19 nt, Human
ggaaccucagccuggccag

SEQ ID NO: 3405183 - RNA, 20 nt, Human
ggaaccucagccuggccaga

SEQ ID NO: 3405184 - RNA, 21 nt, Human
ggaaccucagccuggccagac

SEQ ID NO: 3405185 - RNA, 14 nt, Human
ggaaccucccagag

SEQ ID NO: 3405186 - RNA, 16 nt, Human
ggaaccucccagaggu

SEQ ID NO: 3405187 - RNA, 14 nt, Human
ggaaccuccccagc

SEQ ID NO: 3405188 - RNA, 12 nt, Human
ggaaccuccuuu

SEQ ID NO: 3405189 - RNA, 18 nt, Human
ggaaccucgaguacugug

SEQ ID NO: 3405190 - RNA, 15 nt, Human
ggaaccugcaaaaaa

SEQ ID NO: 3405191 - RNA, 22 nt, Human
ggaaccuguccuaaggaaccuu

SEQ ID NO: 3405192 - RNA, 18 nt, Human
ggaaccugugagcugcac

SEQ ID NO: 3405193 - RNA, 20 nt, Human
ggaaccuuccuuccugcuug

SEQ ID NO: 3405194 - RNA, 14 nt, Human
ggaacgaugugucu

SEQ ID NO: 3405195 - RNA, 16 nt, Human
ggaacgcguugaaauu

SEQ ID NO: 3405196 - RNA, 17 nt, Human
ggaacggaucagauguc

SEQ ID NO: 3405197 - RNA, 18 nt, Human
ggaacgggguccuucaag

SEQ ID NO: 3405198 - RNA, 17 nt, Human
ggaacucaccuggggcu

SEQ ID NO: 3405199 - RNA, 17 nt, Human
ggaacucaucugguuga

SEQ ID NO: 3405200 - RNA, 22 nt, Human
ggaacucauuccugccugucuc

SEQ ID NO: 3405201 - RNA, 15 nt, Human
ggaacucccaagaac

SEQ ID NO: 3405202 - RNA, 23 nt, Human
ggaacucccaagaacagcaggcc

SEQ ID NO: 3405203 - RNA, 11 nt, Human
ggaacucccag

SEQ ID NO: 3405204 - RNA, 22 nt, Human
ggaacucccagcaacacaagcu

SEQ ID NO: 3405205 - RNA, 19 nt, Human
ggaacucuaucugggccug

SEQ ID NO: 3405206 - RNA, 21 nt, Human
ggaacucuaucugggccuggg

SEQ ID NO: 3405207 - RNA, 12 nt, Human
ggaacucugaca

SEQ ID NO: 3405208 - RNA, 20 nt, Human
ggaacucuggcuuccaggua

SEQ ID NO: 3405209 - RNA, 15 nt, Human
ggaacugcaugcugc

SEQ ID NO: 3405210 - RNA, 16 nt, Human
ggaacugcaugcugcu

SEQ ID NO: 3405211 - RNA, 13 nt, Human
ggaacugcugcca

SEQ ID NO: 3405212 - RNA, 17 nt, Human
ggaacugcugccacuga

SEQ ID NO: 3405213 - RNA, 14 nt, Human
ggaacugcugggcu

SEQ ID NO: 3405214 - RNA, 16 nt, Human
ggaacuggccaagcug

SEQ ID NO: 3405215 - RNA, 16 nt, Human
ggaacuguccagagag

SEQ ID NO: 3405216 - RNA, 18 nt, Human
ggaacuguccagagagca

SEQ ID NO: 3405217 - RNA, 13 nt, Human
ggaacuugagaac

SEQ ID NO: 3405218 - RNA, 17 nt, Human
ggaacuugccugccuuu

SEQ ID NO: 3405219 - RNA, 15 nt, Human
ggaagaaaacacugu

SEQ ID NO: 3405220 - RNA, 14 nt, Human
ggaagaaaagagcu

SEQ ID NO: 3405221 - RNA, 14 nt, Human
ggaagaaaaugguu

SEQ ID NO: 3405222 - RNA, 15 nt, Human
ggaagaaagaauguu

SEQ ID NO: 3405223 - RNA, 15 nt, Human
ggaagaacaggccuc

SEQ ID NO: 3405224 - RNA, 14 nt, Human
ggaagaacauagaa

SEQ ID NO: 3405225 - RNA, 20 nt, Human
ggaagaagagaucaggaaga

SEQ ID NO: 3405226 - RNA, 22 nt, Human
ggaagaagagaucaggaagaga

SEQ ID NO: 3405227 - RNA, 14 nt, Human
ggaagaagggagaa

SEQ ID NO: 3405228 - RNA, 15 nt, Human
ggaagaagggagaag

SEQ ID NO: 3405229 - RNA, 18 nt, Human
ggaagaagggagaagaaa

SEQ ID NO: 3405230 - RNA, 23 nt, Human
ggaagaauagggcccaugggagg

SEQ ID NO: 3405231 - RNA, 13 nt, Human
ggaagaaugaaag

SEQ ID NO: 3405232 - RNA, 16 nt, Human
ggaagaaugaaagcug

SEQ ID NO: 3405233 - RNA, 16 nt, Human
ggaagacaaugugaaa

SEQ ID NO: 3405234 - RNA, 22 nt, Human
ggaagacaaugugaaaagaaaa

SEQ ID NO: 3405235 - RNA, 13 nt, Human
ggaagacagcucu

SEQ ID NO: 3405236 - RNA, 22 nt, Human
ggaagacauggggaggaaggac

SEQ ID NO: 3405237 - RNA, 15 nt, Human
ggaagacauuuuucc

SEQ ID NO: 3405238 - RNA, 20 nt, Human
ggaagacccaacacauggga

SEQ ID NO: 3405239 - RNA, 17 nt, Human
ggaagacccauuccuuc

SEQ ID NO: 3405240 - RNA, 23 nt, Human
ggaagaccccacccaagcuuggc

SEQ ID NO: 3405241 - RNA, 15 nt, Human
ggaagacgaggcccu

SEQ ID NO: 3405242 - RNA, 16 nt, Human
ggaagacgaggcccuc

SEQ ID NO: 3405243 - RNA, 16 nt, Human
ggaagacgccugagcu

SEQ ID NO: 3405244 - RNA, 17 nt, Human
ggaagacuuuggaaaga

SEQ ID NO: 3405245 - RNA, 17 nt, Human
ggaagagacagcccagg

SEQ ID NO: 3405246 - RNA, 13 nt, Human
ggaagagagaaag

SEQ ID NO: 3405247 - RNA, 21 nt, Human
ggaagagagccugcaggaucu

SEQ ID NO: 3405248 - RNA, 19 nt, Human
ggaagagaggaguucaaug

SEQ ID NO: 3405249 - RNA, 17 nt, Human
ggaagagcacagcccuc

SEQ ID NO: 3405250 - RNA, 18 nt, Human
ggaagagcacagcccucc

SEQ ID NO: 3405251 - RNA, 19 nt, Human
ggaagagcagaacggagcc

SEQ ID NO: 3405252 - RNA, 13 nt, Human
ggaagagcaggac

SEQ ID NO: 3405253 - RNA, 23 nt, Human
ggaagagcaggacuccaggccca

SEQ ID NO: 3405254 - RNA, 21 nt, Human
ggaagagcaggcacauggagg

SEQ ID NO: 3405255 - RNA, 20 nt, Human
ggaagagccuuccacccagg

SEQ ID NO: 3405256 - RNA, 18 nt, Human
ggaagaggaaaaggcugg

SEQ ID NO: 3405257 - RNA, 14 nt, Human
ggaagaggaaaauu

SEQ ID NO: 3405258 - RNA, 14 nt, Human
ggaagaggggacag

SEQ ID NO: 3405259 - RNA, 22 nt, Human
ggaagaggggugcagaggcugu

SEQ ID NO: 3405260 - RNA, 20 nt, Human
ggaagagugacucuccaggg

SEQ ID NO: 3405261 - RNA, 19 nt, Human
ggaagaguguacugggggu

SEQ ID NO: 3405262 - RNA, 14 nt, Human
ggaagagugugugu

SEQ ID NO: 3405263 - RNA, 18 nt, Human
ggaagauaggcucugcac

SEQ ID NO: 3405264 - RNA, 21 nt, Human
ggaagauaggcucugcacaga

SEQ ID NO: 3405265 - RNA, 22 nt, Human
ggaagaucccccagaaaagaaa

SEQ ID NO: 3405266 - RNA, 14 nt, Human
ggaagaucccuuug

SEQ ID NO: 3405267 - RNA, 22 nt, Human
ggaagauccugcggguggggcu

SEQ ID NO: 3405268 - RNA, 16 nt, Human
ggaagauccugugagg

SEQ ID NO: 3405269 - RNA, 19 nt, Human
ggaagauccugugaggagc

SEQ ID NO: 3405270 - RNA, 19 nt, Human
ggaagaucucugcagggcc

SEQ ID NO: 3405271 - RNA, 22 nt, Human
ggaagaucuuaaauuuugugau

SEQ ID NO: 3405272 - RNA, 18 nt, Human
ggaagauuucuaaauaaa

SEQ ID NO: 3405273 - RNA, 16 nt, Human
ggaagcacagaaaacu

SEQ ID NO: 3405274 - RNA, 17 nt, Human
ggaagcacagcuucauu

SEQ ID NO: 3405275 - RNA, 22 nt, Human
ggaagcacaugccucucucagg

SEQ ID NO: 3405276 - RNA, 23 nt, Human
ggaagcacauguuuauuuauucu

SEQ ID NO: 3405277 - RNA, 13 nt, Human
ggaagcagaagga

SEQ ID NO: 3405278 - RNA, 12 nt, Human
ggaagcagaaua

SEQ ID NO: 3405279 - RNA, 20 nt, Human
ggaagcagugccuuccauaa

SEQ ID NO: 3405280 - RNA, 18 nt, Human
ggaagcauucagagagca

SEQ ID NO: 3405281 - RNA, 19 nt, Human
ggaagcauuuguuucuacu

SEQ ID NO: 3405282 - RNA, 22 nt, Human
ggaagccaaaccucugugagca

SEQ ID NO: 3405283 - RNA, 18 nt, Human
ggaagccaacuuggcuuu

SEQ ID NO: 3405284 - RNA, 23 nt, Human
ggaagcccagccccuacugcugu

SEQ ID NO: 3405285 - RNA, 16 nt, Human
ggaagcccagcuccag

SEQ ID NO: 3405286 - RNA, 19 nt, Human
ggaagcccaggagccucac

SEQ ID NO: 3405287 - RNA, 17 nt, Human
ggaagcccauccugacc

SEQ ID NO: 3405288 - RNA, 20 nt, Human
ggaagcccauccugaccagc

SEQ ID NO: 3405289 - RNA, 13 nt, Human
ggaagccccacau

SEQ ID NO: 3405290 - RNA, 10 nt, Human
ggacccagac

SEQ ID NO: 3405291 - RNA, 13 nt, Human
ggacccagaccca

SEQ ID NO: 3405292 - RNA, 21 nt, Human
ggacccagaggaaggggccag

SEQ ID NO: 3405293 - RNA, 15 nt, Human
ggacccagccaggcc

SEQ ID NO: 3405294 - RNA, 20 nt, Human
ggacccagccaggcccagcc

SEQ ID NO: 3405295 - RNA, 10 nt, Human
ggacccagga

SEQ ID NO: 3405296 - RNA, 14 nt, Human
ggacccagggauga

SEQ ID NO: 3405297 - RNA, 13 nt, Human
ggacccagggcuc

SEQ ID NO: 3405298 - RNA, 16 nt, Human
ggacccagugcagaau

SEQ ID NO: 3405299 - RNA, 11 nt, Human
ggacccagugg

SEQ ID NO: 3405300 - RNA, 16 nt, Human
ggacccaguggcaggg

SEQ ID NO: 3405301 - RNA, 18 nt, Human
ggacccaguggcagggca

SEQ ID NO: 3405302 - RNA, 22 nt, Human
ggacccaugaguuggggucugg

SEQ ID NO: 3405303 - RNA, 14 nt, Human
ggaccccagccuca

SEQ ID NO: 3405304 - RNA, 15 nt, Human
ggaccccagcucugc

SEQ ID NO: 3405305 - RNA, 12 nt, Human
ggaccccagcug

SEQ ID NO: 3405306 - RNA, 21 nt, Human
ggaccccagcugggaggcaag

SEQ ID NO: 3405307 - RNA, 20 nt, Human
ggaccccaucugugaauaag

SEQ ID NO: 3405308 - RNA, 19 nt, Human
ggacccccaggacaggcug

SEQ ID NO: 3405309 - RNA, 16 nt, Human
ggacccccgcccccug

SEQ ID NO: 3405310 - RNA, 13 nt, Human
ggaccccugcccu

SEQ ID NO: 3405311 - RNA, 15 nt, Human
ggacccgcucuggac

SEQ ID NO: 3405312 - RNA, 16 nt, Human
ggacccuccaaggcca

SEQ ID NO: 3405313 - RNA, 21 nt, Human
ggacccuccgcucuguagugc

SEQ ID NO: 3405314 - RNA, 17 nt, Human
ggacccucgcuggcccc

SEQ ID NO: 3405315 - RNA, 18 nt, Human
ggacccucgcuggccccc

SEQ ID NO: 3405316 - RNA, 14 nt, Human
ggacccugaaaugu

SEQ ID NO: 3405317 - RNA, 14 nt, Human
ggacccugaggccc

SEQ ID NO: 3405318 - RNA, 15 nt, Human
ggacccugaggccca

SEQ ID NO: 3405319 - RNA, 18 nt, Human
ggacccugaggcccagag

SEQ ID NO: 3405320 - RNA, 16 nt, Human
ggacccugugacaugg

SEQ ID NO: 3405321 - RNA, 18 nt, Human
ggacccuuuuuguuauga

SEQ ID NO: 3405322 - RNA, 15 nt, Human
ggaccgccaaagaau

SEQ ID NO: 3405323 - RNA, 15 nt, Human
ggaccgccagauggg

SEQ ID NO: 3405324 - RNA, 18 nt, Human
ggaccggagagugggggu

SEQ ID NO: 3405325 - RNA, 19 nt, Human
ggaccggagagugggggug

SEQ ID NO: 3405326 - RNA, 22 nt, Human
ggaccuagggaggcauggucug

SEQ ID NO: 3405327 - RNA, 23 nt, Human
ggaccuagggaggcauggucugc

SEQ ID NO: 3405328 - RNA, 13 nt, Human
ggaccucaccaag

SEQ ID NO: 3405329 - RNA, 16 nt, Human
ggaccucagcugcuuc

SEQ ID NO: 3405330 - RNA, 12 nt, Human
ggaccucaggcc

SEQ ID NO: 3405331 - RNA, 14 nt, Human
ggaccucaggccug

SEQ ID NO: 3405332 - RNA, 14 nt, Human
ggaccuccccugag

SEQ ID NO: 3405333 - RNA, 16 nt, Human
ggaccuccucuucccc

SEQ ID NO: 3405334 - RNA, 13 nt, Human
ggaccucgugcca

SEQ ID NO: 3405335 - RNA, 17 nt, Human
ggaccucugcucugagg

SEQ ID NO: 3405336 - RNA, 12 nt, Human
ggaccucugggc

SEQ ID NO: 3405337 - RNA, 23 nt, Human
ggaccugagccugccgagcaacc

SEQ ID NO: 3405338 - RNA, 14 nt, Human
ggaccugccaggca

SEQ ID NO: 3405339 - RNA, 11 nt, Human
ggaccugcccc

SEQ ID NO: 3405340 - RNA, 13 nt, Human
ggaccugccugca

SEQ ID NO: 3405341 - RNA, 14 nt, Human
ggaccuggcugcca

SEQ ID NO: 3405342 - RNA, 15 nt, Human
ggaccuggggcacag

SEQ ID NO: 3405343 - RNA, 22 nt, Human
ggaccuguauuuaagcaaauac

SEQ ID NO: 3405344 - RNA, 23 nt, Human
ggaccuguauuuaagcaaauacu

SEQ ID NO: 3405345 - RNA, 20 nt, Human
ggaccuuacgaucaggcaca

SEQ ID NO: 3405346 - RNA, 18 nt, Human
ggaccuuaggccuuccuc

SEQ ID NO: 3405347 - RNA, 22 nt, Human
ggaccuuaucugugcgugaaac

SEQ ID NO: 3405348 - RNA, 21 nt, Human
ggaccuucacucuaagauguu

SEQ ID NO: 3405349 - RNA, 12 nt, Human
ggaccuuccugc

SEQ ID NO: 3405350 - RNA, 13 nt, Human
ggaccuuccugcc

SEQ ID NO: 3405351 - RNA, 15 nt, Human
ggaccuugaacuggg

SEQ ID NO: 3405352 - RNA, 17 nt, Human
ggaccuugaacugggua

SEQ ID NO: 3405353 - RNA, 15 nt, Human
ggaccuuucagcugu

SEQ ID NO: 3405354 - RNA, 21 nt, Human
ggaccuuuuaaaguguuucag

SEQ ID NO: 3405355 - RNA, 16 nt, Human
ggaccuuuuguuuucu

SEQ ID NO: 3405356 - RNA, 23 nt, Human
ggacgacacggucggggcaucug

SEQ ID NO: 3405357 - RNA, 19 nt, Human
ggacgccacucauuucauc

SEQ ID NO: 3405358 - RNA, 17 nt, Human
ggacgcccaggacccca

SEQ ID NO: 3405359 - RNA, 19 nt, Human
ggacgccugggggugccag

SEQ ID NO: 3405360 - RNA, 17 nt, Human
ggacgcuacccgggaag

SEQ ID NO: 3405361 - RNA, 17 nt, Human
ggacgcugaccguggag

SEQ ID NO: 3405362 - RNA, 12 nt, Human
ggacggccaaga

SEQ ID NO: 3405363 - RNA, 22 nt, Human
ggacggccugaugcucccuccc

SEQ ID NO: 3405364 - RNA, 15 nt, Human
ggacggcugggcaca

SEQ ID NO: 3405365 - RNA, 19 nt, Human
ggacggggggccccaguca

SEQ ID NO: 3405366 - RNA, 21 nt, Human
ggacggggggccccagucagc

SEQ ID NO: 3405367 - RNA, 23 nt, Human
ggacggggggccccagucagccu

SEQ ID NO: 3405368 - RNA, 19 nt, Human
ggacggugcccaagccaga

SEQ ID NO: 3405369 - RNA, 15 nt, Human
ggacggugcuccagg

SEQ ID NO: 3405370 - RNA, 20 nt, Human
ggacggugcuccaggcaggc

SEQ ID NO: 3405371 - RNA, 21 nt, Human
ggacguacguaauaagguuuu

SEQ ID NO: 3405372 - RNA, 13 nt, Human
ggacguccuccaa

SEQ ID NO: 3405373 - RNA, 18 nt, Human
ggacguccugccaccugg

SEQ ID NO: 3405374 - RNA, 13 nt, Human
ggacgucuuucuu

SEQ ID NO: 3405375 - RNA, 12 nt, Human
ggacgugcuggg

SEQ ID NO: 3405376 - RNA, 13 nt, Human
ggacgugggcugg

SEQ ID NO: 3405377 - RNA, 14 nt, Human
ggacguuccagccg

SEQ ID NO: 3405378 - RNA, 12 nt, Human
ggacuaaaagau

SEQ ID NO: 3405379 - RNA, 16 nt, Human
ggacuaggguccuggg

SEQ ID NO: 3405380 - RNA, 15 nt, Human
ggacuauagcccagg

SEQ ID NO: 3405381 - RNA, 23 nt, Human
ggacuauauuugggccugcucca

SEQ ID NO: 3405382 - RNA, 16 nt, Human
ggacucaaguuucuuc

SEQ ID NO: 3405383 - RNA, 19 nt, Human
ggacucaaguuucuucaau

SEQ ID NO: 3405384 - RNA, 18 nt, Human
ggacucaaugcacugaca

SEQ ID NO: 3405385 - RNA, 18 nt, Human
ggacucaauuucucccca

SEQ ID NO: 3405386 - RNA, 20 nt, Human
ggacucacagguuggaagag

SEQ ID NO: 3405387 - RNA, 23 nt, Human
ggacucacagguuggaagagaau

SEQ ID NO: 3405388 - RNA, 15 nt, Human
ggacucacuggcagc

SEQ ID NO: 3405389 - RNA, 19 nt, Human
ggacucacuggcagcccca

SEQ ID NO: 3405390 - RNA, 17 nt, Human
ggacucagaagccucug

SEQ ID NO: 3405391 - RNA, 18 nt, Human
ggacucagaagccucugg

SEQ ID NO: 3405392 - RNA, 15 nt, Human
ggacucagcccugag

SEQ ID NO: 3405393 - RNA, 21 nt, Human
ggacucagccuucagacagag

SEQ ID NO: 3405394 - RNA, 18 nt, Human
ggacucaggaugcccagg

SEQ ID NO: 3405395 - RNA, 16 nt, Human
ggacucaggcgggaca

SEQ ID NO: 3405396 - RNA, 13 nt, Human
ggacucagggcag

SEQ ID NO: 3405397 - RNA, 22 nt, Human
ggacucagggcagcgccaggcu

SEQ ID NO: 3405398 - RNA, 22 nt, Human
ggacucaucuuucccuccuugg

SEQ ID NO: 3405399 - RNA, 20 nt, Human
ggacuccacccauccuauca

SEQ ID NO: 3405400 - RNA, 18 nt, Human
ggacuccagaaucuaaag

SEQ ID NO: 3405401 - RNA, 19 nt, Human
ggacuccagacucucugug

SEQ ID NO: 3405402 - RNA, 10 nt, Human
ggacuccagc

SEQ ID NO: 3405403 - RNA, 23 nt, Human
ggacuccaggcccaaggcucccg

SEQ ID NO: 3405404 - RNA, 16 nt, Human
ggacuccccaggccag

SEQ ID NO: 3405405 - RNA, 20 nt, Human
ggacucccuccucaccucug

SEQ ID NO: 3405406 - RNA, 16 nt, Human
ggacuccggcccuccu

SEQ ID NO: 3405407 - RNA, 22 nt, Human
ggacuccuccccacccuccugg

SEQ ID NO: 3405408 - RNA, 15 nt, Human
ggacuccuccuuucu

SEQ ID NO: 3405409 - RNA, 17 nt, Human
ggacuccuccuuucucc

SEQ ID NO: 3405410 - RNA, 14 nt, Human
ggacuccucugucc

SEQ ID NO: 3405411 - RNA, 11 nt, Human
ggacuccugaa

SEQ ID NO: 3405412 - RNA, 16 nt, Human
ggacucgcuuguaaau

SEQ ID NO: 3405413 - RNA, 17 nt, Human
ggacucucagucucuga

SEQ ID NO: 3405414 - RNA, 18 nt, Human
ggacucucagucucugag

SEQ ID NO: 3405415 - RNA, 20 nt, Human
ggacucucagucucugagca

SEQ ID NO: 3405416 - RNA, 21 nt, Human
ggacucucagucucugagcag

SEQ ID NO: 3405417 - RNA, 19 nt, Human
ggacucugagcgggaggca

SEQ ID NO: 3405418 - RNA, 21 nt, Human
ggacucugagcgggaggcaga

SEQ ID NO: 3405419 - RNA, 20 nt, Human
ggacucugcacaugucuugu

SEQ ID NO: 3405420 - RNA, 12 nt, Human
ggacucuguccu

SEQ ID NO: 3405421 - RNA, 21 nt, Human
ggacucuucagcacaaaagga

SEQ ID NO: 3405422 - RNA, 16 nt, Human
ggacugacacccaugu

SEQ ID NO: 3405423 - RNA, 20 nt, Human
ggacugacagcaugugcccu

SEQ ID NO: 3405424 - RNA, 13 nt, Human
ggacugccaccuc

SEQ ID NO: 3405425 - RNA, 15 nt, Human
ggacugccucugcca

SEQ ID NO: 3405426 - RNA, 20 nt, Human
ggacugccuugaauaucccc

SEQ ID NO: 3405427 - RNA, 19 nt, Human
ggacugcuaaauaaaauuu

SEQ ID NO: 3405428 - RNA, 22 nt, Human
ggacugcuaccuuucaaagcuu

SEQ ID NO: 3405429 - RNA, 16 nt, Human
ggacugcucaggaaac

SEQ ID NO: 3405430 - RNA, 17 nt, Human
ggacugcugcugccugg

SEQ ID NO: 3405431 - RNA, 17 nt, Human
ggacuggaaccagggag

SEQ ID NO: 3405432 - RNA, 17 nt, Human
ggacuggagucccugug

SEQ ID NO: 3405433 - RNA, 15 nt, Human
ggacuggaguggagc

SEQ ID NO: 3405434 - RNA, 14 nt, Human
ggacuggccccugg

SEQ ID NO: 3405435 - RNA, 15 nt, Human
ggacuggccccuggg

SEQ ID NO: 3405436 - RNA, 23 nt, Human
ggcaggucuugaacuccuggccu

SEQ ID NO: 3405437 - RNA, 16 nt, Human
ggcaggugccuccagg

SEQ ID NO: 3405438 - RNA, 19 nt, Human
ggcaggugcuggagcacug

SEQ ID NO: 3405439 - RNA, 20 nt, Human
ggcaggugcuggagcacugg

SEQ ID NO: 3405440 - RNA, 14 nt, Human
ggcaggugguggca

SEQ ID NO: 3405441 - RNA, 20 nt, Human
ggcagguuagaaccuagaag

SEQ ID NO: 3405442 - RNA, 15 nt, Human
ggcaguaaagagaaa

SEQ ID NO: 3405443 - RNA, 14 nt, Human
ggcaguaauaaaaa

SEQ ID NO: 3405444 - RNA, 20 nt, Human
ggcaguaccugagggucugu

SEQ ID NO: 3405445 - RNA, 23 nt, Human
ggcaguagcuguggugagguggg

SEQ ID NO: 3405446 - RNA, 20 nt, Human
ggcagucauuggcugucucc

SEQ ID NO: 3405447 - RNA, 16 nt, Human
ggcaguccgugggacg

SEQ ID NO: 3405448 - RNA, 23 nt, Human
ggcagucgggggcuggccuagga

SEQ ID NO: 3405449 - RNA, 14 nt, Human
ggcagucuggaggg

SEQ ID NO: 3405450 - RNA, 16 nt, Human
ggcagucuggaggggc

SEQ ID NO: 3405451 - RNA, 18 nt, Human
ggcagugagugagccugg

SEQ ID NO: 3405452 - RNA, 17 nt, Human
ggcagugcgggaggaau

SEQ ID NO: 3405453 - RNA, 24 nt, Human
ggcagugcuagugagcugggcaug

SEQ ID NO: 3405454 - RNA, 18 nt, Human
ggcagugcuuggcccagg

SEQ ID NO: 3405455 - RNA, 19 nt, Human
ggcagugcuuggcccagga

SEQ ID NO: 3405456 - RNA, 15 nt, Human
ggcagugggaaaaau

SEQ ID NO: 3405457 - RNA, 13 nt, Human
ggcagugggagcu

SEQ ID NO: 3405458 - RNA, 20 nt, Human
ggcagugguaagcucuggcu

SEQ ID NO: 3405459 - RNA, 20 nt, Human
ggcaguggugguuuucuguu

SEQ ID NO: 3405460 - RNA, 11 nt, Human
ggcaguuacau

SEQ ID NO: 3405461 - RNA, 22 nt, Human
ggcaguuaccauuaaaccaucu

SEQ ID NO: 3405462 - RNA, 23 nt, Human
ggcaguuaccauuaaaccaucuc

SEQ ID NO: 3405463 - RNA, 20 nt, Human
ggcaguuagagaugccuccc

SEQ ID NO: 3405464 - RNA, 15 nt, Human
ggcaguucgcagcca

SEQ ID NO: 3405465 - RNA, 18 nt, Human
ggcaguucgcagccaccc

SEQ ID NO: 3405466 - RNA, 19 nt, Human
ggcaguucgcagccacccu

SEQ ID NO: 3405467 - RNA, 20 nt, Human
ggcaguucgcagccacccug

SEQ ID NO: 3405468 - RNA, 21 nt, Human
ggcaguucugggugcucccua

SEQ ID NO: 3405469 - RNA, 21 nt, Human
ggcaguuuugacaucagccag

SEQ ID NO: 3405470 - RNA, 15 nt, Human
ggcaguuuuucugua

SEQ ID NO: 3405471 - RNA, 19 nt, Human
ggcaguuuuucuguauuuu

SEQ ID NO: 3405472 - RNA, 14 nt, Human
ggcauaaacuguuu

SEQ ID NO: 3405473 - RNA, 17 nt, Human
ggcauaacauaaaucug

SEQ ID NO: 3405474 - RNA, 22 nt, Human
ggcauacgagagcagaggucuc

SEQ ID NO: 3405475 - RNA, 21 nt, Human
ggcauacgccuguaguccuag

SEQ ID NO: 3405476 - RNA, 22 nt, Human
ggcauagaggcuucuccgccag

SEQ ID NO: 3405477 - RNA, 21 nt, Human
ggcauagcccagacacagaag

SEQ ID NO: 3405478 - RNA, 15 nt, Human
ggcauaggccugggu

SEQ ID NO: 3405479 - RNA, 23 nt, Human
ggcauauauguacuaguggcaug

SEQ ID NO: 3405480 - RNA, 22 nt, Human
ggcauauccaccaccucccuca

SEQ ID NO: 3405481 - RNA, 21 nt, Human
ggcaucaagaggugggagggc

SEQ ID NO: 3405482 - RNA, 18 nt, Human
ggcaucaccuuaggcagg

SEQ ID NO: 3405483 - RNA, 20 nt, Human
ggcaucaguguccuuggcag

SEQ ID NO: 3405484 - RNA, 17 nt, Human
ggcaucaucaauaaaac

SEQ ID NO: 3405485 - RNA, 13 nt, Human
ggcaucaugcaug

SEQ ID NO: 3405486 - RNA, 16 nt, Human
ggcauccagagucccu

SEQ ID NO: 3405487 - RNA, 18 nt, Human
ggcauccagcagucucug

SEQ ID NO: 3405488 - RNA, 15 nt, Human
ggcaucccaggggac

SEQ ID NO: 3405489 - RNA, 18 nt, Human
ggcaucccaguggccuca

SEQ ID NO: 3405490 - RNA, 12 nt, Human
ggcaucccuggg

SEQ ID NO: 3405491 - RNA, 14 nt, Human
ggcauccuccagcc

SEQ ID NO: 3405492 - RNA, 21 nt, Human
ggcaucuagagcuugaugcca

SEQ ID NO: 3405493 - RNA, 16 nt, Human
ggcaucuaucugugcu

SEQ ID NO: 3405494 - RNA, 16 nt, Human
ggcaucuccugugcau

SEQ ID NO: 3405495 - RNA, 14 nt, Human
ggcaucucuguccc

SEQ ID NO: 3405496 - RNA, 15 nt, Human
ggcaucucuguccca

SEQ ID NO: 3405497 - RNA, 14 nt, Human
ggcaucugccccuc

SEQ ID NO: 3405498 - RNA, 18 nt, Human
ggcaucugccccuccccc

SEQ ID NO: 3405499 - RNA, 16 nt, Human
ggcaucuugcuggcua

SEQ ID NO: 3405500 - RNA, 22 nt, Human
ggcaucuuugccuugggcugcu

SEQ ID NO: 3405501 - RNA, 17 nt, Human
ggcaugaaaugaacaca

SEQ ID NO: 3405502 - RNA, 18 nt, Human
ggcaugaacauguacugu

SEQ ID NO: 3405503 - RNA, 23 nt, Human
ggcaugaaguuuccuuggcuggu

SEQ ID NO: 3405504 - RNA, 18 nt, Human
ggcaugacacgaauauug

SEQ ID NO: 3405505 - RNA, 13 nt, Human
ggcaugaccagau

SEQ ID NO: 3405506 - RNA, 12 nt, Human
ggcaugagauag

SEQ ID NO: 3405507 - RNA, 19 nt, Human
ggcaugagggaucacaggg

SEQ ID NO: 3405508 - RNA, 23 nt, Human
ggcaugagggguuccuccccucc

SEQ ID NO: 3405509 - RNA, 15 nt, Human
ggcaugccccggcca

SEQ ID NO: 3405510 - RNA, 22 nt, Human
ggcaugccccggccaccucugc

SEQ ID NO: 3405511 - RNA, 14 nt, Human
ggcaugccugugug

SEQ ID NO: 3405512 - RNA, 19 nt, Human
ggcaugcgcacaaggcuga

SEQ ID NO: 3405513 - RNA, 17 nt, Human
ggcaugcggucgggcag

SEQ ID NO: 3405514 - RNA, 11 nt, Human
ggcaugcuaaa

SEQ ID NO: 3405515 - RNA, 12 nt, Human
ggcaugcugggg

SEQ ID NO: 3405516 - RNA, 13 nt, Human
ggcaugcuggggc

SEQ ID NO: 3405517 - RNA, 15 nt, Human
ggcauggacuucugg

SEQ ID NO: 3405518 - RNA, 18 nt, Human
ggcaugggaaugaauguc

SEQ ID NO: 3405519 - RNA, 22 nt, Human
ggcaugggaaugaaugucagug

SEQ ID NO: 3405520 - RNA, 19 nt, Human
ggcaugguaccagcccugg

SEQ ID NO: 3405521 - RNA, 20 nt, Human
ggcaugguaccagcccuggg

SEQ ID NO: 3405522 - RNA, 21 nt, Human
ggcaugguggcgcaagccugu

SEQ ID NO: 3405523 - RNA, 22 nt, Human
ggcaugguggcgcaagccugua

SEQ ID NO: 3405524 - RNA, 11 nt, Human
ggcauguaaau

SEQ ID NO: 3405525 - RNA, 19 nt, Human
ggcauguauuggccuggag

SEQ ID NO: 3405526 - RNA, 20 nt, Human
ggcauguauuggccuggagg

SEQ ID NO: 3405527 - RNA, 18 nt, Human
ggcaugugaugagaggaa

SEQ ID NO: 3405528 - RNA, 20 nt, Human
ggcauguggccuguggccug

SEQ ID NO: 3405529 - RNA, 16 nt, Human
ggcauuaacacaaagg

SEQ ID NO: 3405530 - RNA, 15 nt, Human
ggcauuccccaggag

SEQ ID NO: 3405531 - RNA, 13 nt, Human
ggcauuccugcuu

SEQ ID NO: 3405532 - RNA, 15 nt, Human
ggcauuccugcuuau

SEQ ID NO: 3405533 - RNA, 12 nt, Human
ggcauuccuucu

SEQ ID NO: 3405534 - RNA, 12 nt, Human
ggcauucucuga

SEQ ID NO: 3405535 - RNA, 18 nt, Human
ggcauucuggaccucugg

SEQ ID NO: 3405536 - RNA, 18 nt, Human
ggcauucuuguacagugu

SEQ ID NO: 3405537 - RNA, 17 nt, Human
ggcauugacaaaucugu

SEQ ID NO: 3405538 - RNA, 19 nt, Human
ggcauugaggaagagucuu

SEQ ID NO: 3405539 - RNA, 11 nt, Human
ggcauugagua

SEQ ID NO: 3405540 - RNA, 19 nt, Human
ggcauugaguauuguuuaa

SEQ ID NO: 3405541 - RNA, 23 nt, Human
ggcauugauggggaaggaggcug

SEQ ID NO: 3405542 - RNA, 21 nt, Human
ggcauuggcagcaggugcugc

SEQ ID NO: 3405543 - RNA, 20 nt, Human
ggcauugguucccuuugcuc

SEQ ID NO: 3405544 - RNA, 16 nt, Human
ggcauuguaucugucu

SEQ ID NO: 3405545 - RNA, 21 nt, Human
ggcauuguaucugucuuucca

SEQ ID NO: 3405546 - RNA, 19 nt, Human
ggcauugucccugugccua

SEQ ID NO: 3405547 - RNA, 12 nt, Human
ggcauuguggga

SEQ ID NO: 3405548 - RNA, 22 nt, Human
ggcauuuguaaauauuaaacca

SEQ ID NO: 3405549 - RNA, 16 nt, Human
ggcauuuuauagacac

SEQ ID NO: 3405550 - RNA, 22 nt, Human
ggcauuuucccccuuggcucuc

SEQ ID NO: 3405551 - RNA, 23 nt, Human
ggccaaaagcuucccucccugcu

SEQ ID NO: 3405552 - RNA, 19 nt, Human
ggccaaaaggaaaaagcuc

SEQ ID NO: 3405553 - RNA, 23 nt, Human
ggccaaacaacagucuucauuuu

SEQ ID NO: 3405554 - RNA, 12 nt, Human
ggccaaaccucu

SEQ ID NO: 3405555 - RNA, 17 nt, Human
ggccaaacucaccugcc

SEQ ID NO: 3405556 - RNA, 21 nt, Human
ggccaaacucaccugccccuc

SEQ ID NO: 3405557 - RNA, 22 nt, Human
ggccaaagaaccaaagaagaaa

SEQ ID NO: 3405558 - RNA, 15 nt, Human
ggccaaagccaaagc

SEQ ID NO: 3405559 - RNA, 16 nt, Human
ggccaaaggaagcaca

SEQ ID NO: 3405560 - RNA, 19 nt, Human
ggccaaaggaagcacaugc

SEQ ID NO: 3405561 - RNA, 21 nt, Human
ggccaaaggaagcacaugccu

SEQ ID NO: 3405562 - RNA, 19 nt, Human
ggccaaaggggaccuggaa

SEQ ID NO: 3405563 - RNA, 23 nt, Human
ggccaaagugccggugagaccca

SEQ ID NO: 3405564 - RNA, 19 nt, Human
ggccaaaucacccuuagaa

SEQ ID NO: 3405565 - RNA, 21 nt, Human
ggccaaauuauuuguguaaua

SEQ ID NO: 3405566 - RNA, 14 nt, Human
ggccaacaaagaac

SEQ ID NO: 3405567 - RNA, 15 nt, Human
ggccaagacuuggca

SEQ ID NO: 3405568 - RNA, 19 nt, Human
ggccaagauaggaccuugg

SEQ ID NO: 3405569 - RNA, 15 nt, Human
ggccaagcugaggug

SEQ ID NO: 3405570 - RNA, 14 nt, Human
ggccaaggagcugc

SEQ ID NO: 3405571 - RNA, 16 nt, Human
ggccaaggagggugag

SEQ ID NO: 3405572 - RNA, 16 nt, Human
ggccaaggccuucucc

SEQ ID NO: 3405573 - RNA, 18 nt, Human
ggccaaggccuucuccuc

SEQ ID NO: 3405574 - RNA, 13 nt, Human
ggccaagguggga

SEQ ID NO: 3405575 - RNA, 19 nt, Human
ggccaagguguccuacaga

SEQ ID NO: 3405576 - RNA, 23 nt, Human
ggccaaguccgcagaagcccuga

SEQ ID NO: 3405577 - RNA, 18 nt, Human
ggccaagugcaggcuggc

SEQ ID NO: 3405578 - RNA, 15 nt, Human
ggccaaguuccucua

SEQ ID NO: 3405579 - RNA, 19 nt, Human
ggccccgcuuguccagcgc

SEQ ID NO: 3405580 - RNA, 23 nt, Human
ggccccggaucagagcaggaccu

SEQ ID NO: 3405581 - RNA, 24 nt, Human
ggccccggaucagagcaggaccuc

SEQ ID NO: 3405582 - RNA, 13 nt, Human
ggccccggcccca

SEQ ID NO: 3405583 - RNA, 14 nt, Human
ggccccggccccag

SEQ ID NO: 3405584 - RNA, 16 nt, Human
ggccccggccccagcc

SEQ ID NO: 3405585 - RNA, 15 nt, Human
ggccccgucucaggu

SEQ ID NO: 3405586 - RNA, 19 nt, Human
ggccccgucucaggucuga

SEQ ID NO: 3405587 - RNA, 18 nt, Human
ggccccguuucugguggu

SEQ ID NO: 3405588 - RNA, 20 nt, Human
ggccccucagggucccuggu

SEQ ID NO: 3405589 - RNA, 21 nt, Human
ggccccucagggucccuggug

SEQ ID NO: 3405590 - RNA, 23 nt, Human
ggccccucaucugcucagcagcu

SEQ ID NO: 3405591 - RNA, 17 nt, Human
ggccccuccagcuugug

SEQ ID NO: 3405592 - RNA, 14 nt, Human
ggccccucccacac

SEQ ID NO: 3405593 - RNA, 23 nt, Human
ggccccucccacacccaaagcug

SEQ ID NO: 3405594 - RNA, 17 nt, Human
ggccccucccccguccu

SEQ ID NO: 3405595 - RNA, 20 nt, Human
ggccccucccuaccucaacc

SEQ ID NO: 3405596 - RNA, 15 nt, Human
ggccccucccucucc

SEQ ID NO: 3405597 - RNA, 13 nt, Human
ggccccucucagc

SEQ ID NO: 3405598 - RNA, 23 nt, Human
ggccccucucccuugggcucuga

SEQ ID NO: 3405599 - RNA, 12 nt, Human
ggccccucugcc

SEQ ID NO: 3405600 - RNA, 17 nt, Human
ggccccugagaucucug

SEQ ID NO: 3405601 - RNA, 18 nt, Human
ggccccugccacccuggg

SEQ ID NO: 3405602 - RNA, 13 nt, Human
ggccccugcccgg

SEQ ID NO: 3405603 - RNA, 16 nt, Human
ggccccugcccggcug

SEQ ID NO: 3405604 - RNA, 17 nt, Human
ggccccugcccggcugc

SEQ ID NO: 3405605 - RNA, 18 nt, Human
ggccccugccucucugca

SEQ ID NO: 3405606 - RNA, 23 nt, Human
ggccccugcugguucaggguugg

SEQ ID NO: 3405607 - RNA, 16 nt, Human
ggccccugcuucucca

SEQ ID NO: 3405608 - RNA, 14 nt, Human
ggccccuggaggcu

SEQ ID NO: 3405609 - RNA, 13 nt, Human
ggccccuggcacu

SEQ ID NO: 3405610 - RNA, 17 nt, Human
ggccccuggcccagcgg

SEQ ID NO: 3405611 - RNA, 18 nt, Human
ggccccuggcccagcggc

SEQ ID NO: 3405612 - RNA, 13 nt, Human
ggccccugugagu

SEQ ID NO: 3405613 - RNA, 20 nt, Human
ggccccuucacuucugacca

SEQ ID NO: 3405614 - RNA, 21 nt, Human
ggccccuucacuucugaccac

SEQ ID NO: 3405615 - RNA, 23 nt, Human
ggccccuucucucccugccagag

SEQ ID NO: 3405616 - RNA, 20 nt, Human
ggccccuugacucuggggac

SEQ ID NO: 3405617 - RNA, 17 nt, Human
ggccccuuugggcccug

SEQ ID NO: 3405618 - RNA, 21 nt, Human
ggccccuuugggcccugcaug

SEQ ID NO: 3405619 - RNA, 20 nt, Human
ggccccuuuucacucccucc

SEQ ID NO: 3405620 - RNA, 15 nt, Human
ggcccgacagccugg

SEQ ID NO: 3405621 - RNA, 16 nt, Human
ggcccgacagccuggc

SEQ ID NO: 3405622 - RNA, 22 nt, Human
ggcccgagcagcugagcagggc

SEQ ID NO: 3405623 - RNA, 15 nt, Human
ggcccgccuggcaga

SEQ ID NO: 3405624 - RNA, 19 nt, Human
ggcccgcuugccucggcuc

SEQ ID NO: 3405625 - RNA, 23 nt, Human
ggcccgcuugccucggcuccugc

SEQ ID NO: 3405626 - RNA, 17 nt, Human
ggcccggaugcugcuuc

SEQ ID NO: 3405627 - RNA, 20 nt, Human
ggcccggccagccaugucug

SEQ ID NO: 3405628 - RNA, 15 nt, Human
ggcccggcuccaggc

SEQ ID NO: 3405629 - RNA, 19 nt, Human
ggcccggggcuggcggcua

SEQ ID NO: 3405630 - RNA, 15 nt, Human
ggcccgucauguucc

SEQ ID NO: 3405631 - RNA, 18 nt, Human
ggcccgucuguccaucug

SEQ ID NO: 3405632 - RNA, 19 nt, Human
ggcccgucuguccaucugc

SEQ ID NO: 3405633 - RNA, 16 nt, Human
ggcccguugaggauga

SEQ ID NO: 3405634 - RNA, 18 nt, Human
ggcccguugucucccugg

SEQ ID NO: 3405635 - RNA, 21 nt, Human
ggcccguugucucccuggccc

SEQ ID NO: 3405636 - RNA, 16 nt, Human
ggcccuaauucagcca

SEQ ID NO: 3405637 - RNA, 22 nt, Human
ggcccuagacucggggugcuuc

SEQ ID NO: 3405638 - RNA, 21 nt, Human
ggcccuagcccagcgcucugc

SEQ ID NO: 3405639 - RNA, 23 nt, Human
ggcccucaaggccucccacagug

SEQ ID NO: 3405640 - RNA, 19 nt, Human
ggcccucaagucuuucucu

SEQ ID NO: 3405641 - RNA, 21 nt, Human
ggcccucaguagucccugcac

SEQ ID NO: 3405642 - RNA, 14 nt, Human
ggcccuccacaccu

SEQ ID NO: 3405643 - RNA, 15 nt, Human
ggcccuccacaccug

SEQ ID NO: 3405644 - RNA, 19 nt, Human
ggcccuccacaccugcggc

SEQ ID NO: 3405645 - RNA, 23 nt, Human
ggcccuccagagccccacagccc

SEQ ID NO: 3405646 - RNA, 12 nt, Human
ggcccucccagu

SEQ ID NO: 3405647 - RNA, 14 nt, Human
ggcccucccaguac

SEQ ID NO: 3405648 - RNA, 19 nt, Human
ggcccucccuguuccccag

SEQ ID NO: 3405649 - RNA, 21 nt, Human
ggcccucccuguuccccagag

SEQ ID NO: 3405650 - RNA, 22 nt, Human
ggcccucccuguuccccagaga

SEQ ID NO: 3405651 - RNA, 23 nt, Human
ggcccucccuguuccccagagaa

SEQ ID NO: 3405652 - RNA, 15 nt, Human
ggcccucccuuggaa

SEQ ID NO: 3405653 - RNA, 22 nt, Human
ggcccuccgaccacuuccaggg

SEQ ID NO: 3405654 - RNA, 23 nt, Human
ggcccucgacacucaccaugaag

SEQ ID NO: 3405655 - RNA, 19 nt, Human
ggcccucgcugccagcucu

SEQ ID NO: 3405656 - RNA, 16 nt, Human
ggcccucuccccugcc

SEQ ID NO: 3405657 - RNA, 17 nt, Human
ggcccucucccuuaccc

SEQ ID NO: 3405658 - RNA, 20 nt, Human
ggcccucucugaaggaggcc

SEQ ID NO: 3405659 - RNA, 20 nt, Human
ggcccucucuucucaccuuu

SEQ ID NO: 3405660 - RNA, 14 nt, Human
ggcccucuggagug

SEQ ID NO: 3405661 - RNA, 14 nt, Human
ggcccugagcucgg

SEQ ID NO: 3405662 - RNA, 14 nt, Human
ggcccugagcugag

SEQ ID NO: 3405663 - RNA, 15 nt, Human
ggcccugaggugugg

SEQ ID NO: 3405664 - RNA, 21 nt, Human
ggcccugaggugugggggcug

SEQ ID NO: 3405665 - RNA, 22 nt, Human
ggcccugcaauguaucccuucu

SEQ ID NO: 3405666 - RNA, 17 nt, Human
ggcccugcacuguccug

SEQ ID NO: 3405667 - RNA, 21 nt, Human
ggcccugcacuguccugcucc

SEQ ID NO: 3405668 - RNA, 22 nt, Human
ggcccugcacuguccugcucca

SEQ ID NO: 3405669 - RNA, 16 nt, Human
ggcccugcagccagcu

SEQ ID NO: 3405670 - RNA, 17 nt, Human
ggcccugcagccagcuc

SEQ ID NO: 3405671 - RNA, 12 nt, Human
ggcccugcagcu

SEQ ID NO: 3405672 - RNA, 15 nt, Human
ggcccugcaguguuc

SEQ ID NO: 3405673 - RNA, 11 nt, Human
ggcccugcaug

SEQ ID NO: 3405674 - RNA, 18 nt, Human
ggcccugccaucuuccca

SEQ ID NO: 3405675 - RNA, 11 nt, Human
ggcccugccca

SEQ ID NO: 3405676 - RNA, 11 nt, Human
ggcccugcccu

SEQ ID NO: 3405677 - RNA, 12 nt, Human
ggcccugcccug

SEQ ID NO: 3405678 - RNA, 19 nt, Human
ggcccugcccugaggaagg

SEQ ID NO: 3405679 - RNA, 13 nt, Human
ggcccugccucug

SEQ ID NO: 3405680 - RNA, 13 nt, Human
ggcccugccugcu

SEQ ID NO: 3405681 - RNA, 21 nt, Human
ggcccugcuccugcagcaugg

SEQ ID NO: 3405682 - RNA, 15 nt, Human
ggcccugcuuccugc

SEQ ID NO: 3405683 - RNA, 20 nt, Human
ggcccuggaucagcguggcc

SEQ ID NO: 3405684 - RNA, 22 nt, Human
ggcccuggaucagcguggccuu

SEQ ID NO: 3405685 - RNA, 14 nt, Human
ggcccuggcagccc

SEQ ID NO: 3405686 - RNA, 13 nt, Human
ggcccuggccucc

SEQ ID NO: 3405687 - RNA, 14 nt, Human
ggcccuggccuccc

SEQ ID NO: 3405688 - RNA, 15 nt, Human
ggcccuggccugcug

SEQ ID NO: 3405689 - RNA, 17 nt, Human
ggcccuggccugcuggg

SEQ ID NO: 3405690 - RNA, 13 nt, Human
ggcccuggcugcc

SEQ ID NO: 3405691 - RNA, 16 nt, Human
ggcccugggcucggag

SEQ ID NO: 3405692 - RNA, 13 nt, Human
ggcccugggcugg

SEQ ID NO: 3405693 - RNA, 12 nt, Human
ggcccuggggcc

SEQ ID NO: 3405694 - RNA, 14 nt, Human
ggcccuggggccug

SEQ ID NO: 3405695 - RNA, 18 nt, Human
ggcccuggggccuguacu

SEQ ID NO: 3405696 - RNA, 12 nt, Human
ggcccugguccu

SEQ ID NO: 3405697 - RNA, 19 nt, Human
ggcccugguguuucuagca

SEQ ID NO: 3405698 - RNA, 20 nt, Human
ggcccugucccucccaccuc

SEQ ID NO: 3405699 - RNA, 22 nt, Human
ggcccugucccucccaccucug

SEQ ID NO: 3405700 - RNA, 20 nt, Human
ggcccuuaugacugccaaga

SEQ ID NO: 3405701 - RNA, 20 nt, Human
ggcccuucacugccuuugcu

SEQ ID NO: 3405702 - RNA, 19 nt, Human
ggcccuucccacaggacau

SEQ ID NO: 3405703 - RNA, 19 nt, Human
ggcccuuccuccuccacca

SEQ ID NO: 3405704 - RNA, 21 nt, Human
ggcccuuccuccuccaccacc

SEQ ID NO: 3405705 - RNA, 15 nt, Human
ggcccuuccucucca

SEQ ID NO: 3405706 - RNA, 12 nt, Human
ggcccuuccugg

SEQ ID NO: 3405707 - RNA, 16 nt, Human
ggcccuuccuggacag

SEQ ID NO: 3405708 - RNA, 23 nt, Human
ggcccuuccuggacagcugugcc

SEQ ID NO: 3405709 - RNA, 16 nt, Human
ggcccuucucuccagc

SEQ ID NO: 3405710 - RNA, 18 nt, Human
ggcccuucucuccagccc

SEQ ID NO: 3405711 - RNA, 21 nt, Human
ggcccuucucuccagccccug

SEQ ID NO: 3405712 - RNA, 22 nt, Human
ggcccuucucuccagccccugg

SEQ ID NO: 3405713 - RNA, 23 nt, Human
ggcccuucuugcugcccugcccc

SEQ ID NO: 3405714 - RNA, 18 nt, Human
ggcccuuuccucaggcaa

SEQ ID NO: 3405715 - RNA, 18 nt, Human
ggcccuuugaagccucag

SEQ ID NO: 3405716 - RNA, 20 nt, Human
ggcccuuugaagccucagcu

SEQ ID NO: 3405717 - RNA, 14 nt, Human
ggcccuuugcuguc

SEQ ID NO: 3405718 - RNA, 19 nt, Human
ggcccuuuuucaauaacug

SEQ ID NO: 3405719 - RNA, 15 nt, Human
ggccgaagcucuggc

SEQ ID NO: 3405720 - RNA, 19 nt, Human
ggccgaauccccucccugu

SEQ ID NO: 3405721 - RNA, 21 nt, Human
ggccgaauccccucccuguca

SEQ ID NO: 3405722 - RNA, 12 nt, Human
ggccgagaagca

SEQ ID NO: 3405723 - RNA, 20 nt, Human
ggcggagcuugcagugagcc

SEQ ID NO: 3405724 - RNA, 21 nt, Human
ggcggagcuugcagugagccg

SEQ ID NO: 3405725 - RNA, 14 nt, Human
ggcggcacagccuu

SEQ ID NO: 3405726 - RNA, 15 nt, Human
ggcggcacagccuuc

SEQ ID NO: 3405727 - RNA, 16 nt, Human
ggcggcgggcggcugg

SEQ ID NO: 3405728 - RNA, 20 nt, Human
ggcggcuacucagcagcccu

SEQ ID NO: 3405729 - RNA, 22 nt, Human
ggcggcuacucagcagcccucc

SEQ ID NO: 3405730 - RNA, 23 nt, Human
ggcggcuacucagcagcccuccu

SEQ ID NO: 3405731 - RNA, 18 nt, Human
ggcggcucggaggaagcc

SEQ ID NO: 3405732 - RNA, 18 nt, Human
ggcggcugagagccccag

SEQ ID NO: 3405733 - RNA, 18 nt, Human
ggcggcuggggucccagc

SEQ ID NO: 3405734 - RNA, 19 nt, Human
ggcgggacccaggcaccug

SEQ ID NO: 3405735 - RNA, 21 nt, Human
ggcgggaguggaguggaagaa

SEQ ID NO: 3405736 - RNA, 20 nt, Human
ggcgggcacaccuccuccca

SEQ ID NO: 3405737 - RNA, 22 nt, Human
ggcgggcaccuauagucccagc

SEQ ID NO: 3405738 - RNA, 17 nt, Human
ggcgggcagagggcugg

SEQ ID NO: 3405739 - RNA, 15 nt, Human
ggcgggccagccagg

SEQ ID NO: 3405740 - RNA, 17 nt, Human
ggcgggccagccaggcg

SEQ ID NO: 3405741 - RNA, 14 nt, Human
ggcgggccccucau

SEQ ID NO: 3405742 - RNA, 12 nt, Human
ggcggguggggg

SEQ ID NO: 3405743 - RNA, 17 nt, Human
ggcggugcccacaccgg

SEQ ID NO: 3405744 - RNA, 20 nt, Human
ggcguaaguacagagaagcc

SEQ ID NO: 3405745 - RNA, 22 nt, Human
ggcguaaguacagagaagccau

SEQ ID NO: 3405746 - RNA, 17 nt, Human
ggcgucagccuccagcc

SEQ ID NO: 3405747 - RNA, 15 nt, Human
ggcgucagucuuuuu

SEQ ID NO: 3405748 - RNA, 15 nt, Human
ggcgucugucuucaa

SEQ ID NO: 3405749 - RNA, 14 nt, Human
ggcgucugugugcg

SEQ ID NO: 3405750 - RNA, 14 nt, Human
ggcgugagaccugc

SEQ ID NO: 3405751 - RNA, 18 nt, Human
ggcgugagccaccgugcc

SEQ ID NO: 3405752 - RNA, 15 nt, Human
ggcgugaggauggga

SEQ ID NO: 3405753 - RNA, 12 nt, Human
ggcgugaucucg

SEQ ID NO: 3405754 - RNA, 14 nt, Human
ggcgugcaguggug

SEQ ID NO: 3405755 - RNA, 15 nt, Human
ggcguggagcaggcg

SEQ ID NO: 3405756 - RNA, 15 nt, Human
ggcguggagcugccu

SEQ ID NO: 3405757 - RNA, 17 nt, Human
ggcguggagggaggccc

SEQ ID NO: 3405758 - RNA, 18 nt, Human
ggcguggagggaggcccc

SEQ ID NO: 3405759 - RNA, 23 nt, Human
ggcguucuuaggcugcugggaug

SEQ ID NO: 3405760 - RNA, 21 nt, Human
ggcuaaacauccaauauuuuc

SEQ ID NO: 3405761 - RNA, 14 nt, Human
ggcuaacuggaagc

SEQ ID NO: 3405762 - RNA, 19 nt, Human
ggcuaagaguguccuagga

SEQ ID NO: 3405763 - RNA, 20 nt, Human
ggcuaagcuucacuguaaaa

SEQ ID NO: 3405764 - RNA, 23 nt, Human
ggcuaaguugggaucuaggagag

SEQ ID NO: 3405765 - RNA, 23 nt, Human
ggcuaauucccagagugugaaac

SEQ ID NO: 3405766 - RNA, 22 nt, Human
ggcuacaccuuagccugcccuc

SEQ ID NO: 3405767 - RNA, 13 nt, Human
ggcuacagagaag

SEQ ID NO: 3405768 - RNA, 15 nt, Human
ggcuacagagaagcc

SEQ ID NO: 3405769 - RNA, 17 nt, Human
ggcuacagagaagccuu

SEQ ID NO: 3405770 - RNA, 22 nt, Human
ggcuaccaacuuguauccaggc

SEQ ID NO: 3405771 - RNA, 15 nt, Human
ggcuacgaaucuucc

SEQ ID NO: 3405772 - RNA, 23 nt, Human
ggcuacucacucaaguucaagga

SEQ ID NO: 3405773 - RNA, 15 nt, Human
ggcuacucagcagcc

SEQ ID NO: 3405774 - RNA, 16 nt, Human
ggcuacucagcagccc

SEQ ID NO: 3405775 - RNA, 17 nt, Human
ggcuacucagcagcccu

SEQ ID NO: 3405776 - RNA, 18 nt, Human
ggcuacucagcagcccuc

SEQ ID NO: 3405777 - RNA, 24 nt, Human
ggcuacucugugccagagccuggg

SEQ ID NO: 3405778 - RNA, 18 nt, Human
ggcuacugcagcuuuaca

SEQ ID NO: 3405779 - RNA, 16 nt, Human
ggcuagaaccuggaga

SEQ ID NO: 3405780 - RNA, 22 nt, Human
ggcuagaaccuggagagcuaga

SEQ ID NO: 3405781 - RNA, 22 nt, Human
ggcuagaaccuguagagcuaga

SEQ ID NO: 3405782 - RNA, 14 nt, Human
ggcuagaaucugga

SEQ ID NO: 3405783 - RNA, 16 nt, Human
ggcuagaaucuggaga

SEQ ID NO: 3405784 - RNA, 22 nt, Human
ggcuagagguucaaagauauuu

SEQ ID NO: 3405785 - RNA, 20 nt, Human
ggcuagagugcgguggcgcg

SEQ ID NO: 3405786 - RNA, 16 nt, Human
ggcuagcuggagccug

SEQ ID NO: 3405787 - RNA, 20 nt, Human
ggcuagcuucugcuuuucug

SEQ ID NO: 3405788 - RNA, 22 nt, Human
ggcuagcuucugcuuuucugcc

SEQ ID NO: 3405789 - RNA, 16 nt, Human
ggcuaggaccccucca

SEQ ID NO: 3405790 - RNA, 22 nt, Human
ggcuaggaccccuccauguggg

SEQ ID NO: 3405791 - RNA, 14 nt, Human
ggcuagggggagcc

SEQ ID NO: 3405792 - RNA, 16 nt, Human
ggcuaggguggggaga

SEQ ID NO: 3405793 - RNA, 13 nt, Human
ggcuagguacaca

SEQ ID NO: 3405794 - RNA, 21 nt, Human
ggcuagguagaaaaaggguca

SEQ ID NO: 3405795 - RNA, 19 nt, Human
ggcuagguggguugaaagc

SEQ ID NO: 3405796 - RNA, 20 nt, Human
ggcuaguaucaaaagaaaga

SEQ ID NO: 3405797 - RNA, 15 nt, Human
ggcuagucagagaga

SEQ ID NO: 3405798 - RNA, 23 nt, Human
ggcuagugugguguuuccuggca

SEQ ID NO: 3405799 - RNA, 21 nt, Human
ggcuaucaaagaauaagaaaa

SEQ ID NO: 3405800 - RNA, 13 nt, Human
ggcuauccugauu

SEQ ID NO: 3405801 - RNA, 13 nt, Human
ggcuaugcauuug

SEQ ID NO: 3405802 - RNA, 14 nt, Human
ggcuaugcauuuga

SEQ ID NO: 3405803 - RNA, 17 nt, Human
ggcuaugguguggacug

SEQ ID NO: 3405804 - RNA, 19 nt, Human
ggcuauguauggaauacag

SEQ ID NO: 3405805 - RNA, 19 nt, Human
ggcuauuccauaauuccau

SEQ ID NO: 3405806 - RNA, 23 nt, Human
ggcucaagcagucuacccaccuc

SEQ ID NO: 3405807 - RNA, 18 nt, Human
ggcucaagcccaggaggg

SEQ ID NO: 3405808 - RNA, 15 nt, Human
ggcucaaguccucuu

SEQ ID NO: 3405809 - RNA, 21 nt, Human
ggcucaaguccucuuuucuga

SEQ ID NO: 3405810 - RNA, 14 nt, Human
ggcucacacugaga

SEQ ID NO: 3405811 - RNA, 15 nt, Human
ggcucacacugagaa

SEQ ID NO: 3405812 - RNA, 17 nt, Human
ggcucacacugagaaug

SEQ ID NO: 3405813 - RNA, 14 nt, Human
ggcucacagacugg

SEQ ID NO: 3405814 - RNA, 23 nt, Human
ggcucacaguacagcaugugccu

SEQ ID NO: 3405815 - RNA, 17 nt, Human
ggcucacccccuucucc

SEQ ID NO: 3405816 - RNA, 22 nt, Human
ggcucacccccuucuccaucca

SEQ ID NO: 3405817 - RNA, 23 nt, Human
ggcucacgccuguaaucccagca

SEQ ID NO: 3405818 - RNA, 24 nt, Human
ggcucacgccuguaaucccagcag

SEQ ID NO: 3405819 - RNA, 14 nt, Human
ggcucacucagcca

SEQ ID NO: 3405820 - RNA, 14 nt, Human
ggcucacugcagcc

SEQ ID NO: 3405821 - RNA, 17 nt, Human
ggcucacugcagccuca

SEQ ID NO: 3405822 - RNA, 19 nt, Human
ggcucacugccaggccagc

SEQ ID NO: 3405823 - RNA, 21 nt, Human
ggcucagagggggacugcugc

SEQ ID NO: 3405824 - RNA, 20 nt, Human
ggcucagaggguguccugca

SEQ ID NO: 3405825 - RNA, 14 nt, Human
ggcucagagugggg

SEQ ID NO: 3405826 - RNA, 13 nt, Human
ggcucagaucuca

SEQ ID NO: 3405827 - RNA, 16 nt, Human
ggcucagauuguaaua

SEQ ID NO: 3405828 - RNA, 23 nt, Human
ggcucagcaaaagaugcuucuca

SEQ ID NO: 3405829 - RNA, 14 nt, Human
ggcucagcaaggcc

SEQ ID NO: 3405830 - RNA, 15 nt, Human
ggcucagccagcacu

SEQ ID NO: 3405831 - RNA, 10 nt, Human
ggcucagccu

SEQ ID NO: 3405832 - RNA, 13 nt, Human
ggcucagccuggu

SEQ ID NO: 3405833 - RNA, 20 nt, Human
ggcucagccuggugggccuc

SEQ ID NO: 3405834 - RNA, 18 nt, Human
ggcucagcggggacagcu

SEQ ID NO: 3405835 - RNA, 19 nt, Human
ggcucagcggggacagcuc

SEQ ID NO: 3405836 - RNA, 13 nt, Human
ggcucagcucugg

SEQ ID NO: 3405837 - RNA, 14 nt, Human
ggcucagcucuggc

SEQ ID NO: 3405838 - RNA, 12 nt, Human
ggcucaggaaaa

SEQ ID NO: 3405839 - RNA, 17 nt, Human
ggcucaggcaggggccu

SEQ ID NO: 3405840 - RNA, 15 nt, Human
ggcucaggcugagcu

SEQ ID NO: 3405841 - RNA, 18 nt, Human
ggcucagggaccacagca

SEQ ID NO: 3405842 - RNA, 19 nt, Human
ggcucagguggggucacuc

SEQ ID NO: 3405843 - RNA, 14 nt, Human
ggcucagucucagg

SEQ ID NO: 3405844 - RNA, 19 nt, Human
ggcucagugcaaccucugc

SEQ ID NO: 3405845 - RNA, 21 nt, Human
ggcucagugcaaccucugcuu

SEQ ID NO: 3405846 - RNA, 17 nt, Human
ggcuccaaacccucgag

SEQ ID NO: 3405847 - RNA, 14 nt, Human
ggcuccacacacac

SEQ ID NO: 3405848 - RNA, 23 nt, Human
ggcuccacacacacaaaaaaaga

SEQ ID NO: 3405849 - RNA, 13 nt, Human
ggcuccagagggc

SEQ ID NO: 3405850 - RNA, 22 nt, Human
ggcuccagagggcacucugcuu

SEQ ID NO: 3405851 - RNA, 15 nt, Human
ggcuccagccccucu

SEQ ID NO: 3405852 - RNA, 17 nt, Human
ggcuccaggagcagcca

SEQ ID NO: 3405853 - RNA, 14 nt, Human
ggcuccaggcagca

SEQ ID NO: 3405854 - RNA, 15 nt, Human
ggcuccaguccccag

SEQ ID NO: 3405855 - RNA, 24 nt, Human
ggcuccagucugcugcccuccauc

SEQ ID NO: 3405856 - RNA, 12 nt, Human
ggcuccaugcca

SEQ ID NO: 3405857 - RNA, 18 nt, Human
ggcuccaugcuccucacu

SEQ ID NO: 3405858 - RNA, 22 nt, Human
ggcucccaaaacaccugacagc

SEQ ID NO: 3405859 - RNA, 16 nt, Human
ggcucccagccaggcc

SEQ ID NO: 3405860 - RNA, 16 nt, Human
ggcucccagccucagc

SEQ ID NO: 3405861 - RNA, 17 nt, Human
ggcucccaugucaagag

SEQ ID NO: 3405862 - RNA, 22 nt, Human
ggcucccauucacucuuccaga

SEQ ID NO: 3405863 - RNA, 16 nt, Human
ggcuccccugcagccc

SEQ ID NO: 3405864 - RNA, 23 nt, Human
ggcuccccugcagcccuggccca

SEQ ID NO: 3405865 - RNA, 15 nt, Human
ggcucccgccuccaa

SEQ ID NO: 3405866 - RNA, 15 nt, Human
ggcucccggaauucc

SEQ ID NO: 3405867 - RNA, 16 nt, Human
ggcucccucacucuca

SEQ ID NO: 3405868 - RNA, 20 nt, Human
ggcucccuccuccaggccug

SEQ ID NO: 3405869 - RNA, 11 nt, Human
ggcucccugga

SEQ ID NO: 3405870 - RNA, 21 nt, Human
ggcucccuucaucuccaggga

SEQ ID NO: 3405871 - RNA, 13 nt, Human
ggcucccuuccca

SEQ ID NO: 3405872 - RNA, 16 nt, Human
ggcucccuucccaccu

SEQ ID NO: 3405873 - RNA, 17 nt, Human
ggcucccuucccaccuc

SEQ ID NO: 3405874 - RNA, 16 nt, Human
ggcucccuuccuccca

SEQ ID NO: 3405875 - RNA, 14 nt, Human
ggcuccguguggga

SEQ ID NO: 3405876 - RNA, 17 nt, Human
ggcuccgugugggagac

SEQ ID NO: 3405877 - RNA, 18 nt, Human
ggcuccgugugggagacc

SEQ ID NO: 3405878 - RNA, 14 nt, Human
ggcuccucacauag

SEQ ID NO: 3405879 - RNA, 17 nt, Human
ggcuccucccggugccc

SEQ ID NO: 3405880 - RNA, 16 nt, Human
ggcuccucccucccuc

SEQ ID NO: 3405881 - RNA, 19 nt, Human
ggcuccugagggagcucca

SEQ ID NO: 3405882 - RNA, 12 nt, Human
ggcuccugccag

SEQ ID NO: 3405883 - RNA, 13 nt, Human
ggcuccugcugca

SEQ ID NO: 3405884 - RNA, 21 nt, Human
ggcuccugcugcaccaaccca

SEQ ID NO: 3405885 - RNA, 14 nt, Human
ggcuccuggacccc

SEQ ID NO: 3405886 - RNA, 17 nt, Human
ggcuccugugcccuuau

SEQ ID NO: 3405887 - RNA, 21 nt, Human
ggcuccuguuagcuccucacu

SEQ ID NO: 3405888 - RNA, 12 nt, Human
ggcuccuuucca

SEQ ID NO: 3405889 - RNA, 12 nt, Human
ggcuccuuucuc

SEQ ID NO: 3405890 - RNA, 13 nt, Human
ggcuccuuucucc

SEQ ID NO: 3405891 - RNA, 20 nt, Human
ggcuccuuuuucucccucug

SEQ ID NO: 3405892 - RNA, 18 nt, Human
ggcucgaaucucugugcc

SEQ ID NO: 3405893 - RNA, 19 nt, Human
ggcucgauuuuguaucugc

SEQ ID NO: 3405894 - RNA, 13 nt, Human
ggcucgccaggcc

SEQ ID NO: 3405895 - RNA, 17 nt, Human
ggcucgccaugccgggg

SEQ ID NO: 3405896 - RNA, 15 nt, Human
ggcucgccuucccuc

SEQ ID NO: 3405897 - RNA, 18 nt, Human
ggcucgccuucccuccug

SEQ ID NO: 3405898 - RNA, 15 nt, Human
ggcucggccugcccc

SEQ ID NO: 3405899 - RNA, 13 nt, Human
ggcucguggacug

SEQ ID NO: 3405900 - RNA, 23 nt, Human
ggcucguggacugagugggaagc

SEQ ID NO: 3405901 - RNA, 15 nt, Human
ggcucuaacgccuga

SEQ ID NO: 3405902 - RNA, 19 nt, Human
ggcucuaacgccugagccc

SEQ ID NO: 3405903 - RNA, 18 nt, Human
ggcucuacaacugagucc

SEQ ID NO: 3405904 - RNA, 19 nt, Human
ggcucuacaacugaguccu

SEQ ID NO: 3405905 - RNA, 11 nt, Human
ggcucuagauc

SEQ ID NO: 3405906 - RNA, 18 nt, Human
ggcucuaugagucuagau

SEQ ID NO: 3405907 - RNA, 17 nt, Human
ggcucucaaugcuguuu

SEQ ID NO: 3405908 - RNA, 11 nt, Human
ggcucucaggc

SEQ ID NO: 3405909 - RNA, 17 nt, Human
ggcucucaggccagcug

SEQ ID NO: 3405910 - RNA, 18 nt, Human
ggcucucaggccagcugc

SEQ ID NO: 3405911 - RNA, 17 nt, Human
ggcucuccaagugccag

SEQ ID NO: 3405912 - RNA, 23 nt, Human
ggcucuccaagugccagaggugg

SEQ ID NO: 3405913 - RNA, 12 nt, Human
ggcucuccaccu

SEQ ID NO: 3405914 - RNA, 16 nt, Human
ggcucuccaccucagc

SEQ ID NO: 3405915 - RNA, 17 nt, Human
ggcucuccaccucagcc

SEQ ID NO: 3405916 - RNA, 18 nt, Human
ggcucuccaccucagccu

SEQ ID NO: 3405917 - RNA, 23 nt, Human
ggcucuccggggccauuugcaau

SEQ ID NO: 3405918 - RNA, 20 nt, Human
ggcucuccucagaagaaaga

SEQ ID NO: 3405919 - RNA, 12 nt, Human
ggcucuccuggc

SEQ ID NO: 3405920 - RNA, 13 nt, Human
ggcucuccuggcu

SEQ ID NO: 3405921 - RNA, 16 nt, Human
ggcucuccuggcuucc

SEQ ID NO: 3405922 - RNA, 12 nt, Human
ggcucucugagu

SEQ ID NO: 3405923 - RNA, 17 nt, Human
ggcucucuuuccuucuu

SEQ ID NO: 3405924 - RNA, 18 nt, Human
ggcucucuuuccuucuug

SEQ ID NO: 3405925 - RNA, 16 nt, Human
ggcucugaagcaaggc

SEQ ID NO: 3405926 - RNA, 22 nt, Human
ggcucugagagucuagauucuc

SEQ ID NO: 3405927 - RNA, 20 nt, Human
ggcucugaggugccuguccc

SEQ ID NO: 3405928 - RNA, 23 nt, Human
ggcucugaggugccugucccacc

SEQ ID NO: 3405929 - RNA, 19 nt, Human
ggcucugcaauuccccucu

SEQ ID NO: 3405930 - RNA, 16 nt, Human
ggcucugcaccccucu

SEQ ID NO: 3405931 - RNA, 19 nt, Human
ggcucugccacccuaccug

SEQ ID NO: 3405932 - RNA, 16 nt, Human
ggcucugccaguccug

SEQ ID NO: 3405933 - RNA, 13 nt, Human
ggcucugccccag

SEQ ID NO: 3405934 - RNA, 23 nt, Human
ggcucugccccagcucuggcuuc

SEQ ID NO: 3405935 - RNA, 14 nt, Human
ggcucugcccuugg

SEQ ID NO: 3405936 - RNA, 15 nt, Human
ggcucugccucccau

SEQ ID NO: 3405937 - RNA, 16 nt, Human
ggcucuggacucuaaa

SEQ ID NO: 3405938 - RNA, 19 nt, Human
ggcucuggagacagcccca

SEQ ID NO: 3405939 - RNA, 15 nt, Human
ggcucuggagagaaa

SEQ ID NO: 3405940 - RNA, 19 nt, Human
ggcucuggagcccacugua

SEQ ID NO: 3405941 - RNA, 23 nt, Human
ggcucugggauagcugacccagc

SEQ ID NO: 3405942 - RNA, 18 nt, Human
ggcucugugcugacccuc

SEQ ID NO: 3405943 - RNA, 15 nt, Human
ggcucugugggcugc

SEQ ID NO: 3405944 - RNA, 22 nt, Human
ggcucugugggugauggggagg

SEQ ID NO: 3405945 - RNA, 18 nt, Human
ggcucuuagcagcuucca

SEQ ID NO: 3405946 - RNA, 14 nt, Human
ggcucuuccaggcu

SEQ ID NO: 3405947 - RNA, 15 nt, Human
ggcucuuccaggcug

SEQ ID NO: 3405948 - RNA, 17 nt, Human
ggcucuuccaggcuggg

SEQ ID NO: 3405949 - RNA, 20 nt, Human
ggcucuucucauuucacccc

SEQ ID NO: 3405950 - RNA, 15 nt, Human
ggcucuucuccuuuc

SEQ ID NO: 3405951 - RNA, 23 nt, Human
ggcucuucuccuuucacaaccuu

SEQ ID NO: 3405952 - RNA, 14 nt, Human
ggcucuucugacua

SEQ ID NO: 3405953 - RNA, 19 nt, Human
ggcucuugaacugagcuug

SEQ ID NO: 3405954 - RNA, 20 nt, Human
ggcucuugauaccccccucu

SEQ ID NO: 3405955 - RNA, 21 nt, Human
ggcucuugauaccccccucug

SEQ ID NO: 3405956 - RNA, 20 nt, Human
ggcucuugugcuggauggag

SEQ ID NO: 3405957 - RNA, 14 nt, Human
ggcucuuuccuugc

SEQ ID NO: 3405958 - RNA, 16 nt, Human
ggcucuuuccuugcuc

SEQ ID NO: 3405959 - RNA, 20 nt, Human
ggcugaaagaggccaaugcc

SEQ ID NO: 3405960 - RNA, 16 nt, Human
ggcugaaauucuccug

SEQ ID NO: 3405961 - RNA, 21 nt, Human
ggcugaaauucuccuggaggu

SEQ ID NO: 3405962 - RNA, 21 nt, Human
ggcugaacacuccaauuaagg

SEQ ID NO: 3405963 - RNA, 16 nt, Human
ggcugaacccugugcu

SEQ ID NO: 3405964 - RNA, 19 nt, Human
ggcugaacccugugcuggu

SEQ ID NO: 3405965 - RNA, 20 nt, Human
ggcugaacggggagaaaagg

SEQ ID NO: 3405966 - RNA, 18 nt, Human
ggcugaacuuuguggucg

SEQ ID NO: 3405967 - RNA, 20 nt, Human
ggcugaagcuguguccucau

SEQ ID NO: 3405968 - RNA, 19 nt, Human
ggcugacccagucccuggg

SEQ ID NO: 3405969 - RNA, 22 nt, Human
ggcugacccagucccuggggga

SEQ ID NO: 3405970 - RNA, 13 nt, Human
ggcugaccccccu

SEQ ID NO: 3405971 - RNA, 17 nt, Human
ggcugaccugccucuca

SEQ ID NO: 3405972 - RNA, 21 nt, Human
ggcugaccuugaacuccuggg

SEQ ID NO: 3405973 - RNA, 17 nt, Human
ggcugacguuccgggca

SEQ ID NO: 3405974 - RNA, 19 nt, Human
ggcugacuagaagggccag

SEQ ID NO: 3405975 - RNA, 22 nt, Human
ggcugacuagaagggccagucc

SEQ ID NO: 3405976 - RNA, 21 nt, Human
ggcugagacuggauacugccc

SEQ ID NO: 3405977 - RNA, 18 nt, Human
ggcugagagccccagcug

SEQ ID NO: 3405978 - RNA, 13 nt, Human
ggcugagccccua

SEQ ID NO: 3405979 - RNA, 12 nt, Human
ggcugagcccug

SEQ ID NO: 3405980 - RNA, 13 nt, Human
ggcugagcccugg

SEQ ID NO: 3405981 - RNA, 15 nt, Human
ggcugagcccuggca

SEQ ID NO: 3405982 - RNA, 16 nt, Human
ggcugagcccuggcag

SEQ ID NO: 3405983 - RNA, 20 nt, Human
ggcugagcucucugugggcu

SEQ ID NO: 3405984 - RNA, 15 nt, Human
ggcugaggaggccuc

SEQ ID NO: 3405985 - RNA, 14 nt, Human
ggcugaggcuggca

SEQ ID NO: 3405986 - RNA, 17 nt, Human
ggcugaggcuggcacag

SEQ ID NO: 3405987 - RNA, 23 nt, Human
ggcugagggauggacugaugcuu

SEQ ID NO: 3405988 - RNA, 14 nt, Human
ggcugagggcagcu

SEQ ID NO: 3405989 - RNA, 21 nt, Human
ggcugagggcaguucgcagcc

SEQ ID NO: 3405990 - RNA, 18 nt, Human
ggcugagggccugcugga

SEQ ID NO: 3405991 - RNA, 21 nt, Human
ggcugagggccugcuggaggc

SEQ ID NO: 3405992 - RNA, 19 nt, Human
ggcugaggggcaacgaaga

SEQ ID NO: 3405993 - RNA, 14 nt, Human
ggcugagguuccuc

SEQ ID NO: 3405994 - RNA, 21 nt, Human
ggcugagguuccucugccugc

SEQ ID NO: 3405995 - RNA, 23 nt, Human
ggcugagguuccucugccugccc

SEQ ID NO: 3405996 - RNA, 20 nt, Human
ggcugagugcaggcccaccc

SEQ ID NO: 3405997 - RNA, 21 nt, Human
ggcugagugcaggcccacccu

SEQ ID NO: 3405998 - RNA, 21 nt, Human
ggcugaguucuggucaaagaa

SEQ ID NO: 3405999 - RNA, 15 nt, Human
ggcugauaauuuuaa

SEQ ID NO: 3406000 - RNA, 22 nt, Human
ggcugaucucagggaagcccag

SEQ ID NO: 3406001 - RNA, 15 nt, Human
ggcugauggaguaaa

SEQ ID NO: 3406002 - RNA, 22 nt, Human
ggcugaugucaauuucuguguu

SEQ ID NO: 3406003 - RNA, 24 nt, Human
ggcugaugucaauuucuguguugc

SEQ ID NO: 3406004 - RNA, 24 nt, Human
ggcugcaaaggguaucaggugcug

SEQ ID NO: 3406005 - RNA, 22 nt, Human
ggcugcaagguuuaggcuggug

SEQ ID NO: 3406006 - RNA, 18 nt, Human
ggcugcaccggcuggccu

SEQ ID NO: 3406007 - RNA, 19 nt, Human
ggcugcaccggcuggccug

SEQ ID NO: 3406008 - RNA, 16 nt, Human
ggcugcacucugugcc

SEQ ID NO: 3406009 - RNA, 18 nt, Human
ggcugcacucugugccca

SEQ ID NO: 3406010 - RNA, 19 nt, Human
ggcugcacucugugcccau

SEQ ID NO: 3406011 - RNA, 16 nt, Human
ggguggggguggguca

SEQ ID NO: 3406012 - RNA, 17 nt, Human
gggugggguagggcuga

SEQ ID NO: 3406013 - RNA, 12 nt, Human
ggguggguauaa

SEQ ID NO: 3406014 - RNA, 21 nt, Human
gggugggucagaacccugcca

SEQ ID NO: 3406015 - RNA, 15 nt, Human
gggugggugcucaga

SEQ ID NO: 3406016 - RNA, 16 nt, Human
gggugggugcucagaa

SEQ ID NO: 3406017 - RNA, 12 nt, Human
ggguggugaccu

SEQ ID NO: 3406018 - RNA, 15 nt, Human
gggugguggccuggu

SEQ ID NO: 3406019 - RNA, 12 nt, Human
ggguggugggga

SEQ ID NO: 3406020 - RNA, 19 nt, Human
gggugguggggaggggcgc

SEQ ID NO: 3406021 - RNA, 15 nt, Human
gggugguggugauag

SEQ ID NO: 3406022 - RNA, 18 nt, Human
ggguguaacaggucuccu

SEQ ID NO: 3406023 - RNA, 13 nt, Human
ggguguagccagg

SEQ ID NO: 3406024 - RNA, 23 nt, Human
ggguguauuuauuuuccucccca

SEQ ID NO: 3406025 - RNA, 17 nt, Human
ggguguccugcaccggg

SEQ ID NO: 3406026 - RNA, 21 nt, Human
ggguguccugcaccggggccu

SEQ ID NO: 3406027 - RNA, 21 nt, Human
gggugucuugggcagagcugg

SEQ ID NO: 3406028 - RNA, 13 nt, Human
gggugugggaggc

SEQ ID NO: 3406029 - RNA, 22 nt, Human
ggguuaacccuucaucuuccug

SEQ ID NO: 3406030 - RNA, 22 nt, Human
ggguuaagaaaagagauauuuu

SEQ ID NO: 3406031 - RNA, 14 nt, Human
ggguuaaggccuga

SEQ ID NO: 3406032 - RNA, 18 nt, Human
ggguuauguaucagaaga

SEQ ID NO: 3406033 - RNA, 22 nt, Human
ggguucaagcgauucuucugcu

SEQ ID NO: 3406034 - RNA, 20 nt, Human
ggguucaccugggcugaggc

SEQ ID NO: 3406035 - RNA, 21 nt, Human
ggguucagaaaugcugccugc

SEQ ID NO: 3406036 - RNA, 22 nt, Human
ggguucauaggucacuggcucu

SEQ ID NO: 3406037 - RNA, 13 nt, Human
ggguucauuauug

SEQ ID NO: 3406038 - RNA, 18 nt, Human
ggguucccuuuccuucca

SEQ ID NO: 3406039 - RNA, 23 nt, Human
ggguucccuuuuuuggcugcuga

SEQ ID NO: 3406040 - RNA, 19 nt, Human
ggguuccuccccuccagcu

SEQ ID NO: 3406041 - RNA, 14 nt, Human
ggguuccucuuccc

SEQ ID NO: 3406042 - RNA, 11 nt, Human
ggguuccugca

SEQ ID NO: 3406043 - RNA, 20 nt, Human
ggguuccuuccucugagccu

SEQ ID NO: 3406044 - RNA, 15 nt, Human
ggguucucacagugg

SEQ ID NO: 3406045 - RNA, 16 nt, Human
ggguucuccucucccc

SEQ ID NO: 3406046 - RNA, 18 nt, Human
ggguucuccucuccccuc

SEQ ID NO: 3406047 - RNA, 13 nt, Human
ggguucugccucu

SEQ ID NO: 3406048 - RNA, 21 nt, Human
ggguucugccugccagcugca

SEQ ID NO: 3406049 - RNA, 19 nt, Human
ggguucuuuggaaggagug

SEQ ID NO: 3406050 - RNA, 18 nt, Human
ggguugcaguggagaggg

SEQ ID NO: 3406051 - RNA, 18 nt, Human
ggguugcaucagaaaugu

SEQ ID NO: 3406052 - RNA, 20 nt, Human
ggguugccacaggccucccu

SEQ ID NO: 3406053 - RNA, 14 nt, Human
ggguugggcccaga

SEQ ID NO: 3406054 - RNA, 16 nt, Human
ggguugggcccagugu

SEQ ID NO: 3406055 - RNA, 15 nt, Human
ggguuggggccgggc

SEQ ID NO: 3406056 - RNA, 15 nt, Human
ggguuggggugacag

SEQ ID NO: 3406057 - RNA, 19 nt, Human
ggguuggugcacagugauu

SEQ ID NO: 3406058 - RNA, 23 nt, Human
ggguuguaaauuggcauggaaau

SEQ ID NO: 3406059 - RNA, 23 nt, Human
ggguugugaggccuggccaggca

SEQ ID NO: 3406060 - RNA, 19 nt, Human
ggguuuaauccccaguaaa

SEQ ID NO: 3406061 - RNA, 22 nt, Human
ggguuuaauccccaguaaaauu

SEQ ID NO: 3406062 - RNA, 20 nt, Human
ggguuucaccauguuggcca

SEQ ID NO: 3406063 - RNA, 20 nt, Human
ggguuucacuguguuagcca

SEQ ID NO: 3406064 - RNA, 14 nt, Human
ggguuugaauuguu

SEQ ID NO: 3406065 - RNA, 18 nt, Human
ggguuuggaccccagcug

SEQ ID NO: 3406066 - RNA, 17 nt, Human
ggguuugugacagggcg

SEQ ID NO: 3406067 - RNA, 15 nt, Human
ggguuuuaacuuugu

SEQ ID NO: 3406068 - RNA, 12 nt, Human
ggguuuucucuc

SEQ ID NO: 3406069 - RNA, 18 nt, Human
ggguuuuguauucucuga

SEQ ID NO: 3406070 - RNA, 14 nt, Human
gguaaaaaauuuau

SEQ ID NO: 3406071 - RNA, 18 nt, Human
gguaaaaaguauuuuuuc

SEQ ID NO: 3406072 - RNA, 19 nt, Human
gguaaaacucacugugauc

SEQ ID NO: 3406073 - RNA, 12 nt, Human
gguaaaaugaag

SEQ ID NO: 3406074 - RNA, 13 nt, Human
gguaaaaugaaga

SEQ ID NO: 3406075 - RNA, 14 nt, Human
gguaaaaugaagaa

SEQ ID NO: 3406076 - RNA, 13 nt, Human
gguaaaauucuaa

SEQ ID NO: 3406077 - RNA, 14 nt, Human
gguaaaauucuaaa

SEQ ID NO: 3406078 - RNA, 14 nt, Human
gguaaaauugcaug

SEQ ID NO: 3406079 - RNA, 15 nt, Human
gguaaauaaaccacu

SEQ ID NO: 3406080 - RNA, 17 nt, Human
gguaaaugcaaaguucu

SEQ ID NO: 3406081 - RNA, 12 nt, Human
gguaaauguuuc

SEQ ID NO: 3406082 - RNA, 14 nt, Human
gguaacagaacagc

SEQ ID NO: 3406083 - RNA, 13 nt, Human
gguaacaggcaga

SEQ ID NO: 3406084 - RNA, 21 nt, Human
gguaacaguucauguuugcuu

SEQ ID NO: 3406085 - RNA, 13 nt, Human
gguaacuguccug

SEQ ID NO: 3406086 - RNA, 16 nt, Human
gguaacuguccugucc

SEQ ID NO: 3406087 - RNA, 18 nt, Human
gguaagauuguuauuaaa

SEQ ID NO: 3406088 - RNA, 20 nt, Human
gguaaggaauaccugucccc

SEQ ID NO: 3406089 - RNA, 13 nt, Human
gguaaggugccuu

SEQ ID NO: 3406090 - RNA, 19 nt, Human
gguaaguuguuaagagugg

SEQ ID NO: 3406091 - RNA, 18 nt, Human
gguaaguuuuuugaaauu

SEQ ID NO: 3406092 - RNA, 19 nt, Human
gguaauaaguacuguguac

SEQ ID NO: 3406093 - RNA, 20 nt, Human
gguaauacuuccagaagugc

SEQ ID NO: 3406094 - RNA, 18 nt, Human
gguaaucgaccugccucg

SEQ ID NO: 3406095 - RNA, 13 nt, Human
gguacaaaaauaa

SEQ ID NO: 3406096 - RNA, 14 nt, Human
gguacaaaaauaaa

SEQ ID NO: 3406097 - RNA, 15 nt, Human
gguacaaaaauaaau

SEQ ID NO: 3406098 - RNA, 23 nt, Human
gguacaaccuguucugcuuuccu

SEQ ID NO: 3406099 - RNA, 12 nt, Human
gguacagagaag

SEQ ID NO: 3406100 - RNA, 15 nt, Human
gguacagagaagcca

SEQ ID NO: 3406101 - RNA, 18 nt, Human
gguacagagaaggaaugu

SEQ ID NO: 3406102 - RNA, 15 nt, Human
gguaccaaugcugca

SEQ ID NO: 3406103 - RNA, 17 nt, Human
gguaccagauaaaauua

SEQ ID NO: 3406104 - RNA, 12 nt, Human
gguaccagcugc

SEQ ID NO: 3406105 - RNA, 16 nt, Human
gguacccaauucaauu

SEQ ID NO: 3406106 - RNA, 17 nt, Human
gguacccacugcucugg

SEQ ID NO: 3406107 - RNA, 19 nt, Human
gguaccccuuucuggcucu

SEQ ID NO: 3406108 - RNA, 19 nt, Human
gguacccggggcccagggc

SEQ ID NO: 3406109 - RNA, 13 nt, Human
gguacccucugga

SEQ ID NO: 3406110 - RNA, 18 nt, Human
gguaccgucuacauuuca

SEQ ID NO: 3406111 - RNA, 14 nt, Human
gguacgcacagaca

SEQ ID NO: 3406112 - RNA, 18 nt, Human
gguacuaauaaucuuguu

SEQ ID NO: 3406113 - RNA, 23 nt, Human
gguacuauaaaagcuuucugcca

SEQ ID NO: 3406114 - RNA, 19 nt, Human
gguacuauucugauuacac

SEQ ID NO: 3406115 - RNA, 18 nt, Human
gguacugacuuugcuugc

SEQ ID NO: 3406116 - RNA, 15 nt, Human
gguacuguacagcug

SEQ ID NO: 3406117 - RNA, 17 nt, Human
gguacuguaugaucaaa

SEQ ID NO: 3406118 - RNA, 20 nt, Human
gguacuucaggggcacuuca

SEQ ID NO: 3406119 - RNA, 15 nt, Human
gguacuucuugaagg

SEQ ID NO: 3406120 - RNA, 17 nt, Human
gguacuuguggacacag

SEQ ID NO: 3406121 - RNA, 20 nt, Human
gguacuuguggacacagcuc

SEQ ID NO: 3406122 - RNA, 16 nt, Human
gguacuuuuaaaaaca

SEQ ID NO: 3406123 - RNA, 23 nt, Human
gguacuuuuaugauguauauuua

SEQ ID NO: 3406124 - RNA, 22 nt, Human
gguagaaauaucugaaaaugua

SEQ ID NO: 3406125 - RNA, 15 nt, Human
gguagaagggaaagc

SEQ ID NO: 3406126 - RNA, 19 nt, Human
gguagaccugucuccuggc

SEQ ID NO: 3406127 - RNA, 17 nt, Human
gguagagauggaggagg

SEQ ID NO: 3406128 - RNA, 17 nt, Human
gguagagcugauccaga

SEQ ID NO: 3406129 - RNA, 21 nt, Human
gguagagcugauccagagcac

SEQ ID NO: 3406130 - RNA, 20 nt, Human
gguagaggugcaugccuaau

SEQ ID NO: 3406131 - RNA, 18 nt, Human
gguagaguuuacagcucu

SEQ ID NO: 3406132 - RNA, 12 nt, Human
gguagcagcugg

SEQ ID NO: 3406133 - RNA, 14 nt, Human
gguagcagcuggac

SEQ ID NO: 3406134 - RNA, 16 nt, Human
gguagcccgccugcca

SEQ ID NO: 3406135 - RNA, 18 nt, Human
gguagcccuggccagagg

SEQ ID NO: 3406136 - RNA, 17 nt, Human
gguagcuagaggaacca

SEQ ID NO: 3406137 - RNA, 12 nt, Human
gguagcucaggu

SEQ ID NO: 3406138 - RNA, 17 nt, Human
gguagcucaggugggcg

SEQ ID NO: 3406139 - RNA, 12 nt, Human
gguagcugccac

SEQ ID NO: 3406140 - RNA, 18 nt, Human
gguagcugggaaagcaua

SEQ ID NO: 3406141 - RNA, 14 nt, Human
gguagcuuuucccu

SEQ ID NO: 3406142 - RNA, 17 nt, Human
gguaggagggugggaag

SEQ ID NO: 3406143 - RNA, 18 nt, Human
gguaggccaagguguccu

SEQ ID NO: 3406144 - RNA, 14 nt, Human
gguagggcucugac

SEQ ID NO: 3406145 - RNA, 18 nt, Human
gguaggggccccucucag

SEQ ID NO: 3406146 - RNA, 21 nt, Human
gguaggggccccucucagccc

SEQ ID NO: 3406147 - RNA, 16 nt, Human
gguaggggcugggaac

SEQ ID NO: 3406148 - RNA, 13 nt, Human
gguagggggcugg

SEQ ID NO: 3406149 - RNA, 20 nt, Human
gguaggguaagugagagagg

SEQ ID NO: 3406150 - RNA, 16 nt, Human
gguagguucagccaag

SEQ ID NO: 3406151 - RNA, 15 nt, Human
gguagguugggacac

SEQ ID NO: 3406152 - RNA, 14 nt, Human
gguagucaaaggca

SEQ ID NO: 3406153 - RNA, 14 nt, Human
gguaguucaagaaa

SEQ ID NO: 3406154 - RNA, 23 nt, Human
gguaguuuuccauggucacagag

SEQ ID NO: 3406155 - RNA, 12 nt, Human
gguauaaaagau

SEQ ID NO: 3406156 - RNA, 17 nt, Human
gguauaaugguugacug

SEQ ID NO: 3406157 - RNA, 14 nt, Human
ggugacugucuggg

SEQ ID NO: 3406158 - RNA, 19 nt, Human
ggugacuuuggauaauaag

SEQ ID NO: 3406159 - RNA, 15 nt, Human
ggugagaagcagagg

SEQ ID NO: 3406160 - RNA, 16 nt, Human
ggugagaauagaaucu

SEQ ID NO: 3406161 - RNA, 12 nt, Human
ggugagagcugc

SEQ ID NO: 3406162 - RNA, 20 nt, Human
ggugagagggccgggcagag

SEQ ID NO: 3406163 - RNA, 16 nt, Human
ggugagaugcagcugg

SEQ ID NO: 3406164 - RNA, 21 nt, Human
ggugagaugcuggagaagaga

SEQ ID NO: 3406165 - RNA, 23 nt, Human
ggugagaugcuggagaagagagg

SEQ ID NO: 3406166 - RNA, 14 nt, Human
ggugagcaaccagu

SEQ ID NO: 3406167 - RNA, 22 nt, Human
ggugagcccauggcccucccag

SEQ ID NO: 3406168 - RNA, 15 nt, Human
ggugaggaccacucc

SEQ ID NO: 3406169 - RNA, 14 nt, Human
ggugaggcaggcuu

SEQ ID NO: 3406170 - RNA, 17 nt, Human
ggugaggccugucugug

SEQ ID NO: 3406171 - RNA, 19 nt, Human
ggugaggccugucugugac

SEQ ID NO: 3406172 - RNA, 12 nt, Human
ggugagggaugu

SEQ ID NO: 3406173 - RNA, 23 nt, Human
ggugaggucuguuccuuuuauau

SEQ ID NO: 3406174 - RNA, 15 nt, Human
ggugaguccuccaga

SEQ ID NO: 3406175 - RNA, 19 nt, Human
ggugaguuugagcugccuu

SEQ ID NO: 3406176 - RNA, 16 nt, Human
ggugauagcauugcuu

SEQ ID NO: 3406177 - RNA, 20 nt, Human
ggugauauccauucuuucug

SEQ ID NO: 3406178 - RNA, 22 nt, Human
ggugaugagggcagcagccagc

SEQ ID NO: 3406179 - RNA, 15 nt, Human
ggugaugcugggcug

SEQ ID NO: 3406180 - RNA, 13 nt, Human
ggugauggggagg

SEQ ID NO: 3406181 - RNA, 18 nt, Human
ggugauguagcccauccu

SEQ ID NO: 3406182 - RNA, 16 nt, Human
ggugauguccuguaaa

SEQ ID NO: 3406183 - RNA, 22 nt, Human
ggugauuacauaaucuguacaa

SEQ ID NO: 3406184 - RNA, 12 nt, Human
ggugcaaauccu

SEQ ID NO: 3406185 - RNA, 12 nt, Human
ggugcaaccagg

SEQ ID NO: 3406186 - RNA, 22 nt, Human
ggugcaacccaaggacugaggg

SEQ ID NO: 3406187 - RNA, 19 nt, Human
ggugcaaugaccuuucaau

SEQ ID NO: 3406188 - RNA, 20 nt, Human
ggugcaaugaccuuucaaua

SEQ ID NO: 3406189 - RNA, 21 nt, Human
ggugcaauguguguauaugga

SEQ ID NO: 3406190 - RNA, 13 nt, Human
ggugcaauuucaa

SEQ ID NO: 3406191 - RNA, 16 nt, Human
ggugcacaagcuccaa

SEQ ID NO: 3406192 - RNA, 12 nt, Human
ggugcacaggag

SEQ ID NO: 3406193 - RNA, 15 nt, Human
ggugcacagugauuu

SEQ ID NO: 3406194 - RNA, 16 nt, Human
ggugcacagugauuuu

SEQ ID NO: 3406195 - RNA, 17 nt, Human
ggugcacuggccccacc

SEQ ID NO: 3406196 - RNA, 18 nt, Human
ggugcaugccgcugcauc

SEQ ID NO: 3406197 - RNA, 15 nt, Human
ggugccaacuggugu

SEQ ID NO: 3406198 - RNA, 22 nt, Human
ggugccaauggaaccuccuuuc

SEQ ID NO: 3406199 - RNA, 15 nt, Human
ggugccagcaaagcc

SEQ ID NO: 3406200 - RNA, 16 nt, Human
ggugccagcaaagccc

SEQ ID NO: 3406201 - RNA, 17 nt, Human
ggugccagcaacugaau

SEQ ID NO: 3406202 - RNA, 19 nt, Human
ggugccagcaacugaauaa

SEQ ID NO: 3406203 - RNA, 17 nt, Human
ggugccagccugaggca

SEQ ID NO: 3406204 - RNA, 17 nt, Human
ggugcccaagccagagg

SEQ ID NO: 3406205 - RNA, 21 nt, Human
ggugcccaagccagaggcugg

SEQ ID NO: 3406206 - RNA, 22 nt, Human
ggugcccaagccagaggcuggg

SEQ ID NO: 3406207 - RNA, 22 nt, Human
ggugcccaagcucagaaggcuc

SEQ ID NO: 3406208 - RNA, 13 nt, Human
ggugcccacaggc

SEQ ID NO: 3406209 - RNA, 20 nt, Human
ggugcccagaaugaggcugc

SEQ ID NO: 3406210 - RNA, 13 nt, Human
ggugcccaggaga

SEQ ID NO: 3406211 - RNA, 14 nt, Human
ggugcccaggagaa

SEQ ID NO: 3406212 - RNA, 15 nt, Human
ggugccccaggacca

SEQ ID NO: 3406213 - RNA, 17 nt, Human
ggugccccaggaccagc

SEQ ID NO: 3406214 - RNA, 22 nt, Human
ggugccccccaccccuggaaga

SEQ ID NO: 3406215 - RNA, 22 nt, Human
ggugccccccuugccagacaug

SEQ ID NO: 3406216 - RNA, 19 nt, Human
ggugcccccuccucuccca

SEQ ID NO: 3406217 - RNA, 20 nt, Human
ggugcccccuccucucccau

SEQ ID NO: 3406218 - RNA, 13 nt, Human
ggugcccuggaug

SEQ ID NO: 3406219 - RNA, 17 nt, Human
ggugccugagaggcagg

SEQ ID NO: 3406220 - RNA, 19 nt, Human
ggugccugagaggcaggca

SEQ ID NO: 3406221 - RNA, 18 nt, Human
ggugccuggguggggcug

SEQ ID NO: 3406222 - RNA, 22 nt, Human
ggugccuggguggggcugcucc

SEQ ID NO: 3406223 - RNA, 17 nt, Human
ggugccugugaggcagg

SEQ ID NO: 3406224 - RNA, 19 nt, Human
ggugccugugaggcagggg

SEQ ID NO: 3406225 - RNA, 17 nt, Human
ggugccuuuauuuccac

SEQ ID NO: 3406226 - RNA, 17 nt, Human
ggugccuuuccuguuca

SEQ ID NO: 3406227 - RNA, 22 nt, Human
ggugccuuuccuguucagcauu

SEQ ID NO: 3406228 - RNA, 14 nt, Human
ggugcgaccccauc

SEQ ID NO: 3406229 - RNA, 19 nt, Human
ggugcgaccccaucugccc

SEQ ID NO: 3406230 - RNA, 21 nt, Human
ggugcgaccccaucugcccag

SEQ ID NO: 3406231 - RNA, 18 nt, Human
ggugcgagugcgugaaua

SEQ ID NO: 3406232 - RNA, 17 nt, Human
ggugcggcuggccaugg

SEQ ID NO: 3406233 - RNA, 20 nt, Human
ggugcuaaauggucgcccag

SEQ ID NO: 3406234 - RNA, 21 nt, Human
ggugcuaaauggucgcccagg

SEQ ID NO: 3406235 - RNA, 15 nt, Human
ggugcuacgccugca

SEQ ID NO: 3406236 - RNA, 18 nt, Human
ggugcuacuggggaaacu

SEQ ID NO: 3406237 - RNA, 21 nt, Human
ggugcuauaggcuggagaagc

SEQ ID NO: 3406238 - RNA, 20 nt, Human
ggugcuaucucccccagccc

SEQ ID NO: 3406239 - RNA, 15 nt, Human
ggugcucagggcuga

SEQ ID NO: 3406240 - RNA, 19 nt, Human
ggugcugacuggcuucagc

SEQ ID NO: 3406241 - RNA, 21 nt, Human
ggugcugacuucaucucccac

SEQ ID NO: 3406242 - RNA, 22 nt, Human
ggugcugcuacccucccugcug

SEQ ID NO: 3406243 - RNA, 23 nt, Human
ggugcugcuacccucccugcugu

SEQ ID NO: 3406244 - RNA, 18 nt, Human
ggugcuggagcacugggc

SEQ ID NO: 3406245 - RNA, 21 nt, Human
ggugcuggaggugggagcagg

SEQ ID NO: 3406246 - RNA, 19 nt, Human
ggugcugggccccugccuc

SEQ ID NO: 3406247 - RNA, 20 nt, Human
ggugcugggccccugccucu

SEQ ID NO: 3406248 - RNA, 19 nt, Human
ggugcuguccucagguggc

SEQ ID NO: 3406249 - RNA, 19 nt, Human
ggugcuguggccaggguga

SEQ ID NO: 3406250 - RNA, 18 nt, Human
ggugcuuaagcagaagca

SEQ ID NO: 3406251 - RNA, 20 nt, Human
ggugcuuaagcagaagcauu

SEQ ID NO: 3406252 - RNA, 19 nt, Human
ggugcuuauucucaaagca

SEQ ID NO: 3406253 - RNA, 22 nt, Human
ggugcuucuaguucugccagga

SEQ ID NO: 3406254 - RNA, 15 nt, Human
gguggaacaagcaca

SEQ ID NO: 3406255 - RNA, 19 nt, Human
gguggaagaagggagaaga

SEQ ID NO: 3406256 - RNA, 14 nt, Human
gguggaagagcuca

SEQ ID NO: 3406257 - RNA, 19 nt, Human
gguggaagcuuggggaaga

SEQ ID NO: 3406258 - RNA, 15 nt, Human
gguggaaggaggcgc

SEQ ID NO: 3406259 - RNA, 20 nt, Human
gguggaaggguagagaggcg

SEQ ID NO: 3406260 - RNA, 16 nt, Human
gguggacaguccuggg

SEQ ID NO: 3406261 - RNA, 19 nt, Human
gguggacuuagaaagcagg

SEQ ID NO: 3406262 - RNA, 21 nt, Human
gguggacuuagaaagcagggg

SEQ ID NO: 3406263 - RNA, 16 nt, Human
gguggagaaagcacug

SEQ ID NO: 3406264 - RNA, 11 nt, Human
gguggagaagc

SEQ ID NO: 3406265 - RNA, 13 nt, Human
gguggagaagcca

SEQ ID NO: 3406266 - RNA, 13 nt, Human
gguggaggagagc

SEQ ID NO: 3406267 - RNA, 20 nt, Human
gguggaggguggggggcgcu

SEQ ID NO: 3406268 - RNA, 20 nt, Human
gguggagguugcagugagcu

SEQ ID NO: 3406269 - RNA, 15 nt, Human
gguggaguugaaaga

SEQ ID NO: 3406270 - RNA, 13 nt, Human
gguggauauaaau

SEQ ID NO: 3406271 - RNA, 16 nt, Human
gguggaucaccugagg

SEQ ID NO: 3406272 - RNA, 21 nt, Human
gguggaugccugguggcagcu

SEQ ID NO: 3406273 - RNA, 13 nt, Human
gguggauguaaau

SEQ ID NO: 3406274 - RNA, 19 nt, Human
gguggauuccgagugguga

SEQ ID NO: 3406275 - RNA, 17 nt, Human
gguggcaaggcugugcu

SEQ ID NO: 3406276 - RNA, 12 nt, Human
gguggcaagugc

SEQ ID NO: 3406277 - RNA, 18 nt, Human
gguggcacaggcccccuu

SEQ ID NO: 3406278 - RNA, 16 nt, Human
gguggcacugagcccc

SEQ ID NO: 3406279 - RNA, 20 nt, Human
gguggcacugagccccccca

SEQ ID NO: 3406280 - RNA, 14 nt, Human
gguggcagcaacaa

SEQ ID NO: 3406281 - RNA, 12 nt, Human
gguggcagcugc

SEQ ID NO: 3406282 - RNA, 23 nt, Human
gguggcagcugcgguccacccag

SEQ ID NO: 3406283 - RNA, 14 nt, Human
gguggcaggaccag

SEQ ID NO: 3406284 - RNA, 17 nt, Human
gguggcaggaccaggac

SEQ ID NO: 3406285 - RNA, 15 nt, Human
gguggcaguggaggu

SEQ ID NO: 3406286 - RNA, 15 nt, Human
gguggcauacgccug

SEQ ID NO: 3406287 - RNA, 11 nt, Human
gguggccaggc

SEQ ID NO: 3406288 - RNA, 10 nt, Human
gguggccaug

SEQ ID NO: 3406289 - RNA, 13 nt, Human
gguggcccauccc

SEQ ID NO: 3406290 - RNA, 16 nt, Human
gguggcccgacagccu

SEQ ID NO: 3406291 - RNA, 19 nt, Human
gguggcccgacagccuggc

SEQ ID NO: 3406292 - RNA, 15 nt, Human
gguggcccucucccc

SEQ ID NO: 3406293 - RNA, 20 nt, Human
gguggcccuuaugacugcca

SEQ ID NO: 3406294 - RNA, 11 nt, Human
gguggccucag

SEQ ID NO: 3406295 - RNA, 12 nt, Human
gguggccucggg

SEQ ID NO: 3406296 - RNA, 16 nt, Human
gguggcggccccagca

SEQ ID NO: 3406297 - RNA, 20 nt, Human
gguggcgugagccuguaguc

SEQ ID NO: 3406298 - RNA, 14 nt, Human
gguggcuacucugu

SEQ ID NO: 3406299 - RNA, 18 nt, Human
gguggcuacucugugcca

SEQ ID NO: 3406300 - RNA, 22 nt, Human
gguggcuacucugugccagagc

SEQ ID NO: 3406301 - RNA, 21 nt, Human
gguggcuagucaagcuccucc

SEQ ID NO: 3406302 - RNA, 23 nt, Human
gguggcuagucaagcuccuccuc

SEQ ID NO: 3406303 - RNA, 19 nt, Human
gguggcucacaccuguaau

SEQ ID NO: 3406304 - RNA, 20 nt, Human
gguggcucccggagggcccu

SEQ ID NO: 3406305 - RNA, 21 nt, Human
gguggcugacccagucccugg

SEQ ID NO: 3406306 - RNA, 14 nt, Human
gguggcugcagccu

SEQ ID NO: 3406307 - RNA, 13 nt, Human
gguggcuucagcu

SEQ ID NO: 3406308 - RNA, 21 nt, Human
gguggcuuuccuuguggcaga

SEQ ID NO: 3406309 - RNA, 22 nt, Human
gguggcuuuccuuguggcagag

SEQ ID NO: 3406310 - RNA, 14 nt, Human
gguggcuuuugcgg

SEQ ID NO: 3406311 - RNA, 13 nt, Human
ggugggacacccu

SEQ ID NO: 3406312 - RNA, 17 nt, Human
ggugggacacccuguga

SEQ ID NO: 3406313 - RNA, 11 nt, Human
ggugggacccc

SEQ ID NO: 3406314 - RNA, 16 nt, Human
ggugggagagcccagc

SEQ ID NO: 3406315 - RNA, 19 nt, Human
ggugggauccuccaggugc

SEQ ID NO: 3406316 - RNA, 16 nt, Human
ggugggauggaggaga

SEQ ID NO: 3406317 - RNA, 17 nt, Human
ggugggauggaggagaa

SEQ ID NO: 3406318 - RNA, 17 nt, Human
ggugggcacccacccug

SEQ ID NO: 3406319 - RNA, 17 nt, Human
ggugggcccaggaccag

SEQ ID NO: 3406320 - RNA, 23 nt, Human
ggugggcccaggaccagcugggg

SEQ ID NO: 3406321 - RNA, 22 nt, Human
ggugggcccggcccgcgccaca

SEQ ID NO: 3406322 - RNA, 16 nt, Human
ggugggccgcaggcgg

SEQ ID NO: 3406323 - RNA, 15 nt, Human
ggugggccuugcugg

SEQ ID NO: 3406324 - RNA, 13 nt, Human
ggugggcugagcc

SEQ ID NO: 3406325 - RNA, 16 nt, Human
ggugggcugguaucuc

SEQ ID NO: 3406326 - RNA, 16 nt, Human
ggugggcuucagggca

SEQ ID NO: 3406327 - RNA, 12 nt, Human
gguggggaaagg

SEQ ID NO: 3406328 - RNA, 12 nt, Human
gguggggagggg

SEQ ID NO: 3406329 - RNA, 13 nt, Human
gguggggaggggc

SEQ ID NO: 3406330 - RNA, 17 nt, Human
gguggggcagcuugagg

SEQ ID NO: 3406331 - RNA, 16 nt, Human
gguggggcgggaaagc

SEQ ID NO: 3406332 - RNA, 17 nt, Human
gguggggcgggaaagcc

SEQ ID NO: 3406333 - RNA, 18 nt, Human
gguggggcugcuccucca

SEQ ID NO: 3406334 - RNA, 14 nt, Human
ggugggggagggag

SEQ ID NO: 3406335 - RNA, 20 nt, Human
ggugggggccaccugccugc

SEQ ID NO: 3406336 - RNA, 16 nt, Human
gguggggggcuucaua

SEQ ID NO: 3406337 - RNA, 17 nt, Human
gguggggggggugcugg

SEQ ID NO: 3406338 - RNA, 23 nt, Human
gguggggguagagcugauccaga

SEQ ID NO: 3406339 - RNA, 16 nt, Human
gguggggguggaggcu

SEQ ID NO: 3406340 - RNA, 16 nt, Human
ggugggggugggucag

SEQ ID NO: 3406341 - RNA, 15 nt, Human
gguggggucacucug

SEQ ID NO: 3406342 - RNA, 20 nt, Human
ggugggucccggcucugugg

SEQ ID NO: 3406343 - RNA, 14 nt, Human
gguggguggugggg

SEQ ID NO: 3406344 - RNA, 15 nt, Human
gguggguuaauuaaa

SEQ ID NO: 3406345 - RNA, 17 nt, Human
gguggguuuucuuccca

SEQ ID NO: 3406346 - RNA, 22 nt, Human
ggugguaccaggucuccuccac

SEQ ID NO: 3406347 - RNA, 19 nt, Human
gguggucacuggaacucag

SEQ ID NO: 3406348 - RNA, 14 nt, Human
gguggucagcccua

SEQ ID NO: 3406349 - RNA, 18 nt, Human
ggugguccugagaccuga

SEQ ID NO: 3406350 - RNA, 18 nt, Human
gguggucugcaggcaggg

SEQ ID NO: 3406351 - RNA, 13 nt, Human
gguggucugcucg

SEQ ID NO: 3406352 - RNA, 16 nt, Human
gguggucuguuggcag

SEQ ID NO: 3406353 - RNA, 23 nt, Human
gguggugcugggacugagccagu

SEQ ID NO: 3406354 - RNA, 13 nt, Human
ggugguggagcca

SEQ ID NO: 3406355 - RNA, 14 nt, Human
ggugguggggaggg

SEQ ID NO: 3406356 - RNA, 16 nt, Human
gguggugucgggcccu

SEQ ID NO: 3406357 - RNA, 14 nt, Human
gguguaaacacauc

SEQ ID NO: 3406358 - RNA, 22 nt, Human
gguguagaacacuaauucauaa

SEQ ID NO: 3406359 - RNA, 15 nt, Human
gguguagcuacagag

SEQ ID NO: 3406360 - RNA, 22 nt, Human
gguguagcuacagagaaaccag

SEQ ID NO: 3406361 - RNA, 16 nt, Human
gguguaugguucugug

SEQ ID NO: 3406362 - RNA, 19 nt, Human
ggugucaagagggucugag

SEQ ID NO: 3406363 - RNA, 21 nt, Human
ggugucacccaaaccggcagg

SEQ ID NO: 3406364 - RNA, 18 nt, Human
ggugucagacccuggagg

SEQ ID NO: 3406365 - RNA, 13 nt, Human
ggugucaggcugc

SEQ ID NO: 3406366 - RNA, 17 nt, Human
ggugucaggcugcuggc

SEQ ID NO: 3406367 - RNA, 17 nt, Human
ggugucauuucauucca

SEQ ID NO: 3406368 - RNA, 16 nt, Human
ggugucccagaccccg

SEQ ID NO: 3406369 - RNA, 13 nt, Human
gguguccccaaca

SEQ ID NO: 3406370 - RNA, 17 nt, Human
gguguccccagcccacu

SEQ ID NO: 3406371 - RNA, 14 nt, Human
gguguccuacagaa

SEQ ID NO: 3406372 - RNA, 16 nt, Human
gguguccuacagaaaa

SEQ ID NO: 3406373 - RNA, 21 nt, Human
gguguccuacagaaaaaccuu

SEQ ID NO: 3406374 - RNA, 14 nt, Human
gguguccugaccac

SEQ ID NO: 3406375 - RNA, 17 nt, Human
gguguccugaccacccu

SEQ ID NO: 3406376 - RNA, 15 nt, Human
gguguccugccuguc

SEQ ID NO: 3406377 - RNA, 18 nt, Human
gguguccugccugucugc

SEQ ID NO: 3406378 - RNA, 15 nt, Human
ggugucgcgccuucu

SEQ ID NO: 3406379 - RNA, 16 nt, Human
ggugucgggcaugaca

SEQ ID NO: 3406380 - RNA, 15 nt, Human
ggugucucaggcugc

SEQ ID NO: 3406381 - RNA, 16 nt, Human
ggugucucaggcugcc

SEQ ID NO: 3406382 - RNA, 20 nt, Human
ggugucucaggcugccugag

SEQ ID NO: 3406383 - RNA, 21 nt, Human
ggugucucaggcugccugagu

SEQ ID NO: 3406384 - RNA, 16 nt, Human
ggugucugcacccagg

SEQ ID NO: 3406385 - RNA, 15 nt, Human
ggugucuuucucuuu

SEQ ID NO: 3406386 - RNA, 22 nt, Human
ggugugagggcagugcaaggag

SEQ ID NO: 3406387 - RNA, 18 nt, Human
ggugugagucaccaagcc

SEQ ID NO: 3406388 - RNA, 18 nt, Human
ggugugaucgucugacug

SEQ ID NO: 3406389 - RNA, 20 nt, Human
ggugugcaaugucugaguga

SEQ ID NO: 3406390 - RNA, 23 nt, Human
ggugugcacaucucugcuugagu

SEQ ID NO: 3406391 - RNA, 17 nt, Human
ggugugcaccaggguug

SEQ ID NO: 3406392 - RNA, 17 nt, Human
ggugugccuuccagauc

SEQ ID NO: 3406393 - RNA, 22 nt, Human
ggugugcugggagcuccacucu

SEQ ID NO: 3406394 - RNA, 12 nt, Human
gguguggagaag

SEQ ID NO: 3406395 - RNA, 18 nt, Human
gguguggcccugccaucu

SEQ ID NO: 3406396 - RNA, 17 nt, Human
ggugugguacagagaag

SEQ ID NO: 3406397 - RNA, 20 nt, Human
ggugugguacagagaagcca

SEQ ID NO: 3406398 - RNA, 15 nt, Human
gguguggugcagugu

SEQ ID NO: 3406399 - RNA, 17 nt, Human
gguguggugcaguguga

SEQ ID NO: 3406400 - RNA, 18 nt, Human
gguguguggagaugcaga

SEQ ID NO: 3406401 - RNA, 22 nt, Human
gguguguuuuugggaugucuua

SEQ ID NO: 3406402 - RNA, 21 nt, Human
gguguuaucaccgugggcucc

SEQ ID NO: 3406403 - RNA, 11 nt, Human
gguguucuaag

SEQ ID NO: 3406404 - RNA, 17 nt, Human
gguguugacaugugcuu

SEQ ID NO: 3406405 - RNA, 21 nt, Human
gguguugccaaauauguccug

SEQ ID NO: 3406406 - RNA, 19 nt, Human
gguguuguacucaauuuua

SEQ ID NO: 3406407 - RNA, 17 nt, Human
gguguuguaugccuuua

SEQ ID NO: 3406408 - RNA, 13 nt, Human
gguguuuauacag

SEQ ID NO: 3406409 - RNA, 19 nt, Human
gguguuuccuggcacugcu

SEQ ID NO: 3406410 - RNA, 13 nt, Human
gguguuugaaaau

SEQ ID NO: 3406411 - RNA, 20 nt, Human
gguguuuuguucaccauuau

SEQ ID NO: 3406412 - RNA, 23 nt, Human
gguuaaaaaaaggcauuguuuga

SEQ ID NO: 3406413 - RNA, 20 nt, Human
gguuaaaaaaauggcaguga

SEQ ID NO: 3406414 - RNA, 22 nt, Human
gguuaacccuucaucuuccugu

SEQ ID NO: 3406415 - RNA, 22 nt, Human
gguuaaggcugaggaaaggcca

SEQ ID NO: 3406416 - RNA, 17 nt, Human
gguuaaucuuuccugau

SEQ ID NO: 3406417 - RNA, 13 nt, Human
gguuacaacagau

SEQ ID NO: 3406418 - RNA, 19 nt, Human
gguuacaacagauuuguga

SEQ ID NO: 3406419 - RNA, 23 nt, Human
gguuacaaucauugcugaaaaug

SEQ ID NO: 3406420 - RNA, 15 nt, Human
gguuacacuguuaga

SEQ ID NO: 3406421 - RNA, 20 nt, Human
gguuacacuguuagaacacu

SEQ ID NO: 3406422 - RNA, 16 nt, Human
gguuacagagaccuau

SEQ ID NO: 3406423 - RNA, 22 nt, Human
gguuacaguaugcuugcucuaa

SEQ ID NO: 3406424 - RNA, 22 nt, Human
gguuagacagccaaaggcuggc

SEQ ID NO: 3406425 - RNA, 14 nt, Human
gguuagaccuacag

SEQ ID NO: 3406426 - RNA, 20 nt, Human
gguuagaccuacaggggguc

SEQ ID NO: 3406427 - RNA, 13 nt, Human
gguuagauguugc

SEQ ID NO: 3406428 - RNA, 18 nt, Human
gguuagauucaaggcccc

SEQ ID NO: 3406429 - RNA, 16 nt, Human
gguuaggauuuaacag

SEQ ID NO: 3406430 - RNA, 12 nt, Human
gguuauaauuuu

SEQ ID NO: 3406431 - RNA, 23 nt, Human
gguuauacaugacacugaaaugc

SEQ ID NO: 3406432 - RNA, 15 nt, Human
gguuaucugucccag

SEQ ID NO: 3406433 - RNA, 12 nt, Human
gguuaugaaaga

SEQ ID NO: 3406434 - RNA, 17 nt, Human
gguuauguaucagaaga

SEQ ID NO: 3406435 - RNA, 18 nt, Human
gguuauuuaaaauguaaa

SEQ ID NO: 3406436 - RNA, 20 nt, Human
gguuauuuagggaacugcuu

SEQ ID NO: 3406437 - RNA, 17 nt, Human
gguuauuuuaguuucug

SEQ ID NO: 3406438 - RNA, 19 nt, Human
gguuauuuuaguuucuguu

SEQ ID NO: 3406439 - RNA, 23 nt, Human
gguuauuuugauguaaagauguu

SEQ ID NO: 3406440 - RNA, 13 nt, Human
gguucaaagauau

SEQ ID NO: 3406441 - RNA, 22 nt, Human
gguucacaaacuucauuucaga

SEQ ID NO: 3406442 - RNA, 22 nt, Human
gguucacaggcgaggccuggag

SEQ ID NO: 3406443 - RNA, 12 nt, Human
gguucaccagcc

SEQ ID NO: 3406444 - RNA, 14 nt, Human
gguucaccagccuc

SEQ ID NO: 3406445 - RNA, 20 nt, Human
gguucacucuuggagccugc

SEQ ID NO: 3406446 - RNA, 23 nt, Human
gguucacucuuggagccugcaga

SEQ ID NO: 3406447 - RNA, 14 nt, Human
gucagccagggccu

SEQ ID NO: 3406448 - RNA, 16 nt, Human
gucagccagggccugc

SEQ ID NO: 3406449 - RNA, 13 nt, Human
gucagcccuaggg

SEQ ID NO: 3406450 - RNA, 12 nt, Human
gucagccuccag

SEQ ID NO: 3406451 - RNA, 11 nt, Human
gucagccucuc

SEQ ID NO: 3406452 - RNA, 16 nt, Human
gucagccucucuccca

SEQ ID NO: 3406453 - RNA, 20 nt, Human
gucagccucucucccagucu

SEQ ID NO: 3406454 - RNA, 21 nt, Human
gucagccucucucccagucua

SEQ ID NO: 3406455 - RNA, 22 nt, Human
gucagccuucccccucccaggg

SEQ ID NO: 3406456 - RNA, 19 nt, Human
gucagcguugcaugucgug

SEQ ID NO: 3406457 - RNA, 13 nt, Human
gucagcuaaagaa

SEQ ID NO: 3406458 - RNA, 23 nt, Human
gucagcuccccucggagaagagc

SEQ ID NO: 3406459 - RNA, 15 nt, Human
gucagcucccuucuc

SEQ ID NO: 3406460 - RNA, 19 nt, Human
gucagcucucaucugaggc

SEQ ID NO: 3406461 - RNA, 23 nt, Human
gucagcugaggcugggggagagc

SEQ ID NO: 3406462 - RNA, 16 nt, Human
gucagcuugcugcccu

SEQ ID NO: 3406463 - RNA, 18 nt, Human
gucagcuuugccuuccac

SEQ ID NO: 3406464 - RNA, 15 nt, Human
gucaggaagaaauca

SEQ ID NO: 3406465 - RNA, 17 nt, Human
gucaggaggcagaagga

SEQ ID NO: 3406466 - RNA, 20 nt, Human
gucaggagugugugugagug

SEQ ID NO: 3406467 - RNA, 19 nt, Human
gucaggauugcgagagaug

SEQ ID NO: 3406468 - RNA, 14 nt, Human
gucaggcagccagu

SEQ ID NO: 3406469 - RNA, 13 nt, Human
gucaggcagggug

SEQ ID NO: 3406470 - RNA, 15 nt, Human
gucaggccacggcag

SEQ ID NO: 3406471 - RNA, 13 nt, Human
gucaggcccugga

SEQ ID NO: 3406472 - RNA, 16 nt, Human
gucaggccgggcagag

SEQ ID NO: 3406473 - RNA, 22 nt, Human
gucaggccgggcagagcacagc

SEQ ID NO: 3406474 - RNA, 12 nt, Human
gucaggcuccau

SEQ ID NO: 3406475 - RNA, 14 nt, Human
gucaggcucucugg

SEQ ID NO: 3406476 - RNA, 16 nt, Human
gucaggcugcuggcgc

SEQ ID NO: 3406477 - RNA, 17 nt, Human
gucaggcugcuggcgcc

SEQ ID NO: 3406478 - RNA, 13 nt, Human
gucagggaccaag

SEQ ID NO: 3406479 - RNA, 16 nt, Human
gucagggaccaaggac

SEQ ID NO: 3406480 - RNA, 18 nt, Human
gucagggaccccugcccu

SEQ ID NO: 3406481 - RNA, 19 nt, Human
gucagggcccaagucccug

SEQ ID NO: 3406482 - RNA, 16 nt, Human
gucagggcccagaggc

SEQ ID NO: 3406483 - RNA, 20 nt, Human
gucagggcccagaggcugag

SEQ ID NO: 3406484 - RNA, 14 nt, Human
gucaggggcagcug

SEQ ID NO: 3406485 - RNA, 15 nt, Human
gucaggggugacaca

SEQ ID NO: 3406486 - RNA, 15 nt, Human
gucagggugagccca

SEQ ID NO: 3406487 - RNA, 18 nt, Human
gucaggguuggugugcug

SEQ ID NO: 3406488 - RNA, 18 nt, Human
gucagguaggggggaaac

SEQ ID NO: 3406489 - RNA, 16 nt, Human
gucagguggggcagcu

SEQ ID NO: 3406490 - RNA, 17 nt, Human
gucagguggggcagcuu

SEQ ID NO: 3406491 - RNA, 18 nt, Human
gucagguggggcagcuug

SEQ ID NO: 3406492 - RNA, 18 nt, Human
gucagguugacaggaggu

SEQ ID NO: 3406493 - RNA, 18 nt, Human
gucaguacccaccugagc

SEQ ID NO: 3406494 - RNA, 20 nt, Human
gucaguacccaccugagcuu

SEQ ID NO: 3406495 - RNA, 16 nt, Human
gucaguaccuucaaac

SEQ ID NO: 3406496 - RNA, 16 nt, Human
gucaguaucaggccug

SEQ ID NO: 3406497 - RNA, 21 nt, Human
gucaguaucuguaucucucuc

SEQ ID NO: 3406498 - RNA, 16 nt, Human
gucagucuuuuucugu

SEQ ID NO: 3406499 - RNA, 23 nt, Human
gucagugaggcccagggagaggc

SEQ ID NO: 3406500 - RNA, 18 nt, Human
gucagugcaaaugucaga

SEQ ID NO: 3406501 - RNA, 22 nt, Human
gucagugguccacaucccggga

SEQ ID NO: 3406502 - RNA, 16 nt, Human
gucaguguagaucaac

SEQ ID NO: 3406503 - RNA, 17 nt, Human
gucaguguccaaagcag

SEQ ID NO: 3406504 - RNA, 11 nt, Human
gucaguuuuca

SEQ ID NO: 3406505 - RNA, 21 nt, Human
gucauaaagugagaaaacugu

SEQ ID NO: 3406506 - RNA, 22 nt, Human
gucauaaagugagaaaacugug

SEQ ID NO: 3406507 - RNA, 17 nt, Human
gucauaacuagaacuga

SEQ ID NO: 3406508 - RNA, 13 nt, Human
gucauacagagaa

SEQ ID NO: 3406509 - RNA, 14 nt, Human
gucauacagagaag

SEQ ID NO: 3406510 - RNA, 16 nt, Human
gucauaccaacuuuag

SEQ ID NO: 3406511 - RNA, 15 nt, Human
gucauaccaaugaaa

SEQ ID NO: 3406512 - RNA, 19 nt, Human
gucauagauguuuccuugc

SEQ ID NO: 3406513 - RNA, 15 nt, Human
gucauaggaaguuag

SEQ ID NO: 3406514 - RNA, 21 nt, Human
gucauauaagauucauauuua

SEQ ID NO: 3406515 - RNA, 23 nt, Human
gucaucaauaguguccuaugcaa

SEQ ID NO: 3406516 - RNA, 23 nt, Human
gucaucacucuagguuuuacaga

SEQ ID NO: 3406517 - RNA, 17 nt, Human
gucaucacuuuucagug

SEQ ID NO: 3406518 - RNA, 14 nt, Human
gucaucagccacca

SEQ ID NO: 3406519 - RNA, 17 nt, Human
gucaucaggagaaaaag

SEQ ID NO: 3406520 - RNA, 17 nt, Human
gucaucaucauggccag

SEQ ID NO: 3406521 - RNA, 21 nt, Human
gucaucauuguauauaugugu

SEQ ID NO: 3406522 - RNA, 18 nt, Human
gucauccagacucagagc

SEQ ID NO: 3406523 - RNA, 21 nt, Human
gucaucccaucauuuuccaua

SEQ ID NO: 3406524 - RNA, 22 nt, Human
gucauccuuggucuuuguaucu

SEQ ID NO: 3406525 - RNA, 12 nt, Human
gucaucuaguuu

SEQ ID NO: 3406526 - RNA, 16 nt, Human
gucaucucagcuggau

SEQ ID NO: 3406527 - RNA, 17 nt, Human
gucaucuccaucagcug

SEQ ID NO: 3406528 - RNA, 23 nt, Human
gucaucugaauuugcccugggaa

SEQ ID NO: 3406529 - RNA, 18 nt, Human
gucaucuugaccaagcag

SEQ ID NO: 3406530 - RNA, 23 nt, Human
gucaucuuucuuuucuuugaguc

SEQ ID NO: 3406531 - RNA, 16 nt, Human
gucaugagcugagcag

SEQ ID NO: 3406532 - RNA, 22 nt, Human
gucaugaucucccugccgccuc

SEQ ID NO: 3406533 - RNA, 17 nt, Human
gucaugcaaaggcuggg

SEQ ID NO: 3406534 - RNA, 19 nt, Human
gucaugcacaguauuugua

SEQ ID NO: 3406535 - RNA, 24 nt, Human
gucaugcacaguauuuguaauuaa

SEQ ID NO: 3406536 - RNA, 19 nt, Human
gucaugcuccccugugcca

SEQ ID NO: 3406537 - RNA, 16 nt, Human
gucauggagaaccacc

SEQ ID NO: 3406538 - RNA, 16 nt, Human
gucauggccacacugu

SEQ ID NO: 3406539 - RNA, 22 nt, Human
gucauggccacacugugacaca

SEQ ID NO: 3406540 - RNA, 22 nt, Human
gucauggcugugcccucuugau

SEQ ID NO: 3406541 - RNA, 16 nt, Human
gucauguaaauacugu

SEQ ID NO: 3406542 - RNA, 19 nt, Human
gucauguaaauacuguugg

SEQ ID NO: 3406543 - RNA, 15 nt, Human
gucaugugacaggua

SEQ ID NO: 3406544 - RNA, 12 nt, Human
gucauguguaua

SEQ ID NO: 3406545 - RNA, 23 nt, Human
gucauguguucccuuugucuuuc

SEQ ID NO: 3406546 - RNA, 23 nt, Human
gucauguuggucaaaagcuggau

SEQ ID NO: 3406547 - RNA, 14 nt, Human
gucauguuuaucug

SEQ ID NO: 3406548 - RNA, 16 nt, Human
gucauguuuuaaaugu

SEQ ID NO: 3406549 - RNA, 17 nt, Human
gucauguuuuaaaugua

SEQ ID NO: 3406550 - RNA, 20 nt, Human
gucauguuuuaaauguacag

SEQ ID NO: 3406551 - RNA, 14 nt, Human
gucauuaaaauaaa

SEQ ID NO: 3406552 - RNA, 12 nt, Human
gucauuaaacug

SEQ ID NO: 3406553 - RNA, 19 nt, Human
gucauuagccugaguagaa

SEQ ID NO: 3406554 - RNA, 21 nt, Human
gucauuagccugaguagaaag

SEQ ID NO: 3406555 - RNA, 22 nt, Human
gucauuauagaucccccagacu

SEQ ID NO: 3406556 - RNA, 21 nt, Human
gucauuauggguuaggcauua

SEQ ID NO: 3406557 - RNA, 21 nt, Human
gucauucagauaugauucaaa

SEQ ID NO: 3406558 - RNA, 21 nt, Human
gucauucgcuacuaugauuua

SEQ ID NO: 3406559 - RNA, 18 nt, Human
gucauugcuguugucccu

SEQ ID NO: 3406560 - RNA, 13 nt, Human
gucauugcuucuu

SEQ ID NO: 3406561 - RNA, 15 nt, Human
gucauugcuucuucu

SEQ ID NO: 3406562 - RNA, 16 nt, Human
gucauugcuuuacugg

SEQ ID NO: 3406563 - RNA, 20 nt, Human
gucauuguaaacaaacucuu

SEQ ID NO: 3406564 - RNA, 23 nt, Human
gucauuguaauguugugaauaau

SEQ ID NO: 3406565 - RNA, 21 nt, Human
gucauuguuauauaaucauua

SEQ ID NO: 3406566 - RNA, 14 nt, Human
gucauuuaaaugug

SEQ ID NO: 3406567 - RNA, 17 nt, Human
gucauuuacuaaacaua

SEQ ID NO: 3406568 - RNA, 16 nt, Human
gucauuuauuuuaaaa

SEQ ID NO: 3406569 - RNA, 15 nt, Human
gucauuucauuccau

SEQ ID NO: 3406570 - RNA, 16 nt, Human
gucauuucauuccauu

SEQ ID NO: 3406571 - RNA, 20 nt, Human
gucauuucauuccauugccu

SEQ ID NO: 3406572 - RNA, 17 nt, Human
gucauuugagcagggcu

SEQ ID NO: 3406573 - RNA, 21 nt, Human
gucauuugagcagggcucagc

SEQ ID NO: 3406574 - RNA, 16 nt, Human
gucauuugcucugccu

SEQ ID NO: 3406575 - RNA, 18 nt, Human
gucauuuugguacuuugg

SEQ ID NO: 3406576 - RNA, 20 nt, Human
guccaaaaccgccagcucug

SEQ ID NO: 3406577 - RNA, 20 nt, Human
guccaaauaaaaacuaaauu

SEQ ID NO: 3406578 - RNA, 18 nt, Human
guccaacguggggcagca

SEQ ID NO: 3406579 - RNA, 14 nt, Human
guccaacuccagua

SEQ ID NO: 3406580 - RNA, 22 nt, Human
guccaagaauccacauuucuaa

SEQ ID NO: 3406581 - RNA, 13 nt, Human
guccaagcagauu

SEQ ID NO: 3406582 - RNA, 21 nt, Human
guccaagcauuuagauguaua

SEQ ID NO: 3406583 - RNA, 22 nt, Human
guccaaggaaaccacagcugcu

SEQ ID NO: 3406584 - RNA, 22 nt, Human
guccaagggguccccuccagga

SEQ ID NO: 3406585 - RNA, 15 nt, Human
guccaagugugugug

SEQ ID NO: 3406586 - RNA, 16 nt, Human
guccaagugugugugc

SEQ ID NO: 3406587 - RNA, 17 nt, Human
guccaagugugugugcg

SEQ ID NO: 3406588 - RNA, 17 nt, Human
guccaauccuauguuuu

SEQ ID NO: 3406589 - RNA, 15 nt, Human
guccaaugagcuuuc

SEQ ID NO: 3406590 - RNA, 17 nt, Human
guccaaugagcuuucug

SEQ ID NO: 3406591 - RNA, 15 nt, Human
guccucccccugcca

SEQ ID NO: 3406592 - RNA, 19 nt, Human
guccuccccucacagccuc

SEQ ID NO: 3406593 - RNA, 17 nt, Human
guccuccccucucuugu

SEQ ID NO: 3406594 - RNA, 16 nt, Human
guccucccgagcuccu

SEQ ID NO: 3406595 - RNA, 17 nt, Human
guccucccgggcccucc

SEQ ID NO: 3406596 - RNA, 14 nt, Human
guccucccucaccc

SEQ ID NO: 3406597 - RNA, 13 nt, Human
guccuccucaccu

SEQ ID NO: 3406598 - RNA, 17 nt, Human
guccuccuccagggaca

SEQ ID NO: 3406599 - RNA, 22 nt, Human
guccuccucggaucaccgagag

SEQ ID NO: 3406600 - RNA, 14 nt, Human
guccuccucuguga

SEQ ID NO: 3406601 - RNA, 17 nt, Human
guccuccugcugccagu

SEQ ID NO: 3406602 - RNA, 22 nt, Human
guccuccugguggguccagggg

SEQ ID NO: 3406603 - RNA, 23 nt, Human
guccuccugguggguccaggggc

SEQ ID NO: 3406604 - RNA, 18 nt, Human
guccucguuuguguucug

SEQ ID NO: 3406605 - RNA, 18 nt, Human
guccucuccaccuagugg

SEQ ID NO: 3406606 - RNA, 20 nt, Human
guccucuccaccuaguggcu

SEQ ID NO: 3406607 - RNA, 13 nt, Human
guccucugaauga

SEQ ID NO: 3406608 - RNA, 17 nt, Human
guccucugaaugaaccu

SEQ ID NO: 3406609 - RNA, 19 nt, Human
guccucugauacccagagc

SEQ ID NO: 3406610 - RNA, 21 nt, Human
guccucuggauggcaccagag

SEQ ID NO: 3406611 - RNA, 19 nt, Human
guccucuucccucucugca

SEQ ID NO: 3406612 - RNA, 13 nt, Human
guccucuucugca

SEQ ID NO: 3406613 - RNA, 15 nt, Human
guccucuuucaaagg

SEQ ID NO: 3406614 - RNA, 16 nt, Human
guccucuuucagaaaa

SEQ ID NO: 3406615 - RNA, 20 nt, Human
guccucuuucagaaaacaga

SEQ ID NO: 3406616 - RNA, 13 nt, Human
guccucuuucagc

SEQ ID NO: 3406617 - RNA, 19 nt, Human
guccucuuucagcuccuga

SEQ ID NO: 3406618 - RNA, 15 nt, Human
guccugaccacccuc

SEQ ID NO: 3406619 - RNA, 16 nt, Human
guccugaccacccucc

SEQ ID NO: 3406620 - RNA, 21 nt, Human
guccugaccacccuccccucu

SEQ ID NO: 3406621 - RNA, 23 nt, Human
guccugaccacccuccccucucu

SEQ ID NO: 3406622 - RNA, 17 nt, Human
guccugacuucaggggc

SEQ ID NO: 3406623 - RNA, 20 nt, Human
guccugacuucaggggcugc

SEQ ID NO: 3406624 - RNA, 13 nt, Human
guccugagaccug

SEQ ID NO: 3406625 - RNA, 18 nt, Human
guccugagcacugccagg

SEQ ID NO: 3406626 - RNA, 19 nt, Human
guccugagcacugccagga

SEQ ID NO: 3406627 - RNA, 18 nt, Human
guccugagccccagggag

SEQ ID NO: 3406628 - RNA, 18 nt, Human
guccugagcucagcgugg

SEQ ID NO: 3406629 - RNA, 19 nt, Human
guccugauggucagcuccc

SEQ ID NO: 3406630 - RNA, 20 nt, Human
guccugauggucagcucccu

SEQ ID NO: 3406631 - RNA, 10 nt, Human
guccugcagc

SEQ ID NO: 3406632 - RNA, 23 nt, Human
guccugcagcaaacacuccaccc

SEQ ID NO: 3406633 - RNA, 19 nt, Human
guccugcagucuggcugag

SEQ ID NO: 3406634 - RNA, 20 nt, Human
guccugccacccagccccag

SEQ ID NO: 3406635 - RNA, 14 nt, Human
guccugccaccugg

SEQ ID NO: 3406636 - RNA, 17 nt, Human
guccugccaccuggggc

SEQ ID NO: 3406637 - RNA, 16 nt, Human
guccugccggagagga

SEQ ID NO: 3406638 - RNA, 22 nt, Human
guccugccuaaggcugaacuug

SEQ ID NO: 3406639 - RNA, 15 nt, Human
guccugccucagccu

SEQ ID NO: 3406640 - RNA, 13 nt, Human
guccugccuggcc

SEQ ID NO: 3406641 - RNA, 12 nt, Human
guccugccuguc

SEQ ID NO: 3406642 - RNA, 22 nt, Human
guccugccuguggcgccgucuc

SEQ ID NO: 3406643 - RNA, 21 nt, Human
guccugcuauuucccaagcug

SEQ ID NO: 3406644 - RNA, 21 nt, Human
guccugcucauuaugccacuu

SEQ ID NO: 3406645 - RNA, 11 nt, Human
guccugcucca

SEQ ID NO: 3406646 - RNA, 19 nt, Human
guccugcugcaguugccag

SEQ ID NO: 3406647 - RNA, 17 nt, Human
guccuggagcaaucaca

SEQ ID NO: 3406648 - RNA, 14 nt, Human
guccuggaggggcu

SEQ ID NO: 3406649 - RNA, 17 nt, Human
guccuggauguugugug

SEQ ID NO: 3406650 - RNA, 16 nt, Human
guccuggcaugggaau

SEQ ID NO: 3406651 - RNA, 22 nt, Human
guccuggccagauggcccggau

SEQ ID NO: 3406652 - RNA, 18 nt, Human
guccuggccaucccacaa

SEQ ID NO: 3406653 - RNA, 14 nt, Human
guccuggccuggcu

SEQ ID NO: 3406654 - RNA, 11 nt, Human
guccuggcucc

SEQ ID NO: 3406655 - RNA, 16 nt, Human
guccugggaggagaga

SEQ ID NO: 3406656 - RNA, 15 nt, Human
guccugggagugagc

SEQ ID NO: 3406657 - RNA, 17 nt, Human
guccugggagugagcug

SEQ ID NO: 3406658 - RNA, 19 nt, Human
guccugggagugagcuggu

SEQ ID NO: 3406659 - RNA, 13 nt, Human
guccugggccugc

SEQ ID NO: 3406660 - RNA, 17 nt, Human
guccugggccugcagaa

SEQ ID NO: 3406661 - RNA, 17 nt, Human
guccugggcgcccugga

SEQ ID NO: 3406662 - RNA, 23 nt, Human
guccugggcgcccuggaagccgg

SEQ ID NO: 3406663 - RNA, 12 nt, Human
guccugggcugg

SEQ ID NO: 3406664 - RNA, 17 nt, Human
guccuggggcucugugc

SEQ ID NO: 3406665 - RNA, 12 nt, Human
guccuggugccc

SEQ ID NO: 3406666 - RNA, 11 nt, Human
guccugguguc

SEQ ID NO: 3406667 - RNA, 13 nt, Human
guccuggugucac

SEQ ID NO: 3406668 - RNA, 22 nt, Human
guccuguaguuuuauuuuaugu

SEQ ID NO: 3406669 - RNA, 15 nt, Human
guccuguaugucugu

SEQ ID NO: 3406670 - RNA, 19 nt, Human
guccugucagugccgccgc

SEQ ID NO: 3406671 - RNA, 23 nt, Human
guccugucaucaucauggccagc

SEQ ID NO: 3406672 - RNA, 18 nt, Human
guccugucuccccucugc

SEQ ID NO: 3406673 - RNA, 15 nt, Human
guccugugaauuucu

SEQ ID NO: 3406674 - RNA, 16 nt, Human
guccugugagaugugu

SEQ ID NO: 3406675 - RNA, 19 nt, Human
guccugugagguuucccaa

SEQ ID NO: 3406676 - RNA, 20 nt, Human
guccugugagguuucccaau

SEQ ID NO: 3406677 - RNA, 23 nt, Human
guccuuaaacagggcaucuccag

SEQ ID NO: 3406678 - RNA, 17 nt, Human
guccuuaccagcagagc

SEQ ID NO: 3406679 - RNA, 21 nt, Human
guccuuaccagcagagcaccu

SEQ ID NO: 3406680 - RNA, 18 nt, Human
guccuuacuccuguggga

SEQ ID NO: 3406681 - RNA, 20 nt, Human
guccuuagccuggaccucug

SEQ ID NO: 3406682 - RNA, 18 nt, Human
guccuuaggccucugaga

SEQ ID NO: 3406683 - RNA, 17 nt, Human
guccuuaucuagcugca

SEQ ID NO: 3406684 - RNA, 22 nt, Human
guccuuauguuaagcccuggca

SEQ ID NO: 3406685 - RNA, 13 nt, Human
guccuucaaaggc

SEQ ID NO: 3406686 - RNA, 12 nt, Human
guccuucccucu

SEQ ID NO: 3406687 - RNA, 15 nt, Human
guccuuccugaaacu

SEQ ID NO: 3406688 - RNA, 19 nt, Human
guccuugagugcucuugcu

SEQ ID NO: 3406689 - RNA, 14 nt, Human
guccuugauuucaa

SEQ ID NO: 3406690 - RNA, 17 nt, Human
guccuugcaccugcauc

SEQ ID NO: 3406691 - RNA, 22 nt, Human
guccuugcugguuuucuggaug

SEQ ID NO: 3406692 - RNA, 13 nt, Human
guccuuggccccc

SEQ ID NO: 3406693 - RNA, 15 nt, Human
guccuuggcccccuu

SEQ ID NO: 3406694 - RNA, 22 nt, Human
guccuuggugugacccucugaa

SEQ ID NO: 3406695 - RNA, 21 nt, Human
guccuugugaugugcacguaa

SEQ ID NO: 3406696 - RNA, 13 nt, Human
guccuuuagaaac

SEQ ID NO: 3406697 - RNA, 16 nt, Human
guccuuuauguggaaa

SEQ ID NO: 3406698 - RNA, 22 nt, Human
guccuuucuagagcacugccac

SEQ ID NO: 3406699 - RNA, 20 nt, Human
guccuuucuuccggccccuc

SEQ ID NO: 3406700 - RNA, 19 nt, Human
guccuuuuacuacagcuau

SEQ ID NO: 3406701 - RNA, 18 nt, Human
guccuuuucacuacacca

SEQ ID NO: 3406702 - RNA, 22 nt, Human
guccuuuucauaggucugaaau

SEQ ID NO: 3406703 - RNA, 16 nt, Human
guccuuuugacacugc

SEQ ID NO: 3406704 - RNA, 20 nt, Human
guccuuuugacacugcucua

SEQ ID NO: 3406705 - RNA, 21 nt, Human
guccuuuugacacugcucuaa

SEQ ID NO: 3406706 - RNA, 12 nt, Human
guccuuuuguaa

SEQ ID NO: 3406707 - RNA, 17 nt, Human
guccuuuuguaccaugg

SEQ ID NO: 3406708 - RNA, 13 nt, Human
guccuuuugucuu

SEQ ID NO: 3406709 - RNA, 16 nt, Human
guccuuuuuccucucc

SEQ ID NO: 3406710 - RNA, 13 nt, Human
gucgagcuccccc

SEQ ID NO: 3406711 - RNA, 15 nt, Human
gucgaggggcucuca

SEQ ID NO: 3406712 - RNA, 19 nt, Human
gucgaggggcucucagcuc

SEQ ID NO: 3406713 - RNA, 14 nt, Human
gucgauagagcugu

SEQ ID NO: 3406714 - RNA, 14 nt, Human
gucgauauuuccau

SEQ ID NO: 3406715 - RNA, 12 nt, Human
gucgcccaggag

SEQ ID NO: 3406716 - RNA, 15 nt, Human
gucgcccaggcugga

SEQ ID NO: 3406717 - RNA, 21 nt, Human
gucgcccuuugcugcauggca

SEQ ID NO: 3406718 - RNA, 13 nt, Human
gucgcgcugccug

SEQ ID NO: 3406719 - RNA, 17 nt, Human
gucgcgcugccugugug

SEQ ID NO: 3406720 - RNA, 16 nt, Human
gucgcucaugugugca

SEQ ID NO: 3406721 - RNA, 18 nt, Human
gucgcucugcuggccugg

SEQ ID NO: 3406722 - RNA, 20 nt, Human
gucgcucugcuggccuggcc

SEQ ID NO: 3406723 - RNA, 14 nt, Human
gucggaacagcaga

SEQ ID NO: 3406724 - RNA, 15 nt, Human
gucggaggaaagaca

SEQ ID NO: 3406725 - RNA, 16 nt, Human
gucggaggcuugggac

SEQ ID NO: 3406726 - RNA, 19 nt, Human
gucggccccaccagugccu

SEQ ID NO: 3406727 - RNA, 22 nt, Human
gucggccucuaaccccaggccc

SEQ ID NO: 3406728 - RNA, 11 nt, Human
gucggcuccag

SEQ ID NO: 3406729 - RNA, 17 nt, Human
gucggcugaccaugcuc

SEQ ID NO: 3406730 - RNA, 18 nt, Human
gucgggaguucgagacca

SEQ ID NO: 3406731 - RNA, 14 nt, Human
gucgggcaccagcc

SEQ ID NO: 3406732 - RNA, 18 nt, Human
gucgggcaccagccagcg

SEQ ID NO: 3406733 - RNA, 12 nt, Human
gucgggcucagc

SEQ ID NO: 3406734 - RNA, 16 nt, Human
gucgggcuuuguguga

SEQ ID NO: 3406735 - RNA, 14 nt, Human
gucggggcaucugg

SEQ ID NO: 3406736 - RNA, 15 nt, Human
gucgggggcuggccu

SEQ ID NO: 3406737 - RNA, 23 nt, Human
gucggguuuuauuguuuaaaauc

SEQ ID NO: 3406738 - RNA, 18 nt, Human
gucgguccuggugcccug

SEQ ID NO: 3406739 - RNA, 14 nt, Human
gucggugccuucaa

SEQ ID NO: 3406740 - RNA, 20 nt, Human
gucguagccaaggugggcug

SEQ ID NO: 3406741 - RNA, 17 nt, Human
gucguaguuacucucag

SEQ ID NO: 3406742 - RNA, 18 nt, Human
gucgucaaagcugaaaug

SEQ ID NO: 3406743 - RNA, 15 nt, Human
gucgucgcacagucu

SEQ ID NO: 3406744 - RNA, 12 nt, Human
gucgugccugug

SEQ ID NO: 3406745 - RNA, 24 nt, Human
gucguggagagcuaggagcaaagc

SEQ ID NO: 3406746 - RNA, 17 nt, Human
gucguggagaugucuuc

SEQ ID NO: 3406747 - RNA, 23 nt, Human
gucguggcagauaaucagccucu

SEQ ID NO: 3406748 - RNA, 19 nt, Human
gucguggggugugcuggga

SEQ ID NO: 3406749 - RNA, 17 nt, Human
gucguugacuuuaggga

SEQ ID NO: 3406750 - RNA, 17 nt, Human
gucguuuuccaaacuga

SEQ ID NO: 3406751 - RNA, 13 nt, Human
gucuaaaacaaua

SEQ ID NO: 3406752 - RNA, 16 nt, Human
gucuaaaauccugcuu

SEQ ID NO: 3406753 - RNA, 10 nt, Human
gucuaaacug

SEQ ID NO: 3406754 - RNA, 15 nt, Human
gucuaaaguuuacag

SEQ ID NO: 3406755 - RNA, 17 nt, Human
gucuaaaguuuacagua

SEQ ID NO: 3406756 - RNA, 16 nt, Human
gucuaaauaaguuugc

SEQ ID NO: 3406757 - RNA, 16 nt, Human
gucuaacucagaauua

SEQ ID NO: 3406758 - RNA, 22 nt, Human
gucuaacuuuagaagugcauuu

SEQ ID NO: 3406759 - RNA, 23 nt, Human
gucuaacuuuagaagugcauuuc

SEQ ID NO: 3406760 - RNA, 14 nt, Human
gucuaagaaacauu

SEQ ID NO: 3406761 - RNA, 19 nt, Human
gucuaagaaacauuggaag

SEQ ID NO: 3406762 - RNA, 23 nt, Human
gucuaagacuauauauauaaaug

SEQ ID NO: 3406763 - RNA, 12 nt, Human
gucuaagauucu

SEQ ID NO: 3406764 - RNA, 13 nt, Human
gucuaagauucua

SEQ ID NO: 3406765 - RNA, 18 nt, Human
gucuaagauucuagauca

SEQ ID NO: 3406766 - RNA, 15 nt, Human
gucuaauguuuaagc

SEQ ID NO: 3406767 - RNA, 17 nt, Human
gucuaauguuuaagcag

SEQ ID NO: 3406768 - RNA, 19 nt, Human
gucuacacugcaaucauau

SEQ ID NO: 3406769 - RNA, 21 nt, Human
gucuacacugcaaucauaugu

SEQ ID NO: 3406770 - RNA, 15 nt, Human
gucuacacugugcug

SEQ ID NO: 3406771 - RNA, 15 nt, Human
gucuacagcuccccc

SEQ ID NO: 3406772 - RNA, 17 nt, Human
gucuacagcucccccag

SEQ ID NO: 3406773 - RNA, 22 nt, Human
gucuacauaacuaauacagcug

SEQ ID NO: 3406774 - RNA, 14 nt, Human
gucuaccaucuccc

SEQ ID NO: 3406775 - RNA, 20 nt, Human
gucuacccagagaagccccu

SEQ ID NO: 3406776 - RNA, 23 nt, Human
gucuaccccucccggcccugccu

SEQ ID NO: 3406777 - RNA, 13 nt, Human
gucuacccuggga

SEQ ID NO: 3406778 - RNA, 13 nt, Human
gucuaccugaggg

SEQ ID NO: 3406779 - RNA, 14 nt, Human
gucuaccugagggg

SEQ ID NO: 3406780 - RNA, 15 nt, Human
gucuaccugaggggc

SEQ ID NO: 3406781 - RNA, 16 nt, Human
gucuaccugaggggcc

SEQ ID NO: 3406782 - RNA, 18 nt, Human
gucuacucuuaagccauc

SEQ ID NO: 3406783 - RNA, 23 nt, Human
gucuacucuuaagccaucuuggu

SEQ ID NO: 3406784 - RNA, 21 nt, Human
gucuagaaguuguuugucauc

SEQ ID NO: 3406785 - RNA, 13 nt, Human
gucuagagaggga

SEQ ID NO: 3406786 - RNA, 14 nt, Human
gucuagagagggag

SEQ ID NO: 3406787 - RNA, 15 nt, Human
gucuagagagggagg

SEQ ID NO: 3406788 - RNA, 16 nt, Human
gucuagagagggaggc

SEQ ID NO: 3406789 - RNA, 15 nt, Human
gucuagauggcuccu

SEQ ID NO: 3406790 - RNA, 17 nt, Human
gucuagauggcuccucu

SEQ ID NO: 3406791 - RNA, 18 nt, Human
gucuagauggcuccucuc

SEQ ID NO: 3406792 - RNA, 19 nt, Human
gucuagauggcuccucuca

SEQ ID NO: 3406793 - RNA, 22 nt, Human
gucuagauguuuauucuucuag

SEQ ID NO: 3406794 - RNA, 20 nt, Human
gucuagauuaauacucuauu

SEQ ID NO: 3406795 - RNA, 15 nt, Human
gucuagauucaaagg

SEQ ID NO: 3406796 - RNA, 20 nt, Human
gucuagauucaaagguucua

SEQ ID NO: 3406797 - RNA, 21 nt, Human
gucuagcguagugcagcaggg

SEQ ID NO: 3406798 - RNA, 13 nt, Human
gucuaggagcugg

SEQ ID NO: 3406799 - RNA, 22 nt, Human
gucuaggucaguacccaccuga

SEQ ID NO: 3406800 - RNA, 14 nt, Human
gucuagucucuccu

SEQ ID NO: 3406801 - RNA, 22 nt, Human
gucuaguuccugaugacccagg

SEQ ID NO: 3406802 - RNA, 21 nt, Human
gucuaguugccaaaucuggcu

SEQ ID NO: 3406803 - RNA, 15 nt, Human
gucuauaaagcauuu

SEQ ID NO: 3406804 - RNA, 22 nt, Human
gucuauaccuuaagaaugccaa

SEQ ID NO: 3406805 - RNA, 14 nt, Human
gucuaucauuguug

SEQ ID NO: 3406806 - RNA, 13 nt, Human
gucuauccacaga

SEQ ID NO: 3406807 - RNA, 14 nt, Human
gucuauccacagag

SEQ ID NO: 3406808 - RNA, 15 nt, Human
gucuauccacagaga

SEQ ID NO: 3406809 - RNA, 17 nt, Human
gucuaucuaaugacaug

SEQ ID NO: 3406810 - RNA, 22 nt, Human
gucuaucugguauuaaaugcca

SEQ ID NO: 3406811 - RNA, 21 nt, Human
gucuaugacuuauuuccuuca

SEQ ID NO: 3406812 - RNA, 22 nt, Human
gucuauguaaaugcaucugucc

SEQ ID NO: 3406813 - RNA, 13 nt, Human
gucuauuccagcu

SEQ ID NO: 3406814 - RNA, 20 nt, Human
gucuauuccagcucauucau

SEQ ID NO: 3406815 - RNA, 21 nt, Human
gucuauuccagcucauucauu

SEQ ID NO: 3406816 - RNA, 17 nt, Human
gucuauucuccagcuga

SEQ ID NO: 3406817 - RNA, 14 nt, Human
gucuauuucuaguu

SEQ ID NO: 3406818 - RNA, 13 nt, Human
gucuauuucugcu

SEQ ID NO: 3406819 - RNA, 12 nt, Human
gucuauuugaga

SEQ ID NO: 3406820 - RNA, 11 nt, Human
gucuauuuuaa

SEQ ID NO: 3406821 - RNA, 16 nt, Human
gucucaaacuccugac

SEQ ID NO: 3406822 - RNA, 21 nt, Human
gucucaacucuguccccagga

SEQ ID NO: 3406823 - RNA, 12 nt, Human
gucucaaugcuc

SEQ ID NO: 3406824 - RNA, 14 nt, Human
gucucaaugcucau

SEQ ID NO: 3406825 - RNA, 13 nt, Human
gucucacagcccu

SEQ ID NO: 3406826 - RNA, 19 nt, Human
gucucacaguguugcccag

SEQ ID NO: 3406827 - RNA, 22 nt, Human
gucucaccauuuccccagggca

SEQ ID NO: 3406828 - RNA, 23 nt, Human
gucucacccaugcaagcagagga

SEQ ID NO: 3406829 - RNA, 19 nt, Human
gucucaccggcucucaccu

SEQ ID NO: 3406830 - RNA, 16 nt, Human
gucucacucugucgcc

SEQ ID NO: 3406831 - RNA, 21 nt, Human
gucucacucugucgcccaguc

SEQ ID NO: 3406832 - RNA, 21 nt, Human
gucucacugaaacauuuaaau

SEQ ID NO: 3406833 - RNA, 16 nt, Human
gucucacugagcacug

SEQ ID NO: 3406834 - RNA, 15 nt, Human
gucucacugcuugaa

SEQ ID NO: 3406835 - RNA, 21 nt, Human
gucucacuguugcccaggcug

SEQ ID NO: 3406836 - RNA, 17 nt, Human
gucucagaaucuuuccu

SEQ ID NO: 3406837 - RNA, 17 nt, Human
gucucagauuuuauuau

SEQ ID NO: 3406838 - RNA, 21 nt, Human
gucucagauuuuauuauguaa

SEQ ID NO: 3406839 - RNA, 22 nt, Human
gucucagcagcgaccaccccug

SEQ ID NO: 3406840 - RNA, 13 nt, Human
gucucagccuccc

SEQ ID NO: 3406841 - RNA, 13 nt, Human
gucucaggcugcc

SEQ ID NO: 3406842 - RNA, 18 nt, Human
gucucaggcugccugagu

SEQ ID NO: 3406843 - RNA, 17 nt, Human
gucucaggcugguggga

SEQ ID NO: 3406844 - RNA, 22 nt, Human
gucucaggcuggugggaggggc

SEQ ID NO: 3406845 - RNA, 17 nt, Human
gucucagggugcagagg

SEQ ID NO: 3406846 - RNA, 22 nt, Human
gucucagguuuguuuugugaau

SEQ ID NO: 3406847 - RNA, 18 nt, Human
gucucaguggcuucaucu

SEQ ID NO: 3406848 - RNA, 22 nt, Human
gucucaguggcuucaucuguca

SEQ ID NO: 3406849 - RNA, 14 nt, Human
gucucaguuucuug

SEQ ID NO: 3406850 - RNA, 14 nt, Human
gucucauccccagg

SEQ ID NO: 3406851 - RNA, 14 nt, Human
gucucauccuccug

SEQ ID NO: 3406852 - RNA, 22 nt, Human
gucucaucuggggagcaggcag

SEQ ID NO: 3406853 - RNA, 11 nt, Human
gucucaugugu

SEQ ID NO: 3406854 - RNA, 20 nt, Human
gucucauuccguugucugug

SEQ ID NO: 3406855 - RNA, 15 nt, Human
gucucauuuuaaugu

SEQ ID NO: 3406856 - RNA, 20 nt, Human
gucucauuuuaauguaaaga

SEQ ID NO: 3406857 - RNA, 16 nt, Human
gucuccaaccccccag

SEQ ID NO: 3406858 - RNA, 12 nt, Human
gucuccaccagg

SEQ ID NO: 3406859 - RNA, 15 nt, Human
gucuccaccaggaac

SEQ ID NO: 3406860 - RNA, 20 nt, Human
gucuccagaaagccccaccc

SEQ ID NO: 3406861 - RNA, 20 nt, Human
gucuccagccccuucucaga

SEQ ID NO: 3406862 - RNA, 13 nt, Human
gucuccagcugcu

SEQ ID NO: 3406863 - RNA, 21 nt, Human
gucuccaggggcugcuuccuc

SEQ ID NO: 3406864 - RNA, 22 nt, Human
gucuccaggggcugcuuccucc

SEQ ID NO: 3406865 - RNA, 23 nt, Human
gucuccaggggcugcuuccuccu

SEQ ID NO: 3406866 - RNA, 17 nt, Human
gucucccacgugggaga

SEQ ID NO: 3406867 - RNA, 18 nt, Human
gucucccccaacagcugg

SEQ ID NO: 3406868 - RNA, 23 nt, Human
gucucccccaacagcuggacccu

SEQ ID NO: 3406869 - RNA, 20 nt, Human
gucucccccacccuuguucc

SEQ ID NO: 3406870 - RNA, 14 nt, Human
gucuccccucugcu

SEQ ID NO: 3406871 - RNA, 19 nt, Human
gucuccccucugcuggccg

SEQ ID NO: 3406872 - RNA, 19 nt, Human
gucuccccuguuccccucu

SEQ ID NO: 3406873 - RNA, 22 nt, Human
gucucccuauaaugcuggagcg

SEQ ID NO: 3406874 - RNA, 14 nt, Human
gucucccucuccug

SEQ ID NO: 3406875 - RNA, 19 nt, Human
gucucccucuccugccuac

SEQ ID NO: 3406876 - RNA, 21 nt, Human
gucucccucuccugccuacuc

SEQ ID NO: 3406877 - RNA, 11 nt, Human
gucucccuggc

SEQ ID NO: 3406878 - RNA, 14 nt, Human
gucucccuggcccu

SEQ ID NO: 3406879 - RNA, 15 nt, Human
gucucccuggcccuc

SEQ ID NO: 3406880 - RNA, 15 nt, Human
gucucccuucuccca

SEQ ID NO: 3406881 - RNA, 20 nt, Human
guggguggauauaaauauau

SEQ ID NO: 3406882 - RNA, 14 nt, Human
guggguggggcugc

SEQ ID NO: 3406883 - RNA, 12 nt, Human
guggguguguga

SEQ ID NO: 3406884 - RNA, 13 nt, Human
guggguucuaugu

SEQ ID NO: 3406885 - RNA, 19 nt, Human
guggguuuguggggggagg

SEQ ID NO: 3406886 - RNA, 12 nt, Human
gugguacagaga

SEQ ID NO: 3406887 - RNA, 17 nt, Human
gugguacagagaagcca

SEQ ID NO: 3406888 - RNA, 19 nt, Human
gugguaggccuuuuaacau

SEQ ID NO: 3406889 - RNA, 19 nt, Human
gugguaugaucacggcuca

SEQ ID NO: 3406890 - RNA, 13 nt, Human
gugguaugugaca

SEQ ID NO: 3406891 - RNA, 18 nt, Human
gugguauuaauuuugaua

SEQ ID NO: 3406892 - RNA, 14 nt, Human
gugguauuuucaau

SEQ ID NO: 3406893 - RNA, 18 nt, Human
guggucacagcggaggug

SEQ ID NO: 3406894 - RNA, 22 nt, Human
guggucacagcggaggugugga

SEQ ID NO: 3406895 - RNA, 24 nt, Human
guggucccaacaggaggacaauuc

SEQ ID NO: 3406896 - RNA, 15 nt, Human
gugguccugagaccu

SEQ ID NO: 3406897 - RNA, 13 nt, Human
guggucucaggau

SEQ ID NO: 3406898 - RNA, 17 nt, Human
guggucuccuuggaaau

SEQ ID NO: 3406899 - RNA, 21 nt, Human
guggucugagccaaagagaau

SEQ ID NO: 3406900 - RNA, 22 nt, Human
guggucugcucgggcccaggcc

SEQ ID NO: 3406901 - RNA, 22 nt, Human
guggucuguuggcaggcuggcc

SEQ ID NO: 3406902 - RNA, 16 nt, Human
guggucuuucuggaga

SEQ ID NO: 3406903 - RNA, 17 nt, Human
guggugaccucugccug

SEQ ID NO: 3406904 - RNA, 13 nt, Human
guggugacuuugg

SEQ ID NO: 3406905 - RNA, 16 nt, Human
guggugacuuuggaua

SEQ ID NO: 3406906 - RNA, 18 nt, Human
guggugauuugaaaaaua

SEQ ID NO: 3406907 - RNA, 18 nt, Human
guggugccaucauugcug

SEQ ID NO: 3406908 - RNA, 23 nt, Human
guggugccaucauugcugucugc

SEQ ID NO: 3406909 - RNA, 22 nt, Human
guggugccauccccagggggca

SEQ ID NO: 3406910 - RNA, 19 nt, Human
guggugcgaucuggguuca

SEQ ID NO: 3406911 - RNA, 14 nt, Human
guggugcugggacu

SEQ ID NO: 3406912 - RNA, 14 nt, Human
gugguggcaggcac

SEQ ID NO: 3406913 - RNA, 15 nt, Human
gugguggcagggccu

SEQ ID NO: 3406914 - RNA, 23 nt, Human
gugguggcauacgccuguagucc

SEQ ID NO: 3406915 - RNA, 15 nt, Human
gugguggcucugaga

SEQ ID NO: 3406916 - RNA, 19 nt, Human
guggugguaacccuggugg

SEQ ID NO: 3406917 - RNA, 20 nt, Human
guggugguaacccugguggu

SEQ ID NO: 3406918 - RNA, 15 nt, Human
gugguggucccuggg

SEQ ID NO: 3406919 - RNA, 20 nt, Human
guggugguuuucuguucuuu

SEQ ID NO: 3406920 - RNA, 19 nt, Human
guggugucacugucccucc

SEQ ID NO: 3406921 - RNA, 23 nt, Human
guggugugucccccucuguccag

SEQ ID NO: 3406922 - RNA, 14 nt, Human
gugguuacacagug

SEQ ID NO: 3406923 - RNA, 20 nt, Human
gugguuauaacuuaaugaaa

SEQ ID NO: 3406924 - RNA, 20 nt, Human
gugguucacucuuggagccu

SEQ ID NO: 3406925 - RNA, 21 nt, Human
gugguucacucuuggagccug

SEQ ID NO: 3406926 - RNA, 20 nt, Human
gugguucugagauggcuccc

SEQ ID NO: 3406927 - RNA, 21 nt, Human
gugguugaggcuaaguuggga

SEQ ID NO: 3406928 - RNA, 13 nt, Human
gugguugugaucc

SEQ ID NO: 3406929 - RNA, 23 nt, Human
gugguuuccaaggagcugagaau

SEQ ID NO: 3406930 - RNA, 21 nt, Human
gugguuugauggugacuuccu

SEQ ID NO: 3406931 - RNA, 12 nt, Human
gugguuuggaau

SEQ ID NO: 3406932 - RNA, 24 nt, Human
gugguuuuccccucccuggguuca

SEQ ID NO: 3406933 - RNA, 16 nt, Human
gugguuuucuguuucu

SEQ ID NO: 3406934 - RNA, 15 nt, Human
guguaaaaaugagaa

SEQ ID NO: 3406935 - RNA, 16 nt, Human
guguaaaaaugagaac

SEQ ID NO: 3406936 - RNA, 20 nt, Human
guguaaaaaugagaacaugu

SEQ ID NO: 3406937 - RNA, 18 nt, Human
guguaaaauauuuugaau

SEQ ID NO: 3406938 - RNA, 21 nt, Human
guguaaagcauuccaacaaag

SEQ ID NO: 3406939 - RNA, 18 nt, Human
guguaaauacaauuuugu

SEQ ID NO: 3406940 - RNA, 21 nt, Human
guguaaauacaauuuuguuuc

SEQ ID NO: 3406941 - RNA, 22 nt, Human
guguaaauacaauuuuguuucu

SEQ ID NO: 3406942 - RNA, 19 nt, Human
guguaaauaguuacuccag

SEQ ID NO: 3406943 - RNA, 19 nt, Human
guguaacaauuguguagcc

SEQ ID NO: 3406944 - RNA, 13 nt, Human
guguaacagcucc

SEQ ID NO: 3406945 - RNA, 14 nt, Human
guguaacagcuccu

SEQ ID NO: 3406946 - RNA, 15 nt, Human
guguaacagcugagg

SEQ ID NO: 3406947 - RNA, 21 nt, Human
guguaacagcugaggucucuu

SEQ ID NO: 3406948 - RNA, 21 nt, Human
guguaaccugagauggcccuc

SEQ ID NO: 3406949 - RNA, 23 nt, Human
guguaaccugagauggcccucug

SEQ ID NO: 3406950 - RNA, 19 nt, Human
guguaacugcccaaagcag

SEQ ID NO: 3406951 - RNA, 23 nt, Human
guguaacugucagccgggcccug

SEQ ID NO: 3406952 - RNA, 17 nt, Human
guguaagacaaaaagcu

SEQ ID NO: 3406953 - RNA, 12 nt, Human
guguaagagaau

SEQ ID NO: 3406954 - RNA, 21 nt, Human
guguaaguagauaggccaugg

SEQ ID NO: 3406955 - RNA, 21 nt, Human
guguaauaaaguguuuucaga

SEQ ID NO: 3406956 - RNA, 22 nt, Human
guguaauaaaguguuuucagag

SEQ ID NO: 3406957 - RNA, 12 nt, Human
guguaauaagac

SEQ ID NO: 3406958 - RNA, 14 nt, Human
guguaauaagacau

SEQ ID NO: 3406959 - RNA, 19 nt, Human
guguaaucauuucuugggc

SEQ ID NO: 3406960 - RNA, 23 nt, Human
guguaaucauuucuugggcccuc

SEQ ID NO: 3406961 - RNA, 18 nt, Human
guguaauugagaaggaaa

SEQ ID NO: 3406962 - RNA, 13 nt, Human
guguacaaagaaa

SEQ ID NO: 3406963 - RNA, 16 nt, Human
guguacaauguacaca

SEQ ID NO: 3406964 - RNA, 19 nt, Human
guguacacugacaccuuug

SEQ ID NO: 3406965 - RNA, 18 nt, Human
guguacagaauucugcua

SEQ ID NO: 3406966 - RNA, 16 nt, Human
guguacagccagacca

SEQ ID NO: 3406967 - RNA, 12 nt, Human
guguacagguac

SEQ ID NO: 3406968 - RNA, 16 nt, Human
guguacagucuuguau

SEQ ID NO: 3406969 - RNA, 17 nt, Human
guguacaguuggcaugg

SEQ ID NO: 3406970 - RNA, 16 nt, Human
guguacauaacugaaa

SEQ ID NO: 3406971 - RNA, 12 nt, Human
guguacauaugu

SEQ ID NO: 3406972 - RNA, 19 nt, Human
guguacaucccauguaaca

SEQ ID NO: 3406973 - RNA, 15 nt, Human
guguaccauuaaaau

SEQ ID NO: 3406974 - RNA, 22 nt, Human
guguaccgcgucuacccuggga

SEQ ID NO: 3406975 - RNA, 13 nt, Human
guguacucccagg

SEQ ID NO: 3406976 - RNA, 21 nt, Human
guguacucccagggcuuacgg

SEQ ID NO: 3406977 - RNA, 15 nt, Human
guguacucuggccuc

SEQ ID NO: 3406978 - RNA, 19 nt, Human
guguacucuggccucuguc

SEQ ID NO: 3406979 - RNA, 19 nt, Human
guguacuguauagacaguu

SEQ ID NO: 3406980 - RNA, 23 nt, Human
guguacuucccgggccagggcug

SEQ ID NO: 3406981 - RNA, 13 nt, Human
guguagaagcauu

SEQ ID NO: 3406982 - RNA, 22 nt, Human
guguagacgaagggggcaucug

SEQ ID NO: 3406983 - RNA, 17 nt, Human
guguagaguuaagaagc

SEQ ID NO: 3406984 - RNA, 21 nt, Human
guguagccagguauggcucug

SEQ ID NO: 3406985 - RNA, 15 nt, Human
guguagccccaagaa

SEQ ID NO: 3406986 - RNA, 20 nt, Human
guguagccccaagaaggcug

SEQ ID NO: 3406987 - RNA, 22 nt, Human
guguagcuacagagaaaccagc

SEQ ID NO: 3406988 - RNA, 16 nt, Human
guguagcugugaccug

SEQ ID NO: 3406989 - RNA, 23 nt, Human
guguagcugugaccugcugagcu

SEQ ID NO: 3406990 - RNA, 15 nt, Human
guguaggcagacaca

SEQ ID NO: 3406991 - RNA, 14 nt, Human
guguauaauauaaa

SEQ ID NO: 3406992 - RNA, 14 nt, Human
guguauacaugcca

SEQ ID NO: 3406993 - RNA, 14 nt, Human
guguauauauacau

SEQ ID NO: 3406994 - RNA, 12 nt, Human
guguauauauau

SEQ ID NO: 3406995 - RNA, 13 nt, Human
guguauaucagaa

SEQ ID NO: 3406996 - RNA, 15 nt, Human
guguauauuauuugg

SEQ ID NO: 3406997 - RNA, 15 nt, Human
guguaucaaaaugcu

SEQ ID NO: 3406998 - RNA, 16 nt, Human
guguauccauuaucau

SEQ ID NO: 3406999 - RNA, 23 nt, Human
guguauccauuaucauguguaau

SEQ ID NO: 3407000 - RNA, 13 nt, Human
guguauccugggg

SEQ ID NO: 3407001 - RNA, 14 nt, Human
guguauccuggggc

SEQ ID NO: 3407002 - RNA, 20 nt, Human
guguauccuggggcucccuu

SEQ ID NO: 3407003 - RNA, 23 nt, Human
guguauggguguuggugaacuug

SEQ ID NO: 3407004 - RNA, 17 nt, Human
guguauguacauauaua

SEQ ID NO: 3407005 - RNA, 20 nt, Human
guguaugugaguauucucau

SEQ ID NO: 3407006 - RNA, 21 nt, Human
guguaugugggggucugugug

SEQ ID NO: 3407007 - RNA, 19 nt, Human
guguauucuaguuuuguca

SEQ ID NO: 3407008 - RNA, 12 nt, Human
guguauuguucc

SEQ ID NO: 3407009 - RNA, 17 nt, Human
guguauuuaacagggag

SEQ ID NO: 3407010 - RNA, 20 nt, Human
guguauuuaauuguaaacug

SEQ ID NO: 3407011 - RNA, 17 nt, Human
guguauuuacgcuuuga

SEQ ID NO: 3407012 - RNA, 12 nt, Human
guguauuuauuu

SEQ ID NO: 3407013 - RNA, 21 nt, Human
guguauuuauuuuccucccca

SEQ ID NO: 3407014 - RNA, 14 nt, Human
guguauuucaguuc

SEQ ID NO: 3407015 - RNA, 10 nt, Human
guguauuugc

SEQ ID NO: 3407016 - RNA, 14 nt, Human
guguauuuucaguc

SEQ ID NO: 3407017 - RNA, 17 nt, Human
guguauuuuuuuacuaa

SEQ ID NO: 3407018 - RNA, 23 nt, Human
guguauuuuuuuacuaauagaca

SEQ ID NO: 3407019 - RNA, 19 nt, Human
gugucaaccagacagaggg

SEQ ID NO: 3407020 - RNA, 19 nt, Human
gugucaacucuuuguuauu

SEQ ID NO: 3407021 - RNA, 20 nt, Human
gugucaagagggucugagga

SEQ ID NO: 3407022 - RNA, 16 nt, Human
gugucaaguugugcuu

SEQ ID NO: 3407023 - RNA, 18 nt, Human
gugucaaguugugcuugu

SEQ ID NO: 3407024 - RNA, 15 nt, Human
gugucaccccagagc

SEQ ID NO: 3407025 - RNA, 19 nt, Human
guguuuuuuuaugaauggg

SEQ ID NO: 3407026 - RNA, 22 nt, Human
guguuuuuuuuucguuuguuug

SEQ ID NO: 3407027 - RNA, 15 nt, Human
guuaaaaaaauggca

SEQ ID NO: 3407028 - RNA, 22 nt, Human
guuaaaaacagauuuggaaaga

SEQ ID NO: 3407029 - RNA, 11 nt, Human
guuaaaaauaa

SEQ ID NO: 3407030 - RNA, 18 nt, Human
guuaaaacuguacauuua

SEQ ID NO: 3407031 - RNA, 19 nt, Human
guuaaaacuguacauuuaa

SEQ ID NO: 3407032 - RNA, 12 nt, Human
guuaaaacuguc

SEQ ID NO: 3407033 - RNA, 14 nt, Human
guuaaaagagguuu

SEQ ID NO: 3407034 - RNA, 22 nt, Human
guuaaaauacaguucugucaua

SEQ ID NO: 3407035 - RNA, 14 nt, Human
guuaaaauggauuu

SEQ ID NO: 3407036 - RNA, 13 nt, Human
guuaaaauuauac

SEQ ID NO: 3407037 - RNA, 14 nt, Human
guuaaacauugaag

SEQ ID NO: 3407038 - RNA, 21 nt, Human
guuaaaccaugggauaaaugc

SEQ ID NO: 3407039 - RNA, 19 nt, Human
guuaaacuagcauaucugc

SEQ ID NO: 3407040 - RNA, 22 nt, Human
guuaaacuagcauaucugccuu

SEQ ID NO: 3407041 - RNA, 17 nt, Human
guuaaacucgcucacug

SEQ ID NO: 3407042 - RNA, 12 nt, Human
guuaaacuguua

SEQ ID NO: 3407043 - RNA, 21 nt, Human
guuaaagggaagaaaacacug

SEQ ID NO: 3407044 - RNA, 21 nt, Human
guuaaauaaauuguauauuca

SEQ ID NO: 3407045 - RNA, 16 nt, Human
guuaaauacaggaaac

SEQ ID NO: 3407046 - RNA, 20 nt, Human
guuaaauacaggaaacaguu

SEQ ID NO: 3407047 - RNA, 20 nt, Human
guuaaauagaguauaugcac

SEQ ID NO: 3407048 - RNA, 21 nt, Human
guuaaauagaguauaugcacu

SEQ ID NO: 3407049 - RNA, 15 nt, Human
guuaaaugaaauugu

SEQ ID NO: 3407050 - RNA, 17 nt, Human
guuaaauugcuguguau

SEQ ID NO: 3407051 - RNA, 12 nt, Human
guuaacaaauaa

SEQ ID NO: 3407052 - RNA, 17 nt, Human
guuaacaaauaacaacu

SEQ ID NO: 3407053 - RNA, 14 nt, Human
guuaacaaugauau

SEQ ID NO: 3407054 - RNA, 12 nt, Human
guuaacacauuu

SEQ ID NO: 3407055 - RNA, 20 nt, Human
guuaacagaagggagggcag

SEQ ID NO: 3407056 - RNA, 19 nt, Human
guuaacauaguaaguucag

SEQ ID NO: 3407057 - RNA, 21 nt, Human
guuaacauugaccaagaacug

SEQ ID NO: 3407058 - RNA, 22 nt, Human
guuaacauuguugcucccugug

SEQ ID NO: 3407059 - RNA, 15 nt, Human
guuaaccauuuaagu

SEQ ID NO: 3407060 - RNA, 16 nt, Human
guuaaccucugcuuuu

SEQ ID NO: 3407061 - RNA, 20 nt, Human
guuaacuauguacaauauuu

SEQ ID NO: 3407062 - RNA, 23 nt, Human
guuaacuauguacaauauuuuaa

SEQ ID NO: 3407063 - RNA, 18 nt, Human
guuaacugagugccuuuu

SEQ ID NO: 3407064 - RNA, 12 nt, Human
guuaagaaaaaa

SEQ ID NO: 3407065 - RNA, 20 nt, Human
guuaagaaaucuguuuuugu

SEQ ID NO: 3407066 - RNA, 15 nt, Human
guuaagaaauuucac

SEQ ID NO: 3407067 - RNA, 15 nt, Human
guuaagaaugucgau

SEQ ID NO: 3407068 - RNA, 17 nt, Human
guuaagacaugauuucc

SEQ ID NO: 3407069 - RNA, 16 nt, Human
guuaagacuugacagu

SEQ ID NO: 3407070 - RNA, 17 nt, Human
guuaagacuugacagug

SEQ ID NO: 3407071 - RNA, 19 nt, Human
guuaagacuugacagugga

SEQ ID NO: 3407072 - RNA, 10 nt, Human
guuaagagaa

SEQ ID NO: 3407073 - RNA, 15 nt, Human
guuaagagaaacuuu

SEQ ID NO: 3407074 - RNA, 19 nt, Human
guuaagagaaacuuuauac

SEQ ID NO: 3407075 - RNA, 14 nt, Human
guuaagauuccuaa

SEQ ID NO: 3407076 - RNA, 21 nt, Human
guuaagcauuaccacucaggc

SEQ ID NO: 3407077 - RNA, 12 nt, Human
guuaagccuuug

SEQ ID NO: 3407078 - RNA, 16 nt, Human
guuaagccuuuggaaa

SEQ ID NO: 3407079 - RNA, 19 nt, Human
guuaaggaaacucuuaucu

SEQ ID NO: 3407080 - RNA, 21 nt, Human
guuaaggaaacucuuaucuca

SEQ ID NO: 3407081 - RNA, 13 nt, Human
guuaagggaagga

SEQ ID NO: 3407082 - RNA, 22 nt, Human
guuaagggaaggaacucuggcu

SEQ ID NO: 3407083 - RNA, 15 nt, Human
guuaaggugggcccg

SEQ ID NO: 3407084 - RNA, 21 nt, Human
guuaagucuaucugguauuaa

SEQ ID NO: 3407085 - RNA, 13 nt, Human
guuaagucuguuu

SEQ ID NO: 3407086 - RNA, 23 nt, Human
guuaaguugagauaguuuucauc

SEQ ID NO: 3407087 - RNA, 19 nt, Human
guuaauaagcaaaauccug

SEQ ID NO: 3407088 - RNA, 16 nt, Human
guuaauacaagguaua

SEQ ID NO: 3407089 - RNA, 12 nt, Human
guuaauacuagu

SEQ ID NO: 3407090 - RNA, 16 nt, Human
guuaauauucuuucaa

SEQ ID NO: 3407091 - RNA, 17 nt, Human
guuaauauucuuucaau

SEQ ID NO: 3407092 - RNA, 15 nt, Human
guuaauauuuaagac

SEQ ID NO: 3407093 - RNA, 17 nt, Human
guuaaucaacugaaagu

SEQ ID NO: 3407094 - RNA, 13 nt, Human
guuaaucaauuua

SEQ ID NO: 3407095 - RNA, 17 nt, Human
guuaaucaauuuaaacc

SEQ ID NO: 3407096 - RNA, 22 nt, Human
guuaaucaauuuaaacccauuu

SEQ ID NO: 3407097 - RNA, 19 nt, Human
guuaaucucuguuauguac

SEQ ID NO: 3407098 - RNA, 21 nt, Human
guuaaucuugcuuucuuuguu

SEQ ID NO: 3407099 - RNA, 23 nt, Human
guuaaugaugguugauggguucu

SEQ ID NO: 3407100 - RNA, 23 nt, Human
guuaauguauuuguucauguuug

SEQ ID NO: 3407101 - RNA, 15 nt, Human
guuaauuagcauucu

SEQ ID NO: 3407102 - RNA, 18 nt, Human
guuaauucagcacugauu

SEQ ID NO: 3407103 - RNA, 17 nt, Human
guuaauugauagaauaa

SEQ ID NO: 3407104 - RNA, 13 nt, Human
guuaauuuaaguu

SEQ ID NO: 3407105 - RNA, 22 nt, Human
guuaauuuugaagugcuguuua

SEQ ID NO: 3407106 - RNA, 20 nt, Human
guuaauuuuuccaacuacua

SEQ ID NO: 3407107 - RNA, 14 nt, Human
guuaauuuuuccua

SEQ ID NO: 3407108 - RNA, 13 nt, Human
guuacaaaaugua

SEQ ID NO: 3407109 - RNA, 15 nt, Human
guuacaaacugcaau

SEQ ID NO: 3407110 - RNA, 23 nt, Human
guuacaaacugcaauagagacug

SEQ ID NO: 3407111 - RNA, 17 nt, Human
guuacaaauuauaaugu

SEQ ID NO: 3407112 - RNA, 22 nt, Human
guuacaacagauuugugaacuc

SEQ ID NO: 3407113 - RNA, 18 nt, Human
guuacaaucauugcugaa

SEQ ID NO: 3407114 - RNA, 14 nt, Human
guuacacaaagaac

SEQ ID NO: 3407115 - RNA, 21 nt, Human
guuacacaaaggaccucagcu

SEQ ID NO: 3407116 - RNA, 20 nt, Human
guuacacagaaaugcugcug

SEQ ID NO: 3407117 - RNA, 17 nt, Human
guuacacagugugaaua

SEQ ID NO: 3407118 - RNA, 20 nt, Human
guuacacauuaaguaaucaa

SEQ ID NO: 3407119 - RNA, 16 nt, Human
guuacacauuuuucag

SEQ ID NO: 3407120 - RNA, 15 nt, Human
guuacacuaaaaggu

SEQ ID NO: 3407121 - RNA, 22 nt, Human
guuacacuuuuuggaagugaaa

SEQ ID NO: 3407122 - RNA, 22 nt, Human
guuacagagaccuauguaagaa

SEQ ID NO: 3407123 - RNA, 21 nt, Human
guuacagcacaaaaugauggc

SEQ ID NO: 3407124 - RNA, 16 nt, Human
guuacagccaagugcc

SEQ ID NO: 3407125 - RNA, 19 nt, Human
guuacagcgagaggcagag

SEQ ID NO: 3407126 - RNA, 19 nt, Human
guuacagguaccaguucuu

SEQ ID NO: 3407127 - RNA, 15 nt, Human
guuacaguucugugg

SEQ ID NO: 3407128 - RNA, 20 nt, Human
guuacaugcagccacuuagg

SEQ ID NO: 3407129 - RNA, 19 nt, Human
guuacaugcauacuucaaa

SEQ ID NO: 3407130 - RNA, 14 nt, Human
guuacauguuugca

SEQ ID NO: 3407131 - RNA, 15 nt, Human
guuaccaugucacug

SEQ ID NO: 3407132 - RNA, 15 nt, Human
guuaccaugucuuuc

SEQ ID NO: 3407133 - RNA, 23 nt, Human
guuaccauuaaaccaucucccug

SEQ ID NO: 3407134 - RNA, 14 nt, Human
guuaccauuggaaa

SEQ ID NO: 3407135 - RNA, 16 nt, Human
guuaccauuggaaauu

SEQ ID NO: 3407136 - RNA, 19 nt, Human
guuaccauuggaaauuuca

SEQ ID NO: 3407137 - RNA, 16 nt, Human
guuaccauuuacaugu

SEQ ID NO: 3407138 - RNA, 20 nt, Human
guuacccaguaacucaucug

SEQ ID NO: 3407139 - RNA, 10 nt, Human
guuaccuaau

SEQ ID NO: 3407140 - RNA, 23 nt, Human
guuaccuccaacagaacuaaaug

SEQ ID NO: 3407141 - RNA, 17 nt, Human
guuaccuccuauaaacu

SEQ ID NO: 3407142 - RNA, 21 nt, Human
guuaccugaucaaugacagag

SEQ ID NO: 3407143 - RNA, 13 nt, Human
guuaccugugugc

SEQ ID NO: 3407144 - RNA, 14 nt, Human
guuaccugugugcu

SEQ ID NO: 3407145 - RNA, 20 nt, Human
guuaccuuauaguuacugug

SEQ ID NO: 3407146 - RNA, 22 nt, Human
guuacuaaguuuuuauggcuuu

SEQ ID NO: 3407147 - RNA, 15 nt, Human
guuacuacaugcacu

SEQ ID NO: 3407148 - RNA, 15 nt, Human
guuacucagaauucu

SEQ ID NO: 3407149 - RNA, 15 nt, Human
guuacucagcccugg

SEQ ID NO: 3407150 - RNA, 16 nt, Human
guuacucagcccuggg

SEQ ID NO: 3407151 - RNA, 21 nt, Human
guuacuccaaaacuucguuua

SEQ ID NO: 3407152 - RNA, 17 nt, Human
guuacucuccaaccugg

SEQ ID NO: 3407153 - RNA, 14 nt, Human
guuacucugaaggg

SEQ ID NO: 3407154 - RNA, 15 nt, Human
guuacucuugggaca

SEQ ID NO: 3407155 - RNA, 14 nt, Human
guuacugccuuaau

SEQ ID NO: 3407156 - RNA, 19 nt, Human
guuacugugccauguguuu

SEQ ID NO: 3407157 - RNA, 11 nt, Human
guuacuguucu

SEQ ID NO: 3407158 - RNA, 12 nt, Human
guuacuguucuu

SEQ ID NO: 3407159 - RNA, 24 nt, Human
guuacuguucuugcugcuagaacu

SEQ ID NO: 3407160 - RNA, 14 nt, Human
guuacuguugugac

SEQ ID NO: 3407161 - RNA, 17 nt, Human
guuacuuaccuaaacag

SEQ ID NO: 3407162 - RNA, 14 nt, Human
guuacuucuucucu

SEQ ID NO: 3407163 - RNA, 15 nt, Human
guuacuucuucucuu

SEQ ID NO: 3407164 - RNA, 21 nt, Human
guuacuuuauguuugucuuuu

SEQ ID NO: 3407165 - RNA, 21 nt, Human
guuacuuuccaauucuccuuu

SEQ ID NO: 3407166 - RNA, 21 nt, Human
guuacuuuucauauuugcacu

SEQ ID NO: 3407167 - RNA, 22 nt, Human
guuacuuuucauauuugcacua

SEQ ID NO: 3407168 - RNA, 13 nt, Human
guuacuuuuccuu

SEQ ID NO: 3407169 - RNA, 14 nt, Human
guuacuuuuccuug

SEQ ID NO: 3407170 - RNA, 15 nt, Human
guuagaaaugcaaau

SEQ ID NO: 3407171 - RNA, 19 nt, Human
guuagaacacuauuuucag

SEQ ID NO: 3407172 - RNA, 20 nt, Human
guuagaacacuauuuucaga

SEQ ID NO: 3407173 - RNA, 20 nt, Human
guuagaauaauaaauauuua

SEQ ID NO: 3407174 - RNA, 17 nt, Human
guuagaaucuauuuucu

SEQ ID NO: 3407175 - RNA, 18 nt, Human
guuagaaucuauuuucua

SEQ ID NO: 3407176 - RNA, 19 nt, Human
guuagaaugagaucugaau

SEQ ID NO: 3407177 - RNA, 23 nt, Human
guuagacugacuuguuugucuuc

SEQ ID NO: 3407178 - RNA, 14 nt, Human
guuagacugccagc

SEQ ID NO: 3407179 - RNA, 17 nt, Human
guuagacugccagcucu

SEQ ID NO: 3407180 - RNA, 22 nt, Human
guuagacugccagcucuuccua

SEQ ID NO: 3407181 - RNA, 23 nt, Human
guuagagaacuaaacuaguuuuu

SEQ ID NO: 3407182 - RNA, 20 nt, Human
guuagagagggaccaugugu

SEQ ID NO: 3407183 - RNA, 18 nt, Human
guuagagaugccucccug

SEQ ID NO: 3407184 - RNA, 16 nt, Human
guuagcacuguugaug

SEQ ID NO: 3407185 - RNA, 13 nt, Human
guuagcagacagg

SEQ ID NO: 3407186 - RNA, 18 nt, Human
guuagccuuuuuucccca

SEQ ID NO: 3407187 - RNA, 23 nt, Human
guuagccuuuuuuccccagacuu

SEQ ID NO: 3407188 - RNA, 21 nt, Human
guuagcucagccccagcccag

SEQ ID NO: 3407189 - RNA, 23 nt, Human
guuagcucagccccagcccagcc

SEQ ID NO: 3407190 - RNA, 20 nt, Human
guuagcucaggaggcuugga

SEQ ID NO: 3407191 - RNA, 14 nt, Human
guuagcuccugugg

SEQ ID NO: 3407192 - RNA, 16 nt, Human
guuagcuccuguggcc

SEQ ID NO: 3407193 - RNA, 17 nt, Human
guuagcugaagaauuga

SEQ ID NO: 3407194 - RNA, 14 nt, Human
guuaggaaauaaaa

SEQ ID NO: 3407195 - RNA, 16 nt, Human
guuaggaaauaaaacc

SEQ ID NO: 3407196 - RNA, 19 nt, Human
guuaggaaauaaaaccuuu

SEQ ID NO: 3407197 - RNA, 15 nt, Human
guuaggaguucgaga

SEQ ID NO: 3407198 - RNA, 23 nt, Human
guuaggauuuaacagucauuuaa

SEQ ID NO: 3407199 - RNA, 19 nt, Human
guuaggcauugugggaagg

SEQ ID NO: 3407200 - RNA, 20 nt, Human
guuagggacugaccagcagc

SEQ ID NO: 3407201 - RNA, 23 nt, Human
guuagggugcucuggaagagagg

SEQ ID NO: 3407202 - RNA, 14 nt, Human
guuaguaauaccuc

SEQ ID NO: 3407203 - RNA, 15 nt, Human
guuaguaaucuguau

SEQ ID NO: 3407204 - RNA, 13 nt, Human
guuaguagaaauu

SEQ ID NO: 3407205 - RNA, 16 nt, Human
guuaguaucuaacaug

SEQ ID NO: 3407206 - RNA, 14 nt, Human
guuaguaucuuuug

SEQ ID NO: 3407207 - RNA, 17 nt, Human
guuaguaucuuuugaua

SEQ ID NO: 3407208 - RNA, 18 nt, Human
guuaguaucuuuugauau

SEQ ID NO: 3407209 - RNA, 12 nt, Human
guuagucauuug

SEQ ID NO: 3407210 - RNA, 22 nt, Human
guuaguuaccuuauaguuacug

SEQ ID NO: 3407211 - RNA, 23 nt, Human
guuaguuaccuuauaguuacugu

SEQ ID NO: 3407212 - RNA, 16 nt, Human
guuaguuccacugaga

SEQ ID NO: 3407213 - RNA, 16 nt, Human
guuaguuucuccaagc

SEQ ID NO: 3407214 - RNA, 21 nt, Human
guuaguuuguauauauuauua

SEQ ID NO: 3407215 - RNA, 13 nt, Human
guuauaaaggaau

SEQ ID NO: 3407216 - RNA, 18 nt, Human
guuauaaaucaaugucac

SEQ ID NO: 3407217 - RNA, 17 nt, Human
guuauaacuuaaugaaa

SEQ ID NO: 3407218 - RNA, 21 nt, Human
guuauaacuuaaugaaaacaa

SEQ ID NO: 3407219 - RNA, 13 nt, Human
guuauaagaagaa

SEQ ID NO: 3407220 - RNA, 22 nt, Human
guuauacaguuauaaaauuaaa

SEQ ID NO: 3407221 - RNA, 15 nt, Human
guuauacaugacacu

SEQ ID NO: 3407222 - RNA, 23 nt, Human
guuauacaugacacugaaaugcc

SEQ ID NO: 3407223 - RNA, 22 nt, Human
guuauagagggucuaagauuca

SEQ ID NO: 3407224 - RNA, 17 nt, Human
guuauaggucacuccug

SEQ ID NO: 3407225 - RNA, 17 nt, Human
guuauaguaacucccau

SEQ ID NO: 3407226 - RNA, 13 nt, Human
guuauagugaauu

SEQ ID NO: 3407227 - RNA, 12 nt, Human
guuauauaaaug

SEQ ID NO: 3407228 - RNA, 13 nt, Human
guuauauaaucau

SEQ ID NO: 3407229 - RNA, 16 nt, Human
guuauauaauucacuc

SEQ ID NO: 3407230 - RNA, 12 nt, Human
guuauauaauuu

SEQ ID NO: 3407231 - RNA, 15 nt, Human
guuauauaauuuaga

SEQ ID NO: 3407232 - RNA, 13 nt, Human
guuauauauaaau

SEQ ID NO: 3407233 - RNA, 22 nt, Human
guuauauauaaauauauuauua

SEQ ID NO: 3407234 - RNA, 17 nt, Human
guuauauauuuuuugua

SEQ ID NO: 3407235 - RNA, 14 nt, Human
guuauaucaacaga

SEQ ID NO: 3407236 - RNA, 17 nt, Human
guuauauccccugcuac

SEQ ID NO: 3407237 - RNA, 17 nt, Human
guuauauuuaaugcauu

SEQ ID NO: 3407238 - RNA, 10 nt, Human
guuauauuuc

SEQ ID NO: 3407239 - RNA, 22 nt, Human
guuaucaaaaaaaaaaaaaugu

SEQ ID NO: 3407240 - RNA, 23 nt, Human
guuaucaaacuucagcuguacuu

SEQ ID NO: 3407241 - RNA, 18 nt, Human
guuaucagucucucuuuc

SEQ ID NO: 3407242 - RNA, 17 nt, Human
guuaucagugcuucccg

SEQ ID NO: 3407243 - RNA, 19 nt, Human
guuaucaugaauuuuaaag

SEQ ID NO: 3407244 - RNA, 18 nt, Human
guuaucccaaucauuguu

SEQ ID NO: 3407245 - RNA, 15 nt, Human
guuaucgaaauaaca

SEQ ID NO: 3407246 - RNA, 17 nt, Human
guuaucgaaauaacaau

SEQ ID NO: 3407247 - RNA, 21 nt, Human
guuaucgaaauaacaauguua

SEQ ID NO: 3407248 - RNA, 23 nt, Human
guuaucgaaauaacaauguuaag

SEQ ID NO: 3407249 - RNA, 15 nt, Human
guuaucuaaaagaaa

SEQ ID NO: 3407250 - RNA, 19 nt, Human
guuaucuaauagggcaauu

SEQ ID NO: 3407251 - RNA, 14 nt, Human
guuaucucuguguu

SEQ ID NO: 3407252 - RNA, 17 nt, Human
guuaucuguucuuuuga

SEQ ID NO: 3407253 - RNA, 22 nt, Human
guuaucuuauacuguacaauaa

SEQ ID NO: 3407254 - RNA, 18 nt, Human
guuaucuucucaaguucu

SEQ ID NO: 3407255 - RNA, 23 nt, Human
guuaucuucucaaguucuaagau

SEQ ID NO: 3407256 - RNA, 13 nt, Human
guuaugaaagaau

SEQ ID NO: 3407257 - RNA, 20 nt, Human
guuaugaaagaauauauuua

SEQ ID NO: 3407258 - RNA, 12 nt, Human
guuaugaauauu

SEQ ID NO: 3407259 - RNA, 23 nt, Human
guuaugaauauuuacguuuuugu

SEQ ID NO: 3407260 - RNA, 17 nt, Human
guuaugacuauguaaac

SEQ ID NO: 3407261 - RNA, 14 nt, Human
guuaugaugugcuu

SEQ ID NO: 3407262 - RNA, 17 nt, Human
guuaugaugugcuuaac

SEQ ID NO: 3407263 - RNA, 13 nt, Human
guuaugcugugac

SEQ ID NO: 3407264 - RNA, 21 nt, Human
guuauguaaauaauucuuuuu

SEQ ID NO: 3407265 - RNA, 14 nt, Human
guuauguauauggu

SEQ ID NO: 3407266 - RNA, 15 nt, Human
guuauguauauuuua

SEQ ID NO: 3407267 - RNA, 23 nt, Human
guuauguauuuccuggauguuug

SEQ ID NO: 3407268 - RNA, 19 nt, Human
guuauuaaaaaucucaaau

SEQ ID NO: 3407269 - RNA, 12 nt, Human
guuauuaaaauu

SEQ ID NO: 3407270 - RNA, 13 nt, Human
guuauuaaaauug

SEQ ID NO: 3407271 - RNA, 21 nt, Human
guuauuacauccuuguggcac

SEQ ID NO: 3407272 - RNA, 22 nt, Human
guuauuagagauuaccuccuga

SEQ ID NO: 3407273 - RNA, 21 nt, Human
guuauuagggugguauuuagu

SEQ ID NO: 3407274 - RNA, 17 nt, Human
guuauuauauuuacaaa

SEQ ID NO: 3407275 - RNA, 19 nt, Human
guuauuauauuuacaaaug

SEQ ID NO: 3407276 - RNA, 18 nt, Human
guuauuaugauuagcuuu

SEQ ID NO: 3407277 - RNA, 22 nt, Human
guuauucaacagcaagugugaa

SEQ ID NO: 3407278 - RNA, 18 nt, Human
guuauuccuugaucauuu

SEQ ID NO: 3407279 - RNA, 15 nt, Human
guuauucuuugcacu

SEQ ID NO: 3407280 - RNA, 16 nt, Human
guuauucuuugcacuu

SEQ ID NO: 3407281 - RNA, 22 nt, Human
guuauugagagagauguguaau

SEQ ID NO: 3407282 - RNA, 17 nt, Human
guuauugcaauaaagua

SEQ ID NO: 3407283 - RNA, 20 nt, Human
guuauuggccuuuucuauuc

SEQ ID NO: 3407284 - RNA, 21 nt, Human
guuauugggcaagugauugaa

SEQ ID NO: 3407285 - RNA, 17 nt, Human
guuauuguacagcuguu

SEQ ID NO: 3407286 - RNA, 12 nt, Human
guuauugugaau

SEQ ID NO: 3407287 - RNA, 15 nt, Human
guuauugugaaugau

SEQ ID NO: 3407288 - RNA, 10 nt, Human
guuauuuaaa

SEQ ID NO: 3407289 - RNA, 13 nt, Human
guuauuuaaauga

SEQ ID NO: 3407290 - RNA, 20 nt, Human
guuauuuauacaagauugaa

SEQ ID NO: 3407291 - RNA, 21 nt, Human
guuauuucccuacauuaaaca

SEQ ID NO: 3407292 - RNA, 23 nt, Human
guuauuucccuuuagcuguguua

SEQ ID NO: 3407293 - RNA, 14 nt, Human
guuauuucuuacag

SEQ ID NO: 3407294 - RNA, 16 nt, Human
guuauuugcacacugc

SEQ ID NO: 3407295 - RNA, 17 nt, Human
guuauuuguaauagaug

SEQ ID NO: 3407296 - RNA, 20 nt, Human
guuauuuguacaguucaguu

SEQ ID NO: 3407297 - RNA, 19 nt, Human
guuauuuuaguuucuguuc

SEQ ID NO: 3407298 - RNA, 14 nt, Human
guuauuuucuacag

SEQ ID NO: 3407299 - RNA, 20 nt, Human
guuauuuucuacagugguuu

SEQ ID NO: 3407300 - RNA, 15 nt, Human
guuauuuucuucuaa

SEQ ID NO: 3407301 - RNA, 23 nt, Human
guuauuuucuuugaaauuguuua

SEQ ID NO: 3407302 - RNA, 19 nt, Human
guuauuuuuauaagaaaac

SEQ ID NO: 3407303 - RNA, 23 nt, Human
guuauuuuuauuuauuuaaauuu

SEQ ID NO: 3407304 - RNA, 17 nt, Human
guuauuuuucaaggaag

SEQ ID NO: 3407305 - RNA, 22 nt, Human
guucaaagauauuuugcuuugu

SEQ ID NO: 3407306 - RNA, 12 nt, Human
guucaaagccag

SEQ ID NO: 3407307 - RNA, 14 nt, Human
guucaaagcugccu

SEQ ID NO: 3407308 - RNA, 15 nt, Human
guucaacccacagcu

SEQ ID NO: 3407309 - RNA, 12 nt, Human
guucaacuauuu

SEQ ID NO: 3407310 - RNA, 16 nt, Human
guucaagaaauaaguu

SEQ ID NO: 3407311 - RNA, 18 nt, Human
guucaagaccagccuggc

SEQ ID NO: 3407312 - RNA, 20 nt, Human
guucaagcgauucuccugcc

SEQ ID NO: 3407313 - RNA, 22 nt, Human
guucaaggaacuugaaaaauac

SEQ ID NO: 3407314 - RNA, 13 nt, Human
guucuguuuuguu

SEQ ID NO: 3407315 - RNA, 16 nt, Human
guucuuaagacgugau

SEQ ID NO: 3407316 - RNA, 17 nt, Human
guucuuaauugcacucu

SEQ ID NO: 3407317 - RNA, 13 nt, Human
guucuuacacaua

SEQ ID NO: 3407318 - RNA, 22 nt, Human
guucuuaccuguaugucuccag

SEQ ID NO: 3407319 - RNA, 17 nt, Human
guucuuaguucucacug

SEQ ID NO: 3407320 - RNA, 19 nt, Human
guucuuaguugcuguaugu

SEQ ID NO: 3407321 - RNA, 15 nt, Human
guucuuaugaggagg

SEQ ID NO: 3407322 - RNA, 20 nt, Human
guucuuaugaggaggggagg

SEQ ID NO: 3407323 - RNA, 14 nt, Human
guucuuaugcaaaa

SEQ ID NO: 3407324 - RNA, 14 nt, Human
guucuucaucuaag

SEQ ID NO: 3407325 - RNA, 19 nt, Human
guucuuccaguuacuuucc

SEQ ID NO: 3407326 - RNA, 17 nt, Human
guucuuccucagccagc

SEQ ID NO: 3407327 - RNA, 19 nt, Human
guucuuccucagccagccu

SEQ ID NO: 3407328 - RNA, 20 nt, Human
guucuuccucagccagccuc

SEQ ID NO: 3407329 - RNA, 21 nt, Human
guucuuccuccagcugcacca

SEQ ID NO: 3407330 - RNA, 21 nt, Human
guucuucuguucugcagacac

SEQ ID NO: 3407331 - RNA, 23 nt, Human
guucuugaggggaccaggagugg

SEQ ID NO: 3407332 - RNA, 12 nt, Human
guucuugcugcu

SEQ ID NO: 3407333 - RNA, 18 nt, Human
guucuugcugcuagaacu

SEQ ID NO: 3407334 - RNA, 22 nt, Human
guucuugcugcuagaacuuuuu

SEQ ID NO: 3407335 - RNA, 21 nt, Human
guucuuggcaauaaauuuuga

SEQ ID NO: 3407336 - RNA, 23 nt, Human
guucuuggcaauaaauuuugaaa

SEQ ID NO: 3407337 - RNA, 19 nt, Human
guucuuggggcccuacacc

SEQ ID NO: 3407338 - RNA, 16 nt, Human
guucuugguagagauu

SEQ ID NO: 3407339 - RNA, 15 nt, Human
guucuugguuuguaa

SEQ ID NO: 3407340 - RNA, 18 nt, Human
guucuugguuuguaaauu

SEQ ID NO: 3407341 - RNA, 21 nt, Human
guucuugguuuguaaauuaac

SEQ ID NO: 3407342 - RNA, 13 nt, Human
guucuuguaauuu

SEQ ID NO: 3407343 - RNA, 18 nt, Human
guucuuguaauuuuacac

SEQ ID NO: 3407344 - RNA, 17 nt, Human
guucuuguauuaagaau

SEQ ID NO: 3407345 - RNA, 18 nt, Human
guucuuguauuaagaaug

SEQ ID NO: 3407346 - RNA, 18 nt, Human
guucuuguuuuuaaguuu

SEQ ID NO: 3407347 - RNA, 23 nt, Human
guucuuuaaacugucgugucaua

SEQ ID NO: 3407348 - RNA, 15 nt, Human
guucuuuaggagauu

SEQ ID NO: 3407349 - RNA, 11 nt, Human
guucuuuauau

SEQ ID NO: 3407350 - RNA, 20 nt, Human
guucuuucauuugcuuugga

SEQ ID NO: 3407351 - RNA, 22 nt, Human
guucuuucauuugcuuuggaag

SEQ ID NO: 3407352 - RNA, 20 nt, Human
guucuuuccaaaguacacug

SEQ ID NO: 3407353 - RNA, 13 nt, Human
guucuuucucuuu

SEQ ID NO: 3407354 - RNA, 17 nt, Human
guucuuucuuccucugc

SEQ ID NO: 3407355 - RNA, 19 nt, Human
guucuuucuuccucugcug

SEQ ID NO: 3407356 - RNA, 22 nt, Human
guucuuugagggacugccucug

SEQ ID NO: 3407357 - RNA, 16 nt, Human
guucuuugggccagac

SEQ ID NO: 3407358 - RNA, 13 nt, Human
guucuuuguucau

SEQ ID NO: 3407359 - RNA, 19 nt, Human
guugaaaaaguuuguuuuu

SEQ ID NO: 3407360 - RNA, 21 nt, Human
guugaaaaaguuuguuuuugc

SEQ ID NO: 3407361 - RNA, 15 nt, Human
guugaaaagccaugu

SEQ ID NO: 3407362 - RNA, 23 nt, Human
guugaaaagccauguuuaagauu

SEQ ID NO: 3407363 - RNA, 15 nt, Human
guugaaagaguccua

SEQ ID NO: 3407364 - RNA, 15 nt, Human
guugaaagcaaaaau

SEQ ID NO: 3407365 - RNA, 17 nt, Human
guugaacaaaauaaauu

SEQ ID NO: 3407366 - RNA, 14 nt, Human
guugaacuguuaga

SEQ ID NO: 3407367 - RNA, 16 nt, Human
guugaagacagagcua

SEQ ID NO: 3407368 - RNA, 19 nt, Human
guugaagaccuaaccaggg

SEQ ID NO: 3407369 - RNA, 15 nt, Human
guugaagccaugucu

SEQ ID NO: 3407370 - RNA, 13 nt, Human
guugaagcucugg

SEQ ID NO: 3407371 - RNA, 12 nt, Human
guugaagucacc

SEQ ID NO: 3407372 - RNA, 20 nt, Human
guugaagucaugcuccccug

SEQ ID NO: 3407373 - RNA, 13 nt, Human
guugaauaaaagu

SEQ ID NO: 3407374 - RNA, 17 nt, Human
guugaauacuuuuuaca

SEQ ID NO: 3407375 - RNA, 19 nt, Human
guugaaugacaacagaagc

SEQ ID NO: 3407376 - RNA, 14 nt, Human
guugaauuuauugg

SEQ ID NO: 3407377 - RNA, 22 nt, Human
guugaauuuuguucucugggag

SEQ ID NO: 3407378 - RNA, 20 nt, Human
guugaauuuuuuuuaacauu

SEQ ID NO: 3407379 - RNA, 23 nt, Human
guugaauuuuuuuuaacauuccu

SEQ ID NO: 3407380 - RNA, 16 nt, Human
guugacaguucugaag

SEQ ID NO: 3407381 - RNA, 17 nt, Human
guugacauauuuaaugu

SEQ ID NO: 3407382 - RNA, 13 nt, Human
guugacaugggac

SEQ ID NO: 3407383 - RNA, 15 nt, Human
guugacauucugaau

SEQ ID NO: 3407384 - RNA, 18 nt, Human
guugacauucugaaugcu

SEQ ID NO: 3407385 - RNA, 12 nt, Human
guugacauuugu

SEQ ID NO: 3407386 - RNA, 21 nt, Human
guugacucuaguacugugaau

SEQ ID NO: 3407387 - RNA, 24 nt, Human
guugacuuauaguacaugauaaau

SEQ ID NO: 3407388 - RNA, 15 nt, Human
guugacuuuagggac

SEQ ID NO: 3407389 - RNA, 18 nt, Human
guugacuuuauaaauuuc

SEQ ID NO: 3407390 - RNA, 12 nt, Human
guugagaaauga

SEQ ID NO: 3407391 - RNA, 15 nt, Human
guugagacaagaaaa

SEQ ID NO: 3407392 - RNA, 12 nt, Human
guugagacagag

SEQ ID NO: 3407393 - RNA, 18 nt, Human
guugagauaguuuucauc

SEQ ID NO: 3407394 - RNA, 16 nt, Human
guugagcaucuguccc

SEQ ID NO: 3407395 - RNA, 21 nt, Human
guugagcaugacagccugcag

SEQ ID NO: 3407396 - RNA, 20 nt, Human
guugagccagcagacauugu

SEQ ID NO: 3407397 - RNA, 15 nt, Human
guugagccaggccug

SEQ ID NO: 3407398 - RNA, 10 nt, Human
guugagcccc

SEQ ID NO: 3407399 - RNA, 20 nt, Human
guugagccccaaguccugaa

SEQ ID NO: 3407400 - RNA, 15 nt, Human
guugagccccuggag

SEQ ID NO: 3407401 - RNA, 16 nt, Human
guugagcuaugacuua

SEQ ID NO: 3407402 - RNA, 14 nt, Human
guugaggccacugu

SEQ ID NO: 3407403 - RNA, 22 nt, Human
guugagggaacagacaggagaa

SEQ ID NO: 3407404 - RNA, 23 nt, Human
guugagguggaagcccuccuucc

SEQ ID NO: 3407405 - RNA, 16 nt, Human
guugagguggucugaa

SEQ ID NO: 3407406 - RNA, 12 nt, Human
guugauaaaaac

SEQ ID NO: 3407407 - RNA, 13 nt, Human
guugauaacuuug

SEQ ID NO: 3407408 - RNA, 14 nt, Human
guugauaacuuugc

SEQ ID NO: 3407409 - RNA, 15 nt, Human
guugauaacuuugcu

SEQ ID NO: 3407410 - RNA, 17 nt, Human
guugauaacuuugcuug

SEQ ID NO: 3407411 - RNA, 13 nt, Human
guugauacuguug

SEQ ID NO: 3407412 - RNA, 14 nt, Human
guugauacuguugc

SEQ ID NO: 3407413 - RNA, 12 nt, Human
guugauaguuua

SEQ ID NO: 3407414 - RNA, 14 nt, Human
guugauauuucuau

SEQ ID NO: 3407415 - RNA, 22 nt, Human
guugaucauguacuuuuuagua

SEQ ID NO: 3407416 - RNA, 16 nt, Human
guugaucuggaaccca

SEQ ID NO: 3407417 - RNA, 19 nt, Human
guugaucuggaacccagac

SEQ ID NO: 3407418 - RNA, 16 nt, Human
guugaugaggccucuu

SEQ ID NO: 3407419 - RNA, 12 nt, Human
guugaugcaauc

SEQ ID NO: 3407420 - RNA, 21 nt, Human
guugaugggaugauugaagaa

SEQ ID NO: 3407421 - RNA, 13 nt, Human
guugauguaucug

SEQ ID NO: 3407422 - RNA, 14 nt, Human
guugauguaucuga

SEQ ID NO: 3407423 - RNA, 16 nt, Human
guugauguuggcuggg

SEQ ID NO: 3407424 - RNA, 14 nt, Human
guugauugcuaaau

SEQ ID NO: 3407425 - RNA, 18 nt, Human
guugauugcuaaauguaa

SEQ ID NO: 3407426 - RNA, 22 nt, Human
guugauugcuaaauguaacagu

SEQ ID NO: 3407427 - RNA, 22 nt, Human
guugauuuuuuuuuuuuuuucc

SEQ ID NO: 3407428 - RNA, 14 nt, Human
guugcaacuuugua

SEQ ID NO: 3407429 - RNA, 16 nt, Human
guugcaacuuuguaua

SEQ ID NO: 3407430 - RNA, 18 nt, Human
guugcaagaugugaauua

SEQ ID NO: 3407431 - RNA, 16 nt, Human
guugcaaggccgcugu

SEQ ID NO: 3407432 - RNA, 14 nt, Human
guugcacacuuugg

SEQ ID NO: 3407433 - RNA, 16 nt, Human
guugcacagcaucuca

SEQ ID NO: 3407434 - RNA, 16 nt, Human
guugcacagcuaugaa

SEQ ID NO: 3407435 - RNA, 19 nt, Human
guugcacguguguuuuucu

SEQ ID NO: 3407436 - RNA, 22 nt, Human
guugcacguguguuuuucuauu

SEQ ID NO: 3407437 - RNA, 12 nt, Human
guugcacugaag

SEQ ID NO: 3407438 - RNA, 15 nt, Human
guugcacugaaguuu

SEQ ID NO: 3407439 - RNA, 16 nt, Human
guugcacugaaguuug

SEQ ID NO: 3407440 - RNA, 13 nt, Human
guugcagcuggac

SEQ ID NO: 3407441 - RNA, 23 nt, Human
guugcagcuguuuuguugacauu

SEQ ID NO: 3407442 - RNA, 15 nt, Human
guugcaguggagagg

SEQ ID NO: 3407443 - RNA, 20 nt, Human
guugcauuaaaaaugcauau

SEQ ID NO: 3407444 - RNA, 18 nt, Human
guugcauuccuuugucuu

SEQ ID NO: 3407445 - RNA, 17 nt, Human
guugccaaacagccaca

SEQ ID NO: 3407446 - RNA, 18 nt, Human
guugccaaacagccacac

SEQ ID NO: 3407447 - RNA, 20 nt, Human
guugccaaauauguccuggg

SEQ ID NO: 3407448 - RNA, 13 nt, Human
guugccaagacaa

SEQ ID NO: 3407449 - RNA, 15 nt, Human
guugccaagacaaau

SEQ ID NO: 3407450 - RNA, 15 nt, Human
guugccaagcuccaa

SEQ ID NO: 3407451 - RNA, 19 nt, Human
guugccaagcuccaagccc

SEQ ID NO: 3407452 - RNA, 11 nt, Human
guugccacagg

SEQ ID NO: 3407453 - RNA, 13 nt, Human
guugccacaggac

SEQ ID NO: 3407454 - RNA, 16 nt, Human
guugccacaggacaca

SEQ ID NO: 3407455 - RNA, 12 nt, Human
guugccacaggc

SEQ ID NO: 3407456 - RNA, 15 nt, Human
guugccacaggccuc

SEQ ID NO: 3407457 - RNA, 19 nt, Human
guugccacaggccucccug

SEQ ID NO: 3407458 - RNA, 21 nt, Human
guugccaccaccucuguggca

SEQ ID NO: 3407459 - RNA, 17 nt, Human
guugccagucaccccgg

SEQ ID NO: 3407460 - RNA, 21 nt, Human
uaaaguauguaaaguauguaa

SEQ ID NO: 3407461 - RNA, 19 nt, Human
uaaaguauguauuauuuac

SEQ ID NO: 3407462 - RNA, 21 nt, Human
uaaaguauguauuauuuacau

SEQ ID NO: 3407463 - RNA, 15 nt, Human
uaaaguauuccaccu

SEQ ID NO: 3407464 - RNA, 20 nt, Human
uaaaguauuccaccuuaaau

SEQ ID NO: 3407465 - RNA, 21 nt, Human
uaaaguauuccaccuuaaauu

SEQ ID NO: 3407466 - RNA, 23 nt, Human
uaaaguauuccaccuuaaauuaa

SEQ ID NO: 3407467 - RNA, 13 nt, Human
uaaaguauucuuc

SEQ ID NO: 3407468 - RNA, 23 nt, Human
uaaaguauucuuuuucuuuuuua

SEQ ID NO: 3407469 - RNA, 16 nt, Human
uaaaguauuuaauuag

SEQ ID NO: 3407470 - RNA, 17 nt, Human
uaaaguauuuaauuagu

SEQ ID NO: 3407471 - RNA, 19 nt, Human
uaaaguauuuaauuagugc

SEQ ID NO: 3407472 - RNA, 22 nt, Human
uaaaguauuuaauuagugcuaa

SEQ ID NO: 3407473 - RNA, 17 nt, Human
uaaagucagguccaauu

SEQ ID NO: 3407474 - RNA, 18 nt, Human
uaaagucagguccaauuu

SEQ ID NO: 3407475 - RNA, 21 nt, Human
uaaagucaguugcucaaaaag

SEQ ID NO: 3407476 - RNA, 19 nt, Human
uaaaguccuuuucuugcuu

SEQ ID NO: 3407477 - RNA, 21 nt, Human
uaaaguccuuuucuugcuuac

SEQ ID NO: 3407478 - RNA, 19 nt, Human
uaaagucgagcuuuucuaa

SEQ ID NO: 3407479 - RNA, 22 nt, Human
uaaagugaauuguugacaaaug

SEQ ID NO: 3407480 - RNA, 20 nt, Human
uaaagugacccugcucucac

SEQ ID NO: 3407481 - RNA, 21 nt, Human
uaaagugaggccacugaagag

SEQ ID NO: 3407482 - RNA, 18 nt, Human
uaaagugauuaaacgugc

SEQ ID NO: 3407483 - RNA, 18 nt, Human
uaaagugccaguauuuua

SEQ ID NO: 3407484 - RNA, 22 nt, Human
uaaagugccaguauuuuaaaau

SEQ ID NO: 3407485 - RNA, 18 nt, Human
uaaagugcuaagguucua

SEQ ID NO: 3407486 - RNA, 20 nt, Human
uaaagugcuaagguucuaag

SEQ ID NO: 3407487 - RNA, 16 nt, Human
uaaaguguaaauccuu

SEQ ID NO: 3407488 - RNA, 19 nt, Human
uaaaguguaacaauugugu

SEQ ID NO: 3407489 - RNA, 18 nt, Human
uaaaguguaaguucacaa

SEQ ID NO: 3407490 - RNA, 15 nt, Human
uaaaguguauuuuuu

SEQ ID NO: 3407491 - RNA, 21 nt, Human
uaaaguguauuuuuuuacuaa

SEQ ID NO: 3407492 - RNA, 23 nt, Human
uaaaguguauuuuuuuacuaaua

SEQ ID NO: 3407493 - RNA, 21 nt, Human
uaaaguguccauugacaugua

SEQ ID NO: 3407494 - RNA, 20 nt, Human
uaaaguguggucccaacagg

SEQ ID NO: 3407495 - RNA, 18 nt, Human
uaaaguguguuguugcuu

SEQ ID NO: 3407496 - RNA, 17 nt, Human
uaaaguguguuucuaug

SEQ ID NO: 3407497 - RNA, 13 nt, Human
uaaaguguuacuu

SEQ ID NO: 3407498 - RNA, 17 nt, Human
uaaaguguuacuuuuug

SEQ ID NO: 3407499 - RNA, 18 nt, Human
uaaaguguuucagcuaag

SEQ ID NO: 3407500 - RNA, 14 nt, Human
uaaaguguuuucag

SEQ ID NO: 3407501 - RNA, 14 nt, Human
uaaaguuaaguuga

SEQ ID NO: 3407502 - RNA, 22 nt, Human
uaaaguuagaaucuauuuucua

SEQ ID NO: 3407503 - RNA, 20 nt, Human
uaaaguuaguaucuuuugau

SEQ ID NO: 3407504 - RNA, 13 nt, Human
uaaaguuauauuu

SEQ ID NO: 3407505 - RNA, 14 nt, Human
uaaaguuauucuug

SEQ ID NO: 3407506 - RNA, 15 nt, Human
uaaaguucaacaugu

SEQ ID NO: 3407507 - RNA, 17 nt, Human
uaaaguucauugcaauu

SEQ ID NO: 3407508 - RNA, 18 nt, Human
uaaaguucuaagauucug

SEQ ID NO: 3407509 - RNA, 13 nt, Human
uaaaguucugugu

SEQ ID NO: 3407510 - RNA, 13 nt, Human
uaaaguugaauuu

SEQ ID NO: 3407511 - RNA, 15 nt, Human
uaaaguugaauuuau

SEQ ID NO: 3407512 - RNA, 17 nt, Human
uaaaguugaauuuauug

SEQ ID NO: 3407513 - RNA, 19 nt, Human
uaaaguugaauuuauuggc

SEQ ID NO: 3407514 - RNA, 16 nt, Human
uaaaguugauaaagau

SEQ ID NO: 3407515 - RNA, 14 nt, Human
uaaaguuggaauuu

SEQ ID NO: 3407516 - RNA, 12 nt, Human
uaaaguuguacu

SEQ ID NO: 3407517 - RNA, 16 nt, Human
uaaaguuguacuuuaa

SEQ ID NO: 3407518 - RNA, 16 nt, Human
uaaaguuuacaguaaa

SEQ ID NO: 3407519 - RNA, 13 nt, Human
uaaaguuucaaaa

SEQ ID NO: 3407520 - RNA, 13 nt, Human
uaaaguuucuguu

SEQ ID NO: 3407521 - RNA, 15 nt, Human
uaaaguuugaucuuc

SEQ ID NO: 3407522 - RNA, 17 nt, Human
uaaaguuugaucuuccu

SEQ ID NO: 3407523 - RNA, 14 nt, Human
uaaaguuuguugaa

SEQ ID NO: 3407524 - RNA, 17 nt, Human
uaaaguuuuauauauua

SEQ ID NO: 3407525 - RNA, 23 nt, Human
uaaaguuuuauauauuauaugga

SEQ ID NO: 3407526 - RNA, 23 nt, Human
uaaauaaaaaauaauaauacaag

SEQ ID NO: 3407527 - RNA, 19 nt, Human
uaaauaaaaacuaauuaag

SEQ ID NO: 3407528 - RNA, 21 nt, Human
uaaauaaaagaaaugcacaau

SEQ ID NO: 3407529 - RNA, 17 nt, Human
uaaauaaaauauaauug

SEQ ID NO: 3407530 - RNA, 15 nt, Human
uaaauaaaaucaauu

SEQ ID NO: 3407531 - RNA, 17 nt, Human
uaaauaaaaugcuaggu

SEQ ID NO: 3407532 - RNA, 23 nt, Human
uaaauaaacacauagauucaccu

SEQ ID NO: 3407533 - RNA, 11 nt, Human
uaaauaaacuu

SEQ ID NO: 3407534 - RNA, 21 nt, Human
uaaauaaaguuuguugaaaca

SEQ ID NO: 3407535 - RNA, 12 nt, Human
uaaauaaauaca

SEQ ID NO: 3407536 - RNA, 12 nt, Human
uaaauaaauaua

SEQ ID NO: 3407537 - RNA, 13 nt, Human
uaaauaaauauau

SEQ ID NO: 3407538 - RNA, 14 nt, Human
uaaauaaauauaua

SEQ ID NO: 3407539 - RNA, 22 nt, Human
uaaauaaaugaaguauuucuca

SEQ ID NO: 3407540 - RNA, 17 nt, Human
uaaauaaauuguauauu

SEQ ID NO: 3407541 - RNA, 20 nt, Human
uaaauaaauuguauauucac

SEQ ID NO: 3407542 - RNA, 22 nt, Human
uaaauaaauuguauauucacuu

SEQ ID NO: 3407543 - RNA, 13 nt, Human
uaaauaaauuguu

SEQ ID NO: 3407544 - RNA, 14 nt, Human
uaaauaacuggaaa

SEQ ID NO: 3407545 - RNA, 22 nt, Human
uaaauaacuggaggaauuuucu

SEQ ID NO: 3407546 - RNA, 15 nt, Human
uaaauaagauucuaa

SEQ ID NO: 3407547 - RNA, 17 nt, Human
uaaauaaggaaaagcuu

SEQ ID NO: 3407548 - RNA, 18 nt, Human
uaaauaaugcuucagaua

SEQ ID NO: 3407549 - RNA, 17 nt, Human
uaaauaauucuuuuuua

SEQ ID NO: 3407550 - RNA, 23 nt, Human
uaaauaauucuuuuuuauuaauc

SEQ ID NO: 3407551 - RNA, 16 nt, Human
uaaauaauuuccuaca

SEQ ID NO: 3407552 - RNA, 15 nt, Human
uaaauacaauuuugu

SEQ ID NO: 3407553 - RNA, 22 nt, Human
uaaauacaauuuuguuucugua

SEQ ID NO: 3407554 - RNA, 16 nt, Human
uaaauacagacacuaa

SEQ ID NO: 3407555 - RNA, 22 nt, Human
uaaauacagacacuaaguuaua

SEQ ID NO: 3407556 - RNA, 17 nt, Human
uaaauacagucuuccau

SEQ ID NO: 3407557 - RNA, 16 nt, Human
uaaauacauauggaug

SEQ ID NO: 3407558 - RNA, 15 nt, Human
uaaauacaugcauau

SEQ ID NO: 3407559 - RNA, 12 nt, Human
uaaauaccagga

SEQ ID NO: 3407560 - RNA, 22 nt, Human
uaaauaccucaaccuaugguau

SEQ ID NO: 3407561 - RNA, 13 nt, Human
uaaauaccucuua

SEQ ID NO: 3407562 - RNA, 20 nt, Human
uaaauacugagaaaaccugu

SEQ ID NO: 3407563 - RNA, 16 nt, Human
uaaauacuguguggaa

SEQ ID NO: 3407564 - RNA, 17 nt, Human
uaaauacuguguggaac

SEQ ID NO: 3407565 - RNA, 13 nt, Human
uaaauagaaugua

SEQ ID NO: 3407566 - RNA, 18 nt, Human
uaaauagaauguaaaugu

SEQ ID NO: 3407567 - RNA, 15 nt, Human
uaaauagacacgcac

SEQ ID NO: 3407568 - RNA, 13 nt, Human
uaaauagcaugua

SEQ ID NO: 3407569 - RNA, 23 nt, Human
uaaauagcuagacuggugacuga

SEQ ID NO: 3407570 - RNA, 16 nt, Human
uaaauagcuauaucca

SEQ ID NO: 3407571 - RNA, 12 nt, Human
uaaauagcuuuu

SEQ ID NO: 3407572 - RNA, 21 nt, Human
uaaauaggagaggaugagagc

SEQ ID NO: 3407573 - RNA, 22 nt, Human
uaaauaggcggggcuugccuuc

SEQ ID NO: 3407574 - RNA, 20 nt, Human
uaaauaguaaaaauaaaauu

SEQ ID NO: 3407575 - RNA, 12 nt, Human
uaaauaguauuu

SEQ ID NO: 3407576 - RNA, 21 nt, Human
uaaauagucuagacuaaaaga

SEQ ID NO: 3407577 - RNA, 16 nt, Human
uaaauaguguuauuga

SEQ ID NO: 3407578 - RNA, 23 nt, Human
uaaauauaaagacguuuuauaag

SEQ ID NO: 3407579 - RNA, 21 nt, Human
uaaauauaccacucuuuaccu

SEQ ID NO: 3407580 - RNA, 16 nt, Human
uaaauauagauuagaa

SEQ ID NO: 3407581 - RNA, 21 nt, Human
uaaauauagcaguagucuuuu

SEQ ID NO: 3407582 - RNA, 15 nt, Human
uaaauauaguuccua

SEQ ID NO: 3407583 - RNA, 12 nt, Human
uaaauauauaaa

SEQ ID NO: 3407584 - RNA, 14 nt, Human
uaaauauauaaaaa

SEQ ID NO: 3407585 - RNA, 13 nt, Human
uaaauauauaaau

SEQ ID NO: 3407586 - RNA, 16 nt, Human
uaaauauauaaauaua

SEQ ID NO: 3407587 - RNA, 17 nt, Human
uaaauauauaaauauau

SEQ ID NO: 3407588 - RNA, 11 nt, Human
uaaauauauau

SEQ ID NO: 3407589 - RNA, 15 nt, Human
uaaauauauauaaac

SEQ ID NO: 3407590 - RNA, 19 nt, Human
uaaauauauauaaaccuaa

SEQ ID NO: 3407591 - RNA, 15 nt, Human
uaaauauauguaugu

SEQ ID NO: 3407592 - RNA, 19 nt, Human
uaaauauauguauguaaaa

SEQ ID NO: 3407593 - RNA, 13 nt, Human
uaaauauauuauu

SEQ ID NO: 3407594 - RNA, 15 nt, Human
uaaauauauuauuac

SEQ ID NO: 3407595 - RNA, 17 nt, Human
uaaauauauuauuacuu

SEQ ID NO: 3407596 - RNA, 22 nt, Human
uaaauauauuauuacuuguaaa

SEQ ID NO: 3407597 - RNA, 16 nt, Human
uaaauauauuuuaaga

SEQ ID NO: 3407598 - RNA, 16 nt, Human
uaaauaucaaucauuu

SEQ ID NO: 3407599 - RNA, 21 nt, Human
uaaauaucugaacauuuacua

SEQ ID NO: 3407600 - RNA, 17 nt, Human
uaaauaucuucugauuu

SEQ ID NO: 3407601 - RNA, 15 nt, Human
uaaauaucuuuuaug

SEQ ID NO: 3407602 - RNA, 23 nt, Human
uaaauaucuuuuauguuugaaua

SEQ ID NO: 3407603 - RNA, 18 nt, Human
uaaauaugaacccuuugu

SEQ ID NO: 3407604 - RNA, 13 nt, Human
uaaauuacaauuu

SEQ ID NO: 3407605 - RNA, 23 nt, Human
uaaauuacaauuuuaucuguuuc

SEQ ID NO: 3407606 - RNA, 17 nt, Human
uaaauuacauuuguaau

SEQ ID NO: 3407607 - RNA, 16 nt, Human
uaaauuacuauagcaa

SEQ ID NO: 3407608 - RNA, 17 nt, Human
uaaauuacuauagcaaa

SEQ ID NO: 3407609 - RNA, 13 nt, Human
uaaauuauaagga

SEQ ID NO: 3407610 - RNA, 20 nt, Human
uaaauuauaaggacugcaug

SEQ ID NO: 3407611 - RNA, 16 nt, Human
uaaauuauacuggaga

SEQ ID NO: 3407612 - RNA, 17 nt, Human
uaaauuauaguguagaa

SEQ ID NO: 3407613 - RNA, 20 nt, Human
uaaauuaugggaaucaagau

SEQ ID NO: 3407614 - RNA, 16 nt, Human
uaaauuaugguauuaa

SEQ ID NO: 3407615 - RNA, 13 nt, Human
uaaauuauguaaa

SEQ ID NO: 3407616 - RNA, 17 nt, Human
uaaauuauguaaugcaa

SEQ ID NO: 3407617 - RNA, 18 nt, Human
uaaauuauguaaugcaaa

SEQ ID NO: 3407618 - RNA, 21 nt, Human
uaaauuaugugaccauaaugu

SEQ ID NO: 3407619 - RNA, 22 nt, Human
uaaauuaugugaccauaaugua

SEQ ID NO: 3407620 - RNA, 13 nt, Human
uaaauuauguuua

SEQ ID NO: 3407621 - RNA, 16 nt, Human
uaaauuauguuuuacu

SEQ ID NO: 3407622 - RNA, 20 nt, Human
uaaauuauuaugacaccuuu

SEQ ID NO: 3407623 - RNA, 21 nt, Human
uaaauuauucaguuaagaaaa

SEQ ID NO: 3407624 - RNA, 13 nt, Human
uaaauuauuuaug

SEQ ID NO: 3407625 - RNA, 22 nt, Human
uaaauuauuugauuauuuaaga

SEQ ID NO: 3407626 - RNA, 15 nt, Human
uaaauucaaaccuaa

SEQ ID NO: 3407627 - RNA, 18 nt, Human
uaaauucaacuuuguaaa

SEQ ID NO: 3407628 - RNA, 19 nt, Human
uaaauucaacuuuguaaaa

SEQ ID NO: 3407629 - RNA, 16 nt, Human
uaaauucacaaacuuu

SEQ ID NO: 3407630 - RNA, 22 nt, Human
uaaauucaccuagucuaaggau

SEQ ID NO: 3407631 - RNA, 18 nt, Human
uaaauucagauauauuuu

SEQ ID NO: 3407632 - RNA, 16 nt, Human
uaaauuccacuggacu

SEQ ID NO: 3407633 - RNA, 18 nt, Human
uaaauucccaacuucucu

SEQ ID NO: 3407634 - RNA, 19 nt, Human
uaaauucccguuuugucac

SEQ ID NO: 3407635 - RNA, 20 nt, Human
uaaauuccucaacaguguuu

SEQ ID NO: 3407636 - RNA, 22 nt, Human
uaaauuccucaacaguguuuuc

SEQ ID NO: 3407637 - RNA, 12 nt, Human
uaaauuccucuu

SEQ ID NO: 3407638 - RNA, 19 nt, Human
uaaauuccucuuugcuuug

SEQ ID NO: 3407639 - RNA, 22 nt, Human
uaaauucucucucuugcaggaa

SEQ ID NO: 3407640 - RNA, 15 nt, Human
uaaauucugagacau

SEQ ID NO: 3407641 - RNA, 17 nt, Human
uaaauucugagccugau

SEQ ID NO: 3407642 - RNA, 13 nt, Human
uaaauucugauuu

SEQ ID NO: 3407643 - RNA, 22 nt, Human
uaaauucuugcaaaguaucccu

SEQ ID NO: 3407644 - RNA, 20 nt, Human
uaaauucuuuuuuaaauuuu

SEQ ID NO: 3407645 - RNA, 20 nt, Human
uaaauugaaauauaaugcaa

SEQ ID NO: 3407646 - RNA, 13 nt, Human
uaaauugaauaau

SEQ ID NO: 3407647 - RNA, 12 nt, Human
uaaauugauguu

SEQ ID NO: 3407648 - RNA, 20 nt, Human
uaaauugcaugcugcuuuaa

SEQ ID NO: 3407649 - RNA, 16 nt, Human
uaaauugcuaauguug

SEQ ID NO: 3407650 - RNA, 13 nt, Human
uaaauuggaaagc

SEQ ID NO: 3407651 - RNA, 18 nt, Human
uaaauuguauauucacuu

SEQ ID NO: 3407652 - RNA, 23 nt, Human
uaaauuguccguguucauacauu

SEQ ID NO: 3407653 - RNA, 18 nt, Human
uaaauugucuuuaaaaac

SEQ ID NO: 3407654 - RNA, 16 nt, Human
uaaauuuaaagauauu

SEQ ID NO: 3407655 - RNA, 14 nt, Human
uaaauuuaauacca

SEQ ID NO: 3407656 - RNA, 17 nt, Human
uaaauuuaauaccagau

SEQ ID NO: 3407657 - RNA, 14 nt, Human
uaaauuuaaugcug

SEQ ID NO: 3407658 - RNA, 22 nt, Human
uaaauuuaguauuuuguuucag

SEQ ID NO: 3407659 - RNA, 12 nt, Human
uaaauuuauuaa

SEQ ID NO: 3407660 - RNA, 16 nt, Human
uaaauuuauuaaauaa

SEQ ID NO: 3407661 - RNA, 14 nt, Human
uaaauuuauuuacu

SEQ ID NO: 3407662 - RNA, 21 nt, Human
uaaauuucacuacuagauuga

SEQ ID NO: 3407663 - RNA, 18 nt, Human
uaaauuuccccaacagug

SEQ ID NO: 3407664 - RNA, 20 nt, Human
uaaauuuccccaacagugug

SEQ ID NO: 3407665 - RNA, 20 nt, Human
uaaauuucuauuuuuaucug

SEQ ID NO: 3407666 - RNA, 13 nt, Human
uaaauuugauacu

SEQ ID NO: 3407667 - RNA, 14 nt, Human
uaaauuugauacuu

SEQ ID NO: 3407668 - RNA, 16 nt, Human
uaaauuugauacuuau

SEQ ID NO: 3407669 - RNA, 21 nt, Human
uaaauuugauacuuauauuuu

SEQ ID NO: 3407670 - RNA, 20 nt, Human
uaaauuugauuuacauauau

SEQ ID NO: 3407671 - RNA, 13 nt, Human
uaaauuuguaagu

SEQ ID NO: 3407672 - RNA, 18 nt, Human
uaaauuuguaaguuucag

SEQ ID NO: 3407673 - RNA, 19 nt, Human
uaaauuuguaaguuucagg

SEQ ID NO: 3407674 - RNA, 23 nt, Human
uaaauuuguaaguuucaggugac

SEQ ID NO: 3407675 - RNA, 13 nt, Human
uaaauuuguacua

SEQ ID NO: 3407676 - RNA, 23 nt, Human
uaaauuuguguaauauuacuuua

SEQ ID NO: 3407677 - RNA, 17 nt, Human
uaaauuuuaacuaaauu

SEQ ID NO: 3407678 - RNA, 16 nt, Human
uaaauuuuacccuuua

SEQ ID NO: 3407679 - RNA, 18 nt, Human
uaaauuuucuucaguugg

SEQ ID NO: 3407680 - RNA, 14 nt, Human
uaaauuuugaaaag

SEQ ID NO: 3407681 - RNA, 18 nt, Human
uaaauuuugaguucuaca

SEQ ID NO: 3407682 - RNA, 17 nt, Human
uaaauuuuguaugaaaa

SEQ ID NO: 3407683 - RNA, 14 nt, Human
uaaauuuuuccuua

SEQ ID NO: 3407684 - RNA, 18 nt, Human
uaaauuuuuuguugacau

SEQ ID NO: 3407685 - RNA, 15 nt, Human
uaaauuuuuuuguau

SEQ ID NO: 3407686 - RNA, 18 nt, Human
uaaauuuuuuuguaugaa

SEQ ID NO: 3407687 - RNA, 20 nt, Human
uaacaaaaaaauauauuuaa

SEQ ID NO: 3407688 - RNA, 18 nt, Human
uaacaaaaacuacacaua

SEQ ID NO: 3407689 - RNA, 13 nt, Human
uaacaaaaauaaa

SEQ ID NO: 3407690 - RNA, 20 nt, Human
uaacaaaaauaaaaacucuu

SEQ ID NO: 3407691 - RNA, 20 nt, Human
uaacaaaagaugaaagcagg

SEQ ID NO: 3407692 - RNA, 12 nt, Human
uaacaaaaugga

SEQ ID NO: 3407693 - RNA, 19 nt, Human
uaacaaaauguaugucugg

SEQ ID NO: 3407694 - RNA, 20 nt, Human
uaacaaacccucguuucuga

SEQ ID NO: 3407695 - RNA, 23 nt, Human
uaacaaacccucguuucugauua

SEQ ID NO: 3407696 - RNA, 20 nt, Human
uaacaaacuacauguaaucc

SEQ ID NO: 3407697 - RNA, 22 nt, Human
uaacaaagaaccuaacauuuau

SEQ ID NO: 3407698 - RNA, 12 nt, Human
uaacaaagauau

SEQ ID NO: 3407699 - RNA, 14 nt, Human
uaacaaagauaucu

SEQ ID NO: 3407700 - RNA, 22 nt, Human
uaacaaagauaucuuuucuuua

SEQ ID NO: 3407701 - RNA, 15 nt, Human
uaacaaaggauacuu

SEQ ID NO: 3407702 - RNA, 16 nt, Human
uaacaaaggauacuua

SEQ ID NO: 3407703 - RNA, 19 nt, Human
uaacaaaggauacuuauuu

SEQ ID NO: 3407704 - RNA, 20 nt, Human
uaacaaaggauacuuauuua

SEQ ID NO: 3407705 - RNA, 21 nt, Human
uaacaaaggauacuuauuuaa

SEQ ID NO: 3407706 - RNA, 21 nt, Human
uaacaaauaaaaaagcucuuu

SEQ ID NO: 3407707 - RNA, 17 nt, Human
uaacaaauaacaacuuu

SEQ ID NO: 3407708 - RNA, 17 nt, Human
uaacaaauaugcuaauu

SEQ ID NO: 3407709 - RNA, 18 nt, Human
uaacaaauaugcuaauuu

SEQ ID NO: 3407710 - RNA, 12 nt, Human
uaacaaaugaac

SEQ ID NO: 3407711 - RNA, 14 nt, Human
uaacaacauguuuc

SEQ ID NO: 3407712 - RNA, 19 nt, Human
uaacaacauguuuccagca

SEQ ID NO: 3407713 - RNA, 20 nt, Human
uaacaacauguuuccagcau

SEQ ID NO: 3407714 - RNA, 15 nt, Human
uaacaaccaaagacu

SEQ ID NO: 3407715 - RNA, 14 nt, Human
uaacaaccuggaga

SEQ ID NO: 3407716 - RNA, 13 nt, Human
uaacaaccuggcc

SEQ ID NO: 3407717 - RNA, 20 nt, Human
uaacaacuuuuuuuucuuuu

SEQ ID NO: 3407718 - RNA, 15 nt, Human
uaacaagaaaacaua

SEQ ID NO: 3407719 - RNA, 15 nt, Human
uaacaagaaaaucaa

SEQ ID NO: 3407720 - RNA, 14 nt, Human
uaacaagaaaauga

SEQ ID NO: 3407721 - RNA, 14 nt, Human
uaacaagaaaggag

SEQ ID NO: 3407722 - RNA, 13 nt, Human
uaacaagaagcaa

SEQ ID NO: 3407723 - RNA, 17 nt, Human
uaacaagcucccaggcc

SEQ ID NO: 3407724 - RNA, 16 nt, Human
uaacaagguccaagau

SEQ ID NO: 3407725 - RNA, 21 nt, Human
uaacaaguaccaaaguuuuau

SEQ ID NO: 3407726 - RNA, 18 nt, Human
uaacaauaacuacugugu

SEQ ID NO: 3407727 - RNA, 19 nt, Human
uaacaauaacuacuguguu

SEQ ID NO: 3407728 - RNA, 20 nt, Human
uaacaauacaaauggauuuu

SEQ ID NO: 3407729 - RNA, 14 nt, Human
uaacaaucagcucc

SEQ ID NO: 3407730 - RNA, 17 nt, Human
uaacaaugaagauaaaa

SEQ ID NO: 3407731 - RNA, 21 nt, Human
uaacaaugacacuagaaaacu

SEQ ID NO: 3407732 - RNA, 13 nt, Human
uaacaaugauaua

SEQ ID NO: 3407733 - RNA, 21 nt, Human
uaacaaugcagcaaggcccug

SEQ ID NO: 3407734 - RNA, 17 nt, Human
uaacaaugccuauugua

SEQ ID NO: 3407735 - RNA, 13 nt, Human
uaacaaugcugua

SEQ ID NO: 3407736 - RNA, 16 nt, Human
uaacaauguauuuucu

SEQ ID NO: 3407737 - RNA, 16 nt, Human
uaacaauguuaaggaa

SEQ ID NO: 3407738 - RNA, 22 nt, Human
uaacaauguuaaggaaacucuu

SEQ ID NO: 3407739 - RNA, 20 nt, Human
uaacaauuaauugucuugca

SEQ ID NO: 3407740 - RNA, 16 nt, Human
uaacaauuaggcagac

SEQ ID NO: 3407741 - RNA, 20 nt, Human
uaacaauuaggcagacucuu

SEQ ID NO: 3407742 - RNA, 15 nt, Human
uaacaauugugaagu

SEQ ID NO: 3407743 - RNA, 18 nt, Human
uaacaauuguguagccuu

SEQ ID NO: 3407744 - RNA, 20 nt, Human
uaacaauuguguagccuuuu

SEQ ID NO: 3407745 - RNA, 13 nt, Human
uaacaauuuccuu

SEQ ID NO: 3407746 - RNA, 15 nt, Human
uaacaauuuccuuua

SEQ ID NO: 3407747 - RNA, 18 nt, Human
uaacaauuuuaaugcuau

SEQ ID NO: 3407748 - RNA, 18 nt, Human
uaacacaaaugcucaaag

SEQ ID NO: 3407749 - RNA, 17 nt, Human
uaaccucugcuuuuauc

SEQ ID NO: 3407750 - RNA, 18 nt, Human
uaaccucuguucaggaag

SEQ ID NO: 3407751 - RNA, 20 nt, Human
uaaccugaccgugggcgggg

SEQ ID NO: 3407752 - RNA, 22 nt, Human
uaaccugacugguuaacagcag

SEQ ID NO: 3407753 - RNA, 18 nt, Human
uaaccugucucaccugga

SEQ ID NO: 3407754 - RNA, 23 nt, Human
uaaccugugucugcgaaguccua

SEQ ID NO: 3407755 - RNA, 16 nt, Human
uaaccuuaauuuauua

SEQ ID NO: 3407756 - RNA, 21 nt, Human
uaaccuuaccagauuuuuaca

SEQ ID NO: 3407757 - RNA, 17 nt, Human
uaaccuuauccugcauu

SEQ ID NO: 3407758 - RNA, 15 nt, Human
uaaccuugaaugcug

SEQ ID NO: 3407759 - RNA, 17 nt, Human
uaaccuugaaugcugcc

SEQ ID NO: 3407760 - RNA, 21 nt, Human
uaaccuugccugguacaguau

SEQ ID NO: 3407761 - RNA, 23 nt, Human
uaacgacuucagggcagggcucu

SEQ ID NO: 3407762 - RNA, 17 nt, Human
uaacgcccuauuuuugc

SEQ ID NO: 3407763 - RNA, 19 nt, Human
uaacgccugagcccaggga

SEQ ID NO: 3407764 - RNA, 16 nt, Human
uaacgcgucuuccuga

SEQ ID NO: 3407765 - RNA, 17 nt, Human
uaacgcgucuuccugag

SEQ ID NO: 3407766 - RNA, 14 nt, Human
uaacggaccaaagc

SEQ ID NO: 3407767 - RNA, 13 nt, Human
uaacggaucagaa

SEQ ID NO: 3407768 - RNA, 12 nt, Human
uaacggcuccag

SEQ ID NO: 3407769 - RNA, 18 nt, Human
uaacggcuccaggauuuu

SEQ ID NO: 3407770 - RNA, 17 nt, Human
uaacguugcugugggaa

SEQ ID NO: 3407771 - RNA, 19 nt, Human
uaacguuuuuccuuuaaaa

SEQ ID NO: 3407772 - RNA, 17 nt, Human
uaacuaaaacaaagcca

SEQ ID NO: 3407773 - RNA, 14 nt, Human
uaacuaaaagguau

SEQ ID NO: 3407774 - RNA, 14 nt, Human
uaacuaaacucucu

SEQ ID NO: 3407775 - RNA, 14 nt, Human
uaacuaaauuaaca

SEQ ID NO: 3407776 - RNA, 16 nt, Human
uaacuaaauuaacauu

SEQ ID NO: 3407777 - RNA, 20 nt, Human
uaacuaaauuugauacuuau

SEQ ID NO: 3407778 - RNA, 21 nt, Human
uaacuaaauuugauacuuaua

SEQ ID NO: 3407779 - RNA, 22 nt, Human
uaacuaaauuugauacuuauau

SEQ ID NO: 3407780 - RNA, 14 nt, Human
uaacuaaauuuuaa

SEQ ID NO: 3407781 - RNA, 19 nt, Human
uaacuaacaaacagauucu

SEQ ID NO: 3407782 - RNA, 22 nt, Human
uaacuacaaagguuuaaaugaa

SEQ ID NO: 3407783 - RNA, 23 nt, Human
uaacuacaaagguuuaaaugaac

SEQ ID NO: 3407784 - RNA, 18 nt, Human
uaacuacauauugaauag

SEQ ID NO: 3407785 - RNA, 13 nt, Human
uaacuacauuuau

SEQ ID NO: 3407786 - RNA, 18 nt, Human
uaacuacccuuaauuacu

SEQ ID NO: 3407787 - RNA, 17 nt, Human
uaacuacuccggagaca

SEQ ID NO: 3407788 - RNA, 14 nt, Human
uaacuacuguguuc

SEQ ID NO: 3407789 - RNA, 14 nt, Human
uaacuacuuuauaa

SEQ ID NO: 3407790 - RNA, 14 nt, Human
uaacuagaacugaa

SEQ ID NO: 3407791 - RNA, 17 nt, Human
uaacuagaacugaauuu

SEQ ID NO: 3407792 - RNA, 20 nt, Human
uaacuagaacugaauuuugu

SEQ ID NO: 3407793 - RNA, 15 nt, Human
uaacuagaauuuauu

SEQ ID NO: 3407794 - RNA, 21 nt, Human
uaacuagacacagauaauaau

SEQ ID NO: 3407795 - RNA, 21 nt, Human
uaacuagacaccaaaguucua

SEQ ID NO: 3407796 - RNA, 16 nt, Human
uaacuagauggugcug

SEQ ID NO: 3407797 - RNA, 15 nt, Human
uaacuagcaccaggg

SEQ ID NO: 3407798 - RNA, 19 nt, Human
uaacuaggcucagagaugu

SEQ ID NO: 3407799 - RNA, 17 nt, Human
uaacuauaaauauguac

SEQ ID NO: 3407800 - RNA, 23 nt, Human
uaacuauaguccagcuuuguucu

SEQ ID NO: 3407801 - RNA, 22 nt, Human
uaacuauguacaauauuuuaag

SEQ ID NO: 3407802 - RNA, 16 nt, Human
uaacuauguugauaaa

SEQ ID NO: 3407803 - RNA, 15 nt, Human
uaacuauugcauuua

SEQ ID NO: 3407804 - RNA, 21 nt, Human
uaacucaccagccccacugcc

SEQ ID NO: 3407805 - RNA, 23 nt, Human
uaacucagaucacuacugcaguc

SEQ ID NO: 3407806 - RNA, 15 nt, Human
uaacucaggacucca

SEQ ID NO: 3407807 - RNA, 16 nt, Human
uaacucaggacuccag

SEQ ID NO: 3407808 - RNA, 17 nt, Human
uaacucaggacuccagc

SEQ ID NO: 3407809 - RNA, 20 nt, Human
uaacucaggacuccagccca

SEQ ID NO: 3407810 - RNA, 16 nt, Human
uaacucauaguuuguu

SEQ ID NO: 3407811 - RNA, 14 nt, Human
uaacucaucauaaa

SEQ ID NO: 3407812 - RNA, 17 nt, Human
uaacucaucauaaaaua

SEQ ID NO: 3407813 - RNA, 16 nt, Human
uaacuccccuguuuca

SEQ ID NO: 3407814 - RNA, 12 nt, Human
uaacuccuccca

SEQ ID NO: 3407815 - RNA, 16 nt, Human
uaacuccucccagggu

SEQ ID NO: 3407816 - RNA, 17 nt, Human
uaacuccugagaaaugu

SEQ ID NO: 3407817 - RNA, 14 nt, Human
uaacucugauguaa

SEQ ID NO: 3407818 - RNA, 11 nt, Human
uaacucugucu

SEQ ID NO: 3407819 - RNA, 14 nt, Human
uaacucugucuuca

SEQ ID NO: 3407820 - RNA, 16 nt, Human
uaacucuugucuauuu

SEQ ID NO: 3407821 - RNA, 12 nt, Human
uaacucuuugga

SEQ ID NO: 3407822 - RNA, 23 nt, Human
uaacugaacauccaaaaucuuga

SEQ ID NO: 3407823 - RNA, 14 nt, Human
uaacugaauaccac

SEQ ID NO: 3407824 - RNA, 18 nt, Human
uaacugaauaccacucug

SEQ ID NO: 3407825 - RNA, 22 nt, Human
uaacugaauaccacucuguaau

SEQ ID NO: 3407826 - RNA, 13 nt, Human
uaacugacaacuu

SEQ ID NO: 3407827 - RNA, 17 nt, Human
uaacugacaagccaucu

SEQ ID NO: 3407828 - RNA, 14 nt, Human
uaacugacuauucu

SEQ ID NO: 3407829 - RNA, 21 nt, Human
uaacugacuauucuugaugua

SEQ ID NO: 3407830 - RNA, 16 nt, Human
uaacugagugccuuuu

SEQ ID NO: 3407831 - RNA, 17 nt, Human
uaacugagugccuuuug

SEQ ID NO: 3407832 - RNA, 23 nt, Human
uaacugauuaguaagucuugccu

SEQ ID NO: 3407833 - RNA, 19 nt, Human
uaacugcaaagugaaguug

SEQ ID NO: 3407834 - RNA, 20 nt, Human
uaacugcaauuuuaauugau

SEQ ID NO: 3407835 - RNA, 17 nt, Human
uaacugcauugagaacu

SEQ ID NO: 3407836 - RNA, 23 nt, Human
uaacugccaucaagaugagagaa

SEQ ID NO: 3407837 - RNA, 21 nt, Human
uaacugcccaaagcagcacuu

SEQ ID NO: 3407838 - RNA, 23 nt, Human
uaacugcccagcggacaguggca

SEQ ID NO: 3407839 - RNA, 17 nt, Human
uaacugccguaauuuaa

SEQ ID NO: 3407840 - RNA, 15 nt, Human
uaacugccuagaaac

SEQ ID NO: 3407841 - RNA, 12 nt, Human
uaacugccuuga

SEQ ID NO: 3407842 - RNA, 21 nt, Human
uaacugccuugaaccugugag

SEQ ID NO: 3407843 - RNA, 12 nt, Human
uaacugcucuug

SEQ ID NO: 3407844 - RNA, 15 nt, Human
uaacugcucuugggc

SEQ ID NO: 3407845 - RNA, 19 nt, Human
uaacugcucuugggcaaua

SEQ ID NO: 3407846 - RNA, 14 nt, Human
uaacugcuuucugu

SEQ ID NO: 3407847 - RNA, 17 nt, Human
uaacugcuuucuguucc

SEQ ID NO: 3407848 - RNA, 20 nt, Human
uaacugcuuucuguuccaaa

SEQ ID NO: 3407849 - RNA, 18 nt, Human
uaacuggaaaacagaaca

SEQ ID NO: 3407850 - RNA, 14 nt, Human
uaacuggaaagaag

SEQ ID NO: 3407851 - RNA, 15 nt, Human
uaacuggaaagaagu

SEQ ID NO: 3407852 - RNA, 19 nt, Human
uaacuggaacaaauuauuu

SEQ ID NO: 3407853 - RNA, 17 nt, Human
uaacuggguaaugaaac

SEQ ID NO: 3407854 - RNA, 20 nt, Human
uaacuggguaaugaaacaaa

SEQ ID NO: 3407855 - RNA, 18 nt, Human
uaacuggugauauaucuc

SEQ ID NO: 3407856 - RNA, 23 nt, Human
uaacuguaaagauguuuauuuca

SEQ ID NO: 3407857 - RNA, 13 nt, Human
uaacuguaaauca

SEQ ID NO: 3407858 - RNA, 14 nt, Human
uaacuguaaaucau

SEQ ID NO: 3407859 - RNA, 18 nt, Human
uaacuguaaaugugacau

SEQ ID NO: 3407860 - RNA, 19 nt, Human
uaacuguaauuauuugaau

SEQ ID NO: 3407861 - RNA, 17 nt, Human
uaacuguauauuuguau

SEQ ID NO: 3407862 - RNA, 21 nt, Human
uaacugucaggcugaaaacaa

SEQ ID NO: 3407863 - RNA, 17 nt, Human
uaacugugaaguuuaca

SEQ ID NO: 3407864 - RNA, 16 nt, Human
uaacugugcugaaugc

SEQ ID NO: 3407865 - RNA, 18 nt, Human
uaacuguguauguacaua

SEQ ID NO: 3407866 - RNA, 20 nt, Human
uaacuguguauguacauaua

SEQ ID NO: 3407867 - RNA, 22 nt, Human
uaacuguuaaauugcuguguau

SEQ ID NO: 3407868 - RNA, 20 nt, Human
uaacuguuacaguaauguca

SEQ ID NO: 3407869 - RNA, 16 nt, Human
uaacuguuauuuauaa

SEQ ID NO: 3407870 - RNA, 17 nt, Human
uaacuguuucaaagcca

SEQ ID NO: 3407871 - RNA, 21 nt, Human
uaacuuaaaaauguaaauauu

SEQ ID NO: 3407872 - RNA, 22 nt, Human
uaacuuaaaagaacauguauau

SEQ ID NO: 3407873 - RNA, 16 nt, Human
uaacuuaauaaucaag

SEQ ID NO: 3407874 - RNA, 14 nt, Human
uaacuuaaucaauu

SEQ ID NO: 3407875 - RNA, 15 nt, Human
uaacuuaaugaaaac

SEQ ID NO: 3407876 - RNA, 17 nt, Human
uaacuuagagcuuuuuu

SEQ ID NO: 3407877 - RNA, 17 nt, Human
uaacuuaguuuugcaua

SEQ ID NO: 3407878 - RNA, 16 nt, Human
uaacuuauauugaaga

SEQ ID NO: 3407879 - RNA, 17 nt, Human
uaacuuauauuguaaga

SEQ ID NO: 3407880 - RNA, 18 nt, Human
uaacuuauauuguaagaa

SEQ ID NO: 3407881 - RNA, 19 nt, Human
uaacuuauauuguaagaaa

SEQ ID NO: 3407882 - RNA, 20 nt, Human
uaacuuauauuguaagaaau

SEQ ID NO: 3407883 - RNA, 21 nt, Human
uaacuuauauuguaagaaaua

SEQ ID NO: 3407884 - RNA, 21 nt, Human
uaacuuauguagauauuuggc

SEQ ID NO: 3407885 - RNA, 17 nt, Human
uaacuuauucaaagaga

SEQ ID NO: 3407886 - RNA, 16 nt, Human
uaacuuauuuagagau

SEQ ID NO: 3407887 - RNA, 23 nt, Human
uaacuuauuuauguuaaaagauu

SEQ ID NO: 3407888 - RNA, 21 nt, Human
uaacuucacauauugauuucc

SEQ ID NO: 3407889 - RNA, 18 nt, Human
uaacuucacauuaaaaaa

SEQ ID NO: 3407890 - RNA, 14 nt, Human
uaacuucaccauau

SEQ ID NO: 3407891 - RNA, 16 nt, Human
uaacuucauaagcaaa

SEQ ID NO: 3407892 - RNA, 17 nt, Human
uaacuuccaugugaggg

SEQ ID NO: 3407893 - RNA, 15 nt, Human
uacagguuacaacag

SEQ ID NO: 3407894 - RNA, 18 nt, Human
uacagguuacaacagauu

SEQ ID NO: 3407895 - RNA, 21 nt, Human
uacagguuacaacagauuugu

SEQ ID NO: 3407896 - RNA, 23 nt, Human
uacagguuacaacagauuuguga

SEQ ID NO: 3407897 - RNA, 13 nt, Human
uacaguaaauaaa

SEQ ID NO: 3407898 - RNA, 17 nt, Human
uacaguaaauaaauugu

SEQ ID NO: 3407899 - RNA, 18 nt, Human
uacaguaaauaaauuguu

SEQ ID NO: 3407900 - RNA, 13 nt, Human
uacaguaggagcc

SEQ ID NO: 3407901 - RNA, 20 nt, Human
uacaguaggagcccagcucu

SEQ ID NO: 3407902 - RNA, 16 nt, Human
uacaguagugagaaga

SEQ ID NO: 3407903 - RNA, 16 nt, Human
uacaguauaauuaaca

SEQ ID NO: 3407904 - RNA, 17 nt, Human
uacaguauaauuaacau

SEQ ID NO: 3407905 - RNA, 20 nt, Human
uacaguauggggguuguaaa

SEQ ID NO: 3407906 - RNA, 13 nt, Human
uacaguauucugu

SEQ ID NO: 3407907 - RNA, 18 nt, Human
uacagucaagauagaaag

SEQ ID NO: 3407908 - RNA, 19 nt, Human
uacaguccaaaauacuguu

SEQ ID NO: 3407909 - RNA, 15 nt, Human
uacaguccuucaaaa

SEQ ID NO: 3407910 - RNA, 19 nt, Human
uacaguccuucaaaauccu

SEQ ID NO: 3407911 - RNA, 15 nt, Human
uacagucuaaagcug

SEQ ID NO: 3407912 - RNA, 13 nt, Human
uacagucuauuug

SEQ ID NO: 3407913 - RNA, 14 nt, Human
uacagucugucaug

SEQ ID NO: 3407914 - RNA, 15 nt, Human
uacagucugucauga

SEQ ID NO: 3407915 - RNA, 14 nt, Human
uacagucuuccaca

SEQ ID NO: 3407916 - RNA, 19 nt, Human
uacagucuuccauuugcaa

SEQ ID NO: 3407917 - RNA, 20 nt, Human
uacagucuuccauuugcaag

SEQ ID NO: 3407918 - RNA, 19 nt, Human
uacagucuucuuacuugga

SEQ ID NO: 3407919 - RNA, 12 nt, Human
uacagucuugua

SEQ ID NO: 3407920 - RNA, 16 nt, Human
uacaguggauugcuca

SEQ ID NO: 3407921 - RNA, 11 nt, Human
uacagugguuu

SEQ ID NO: 3407922 - RNA, 13 nt, Human
uacaguguacagu

SEQ ID NO: 3407923 - RNA, 22 nt, Human
uacaguguacagucuuguauua

SEQ ID NO: 3407924 - RNA, 14 nt, Human
uacagugucuuuuu

SEQ ID NO: 3407925 - RNA, 19 nt, Human
uacaguguuauuuucuuug

SEQ ID NO: 3407926 - RNA, 15 nt, Human
uacaguguuuauccu

SEQ ID NO: 3407927 - RNA, 23 nt, Human
uacaguguuuauccuuucauaua

SEQ ID NO: 3407928 - RNA, 17 nt, Human
uacaguuacuuuuccuu

SEQ ID NO: 3407929 - RNA, 20 nt, Human
uacaguuaggcaccagaaga

SEQ ID NO: 3407930 - RNA, 23 nt, Human
uacaguuaggcaccagaagaaca

SEQ ID NO: 3407931 - RNA, 12 nt, Human
uacaguucaguu

SEQ ID NO: 3407932 - RNA, 23 nt, Human
uacaguucggugagcuacaaaug

SEQ ID NO: 3407933 - RNA, 20 nt, Human
uacaguucugcucugguugu

SEQ ID NO: 3407934 - RNA, 14 nt, Human
uacaguucuguggu

SEQ ID NO: 3407935 - RNA, 15 nt, Human
uacaguucugugguu

SEQ ID NO: 3407936 - RNA, 21 nt, Human
uacaguucugugguuucaugu

SEQ ID NO: 3407937 - RNA, 18 nt, Human
uacaguucuucgggaaga

SEQ ID NO: 3407938 - RNA, 18 nt, Human
uacaguuguuggccuccg

SEQ ID NO: 3407939 - RNA, 23 nt, Human
uacaguuuauuuuuaaagauaga

SEQ ID NO: 3407940 - RNA, 13 nt, Human
uacaguuucaaaa

SEQ ID NO: 3407941 - RNA, 15 nt, Human
uacaguuuguuuaca

SEQ ID NO: 3407942 - RNA, 13 nt, Human
uacaguuuuaugc

SEQ ID NO: 3407943 - RNA, 17 nt, Human
uacaguuuuaugcucuu

SEQ ID NO: 3407944 - RNA, 15 nt, Human
uacaguuuucagaaa

SEQ ID NO: 3407945 - RNA, 15 nt, Human
uacauaaaagaauuu

SEQ ID NO: 3407946 - RNA, 16 nt, Human
uacauaaaagaauuuu

SEQ ID NO: 3407947 - RNA, 23 nt, Human
uacauaaaccauuuuuguuacuc

SEQ ID NO: 3407948 - RNA, 17 nt, Human
uacauaaacugacuuua

SEQ ID NO: 3407949 - RNA, 16 nt, Human
uacauaaauuggccug

SEQ ID NO: 3407950 - RNA, 23 nt, Human
uacauaacaggguaaauuauuca

SEQ ID NO: 3407951 - RNA, 21 nt, Human
uacauaacugaaaaugugcua

SEQ ID NO: 3407952 - RNA, 15 nt, Human
uacauaaguaauuca

SEQ ID NO: 3407953 - RNA, 20 nt, Human
uacauaauacugaaccacuu

SEQ ID NO: 3407954 - RNA, 24 nt, Human
uacauaaugcgugcauaccacuuu

SEQ ID NO: 3407955 - RNA, 22 nt, Human
uacauaaugcuuaauuucuaaa

SEQ ID NO: 3407956 - RNA, 15 nt, Human
uacauaauucacucu

SEQ ID NO: 3407957 - RNA, 17 nt, Human
uacauaauucacucuga

SEQ ID NO: 3407958 - RNA, 23 nt, Human
uacauacacauauauacacacac

SEQ ID NO: 3407959 - RNA, 16 nt, Human
uacauacaccagcauu

SEQ ID NO: 3407960 - RNA, 21 nt, Human
uacauacacuuguauaaaugu

SEQ ID NO: 3407961 - RNA, 12 nt, Human
uacauacagaau

SEQ ID NO: 3407962 - RNA, 20 nt, Human
uacauacagaauuacuguaa

SEQ ID NO: 3407963 - RNA, 20 nt, Human
uacauaccacgcuagggcug

SEQ ID NO: 3407964 - RNA, 15 nt, Human
uacauacgauuuaag

SEQ ID NO: 3407965 - RNA, 13 nt, Human
uacauacggucag

SEQ ID NO: 3407966 - RNA, 17 nt, Human
uacauacggucagguuu

SEQ ID NO: 3407967 - RNA, 23 nt, Human
uacauacggucagguuuaacauu

SEQ ID NO: 3407968 - RNA, 17 nt, Human
uacauacuaugaaauau

SEQ ID NO: 3407969 - RNA, 12 nt, Human
uacauacugcug

SEQ ID NO: 3407970 - RNA, 13 nt, Human
uacauacugcugu

SEQ ID NO: 3407971 - RNA, 19 nt, Human
uacauacuuuaucaaugug

SEQ ID NO: 3407972 - RNA, 14 nt, Human
uacauagaugcuua

SEQ ID NO: 3407973 - RNA, 17 nt, Human
uacauagaugcuuaguc

SEQ ID NO: 3407974 - RNA, 13 nt, Human
uacauagccuaua

SEQ ID NO: 3407975 - RNA, 21 nt, Human
uacauagggauaugcguauua

SEQ ID NO: 3407976 - RNA, 16 nt, Human
uacauagugcuaacau

SEQ ID NO: 3407977 - RNA, 23 nt, Human
uacauagugcuaacaugaagacc

SEQ ID NO: 3407978 - RNA, 17 nt, Human
uacauagugcugcugug

SEQ ID NO: 3407979 - RNA, 19 nt, Human
uacauagugcugcugugug

SEQ ID NO: 3407980 - RNA, 15 nt, Human
uacauauauuuuuaa

SEQ ID NO: 3407981 - RNA, 15 nt, Human
uacauaucgcugacu

SEQ ID NO: 3407982 - RNA, 17 nt, Human
uacauaucgcugacuuc

SEQ ID NO: 3407983 - RNA, 20 nt, Human
uacauaucgcugacuucaug

SEQ ID NO: 3407984 - RNA, 22 nt, Human
uacauaucuuuauuaaucacua

SEQ ID NO: 3407985 - RNA, 17 nt, Human
uacauaugaucugucug

SEQ ID NO: 3407986 - RNA, 14 nt, Human
uacauaugcuuuaa

SEQ ID NO: 3407987 - RNA, 17 nt, Human
uacauaugcuuuaagaa

SEQ ID NO: 3407988 - RNA, 18 nt, Human
uacauauggauguuacuc

SEQ ID NO: 3407989 - RNA, 15 nt, Human
uacauauguagacua

SEQ ID NO: 3407990 - RNA, 17 nt, Human
uacauauguagacuaua

SEQ ID NO: 3407991 - RNA, 14 nt, Human
uacauauucuuuaa

SEQ ID NO: 3407992 - RNA, 17 nt, Human
uacauauuuauuuucuu

SEQ ID NO: 3407993 - RNA, 13 nt, Human
uacauauuuccaa

SEQ ID NO: 3407994 - RNA, 19 nt, Human
uacauauuugcauauguau

SEQ ID NO: 3407995 - RNA, 17 nt, Human
uacauauuuguggaaua

SEQ ID NO: 3407996 - RNA, 12 nt, Human
uacaucacugcu

SEQ ID NO: 3407997 - RNA, 15 nt, Human
uacaucacugcuuga

SEQ ID NO: 3407998 - RNA, 22 nt, Human
uacaucacugcuugaugaagca

SEQ ID NO: 3407999 - RNA, 12 nt, Human
uacaucauuucu

SEQ ID NO: 3408000 - RNA, 19 nt, Human
uacauccaaagcagacagc

SEQ ID NO: 3408001 - RNA, 20 nt, Human
uacauccaaagcagacagcu

SEQ ID NO: 3408002 - RNA, 16 nt, Human
uacaucccauguaaca

SEQ ID NO: 3408003 - RNA, 18 nt, Human
uacaucccauguaacaga

SEQ ID NO: 3408004 - RNA, 22 nt, Human
uacaucccauguaacagaaagg

SEQ ID NO: 3408005 - RNA, 14 nt, Human
uacauccuggguaa

SEQ ID NO: 3408006 - RNA, 20 nt, Human
uacauccuuguggcacauuu

SEQ ID NO: 3408007 - RNA, 19 nt, Human
uacaucuauuuuggauugu

SEQ ID NO: 3408008 - RNA, 15 nt, Human
uacaucucuccccaa

SEQ ID NO: 3408009 - RNA, 17 nt, Human
uacaucuggcuuauuuu

SEQ ID NO: 3408010 - RNA, 14 nt, Human
uacaucuucugccu

SEQ ID NO: 3408011 - RNA, 17 nt, Human
uacaucuucugccuuag

SEQ ID NO: 3408012 - RNA, 16 nt, Human
uacaucuuuaaacagu

SEQ ID NO: 3408013 - RNA, 14 nt, Human
uacaucuuucacau

SEQ ID NO: 3408014 - RNA, 17 nt, Human
uacaucuuuuuucacaa

SEQ ID NO: 3408015 - RNA, 20 nt, Human
uacaucuuuuuucacaaauu

SEQ ID NO: 3408016 - RNA, 12 nt, Human
uacaugaaacag

SEQ ID NO: 3408017 - RNA, 13 nt, Human
uacaugaaacaga

SEQ ID NO: 3408018 - RNA, 14 nt, Human
uacaugaaacagaa

SEQ ID NO: 3408019 - RNA, 18 nt, Human
uacaugaaauuuuuguaa

SEQ ID NO: 3408020 - RNA, 13 nt, Human
uacaugaaguauu

SEQ ID NO: 3408021 - RNA, 14 nt, Human
uacaugaauacaaa

SEQ ID NO: 3408022 - RNA, 18 nt, Human
uacaugacacugaaaugc

SEQ ID NO: 3408023 - RNA, 20 nt, Human
uacaugacacugaaaugccu

SEQ ID NO: 3408024 - RNA, 21 nt, Human
uacaugacauuuauuuuucau

SEQ ID NO: 3408025 - RNA, 18 nt, Human
uacaugacgacaaagcug

SEQ ID NO: 3408026 - RNA, 23 nt, Human
uacaugacgacaaagcugcuaaa

SEQ ID NO: 3408027 - RNA, 19 nt, Human
uacaugacucagcauaccu

SEQ ID NO: 3408028 - RNA, 13 nt, Human
uacaugaggacuc

SEQ ID NO: 3408029 - RNA, 14 nt, Human
uacaugaggacucu

SEQ ID NO: 3408030 - RNA, 22 nt, Human
uacaugaggacucuauucuuua

SEQ ID NO: 3408031 - RNA, 15 nt, Human
uacaugaugauuuca

SEQ ID NO: 3408032 - RNA, 14 nt, Human
uacaugauucauuu

SEQ ID NO: 3408033 - RNA, 15 nt, Human
uacaugauucauuuu

SEQ ID NO: 3408034 - RNA, 16 nt, Human
uacaugcaaaaagaaa

SEQ ID NO: 3408035 - RNA, 22 nt, Human
uacaugcaauuuauuaaaauga

SEQ ID NO: 3408036 - RNA, 14 nt, Human
uacaugcauacacu

SEQ ID NO: 3408037 - RNA, 14 nt, Human
uacaugcauacuuc

SEQ ID NO: 3408038 - RNA, 17 nt, Human
uaccugaccucuugcug

SEQ ID NO: 3408039 - RNA, 22 nt, Human
uaccugaccucuugcugucucu

SEQ ID NO: 3408040 - RNA, 15 nt, Human
uaccugaggggccuc

SEQ ID NO: 3408041 - RNA, 20 nt, Human
uaccugccacucacacagcc

SEQ ID NO: 3408042 - RNA, 22 nt, Human
uaccugccacucacacagccag

SEQ ID NO: 3408043 - RNA, 20 nt, Human
uaccugccaggaagccagca

SEQ ID NO: 3408044 - RNA, 13 nt, Human
uaccugcccugga

SEQ ID NO: 3408045 - RNA, 21 nt, Human
uaccugcucacgucaaaugca

SEQ ID NO: 3408046 - RNA, 14 nt, Human
uaccugcugcuucu

SEQ ID NO: 3408047 - RNA, 17 nt, Human
uaccuggaggaggagca

SEQ ID NO: 3408048 - RNA, 15 nt, Human
uaccuggauguucuu

SEQ ID NO: 3408049 - RNA, 14 nt, Human
uaccugggaagggg

SEQ ID NO: 3408050 - RNA, 20 nt, Human
uaccugggcauacuaauaaa

SEQ ID NO: 3408051 - RNA, 14 nt, Human
uaccuguacacuga

SEQ ID NO: 3408052 - RNA, 12 nt, Human
uaccuguauaca

SEQ ID NO: 3408053 - RNA, 18 nt, Human
uaccuguauuuaaaaaua

SEQ ID NO: 3408054 - RNA, 22 nt, Human
uaccuguauuuaaaaauagaaa

SEQ ID NO: 3408055 - RNA, 14 nt, Human
uaccugucacauug

SEQ ID NO: 3408056 - RNA, 19 nt, Human
uaccugucacauugcauuc

SEQ ID NO: 3408057 - RNA, 10 nt, Human
uaccuguccc

SEQ ID NO: 3408058 - RNA, 13 nt, Human
uaccugucccccu

SEQ ID NO: 3408059 - RNA, 15 nt, Human
uaccugugaaguguu

SEQ ID NO: 3408060 - RNA, 22 nt, Human
uaccuguguauuuuuuaaagcu

SEQ ID NO: 3408061 - RNA, 17 nt, Human
uaccuguguuucuugcc

SEQ ID NO: 3408062 - RNA, 17 nt, Human
uaccuuaaaauuugaaa

SEQ ID NO: 3408063 - RNA, 18 nt, Human
uaccuuaaaauuugaaac

SEQ ID NO: 3408064 - RNA, 18 nt, Human
uaccuuauaguuacugug

SEQ ID NO: 3408065 - RNA, 14 nt, Human
uaccuuaucuuaca

SEQ ID NO: 3408066 - RNA, 14 nt, Human
uaccuucauuucag

SEQ ID NO: 3408067 - RNA, 20 nt, Human
uaccuuccagucaggaugac

SEQ ID NO: 3408068 - RNA, 23 nt, Human
uaccuucuccccagcucccagga

SEQ ID NO: 3408069 - RNA, 16 nt, Human
uaccuugaacugaagg

SEQ ID NO: 3408070 - RNA, 18 nt, Human
uaccuugacacauaguuu

SEQ ID NO: 3408071 - RNA, 15 nt, Human
uaccuugaggucuuu

SEQ ID NO: 3408072 - RNA, 23 nt, Human
uaccuugcacacaucaucuguaa

SEQ ID NO: 3408073 - RNA, 17 nt, Human
uaccuugcaucucacag

SEQ ID NO: 3408074 - RNA, 18 nt, Human
uaccuugccaauuaguaa

SEQ ID NO: 3408075 - RNA, 16 nt, Human
uaccuuguauacugua

SEQ ID NO: 3408076 - RNA, 19 nt, Human
uaccuugucauuuuggucu

SEQ ID NO: 3408077 - RNA, 18 nt, Human
uaccuugugacccagcac

SEQ ID NO: 3408078 - RNA, 14 nt, Human
uaccuuuaugguuu

SEQ ID NO: 3408079 - RNA, 16 nt, Human
uaccuuuaugguuucu

SEQ ID NO: 3408080 - RNA, 14 nt, Human
uaccuuucaaagcu

SEQ ID NO: 3408081 - RNA, 12 nt, Human
uaccuuucauac

SEQ ID NO: 3408082 - RNA, 20 nt, Human
uaccuuugaauucaagaaca

SEQ ID NO: 3408083 - RNA, 12 nt, Human
uaccuuugucac

SEQ ID NO: 3408084 - RNA, 21 nt, Human
uaccuuuuaacaccugaugug

SEQ ID NO: 3408085 - RNA, 17 nt, Human
uaccuuuuaccagcuuu

SEQ ID NO: 3408086 - RNA, 18 nt, Human
uaccuuuuaccagcuuuu

SEQ ID NO: 3408087 - RNA, 16 nt, Human
uaccuuuuauguagca

SEQ ID NO: 3408088 - RNA, 19 nt, Human
uaccuuuuuuagaguugau

SEQ ID NO: 3408089 - RNA, 16 nt, Human
uaccuuuuuuauacau

SEQ ID NO: 3408090 - RNA, 17 nt, Human
uaccuuuuuuauacaua

SEQ ID NO: 3408091 - RNA, 22 nt, Human
uaccuuuuuuauacauaaacaa

SEQ ID NO: 3408092 - RNA, 21 nt, Human
uaccuuuuuugauaaaguuuc

SEQ ID NO: 3408093 - RNA, 22 nt, Human
uaccuuuuuuguuuuuucaaaa

SEQ ID NO: 3408094 - RNA, 15 nt, Human
uaccuuuuuuuuucu

SEQ ID NO: 3408095 - RNA, 19 nt, Human
uaccuuuuuuuuucuuuuu

SEQ ID NO: 3408096 - RNA, 20 nt, Human
uaccuuuuuuuuuucuuggu

SEQ ID NO: 3408097 - RNA, 23 nt, Human
uacgaagaguauuuuugacagaa

SEQ ID NO: 3408098 - RNA, 16 nt, Human
uacgaaguucaagauc

SEQ ID NO: 3408099 - RNA, 18 nt, Human
uacgaaguucaagaucaa

SEQ ID NO: 3408100 - RNA, 15 nt, Human
uacgacuuuauuuuc

SEQ ID NO: 3408101 - RNA, 17 nt, Human
uacgacuuuauuuucug

SEQ ID NO: 3408102 - RNA, 19 nt, Human
uacgagagcagaggucucc

SEQ ID NO: 3408103 - RNA, 21 nt, Human
uacgagcaccuccagccugaa

SEQ ID NO: 3408104 - RNA, 14 nt, Human
uacgaucaggcaca

SEQ ID NO: 3408105 - RNA, 16 nt, Human
uacgaucaggcacagg

SEQ ID NO: 3408106 - RNA, 13 nt, Human
uacgcacagacag

SEQ ID NO: 3408107 - RNA, 14 nt, Human
uacgcacagacagg

SEQ ID NO: 3408108 - RNA, 17 nt, Human
uacgcaggcaucugauu

SEQ ID NO: 3408109 - RNA, 17 nt, Human
uacgcccaacccuuccc

SEQ ID NO: 3408110 - RNA, 13 nt, Human
uacgccucuucug

SEQ ID NO: 3408111 - RNA, 17 nt, Human
uacgccugcauguaaac

SEQ ID NO: 3408112 - RNA, 16 nt, Human
uacgccugccuccccu

SEQ ID NO: 3408113 - RNA, 13 nt, Human
uacgcugaagaug

SEQ ID NO: 3408114 - RNA, 13 nt, Human
uacgcuggugcug

SEQ ID NO: 3408115 - RNA, 20 nt, Human
uacgcuuugucacacaaaaa

SEQ ID NO: 3408116 - RNA, 17 nt, Human
uacgcuuuucuuuguua

SEQ ID NO: 3408117 - RNA, 20 nt, Human
uacggucagguuuaacauuu

SEQ ID NO: 3408118 - RNA, 12 nt, Human
uacguaugucug

SEQ ID NO: 3408119 - RNA, 14 nt, Human
uacguaugucuggu

SEQ ID NO: 3408120 - RNA, 21 nt, Human
uacgugacccucugcugaaga

SEQ ID NO: 3408121 - RNA, 13 nt, Human
uacgugaguccug

SEQ ID NO: 3408122 - RNA, 15 nt, Human
uacgugugauuuuuc

SEQ ID NO: 3408123 - RNA, 14 nt, Human
uacguuaccaggca

SEQ ID NO: 3408124 - RNA, 15 nt, Human
uacguuccuauuguc

SEQ ID NO: 3408125 - RNA, 15 nt, Human
uacguugugcauuug

SEQ ID NO: 3408126 - RNA, 11 nt, Human
uacguuucuuu

SEQ ID NO: 3408127 - RNA, 13 nt, Human
uacguuuguaugu

SEQ ID NO: 3408128 - RNA, 20 nt, Human
uacguuuguauguguguaga

SEQ ID NO: 3408129 - RNA, 13 nt, Human
uacguuuuuguaa

SEQ ID NO: 3408130 - RNA, 16 nt, Human
uacuaaaaaaaagaug

SEQ ID NO: 3408131 - RNA, 18 nt, Human
uacuaaaaaguauaaaau

SEQ ID NO: 3408132 - RNA, 19 nt, Human
uacuaaaaaguauaaaaua

SEQ ID NO: 3408133 - RNA, 16 nt, Human
uacuaaaaaugcaaaa

SEQ ID NO: 3408134 - RNA, 20 nt, Human
uacuaaaaguucuucuccaa

SEQ ID NO: 3408135 - RNA, 21 nt, Human
uacuaaaaguuuugagaaauu

SEQ ID NO: 3408136 - RNA, 13 nt, Human
uacuaaaauauau

SEQ ID NO: 3408137 - RNA, 18 nt, Human
uacuaaacauaugauuuc

SEQ ID NO: 3408138 - RNA, 16 nt, Human
uacuaaagaaagauua

SEQ ID NO: 3408139 - RNA, 14 nt, Human
uacuaaagccaaac

SEQ ID NO: 3408140 - RNA, 14 nt, Human
uacuaaauuuaaau

SEQ ID NO: 3408141 - RNA, 17 nt, Human
uacuaaauuuaaauuua

SEQ ID NO: 3408142 - RNA, 23 nt, Human
uacuaaauuuaaauuuaaagaua

SEQ ID NO: 3408143 - RNA, 18 nt, Human
uacuaacauuuauuugag

SEQ ID NO: 3408144 - RNA, 17 nt, Human
uacuaaccagcagaaau

SEQ ID NO: 3408145 - RNA, 19 nt, Human
uacuaaccagcagaaaugc

SEQ ID NO: 3408146 - RNA, 20 nt, Human
uacuaagcauagcaaacaga

SEQ ID NO: 3408147 - RNA, 14 nt, Human
uacuaaggaaucuu

SEQ ID NO: 3408148 - RNA, 18 nt, Human
uacuaaggaguaaucugu

SEQ ID NO: 3408149 - RNA, 23 nt, Human
uacuaaggaguaaucuguguaca

SEQ ID NO: 3408150 - RNA, 23 nt, Human
uacuaauagaauaaaggcaguuu

SEQ ID NO: 3408151 - RNA, 17 nt, Human
uacuaauagacaauuua

SEQ ID NO: 3408152 - RNA, 20 nt, Human
uacuaauagacaauuuauua

SEQ ID NO: 3408153 - RNA, 21 nt, Human
uacuaauagacaauuuauuau

SEQ ID NO: 3408154 - RNA, 16 nt, Human
uacuaaugaaaacaga

SEQ ID NO: 3408155 - RNA, 16 nt, Human
uacuaauguaaaauga

SEQ ID NO: 3408156 - RNA, 19 nt, Human
uacuaauuaacauauaaua

SEQ ID NO: 3408157 - RNA, 23 nt, Human
uacuaauuaacauauaauauaug

SEQ ID NO: 3408158 - RNA, 13 nt, Human
uacuacaaaauuu

SEQ ID NO: 3408159 - RNA, 18 nt, Human
uacuacaaaauuugaaau

SEQ ID NO: 3408160 - RNA, 17 nt, Human
uacuacaauauguacau

SEQ ID NO: 3408161 - RNA, 18 nt, Human
uacuacacauucaauaag

SEQ ID NO: 3408162 - RNA, 15 nt, Human
uacuacacauuuuua

SEQ ID NO: 3408163 - RNA, 15 nt, Human
uacuacacugaggag

SEQ ID NO: 3408164 - RNA, 15 nt, Human
uacuacagucaagau

SEQ ID NO: 3408165 - RNA, 14 nt, Human
uacuacaguccucc

SEQ ID NO: 3408166 - RNA, 17 nt, Human
uacuacaguccucccau

SEQ ID NO: 3408167 - RNA, 14 nt, Human
uacuacaguuuguu

SEQ ID NO: 3408168 - RNA, 13 nt, Human
uacuacaugcacu

SEQ ID NO: 3408169 - RNA, 18 nt, Human
uacuacaugugggagcuu

SEQ ID NO: 3408170 - RNA, 16 nt, Human
uacuaccuugaaaaua

SEQ ID NO: 3408171 - RNA, 17 nt, Human
uacuacugaaucucuaa

SEQ ID NO: 3408172 - RNA, 20 nt, Human
uacuacuguggaaaaauauu

SEQ ID NO: 3408173 - RNA, 22 nt, Human
uacuacuguggaaaaauauuua

SEQ ID NO: 3408174 - RNA, 13 nt, Human
uacuagaaugcuu

SEQ ID NO: 3408175 - RNA, 14 nt, Human
uacuagaaugcuua

SEQ ID NO: 3408176 - RNA, 23 nt, Human
uacuagagauauuuuguaaaaug

SEQ ID NO: 3408177 - RNA, 16 nt, Human
uacuagaguuggcaug

SEQ ID NO: 3408178 - RNA, 14 nt, Human
uacuagaugucuuu

SEQ ID NO: 3408179 - RNA, 23 nt, Human
uacuagauuugggagaagggcag

SEQ ID NO: 3408180 - RNA, 14 nt, Human
uacuagcaaaauaa

SEQ ID NO: 3408181 - RNA, 19 nt, Human
uacuagcaaaauaaaacau

SEQ ID NO: 3408182 - RNA, 18 nt, Human
uacuagggagaagguuuc

SEQ ID NO: 3408183 - RNA, 21 nt, Human
uacuagggaucccucaucugu

SEQ ID NO: 3408184 - RNA, 13 nt, Human
uacuagguaacuu

SEQ ID NO: 3408185 - RNA, 21 nt, Human
uacuaguacuguguacuguau

SEQ ID NO: 3408186 - RNA, 19 nt, Human
uacuagucugugugggacu

SEQ ID NO: 3408187 - RNA, 14 nt, Human
uacuaguguucugu

SEQ ID NO: 3408188 - RNA, 22 nt, Human
uacuaguucagacacuuuggaa

SEQ ID NO: 3408189 - RNA, 12 nt, Human
uacuauaguacc

SEQ ID NO: 3408190 - RNA, 16 nt, Human
uacuauaucuguuuua

SEQ ID NO: 3408191 - RNA, 14 nt, Human
uacuauauuuaugg

SEQ ID NO: 3408192 - RNA, 14 nt, Human
uacuauauuugcua

SEQ ID NO: 3408193 - RNA, 15 nt, Human
uacuauauuugcuag

SEQ ID NO: 3408194 - RNA, 17 nt, Human
uacuauccaguuacugc

SEQ ID NO: 3408195 - RNA, 15 nt, Human
uacuaucuacucucc

SEQ ID NO: 3408196 - RNA, 17 nt, Human
uacuaucuuaucucaga

SEQ ID NO: 3408197 - RNA, 14 nt, Human
uacuaugccugugu

SEQ ID NO: 3408198 - RNA, 13 nt, Human
uacuauuaaacau

SEQ ID NO: 3408199 - RNA, 14 nt, Human
uacuauuaaacaug

SEQ ID NO: 3408200 - RNA, 18 nt, Human
uacuauuaaacaugcugu

SEQ ID NO: 3408201 - RNA, 19 nt, Human
uacuauucagguaacacua

SEQ ID NO: 3408202 - RNA, 23 nt, Human
uacuauuguugcugaaacuugcu

SEQ ID NO: 3408203 - RNA, 12 nt, Human
uacuauuuaaag

SEQ ID NO: 3408204 - RNA, 12 nt, Human
uacuauuuaacu

SEQ ID NO: 3408205 - RNA, 21 nt, Human
uacuauuuaagaugugaaaau

SEQ ID NO: 3408206 - RNA, 11 nt, Human
uacuauuucca

SEQ ID NO: 3408207 - RNA, 22 nt, Human
uacuauuucuugugguuauaac

SEQ ID NO: 3408208 - RNA, 14 nt, Human
uacuauuuuacuuc

SEQ ID NO: 3408209 - RNA, 14 nt, Human
uacuauuuuuacug

SEQ ID NO: 3408210 - RNA, 17 nt, Human
uacucaaacuccauucu

SEQ ID NO: 3408211 - RNA, 18 nt, Human
uacucaaaugaguaacau

SEQ ID NO: 3408212 - RNA, 23 nt, Human
uacucaaaugaguaacauuugcu

SEQ ID NO: 3408213 - RNA, 19 nt, Human
uacucaagcggguggcucu

SEQ ID NO: 3408214 - RNA, 23 nt, Human
uacucaauggaguaugucugaug

SEQ ID NO: 3408215 - RNA, 22 nt, Human
uacucaauguuacuaucugcuu

SEQ ID NO: 3408216 - RNA, 14 nt, Human
uacucaauuuuaac

SEQ ID NO: 3408217 - RNA, 21 nt, Human
uacucacacaggcauuuccug

SEQ ID NO: 3408218 - RNA, 15 nt, Human
uacucacagucucuu

SEQ ID NO: 3408219 - RNA, 20 nt, Human
uacucacucaaguucaagga

SEQ ID NO: 3408220 - RNA, 15 nt, Human
uacucacugaagccu

SEQ ID NO: 3408221 - RNA, 20 nt, Human
uacucacuuucuagauuaag

SEQ ID NO: 3408222 - RNA, 16 nt, Human
uacucagaagccugag

SEQ ID NO: 3408223 - RNA, 14 nt, Human
uacucagaauuaag

SEQ ID NO: 3408224 - RNA, 22 nt, Human
uacucagaauucucuaguuuga

SEQ ID NO: 3408225 - RNA, 14 nt, Human
uacucagcagcccu

SEQ ID NO: 3408226 - RNA, 15 nt, Human
uacucagcagcccuc

SEQ ID NO: 3408227 - RNA, 14 nt, Human
uacucagcccuggg

SEQ ID NO: 3408228 - RNA, 22 nt, Human
uacucagcccugggccccacca

SEQ ID NO: 3408229 - RNA, 23 nt, Human
uacucagcccugggccccaccac

SEQ ID NO: 3408230 - RNA, 16 nt, Human
uacucagccugcugcc

SEQ ID NO: 3408231 - RNA, 13 nt, Human
uacucaggaagaa

SEQ ID NO: 3408232 - RNA, 16 nt, Human
uacucagggcuccucc

SEQ ID NO: 3408233 - RNA, 18 nt, Human
uacucagggcuccuccca

SEQ ID NO: 3408234 - RNA, 20 nt, Human
uacucagggcuccucccagc

SEQ ID NO: 3408235 - RNA, 14 nt, Human
uacucauaauguga

SEQ ID NO: 3408236 - RNA, 15 nt, Human
uacucauugaaaugu

SEQ ID NO: 3408237 - RNA, 16 nt, Human
uacucauugaaauguc

SEQ ID NO: 3408238 - RNA, 17 nt, Human
uacucauugaaauguca

SEQ ID NO: 3408239 - RNA, 11 nt, Human
uacucauuucu

SEQ ID NO: 3408240 - RNA, 11 nt, Human
uacucauuuuu

SEQ ID NO: 3408241 - RNA, 14 nt, Human
uacucauuuuucau

SEQ ID NO: 3408242 - RNA, 19 nt, Human
uacuccaaaacuucguuua

SEQ ID NO: 3408243 - RNA, 22 nt, Human
uacuccaaaacuucguuuaaug

SEQ ID NO: 3408244 - RNA, 17 nt, Human
uacuccacacugcacaa

SEQ ID NO: 3408245 - RNA, 12 nt, Human
uacucccaucug

SEQ ID NO: 3408246 - RNA, 14 nt, Human
uacucccaucugug

SEQ ID NO: 3408247 - RNA, 16 nt, Human
uacucccaucugugaa

SEQ ID NO: 3408248 - RNA, 10 nt, Human
uacuccccuu

SEQ ID NO: 3408249 - RNA, 15 nt, Human
uacuccccuugagcu

SEQ ID NO: 3408250 - RNA, 13 nt, Human
uacucccugcaga

SEQ ID NO: 3408251 - RNA, 18 nt, Human
uacucccugcagaugcca

SEQ ID NO: 3408252 - RNA, 13 nt, Human
uacuccuauuuuu

SEQ ID NO: 3408253 - RNA, 20 nt, Human
uacuccuauuuuuguaaacu

SEQ ID NO: 3408254 - RNA, 21 nt, Human
uacuccuauuuuuguaaacug

SEQ ID NO: 3408255 - RNA, 12 nt, Human
uacuccucugca

SEQ ID NO: 3408256 - RNA, 11 nt, Human
uacuccugacu

SEQ ID NO: 3408257 - RNA, 11 nt, Human
uacuccugugg

SEQ ID NO: 3408258 - RNA, 18 nt, Human
uacucgaguuacagacaa

SEQ ID NO: 3408259 - RNA, 22 nt, Human
uacucgggaggcugaggcagga

SEQ ID NO: 3408260 - RNA, 18 nt, Human
uacucuaagaucuuagau

SEQ ID NO: 3408261 - RNA, 14 nt, Human
uacucuaauucuaa

SEQ ID NO: 3408262 - RNA, 15 nt, Human
uacucuaauucuaac

SEQ ID NO: 3408263 - RNA, 16 nt, Human
uacucuaauucuaacc

SEQ ID NO: 3408264 - RNA, 22 nt, Human
uacucuacccucuuagaaaaac

SEQ ID NO: 3408265 - RNA, 15 nt, Human
uacucuagauuuugu

SEQ ID NO: 3408266 - RNA, 20 nt, Human
uacucuauaaccaaaugaaa

SEQ ID NO: 3408267 - RNA, 18 nt, Human
uacucuccaaccuggaca

SEQ ID NO: 3408268 - RNA, 14 nt, Human
uacucuccuagaga

SEQ ID NO: 3408269 - RNA, 19 nt, Human
uacucuccucggcccccuc

SEQ ID NO: 3408270 - RNA, 21 nt, Human
uacucuccuugaguguaugag

SEQ ID NO: 3408271 - RNA, 14 nt, Human
uacucucuucuucu

SEQ ID NO: 3408272 - RNA, 19 nt, Human
uacucugaagggcaucaug

SEQ ID NO: 3408273 - RNA, 20 nt, Human
uacucugccacuuuauuucu

SEQ ID NO: 3408274 - RNA, 11 nt, Human
uacucugggaa

SEQ ID NO: 3408275 - RNA, 13 nt, Human
uacucugggaacu

SEQ ID NO: 3408276 - RNA, 21 nt, Human
uacucuggggugcugccugaa

SEQ ID NO: 3408277 - RNA, 15 nt, Human
uacucugucagaugg

SEQ ID NO: 3408278 - RNA, 19 nt, Human
uacucuguccauuuaucca

SEQ ID NO: 3408279 - RNA, 12 nt, Human
uacucugucucc

SEQ ID NO: 3408280 - RNA, 13 nt, Human
uacucugucuccc

SEQ ID NO: 3408281 - RNA, 15 nt, Human
uacucugugccagag

SEQ ID NO: 3408282 - RNA, 17 nt, Human
uacucugugccagagcc

SEQ ID NO: 3408283 - RNA, 18 nt, Human
uacucugugccagagccu

SEQ ID NO: 3408284 - RNA, 20 nt, Human
uacucugugccagagccugg

SEQ ID NO: 3408285 - RNA, 21 nt, Human
uacucugugccagagccuggg

SEQ ID NO: 3408286 - RNA, 12 nt, Human
uacucuguguca

SEQ ID NO: 3408287 - RNA, 14 nt, Human
uacucuguuccuuc

SEQ ID NO: 3408288 - RNA, 15 nt, Human
uacucuuaagccauc

SEQ ID NO: 3408289 - RNA, 12 nt, Human
uacucuuccgaa

SEQ ID NO: 3408290 - RNA, 16 nt, Human
uacucuucucucugcu

SEQ ID NO: 3408291 - RNA, 17 nt, Human
uacucuucucucugcuc

SEQ ID NO: 3408292 - RNA, 18 nt, Human
uacucuucucucugcucu

SEQ ID NO: 3408293 - RNA, 19 nt, Human
uacucuucucucugcucug

SEQ ID NO: 3408294 - RNA, 17 nt, Human
uacucuucuugaaauuu

SEQ ID NO: 3408295 - RNA, 16 nt, Human
uacucuugguuuuuau

SEQ ID NO: 3408296 - RNA, 20 nt, Human
uacucuuguaagauuuugaa

SEQ ID NO: 3408297 - RNA, 17 nt, Human
uacucuuguugaguucu

SEQ ID NO: 3408298 - RNA, 13 nt, Human
uacucuuucugua

SEQ ID NO: 3408299 - RNA, 16 nt, Human
uacucuuucuguauau

SEQ ID NO: 3408300 - RNA, 14 nt, Human
uacucuuuuuguuu

SEQ ID NO: 3408301 - RNA, 13 nt, Human
uacugaaagccuu

SEQ ID NO: 3408302 - RNA, 19 nt, Human
uacugaaauaaacgucuua

SEQ ID NO: 3408303 - RNA, 20 nt, Human
uacugaacaucugaguccug

SEQ ID NO: 3408304 - RNA, 21 nt, Human
uacugaacaucugaguccugg

SEQ ID NO: 3408305 - RNA, 19 nt, Human
uacugaaccacuuguagau

SEQ ID NO: 3408306 - RNA, 22 nt, Human
uacugaacuguguguaauuguu

SEQ ID NO: 3408307 - RNA, 13 nt, Human
uacugaaggaaaa

SEQ ID NO: 3408308 - RNA, 23 nt, Human
uacugaaggaaaaacacaagcaa

SEQ ID NO: 3408309 - RNA, 16 nt, Human
uacugaaguaaaacaa

SEQ ID NO: 3408310 - RNA, 19 nt, Human
uacugaaugaagcaguauu

SEQ ID NO: 3408311 - RNA, 12 nt, Human
uacugaauuuuu

SEQ ID NO: 3408312 - RNA, 22 nt, Human
uacugacauguggggccagguc

SEQ ID NO: 3408313 - RNA, 19 nt, Human
uacugacccuggggcuggc

SEQ ID NO: 3408314 - RNA, 20 nt, Human
uacugacuccaaccauucaa

SEQ ID NO: 3408315 - RNA, 17 nt, Human
uacugacuuugcuugcu

SEQ ID NO: 3408316 - RNA, 20 nt, Human
uacugacuuugcuugcuuug

SEQ ID NO: 3408317 - RNA, 22 nt, Human
uacugacuuugcuugcuuugaa

SEQ ID NO: 3408318 - RNA, 15 nt, Human
uacugagccuuguaa

SEQ ID NO: 3408319 - RNA, 15 nt, Human
uacugaggugcuaug

SEQ ID NO: 3408320 - RNA, 20 nt, Human
uacugaguauguggaaggca

SEQ ID NO: 3408321 - RNA, 18 nt, Human
uacugauguuccuuugga

SEQ ID NO: 3408322 - RNA, 20 nt, Human
uacugauucaauuugaugug

SEQ ID NO: 3408323 - RNA, 19 nt, Human
uacugauuucaguaagucu

SEQ ID NO: 3408324 - RNA, 13 nt, Human
uacugauuuuugu

SEQ ID NO: 3408325 - RNA, 16 nt, Human
uacugcaaaaagaaaa

SEQ ID NO: 3408326 - RNA, 14 nt, Human
uacugcaagaaaau

SEQ ID NO: 3408327 - RNA, 21 nt, Human
uacugcaagguucaacuuauu

SEQ ID NO: 3408328 - RNA, 16 nt, Human
uacugcacuccagccu

SEQ ID NO: 3408329 - RNA, 18 nt, Human
uacugcacuccagccugg

SEQ ID NO: 3408330 - RNA, 15 nt, Human
uacuuagcagcuauc

SEQ ID NO: 3408331 - RNA, 15 nt, Human
uacuuagcauccuaa

SEQ ID NO: 3408332 - RNA, 17 nt, Human
uacuuaguauugcaaag

SEQ ID NO: 3408333 - RNA, 16 nt, Human
uacuuauauggaaauu

SEQ ID NO: 3408334 - RNA, 17 nt, Human
uacuuauauuuucguau

SEQ ID NO: 3408335 - RNA, 17 nt, Human
uacuuaucccugcccau

SEQ ID NO: 3408336 - RNA, 13 nt, Human
uacuuauuccaga

SEQ ID NO: 3408337 - RNA, 14 nt, Human
uacuuauuuaaaua

SEQ ID NO: 3408338 - RNA, 16 nt, Human
uacuucaaaaguauuu

SEQ ID NO: 3408339 - RNA, 22 nt, Human
uacuucaaaaguuuguuugcuu

SEQ ID NO: 3408340 - RNA, 14 nt, Human
uacuucaaauccuu

SEQ ID NO: 3408341 - RNA, 19 nt, Human
uacuucaaauccuugaaga

SEQ ID NO: 3408342 - RNA, 14 nt, Human
uacuucacugucag

SEQ ID NO: 3408343 - RNA, 22 nt, Human
uacuucacuuuaauucucaugu

SEQ ID NO: 3408344 - RNA, 23 nt, Human
uacuuccaagacuuauuuucaca

SEQ ID NO: 3408345 - RNA, 14 nt, Human
uacuuccaugaauu

SEQ ID NO: 3408346 - RNA, 19 nt, Human
uacuucccgggccagggcu

SEQ ID NO: 3408347 - RNA, 21 nt, Human
uacuucccgggccagggcugc

SEQ ID NO: 3408348 - RNA, 16 nt, Human
uacuuccuccucccca

SEQ ID NO: 3408349 - RNA, 22 nt, Human
uacuuccuuaugcuucuuucaa

SEQ ID NO: 3408350 - RNA, 15 nt, Human
uacuucugcuacaua

SEQ ID NO: 3408351 - RNA, 20 nt, Human
uacuucuguaauugugugga

SEQ ID NO: 3408352 - RNA, 15 nt, Human
uacuucuuauacauu

SEQ ID NO: 3408353 - RNA, 17 nt, Human
uacuucuucuguaauau

SEQ ID NO: 3408354 - RNA, 16 nt, Human
uacuugaaccauaaaa

SEQ ID NO: 3408355 - RNA, 16 nt, Human
uacuugaacguuuucu

SEQ ID NO: 3408356 - RNA, 18 nt, Human
uacuugaacguuuucuaa

SEQ ID NO: 3408357 - RNA, 23 nt, Human
uacuugaacguuuucuaauugcu

SEQ ID NO: 3408358 - RNA, 11 nt, Human
uacuugaacuu

SEQ ID NO: 3408359 - RNA, 17 nt, Human
uacuugaacuugccucu

SEQ ID NO: 3408360 - RNA, 12 nt, Human
uacuugaagggc

SEQ ID NO: 3408361 - RNA, 17 nt, Human
uacuugaagggccagag

SEQ ID NO: 3408362 - RNA, 18 nt, Human
uacuugaagggccagagc

SEQ ID NO: 3408363 - RNA, 20 nt, Human
uacuugaagggccagagcca

SEQ ID NO: 3408364 - RNA, 21 nt, Human
uacuugaagggccagagccag

SEQ ID NO: 3408365 - RNA, 15 nt, Human
uacuugaauaguauu

SEQ ID NO: 3408366 - RNA, 12 nt, Human
uacuugaaugaa

SEQ ID NO: 3408367 - RNA, 14 nt, Human
uacuugaaugaaaa

SEQ ID NO: 3408368 - RNA, 18 nt, Human
uacuugaguguaauguuu

SEQ ID NO: 3408369 - RNA, 22 nt, Human
uacuugaugaguguaacaagaa

SEQ ID NO: 3408370 - RNA, 16 nt, Human
uacuugcacucuucua

SEQ ID NO: 3408371 - RNA, 15 nt, Human
uacuugccagaaguu

SEQ ID NO: 3408372 - RNA, 14 nt, Human
uacuugcucuggac

SEQ ID NO: 3408373 - RNA, 19 nt, Human
uacuugcucuugaugccug

SEQ ID NO: 3408374 - RNA, 15 nt, Human
uacuugcugcuauuu

SEQ ID NO: 3408375 - RNA, 23 nt, Human
uacuugcuuuaccuuuucagggc

SEQ ID NO: 3408376 - RNA, 17 nt, Human
uacuuggaaauauuaaa

SEQ ID NO: 3408377 - RNA, 14 nt, Human
uacuuggauuuagu

SEQ ID NO: 3408378 - RNA, 19 nt, Human
uacuugggaagcugaggcg

SEQ ID NO: 3408379 - RNA, 15 nt, Human
uacuuggucacagcc

SEQ ID NO: 3408380 - RNA, 19 nt, Human
uacuuggucacagccaggc

SEQ ID NO: 3408381 - RNA, 13 nt, Human
uacuugguuugug

SEQ ID NO: 3408382 - RNA, 14 nt, Human
uacuugguuugugu

SEQ ID NO: 3408383 - RNA, 20 nt, Human
uacuugguuuguguucuucu

SEQ ID NO: 3408384 - RNA, 20 nt, Human
uacuuguaaauauaaagacg

SEQ ID NO: 3408385 - RNA, 14 nt, Human
uacuuguaauuaug

SEQ ID NO: 3408386 - RNA, 11 nt, Human
uacuugucaau

SEQ ID NO: 3408387 - RNA, 20 nt, Human
uacuugugaaacacagcugu

SEQ ID NO: 3408388 - RNA, 13 nt, Human
uacuuguggacac

SEQ ID NO: 3408389 - RNA, 18 nt, Human
uacuuguggacacagcuc

SEQ ID NO: 3408390 - RNA, 19 nt, Human
uacuuguggacacagcucu

SEQ ID NO: 3408391 - RNA, 16 nt, Human
uacuuguggacuaaaa

SEQ ID NO: 3408392 - RNA, 20 nt, Human
uacuuguggacuaaaagaua

SEQ ID NO: 3408393 - RNA, 17 nt, Human
uacuugugguuuucaaa

SEQ ID NO: 3408394 - RNA, 13 nt, Human
uacuuguucaaaa

SEQ ID NO: 3408395 - RNA, 13 nt, Human
uacuuguuguuua

SEQ ID NO: 3408396 - RNA, 14 nt, Human
uacuuguuucagag

SEQ ID NO: 3408397 - RNA, 13 nt, Human
uacuuguuucuau

SEQ ID NO: 3408398 - RNA, 12 nt, Human
uacuuuaaacua

SEQ ID NO: 3408399 - RNA, 13 nt, Human
uacuuuaacaugc

SEQ ID NO: 3408400 - RNA, 21 nt, Human
uacuuuaacuuaguuuugcau

SEQ ID NO: 3408401 - RNA, 23 nt, Human
uacuuuaacuuaguuuugcauag

SEQ ID NO: 3408402 - RNA, 22 nt, Human
uacuuuaagcacuacauaaacu

SEQ ID NO: 3408403 - RNA, 17 nt, Human
uacuuuacauaugcuuu

SEQ ID NO: 3408404 - RNA, 18 nt, Human
uacuuuaccucucuguca

SEQ ID NO: 3408405 - RNA, 22 nt, Human
uacuuuaccucucugucaugug

SEQ ID NO: 3408406 - RNA, 15 nt, Human
uacuuuacugccuga

SEQ ID NO: 3408407 - RNA, 17 nt, Human
uacuuuagaagccugca

SEQ ID NO: 3408408 - RNA, 21 nt, Human
uacuuuagaagccugcauaau

SEQ ID NO: 3408409 - RNA, 21 nt, Human
uacuuuagauggcaagcaugu

SEQ ID NO: 3408410 - RNA, 20 nt, Human
uacuuuauaacuaacauguc

SEQ ID NO: 3408411 - RNA, 23 nt, Human
uacuuuauaacuaacauguccug

SEQ ID NO: 3408412 - RNA, 14 nt, Human
uacuuuaucacuuu

SEQ ID NO: 3408413 - RNA, 18 nt, Human
uacuuuaucacuuuuuga

SEQ ID NO: 3408414 - RNA, 21 nt, Human
uacuuuaucaugaaugcuuuu

SEQ ID NO: 3408415 - RNA, 20 nt, Human
uacuuuauuuauacacuguc

SEQ ID NO: 3408416 - RNA, 15 nt, Human
uacuuucccuugcuu

SEQ ID NO: 3408417 - RNA, 17 nt, Human
uacuuucguacauuggc

SEQ ID NO: 3408418 - RNA, 12 nt, Human
uacuuucuguua

SEQ ID NO: 3408419 - RNA, 18 nt, Human
uacuuugaagucauacca

SEQ ID NO: 3408420 - RNA, 14 nt, Human
uacuuugauucaca

SEQ ID NO: 3408421 - RNA, 17 nt, Human
uacuuugauucacaugu

SEQ ID NO: 3408422 - RNA, 21 nt, Human
uacuuugauucacauguuuuc

SEQ ID NO: 3408423 - RNA, 12 nt, Human
uacuuugcauug

SEQ ID NO: 3408424 - RNA, 20 nt, Human
uacuuugccuuuugcaaacu

SEQ ID NO: 3408425 - RNA, 18 nt, Human
uacuuugguuucugagca

SEQ ID NO: 3408426 - RNA, 23 nt, Human
uacuuuguaaauaggauuuuuag

SEQ ID NO: 3408427 - RNA, 22 nt, Human
uacuuuguaagugagagagaca

SEQ ID NO: 3408428 - RNA, 18 nt, Human
uacuuuguauuguccuau

SEQ ID NO: 3408429 - RNA, 20 nt, Human
uacuuuguccuuuuuguuau

SEQ ID NO: 3408430 - RNA, 17 nt, Human
uacuuugucuaagaaac

SEQ ID NO: 3408431 - RNA, 20 nt, Human
uacuuugucuaagaaacauu

SEQ ID NO: 3408432 - RNA, 16 nt, Human
uacuuugugcuggggu

SEQ ID NO: 3408433 - RNA, 21 nt, Human
uacuuuguggaccaauuauug

SEQ ID NO: 3408434 - RNA, 22 nt, Human
uacuuuguggaccaauuauuga

SEQ ID NO: 3408435 - RNA, 14 nt, Human
uacuuuuaaaaaca

SEQ ID NO: 3408436 - RNA, 15 nt, Human
uacuuuuaaaaacau

SEQ ID NO: 3408437 - RNA, 21 nt, Human
uacuuuuaaacuguguacaua

SEQ ID NO: 3408438 - RNA, 22 nt, Human
uacuuuuaaagaauuucuuuau

SEQ ID NO: 3408439 - RNA, 23 nt, Human
uacuuuuacaaguaacaaaaaua

SEQ ID NO: 3408440 - RNA, 19 nt, Human
uacuuuuauuugcaacauu

SEQ ID NO: 3408441 - RNA, 21 nt, Human
uacuuuuauuugcaacauuua

SEQ ID NO: 3408442 - RNA, 11 nt, Human
uacuuuuccuu

SEQ ID NO: 3408443 - RNA, 13 nt, Human
uacuuuuccuucc

SEQ ID NO: 3408444 - RNA, 22 nt, Human
uacuuuuccuugcauacaaaca

SEQ ID NO: 3408445 - RNA, 21 nt, Human
uacuuuucuucuauugccucu

SEQ ID NO: 3408446 - RNA, 14 nt, Human
uacuuuugagugug

SEQ ID NO: 3408447 - RNA, 17 nt, Human
uacuuuugagugugugu

SEQ ID NO: 3408448 - RNA, 15 nt, Human
uacuuuugcccuuug

SEQ ID NO: 3408449 - RNA, 13 nt, Human
uacuuuuggaauc

SEQ ID NO: 3408450 - RNA, 14 nt, Human
uacuuuuggaaucu

SEQ ID NO: 3408451 - RNA, 19 nt, Human
uacuuuuuaguaauuucuu

SEQ ID NO: 3408452 - RNA, 16 nt, Human
uacuuuuuauauauau

SEQ ID NO: 3408453 - RNA, 14 nt, Human
uacuuuuuggcaua

SEQ ID NO: 3408454 - RNA, 13 nt, Human
uacuuuuugugaa

SEQ ID NO: 3408455 - RNA, 13 nt, Human
uacuuuuuuaaau

SEQ ID NO: 3408456 - RNA, 20 nt, Human
uacuuuuuuaaauauuuucu

SEQ ID NO: 3408457 - RNA, 22 nt, Human
uacuuuuuuaaauauuuucuau

SEQ ID NO: 3408458 - RNA, 23 nt, Human
uacuuuuuuaaauauuuucuauu

SEQ ID NO: 3408459 - RNA, 18 nt, Human
uacuuuuuucuuauuuaa

SEQ ID NO: 3408460 - RNA, 14 nt, Human
uacuuuuuuucaca

SEQ ID NO: 3408461 - RNA, 21 nt, Human
uacuuuuuuuuuuuuuuggua

SEQ ID NO: 3408462 - RNA, 14 nt, Human
uagaaaaacaggca

SEQ ID NO: 3408463 - RNA, 19 nt, Human
uagaaaaagaacaugcagu

SEQ ID NO: 3408464 - RNA, 21 nt, Human
uagaaaaagaacaugcaguuu

SEQ ID NO: 3408465 - RNA, 23 nt, Human
uagaaaaagaacaugcaguuuga

SEQ ID NO: 3408466 - RNA, 13 nt, Human
uagaaaaagcagu

SEQ ID NO: 3408467 - RNA, 20 nt, Human
uagaaaacaaugcaaaaccu

SEQ ID NO: 3408468 - RNA, 23 nt, Human
uagaaaacaggaaaaaaacuuuu

SEQ ID NO: 3408469 - RNA, 20 nt, Human
uagaaaacugaaaaucuaau

SEQ ID NO: 3408470 - RNA, 21 nt, Human
uagaaaacugaaaaucuaaua

SEQ ID NO: 3408471 - RNA, 11 nt, Human
uagaaaacuuu

SEQ ID NO: 3408472 - RNA, 20 nt, Human
uagaaaagcugaucauaagu

SEQ ID NO: 3408473 - RNA, 18 nt, Human
uagaaaagugaauugaag

SEQ ID NO: 3408474 - RNA, 16 nt, Human
uauaagauuagaauga

SEQ ID NO: 3408475 - RNA, 19 nt, Human
uauaagcaaauugcuuuuu

SEQ ID NO: 3408476 - RNA, 23 nt, Human
uauaagcaaauuucaaaagacau

SEQ ID NO: 3408477 - RNA, 22 nt, Human
uauaagcaagaaggcaaaaaua

SEQ ID NO: 3408478 - RNA, 16 nt, Human
uauaagcaucauuauu

SEQ ID NO: 3408479 - RNA, 19 nt, Human
uauaagccaaaauuaaggu

SEQ ID NO: 3408480 - RNA, 22 nt, Human
uauaagccaaaauuaagguguu

SEQ ID NO: 3408481 - RNA, 14 nt, Human
uauaagcuuuucuu

SEQ ID NO: 3408482 - RNA, 14 nt, Human
uauaaggaagauuu

SEQ ID NO: 3408483 - RNA, 15 nt, Human
uauaaggacugcaug

SEQ ID NO: 3408484 - RNA, 21 nt, Human
uauaaggugcucucuuucugu

SEQ ID NO: 3408485 - RNA, 22 nt, Human
uauaaggugcucucuuucuguc

SEQ ID NO: 3408486 - RNA, 20 nt, Human
uauaagguguuuucugugua

SEQ ID NO: 3408487 - RNA, 22 nt, Human
uauaagguguuuucuguguaac

SEQ ID NO: 3408488 - RNA, 17 nt, Human
uauaagguuuaaaaaga

SEQ ID NO: 3408489 - RNA, 15 nt, Human
uauaagguuuuaagu

SEQ ID NO: 3408490 - RNA, 15 nt, Human
uauaagugaagugau

SEQ ID NO: 3408491 - RNA, 21 nt, Human
uauaagugcacacagaaauau

SEQ ID NO: 3408492 - RNA, 22 nt, Human
uauaagugcacacagaaauaua

SEQ ID NO: 3408493 - RNA, 21 nt, Human
uauaagugcuguauaaaauca

SEQ ID NO: 3408494 - RNA, 18 nt, Human
uauaaguggaggcacuuu

SEQ ID NO: 3408495 - RNA, 19 nt, Human
uauaaguggaggcacuuua

SEQ ID NO: 3408496 - RNA, 23 nt, Human
uauaaguguguguuuuucauaaa

SEQ ID NO: 3408497 - RNA, 19 nt, Human
uauaaguuauuuuuguaca

SEQ ID NO: 3408498 - RNA, 20 nt, Human
uauaaguuauuuuuguacau

SEQ ID NO: 3408499 - RNA, 21 nt, Human
uauaaguuauuuuuguacaug

SEQ ID NO: 3408500 - RNA, 12 nt, Human
uauaaguuucuu

SEQ ID NO: 3408501 - RNA, 13 nt, Human
uauaaguuugaag

SEQ ID NO: 3408502 - RNA, 18 nt, Human
uauaauaaaaauauauuu

SEQ ID NO: 3408503 - RNA, 21 nt, Human
uauaauaaaaggaaaagcaaa

SEQ ID NO: 3408504 - RNA, 20 nt, Human
uauaauaaaauguguugaaa

SEQ ID NO: 3408505 - RNA, 14 nt, Human
uauaauaaacauaa

SEQ ID NO: 3408506 - RNA, 16 nt, Human
uauaauacacaaaauc

SEQ ID NO: 3408507 - RNA, 18 nt, Human
uauaauacacaaaaucaa

SEQ ID NO: 3408508 - RNA, 23 nt, Human
uauaauacacaaaaucaaauaau

SEQ ID NO: 3408509 - RNA, 20 nt, Human
uauaauacagaaucuuguuu

SEQ ID NO: 3408510 - RNA, 17 nt, Human
uauaauacucuguugua

SEQ ID NO: 3408511 - RNA, 15 nt, Human
uauaauacuuuguau

SEQ ID NO: 3408512 - RNA, 22 nt, Human
uauaauacuuuguauacaagua

SEQ ID NO: 3408513 - RNA, 22 nt, Human
uauaauauaaaaaauuuuaaaa

SEQ ID NO: 3408514 - RNA, 22 nt, Human
uauaauauauuuguguauuuaa

SEQ ID NO: 3408515 - RNA, 16 nt, Human
uauaaucaccagggcc

SEQ ID NO: 3408516 - RNA, 14 nt, Human
uauaaucagaaugg

SEQ ID NO: 3408517 - RNA, 15 nt, Human
uauaaucucuucuua

SEQ ID NO: 3408518 - RNA, 17 nt, Human
uauaaugaacaaaauua

SEQ ID NO: 3408519 - RNA, 14 nt, Human
uauaaugaagcuuu

SEQ ID NO: 3408520 - RNA, 23 nt, Human
uauaaugaagcuuuauacgugua

SEQ ID NO: 3408521 - RNA, 11 nt, Human
uauaaugaaug

SEQ ID NO: 3408522 - RNA, 20 nt, Human
uauaaugaaugaaacauuuu

SEQ ID NO: 3408523 - RNA, 18 nt, Human
uauaaugaaugagagaau

SEQ ID NO: 3408524 - RNA, 13 nt, Human
uauaaugauuauu

SEQ ID NO: 3408525 - RNA, 17 nt, Human
uauaauggaagagaaau

SEQ ID NO: 3408526 - RNA, 21 nt, Human
uauaauggaagagaaaucuca

SEQ ID NO: 3408527 - RNA, 16 nt, Human
uauaauggaguuaacg

SEQ ID NO: 3408528 - RNA, 17 nt, Human
uauaaugguuucaaaga

SEQ ID NO: 3408529 - RNA, 18 nt, Human
uauaauguauucauauuu

SEQ ID NO: 3408530 - RNA, 19 nt, Human
uauaauguauucauauuug

SEQ ID NO: 3408531 - RNA, 13 nt, Human
uauaaugugugua

SEQ ID NO: 3408532 - RNA, 15 nt, Human
uauaauguguguaug

SEQ ID NO: 3408533 - RNA, 19 nt, Human
uauaauguguguaugugua

SEQ ID NO: 3408534 - RNA, 22 nt, Human
uauaauguguguauguguauuu

SEQ ID NO: 3408535 - RNA, 17 nt, Human
uauaauguuguuauuua

SEQ ID NO: 3408536 - RNA, 19 nt, Human
uauaauguuguuauuuaaa

SEQ ID NO: 3408537 - RNA, 17 nt, Human
uauaauguuuauuaaau

SEQ ID NO: 3408538 - RNA, 13 nt, Human
uauaauuaacaug

SEQ ID NO: 3408539 - RNA, 15 nt, Human
uauaauuaacauguu

SEQ ID NO: 3408540 - RNA, 18 nt, Human
uauaauuaacauguuaaa

SEQ ID NO: 3408541 - RNA, 17 nt, Human
uauaauuauauguugua

SEQ ID NO: 3408542 - RNA, 19 nt, Human
uauaauuauauguuguaag

SEQ ID NO: 3408543 - RNA, 19 nt, Human
uauaauuaucggaagcagu

SEQ ID NO: 3408544 - RNA, 16 nt, Human
uauaauucaguauguu

SEQ ID NO: 3408545 - RNA, 14 nt, Human
uauaauucuguaaa

SEQ ID NO: 3408546 - RNA, 13 nt, Human
uauaauucuguac

SEQ ID NO: 3408547 - RNA, 14 nt, Human
uauaauucuguaca

SEQ ID NO: 3408548 - RNA, 15 nt, Human
uauaauucuguacau

SEQ ID NO: 3408549 - RNA, 22 nt, Human
uauaauucuguacauagccuau

SEQ ID NO: 3408550 - RNA, 18 nt, Human
uauaauucuguacugauu

SEQ ID NO: 3408551 - RNA, 17 nt, Human
uauaauuggauuuccua

SEQ ID NO: 3408552 - RNA, 19 nt, Human
uauaauuggauuuccuaau

SEQ ID NO: 3408553 - RNA, 20 nt, Human
uauaauuggauuuccuaaua

SEQ ID NO: 3408554 - RNA, 13 nt, Human
uauaauuguacaa

SEQ ID NO: 3408555 - RNA, 14 nt, Human
uauaauuguacaaa

SEQ ID NO: 3408556 - RNA, 16 nt, Human
uauaauuguacaaaau

SEQ ID NO: 3408557 - RNA, 13 nt, Human
uauaauuguaucg

SEQ ID NO: 3408558 - RNA, 14 nt, Human
uauaauuguaucgu

SEQ ID NO: 3408559 - RNA, 23 nt, Human
uauaauugugugauauuucagaa

SEQ ID NO: 3408560 - RNA, 21 nt, Human
uauaauuguucucagaauccc

SEQ ID NO: 3408561 - RNA, 14 nt, Human
uauaauuguugcau

SEQ ID NO: 3408562 - RNA, 18 nt, Human
uauaauuguuuuuuaucu

SEQ ID NO: 3408563 - RNA, 15 nt, Human
uauaauuuaacuuca

SEQ ID NO: 3408564 - RNA, 17 nt, Human
uauaauuuaccuaagau

SEQ ID NO: 3408565 - RNA, 20 nt, Human
uauaauuuaccuaagauuac

SEQ ID NO: 3408566 - RNA, 21 nt, Human
uauaauuucgagauuuguagg

SEQ ID NO: 3408567 - RNA, 20 nt, Human
uauaauuuuaagauuccuuu

SEQ ID NO: 3408568 - RNA, 17 nt, Human
uauaauuuuaugaaugu

SEQ ID NO: 3408569 - RNA, 14 nt, Human
uauaauuuugauag

SEQ ID NO: 3408570 - RNA, 15 nt, Human
uauaauuuuuuaaag

SEQ ID NO: 3408571 - RNA, 18 nt, Human
uauaauuuuuuucaauau

SEQ ID NO: 3408572 - RNA, 21 nt, Human
uauacaaaauaagaacgagga

SEQ ID NO: 3408573 - RNA, 13 nt, Human
uauacaaauuaga

SEQ ID NO: 3408574 - RNA, 17 nt, Human
uauacaaauuagaaaau

SEQ ID NO: 3408575 - RNA, 23 nt, Human
uauacaacaccaaaaaauaucua

SEQ ID NO: 3408576 - RNA, 21 nt, Human
uauacaacagugcuaaaaaug

SEQ ID NO: 3408577 - RNA, 15 nt, Human
uauacaauaacauaa

SEQ ID NO: 3408578 - RNA, 13 nt, Human
uauacaauaaugg

SEQ ID NO: 3408579 - RNA, 18 nt, Human
uauacaauauauaaaaau

SEQ ID NO: 3408580 - RNA, 19 nt, Human
uauacaauauauaaaaaua

SEQ ID NO: 3408581 - RNA, 12 nt, Human
uauacacugugu

SEQ ID NO: 3408582 - RNA, 22 nt, Human
uauacagaauugugucugcagg

SEQ ID NO: 3408583 - RNA, 20 nt, Human
uauacagaggaaaucuguaa

SEQ ID NO: 3408584 - RNA, 14 nt, Human
uauacagaugaaaa

SEQ ID NO: 3408585 - RNA, 19 nt, Human
uauacagaugaaaauuuga

SEQ ID NO: 3408586 - RNA, 21 nt, Human
uauacagaugaaaauuugaga

SEQ ID NO: 3408587 - RNA, 19 nt, Human
uauacaggggaauauuuua

SEQ ID NO: 3408588 - RNA, 23 nt, Human
uauacaggggaauauuuuauuca

SEQ ID NO: 3408589 - RNA, 18 nt, Human
uauacaguaacuuuaugu

SEQ ID NO: 3408590 - RNA, 19 nt, Human
uauacaguaacuuuaugug

SEQ ID NO: 3408591 - RNA, 22 nt, Human
uauacaguagugagaagaauau

SEQ ID NO: 3408592 - RNA, 16 nt, Human
uauacaguuauaaaau

SEQ ID NO: 3408593 - RNA, 18 nt, Human
uauacaguuauaaaauua

SEQ ID NO: 3408594 - RNA, 20 nt, Human
uauacaguucaauaaacuua

SEQ ID NO: 3408595 - RNA, 19 nt, Human
uauacaguuuuaaagaauc

SEQ ID NO: 3408596 - RNA, 19 nt, Human
uauacauacuuacaugugu

SEQ ID NO: 3408597 - RNA, 22 nt, Human
uauacauagcaugacauuucuu

SEQ ID NO: 3408598 - RNA, 18 nt, Human
uauacauaucuuuauuaa

SEQ ID NO: 3408599 - RNA, 13 nt, Human
uauacauauguag

SEQ ID NO: 3408600 - RNA, 16 nt, Human
uauacauauguagacu

SEQ ID NO: 3408601 - RNA, 16 nt, Human
uauacaucacguuaaa

SEQ ID NO: 3408602 - RNA, 16 nt, Human
uauacauccuggguaa

SEQ ID NO: 3408603 - RNA, 15 nt, Human
uauacaugaaaauuu

SEQ ID NO: 3408604 - RNA, 15 nt, Human
uauacaugaaauuca

SEQ ID NO: 3408605 - RNA, 12 nt, Human
uauacaugugug

SEQ ID NO: 3408606 - RNA, 18 nt, Human
uauacauguguguauaua

SEQ ID NO: 3408607 - RNA, 20 nt, Human
uauacauguguguauauaug

SEQ ID NO: 3408608 - RNA, 18 nt, Human
uauacauguuuaguauua

SEQ ID NO: 3408609 - RNA, 17 nt, Human
uauacauucuuuaucuu

SEQ ID NO: 3408610 - RNA, 22 nt, Human
uauacauucuuuaucuugacau

SEQ ID NO: 3408611 - RNA, 15 nt, Human
uauaccaaaauguug

SEQ ID NO: 3408612 - RNA, 17 nt, Human
uauaccagcaauauauc

SEQ ID NO: 3408613 - RNA, 18 nt, Human
uauaccauuuccucagcu

SEQ ID NO: 3408614 - RNA, 23 nt, Human
uauacccaugaacuuaaaaugaa

SEQ ID NO: 3408615 - RNA, 15 nt, Human
uauaccuauaaugug

SEQ ID NO: 3408616 - RNA, 19 nt, Human
uauaccuauaaugugugua

SEQ ID NO: 3408617 - RNA, 12 nt, Human
uauaccucacuu

SEQ ID NO: 3408618 - RNA, 20 nt, Human
uauauguucuaauuaauaaa

SEQ ID NO: 3408619 - RNA, 19 nt, Human
uauauguuuuaagaggcag

SEQ ID NO: 3408620 - RNA, 13 nt, Human
uauauuaaaaaua

SEQ ID NO: 3408621 - RNA, 17 nt, Human
uauauuaaaaauauaaa

SEQ ID NO: 3408622 - RNA, 18 nt, Human
uauauuaaaaauauaaaa

SEQ ID NO: 3408623 - RNA, 14 nt, Human
uauauuaaaaaugg

SEQ ID NO: 3408624 - RNA, 16 nt, Human
uauauuaaaaauggua

SEQ ID NO: 3408625 - RNA, 14 nt, Human
uauauuaagcagaa

SEQ ID NO: 3408626 - RNA, 11 nt, Human
uauauuacaag

SEQ ID NO: 3408627 - RNA, 17 nt, Human
uauauuacaaugaucac

SEQ ID NO: 3408628 - RNA, 21 nt, Human
uauauuacacauuuguacaga

SEQ ID NO: 3408629 - RNA, 23 nt, Human
uauauuacugacauuucuucuag

SEQ ID NO: 3408630 - RNA, 22 nt, Human
uauauuagaucaaauaguugca

SEQ ID NO: 3408631 - RNA, 16 nt, Human
uauauuagcauuuagu

SEQ ID NO: 3408632 - RNA, 23 nt, Human
uauauuagcauuuaguccaaugu

SEQ ID NO: 3408633 - RNA, 14 nt, Human
uauauuauaaauau

SEQ ID NO: 3408634 - RNA, 17 nt, Human
uauauuauacuuguaau

SEQ ID NO: 3408635 - RNA, 14 nt, Human
uauauuauauggaa

SEQ ID NO: 3408636 - RNA, 14 nt, Human
uauauuaucaugca

SEQ ID NO: 3408637 - RNA, 12 nt, Human
uauauuauuacu

SEQ ID NO: 3408638 - RNA, 12 nt, Human
uauauuauuaua

SEQ ID NO: 3408639 - RNA, 16 nt, Human
uauauuauuucuagga

SEQ ID NO: 3408640 - RNA, 22 nt, Human
uauauuauuucuaggaagaauu

SEQ ID NO: 3408641 - RNA, 14 nt, Human
uauauuauuuggca

SEQ ID NO: 3408642 - RNA, 22 nt, Human
uauauuauuuggcaguuuggua

SEQ ID NO: 3408643 - RNA, 13 nt, Human
uauauucaaccau

SEQ ID NO: 3408644 - RNA, 19 nt, Human
uauauucauucuuuuugaa

SEQ ID NO: 3408645 - RNA, 18 nt, Human
uauauuccagguuuaagu

SEQ ID NO: 3408646 - RNA, 15 nt, Human
uauauuccuaaacua

SEQ ID NO: 3408647 - RNA, 13 nt, Human
uauauucucuuug

SEQ ID NO: 3408648 - RNA, 12 nt, Human
uauauucuuuca

SEQ ID NO: 3408649 - RNA, 13 nt, Human
uauauugaacuuu

SEQ ID NO: 3408650 - RNA, 14 nt, Human
uauauugagacaaa

SEQ ID NO: 3408651 - RNA, 19 nt, Human
uauauugcacaauuauaaa

SEQ ID NO: 3408652 - RNA, 17 nt, Human
uauauugguaacauccu

SEQ ID NO: 3408653 - RNA, 19 nt, Human
uauauugguaacauccuuu

SEQ ID NO: 3408654 - RNA, 16 nt, Human
uauauugguuuuauga

SEQ ID NO: 3408655 - RNA, 14 nt, Human
uauauuguaauuua

SEQ ID NO: 3408656 - RNA, 19 nt, Human
uauauugucagauauuuuu

SEQ ID NO: 3408657 - RNA, 15 nt, Human
uauauuguugaagag

SEQ ID NO: 3408658 - RNA, 15 nt, Human
uauauuguuugcuaa

SEQ ID NO: 3408659 - RNA, 14 nt, Human
uauauuuaaaagaa

SEQ ID NO: 3408660 - RNA, 18 nt, Human
uauauuuaaaagugucaa

SEQ ID NO: 3408661 - RNA, 13 nt, Human
uauauuuaaacuc

SEQ ID NO: 3408662 - RNA, 19 nt, Human
uauauuuaaagggaaauug

SEQ ID NO: 3408663 - RNA, 18 nt, Human
uauauuuaaguauucaag

SEQ ID NO: 3408664 - RNA, 16 nt, Human
uauauuuaaugcauua

SEQ ID NO: 3408665 - RNA, 14 nt, Human
uauauuuauaacuc

SEQ ID NO: 3408666 - RNA, 21 nt, Human
uauauuuauaacucaucauaa

SEQ ID NO: 3408667 - RNA, 16 nt, Human
uauauuuauacuguau

SEQ ID NO: 3408668 - RNA, 20 nt, Human
uauauuuauuacuguaagaa

SEQ ID NO: 3408669 - RNA, 23 nt, Human
uauauuuauuacuguaagaaaau

SEQ ID NO: 3408670 - RNA, 21 nt, Human
uauauuuauugacucuugagu

SEQ ID NO: 3408671 - RNA, 12 nt, Human
uauauuuauuua

SEQ ID NO: 3408672 - RNA, 12 nt, Human
uauauuucaagu

SEQ ID NO: 3408673 - RNA, 16 nt, Human
uauauuuccacuucuu

SEQ ID NO: 3408674 - RNA, 20 nt, Human
uauauuucccuaaaauacau

SEQ ID NO: 3408675 - RNA, 22 nt, Human
uauauuuccuuuaugugaauuu

SEQ ID NO: 3408676 - RNA, 16 nt, Human
uauauuucuaaauguu

SEQ ID NO: 3408677 - RNA, 13 nt, Human
uauauuucuauua

SEQ ID NO: 3408678 - RNA, 14 nt, Human
uauauuucuuuguu

SEQ ID NO: 3408679 - RNA, 14 nt, Human
uauauuugaaauau

SEQ ID NO: 3408680 - RNA, 16 nt, Human
uauauuugauuuauua

SEQ ID NO: 3408681 - RNA, 23 nt, Human
uauauuuggaugcagaguucagg

SEQ ID NO: 3408682 - RNA, 15 nt, Human
uauauuuguaaagcu

SEQ ID NO: 3408683 - RNA, 13 nt, Human
uauauuuguagga

SEQ ID NO: 3408684 - RNA, 13 nt, Human
uauauuuguaucg

SEQ ID NO: 3408685 - RNA, 21 nt, Human
uauauuugugauagcacuuuc

SEQ ID NO: 3408686 - RNA, 23 nt, Human
uauauuugugauagcacuuucua

SEQ ID NO: 3408687 - RNA, 20 nt, Human
uauauuugugcuauaguauu

SEQ ID NO: 3408688 - RNA, 21 nt, Human
uauauuugugcuauaguauuu

SEQ ID NO: 3408689 - RNA, 22 nt, Human
uauauuugugcuauaguauuug

SEQ ID NO: 3408690 - RNA, 16 nt, Human
uauauuuguguauuua

SEQ ID NO: 3408691 - RNA, 20 nt, Human
uauauuuguguauuuaacag

SEQ ID NO: 3408692 - RNA, 14 nt, Human
uauauuuuaagacg

SEQ ID NO: 3408693 - RNA, 16 nt, Human
uauauuuuacaauuuu

SEQ ID NO: 3408694 - RNA, 21 nt, Human
uauauuuuauacauuaacuuc

SEQ ID NO: 3408695 - RNA, 15 nt, Human
uauauuuuauauuac

SEQ ID NO: 3408696 - RNA, 21 nt, Human
uauauuuucaauucaaaaaug

SEQ ID NO: 3408697 - RNA, 16 nt, Human
uauauuuucauucucc

SEQ ID NO: 3408698 - RNA, 15 nt, Human
uauauuuucuuucuc

SEQ ID NO: 3408699 - RNA, 14 nt, Human
uauauuuugccugu

SEQ ID NO: 3408700 - RNA, 12 nt, Human
uauauuuuggga

SEQ ID NO: 3408701 - RNA, 15 nt, Human
uauauuuuguaugca

SEQ ID NO: 3408702 - RNA, 13 nt, Human
uauauuuugucau

SEQ ID NO: 3408703 - RNA, 14 nt, Human
uauauuuugucaua

SEQ ID NO: 3408704 - RNA, 16 nt, Human
uauauuuugugugaaa

SEQ ID NO: 3408705 - RNA, 18 nt, Human
uauauuuugugugaaauu

SEQ ID NO: 3408706 - RNA, 17 nt, Human
uauauuuuguuuacaaa

SEQ ID NO: 3408707 - RNA, 21 nt, Human
uauauuuuuaaaaaaugaaau

SEQ ID NO: 3408708 - RNA, 20 nt, Human
uauauuuuuaagauaauaau

SEQ ID NO: 3408709 - RNA, 20 nt, Human
uauauuuuuauauuuaguua

SEQ ID NO: 3408710 - RNA, 22 nt, Human
uauauuuuuaucuauauaaaau

SEQ ID NO: 3408711 - RNA, 15 nt, Human
uauauuuuucacagu

SEQ ID NO: 3408712 - RNA, 17 nt, Human
uauauuuuucuuaaaaa

SEQ ID NO: 3408713 - RNA, 20 nt, Human
uauauuuuucuuaaaaagua

SEQ ID NO: 3408714 - RNA, 15 nt, Human
uauauuuuuguuugu

SEQ ID NO: 3408715 - RNA, 20 nt, Human
uauauuuuuguuuguuuugu

SEQ ID NO: 3408716 - RNA, 18 nt, Human
uauauuuuuuaaaauaag

SEQ ID NO: 3408717 - RNA, 19 nt, Human
uauauuuuuuaauuugaug

SEQ ID NO: 3408718 - RNA, 21 nt, Human
uauauuuuuuguuaaaugauu

SEQ ID NO: 3408719 - RNA, 16 nt, Human
uauauuuuuuucugaa

SEQ ID NO: 3408720 - RNA, 21 nt, Human
uaucaaaauaaauugaaauau

SEQ ID NO: 3408721 - RNA, 19 nt, Human
uaucaaacaccaacauaaa

SEQ ID NO: 3408722 - RNA, 20 nt, Human
uaucaaacagaauuuuaaag

SEQ ID NO: 3408723 - RNA, 18 nt, Human
uaucaaacagcucaggcu

SEQ ID NO: 3408724 - RNA, 19 nt, Human
uaucaaacccuagccuugc

SEQ ID NO: 3408725 - RNA, 21 nt, Human
uaucaaacccuagccuugcuu

SEQ ID NO: 3408726 - RNA, 21 nt, Human
uaucaaacuucagcuguacuu

SEQ ID NO: 3408727 - RNA, 22 nt, Human
uaucaaagggugaaaauuauuu

SEQ ID NO: 3408728 - RNA, 19 nt, Human
uaucaaaugcaguauauuu

SEQ ID NO: 3408729 - RNA, 21 nt, Human
uaucaaaugcaguauauuucu

SEQ ID NO: 3408730 - RNA, 23 nt, Human
uaucaaaugcaguauauuucuuc

SEQ ID NO: 3408731 - RNA, 16 nt, Human
uaucaacccagaaaca

SEQ ID NO: 3408732 - RNA, 17 nt, Human
uaucaacccagaaacac

SEQ ID NO: 3408733 - RNA, 14 nt, Human
uaucaacuuccuaa

SEQ ID NO: 3408734 - RNA, 14 nt, Human
uaucaagacauagc

SEQ ID NO: 3408735 - RNA, 20 nt, Human
uaucaagaggcugagacagg

SEQ ID NO: 3408736 - RNA, 15 nt, Human
uaucaagcagccaag

SEQ ID NO: 3408737 - RNA, 22 nt, Human
uaucaaggaagaaaugguucag

SEQ ID NO: 3408738 - RNA, 15 nt, Human
uaucaaguauagaaa

SEQ ID NO: 3408739 - RNA, 15 nt, Human
uaucaaguggcaugu

SEQ ID NO: 3408740 - RNA, 18 nt, Human
uaucaauaucuaauauau

SEQ ID NO: 3408741 - RNA, 21 nt, Human
uaucaauaucuaauauauaug

SEQ ID NO: 3408742 - RNA, 14 nt, Human
uaucaaucauuuuc

SEQ ID NO: 3408743 - RNA, 17 nt, Human
uaucaauccuuguucag

SEQ ID NO: 3408744 - RNA, 18 nt, Human
uaucaaugugucuuucua

SEQ ID NO: 3408745 - RNA, 22 nt, Human
uaucaauuggaaaggaagaaaa

SEQ ID NO: 3408746 - RNA, 16 nt, Human
uaucaauuugucauuu

SEQ ID NO: 3408747 - RNA, 19 nt, Human
uaucaauuugucauuuuga

SEQ ID NO: 3408748 - RNA, 20 nt, Human
uaucaauuugucauuuugaa

SEQ ID NO: 3408749 - RNA, 14 nt, Human
uaucacacaaagca

SEQ ID NO: 3408750 - RNA, 13 nt, Human
uaucacacacauu

SEQ ID NO: 3408751 - RNA, 19 nt, Human
uaucacacacauugcugug

SEQ ID NO: 3408752 - RNA, 13 nt, Human
uaucacacuucug

SEQ ID NO: 3408753 - RNA, 15 nt, Human
uaucacagucuaauu

SEQ ID NO: 3408754 - RNA, 16 nt, Human
uaucacauguauguuu

SEQ ID NO: 3408755 - RNA, 18 nt, Human
uaucacauguuuucucug

SEQ ID NO: 3408756 - RNA, 20 nt, Human
uaucacccagacauaaagga

SEQ ID NO: 3408757 - RNA, 22 nt, Human
uaucacccagacauaaaggaaa

SEQ ID NO: 3408758 - RNA, 19 nt, Human
uaucaccgugggcucccug

SEQ ID NO: 3408759 - RNA, 18 nt, Human
uaucaccuagcugaaugu

SEQ ID NO: 3408760 - RNA, 15 nt, Human
uaucaccuccccucc

SEQ ID NO: 3408761 - RNA, 14 nt, Human
uaucacuuuuugaa

SEQ ID NO: 3408762 - RNA, 18 nt, Human
uaucacuuuuugaacuaa

SEQ ID NO: 3408763 - RNA, 20 nt, Human
ucaaacuccugaccucaggc

SEQ ID NO: 3408764 - RNA, 13 nt, Human
ucaaacucuuaaa

SEQ ID NO: 3408765 - RNA, 16 nt, Human
ucaaacugaagccaga

SEQ ID NO: 3408766 - RNA, 20 nt, Human
ucaaacugccuuggcuucag

SEQ ID NO: 3408767 - RNA, 14 nt, Human
ucaaacuggggccu

SEQ ID NO: 3408768 - RNA, 20 nt, Human
ucaaacuggggccuccagaa

SEQ ID NO: 3408769 - RNA, 14 nt, Human
ucaaacuguagaaa

SEQ ID NO: 3408770 - RNA, 20 nt, Human
ucaaacuguagaaaugauga

SEQ ID NO: 3408771 - RNA, 16 nt, Human
ucaaacuuacuauuuu

SEQ ID NO: 3408772 - RNA, 14 nt, Human
ucaaacuuccaguc

SEQ ID NO: 3408773 - RNA, 12 nt, Human
ucaaagaaauuu

SEQ ID NO: 3408774 - RNA, 19 nt, Human
ucaaagaaauuuccacuca

SEQ ID NO: 3408775 - RNA, 12 nt, Human
ucaaagaaggaa

SEQ ID NO: 3408776 - RNA, 14 nt, Human
ucaaagaaggcauu

SEQ ID NO: 3408777 - RNA, 23 nt, Human
ucaaagaccuggggcugcuguga

SEQ ID NO: 3408778 - RNA, 17 nt, Human
ucaaagaccuugugugu

SEQ ID NO: 3408779 - RNA, 16 nt, Human
ucaaagagaguuuuua

SEQ ID NO: 3408780 - RNA, 21 nt, Human
ucaaagaggcacagagccaaa

SEQ ID NO: 3408781 - RNA, 13 nt, Human
ucaaagauauuuu

SEQ ID NO: 3408782 - RNA, 20 nt, Human
ucaaagauauuuugcuuugu

SEQ ID NO: 3408783 - RNA, 19 nt, Human
ucaaagaugcugugagucu

SEQ ID NO: 3408784 - RNA, 10 nt, Human
ucaaagcaag

SEQ ID NO: 3408785 - RNA, 13 nt, Human
ucaaagcaagcau

SEQ ID NO: 3408786 - RNA, 21 nt, Human
ucaaagcaagcauucagaaga

SEQ ID NO: 3408787 - RNA, 15 nt, Human
ucaaagcaaggaaac

SEQ ID NO: 3408788 - RNA, 17 nt, Human
ucaaagcaaugcauuuu

SEQ ID NO: 3408789 - RNA, 19 nt, Human
ucaaagcaaugcauuuugg

SEQ ID NO: 3408790 - RNA, 19 nt, Human
ucaaagcaauugaaaugca

SEQ ID NO: 3408791 - RNA, 18 nt, Human
ucaaagcaccaaaauaag

SEQ ID NO: 3408792 - RNA, 20 nt, Human
ucaaagcaccaaaauaagaa

SEQ ID NO: 3408793 - RNA, 22 nt, Human
ucaaagcaccaaaauaagaaaa

SEQ ID NO: 3408794 - RNA, 19 nt, Human
ucaaagcacuguugagaag

SEQ ID NO: 3408795 - RNA, 10 nt, Human
ucaaagcaga

SEQ ID NO: 3408796 - RNA, 14 nt, Human
ucaaagcauagaug

SEQ ID NO: 3408797 - RNA, 19 nt, Human
ucaaagcaucuugcauuau

SEQ ID NO: 3408798 - RNA, 12 nt, Human
ucaaagccagcg

SEQ ID NO: 3408799 - RNA, 22 nt, Human
ucaaagccagcguccuccucug

SEQ ID NO: 3408800 - RNA, 23 nt, Human
ucaaagccagcguccuccucugu

SEQ ID NO: 3408801 - RNA, 14 nt, Human
ucaaagcugaaaug

SEQ ID NO: 3408802 - RNA, 14 nt, Human
ucaaagcuugaaga

SEQ ID NO: 3408803 - RNA, 20 nt, Human
ucaaaggagcgagcaugucg

SEQ ID NO: 3408804 - RNA, 14 nt, Human
ucaaaggccagacc

SEQ ID NO: 3408805 - RNA, 19 nt, Human
ucaaagggacggucaguuu

SEQ ID NO: 3408806 - RNA, 17 nt, Human
ucaaagggugaaaauua

SEQ ID NO: 3408807 - RNA, 23 nt, Human
ucaaagguucuagguuucaaaga

SEQ ID NO: 3408808 - RNA, 18 nt, Human
ucaaagguuuggaaggag

SEQ ID NO: 3408809 - RNA, 13 nt, Human
ucaaaguauuugu

SEQ ID NO: 3408810 - RNA, 17 nt, Human
ucaaagucaugauguuu

SEQ ID NO: 3408811 - RNA, 18 nt, Human
ucaaagucucaaugaaau

SEQ ID NO: 3408812 - RNA, 16 nt, Human
ucaaaguggaugcaau

SEQ ID NO: 3408813 - RNA, 20 nt, Human
ucaaaguguaaacaccauag

SEQ ID NO: 3408814 - RNA, 17 nt, Human
ucaaaguucugcuuucu

SEQ ID NO: 3408815 - RNA, 17 nt, Human
ucaaaguugaaaauuca

SEQ ID NO: 3408816 - RNA, 22 nt, Human
ucaaaguugccuaaauccauuu

SEQ ID NO: 3408817 - RNA, 13 nt, Human
ucaaaguuuugaa

SEQ ID NO: 3408818 - RNA, 20 nt, Human
ucaaauaaaaauucuagauu

SEQ ID NO: 3408819 - RNA, 11 nt, Human
ucaaauaaaca

SEQ ID NO: 3408820 - RNA, 15 nt, Human
ucaaauaaacacugu

SEQ ID NO: 3408821 - RNA, 16 nt, Human
ucaaauaaacacugug

SEQ ID NO: 3408822 - RNA, 23 nt, Human
ucaaauaaagagagaacaggacu

SEQ ID NO: 3408823 - RNA, 18 nt, Human
ucaaauaaguauuuauaa

SEQ ID NO: 3408824 - RNA, 14 nt, Human
ucaaauacacauuu

SEQ ID NO: 3408825 - RNA, 17 nt, Human
ucaaauacacauuugcu

SEQ ID NO: 3408826 - RNA, 20 nt, Human
ucaaauacgugggcauucaa

SEQ ID NO: 3408827 - RNA, 21 nt, Human
ucaaauacgugggcauucaaa

SEQ ID NO: 3408828 - RNA, 22 nt, Human
ucaaauacgugggcauucaaau

SEQ ID NO: 3408829 - RNA, 23 nt, Human
ucaaauacuuuaaaggaaaaaau

SEQ ID NO: 3408830 - RNA, 13 nt, Human
ucaaauauauuca

SEQ ID NO: 3408831 - RNA, 21 nt, Human
ucaaauaugaguacaaaugcc

SEQ ID NO: 3408832 - RNA, 18 nt, Human
ucaaauaugcaaagcacu

SEQ ID NO: 3408833 - RNA, 14 nt, Human
ucaaauauuagaug

SEQ ID NO: 3408834 - RNA, 20 nt, Human
ucaaaucaagaaacuuaagg

SEQ ID NO: 3408835 - RNA, 24 nt, Human
ucaaaucagucagugcaaauguca

SEQ ID NO: 3408836 - RNA, 19 nt, Human
ucaaauccaggacccugcc

SEQ ID NO: 3408837 - RNA, 22 nt, Human
ucaaauccaggacccugccagg

SEQ ID NO: 3408838 - RNA, 16 nt, Human
ucaaauccuuccaaaa

SEQ ID NO: 3408839 - RNA, 22 nt, Human
ucaaauccuuccaaaaauuauu

SEQ ID NO: 3408840 - RNA, 15 nt, Human
ucaaaucuaccacug

SEQ ID NO: 3408841 - RNA, 13 nt, Human
ucaaaucuauuca

SEQ ID NO: 3408842 - RNA, 16 nt, Human
ucaaaucuauucagac

SEQ ID NO: 3408843 - RNA, 22 nt, Human
ucaaaucucuacaaauuuuucu

SEQ ID NO: 3408844 - RNA, 17 nt, Human
ucaaaucuuaagaaaua

SEQ ID NO: 3408845 - RNA, 18 nt, Human
ucaaaucuuaagaaauaa

SEQ ID NO: 3408846 - RNA, 13 nt, Human
ucaaaugaaaugu

SEQ ID NO: 3408847 - RNA, 20 nt, Human
ucaaaugaaauguaugcauu

SEQ ID NO: 3408848 - RNA, 23 nt, Human
ucaaaugaaauguaugcauucac

SEQ ID NO: 3408849 - RNA, 19 nt, Human
ucaaaugaauaaugccuuu

SEQ ID NO: 3408850 - RNA, 16 nt, Human
ucaaaugaguaacauu

SEQ ID NO: 3408851 - RNA, 17 nt, Human
ucaaaugaugugcaaaa

SEQ ID NO: 3408852 - RNA, 21 nt, Human
ucaaaugaugugcaaaaccuu

SEQ ID NO: 3408853 - RNA, 19 nt, Human
ucaaaugaugugccugcuu

SEQ ID NO: 3408854 - RNA, 17 nt, Human
ucaaaugcuagaaaaau

SEQ ID NO: 3408855 - RNA, 15 nt, Human
ucaaaugggugauau

SEQ ID NO: 3408856 - RNA, 12 nt, Human
ucaaauguguac

SEQ ID NO: 3408857 - RNA, 13 nt, Human
ucaaauguucuaa

SEQ ID NO: 3408858 - RNA, 15 nt, Human
ucaaauguuuaauca

SEQ ID NO: 3408859 - RNA, 17 nt, Human
ucaaauguuuaaucaua

SEQ ID NO: 3408860 - RNA, 18 nt, Human
ucaaauguuuaaucauau

SEQ ID NO: 3408861 - RNA, 21 nt, Human
ucaaauguuuaaucauauaaa

SEQ ID NO: 3408862 - RNA, 12 nt, Human
ucaaauuaauaa

SEQ ID NO: 3408863 - RNA, 16 nt, Human
ucaaauucucaaccua

SEQ ID NO: 3408864 - RNA, 20 nt, Human
ucaaauuguaagcaugcaca

SEQ ID NO: 3408865 - RNA, 20 nt, Human
ucaaauugucagcaauuuaa

SEQ ID NO: 3408866 - RNA, 15 nt, Human
ucaaauugugugaaa

SEQ ID NO: 3408867 - RNA, 18 nt, Human
ucaaauugugugaaaggu

SEQ ID NO: 3408868 - RNA, 22 nt, Human
ucaaauuuagaaacuaauugac

SEQ ID NO: 3408869 - RNA, 18 nt, Human
ucaaauuuauuuuuuucu

SEQ ID NO: 3408870 - RNA, 15 nt, Human
ucaaauuucuaaauc

SEQ ID NO: 3408871 - RNA, 21 nt, Human
ucaaauuuuuuaaaagagaca

SEQ ID NO: 3408872 - RNA, 16 nt, Human
ucaaauuuuuugacuu

SEQ ID NO: 3408873 - RNA, 18 nt, Human
ucaacaaacuauuucuua

SEQ ID NO: 3408874 - RNA, 21 nt, Human
ucaacaaagaaacaaagaugu

SEQ ID NO: 3408875 - RNA, 14 nt, Human
ucaacaaagaaaua

SEQ ID NO: 3408876 - RNA, 16 nt, Human
ucaacaaagaaauauu

SEQ ID NO: 3408877 - RNA, 21 nt, Human
ucaacaaagaaauauuauuug

SEQ ID NO: 3408878 - RNA, 18 nt, Human
ucaacaaauauucacugg

SEQ ID NO: 3408879 - RNA, 13 nt, Human
ucaacaagccuga

SEQ ID NO: 3408880 - RNA, 20 nt, Human
ucaacaagggagagaccuca

SEQ ID NO: 3408881 - RNA, 15 nt, Human
ucaacaauaaaacau

SEQ ID NO: 3408882 - RNA, 22 nt, Human
ucaacaauuugggcuuccuguu

SEQ ID NO: 3408883 - RNA, 15 nt, Human
ucaacaccccugugu

SEQ ID NO: 3408884 - RNA, 22 nt, Human
ucaacaccuuaauaugcugcaa

SEQ ID NO: 3408885 - RNA, 14 nt, Human
ucaacagaagcauu

SEQ ID NO: 3408886 - RNA, 13 nt, Human
ucaacagaaugaa

SEQ ID NO: 3408887 - RNA, 19 nt, Human
ucaacagagaaggcaggaa

SEQ ID NO: 3408888 - RNA, 15 nt, Human
ucaacagcaagugug

SEQ ID NO: 3408889 - RNA, 16 nt, Human
ucaacagcaaguguga

SEQ ID NO: 3408890 - RNA, 18 nt, Human
ucaacaggagaauuuuac

SEQ ID NO: 3408891 - RNA, 16 nt, Human
ucaacagguuuuccug

SEQ ID NO: 3408892 - RNA, 20 nt, Human
ucaacaguaaaccacugaaa

SEQ ID NO: 3408893 - RNA, 22 nt, Human
ucaacaguaaaccacugaaaaa

SEQ ID NO: 3408894 - RNA, 15 nt, Human
ucaacaguuuuccua

SEQ ID NO: 3408895 - RNA, 17 nt, Human
ucaacaguuuuccuaug

SEQ ID NO: 3408896 - RNA, 20 nt, Human
ucaacaguuuuccuaugcuu

SEQ ID NO: 3408897 - RNA, 14 nt, Human
ucaacaucaauguu

SEQ ID NO: 3408898 - RNA, 15 nt, Human
ucaacaucaauguuc

SEQ ID NO: 3408899 - RNA, 21 nt, Human
ucaacaucaauguucauugua

SEQ ID NO: 3408900 - RNA, 13 nt, Human
ucaacaucacuga

SEQ ID NO: 3408901 - RNA, 14 nt, Human
ucaacauccugcca

SEQ ID NO: 3408902 - RNA, 15 nt, Human
ucaacauccugccag

SEQ ID NO: 3408903 - RNA, 14 nt, Human
ucaacaugaaacac

SEQ ID NO: 3408904 - RNA, 14 nt, Human
ucaacaugucuccu

SEQ ID NO: 3408905 - RNA, 19 nt, Human
ucaacauguuacugaccag

SEQ ID NO: 3408906 - RNA, 22 nt, Human
ucaacauguuacugaccagcaa

SEQ ID NO: 3408907 - RNA, 14 nt, Human
ucaacauucuuugc

SEQ ID NO: 3408908 - RNA, 20 nt, Human
ucaauuacugguccaaaaga

SEQ ID NO: 3408909 - RNA, 16 nt, Human
ucaauuauaguuucug

SEQ ID NO: 3408910 - RNA, 17 nt, Human
ucaauuauaguuucuga

SEQ ID NO: 3408911 - RNA, 19 nt, Human
ucaauuauaguuucugagg

SEQ ID NO: 3408912 - RNA, 15 nt, Human
ucaauuauuuccccc

SEQ ID NO: 3408913 - RNA, 17 nt, Human
ucaauucaaagcugugu

SEQ ID NO: 3408914 - RNA, 13 nt, Human
ucaauucaacacu

SEQ ID NO: 3408915 - RNA, 18 nt, Human
ucaauucauauuuaugaa

SEQ ID NO: 3408916 - RNA, 14 nt, Human
ucaauuccaccugc

SEQ ID NO: 3408917 - RNA, 16 nt, Human
ucaauucccauugcau

SEQ ID NO: 3408918 - RNA, 19 nt, Human
ucaauuccguagccagcug

SEQ ID NO: 3408919 - RNA, 13 nt, Human
ucaauuccugggc

SEQ ID NO: 3408920 - RNA, 12 nt, Human
ucaauucucaaa

SEQ ID NO: 3408921 - RNA, 19 nt, Human
ucaauucuucccuaucuuu

SEQ ID NO: 3408922 - RNA, 16 nt, Human
ucaauucuugccaaau

SEQ ID NO: 3408923 - RNA, 14 nt, Human
ucaauugucacuuu

SEQ ID NO: 3408924 - RNA, 12 nt, Human
ucaauugugaaa

SEQ ID NO: 3408925 - RNA, 12 nt, Human
ucaauuuaaaaa

SEQ ID NO: 3408926 - RNA, 14 nt, Human
ucaauuuaaaccca

SEQ ID NO: 3408927 - RNA, 21 nt, Human
ucaauuuaaacccauuuuagu

SEQ ID NO: 3408928 - RNA, 15 nt, Human
ucaauuuaaauaacc

SEQ ID NO: 3408929 - RNA, 21 nt, Human
ucaauuuaaguguuggaaaaa

SEQ ID NO: 3408930 - RNA, 16 nt, Human
ucaauuuauugcacaa

SEQ ID NO: 3408931 - RNA, 17 nt, Human
ucaauuuauugcacaaa

SEQ ID NO: 3408932 - RNA, 23 nt, Human
ucaauuuauugcacaaaauauaa

SEQ ID NO: 3408933 - RNA, 18 nt, Human
ucaauuuccaagagcuga

SEQ ID NO: 3408934 - RNA, 21 nt, Human
ucaauuucccugacuccucua

SEQ ID NO: 3408935 - RNA, 20 nt, Human
ucaauuuguaauugcuuaca

SEQ ID NO: 3408936 - RNA, 20 nt, Human
ucaauuugucauuuugaagc

SEQ ID NO: 3408937 - RNA, 13 nt, Human
ucaauuuuaaaca

SEQ ID NO: 3408938 - RNA, 14 nt, Human
ucaauuuuaaacau

SEQ ID NO: 3408939 - RNA, 16 nt, Human
ucaauuuuaaacauau

SEQ ID NO: 3408940 - RNA, 13 nt, Human
ucaauuuuaacaa

SEQ ID NO: 3408941 - RNA, 16 nt, Human
ucaauuuuaucccuca

SEQ ID NO: 3408942 - RNA, 21 nt, Human
ucaauuuuaucccucaccugu

SEQ ID NO: 3408943 - RNA, 15 nt, Human
ucaauuuucacugug

SEQ ID NO: 3408944 - RNA, 18 nt, Human
ucaauuuugacuuaaugu

SEQ ID NO: 3408945 - RNA, 20 nt, Human
ucaauuuuugguugaauaaa

SEQ ID NO: 3408946 - RNA, 19 nt, Human
ucaauuuuugucucagaag

SEQ ID NO: 3408947 - RNA, 21 nt, Human
ucacaaaaccuggcacaaugg

SEQ ID NO: 3408948 - RNA, 17 nt, Human
ucacaaacuuuuauacu

SEQ ID NO: 3408949 - RNA, 21 nt, Human
ucacaaacuuuuauacucuuu

SEQ ID NO: 3408950 - RNA, 12 nt, Human
ucacaaaggaau

SEQ ID NO: 3408951 - RNA, 17 nt, Human
ucacaaaggaugcccaa

SEQ ID NO: 3408952 - RNA, 20 nt, Human
ucacaaauauuaaaaagucu

SEQ ID NO: 3408953 - RNA, 20 nt, Human
ucacaaauccuaaaagaagc

SEQ ID NO: 3408954 - RNA, 11 nt, Human
ucacaaaugac

SEQ ID NO: 3408955 - RNA, 12 nt, Human
ucacaaaugacu

SEQ ID NO: 3408956 - RNA, 22 nt, Human
ucacaaauuucacuuauaccug

SEQ ID NO: 3408957 - RNA, 18 nt, Human
ucacaaauuucucuguuc

SEQ ID NO: 3408958 - RNA, 16 nt, Human
ucacaacaaccugguc

SEQ ID NO: 3408959 - RNA, 22 nt, Human
ucacaacagccugacaacauuu

SEQ ID NO: 3408960 - RNA, 13 nt, Human
ucacaaccaagaa

SEQ ID NO: 3408961 - RNA, 13 nt, Human
ucacaacccaucu

SEQ ID NO: 3408962 - RNA, 19 nt, Human
ucacaacuugauggcugcg

SEQ ID NO: 3408963 - RNA, 15 nt, Human
ucacaagaagaccag

SEQ ID NO: 3408964 - RNA, 18 nt, Human
ucacaagacccaaaaggc

SEQ ID NO: 3408965 - RNA, 17 nt, Human
ucacaagagcccagcag

SEQ ID NO: 3408966 - RNA, 12 nt, Human
ucacaagcugcc

SEQ ID NO: 3408967 - RNA, 15 nt, Human
ucacaagcugccucc

SEQ ID NO: 3408968 - RNA, 12 nt, Human
ucacaaggcagc

SEQ ID NO: 3408969 - RNA, 22 nt, Human
ucacaaguuaagauucuuggua

SEQ ID NO: 3408970 - RNA, 20 nt, Human
ucacaaguuguguuugauau

SEQ ID NO: 3408971 - RNA, 17 nt, Human
ucacaaguuuuuuuacu

SEQ ID NO: 3408972 - RNA, 14 nt, Human
ucacaauaaaagcu

SEQ ID NO: 3408973 - RNA, 15 nt, Human
ucacaauaauuuucu

SEQ ID NO: 3408974 - RNA, 13 nt, Human
ucacaauacagau

SEQ ID NO: 3408975 - RNA, 14 nt, Human
ucacaauagaaacu

SEQ ID NO: 3408976 - RNA, 21 nt, Human
ucacaauagccgauaucagaa

SEQ ID NO: 3408977 - RNA, 22 nt, Human
ucacaauagccgauaucagaau

SEQ ID NO: 3408978 - RNA, 17 nt, Human
ucacaaugucaguauuu

SEQ ID NO: 3408979 - RNA, 15 nt, Human
ucacaauuuuuaaug

SEQ ID NO: 3408980 - RNA, 23 nt, Human
ucacacacagacucauauuacug

SEQ ID NO: 3408981 - RNA, 22 nt, Human
ucacacacagacuguugucccu

SEQ ID NO: 3408982 - RNA, 12 nt, Human
ucacacacaugg

SEQ ID NO: 3408983 - RNA, 15 nt, Human
ucacacacccugagg

SEQ ID NO: 3408984 - RNA, 12 nt, Human
ucacacaccugu

SEQ ID NO: 3408985 - RNA, 12 nt, Human
ucacacacugau

SEQ ID NO: 3408986 - RNA, 23 nt, Human
ucacacagccaggugccuuggag

SEQ ID NO: 3408987 - RNA, 19 nt, Human
ucacacaggacccccuucc

SEQ ID NO: 3408988 - RNA, 20 nt, Human
ucacacaggacccccuuccc

SEQ ID NO: 3408989 - RNA, 22 nt, Human
ucacacaguauuacuucugcua

SEQ ID NO: 3408990 - RNA, 21 nt, Human
ucacaccaggcuugccugcag

SEQ ID NO: 3408991 - RNA, 15 nt, Human
ucacacccaccgucc

SEQ ID NO: 3408992 - RNA, 23 nt, Human
ucacacccaccguccgcccugcu

SEQ ID NO: 3408993 - RNA, 15 nt, Human
ucacaccccaccugc

SEQ ID NO: 3408994 - RNA, 14 nt, Human
ucacacccugcaag

SEQ ID NO: 3408995 - RNA, 15 nt, Human
ucacaccucacucuu

SEQ ID NO: 3408996 - RNA, 22 nt, Human
ucacaccucacucuuuauagug

SEQ ID NO: 3408997 - RNA, 21 nt, Human
ucacaccugaaaauguuagug

SEQ ID NO: 3408998 - RNA, 20 nt, Human
ucacaccugaacugaacacc

SEQ ID NO: 3408999 - RNA, 13 nt, Human
ucacaccugacuc

SEQ ID NO: 3409000 - RNA, 18 nt, Human
ucacaccugacucugaaa

SEQ ID NO: 3409001 - RNA, 17 nt, Human
ucacaccugcccuaaac

SEQ ID NO: 3409002 - RNA, 16 nt, Human
ucacacgaccggggcc

SEQ ID NO: 3409003 - RNA, 17 nt, Human
ucacacgggguauuuua

SEQ ID NO: 3409004 - RNA, 12 nt, Human
ucacacucgaca

SEQ ID NO: 3409005 - RNA, 20 nt, Human
ucacacugagaauguaagaa

SEQ ID NO: 3409006 - RNA, 23 nt, Human
ucacacugagaauguaagaacua

SEQ ID NO: 3409007 - RNA, 21 nt, Human
ucacacugggugguggccugg

SEQ ID NO: 3409008 - RNA, 22 nt, Human
ucacacugggugguggccuggu

SEQ ID NO: 3409009 - RNA, 16 nt, Human
ucacacugguucucaa

SEQ ID NO: 3409010 - RNA, 17 nt, Human
ucacacugguucucaau

SEQ ID NO: 3409011 - RNA, 23 nt, Human
ucacacuuacuguaagacauuag

SEQ ID NO: 3409012 - RNA, 23 nt, Human
ucacacuucugugagacccccac

SEQ ID NO: 3409013 - RNA, 16 nt, Human
ucacagaaaugagauc

SEQ ID NO: 3409014 - RNA, 14 nt, Human
ucacagaagaugaa

SEQ ID NO: 3409015 - RNA, 23 nt, Human
ucacagaaguguuaacuuuucua

SEQ ID NO: 3409016 - RNA, 22 nt, Human
ucacagaaucauaugauucugc

SEQ ID NO: 3409017 - RNA, 11 nt, Human
ucacagacagg

SEQ ID NO: 3409018 - RNA, 14 nt, Human
ucacagacaggacc

SEQ ID NO: 3409019 - RNA, 15 nt, Human
ucacagaccuggagc

SEQ ID NO: 3409020 - RNA, 20 nt, Human
ucacagaccuggagccccug

SEQ ID NO: 3409021 - RNA, 23 nt, Human
ucacagaccuggagccccugggu

SEQ ID NO: 3409022 - RNA, 16 nt, Human
ucacagaccuuugaac

SEQ ID NO: 3409023 - RNA, 21 nt, Human
ucacagagacauuccuccgag

SEQ ID NO: 3409024 - RNA, 21 nt, Human
ucacagagucaaggccugcuc

SEQ ID NO: 3409025 - RNA, 15 nt, Human
ucacagagugugcug

SEQ ID NO: 3409026 - RNA, 18 nt, Human
ucacagagugugcuggag

SEQ ID NO: 3409027 - RNA, 14 nt, Human
ucacagaugggugc

SEQ ID NO: 3409028 - RNA, 23 nt, Human
ucacagaugugugauucacagug

SEQ ID NO: 3409029 - RNA, 18 nt, Human
ucacagcacagagaagac

SEQ ID NO: 3409030 - RNA, 14 nt, Human
ucacagcagccucc

SEQ ID NO: 3409031 - RNA, 17 nt, Human
ucacagcagccuccaac

SEQ ID NO: 3409032 - RNA, 16 nt, Human
ucacagccacuuggga

SEQ ID NO: 3409033 - RNA, 17 nt, Human
ucacagccagacuggca

SEQ ID NO: 3409034 - RNA, 11 nt, Human
ucacagccagg

SEQ ID NO: 3409035 - RNA, 13 nt, Human
ucacagcccagcc

SEQ ID NO: 3409036 - RNA, 23 nt, Human
ucacagcccugcuuaccagauaa

SEQ ID NO: 3409037 - RNA, 21 nt, Human
ucacagccucugaccccuccu

SEQ ID NO: 3409038 - RNA, 22 nt, Human
ucacagccucugaccccuccuc

SEQ ID NO: 3409039 - RNA, 20 nt, Human
ucacagcuaugcaaaaagcu

SEQ ID NO: 3409040 - RNA, 19 nt, Human
ucacagcuccaagaauuuc

SEQ ID NO: 3409041 - RNA, 17 nt, Human
ucacagcuuguauuuug

SEQ ID NO: 3409042 - RNA, 17 nt, Human
ucacaggacucugccuc

SEQ ID NO: 3409043 - RNA, 19 nt, Human
ucacaggagggagggggaa

SEQ ID NO: 3409044 - RNA, 14 nt, Human
ucacaggcagccag

SEQ ID NO: 3409045 - RNA, 15 nt, Human
ucacaggcagccagu

SEQ ID NO: 3409046 - RNA, 16 nt, Human
ucacaggcagguccag

SEQ ID NO: 3409047 - RNA, 18 nt, Human
ucacaggcagguccaggg

SEQ ID NO: 3409048 - RNA, 19 nt, Human
ucacaggccccaggaaagg

SEQ ID NO: 3409049 - RNA, 18 nt, Human
ucacaggcgaggccugga

SEQ ID NO: 3409050 - RNA, 19 nt, Human
ucacaggcugggcugggca

SEQ ID NO: 3409051 - RNA, 20 nt, Human
ucacaggcugggcugggcac

SEQ ID NO: 3409052 - RNA, 23 nt, Human
ucacagggacugaaaaccucucc

SEQ ID NO: 3409053 - RNA, 12 nt, Human
ucacucaaggcg

SEQ ID NO: 3409054 - RNA, 20 nt, Human
ucacucaaguucaaggacca

SEQ ID NO: 3409055 - RNA, 14 nt, Human
ucacucacagaguc

SEQ ID NO: 3409056 - RNA, 23 nt, Human
ucacucacagagucaaggccugc

SEQ ID NO: 3409057 - RNA, 15 nt, Human
ucacucacucuaaag

SEQ ID NO: 3409058 - RNA, 16 nt, Human
ucacucacugucaaug

SEQ ID NO: 3409059 - RNA, 18 nt, Human
ucacucagaaguccagag

SEQ ID NO: 3409060 - RNA, 14 nt, Human
ucacucagcaccac

SEQ ID NO: 3409061 - RNA, 14 nt, Human
ucacucauuaauua

SEQ ID NO: 3409062 - RNA, 19 nt, Human
ucacucauugcugagccuc

SEQ ID NO: 3409063 - RNA, 20 nt, Human
ucacucauugcugagccucu

SEQ ID NO: 3409064 - RNA, 13 nt, Human
ucacuccaccacc

SEQ ID NO: 3409065 - RNA, 16 nt, Human
ucacuccaccacccaa

SEQ ID NO: 3409066 - RNA, 23 nt, Human
ucacucccaccugcaucuggggc

SEQ ID NO: 3409067 - RNA, 20 nt, Human
ucacuccccaacccccaacu

SEQ ID NO: 3409068 - RNA, 21 nt, Human
ucacuccccaugccacguucc

SEQ ID NO: 3409069 - RNA, 15 nt, Human
ucacucccuccauca

SEQ ID NO: 3409070 - RNA, 15 nt, Human
ucacucccuucuacc

SEQ ID NO: 3409071 - RNA, 19 nt, Human
ucacucccuucuaccugcc

SEQ ID NO: 3409072 - RNA, 16 nt, Human
ucacucccuucuccuu

SEQ ID NO: 3409073 - RNA, 21 nt, Human
ucacuccugagaccccuggcc

SEQ ID NO: 3409074 - RNA, 22 nt, Human
ucacuccugagaccccuggccu

SEQ ID NO: 3409075 - RNA, 19 nt, Human
ucacuccugcuguaaauuu

SEQ ID NO: 3409076 - RNA, 11 nt, Human
ucacuccuggg

SEQ ID NO: 3409077 - RNA, 20 nt, Human
ucacuccuggggccucuugg

SEQ ID NO: 3409078 - RNA, 14 nt, Human
ucacuccuuuuaaa

SEQ ID NO: 3409079 - RNA, 14 nt, Human
ucacucgauaauaa

SEQ ID NO: 3409080 - RNA, 17 nt, Human
ucacucggcacccugca

SEQ ID NO: 3409081 - RNA, 16 nt, Human
ucacucgucuccccca

SEQ ID NO: 3409082 - RNA, 14 nt, Human
ucacucuaagaugu

SEQ ID NO: 3409083 - RNA, 21 nt, Human
ucacucuaagauguuauauuu

SEQ ID NO: 3409084 - RNA, 16 nt, Human
ucacucuaagucaugu

SEQ ID NO: 3409085 - RNA, 17 nt, Human
ucacucuagguuuuaca

SEQ ID NO: 3409086 - RNA, 21 nt, Human
ucacucuagucaaugacauga

SEQ ID NO: 3409087 - RNA, 17 nt, Human
ucacucuccuaugccuu

SEQ ID NO: 3409088 - RNA, 12 nt, Human
ucacucuccuug

SEQ ID NO: 3409089 - RNA, 23 nt, Human
ucacucuccuuggugucgggcau

SEQ ID NO: 3409090 - RNA, 12 nt, Human
ucacucugccag

SEQ ID NO: 3409091 - RNA, 14 nt, Human
ucacucugccaggg

SEQ ID NO: 3409092 - RNA, 13 nt, Human
ucacucugcugcu

SEQ ID NO: 3409093 - RNA, 15 nt, Human
ucacucuggcagcuc

SEQ ID NO: 3409094 - RNA, 17 nt, Human
ucacucuggcagcucag

SEQ ID NO: 3409095 - RNA, 20 nt, Human
ucacucuggcagcucagaga

SEQ ID NO: 3409096 - RNA, 12 nt, Human
ucacucugggcu

SEQ ID NO: 3409097 - RNA, 12 nt, Human
ucacucugucgc

SEQ ID NO: 3409098 - RNA, 22 nt, Human
ucacucugucgcccagucugga

SEQ ID NO: 3409099 - RNA, 20 nt, Human
ucacucuuauugcccacgcu

SEQ ID NO: 3409100 - RNA, 18 nt, Human
ucacucuuccugcaagga

SEQ ID NO: 3409101 - RNA, 19 nt, Human
ucacucuuccugcaaggac

SEQ ID NO: 3409102 - RNA, 14 nt, Human
ucacucuuuauagu

SEQ ID NO: 3409103 - RNA, 19 nt, Human
ucacucuuuauagugcaca

SEQ ID NO: 3409104 - RNA, 18 nt, Human
ucacugaaaacaucugga

SEQ ID NO: 3409105 - RNA, 17 nt, Human
ucacugaaaauuggaca

SEQ ID NO: 3409106 - RNA, 12 nt, Human
ucacugaagacg

SEQ ID NO: 3409107 - RNA, 11 nt, Human
ucacugaagcc

SEQ ID NO: 3409108 - RNA, 22 nt, Human
ucacugaaugccucaaugugac

SEQ ID NO: 3409109 - RNA, 19 nt, Human
ucacugacacaaaaaguag

SEQ ID NO: 3409110 - RNA, 15 nt, Human
ucacugacacaaagg

SEQ ID NO: 3409111 - RNA, 15 nt, Human
ucacugagcacuguu

SEQ ID NO: 3409112 - RNA, 16 nt, Human
ucacugagcacuguuu

SEQ ID NO: 3409113 - RNA, 16 nt, Human
ucacugaggccugaga

SEQ ID NO: 3409114 - RNA, 18 nt, Human
ucacugcaaccuccaccu

SEQ ID NO: 3409115 - RNA, 21 nt, Human
ucacugcaaccuucgccaccu

SEQ ID NO: 3409116 - RNA, 15 nt, Human
ucacugcacagugca

SEQ ID NO: 3409117 - RNA, 24 nt, Human
ucacugcacagugcaucucagccc

SEQ ID NO: 3409118 - RNA, 20 nt, Human
ucacugcagccuccgcuucc

SEQ ID NO: 3409119 - RNA, 15 nt, Human
ucacugcagccucga

SEQ ID NO: 3409120 - RNA, 13 nt, Human
ucacugcauccuc

SEQ ID NO: 3409121 - RNA, 18 nt, Human
ucacugcauccuccgccu

SEQ ID NO: 3409122 - RNA, 19 nt, Human
ucacugccacuuugcacau

SEQ ID NO: 3409123 - RNA, 11 nt, Human
ucacugccagg

SEQ ID NO: 3409124 - RNA, 18 nt, Human
ucacugccaggccagccu

SEQ ID NO: 3409125 - RNA, 20 nt, Human
ucacugccaggccagccucc

SEQ ID NO: 3409126 - RNA, 23 nt, Human
ucacugccaggccagccuccgag

SEQ ID NO: 3409127 - RNA, 16 nt, Human
ucacugcgccacugcu

SEQ ID NO: 3409128 - RNA, 23 nt, Human
ucacugcgccacugcuccgugga

SEQ ID NO: 3409129 - RNA, 14 nt, Human
ucacugcucacacu

SEQ ID NO: 3409130 - RNA, 20 nt, Human
ucacugcucccugaagccag

SEQ ID NO: 3409131 - RNA, 24 nt, Human
ucacugcucccugaagccagccuu

SEQ ID NO: 3409132 - RNA, 12 nt, Human
ucacugcugcaa

SEQ ID NO: 3409133 - RNA, 17 nt, Human
ucacugcugcaaggccu

SEQ ID NO: 3409134 - RNA, 12 nt, Human
ucacugcuggcu

SEQ ID NO: 3409135 - RNA, 10 nt, Human
ucacugcugu

SEQ ID NO: 3409136 - RNA, 12 nt, Human
ucacugcuguca

SEQ ID NO: 3409137 - RNA, 16 nt, Human
ucacugcugucaucaa

SEQ ID NO: 3409138 - RNA, 22 nt, Human
ucacugcuguuauauuucauca

SEQ ID NO: 3409139 - RNA, 15 nt, Human
ucacugcuuaacuuc

SEQ ID NO: 3409140 - RNA, 19 nt, Human
ucacugcuugaacuaggcu

SEQ ID NO: 3409141 - RNA, 21 nt, Human
ucacugcuugaugaagcaagg

SEQ ID NO: 3409142 - RNA, 15 nt, Human
ucacuggaaagggga

SEQ ID NO: 3409143 - RNA, 23 nt, Human
ucacuggaaaggggagagccugc

SEQ ID NO: 3409144 - RNA, 11 nt, Human
ucacuggagca

SEQ ID NO: 3409145 - RNA, 16 nt, Human
ucacuggagcacaaua

SEQ ID NO: 3409146 - RNA, 15 nt, Human
ucacuggagcccagg

SEQ ID NO: 3409147 - RNA, 19 nt, Human
ucacuggaguuacauuaau

SEQ ID NO: 3409148 - RNA, 21 nt, Human
ucacuggaguuacauuaaugu

SEQ ID NO: 3409149 - RNA, 21 nt, Human
ucacuggccacaguuguuuga

SEQ ID NO: 3409150 - RNA, 15 nt, Human
ucacuggccaucccu

SEQ ID NO: 3409151 - RNA, 13 nt, Human
ucacuggcucucc

SEQ ID NO: 3409152 - RNA, 16 nt, Human
ucacuggcucuccaag

SEQ ID NO: 3409153 - RNA, 22 nt, Human
ucacuggcucuccaagugccag

SEQ ID NO: 3409154 - RNA, 14 nt, Human
ucacuggcugccuc

SEQ ID NO: 3409155 - RNA, 21 nt, Human
ucacugggguccuggggccuc

SEQ ID NO: 3409156 - RNA, 18 nt, Human
ucacugguagaccaaaau

SEQ ID NO: 3409157 - RNA, 20 nt, Human
ucacuguagaaugauuucau

SEQ ID NO: 3409158 - RNA, 14 nt, Human
ucacugucaaugau

SEQ ID NO: 3409159 - RNA, 16 nt, Human
ucacugucccuccugg

SEQ ID NO: 3409160 - RNA, 17 nt, Human
ucacugucccuccuggu

SEQ ID NO: 3409161 - RNA, 15 nt, Human
ucacuguccuccaag

SEQ ID NO: 3409162 - RNA, 15 nt, Human
ucacugucugagagu

SEQ ID NO: 3409163 - RNA, 12 nt, Human
ucacugucuuuc

SEQ ID NO: 3409164 - RNA, 21 nt, Human
ucacugugaucaauauuuuua

SEQ ID NO: 3409165 - RNA, 16 nt, Human
ucacugugcuguuguu

SEQ ID NO: 3409166 - RNA, 15 nt, Human
ucacuguggcugucu

SEQ ID NO: 3409167 - RNA, 20 nt, Human
ucacugugguaaaugccaca

SEQ ID NO: 3409168 - RNA, 21 nt, Human
ucacugugguaaaugccacac

SEQ ID NO: 3409169 - RNA, 21 nt, Human
ucacuguguauauuugauuua

SEQ ID NO: 3409170 - RNA, 16 nt, Human
ucacuguucccucugc

SEQ ID NO: 3409171 - RNA, 21 nt, Human
ucacuguucccucugcuccug

SEQ ID NO: 3409172 - RNA, 15 nt, Human
ucacuguugaaaauu

SEQ ID NO: 3409173 - RNA, 15 nt, Human
ucacuguugcccagg

SEQ ID NO: 3409174 - RNA, 15 nt, Human
ucacuguuuagauuu

SEQ ID NO: 3409175 - RNA, 16 nt, Human
ucacuguuuagauuug

SEQ ID NO: 3409176 - RNA, 17 nt, Human
ucacuguuuagauuugc

SEQ ID NO: 3409177 - RNA, 14 nt, Human
ucacuguuucacua

SEQ ID NO: 3409178 - RNA, 21 nt, Human
ucacuguuucacuacucagca

SEQ ID NO: 3409179 - RNA, 23 nt, Human
ucacuguuucaucuaagugccuc

SEQ ID NO: 3409180 - RNA, 14 nt, Human
ucacuguuuccugg

SEQ ID NO: 3409181 - RNA, 14 nt, Human
ucacuguuucucug

SEQ ID NO: 3409182 - RNA, 17 nt, Human
ucacuguuucucugcug

SEQ ID NO: 3409183 - RNA, 20 nt, Human
ucacuguuucucugcuguug

SEQ ID NO: 3409184 - RNA, 22 nt, Human
ucacuguuuuuagacaccuuca

SEQ ID NO: 3409185 - RNA, 17 nt, Human
ucacuuaccuagauuua

SEQ ID NO: 3409186 - RNA, 15 nt, Human
ucacuuacuguuucu

SEQ ID NO: 3409187 - RNA, 17 nt, Human
ucacuucacgcuuucag

SEQ ID NO: 3409188 - RNA, 15 nt, Human
ucacuucacugugcu

SEQ ID NO: 3409189 - RNA, 19 nt, Human
ucacuucaucuucucagcu

SEQ ID NO: 3409190 - RNA, 18 nt, Human
ucacuuccauacagcucu

SEQ ID NO: 3409191 - RNA, 17 nt, Human
ucacuuccuacaagagc

SEQ ID NO: 3409192 - RNA, 20 nt, Human
ucacuucuaggguaugggaa

SEQ ID NO: 3409193 - RNA, 22 nt, Human
ucacuucucuuaaacuugugaa

SEQ ID NO: 3409194 - RNA, 13 nt, Human
ucacuucuucugu

SEQ ID NO: 3409195 - RNA, 13 nt, Human
ucacuucuuuccc

SEQ ID NO: 3409196 - RNA, 22 nt, Human
ucacuucuuucccuuccuccau

SEQ ID NO: 3409197 - RNA, 22 nt, Human
ucacuugaacccgggaggcaga

SEQ ID NO: 3409198 - RNA, 21 nt, Human
uccaaccggcuuuguggcacu

SEQ ID NO: 3409199 - RNA, 18 nt, Human
uccaaccuaaccccuuuc

SEQ ID NO: 3409200 - RNA, 21 nt, Human
uccaaccuaaccccuuuccug

SEQ ID NO: 3409201 - RNA, 14 nt, Human
uccaaccuaaccug

SEQ ID NO: 3409202 - RNA, 18 nt, Human
uccaaccuaaccuguguc

SEQ ID NO: 3409203 - RNA, 21 nt, Human
uccaaccuggggggcaguggu

SEQ ID NO: 3409204 - RNA, 13 nt, Human
uccaaccuuccca

SEQ ID NO: 3409205 - RNA, 15 nt, Human
uccaacuaaugccuu

SEQ ID NO: 3409206 - RNA, 22 nt, Human
uccaacuaaugccuuacucuuc

SEQ ID NO: 3409207 - RNA, 21 nt, Human
uccaacuccaguacuggagcu

SEQ ID NO: 3409208 - RNA, 18 nt, Human
uccaacucgaaucugugu

SEQ ID NO: 3409209 - RNA, 12 nt, Human
uccaacugcugc

SEQ ID NO: 3409210 - RNA, 23 nt, Human
uccaacuggcccuauuuagauga

SEQ ID NO: 3409211 - RNA, 15 nt, Human
uccaacuuggcugca

SEQ ID NO: 3409212 - RNA, 20 nt, Human
uccaagaagcccaggaaagg

SEQ ID NO: 3409213 - RNA, 18 nt, Human
uccaagaauagcaucugu

SEQ ID NO: 3409214 - RNA, 14 nt, Human
uccaagaauccaca

SEQ ID NO: 3409215 - RNA, 19 nt, Human
uccaagaauccacauuucu

SEQ ID NO: 3409216 - RNA, 23 nt, Human
uccaagaauccacauuucuaaaa

SEQ ID NO: 3409217 - RNA, 13 nt, Human
uccaagaaugcug

SEQ ID NO: 3409218 - RNA, 14 nt, Human
uccaagaaugcuga

SEQ ID NO: 3409219 - RNA, 16 nt, Human
uccaagaaugcugaaa

SEQ ID NO: 3409220 - RNA, 17 nt, Human
uccaagaaugcugaaac

SEQ ID NO: 3409221 - RNA, 18 nt, Human
uccaagacagaauaauga

SEQ ID NO: 3409222 - RNA, 18 nt, Human
uccaagacaguauacagu

SEQ ID NO: 3409223 - RNA, 22 nt, Human
uccaagacaugucuguucuaca

SEQ ID NO: 3409224 - RNA, 19 nt, Human
uccaagaccuucuccuuca

SEQ ID NO: 3409225 - RNA, 13 nt, Human
uccaagacucuag

SEQ ID NO: 3409226 - RNA, 15 nt, Human
uccaagacucuagag

SEQ ID NO: 3409227 - RNA, 12 nt, Human
uccaagagcuga

SEQ ID NO: 3409228 - RNA, 16 nt, Human
uccaagagucuaaaga

SEQ ID NO: 3409229 - RNA, 17 nt, Human
uccaagagucuaaagau

SEQ ID NO: 3409230 - RNA, 13 nt, Human
uccaagauuccgg

SEQ ID NO: 3409231 - RNA, 15 nt, Human
uccaagauuccggau

SEQ ID NO: 3409232 - RNA, 13 nt, Human
uccaagauucuag

SEQ ID NO: 3409233 - RNA, 14 nt, Human
uccaagauucuaga

SEQ ID NO: 3409234 - RNA, 15 nt, Human
uccaagauucuagau

SEQ ID NO: 3409235 - RNA, 20 nt, Human
uccaagauucuagaugauua

SEQ ID NO: 3409236 - RNA, 13 nt, Human
uccaagcaaaugu

SEQ ID NO: 3409237 - RNA, 15 nt, Human
uccaagcaaauguga

SEQ ID NO: 3409238 - RNA, 14 nt, Human
uccaagcaggacau

SEQ ID NO: 3409239 - RNA, 22 nt, Human
uccaagcaggacauggacaagg

SEQ ID NO: 3409240 - RNA, 21 nt, Human
uccaagcccagcccauggaga

SEQ ID NO: 3409241 - RNA, 16 nt, Human
uccaagccuccacagc

SEQ ID NO: 3409242 - RNA, 20 nt, Human
uccaagccuccacagcgagg

SEQ ID NO: 3409243 - RNA, 21 nt, Human
uccaagccuccacagcgaggg

SEQ ID NO: 3409244 - RNA, 23 nt, Human
uccaagccucucuggcacuuuga

SEQ ID NO: 3409245 - RNA, 15 nt, Human
uccaagcucccaggc

SEQ ID NO: 3409246 - RNA, 15 nt, Human
uccaagcucccugcc

SEQ ID NO: 3409247 - RNA, 17 nt, Human
uccaagcugagagucua

SEQ ID NO: 3409248 - RNA, 12 nt, Human
uccaagcuggga

SEQ ID NO: 3409249 - RNA, 16 nt, Human
uccaagcuggucccac

SEQ ID NO: 3409250 - RNA, 20 nt, Human
uccaagcuggucccacucag

SEQ ID NO: 3409251 - RNA, 21 nt, Human
uccaagcuggucccacucagu

SEQ ID NO: 3409252 - RNA, 12 nt, Human
uccaagcuuuug

SEQ ID NO: 3409253 - RNA, 21 nt, Human
uccaaggaaaccacagcugcu

SEQ ID NO: 3409254 - RNA, 21 nt, Human
uccaaggaagggauguauuug

SEQ ID NO: 3409255 - RNA, 23 nt, Human
uccaaggaagggauguauuugua

SEQ ID NO: 3409256 - RNA, 16 nt, Human
uccaaggacagaaggc

SEQ ID NO: 3409257 - RNA, 15 nt, Human
uccaaggagcugaga

SEQ ID NO: 3409258 - RNA, 21 nt, Human
uccaaggaguuccaugaagac

SEQ ID NO: 3409259 - RNA, 16 nt, Human
uccaagggcuucugca

SEQ ID NO: 3409260 - RNA, 19 nt, Human
uccaagggcuucugcaccc

SEQ ID NO: 3409261 - RNA, 21 nt, Human
uccaaggggaaucagaacuca

SEQ ID NO: 3409262 - RNA, 20 nt, Human
uccaagggguccccuccagg

SEQ ID NO: 3409263 - RNA, 23 nt, Human
uccaagguggucugcucgggccc

SEQ ID NO: 3409264 - RNA, 14 nt, Human
uccaagguuuaaag

SEQ ID NO: 3409265 - RNA, 20 nt, Human
uccaagguuuaaagagucua

SEQ ID NO: 3409266 - RNA, 23 nt, Human
uccaagucacugcaaaaccaggu

SEQ ID NO: 3409267 - RNA, 19 nt, Human
uccaaguccacaguggaac

SEQ ID NO: 3409268 - RNA, 14 nt, Human
uccaagucuccacc

SEQ ID NO: 3409269 - RNA, 17 nt, Human
uccaagugaacacuagc

SEQ ID NO: 3409270 - RNA, 15 nt, Human
uccaagugccaauau

SEQ ID NO: 3409271 - RNA, 19 nt, Human
uccaagugugcauauugua

SEQ ID NO: 3409272 - RNA, 21 nt, Human
uccaagugugcauauuguaca

SEQ ID NO: 3409273 - RNA, 14 nt, Human
uccaaguuaaaugu

SEQ ID NO: 3409274 - RNA, 22 nt, Human
uccaaguuguucgggccaagga

SEQ ID NO: 3409275 - RNA, 14 nt, Human
uccaaguuuccaaa

SEQ ID NO: 3409276 - RNA, 14 nt, Human
uccaauaaaccagg

SEQ ID NO: 3409277 - RNA, 17 nt, Human
uccaauaugugauuuuu

SEQ ID NO: 3409278 - RNA, 19 nt, Human
uccaaucaaucuugcaugu

SEQ ID NO: 3409279 - RNA, 22 nt, Human
uccaaucccauagaugggucug

SEQ ID NO: 3409280 - RNA, 16 nt, Human
uccaauccuauguuuu

SEQ ID NO: 3409281 - RNA, 19 nt, Human
uccaaucuaaccacaucaa

SEQ ID NO: 3409282 - RNA, 15 nt, Human
uccaaucucaaggaa

SEQ ID NO: 3409283 - RNA, 15 nt, Human
uccaaucucauggag

SEQ ID NO: 3409284 - RNA, 22 nt, Human
uccaaucugugaugacauuccc

SEQ ID NO: 3409285 - RNA, 16 nt, Human
uccaaugagcuuucug

SEQ ID NO: 3409286 - RNA, 15 nt, Human
uccaaugucuggaga

SEQ ID NO: 3409287 - RNA, 16 nt, Human
uccaaugucuggagac

SEQ ID NO: 3409288 - RNA, 17 nt, Human
uccaaugucuggagacc

SEQ ID NO: 3409289 - RNA, 23 nt, Human
uccaaugucuggagaccaccagg

SEQ ID NO: 3409290 - RNA, 17 nt, Human
uccaauguuuagcaaau

SEQ ID NO: 3409291 - RNA, 14 nt, Human
uccaauguuucaag

SEQ ID NO: 3409292 - RNA, 15 nt, Human
uccaauguuucaagc

SEQ ID NO: 3409293 - RNA, 17 nt, Human
uccaauuagcuuauguu

SEQ ID NO: 3409294 - RNA, 19 nt, Human
uccaauuaguuuccuuuuu

SEQ ID NO: 3409295 - RNA, 23 nt, Human
uccaauuaguuuccuuuuuaaua

SEQ ID NO: 3409296 - RNA, 22 nt, Human
uccaauuauaagaggauaugaa

SEQ ID NO: 3409297 - RNA, 11 nt, Human
uccaauucuau

SEQ ID NO: 3409298 - RNA, 13 nt, Human
uccaauucuccuu

SEQ ID NO: 3409299 - RNA, 15 nt, Human
uccaauuuuccuuca

SEQ ID NO: 3409300 - RNA, 19 nt, Human
uccacaaagaaaauuccua

SEQ ID NO: 3409301 - RNA, 14 nt, Human
uccacaaauuauua

SEQ ID NO: 3409302 - RNA, 14 nt, Human
uccacaacacacag

SEQ ID NO: 3409303 - RNA, 21 nt, Human
uccacaagacagaagcugaag

SEQ ID NO: 3409304 - RNA, 14 nt, Human
uccacaagagccca

SEQ ID NO: 3409305 - RNA, 21 nt, Human
uccacaagagcccaggccucc

SEQ ID NO: 3409306 - RNA, 17 nt, Human
uccacaagauucccaga

SEQ ID NO: 3409307 - RNA, 19 nt, Human
uccacaagauucccagaga

SEQ ID NO: 3409308 - RNA, 18 nt, Human
uccacaaguuaaauaaau

SEQ ID NO: 3409309 - RNA, 23 nt, Human
uccacacaacauauccguauaua

SEQ ID NO: 3409310 - RNA, 18 nt, Human
uccacacaagggaaggac

SEQ ID NO: 3409311 - RNA, 14 nt, Human
uccacacacacaaa

SEQ ID NO: 3409312 - RNA, 15 nt, Human
uccacacacagagga

SEQ ID NO: 3409313 - RNA, 22 nt, Human
uccacacacagaggaagagcag

SEQ ID NO: 3409314 - RNA, 23 nt, Human
uccacacacagaggaagagcagg

SEQ ID NO: 3409315 - RNA, 14 nt, Human
uccacacacgcagg

SEQ ID NO: 3409316 - RNA, 13 nt, Human
uccacacaugaau

SEQ ID NO: 3409317 - RNA, 17 nt, Human
uccacacaugaaucugc

SEQ ID NO: 3409318 - RNA, 17 nt, Human
uccacaccaagcagcaa

SEQ ID NO: 3409319 - RNA, 19 nt, Human
uccacacccucacugcugu

SEQ ID NO: 3409320 - RNA, 19 nt, Human
uccacacccucucccagga

SEQ ID NO: 3409321 - RNA, 20 nt, Human
uccacacccucucccaggac

SEQ ID NO: 3409322 - RNA, 21 nt, Human
uccacacccucucccaggacc

SEQ ID NO: 3409323 - RNA, 14 nt, Human
uccacaccugcggc

SEQ ID NO: 3409324 - RNA, 18 nt, Human
uccacaccugcggcccaa

SEQ ID NO: 3409325 - RNA, 19 nt, Human
uccacaccuggcacugcug

SEQ ID NO: 3409326 - RNA, 20 nt, Human
uccacaccuggcacugcugu

SEQ ID NO: 3409327 - RNA, 22 nt, Human
uccacagagagggagagcagag

SEQ ID NO: 3409328 - RNA, 23 nt, Human
uccacagagagggagagcagaga

SEQ ID NO: 3409329 - RNA, 18 nt, Human
uccacagagagucccacu

SEQ ID NO: 3409330 - RNA, 21 nt, Human
uccacagagagucccacugcc

SEQ ID NO: 3409331 - RNA, 19 nt, Human
uccacagaggacacagaga

SEQ ID NO: 3409332 - RNA, 17 nt, Human
uccacagaguaagacau

SEQ ID NO: 3409333 - RNA, 19 nt, Human
uccacagaguaagacauug

SEQ ID NO: 3409334 - RNA, 17 nt, Human
uccacagaugccuccac

SEQ ID NO: 3409335 - RNA, 11 nt, Human
uccacagauug

SEQ ID NO: 3409336 - RNA, 14 nt, Human
uccacagccauccc

SEQ ID NO: 3409337 - RNA, 21 nt, Human
uccacagcgagggcagcugcu

SEQ ID NO: 3409338 - RNA, 22 nt, Human
uccacagcgagggcagcugcua

SEQ ID NO: 3409339 - RNA, 23 nt, Human
uccacagcugccucuucccucuu

SEQ ID NO: 3409340 - RNA, 23 nt, Human
uccacagcuuccccucucuccuc

SEQ ID NO: 3409341 - RNA, 12 nt, Human
uccacagggcac

SEQ ID NO: 3409342 - RNA, 12 nt, Human
uccaggcagcac

SEQ ID NO: 3409343 - RNA, 18 nt, Human
uccaggcagccucuguca

SEQ ID NO: 3409344 - RNA, 21 nt, Human
uccaggcaggucugaagcuca

SEQ ID NO: 3409345 - RNA, 11 nt, Human
uccaggcccaa

SEQ ID NO: 3409346 - RNA, 15 nt, Human
uccaggcccaaggcu

SEQ ID NO: 3409347 - RNA, 15 nt, Human
uccaggcccgucugu

SEQ ID NO: 3409348 - RNA, 16 nt, Human
uccaggcccgucuguc

SEQ ID NO: 3409349 - RNA, 17 nt, Human
uccaggcccgucugucc

SEQ ID NO: 3409350 - RNA, 19 nt, Human
uccaggcccgucuguccau

SEQ ID NO: 3409351 - RNA, 22 nt, Human
uccaggcccgucuguccaucug

SEQ ID NO: 3409352 - RNA, 16 nt, Human
uccaggccuacuccug

SEQ ID NO: 3409353 - RNA, 14 nt, Human
uccaggccugccuc

SEQ ID NO: 3409354 - RNA, 16 nt, Human
uccaggcugccguggg

SEQ ID NO: 3409355 - RNA, 14 nt, Human
uccaggcugggaga

SEQ ID NO: 3409356 - RNA, 18 nt, Human
uccaggcugggagagccu

SEQ ID NO: 3409357 - RNA, 20 nt, Human
uccaggcugggagagccuuc

SEQ ID NO: 3409358 - RNA, 15 nt, Human
uccaggcuguguuug

SEQ ID NO: 3409359 - RNA, 17 nt, Human
uccaggcuucugcuggg

SEQ ID NO: 3409360 - RNA, 23 nt, Human
uccaggcuucugcuggggccugg

SEQ ID NO: 3409361 - RNA, 20 nt, Human
uccaggcuuucccacuuccc

SEQ ID NO: 3409362 - RNA, 17 nt, Human
uccagggaagcuggccg

SEQ ID NO: 3409363 - RNA, 18 nt, Human
uccagggaauccaagccu

SEQ ID NO: 3409364 - RNA, 19 nt, Human
uccagggaauccaagccuc

SEQ ID NO: 3409365 - RNA, 23 nt, Human
uccagggacagaggccccagccu

SEQ ID NO: 3409366 - RNA, 17 nt, Human
uccagggaggcuggucc

SEQ ID NO: 3409367 - RNA, 18 nt, Human
uccagggaggcugguccu

SEQ ID NO: 3409368 - RNA, 11 nt, Human
uccagggaggg

SEQ ID NO: 3409369 - RNA, 18 nt, Human
uccagggaugauucaagc

SEQ ID NO: 3409370 - RNA, 20 nt, Human
uccagggaugccaucugugg

SEQ ID NO: 3409371 - RNA, 14 nt, Human
uccagggccagaug

SEQ ID NO: 3409372 - RNA, 17 nt, Human
uccagggcucaacacug

SEQ ID NO: 3409373 - RNA, 13 nt, Human
uccagggcucuga

SEQ ID NO: 3409374 - RNA, 14 nt, Human
uccagggcuggacu

SEQ ID NO: 3409375 - RNA, 21 nt, Human
uccagggcuggacugaggccu

SEQ ID NO: 3409376 - RNA, 17 nt, Human
uccaggggaugggaggu

SEQ ID NO: 3409377 - RNA, 19 nt, Human
uccaggggccccuccagcu

SEQ ID NO: 3409378 - RNA, 23 nt, Human
uccaggggcugcuuccuccugga

SEQ ID NO: 3409379 - RNA, 19 nt, Human
uccagggggaaggccaagg

SEQ ID NO: 3409380 - RNA, 19 nt, Human
uccagggguccuaggccuc

SEQ ID NO: 3409381 - RNA, 17 nt, Human
uccagggguuuacagug

SEQ ID NO: 3409382 - RNA, 17 nt, Human
uccagggucccucugug

SEQ ID NO: 3409383 - RNA, 18 nt, Human
uccagggucccucugugu

SEQ ID NO: 3409384 - RNA, 11 nt, Human
uccaggguggu

SEQ ID NO: 3409385 - RNA, 18 nt, Human
uccagguacgcacagaca

SEQ ID NO: 3409386 - RNA, 16 nt, Human
uccagguaucuccagg

SEQ ID NO: 3409387 - RNA, 17 nt, Human
uccaggucaacagaaug

SEQ ID NO: 3409388 - RNA, 22 nt, Human
uccaggucaacagaaugaaaaa

SEQ ID NO: 3409389 - RNA, 22 nt, Human
uccagguccugguggggcagcu

SEQ ID NO: 3409390 - RNA, 16 nt, Human
uccaggucgggcucag

SEQ ID NO: 3409391 - RNA, 18 nt, Human
uccaggucgggcucagcu

SEQ ID NO: 3409392 - RNA, 21 nt, Human
uccagguggggugaggcagug

SEQ ID NO: 3409393 - RNA, 23 nt, Human
uccagguucaacccacagcuacu

SEQ ID NO: 3409394 - RNA, 16 nt, Human
uccagguuuuucaauu

SEQ ID NO: 3409395 - RNA, 18 nt, Human
uccagguuuuucaauuaa

SEQ ID NO: 3409396 - RNA, 19 nt, Human
uccagguuuuucaauuaaa

SEQ ID NO: 3409397 - RNA, 17 nt, Human
uccaguaagaucacugu

SEQ ID NO: 3409398 - RNA, 22 nt, Human
uccaguaccuugcuucuuacug

SEQ ID NO: 3409399 - RNA, 23 nt, Human
uccaguagcuugggacaaaucaa

SEQ ID NO: 3409400 - RNA, 13 nt, Human
uccaguauucuug

SEQ ID NO: 3409401 - RNA, 20 nt, Human
uccagucaggccuaucuaaa

SEQ ID NO: 3409402 - RNA, 12 nt, Human
uccagucaggcu

SEQ ID NO: 3409403 - RNA, 21 nt, Human
uccagucauuauguuaauauu

SEQ ID NO: 3409404 - RNA, 22 nt, Human
uccaguccccagaacucugccu

SEQ ID NO: 3409405 - RNA, 17 nt, Human
uccagucccccuauccu

SEQ ID NO: 3409406 - RNA, 21 nt, Human
uccagucccccuauccuuggc

SEQ ID NO: 3409407 - RNA, 14 nt, Human
uccaguccugcucu

SEQ ID NO: 3409408 - RNA, 22 nt, Human
uccagucuaaaaauaucugucu

SEQ ID NO: 3409409 - RNA, 16 nt, Human
uccagucuaucauugu

SEQ ID NO: 3409410 - RNA, 16 nt, Human
uccagucucuuguaca

SEQ ID NO: 3409411 - RNA, 18 nt, Human
uccagucuuccaccugga

SEQ ID NO: 3409412 - RNA, 15 nt, Human
uccagucuuccugac

SEQ ID NO: 3409413 - RNA, 14 nt, Human
uccagugaccucuc

SEQ ID NO: 3409414 - RNA, 19 nt, Human
uccagugaggcucugcccu

SEQ ID NO: 3409415 - RNA, 22 nt, Human
uccagugaggcucugcccuugg

SEQ ID NO: 3409416 - RNA, 17 nt, Human
uccagugcaaccacaca

SEQ ID NO: 3409417 - RNA, 18 nt, Human
uccagugccaacaauccu

SEQ ID NO: 3409418 - RNA, 17 nt, Human
uccaguggagguuuguc

SEQ ID NO: 3409419 - RNA, 17 nt, Human
uccaguggccuggcucc

SEQ ID NO: 3409420 - RNA, 20 nt, Human
uccaguggccuggcuccgcu

SEQ ID NO: 3409421 - RNA, 23 nt, Human
uccagugggaggugagaccaccu

SEQ ID NO: 3409422 - RNA, 15 nt, Human
uccagugguugcugu

SEQ ID NO: 3409423 - RNA, 16 nt, Human
uccagugguuugagac

SEQ ID NO: 3409424 - RNA, 17 nt, Human
uccaguguccuuagaac

SEQ ID NO: 3409425 - RNA, 20 nt, Human
uccaguguccuuagaacauu

SEQ ID NO: 3409426 - RNA, 15 nt, Human
uccagugucucacag

SEQ ID NO: 3409427 - RNA, 22 nt, Human
uccaguuaaggaccguggcccu

SEQ ID NO: 3409428 - RNA, 19 nt, Human
uccaguucaugagaaucua

SEQ ID NO: 3409429 - RNA, 23 nt, Human
uccaguucuucgacuguuguuau

SEQ ID NO: 3409430 - RNA, 23 nt, Human
uccaguuggaguuuuuuguacca

SEQ ID NO: 3409431 - RNA, 17 nt, Human
uccaguuugcaccuguc

SEQ ID NO: 3409432 - RNA, 18 nt, Human
uccaguuugcaccugucc

SEQ ID NO: 3409433 - RNA, 18 nt, Human
uccauaaagaagcaauaa

SEQ ID NO: 3409434 - RNA, 20 nt, Human
uccauaaagaagcaauaaag

SEQ ID NO: 3409435 - RNA, 14 nt, Human
uccauaaccccacc

SEQ ID NO: 3409436 - RNA, 21 nt, Human
uccauaaucuggacuccucug

SEQ ID NO: 3409437 - RNA, 23 nt, Human
uccauaaucuggacuccucuguc

SEQ ID NO: 3409438 - RNA, 20 nt, Human
uccauaauguauaaagaaca

SEQ ID NO: 3409439 - RNA, 12 nt, Human
uccauaauuaug

SEQ ID NO: 3409440 - RNA, 19 nt, Human
uccauaauuaugacaguua

SEQ ID NO: 3409441 - RNA, 18 nt, Human
uccauacacacgcugccu

SEQ ID NO: 3409442 - RNA, 19 nt, Human
uccauacacacgcugccuu

SEQ ID NO: 3409443 - RNA, 13 nt, Human
uccauacucagga

SEQ ID NO: 3409444 - RNA, 15 nt, Human
uccauagagagcaag

SEQ ID NO: 3409445 - RNA, 22 nt, Human
uccauaguauauuaaaaauggu

SEQ ID NO: 3409446 - RNA, 19 nt, Human
uccauaguuuugaugacug

SEQ ID NO: 3409447 - RNA, 22 nt, Human
uccauaguuuugaugacuggca

SEQ ID NO: 3409448 - RNA, 20 nt, Human
uccauaucagaacugugcca

SEQ ID NO: 3409449 - RNA, 17 nt, Human
uccauaucuaaccagug

SEQ ID NO: 3409450 - RNA, 14 nt, Human
uccauaucuugcga

SEQ ID NO: 3409451 - RNA, 18 nt, Human
uccauaugaccucaugca

SEQ ID NO: 3409452 - RNA, 24 nt, Human
uccauaugaccucaugcaucucca

SEQ ID NO: 3409453 - RNA, 15 nt, Human
uccauauuagaaaac

SEQ ID NO: 3409454 - RNA, 17 nt, Human
uccauauuagaaaacuu

SEQ ID NO: 3409455 - RNA, 18 nt, Human
uccauauuagaaaacuuu

SEQ ID NO: 3409456 - RNA, 14 nt, Human
uccauauuuggaag

SEQ ID NO: 3409457 - RNA, 15 nt, Human
uccauauuuggaaga

SEQ ID NO: 3409458 - RNA, 19 nt, Human
uccauauuuuauuacuguu

SEQ ID NO: 3409459 - RNA, 20 nt, Human
uccauauuuuauuacuguuu

SEQ ID NO: 3409460 - RNA, 13 nt, Human
uccauauuuucac

SEQ ID NO: 3409461 - RNA, 16 nt, Human
uccauauuuuuacaac

SEQ ID NO: 3409462 - RNA, 17 nt, Human
uccauauuuuuuuccuu

SEQ ID NO: 3409463 - RNA, 18 nt, Human
uccauauuuuuuuccuua

SEQ ID NO: 3409464 - RNA, 22 nt, Human
uccaucaagccaagccuccugu

SEQ ID NO: 3409465 - RNA, 23 nt, Human
uccaucacccucuuccugugauc

SEQ ID NO: 3409466 - RNA, 19 nt, Human
uccaucagguuccaucccg

SEQ ID NO: 3409467 - RNA, 13 nt, Human
uccaucaucaugu

SEQ ID NO: 3409468 - RNA, 13 nt, Human
uccaucauguccc

SEQ ID NO: 3409469 - RNA, 15 nt, Human
uccaucaugucccca

SEQ ID NO: 3409470 - RNA, 16 nt, Human
uccauccagcuugcca

SEQ ID NO: 3409471 - RNA, 18 nt, Human
uccauccagcuugccaga

SEQ ID NO: 3409472 - RNA, 22 nt, Human
uccauccauaaauccaguucua

SEQ ID NO: 3409473 - RNA, 15 nt, Human
uccauccauggccag

SEQ ID NO: 3409474 - RNA, 17 nt, Human
uccaucccaacagccau

SEQ ID NO: 3409475 - RNA, 19 nt, Human
uccaucccaaccagugcca

SEQ ID NO: 3409476 - RNA, 22 nt, Human
uccaucccaggacaccacaccc

SEQ ID NO: 3409477 - RNA, 13 nt, Human
uccaucccuggcc

SEQ ID NO: 3409478 - RNA, 14 nt, Human
uccaucccuggccc

SEQ ID NO: 3409479 - RNA, 23 nt, Human
uccaucccuggcccccucccugg

SEQ ID NO: 3409480 - RNA, 16 nt, Human
uccauccuacccccug

SEQ ID NO: 3409481 - RNA, 20 nt, Human
uccauccuacccccugugcc

SEQ ID NO: 3409482 - RNA, 18 nt, Human
uccauccuccuccuuccu

SEQ ID NO: 3409483 - RNA, 11 nt, Human
uccauccugag

SEQ ID NO: 3409484 - RNA, 12 nt, Human
uccauccugagg

SEQ ID NO: 3409485 - RNA, 13 nt, Human
uccauccugaggc

SEQ ID NO: 3409486 - RNA, 19 nt, Human
uccucuuccccuugcccuu

SEQ ID NO: 3409487 - RNA, 14 nt, Human
uccucuucccucuc

SEQ ID NO: 3409488 - RNA, 18 nt, Human
uccucuucccucucugca

SEQ ID NO: 3409489 - RNA, 12 nt, Human
uccucuuccucu

SEQ ID NO: 3409490 - RNA, 13 nt, Human
uccucuuccucug

SEQ ID NO: 3409491 - RNA, 14 nt, Human
uccucuuccucuga

SEQ ID NO: 3409492 - RNA, 15 nt, Human
uccucuuccucugag

SEQ ID NO: 3409493 - RNA, 21 nt, Human
uccucuuccugaauuuuauuu

SEQ ID NO: 3409494 - RNA, 21 nt, Human
uccucuucggcccucagaugu

SEQ ID NO: 3409495 - RNA, 17 nt, Human
uccucuucugacgugcc

SEQ ID NO: 3409496 - RNA, 13 nt, Human
uccucuucugggc

SEQ ID NO: 3409497 - RNA, 13 nt, Human
uccucuucuuuau

SEQ ID NO: 3409498 - RNA, 17 nt, Human
uccucuugccuccugga

SEQ ID NO: 3409499 - RNA, 20 nt, Human
uccucuuguaaauaaagccc

SEQ ID NO: 3409500 - RNA, 13 nt, Human
uccucuuguccua

SEQ ID NO: 3409501 - RNA, 19 nt, Human
uccucuuuaaaacaaaaca

SEQ ID NO: 3409502 - RNA, 19 nt, Human
uccucuuuaguuuuugguu

SEQ ID NO: 3409503 - RNA, 19 nt, Human
uccucuuuccaucuacccu

SEQ ID NO: 3409504 - RNA, 17 nt, Human
uccucuuugcauggaau

SEQ ID NO: 3409505 - RNA, 15 nt, Human
uccucuuugcuuugc

SEQ ID NO: 3409506 - RNA, 20 nt, Human
uccucuuugcuuugcuuucu

SEQ ID NO: 3409507 - RNA, 15 nt, Human
uccucuuuguuuugu

SEQ ID NO: 3409508 - RNA, 21 nt, Human
uccucuuuuaucuuggacuga

SEQ ID NO: 3409509 - RNA, 18 nt, Human
uccucuuuuccuucccaa

SEQ ID NO: 3409510 - RNA, 18 nt, Human
uccucuuuuguuguuucu

SEQ ID NO: 3409511 - RNA, 21 nt, Human
uccugaaacuauauuuuguca

SEQ ID NO: 3409512 - RNA, 19 nt, Human
uccugaaacuuacacacaa

SEQ ID NO: 3409513 - RNA, 12 nt, Human
uccugaaaucaa

SEQ ID NO: 3409514 - RNA, 15 nt, Human
uccugaaauuucaga

SEQ ID NO: 3409515 - RNA, 13 nt, Human
uccugaacagcau

SEQ ID NO: 3409516 - RNA, 18 nt, Human
uccugaaccgcacagcuc

SEQ ID NO: 3409517 - RNA, 22 nt, Human
uccugaaccgcacagcucagga

SEQ ID NO: 3409518 - RNA, 14 nt, Human
uccugaagaaccag

SEQ ID NO: 3409519 - RNA, 16 nt, Human
uccugaagaaccaguc

SEQ ID NO: 3409520 - RNA, 18 nt, Human
uccugaagaaccaguccc

SEQ ID NO: 3409521 - RNA, 13 nt, Human
uccugaagaauua

SEQ ID NO: 3409522 - RNA, 19 nt, Human
uccugaagaggcgggccag

SEQ ID NO: 3409523 - RNA, 22 nt, Human
uccugaagaggcgggccagcca

SEQ ID NO: 3409524 - RNA, 13 nt, Human
uccugaagccaca

SEQ ID NO: 3409525 - RNA, 21 nt, Human
uccugacacaccugcagccuc

SEQ ID NO: 3409526 - RNA, 16 nt, Human
uccugacaccccacuu

SEQ ID NO: 3409527 - RNA, 19 nt, Human
uccugacacccuucuccca

SEQ ID NO: 3409528 - RNA, 20 nt, Human
uccugacacccuucucccac

SEQ ID NO: 3409529 - RNA, 13 nt, Human
uccugacacugca

SEQ ID NO: 3409530 - RNA, 20 nt, Human
uccugacaucacagcagccu

SEQ ID NO: 3409531 - RNA, 14 nt, Human
uccugacauugucu

SEQ ID NO: 3409532 - RNA, 14 nt, Human
uccugaccacccuc

SEQ ID NO: 3409533 - RNA, 19 nt, Human
uccugaccacccuccccuc

SEQ ID NO: 3409534 - RNA, 11 nt, Human
uccugaccagc

SEQ ID NO: 3409535 - RNA, 14 nt, Human
uccugaccaguugc

SEQ ID NO: 3409536 - RNA, 14 nt, Human
uccugacccaggcc

SEQ ID NO: 3409537 - RNA, 15 nt, Human
uccugacccaguccc

SEQ ID NO: 3409538 - RNA, 15 nt, Human
uccugaccuccgcca

SEQ ID NO: 3409539 - RNA, 14 nt, Human
uccugaccugaggc

SEQ ID NO: 3409540 - RNA, 20 nt, Human
uccugacgaaacuggccccg

SEQ ID NO: 3409541 - RNA, 18 nt, Human
uccugacgagauaagcag

SEQ ID NO: 3409542 - RNA, 21 nt, Human
uccugacggcgcccccagugu

SEQ ID NO: 3409543 - RNA, 18 nt, Human
uccugacgucugaagcuu

SEQ ID NO: 3409544 - RNA, 17 nt, Human
uccugacuauuauguug

SEQ ID NO: 3409545 - RNA, 15 nt, Human
uccugacucugcccc

SEQ ID NO: 3409546 - RNA, 23 nt, Human
uccugacucugcccccugcuggc

SEQ ID NO: 3409547 - RNA, 13 nt, Human
uccugacugcccg

SEQ ID NO: 3409548 - RNA, 14 nt, Human
uccugacuggugcu

SEQ ID NO: 3409549 - RNA, 13 nt, Human
uccugacuguaac

SEQ ID NO: 3409550 - RNA, 22 nt, Human
uccugacuguaacauauucugu

SEQ ID NO: 3409551 - RNA, 16 nt, Human
uccugacuucaggggc

SEQ ID NO: 3409552 - RNA, 21 nt, Human
uccugacuucaggggcugccc

SEQ ID NO: 3409553 - RNA, 24 nt, Human
uccugagaaaaaagguuccgcuug

SEQ ID NO: 3409554 - RNA, 18 nt, Human
uccugagaaagcucaaag

SEQ ID NO: 3409555 - RNA, 18 nt, Human
uccugagaccccuggccu

SEQ ID NO: 3409556 - RNA, 19 nt, Human
uccugagaccccuggccuc

SEQ ID NO: 3409557 - RNA, 20 nt, Human
uccugagauuuccuccuggc

SEQ ID NO: 3409558 - RNA, 12 nt, Human
uccugagcacug

SEQ ID NO: 3409559 - RNA, 13 nt, Human
uccugagcacugc

SEQ ID NO: 3409560 - RNA, 22 nt, Human
uccugagcacugccaggaggga

SEQ ID NO: 3409561 - RNA, 11 nt, Human
uccugagcccc

SEQ ID NO: 3409562 - RNA, 17 nt, Human
uccugagccccagggag

SEQ ID NO: 3409563 - RNA, 16 nt, Human
uccugagcccccagcu

SEQ ID NO: 3409564 - RNA, 14 nt, Human
uccugagccccgcc

SEQ ID NO: 3409565 - RNA, 18 nt, Human
uccugagcucagcgugga

SEQ ID NO: 3409566 - RNA, 12 nt, Human
uccugagcuugg

SEQ ID NO: 3409567 - RNA, 15 nt, Human
uccugagcuuggcca

SEQ ID NO: 3409568 - RNA, 16 nt, Human
uccugagcuuggccag

SEQ ID NO: 3409569 - RNA, 19 nt, Human
uccugagcuuggccagaag

SEQ ID NO: 3409570 - RNA, 20 nt, Human
uccugagcuuggccagaagg

SEQ ID NO: 3409571 - RNA, 15 nt, Human
uccugaggaucagaa

SEQ ID NO: 3409572 - RNA, 18 nt, Human
uccugaggaucagaaagu

SEQ ID NO: 3409573 - RNA, 19 nt, Human
uccugaggcuccacuuggu

SEQ ID NO: 3409574 - RNA, 16 nt, Human
uccugaggcuuuggau

SEQ ID NO: 3409575 - RNA, 16 nt, Human
uccugagggagcucca

SEQ ID NO: 3409576 - RNA, 23 nt, Human
uccugagggaggaccuggggcac

SEQ ID NO: 3409577 - RNA, 20 nt, Human
uccugaggggagacagagca

SEQ ID NO: 3409578 - RNA, 20 nt, Human
uccugaggggcaucugcccc

SEQ ID NO: 3409579 - RNA, 21 nt, Human
uccugaggggcaucugccccu

SEQ ID NO: 3409580 - RNA, 22 nt, Human
uccugaggggcaucugccccuc

SEQ ID NO: 3409581 - RNA, 13 nt, Human
uccugaguagcug

SEQ ID NO: 3409582 - RNA, 20 nt, Human
uccugaguagcugggauuac

SEQ ID NO: 3409583 - RNA, 15 nt, Human
uccugagugcuugcu

SEQ ID NO: 3409584 - RNA, 18 nt, Human
uccugauaaagcacagcu

SEQ ID NO: 3409585 - RNA, 18 nt, Human
uccugauaauaauugauc

SEQ ID NO: 3409586 - RNA, 23 nt, Human
uccugauagcauaugacaaaugu

SEQ ID NO: 3409587 - RNA, 24 nt, Human
uccugauaugauuuaaaacaugua

SEQ ID NO: 3409588 - RNA, 14 nt, Human
uccugaucagagcc

SEQ ID NO: 3409589 - RNA, 15 nt, Human
uccugaucagagccg

SEQ ID NO: 3409590 - RNA, 14 nt, Human
uccugaucugugau

SEQ ID NO: 3409591 - RNA, 18 nt, Human
uccugaugguacaggaaa

SEQ ID NO: 3409592 - RNA, 17 nt, Human
uccugauggucagcucc

SEQ ID NO: 3409593 - RNA, 18 nt, Human
uccugauggucagcuccc

SEQ ID NO: 3409594 - RNA, 19 nt, Human
uccugauggucagcucccu

SEQ ID NO: 3409595 - RNA, 20 nt, Human
uccugauugguuucucuucu

SEQ ID NO: 3409596 - RNA, 21 nt, Human
uccugauugguuucucuucuc

SEQ ID NO: 3409597 - RNA, 23 nt, Human
uccugauuucuagaacccgugac

SEQ ID NO: 3409598 - RNA, 17 nt, Human
uccugcaacucaaggac

SEQ ID NO: 3409599 - RNA, 13 nt, Human
uccugcaaugaaa

SEQ ID NO: 3409600 - RNA, 15 nt, Human
uccugcaaugaaguc

SEQ ID NO: 3409601 - RNA, 20 nt, Human
uccugcaaugaagucucuga

SEQ ID NO: 3409602 - RNA, 21 nt, Human
uccugcaaugaagucucugaa

SEQ ID NO: 3409603 - RNA, 21 nt, Human
uccugcacugacccacagccu

SEQ ID NO: 3409604 - RNA, 15 nt, Human
uccugcacuguuuaa

SEQ ID NO: 3409605 - RNA, 17 nt, Human
uccugcagaccacgccc

SEQ ID NO: 3409606 - RNA, 20 nt, Human
uccugcagcaaacacuccac

SEQ ID NO: 3409607 - RNA, 16 nt, Human
uccugcagccuccucc

SEQ ID NO: 3409608 - RNA, 17 nt, Human
uccugcaggcaggaaca

SEQ ID NO: 3409609 - RNA, 14 nt, Human
uccugcaggccagg

SEQ ID NO: 3409610 - RNA, 22 nt, Human
uccugcagggccagaccugccu

SEQ ID NO: 3409611 - RNA, 18 nt, Human
uccugcagguaaacaguu

SEQ ID NO: 3409612 - RNA, 18 nt, Human
uccugccacauuagaacu

SEQ ID NO: 3409613 - RNA, 19 nt, Human
uccugccacauuagaacuu

SEQ ID NO: 3409614 - RNA, 11 nt, Human
uccugccacca

SEQ ID NO: 3409615 - RNA, 16 nt, Human
uccugccaccacgccc

SEQ ID NO: 3409616 - RNA, 14 nt, Human
uccugccaccaguc

SEQ ID NO: 3409617 - RNA, 22 nt, Human
uccugccaccagucacuguccc

SEQ ID NO: 3409618 - RNA, 18 nt, Human
uccugccaccuggggcag

SEQ ID NO: 3409619 - RNA, 22 nt, Human
uccugccagccccacacagcua

SEQ ID NO: 3409620 - RNA, 13 nt, Human
uccugccaggcau

SEQ ID NO: 3409621 - RNA, 14 nt, Human
uccugccaggcaug

SEQ ID NO: 3409622 - RNA, 15 nt, Human
uccugcccacugaua

SEQ ID NO: 3409623 - RNA, 12 nt, Human
uccugcccagga

SEQ ID NO: 3409624 - RNA, 14 nt, Human
uccugcccaggaga

SEQ ID NO: 3409625 - RNA, 18 nt, Human
uccugcccaggagagcca

SEQ ID NO: 3409626 - RNA, 22 nt, Human
uccugcccaggagagccagccc

SEQ ID NO: 3409627 - RNA, 13 nt, Human
uccugcccagucc

SEQ ID NO: 3409628 - RNA, 15 nt, Human
uccugcccagucccc

SEQ ID NO: 3409629 - RNA, 16 nt, Human
uccugcccaguccccc

SEQ ID NO: 3409630 - RNA, 21 nt, Human
uccugccccaacuccuuccag

SEQ ID NO: 3409631 - RNA, 17 nt, Human
uccuuccccuuucccca

SEQ ID NO: 3409632 - RNA, 17 nt, Human
uccuucccucaaagcuu

SEQ ID NO: 3409633 - RNA, 14 nt, Human
uccuucccugcugu

SEQ ID NO: 3409634 - RNA, 12 nt, Human
uccuucccuggc

SEQ ID NO: 3409635 - RNA, 19 nt, Human
uccuucccugggcugugcu

SEQ ID NO: 3409636 - RNA, 23 nt, Human
uccuuccuaaauuuuccuguccu

SEQ ID NO: 3409637 - RNA, 21 nt, Human
uccuuccuacacccuuggacu

SEQ ID NO: 3409638 - RNA, 13 nt, Human
uccuuccuacccu

SEQ ID NO: 3409639 - RNA, 16 nt, Human
uccuuccucacaccag

SEQ ID NO: 3409640 - RNA, 14 nt, Human
uccuuccucuccuu

SEQ ID NO: 3409641 - RNA, 17 nt, Human
uccuuccucugagccuu

SEQ ID NO: 3409642 - RNA, 16 nt, Human
uccuuccucugaggcu

SEQ ID NO: 3409643 - RNA, 17 nt, Human
uccuuccuggccugaga

SEQ ID NO: 3409644 - RNA, 13 nt, Human
uccuuccugucuu

SEQ ID NO: 3409645 - RNA, 14 nt, Human
uccuuccugucuuc

SEQ ID NO: 3409646 - RNA, 14 nt, Human
uccuuccuguucug

SEQ ID NO: 3409647 - RNA, 19 nt, Human
uccuuccuugcuguccuag

SEQ ID NO: 3409648 - RNA, 23 nt, Human
uccuucuaaucugcuaugcuuga

SEQ ID NO: 3409649 - RNA, 16 nt, Human
uccuucuaguuuccca

SEQ ID NO: 3409650 - RNA, 18 nt, Human
uccuucucccaucucuuc

SEQ ID NO: 3409651 - RNA, 12 nt, Human
uccuucucccuu

SEQ ID NO: 3409652 - RNA, 12 nt, Human
uccuucucuguc

SEQ ID NO: 3409653 - RNA, 15 nt, Human
uccuucucugucuca

SEQ ID NO: 3409654 - RNA, 18 nt, Human
uccuucugccugagcuuc

SEQ ID NO: 3409655 - RNA, 12 nt, Human
uccuucuggccu

SEQ ID NO: 3409656 - RNA, 13 nt, Human
uccuucuggccuu

SEQ ID NO: 3409657 - RNA, 12 nt, Human
uccuucuguccu

SEQ ID NO: 3409658 - RNA, 22 nt, Human
uccuucuuucuaguucagcugc

SEQ ID NO: 3409659 - RNA, 20 nt, Human
uccuucuuugauaauguuaa

SEQ ID NO: 3409660 - RNA, 19 nt, Human
uccuucuuugcccuuuacu

SEQ ID NO: 3409661 - RNA, 15 nt, Human
uccuucuuuuuaaaa

SEQ ID NO: 3409662 - RNA, 18 nt, Human
uccuugaagaacugcagg

SEQ ID NO: 3409663 - RNA, 21 nt, Human
uccuugaaggacuaauagaaa

SEQ ID NO: 3409664 - RNA, 21 nt, Human
uccuugaccagcagaucccag

SEQ ID NO: 3409665 - RNA, 22 nt, Human
uccuugaccugcauuguaaaua

SEQ ID NO: 3409666 - RNA, 17 nt, Human
uccuugaccuuccucug

SEQ ID NO: 3409667 - RNA, 21 nt, Human
uccuugaccuuccucuggggc

SEQ ID NO: 3409668 - RNA, 21 nt, Human
uccuugagacacggagcccag

SEQ ID NO: 3409669 - RNA, 22 nt, Human
uccuugaggggagccaggaggg

SEQ ID NO: 3409670 - RNA, 14 nt, Human
uccuugauaacagc

SEQ ID NO: 3409671 - RNA, 12 nt, Human
uccuugauaaug

SEQ ID NO: 3409672 - RNA, 14 nt, Human
uccuugaucauuuu

SEQ ID NO: 3409673 - RNA, 14 nt, Human
uccuugauuucaaa

SEQ ID NO: 3409674 - RNA, 22 nt, Human
uccuugauuuuagccuucucug

SEQ ID NO: 3409675 - RNA, 23 nt, Human
uccuugauuuuagccuucucugu

SEQ ID NO: 3409676 - RNA, 21 nt, Human
uccuugcacacuccccugcac

SEQ ID NO: 3409677 - RNA, 21 nt, Human
uccuugcaccccucacucugg

SEQ ID NO: 3409678 - RNA, 21 nt, Human
uccuugcagguggggguugcu

SEQ ID NO: 3409679 - RNA, 15 nt, Human
uccuugcuaugauga

SEQ ID NO: 3409680 - RNA, 13 nt, Human
uccuugcucuccc

SEQ ID NO: 3409681 - RNA, 15 nt, Human
uccuugcucugcacc

SEQ ID NO: 3409682 - RNA, 14 nt, Human
uccuugcucugcag

SEQ ID NO: 3409683 - RNA, 16 nt, Human
uccuugcucugcaggc

SEQ ID NO: 3409684 - RNA, 22 nt, Human
uccuugcugcaaggcucuuccu

SEQ ID NO: 3409685 - RNA, 21 nt, Human
uccuugcuguccuaggccaca

SEQ ID NO: 3409686 - RNA, 23 nt, Human
uccuuggcaggcugauuucuagg

SEQ ID NO: 3409687 - RNA, 21 nt, Human
uccuuggcaguggacucagaa

SEQ ID NO: 3409688 - RNA, 20 nt, Human
uccuuggcaugccuuccagc

SEQ ID NO: 3409689 - RNA, 16 nt, Human
uccuuggccaugcaga

SEQ ID NO: 3409690 - RNA, 17 nt, Human
uccuuggccaugcagaa

SEQ ID NO: 3409691 - RNA, 14 nt, Human
uccuuggcccccuu

SEQ ID NO: 3409692 - RNA, 21 nt, Human
uccuuggcccccuuucccggg

SEQ ID NO: 3409693 - RNA, 22 nt, Human
uccuuggccuagcccacccugc

SEQ ID NO: 3409694 - RNA, 16 nt, Human
uccuugggaggaagca

SEQ ID NO: 3409695 - RNA, 19 nt, Human
uccuugggaggaagcagaa

SEQ ID NO: 3409696 - RNA, 21 nt, Human
uccuugggaggaagcagaaua

SEQ ID NO: 3409697 - RNA, 22 nt, Human
uccuugggaggaagcagaauaa

SEQ ID NO: 3409698 - RNA, 14 nt, Human
uccuugggcccuuu

SEQ ID NO: 3409699 - RNA, 16 nt, Human
uccuugggcccuuuga

SEQ ID NO: 3409700 - RNA, 14 nt, Human
uccuuggggcaggc

SEQ ID NO: 3409701 - RNA, 15 nt, Human
uccuuggggcaggca

SEQ ID NO: 3409702 - RNA, 16 nt, Human
uccuuggggcaggcag

SEQ ID NO: 3409703 - RNA, 18 nt, Human
uccuugggggcucccagg

SEQ ID NO: 3409704 - RNA, 14 nt, Human
uccuuggugccugg

SEQ ID NO: 3409705 - RNA, 18 nt, Human
uccuuggugccuggccug

SEQ ID NO: 3409706 - RNA, 18 nt, Human
uccuuggugucgggcaug

SEQ ID NO: 3409707 - RNA, 15 nt, Human
uccuuguauuuaaau

SEQ ID NO: 3409708 - RNA, 13 nt, Human
uccuugucacugg

SEQ ID NO: 3409709 - RNA, 15 nt, Human
uccuuguccacccac

SEQ ID NO: 3409710 - RNA, 13 nt, Human
uccuuguccccac

SEQ ID NO: 3409711 - RNA, 19 nt, Human
uccuuguccccacacuccu

SEQ ID NO: 3409712 - RNA, 16 nt, Human
uccuugucuuggcagc

SEQ ID NO: 3409713 - RNA, 20 nt, Human
uccuugugaugugcacguaa

SEQ ID NO: 3409714 - RNA, 23 nt, Human
uccuugugcaaaauauuugacua

SEQ ID NO: 3409715 - RNA, 12 nt, Human
uccuugugcaug

SEQ ID NO: 3409716 - RNA, 18 nt, Human
uccuuguggccugggccu

SEQ ID NO: 3409717 - RNA, 16 nt, Human
uccuugugggccuggg

SEQ ID NO: 3409718 - RNA, 22 nt, Human
uccuugugguuuaugucaucau

SEQ ID NO: 3409719 - RNA, 23 nt, Human
uccuuguguuacuaaguuuuuau

SEQ ID NO: 3409720 - RNA, 13 nt, Human
uccuuguuuauca

SEQ ID NO: 3409721 - RNA, 13 nt, Human
uccuuguuucaaa

SEQ ID NO: 3409722 - RNA, 14 nt, Human
uccuuguuucaaac

SEQ ID NO: 3409723 - RNA, 22 nt, Human
uccuuuaaaaaaauuuaagugc

SEQ ID NO: 3409724 - RNA, 17 nt, Human
uccuuuaaauccuucca

SEQ ID NO: 3409725 - RNA, 11 nt, Human
uccuuuaacaa

SEQ ID NO: 3409726 - RNA, 14 nt, Human
uccuuuaauaugaa

SEQ ID NO: 3409727 - RNA, 18 nt, Human
uccuuuaauaugaaauuu

SEQ ID NO: 3409728 - RNA, 13 nt, Human
uccuuuacuuucc

SEQ ID NO: 3409729 - RNA, 13 nt, Human
uccuuuagaaaca

SEQ ID NO: 3409730 - RNA, 19 nt, Human
uccuuuagauagcagccug

SEQ ID NO: 3409731 - RNA, 15 nt, Human
uccuuuagcgcccag

SEQ ID NO: 3409732 - RNA, 19 nt, Human
uccuuuaggguucugccuc

SEQ ID NO: 3409733 - RNA, 23 nt, Human
uccuuuaguaaaacuccgaguga

SEQ ID NO: 3409734 - RNA, 13 nt, Human
uccuuuauaauga

SEQ ID NO: 3409735 - RNA, 16 nt, Human
uccuuuauauuuagug

SEQ ID NO: 3409736 - RNA, 14 nt, Human
uccuuuaugugaau

SEQ ID NO: 3409737 - RNA, 20 nt, Human
uccuuuaugugaauuuuuaa

SEQ ID NO: 3409738 - RNA, 18 nt, Human
uccuuucaagguaacugu

SEQ ID NO: 3409739 - RNA, 18 nt, Human
uccuuucacaaccuucug

SEQ ID NO: 3409740 - RNA, 21 nt, Human
uccuuucagggaauuucagga

SEQ ID NO: 3409741 - RNA, 23 nt, Human
uccuuucagggaauuucaggaac

SEQ ID NO: 3409742 - RNA, 19 nt, Human
uccuuucauauaguuagcu

SEQ ID NO: 3409743 - RNA, 20 nt, Human
uccuuucauuuacuguggcu

SEQ ID NO: 3409744 - RNA, 13 nt, Human
uccuuuccaccuu

SEQ ID NO: 3409745 - RNA, 21 nt, Human
uccuuucccaagccuucgggc

SEQ ID NO: 3409746 - RNA, 15 nt, Human
uccuuuccccagccc

SEQ ID NO: 3409747 - RNA, 14 nt, Human
uccuuucuaaacaa

SEQ ID NO: 3409748 - RNA, 22 nt, Human
uccuuucuaacaaaaaaauaua

SEQ ID NO: 3409749 - RNA, 20 nt, Human
uccuuucuagagcacugcca

SEQ ID NO: 3409750 - RNA, 11 nt, Human
uccuuucuauc

SEQ ID NO: 3409751 - RNA, 15 nt, Human
uccuuucuccaggac

SEQ ID NO: 3409752 - RNA, 13 nt, Human
uccuuucucuuuc

SEQ ID NO: 3409753 - RNA, 13 nt, Human
uccuuucugugcc

SEQ ID NO: 3409754 - RNA, 16 nt, Human
uccuuucugugcccua

SEQ ID NO: 3409755 - RNA, 12 nt, Human
uccuuucuuccg

SEQ ID NO: 3409756 - RNA, 20 nt, Human
uccuuucuugguucauaaau

SEQ ID NO: 3409757 - RNA, 13 nt, Human
uccuuucuuuucc

SEQ ID NO: 3409758 - RNA, 14 nt, Human
uccuuucuuuuucu

SEQ ID NO: 3409759 - RNA, 21 nt, Human
uccuuugaauccucucucugu

SEQ ID NO: 3409760 - RNA, 22 nt, Human
uccuuuggagcuuuuuucuuua

SEQ ID NO: 3409761 - RNA, 12 nt, Human
uccuuuguaaaa

SEQ ID NO: 3409762 - RNA, 18 nt, Human
uccuuuguacuuugugcu

SEQ ID NO: 3409763 - RNA, 12 nt, Human
uccuuugucuuc

SEQ ID NO: 3409764 - RNA, 17 nt, Human
uccuuugugaggaagcc

SEQ ID NO: 3409765 - RNA, 17 nt, Human
uccuuuguguguguguc

SEQ ID NO: 3409766 - RNA, 20 nt, Human
uccuuuguguuucuauugac

SEQ ID NO: 3409767 - RNA, 16 nt, Human
uccuuuguucuuaccu

SEQ ID NO: 3409768 - RNA, 19 nt, Human
uccuuuguuuuuuuuuccu

SEQ ID NO: 3409769 - RNA, 23 nt, Human
uccuuuguuuuuuuuuccugucc

SEQ ID NO: 3409770 - RNA, 13 nt, Human
uccuuuuaaagaa

SEQ ID NO: 3409771 - RNA, 15 nt, Human
uccuuuuagccuagu

SEQ ID NO: 3409772 - RNA, 14 nt, Human
uccuuuucauaggu

SEQ ID NO: 3409773 - RNA, 13 nt, Human
uccuuuucccugc

SEQ ID NO: 3409774 - RNA, 18 nt, Human
uccuuuucgcaggauucu

SEQ ID NO: 3409775 - RNA, 15 nt, Human
uccuuuucuguguuu

SEQ ID NO: 3409776 - RNA, 13 nt, Human
uccuuuucuuuaa

SEQ ID NO: 3409777 - RNA, 18 nt, Human
ucuaaaacuguacuuuga

SEQ ID NO: 3409778 - RNA, 12 nt, Human
ucuaaaagacuu

SEQ ID NO: 3409779 - RNA, 17 nt, Human
ucuaaaagcagaaaaua

SEQ ID NO: 3409780 - RNA, 22 nt, Human
ucuaaaaucuuauaguucuagg

SEQ ID NO: 3409781 - RNA, 21 nt, Human
ucuaaaaugccucaguguauu

SEQ ID NO: 3409782 - RNA, 22 nt, Human
ucuaaaaugccucaguguauuu

SEQ ID NO: 3409783 - RNA, 20 nt, Human
ucuaaaaugugauguucuaa

SEQ ID NO: 3409784 - RNA, 14 nt, Human
ucuaaaauuacaua

SEQ ID NO: 3409785 - RNA, 19 nt, Human
ucuaaacccaauccaaaug

SEQ ID NO: 3409786 - RNA, 21 nt, Human
ucuaaacuggauucacagcuc

SEQ ID NO: 3409787 - RNA, 22 nt, Human
ucuaaagaccaaacuucacucu

SEQ ID NO: 3409788 - RNA, 20 nt, Human
ucuaaagaguuuauuuuaag

SEQ ID NO: 3409789 - RNA, 18 nt, Human
ucuaaagauggaguuucu

SEQ ID NO: 3409790 - RNA, 22 nt, Human
ucuaaagauucuauaguucuag

SEQ ID NO: 3409791 - RNA, 12 nt, Human
ucuaaagcaaau

SEQ ID NO: 3409792 - RNA, 18 nt, Human
ucuaaagccuuaagucuu

SEQ ID NO: 3409793 - RNA, 12 nt, Human
ucuaaagcucug

SEQ ID NO: 3409794 - RNA, 14 nt, Human
ucuaaagcugccag

SEQ ID NO: 3409795 - RNA, 21 nt, Human
ucuaaagcugguuuaauguuu

SEQ ID NO: 3409796 - RNA, 20 nt, Human
ucuaaaggcuaccuuuguau

SEQ ID NO: 3409797 - RNA, 15 nt, Human
ucuaaagguccacag

SEQ ID NO: 3409798 - RNA, 22 nt, Human
ucuaaagguccacaggucuaga

SEQ ID NO: 3409799 - RNA, 16 nt, Human
ucuaaaguacugagca

SEQ ID NO: 3409800 - RNA, 13 nt, Human
ucuaaaguucuaa

SEQ ID NO: 3409801 - RNA, 15 nt, Human
ucuaaaguuuacagu

SEQ ID NO: 3409802 - RNA, 18 nt, Human
ucuaaaguuuacaguaaa

SEQ ID NO: 3409803 - RNA, 17 nt, Human
ucuaaauaaaauauaau

SEQ ID NO: 3409804 - RNA, 22 nt, Human
ucuaaauaucccuuggacauuu

SEQ ID NO: 3409805 - RNA, 14 nt, Human
ucuaaaucuauuua

SEQ ID NO: 3409806 - RNA, 21 nt, Human
ucuaaaucuccaaaauaaaac

SEQ ID NO: 3409807 - RNA, 21 nt, Human
ucuaaaucuguccaacugaga

SEQ ID NO: 3409808 - RNA, 17 nt, Human
ucuaaauucuuuauuuc

SEQ ID NO: 3409809 - RNA, 15 nt, Human
ucuaaauugaauaau

SEQ ID NO: 3409810 - RNA, 23 nt, Human
ucuaaauuugaauguuaagcaga

SEQ ID NO: 3409811 - RNA, 23 nt, Human
ucuaaauuuuauaucuuguagcu

SEQ ID NO: 3409812 - RNA, 19 nt, Human
ucuaacaaaaaaauauauu

SEQ ID NO: 3409813 - RNA, 13 nt, Human
ucuaacaaugaca

SEQ ID NO: 3409814 - RNA, 13 nt, Human
ucuaacagauuag

SEQ ID NO: 3409815 - RNA, 14 nt, Human
ucuaacagcaccaa

SEQ ID NO: 3409816 - RNA, 15 nt, Human
ucuaacagcucagga

SEQ ID NO: 3409817 - RNA, 18 nt, Human
ucuaacaggggcuggugg

SEQ ID NO: 3409818 - RNA, 24 nt, Human
ucuaacaggggcuggugggcacca

SEQ ID NO: 3409819 - RNA, 16 nt, Human
ucuaaccacagcuccu

SEQ ID NO: 3409820 - RNA, 20 nt, Human
ucuaaccacagcuccuuuuc

SEQ ID NO: 3409821 - RNA, 13 nt, Human
ucuaaccagugau

SEQ ID NO: 3409822 - RNA, 16 nt, Human
ucuaaccccaggcccc

SEQ ID NO: 3409823 - RNA, 17 nt, Human
ucuaaccccaggccccg

SEQ ID NO: 3409824 - RNA, 23 nt, Human
ucuaacccuaggcaucacaugcu

SEQ ID NO: 3409825 - RNA, 19 nt, Human
ucuaacccuauacuguagu

SEQ ID NO: 3409826 - RNA, 20 nt, Human
ucuaacccucccauggcacc

SEQ ID NO: 3409827 - RNA, 13 nt, Human
ucuaaccucaucu

SEQ ID NO: 3409828 - RNA, 14 nt, Human
ucuaaccugugacc

SEQ ID NO: 3409829 - RNA, 12 nt, Human
ucuaaccuugaa

SEQ ID NO: 3409830 - RNA, 17 nt, Human
ucuaaccuugaaugcug

SEQ ID NO: 3409831 - RNA, 19 nt, Human
ucuaaccuugaaugcugcc

SEQ ID NO: 3409832 - RNA, 16 nt, Human
ucuaaccuuuacauga

SEQ ID NO: 3409833 - RNA, 13 nt, Human
ucuaacgccugag

SEQ ID NO: 3409834 - RNA, 14 nt, Human
ucuaacgccugagc

SEQ ID NO: 3409835 - RNA, 22 nt, Human
ucuaacggucuguucuguuuca

SEQ ID NO: 3409836 - RNA, 16 nt, Human
ucuaacucagaauuau

SEQ ID NO: 3409837 - RNA, 18 nt, Human
ucuaacucagaauuauuu

SEQ ID NO: 3409838 - RNA, 16 nt, Human
ucuaacucugauguaa

SEQ ID NO: 3409839 - RNA, 20 nt, Human
ucuaacucugauguaaauga

SEQ ID NO: 3409840 - RNA, 18 nt, Human
ucuaacuguauauuugua

SEQ ID NO: 3409841 - RNA, 21 nt, Human
ucuaacuuaagaaauaaauca

SEQ ID NO: 3409842 - RNA, 16 nt, Human
ucuaacuucaccauau

SEQ ID NO: 3409843 - RNA, 16 nt, Human
ucuaagaaacauugga

SEQ ID NO: 3409844 - RNA, 17 nt, Human
ucuaagaaacauuggaa

SEQ ID NO: 3409845 - RNA, 22 nt, Human
ucuaagaaacauuuauauugau

SEQ ID NO: 3409846 - RNA, 16 nt, Human
ucuaagaaauaucugu

SEQ ID NO: 3409847 - RNA, 21 nt, Human
ucuaagaaauaucugugaaau

SEQ ID NO: 3409848 - RNA, 22 nt, Human
ucuaagaaauaucugugaaaua

SEQ ID NO: 3409849 - RNA, 16 nt, Human
ucuaagaaauugaaua

SEQ ID NO: 3409850 - RNA, 24 nt, Human
ucuaagaaauugaauacuuugaau

SEQ ID NO: 3409851 - RNA, 14 nt, Human
ucuaagaauaauaa

SEQ ID NO: 3409852 - RNA, 17 nt, Human
ucuaagaauacagcuuu

SEQ ID NO: 3409853 - RNA, 21 nt, Human
ucuaagacucaaauguucuaa

SEQ ID NO: 3409854 - RNA, 22 nt, Human
ucuaagacucaaauguucuaag

SEQ ID NO: 3409855 - RNA, 12 nt, Human
ucuaagagaagu

SEQ ID NO: 3409856 - RNA, 20 nt, Human
ucuaagaugugauauucuaa

SEQ ID NO: 3409857 - RNA, 21 nt, Human
ucuaagauguuauauuuuucu

SEQ ID NO: 3409858 - RNA, 22 nt, Human
ucuaagauguuauauuuuucuu

SEQ ID NO: 3409859 - RNA, 18 nt, Human
ucuaagauucuaaagguc

SEQ ID NO: 3409860 - RNA, 14 nt, Human
ucuaagcagcauuu

SEQ ID NO: 3409861 - RNA, 15 nt, Human
ucuaagccugaaggg

SEQ ID NO: 3409862 - RNA, 22 nt, Human
ucuaaggaagaucacuuugcuc

SEQ ID NO: 3409863 - RNA, 20 nt, Human
ucuaaggaugucacagggcc

SEQ ID NO: 3409864 - RNA, 15 nt, Human
ucuaaggcaggaugu

SEQ ID NO: 3409865 - RNA, 21 nt, Human
ucuaaggccuaggauucuaaa

SEQ ID NO: 3409866 - RNA, 14 nt, Human
ucuaaggcucugag

SEQ ID NO: 3409867 - RNA, 15 nt, Human
ucuaaggcucugaga

SEQ ID NO: 3409868 - RNA, 20 nt, Human
ucuaaggcucugagagucua

SEQ ID NO: 3409869 - RNA, 23 nt, Human
ucuaaggcucugagagucuagau

SEQ ID NO: 3409870 - RNA, 15 nt, Human
ucuaaggucuaucaa

SEQ ID NO: 3409871 - RNA, 18 nt, Human
ucuaagguucucauagga

SEQ ID NO: 3409872 - RNA, 21 nt, Human
ucuaaguaaaaccacagcagu

SEQ ID NO: 3409873 - RNA, 15 nt, Human
ucuaaguaaauacaa

SEQ ID NO: 3409874 - RNA, 16 nt, Human
ucuaagucauguaugu

SEQ ID NO: 3409875 - RNA, 20 nt, Human
ucuaagucauguauguuucu

SEQ ID NO: 3409876 - RNA, 20 nt, Human
ucuaagucgguuaaaaugga

SEQ ID NO: 3409877 - RNA, 13 nt, Human
ucuaagucuuucc

SEQ ID NO: 3409878 - RNA, 18 nt, Human
ucuaaguuaauuuaaagu

SEQ ID NO: 3409879 - RNA, 21 nt, Human
ucuaaguuaauuuaaaguugu

SEQ ID NO: 3409880 - RNA, 22 nt, Human
ucuaaguuauaagacucucaca

SEQ ID NO: 3409881 - RNA, 18 nt, Human
ucuaaguuucuaagauuc

SEQ ID NO: 3409882 - RNA, 11 nt, Human
ucuaauaaacu

SEQ ID NO: 3409883 - RNA, 14 nt, Human
ucuaauaaauuaua

SEQ ID NO: 3409884 - RNA, 18 nt, Human
ucuaauaagcuaguugaa

SEQ ID NO: 3409885 - RNA, 13 nt, Human
ucuaauaauaaau

SEQ ID NO: 3409886 - RNA, 16 nt, Human
ucuaauaauuucuaau

SEQ ID NO: 3409887 - RNA, 17 nt, Human
ucuaauaauuucuaaug

SEQ ID NO: 3409888 - RNA, 14 nt, Human
ucuaauaccucugu

SEQ ID NO: 3409889 - RNA, 17 nt, Human
ucuaauaccucugugug

SEQ ID NO: 3409890 - RNA, 20 nt, Human
ucuaauaccucugugugcuc

SEQ ID NO: 3409891 - RNA, 16 nt, Human
ucuaauagggcaauua

SEQ ID NO: 3409892 - RNA, 13 nt, Human
ucuaauagugcuu

SEQ ID NO: 3409893 - RNA, 17 nt, Human
ucuaauauuaaaaauau

SEQ ID NO: 3409894 - RNA, 18 nt, Human
ucuaaucaugaaacuccc

SEQ ID NO: 3409895 - RNA, 20 nt, Human
ucuaaucugcuaugcuugaa

SEQ ID NO: 3409896 - RNA, 20 nt, Human
ucuaaucugugcuguuucaa

SEQ ID NO: 3409897 - RNA, 22 nt, Human
ucuaaugaggagagaaaauaua

SEQ ID NO: 3409898 - RNA, 16 nt, Human
ucuaaugauggcccau

SEQ ID NO: 3409899 - RNA, 15 nt, Human
ucuaaugcucacgcu

SEQ ID NO: 3409900 - RNA, 20 nt, Human
ucuaauggguauuuaaacaa

SEQ ID NO: 3409901 - RNA, 17 nt, Human
ucuaauguauuuuauug

SEQ ID NO: 3409902 - RNA, 20 nt, Human
ucuaaugugguuauuucucu

SEQ ID NO: 3409903 - RNA, 14 nt, Human
ucuaaugugugaau

SEQ ID NO: 3409904 - RNA, 17 nt, Human
ucuaauguuugcauaua

SEQ ID NO: 3409905 - RNA, 18 nt, Human
ucuaauuaaccuuacuaa

SEQ ID NO: 3409906 - RNA, 21 nt, Human
ucuaauucccauuuugcaaaa

SEQ ID NO: 3409907 - RNA, 16 nt, Human
ucuaauuccuguuugu

SEQ ID NO: 3409908 - RNA, 12 nt, Human
ucuaauucuaac

SEQ ID NO: 3409909 - RNA, 17 nt, Human
ucuaauucuuccuuugu

SEQ ID NO: 3409910 - RNA, 21 nt, Human
ucuaauucuuccuuuguaaaa

SEQ ID NO: 3409911 - RNA, 19 nt, Human
ucuaauugcaucucaaaau

SEQ ID NO: 3409912 - RNA, 14 nt, Human
ucuaauugcuuauu

SEQ ID NO: 3409913 - RNA, 13 nt, Human
ucuaauuuauaaa

SEQ ID NO: 3409914 - RNA, 14 nt, Human
ucuaauuuauaaaa

SEQ ID NO: 3409915 - RNA, 22 nt, Human
ucuaauuuaucuugucucuggg

SEQ ID NO: 3409916 - RNA, 15 nt, Human
ucuaauuugcugcug

SEQ ID NO: 3409917 - RNA, 14 nt, Human
ucuaauuuuuaaga

SEQ ID NO: 3409918 - RNA, 15 nt, Human
ucuaauuuuuaagaa

SEQ ID NO: 3409919 - RNA, 17 nt, Human
ucuaauuuuuauucaua

SEQ ID NO: 3409920 - RNA, 17 nt, Human
ucuacaacucauacacu

SEQ ID NO: 3409921 - RNA, 16 nt, Human
ucugcugaauuuucac

SEQ ID NO: 3409922 - RNA, 17 nt, Human
ucugcugaauuuucaca

SEQ ID NO: 3409923 - RNA, 19 nt, Human
ucugcugacagacacaggc

SEQ ID NO: 3409924 - RNA, 15 nt, Human
ucugcugaccugcug

SEQ ID NO: 3409925 - RNA, 12 nt, Human
ucugcugagggu

SEQ ID NO: 3409926 - RNA, 16 nt, Human
ucugcugcagagcagu

SEQ ID NO: 3409927 - RNA, 13 nt, Human
ucugcugcuggcu

SEQ ID NO: 3409928 - RNA, 17 nt, Human
ucugcugcuggcugguu

SEQ ID NO: 3409929 - RNA, 21 nt, Human
ucugcuggccgggcacagcug

SEQ ID NO: 3409930 - RNA, 23 nt, Human
ucugcuggccgggcacagcugug

SEQ ID NO: 3409931 - RNA, 14 nt, Human
ucugcuggccucug

SEQ ID NO: 3409932 - RNA, 16 nt, Human
ucugcuggccucugcg

SEQ ID NO: 3409933 - RNA, 19 nt, Human
ucugcuggccucugcgagu

SEQ ID NO: 3409934 - RNA, 15 nt, Human
ucugcuggccuggau

SEQ ID NO: 3409935 - RNA, 15 nt, Human
ucugcuggccuggcc

SEQ ID NO: 3409936 - RNA, 12 nt, Human
ucugcugggcug

SEQ ID NO: 3409937 - RNA, 17 nt, Human
ucugcugggcuggggcc

SEQ ID NO: 3409938 - RNA, 22 nt, Human
ucugcugggcuggggccugaug

SEQ ID NO: 3409939 - RNA, 19 nt, Human
ucugcuggggccugggaca

SEQ ID NO: 3409940 - RNA, 20 nt, Human
ucugcuggucacuucuucug

SEQ ID NO: 3409941 - RNA, 16 nt, Human
ucugcugguuuuaaca

SEQ ID NO: 3409942 - RNA, 12 nt, Human
ucugcuguagaa

SEQ ID NO: 3409943 - RNA, 18 nt, Human
ucugcugucagucugcuu

SEQ ID NO: 3409944 - RNA, 17 nt, Human
ucugcuguccagacagc

SEQ ID NO: 3409945 - RNA, 21 nt, Human
ucugcuguccagacagccugu

SEQ ID NO: 3409946 - RNA, 17 nt, Human
ucugcuguccccuuggc

SEQ ID NO: 3409947 - RNA, 16 nt, Human
ucugcugucucagccu

SEQ ID NO: 3409948 - RNA, 22 nt, Human
ucugcugugggcacaggucagg

SEQ ID NO: 3409949 - RNA, 16 nt, Human
ucugcuguuccagugg

SEQ ID NO: 3409950 - RNA, 21 nt, Human
ucugcuguucucuagaaagaa

SEQ ID NO: 3409951 - RNA, 16 nt, Human
ucugcuuaaaaacuca

SEQ ID NO: 3409952 - RNA, 19 nt, Human
ucugcuuacaauucccugc

SEQ ID NO: 3409953 - RNA, 22 nt, Human
ucugcuuacaauucccugcugu

SEQ ID NO: 3409954 - RNA, 14 nt, Human
ucugcuuagaaaua

SEQ ID NO: 3409955 - RNA, 16 nt, Human
ucugcuuagaaauaac

SEQ ID NO: 3409956 - RNA, 16 nt, Human
ucugcuuauccuucca

SEQ ID NO: 3409957 - RNA, 19 nt, Human
ucugcuucaauaaaucuuu

SEQ ID NO: 3409958 - RNA, 13 nt, Human
ucugcuucagccu

SEQ ID NO: 3409959 - RNA, 13 nt, Human
ucugcuucagcuu

SEQ ID NO: 3409960 - RNA, 12 nt, Human
ucugcuucccag

SEQ ID NO: 3409961 - RNA, 22 nt, Human
ucugcuucccagguucaagcga

SEQ ID NO: 3409962 - RNA, 16 nt, Human
ucugcuucucugacuu

SEQ ID NO: 3409963 - RNA, 16 nt, Human
ucugcuugccaucccu

SEQ ID NO: 3409964 - RNA, 17 nt, Human
ucugcuugccaucccuc

SEQ ID NO: 3409965 - RNA, 23 nt, Human
ucugcuugccaucccucccucca

SEQ ID NO: 3409966 - RNA, 21 nt, Human
ucugcuuuaaagggccugccu

SEQ ID NO: 3409967 - RNA, 13 nt, Human
ucugcuuuccucu

SEQ ID NO: 3409968 - RNA, 18 nt, Human
ucugcuuuccucuuccug

SEQ ID NO: 3409969 - RNA, 19 nt, Human
ucugcuuucuuugauucuc

SEQ ID NO: 3409970 - RNA, 20 nt, Human
ucugcuuugcucuucaagaa

SEQ ID NO: 3409971 - RNA, 22 nt, Human
ucugcuuugggguuuaucagaa

SEQ ID NO: 3409972 - RNA, 22 nt, Human
ucugcuuuguugugugccucua

SEQ ID NO: 3409973 - RNA, 13 nt, Human
ucugcuuuuaucu

SEQ ID NO: 3409974 - RNA, 13 nt, Human
ucugcuuuuauua

SEQ ID NO: 3409975 - RNA, 16 nt, Human
ucugcuuuucugcccu

SEQ ID NO: 3409976 - RNA, 19 nt, Human
ucugcuuuucugcccuggc

SEQ ID NO: 3409977 - RNA, 20 nt, Human
ucuggaaaccucuacauauu

SEQ ID NO: 3409978 - RNA, 14 nt, Human
ucuggaacccagac

SEQ ID NO: 3409979 - RNA, 22 nt, Human
ucuggaacccagacucagacau

SEQ ID NO: 3409980 - RNA, 15 nt, Human
ucuggaaccucagcc

SEQ ID NO: 3409981 - RNA, 13 nt, Human
ucuggaagagagg

SEQ ID NO: 3409982 - RNA, 17 nt, Human
ucuggaagccccugggc

SEQ ID NO: 3409983 - RNA, 13 nt, Human
ucuggaagggcca

SEQ ID NO: 3409984 - RNA, 18 nt, Human
ucuggaagugacuuuggc

SEQ ID NO: 3409985 - RNA, 19 nt, Human
ucuggaagugacuuuggcu

SEQ ID NO: 3409986 - RNA, 19 nt, Human
ucuggaauaaggagaauga

SEQ ID NO: 3409987 - RNA, 20 nt, Human
ucuggaauaugcaacauugu

SEQ ID NO: 3409988 - RNA, 22 nt, Human
ucuggaauguaaucaauguuuc

SEQ ID NO: 3409989 - RNA, 14 nt, Human
ucuggaaugugaag

SEQ ID NO: 3409990 - RNA, 15 nt, Human
ucuggaauuguggcu

SEQ ID NO: 3409991 - RNA, 19 nt, Human
ucuggaauuuaaggcccaa

SEQ ID NO: 3409992 - RNA, 21 nt, Human
ucuggacaggcauguucucug

SEQ ID NO: 3409993 - RNA, 18 nt, Human
ucuggacagucagcucuu

SEQ ID NO: 3409994 - RNA, 22 nt, Human
ucuggaccaacccuguuuccug

SEQ ID NO: 3409995 - RNA, 17 nt, Human
ucuggaccccaucugug

SEQ ID NO: 3409996 - RNA, 18 nt, Human
ucuggaccccaucuguga

SEQ ID NO: 3409997 - RNA, 20 nt, Human
ucuggaccuuguuguuguua

SEQ ID NO: 3409998 - RNA, 21 nt, Human
ucuggacggcaggcucacugc

SEQ ID NO: 3409999 - RNA, 23 nt, Human
ucuggacggcaggcucacugcca

SEQ ID NO: 3410000 - RNA, 20 nt, Human
ucuggacucuaaagaccaaa

SEQ ID NO: 3410001 - RNA, 14 nt, Human
ucuggacucuggac

SEQ ID NO: 3410002 - RNA, 13 nt, Human
ucuggacugaagc

SEQ ID NO: 3410003 - RNA, 21 nt, Human
ucuggacugaagccugcagga

SEQ ID NO: 3410004 - RNA, 19 nt, Human
ucuggacuuggcaacagaa

SEQ ID NO: 3410005 - RNA, 21 nt, Human
ucuggagaaagggcccugggc

SEQ ID NO: 3410006 - RNA, 11 nt, Human
ucuggagaagc

SEQ ID NO: 3410007 - RNA, 22 nt, Human
ucuggagaagcucccaggaaca

SEQ ID NO: 3410008 - RNA, 19 nt, Human
ucuggagaccaccagggca

SEQ ID NO: 3410009 - RNA, 20 nt, Human
ucuggagaccaccagggcau

SEQ ID NO: 3410010 - RNA, 15 nt, Human
ucuggagaccaggga

SEQ ID NO: 3410011 - RNA, 13 nt, Human
ucuggagagcuag

SEQ ID NO: 3410012 - RNA, 20 nt, Human
ucuggagagcuagaaccugg

SEQ ID NO: 3410013 - RNA, 22 nt, Human
ucuggagagguuauaggucacu

SEQ ID NO: 3410014 - RNA, 13 nt, Human
ucuggagccaccu

SEQ ID NO: 3410015 - RNA, 15 nt, Human
ucuggagccaccugu

SEQ ID NO: 3410016 - RNA, 20 nt, Human
ucuggagccaccugucccac

SEQ ID NO: 3410017 - RNA, 23 nt, Human
ucuggagccaccugucccaccuc

SEQ ID NO: 3410018 - RNA, 22 nt, Human
ucuggagccagccgagcaggag

SEQ ID NO: 3410019 - RNA, 12 nt, Human
ucuggagcccac

SEQ ID NO: 3410020 - RNA, 23 nt, Human
ucuggagcccacuguacuugcuc

SEQ ID NO: 3410021 - RNA, 16 nt, Human
ucuggagcccuaaccc

SEQ ID NO: 3410022 - RNA, 21 nt, Human
ucuggagcccuaaccccuucc

SEQ ID NO: 3410023 - RNA, 23 nt, Human
ucuggagcccuaaccccuuccag

SEQ ID NO: 3410024 - RNA, 14 nt, Human
ucuggaggaaaggg

SEQ ID NO: 3410025 - RNA, 23 nt, Human
ucuggaggccuuccagcugcugu

SEQ ID NO: 3410026 - RNA, 21 nt, Human
ucuggaggggagggggauccg

SEQ ID NO: 3410027 - RNA, 17 nt, Human
ucuggaggggccccugc

SEQ ID NO: 3410028 - RNA, 17 nt, Human
ucuggagguugauaacu

SEQ ID NO: 3410029 - RNA, 19 nt, Human
ucuggagguugauaacuuu

SEQ ID NO: 3410030 - RNA, 20 nt, Human
ucuggagguugauaacuuug

SEQ ID NO: 3410031 - RNA, 17 nt, Human
ucuggaguugaucugga

SEQ ID NO: 3410032 - RNA, 24 nt, Human
ucuggaguuuuuguuuggagagca

SEQ ID NO: 3410033 - RNA, 21 nt, Human
ucuggauaacuuccacagggu

SEQ ID NO: 3410034 - RNA, 14 nt, Human
ucuggauaggagcc

SEQ ID NO: 3410035 - RNA, 17 nt, Human
ucuggaugcauuucucu

SEQ ID NO: 3410036 - RNA, 21 nt, Human
ucuggauggugugccuuccag

SEQ ID NO: 3410037 - RNA, 17 nt, Human
ucuggauuaggucucug

SEQ ID NO: 3410038 - RNA, 18 nt, Human
ucuggauucagccuucuu

SEQ ID NO: 3410039 - RNA, 16 nt, Human
ucuggauucauauuua

SEQ ID NO: 3410040 - RNA, 22 nt, Human
ucuggauuccagagcacugcuc

SEQ ID NO: 3410041 - RNA, 14 nt, Human
ucuggauucccagg

SEQ ID NO: 3410042 - RNA, 16 nt, Human
ucuggauucugaaucu

SEQ ID NO: 3410043 - RNA, 15 nt, Human
ucuggauucuuggcc

SEQ ID NO: 3410044 - RNA, 14 nt, Human
ucuggauuguggga

SEQ ID NO: 3410045 - RNA, 14 nt, Human
ucuggcaaugccac

SEQ ID NO: 3410046 - RNA, 15 nt, Human
ucuggcaaugccaca

SEQ ID NO: 3410047 - RNA, 20 nt, Human
ucuggcaaugccacagcccu

SEQ ID NO: 3410048 - RNA, 21 nt, Human
ucuggcaaugccacagcccug

SEQ ID NO: 3410049 - RNA, 22 nt, Human
ucuggcacagccuggcuguggc

SEQ ID NO: 3410050 - RNA, 23 nt, Human
ucuggcagaguugaagacagagc

SEQ ID NO: 3410051 - RNA, 22 nt, Human
ucuggcagcaccgccucuuccc

SEQ ID NO: 3410052 - RNA, 11 nt, Human
ucuggcagcca

SEQ ID NO: 3410053 - RNA, 12 nt, Human
ucuggcagccac

SEQ ID NO: 3410054 - RNA, 18 nt, Human
ucuggcagccacacuucu

SEQ ID NO: 3410055 - RNA, 22 nt, Human
ucuggcagccacacuucucagg

SEQ ID NO: 3410056 - RNA, 15 nt, Human
ucuggcagcucagag

SEQ ID NO: 3410057 - RNA, 17 nt, Human
ucuggcagcucagagag

SEQ ID NO: 3410058 - RNA, 18 nt, Human
ucuggcagcucagagagg

SEQ ID NO: 3410059 - RNA, 23 nt, Human
ucuggcaguuuugacaucagcca

SEQ ID NO: 3410060 - RNA, 16 nt, Human
ucuggccaggaagcuu

SEQ ID NO: 3410061 - RNA, 17 nt, Human
ucuggccaggaagcuuu

SEQ ID NO: 3410062 - RNA, 12 nt, Human
ucuggccccccu

SEQ ID NO: 3410063 - RNA, 14 nt, Human
ucuggcccuagacu

SEQ ID NO: 3410064 - RNA, 14 nt, Human
ucuggcccugccuu

SEQ ID NO: 3410065 - RNA, 21 nt, Human
ucugugugcacaaauauuuau

SEQ ID NO: 3410066 - RNA, 18 nt, Human
ucugugugcaccuuacca

SEQ ID NO: 3410067 - RNA, 19 nt, Human
ucugugugggacuguacac

SEQ ID NO: 3410068 - RNA, 18 nt, Human
ucugugugucaguuuuca

SEQ ID NO: 3410069 - RNA, 20 nt, Human
ucugugugugaccccuccug

SEQ ID NO: 3410070 - RNA, 21 nt, Human
ucugugugugaccccuccugg

SEQ ID NO: 3410071 - RNA, 19 nt, Human
ucuguguguguguaugugg

SEQ ID NO: 3410072 - RNA, 15 nt, Human
ucuguguguuccugg

SEQ ID NO: 3410073 - RNA, 20 nt, Human
ucuguguguuuaugugugug

SEQ ID NO: 3410074 - RNA, 21 nt, Human
ucuguguugcauuauucauuu

SEQ ID NO: 3410075 - RNA, 22 nt, Human
ucuguguugcauuauucauuua

SEQ ID NO: 3410076 - RNA, 18 nt, Human
ucuguguuuaauuucuuc

SEQ ID NO: 3410077 - RNA, 20 nt, Human
ucuguguuuacagagauguc

SEQ ID NO: 3410078 - RNA, 17 nt, Human
ucuguguuuauucaaac

SEQ ID NO: 3410079 - RNA, 14 nt, Human
ucuguguuuugaau

SEQ ID NO: 3410080 - RNA, 18 nt, Human
ucuguuaaaauaaaauug

SEQ ID NO: 3410081 - RNA, 14 nt, Human
ucuguuaaaaugca

SEQ ID NO: 3410082 - RNA, 14 nt, Human
ucuguuacaaaaug

SEQ ID NO: 3410083 - RNA, 17 nt, Human
ucuguuacaaaauguaa

SEQ ID NO: 3410084 - RNA, 19 nt, Human
ucuguuacacuuuuuggaa

SEQ ID NO: 3410085 - RNA, 14 nt, Human
ucuguuagaugcua

SEQ ID NO: 3410086 - RNA, 14 nt, Human
ucuguuagggccuu

SEQ ID NO: 3410087 - RNA, 21 nt, Human
ucuguuauagguccuuuagaa

SEQ ID NO: 3410088 - RNA, 15 nt, Human
ucuguuaugggcuuu

SEQ ID NO: 3410089 - RNA, 21 nt, Human
ucuguuaugggcuuuugggga

SEQ ID NO: 3410090 - RNA, 16 nt, Human
ucuguuauguacugua

SEQ ID NO: 3410091 - RNA, 19 nt, Human
ucuguuauguacuguacua

SEQ ID NO: 3410092 - RNA, 22 nt, Human
ucuguucacuuuuccucccuca

SEQ ID NO: 3410093 - RNA, 17 nt, Human
ucuguucaguguaaaua

SEQ ID NO: 3410094 - RNA, 21 nt, Human
ucuguucauuuguuauucuua

SEQ ID NO: 3410095 - RNA, 13 nt, Human
ucuguuccaaauu

SEQ ID NO: 3410096 - RNA, 20 nt, Human
ucuguucccccuucacaaag

SEQ ID NO: 3410097 - RNA, 22 nt, Human
ucuguuccuggcucagccucaa

SEQ ID NO: 3410098 - RNA, 20 nt, Human
ucuguucuacauagaugcuu

SEQ ID NO: 3410099 - RNA, 12 nt, Human
ucuguucugaua

SEQ ID NO: 3410100 - RNA, 23 nt, Human
ucuguucugauauuaauuuauca

SEQ ID NO: 3410101 - RNA, 17 nt, Human
ucuguucugcacacagc

SEQ ID NO: 3410102 - RNA, 19 nt, Human
ucuguucugcacacagcac

SEQ ID NO: 3410103 - RNA, 19 nt, Human
ucuguucuguggaaagugu

SEQ ID NO: 3410104 - RNA, 13 nt, Human
ucuguucuuucca

SEQ ID NO: 3410105 - RNA, 19 nt, Human
ucuguugcaauuaggauuu

SEQ ID NO: 3410106 - RNA, 15 nt, Human
ucuguugccaggcua

SEQ ID NO: 3410107 - RNA, 16 nt, Human
ucuguugcccaggcug

SEQ ID NO: 3410108 - RNA, 19 nt, Human
ucuguugcccaggcuggag

SEQ ID NO: 3410109 - RNA, 11 nt, Human
ucuguuguaac

SEQ ID NO: 3410110 - RNA, 15 nt, Human
ucuguuguaagaaua

SEQ ID NO: 3410111 - RNA, 16 nt, Human
ucuguugucaccuuca

SEQ ID NO: 3410112 - RNA, 17 nt, Human
ucuguugucaccuucac

SEQ ID NO: 3410113 - RNA, 18 nt, Human
ucuguugucauugcuguu

SEQ ID NO: 3410114 - RNA, 15 nt, Human
ucuguuguccucccc

SEQ ID NO: 3410115 - RNA, 15 nt, Human
ucuguuguguucguu

SEQ ID NO: 3410116 - RNA, 22 nt, Human
ucuguuuaaagcauauagagau

SEQ ID NO: 3410117 - RNA, 13 nt, Human
ucuguuuaaagug

SEQ ID NO: 3410118 - RNA, 20 nt, Human
ucuguuuaagaaaaguauuu

SEQ ID NO: 3410119 - RNA, 17 nt, Human
ucuguuuaauacucauc

SEQ ID NO: 3410120 - RNA, 16 nt, Human
ucuguuuagauaauac

SEQ ID NO: 3410121 - RNA, 23 nt, Human
ucuguuuauggccacauuuaaua

SEQ ID NO: 3410122 - RNA, 18 nt, Human
ucuguuucucuuuccuug

SEQ ID NO: 3410123 - RNA, 16 nt, Human
ucuguuugauucuuuu

SEQ ID NO: 3410124 - RNA, 18 nt, Human
ucuguuugcuguggaacu

SEQ ID NO: 3410125 - RNA, 19 nt, Human
ucuguuuggacugcagaag

SEQ ID NO: 3410126 - RNA, 21 nt, Human
ucuguuuggacugcagaagca

SEQ ID NO: 3410127 - RNA, 14 nt, Human
ucuguuuguuaaaa

SEQ ID NO: 3410128 - RNA, 20 nt, Human
ucuguuuuauaauuuuguga

SEQ ID NO: 3410129 - RNA, 13 nt, Human
ucuguuuuaugac

SEQ ID NO: 3410130 - RNA, 12 nt, Human
ucuguuuucaau

SEQ ID NO: 3410131 - RNA, 16 nt, Human
ucuguuuuccuuucuc

SEQ ID NO: 3410132 - RNA, 20 nt, Human
ucuguuuuccuuucucaccg

SEQ ID NO: 3410133 - RNA, 16 nt, Human
ucuguuuugccugaag

SEQ ID NO: 3410134 - RNA, 19 nt, Human
ucuguuuugugguuuggaa

SEQ ID NO: 3410135 - RNA, 13 nt, Human
ucuuaaaaacaac

SEQ ID NO: 3410136 - RNA, 22 nt, Human
ucuuaaaaacaacgaaagaagg

SEQ ID NO: 3410137 - RNA, 12 nt, Human
ucuuaaaaagua

SEQ ID NO: 3410138 - RNA, 21 nt, Human
ucuuaaaaaguuguucaacua

SEQ ID NO: 3410139 - RNA, 24 nt, Human
ucuuaaaagcuaucuucauguaaa

SEQ ID NO: 3410140 - RNA, 23 nt, Human
ucuuaaaaguugugauuccagau

SEQ ID NO: 3410141 - RNA, 21 nt, Human
ucuuaaaauaacuuauaucau

SEQ ID NO: 3410142 - RNA, 20 nt, Human
ucuuaaaauauauuucagau

SEQ ID NO: 3410143 - RNA, 14 nt, Human
ucuuaaaaugcaau

SEQ ID NO: 3410144 - RNA, 16 nt, Human
ucuuaaaauguuucaa

SEQ ID NO: 3410145 - RNA, 17 nt, Human
ucuuaaacaaauguaug

SEQ ID NO: 3410146 - RNA, 15 nt, Human
ucuuaaacuugugaa

SEQ ID NO: 3410147 - RNA, 20 nt, Human
ucuuaaagaaaacccacccc

SEQ ID NO: 3410148 - RNA, 19 nt, Human
ucuuaaagcaaaaaaugaa

SEQ ID NO: 3410149 - RNA, 21 nt, Human
ucuuaaagcugccuguaguua

SEQ ID NO: 3410150 - RNA, 22 nt, Human
ucuuaaauaaaagaaaugcaca

SEQ ID NO: 3410151 - RNA, 16 nt, Human
ucuuaaauaagaaacu

SEQ ID NO: 3410152 - RNA, 23 nt, Human
ucuuaaauuggguucaugaugca

SEQ ID NO: 3410153 - RNA, 13 nt, Human
ucuuaaauuuugu

SEQ ID NO: 3410154 - RNA, 18 nt, Human
ucuuaaauuuugugauau

SEQ ID NO: 3410155 - RNA, 23 nt, Human
ucuuaacacauguccuugugugu

SEQ ID NO: 3410156 - RNA, 12 nt, Human
ucuuaacuucuu

SEQ ID NO: 3410157 - RNA, 14 nt, Human
ucuuaagaaaugua

SEQ ID NO: 3410158 - RNA, 15 nt, Human
ucuuaagacuuuugg

SEQ ID NO: 3410159 - RNA, 16 nt, Human
ucuuaagaggcugaca

SEQ ID NO: 3410160 - RNA, 19 nt, Human
ucuuaagccaucuugguaa

SEQ ID NO: 3410161 - RNA, 20 nt, Human
ucuuaagccaucuugguaaa

SEQ ID NO: 3410162 - RNA, 21 nt, Human
ucuuaagccuuuugcucacaa

SEQ ID NO: 3410163 - RNA, 15 nt, Human
ucuuaaguuucucag

SEQ ID NO: 3410164 - RNA, 15 nt, Human
ucuuaauacuguuau

SEQ ID NO: 3410165 - RNA, 19 nt, Human
ucuuaauacuguuauucuu

SEQ ID NO: 3410166 - RNA, 19 nt, Human
ucuuaauauguucuuuuaa

SEQ ID NO: 3410167 - RNA, 18 nt, Human
ucuuaauauucuggaguc

SEQ ID NO: 3410168 - RNA, 17 nt, Human
ucuuaaugaaguuugaa

SEQ ID NO: 3410169 - RNA, 18 nt, Human
ucuuaaugaaguuugaau

SEQ ID NO: 3410170 - RNA, 18 nt, Human
ucuuaauggaugaaauca

SEQ ID NO: 3410171 - RNA, 15 nt, Human
ucuuaauguaucaaa

SEQ ID NO: 3410172 - RNA, 17 nt, Human
ucuuaauguaucaaacu

SEQ ID NO: 3410173 - RNA, 20 nt, Human
ucuuaauguuccucaaagcu

SEQ ID NO: 3410174 - RNA, 21 nt, Human
ucuuaauguuccucaaagcuu

SEQ ID NO: 3410175 - RNA, 18 nt, Human
ucuuaauuaaaagaauau

SEQ ID NO: 3410176 - RNA, 21 nt, Human
ucuuaauuaaaagaauauuuu

SEQ ID NO: 3410177 - RNA, 14 nt, Human
ucuuaauuaaguaa

SEQ ID NO: 3410178 - RNA, 14 nt, Human
ucuuaauuauuaua

SEQ ID NO: 3410179 - RNA, 10 nt, Human
ucuuaauuuu

SEQ ID NO: 3410180 - RNA, 17 nt, Human
ucuuaauuuugguugua

SEQ ID NO: 3410181 - RNA, 20 nt, Human
ucuuacaaaguguauuuuau

SEQ ID NO: 3410182 - RNA, 19 nt, Human
ucuuacaauaauucuauga

SEQ ID NO: 3410183 - RNA, 21 nt, Human
ucuuacaauauugauugggaa

SEQ ID NO: 3410184 - RNA, 14 nt, Human
ucuuacacauacag

SEQ ID NO: 3410185 - RNA, 13 nt, Human
ucuuacagcaggc

SEQ ID NO: 3410186 - RNA, 19 nt, Human
ucuuacaggcacaaaauga

SEQ ID NO: 3410187 - RNA, 16 nt, Human
ucuuacauaaaccauu

SEQ ID NO: 3410188 - RNA, 15 nt, Human
ucuuacaucugaaau

SEQ ID NO: 3410189 - RNA, 14 nt, Human
ucuuacauguuuuc

SEQ ID NO: 3410190 - RNA, 22 nt, Human
ucuuaccagaugcuuuccuguu

SEQ ID NO: 3410191 - RNA, 16 nt, Human
ucuuacccuucugugc

SEQ ID NO: 3410192 - RNA, 22 nt, Human
ucuuaccgacaagcacagucag

SEQ ID NO: 3410193 - RNA, 21 nt, Human
ucuuaccuguaugucuccagu

SEQ ID NO: 3410194 - RNA, 14 nt, Human
ucuuacuaaacauu

SEQ ID NO: 3410195 - RNA, 15 nt, Human
ucuuacuaauguaaa

SEQ ID NO: 3410196 - RNA, 16 nt, Human
ucuuacuaauguaaaa

SEQ ID NO: 3410197 - RNA, 17 nt, Human
ucuuacuauuaagcagu

SEQ ID NO: 3410198 - RNA, 23 nt, Human
ucuuacuauuaagcaguaaaaac

SEQ ID NO: 3410199 - RNA, 17 nt, Human
ucuuacuccuccucuuu

SEQ ID NO: 3410200 - RNA, 13 nt, Human
ucuuacucugccg

SEQ ID NO: 3410201 - RNA, 14 nt, Human
ucuuacugcaaaug

SEQ ID NO: 3410202 - RNA, 15 nt, Human
ucuuacugcaaaugu

SEQ ID NO: 3410203 - RNA, 22 nt, Human
ucuuacugcaaaugucaucaga

SEQ ID NO: 3410204 - RNA, 12 nt, Human
ucuuacugcuug

SEQ ID NO: 3410205 - RNA, 23 nt, Human
ucuuacuuacuaaaauauauaua

SEQ ID NO: 3410206 - RNA, 16 nt, Human
ucuuacuugagccuuu

SEQ ID NO: 3410207 - RNA, 22 nt, Human
ucuuacuuuccuuuccccagcc

SEQ ID NO: 3410208 - RNA, 14 nt, Human
ucuuacuuuguaaa

SEQ ID NO: 3410209 - RNA, 17 nt, Human
ucuuacuuuguaaauuc

SEQ ID NO: 3410210 - RNA, 14 nt, Human
ucuuagaaaugaag

SEQ ID NO: 3410211 - RNA, 15 nt, Human
ucuuagaaaugaagg

SEQ ID NO: 3410212 - RNA, 13 nt, Human
ucuuagaagaaua

SEQ ID NO: 3410213 - RNA, 20 nt, Human
ucuuagacuucugcuuucca

SEQ ID NO: 3410214 - RNA, 14 nt, Human
ucuuagauaucuuu

SEQ ID NO: 3410215 - RNA, 21 nt, Human
ucuuagauaucuuuuuauuga

SEQ ID NO: 3410216 - RNA, 24 nt, Human
ucuuagauaucuuuuuauugaugu

SEQ ID NO: 3410217 - RNA, 18 nt, Human
ucuuagauggauucucca

SEQ ID NO: 3410218 - RNA, 14 nt, Human
ucuuagauguauau

SEQ ID NO: 3410219 - RNA, 15 nt, Human
ucuuagauguauaua

SEQ ID NO: 3410220 - RNA, 12 nt, Human
ucuuagcugagu

SEQ ID NO: 3410221 - RNA, 14 nt, Human
ucuuagcugccaag

SEQ ID NO: 3410222 - RNA, 17 nt, Human
ucuuagcuuuuuaauug

SEQ ID NO: 3410223 - RNA, 18 nt, Human
ucuuagcuuuuuaauugu

SEQ ID NO: 3410224 - RNA, 14 nt, Human
ucuuaggugcuucu

SEQ ID NO: 3410225 - RNA, 14 nt, Human
ucuuagugccugag

SEQ ID NO: 3410226 - RNA, 14 nt, Human
ucuuagugugugca

SEQ ID NO: 3410227 - RNA, 16 nt, Human
ucuuaguuuggauucu

SEQ ID NO: 3410228 - RNA, 23 nt, Human
ucuuaguuuggauucuuauguag

SEQ ID NO: 3410229 - RNA, 21 nt, Human
ucuuauaaaguggaaguaugu

SEQ ID NO: 3410230 - RNA, 11 nt, Human
ucuuauaaaua

SEQ ID NO: 3410231 - RNA, 13 nt, Human
ucuuauaaauaug

SEQ ID NO: 3410232 - RNA, 19 nt, Human
ucuuauaauacucuguugu

SEQ ID NO: 3410233 - RNA, 20 nt, Human
ucuuauaauacucuguugua

SEQ ID NO: 3410234 - RNA, 13 nt, Human
ucuuauaauuuaa

SEQ ID NO: 3410235 - RNA, 20 nt, Human
ucuuauacagauaaaacaug

SEQ ID NO: 3410236 - RNA, 15 nt, Human
ucuuauacuguacaa

SEQ ID NO: 3410237 - RNA, 13 nt, Human
ucuuauagaaagu

SEQ ID NO: 3410238 - RNA, 19 nt, Human
ucuuauagaauauuuauua

SEQ ID NO: 3410239 - RNA, 20 nt, Human
ucuuauagaauauuuauuac

SEQ ID NO: 3410240 - RNA, 17 nt, Human
ucuuauagcacuuugaa

SEQ ID NO: 3410241 - RNA, 22 nt, Human
ucuuauagucaauguuucuuuu

SEQ ID NO: 3410242 - RNA, 13 nt, Human
ucuuauaguucua

SEQ ID NO: 3410243 - RNA, 17 nt, Human
ucuuauaguucuaggca

SEQ ID NO: 3410244 - RNA, 15 nt, Human
ucuuauauaugugaa

SEQ ID NO: 3410245 - RNA, 23 nt, Human
ucuuaucaagaguugugacaacu

SEQ ID NO: 3410246 - RNA, 13 nt, Human
ucuuaucaagcag

SEQ ID NO: 3410247 - RNA, 16 nt, Human
ucuuaucaagcagcca

SEQ ID NO: 3410248 - RNA, 14 nt, Human
ucuuaucucaguca

SEQ ID NO: 3410249 - RNA, 16 nt, Human
ucuuaugcaaaaugga

SEQ ID NO: 3410250 - RNA, 14 nt, Human
ucuuaugcaauuuc

SEQ ID NO: 3410251 - RNA, 17 nt, Human
ucuuaugcuuauaauau

SEQ ID NO: 3410252 - RNA, 20 nt, Human
ucuuaugcuuccagaaacac

SEQ ID NO: 3410253 - RNA, 17 nt, Human
ucuuauggaauugauuu

SEQ ID NO: 3410254 - RNA, 15 nt, Human
ucuuaugggcugggu

SEQ ID NO: 3410255 - RNA, 18 nt, Human
ucuuaugggcuggguucu

SEQ ID NO: 3410256 - RNA, 13 nt, Human
ucuuaugugacau

SEQ ID NO: 3410257 - RNA, 17 nt, Human
ucuuauuaaaguuucaa

SEQ ID NO: 3410258 - RNA, 19 nt, Human
ucuuauuaaaguuucaaaa

SEQ ID NO: 3410259 - RNA, 17 nt, Human
ucuuauuagggagaaaa

SEQ ID NO: 3410260 - RNA, 22 nt, Human
ucuuauuaguuccccaaauaca

SEQ ID NO: 3410261 - RNA, 18 nt, Human
ucuuauucaaagaaauau

SEQ ID NO: 3410262 - RNA, 18 nt, Human
ucuuauucaguaaaaaac

SEQ ID NO: 3410263 - RNA, 14 nt, Human
ucuuauuccauauu

SEQ ID NO: 3410264 - RNA, 20 nt, Human
ucuuauucccuuccugccag

SEQ ID NO: 3410265 - RNA, 14 nt, Human
ucuuauucuuucgu

SEQ ID NO: 3410266 - RNA, 21 nt, Human
ucuuauucuuucguucaguua

SEQ ID NO: 3410267 - RNA, 14 nt, Human
ucuuauugcccacg

SEQ ID NO: 3410268 - RNA, 22 nt, Human
ucuuauugcccacgcuggagug

SEQ ID NO: 3410269 - RNA, 14 nt, Human
ucuuauuuaacuua

SEQ ID NO: 3410270 - RNA, 17 nt, Human
ucuuauuuaaugaaaga

SEQ ID NO: 3410271 - RNA, 14 nt, Human
ucuuauuucaugaa

SEQ ID NO: 3410272 - RNA, 16 nt, Human
ucuuauuucaugaaaa

SEQ ID NO: 3410273 - RNA, 16 nt, Human
ucuuauuuuucuaaac

SEQ ID NO: 3410274 - RNA, 16 nt, Human
ucuuauuuuuuucuau

SEQ ID NO: 3410275 - RNA, 22 nt, Human
ucuucaaaaguaaugccucugu

SEQ ID NO: 3410276 - RNA, 14 nt, Human
ucuucaaaauguau

SEQ ID NO: 3410277 - RNA, 17 nt, Human
ucuucaaaauguauaua

SEQ ID NO: 3410278 - RNA, 14 nt, Human
ucuucaaacuguga

SEQ ID NO: 3410279 - RNA, 15 nt, Human
ucuucaaauaucucu

SEQ ID NO: 3410280 - RNA, 20 nt, Human
ucuucaaauuagaagacauu

SEQ ID NO: 3410281 - RNA, 11 nt, Human
ucuucaacaga

SEQ ID NO: 3410282 - RNA, 22 nt, Human
ucuucaacauccugccagcccc

SEQ ID NO: 3410283 - RNA, 20 nt, Human
ucuucaaccagggauuguuu

SEQ ID NO: 3410284 - RNA, 12 nt, Human
ucuucaaccagu

SEQ ID NO: 3410285 - RNA, 22 nt, Human
ucuucaagagacccuucaaacu

SEQ ID NO: 3410286 - RNA, 16 nt, Human
ucuucaaggcuucagu

SEQ ID NO: 3410287 - RNA, 17 nt, Human
ucuucaagggcugcuuc

SEQ ID NO: 3410288 - RNA, 20 nt, Human
ucuucaauuuguauaaaaug

SEQ ID NO: 3410289 - RNA, 16 nt, Human
ucuucaccaaaucuug

SEQ ID NO: 3410290 - RNA, 17 nt, Human
ucuucaccccggcaggc

SEQ ID NO: 3410291 - RNA, 22 nt, Human
ucuucaccccggcaggcccugc

SEQ ID NO: 3410292 - RNA, 16 nt, Human
ucuucacucaaauuuu

SEQ ID NO: 3410293 - RNA, 20 nt, Human
ucuucagaaagugugcuuua

SEQ ID NO: 3410294 - RNA, 22 nt, Human
ucuucagacucucagcccagaa

SEQ ID NO: 3410295 - RNA, 18 nt, Human
ucuucagagacuccugca

SEQ ID NO: 3410296 - RNA, 21 nt, Human
ucuucagagacuccugcaggc

SEQ ID NO: 3410297 - RNA, 13 nt, Human
ucuucagagauca

SEQ ID NO: 3410298 - RNA, 16 nt, Human
ucuucagagcaggggu

SEQ ID NO: 3410299 - RNA, 12 nt, Human
ucuucagagcug

SEQ ID NO: 3410300 - RNA, 15 nt, Human
ucuucagaucucuaa

SEQ ID NO: 3410301 - RNA, 18 nt, Human
ucuucagaucucuaacuu

SEQ ID NO: 3410302 - RNA, 17 nt, Human
ucuucagcacaaaagga

SEQ ID NO: 3410303 - RNA, 16 nt, Human
ucuucagccaccucuc

SEQ ID NO: 3410304 - RNA, 16 nt, Human
ucuucagccaucaaca

SEQ ID NO: 3410305 - RNA, 22 nt, Human
ucuucagccucuuucugucccu

SEQ ID NO: 3410306 - RNA, 18 nt, Human
ucuucagcguaaaauggu

SEQ ID NO: 3410307 - RNA, 13 nt, Human
ucuucaggccucc

SEQ ID NO: 3410308 - RNA, 13 nt, Human
ucuucagggccug

SEQ ID NO: 3410309 - RNA, 16 nt, Human
ucuucaguaagccgug

SEQ ID NO: 3410310 - RNA, 22 nt, Human
ucuucagucagaaaacuuuaaa

SEQ ID NO: 3410311 - RNA, 19 nt, Human
ucuucaguuaagccuuugg

SEQ ID NO: 3410312 - RNA, 15 nt, Human
ucuucaguugucucu

SEQ ID NO: 3410313 - RNA, 17 nt, Human
ucuucaguugucucuga

SEQ ID NO: 3410314 - RNA, 21 nt, Human
ucuucaguugucucugaugca

SEQ ID NO: 3410315 - RNA, 12 nt, Human
ucuucaguuuua

SEQ ID NO: 3410316 - RNA, 18 nt, Human
ucuucaguuuuaucuuua

SEQ ID NO: 3410317 - RNA, 19 nt, Human
ucuucaguuuuaucuuuaa

SEQ ID NO: 3410318 - RNA, 21 nt, Human
ucuucauaccuacauguauuu

SEQ ID NO: 3410319 - RNA, 22 nt, Human
ucuucauacuuuuuuucacagu

SEQ ID NO: 3410320 - RNA, 16 nt, Human
ucuucaucccauucca

SEQ ID NO: 3410321 - RNA, 15 nt, Human
ucuucauccuuagca

SEQ ID NO: 3410322 - RNA, 21 nt, Human
ucuucauccuuagcaacagcc

SEQ ID NO: 3410323 - RNA, 18 nt, Human
ucuucaucuaauaugaua

SEQ ID NO: 3410324 - RNA, 14 nt, Human
ucuucaucugccca

SEQ ID NO: 3410325 - RNA, 14 nt, Human
ucuucaugaaaugc

SEQ ID NO: 3410326 - RNA, 18 nt, Human
ucuucauggaauucacaa

SEQ ID NO: 3410327 - RNA, 16 nt, Human
ucuucauggugacacu

SEQ ID NO: 3410328 - RNA, 20 nt, Human
ucuucauguaaauugacugu

SEQ ID NO: 3410329 - RNA, 21 nt, Human
ucuucauguacauuuggaacu

SEQ ID NO: 3410330 - RNA, 22 nt, Human
ucuucauuaagcccucuuccau

SEQ ID NO: 3410331 - RNA, 20 nt, Human
ucuucauucuaucaagccca

SEQ ID NO: 3410332 - RNA, 15 nt, Human
ucuucauuucauugu

SEQ ID NO: 3410333 - RNA, 16 nt, Human
ucuucauuucauugua

SEQ ID NO: 3410334 - RNA, 15 nt, Human
ucuuccaaaggcaua

SEQ ID NO: 3410335 - RNA, 17 nt, Human
ucuuccacaaagaaaau

SEQ ID NO: 3410336 - RNA, 21 nt, Human
ucuuccacaagagcccaggcc

SEQ ID NO: 3410337 - RNA, 13 nt, Human
ucuuccaccugga

SEQ ID NO: 3410338 - RNA, 13 nt, Human
ucuuccacuuugc

SEQ ID NO: 3410339 - RNA, 18 nt, Human
ucuuccagaagugugauu

SEQ ID NO: 3410340 - RNA, 13 nt, Human
ucuuccagaaucc

SEQ ID NO: 3410341 - RNA, 13 nt, Human
ucuuccaggcagc

SEQ ID NO: 3410342 - RNA, 15 nt, Human
ucuuccaggugccca

SEQ ID NO: 3410343 - RNA, 18 nt, Human
ucuuccaggugcccagcu

SEQ ID NO: 3410344 - RNA, 16 nt, Human
ucuuccauaauguaua

SEQ ID NO: 3410345 - RNA, 16 nt, Human
ucuuccaucauguccc

SEQ ID NO: 3410346 - RNA, 15 nt, Human
ucuuccaucccagga

SEQ ID NO: 3410347 - RNA, 19 nt, Human
ucuuccauguaucuuuuga

SEQ ID NO: 3410348 - RNA, 14 nt, Human
ucuuccauuugcaa

SEQ ID NO: 3410349 - RNA, 18 nt, Human
ucuucccaggcuggggcu

SEQ ID NO: 3410350 - RNA, 12 nt, Human
ucuucccagggu

SEQ ID NO: 3410351 - RNA, 13 nt, Human
ucuucccauucuc

SEQ ID NO: 3410352 - RNA, 15 nt, Human
ucuucccauucucca

SEQ ID NO: 3410353 - RNA, 18 nt, Human
ucuucccccucucccagu

SEQ ID NO: 3410354 - RNA, 14 nt, Human
ucuuccccucucag

SEQ ID NO: 3410355 - RNA, 13 nt, Human
ugaauuauugaca

SEQ ID NO: 3410356 - RNA, 14 nt, Human
ugaauuauugacac

SEQ ID NO: 3410357 - RNA, 16 nt, Human
ugaauuauugacacug

SEQ ID NO: 3410358 - RNA, 17 nt, Human
ugaauuauugacacuga

SEQ ID NO: 3410359 - RNA, 17 nt, Human
ugaauucagauuuuaaa

SEQ ID NO: 3410360 - RNA, 16 nt, Human
ugaauucauuucacug

SEQ ID NO: 3410361 - RNA, 12 nt, Human
ugaauucccuca

SEQ ID NO: 3410362 - RNA, 16 nt, Human
ugaauuccuagaauua

SEQ ID NO: 3410363 - RNA, 20 nt, Human
ugaauucuugguugaggaaa

SEQ ID NO: 3410364 - RNA, 21 nt, Human
ugaauucuugguugaggaaac

SEQ ID NO: 3410365 - RNA, 17 nt, Human
ugaauugacuuauuuca

SEQ ID NO: 3410366 - RNA, 18 nt, Human
ugaauugagccuaaaaau

SEQ ID NO: 3410367 - RNA, 18 nt, Human
ugaauugagcugcagaaa

SEQ ID NO: 3410368 - RNA, 21 nt, Human
ugaauugcauuuuuuaaaaca

SEQ ID NO: 3410369 - RNA, 22 nt, Human
ugaauugcguuggucucugcau

SEQ ID NO: 3410370 - RNA, 15 nt, Human
ugaauuguaaaagca

SEQ ID NO: 3410371 - RNA, 21 nt, Human
ugaauuguaaaagcaacauca

SEQ ID NO: 3410372 - RNA, 18 nt, Human
ugaauuguaacuguucuu

SEQ ID NO: 3410373 - RNA, 19 nt, Human
ugaauuguuuuuauuguuu

SEQ ID NO: 3410374 - RNA, 16 nt, Human
ugaauuuaaauauaau

SEQ ID NO: 3410375 - RNA, 20 nt, Human
ugaauuuaaauauaauucug

SEQ ID NO: 3410376 - RNA, 14 nt, Human
ugaauuuaacaaug

SEQ ID NO: 3410377 - RNA, 16 nt, Human
ugaauuuaacaaugcg

SEQ ID NO: 3410378 - RNA, 19 nt, Human
ugaauuuaauaaucuguag

SEQ ID NO: 3410379 - RNA, 21 nt, Human
ugaauuuauaccuaccugugu

SEQ ID NO: 3410380 - RNA, 12 nt, Human
ugaauuuauugg

SEQ ID NO: 3410381 - RNA, 16 nt, Human
ugaauuuauuggcuuu

SEQ ID NO: 3410382 - RNA, 23 nt, Human
ugaauuuauuggcuuuucugauc

SEQ ID NO: 3410383 - RNA, 13 nt, Human
ugaauuucacugu

SEQ ID NO: 3410384 - RNA, 15 nt, Human
ugaauuucucuacag

SEQ ID NO: 3410385 - RNA, 21 nt, Human
ugaauuucuucacuguugaaa

SEQ ID NO: 3410386 - RNA, 17 nt, Human
ugaauuugaaugaaaaa

SEQ ID NO: 3410387 - RNA, 18 nt, Human
ugaauuugaaugaaaaau

SEQ ID NO: 3410388 - RNA, 19 nt, Human
ugaauuugcaaaguacugu

SEQ ID NO: 3410389 - RNA, 15 nt, Human
ugaauuugcccuggg

SEQ ID NO: 3410390 - RNA, 14 nt, Human
ugaauuugccuaau

SEQ ID NO: 3410391 - RNA, 14 nt, Human
ugaauuuggagacu

SEQ ID NO: 3410392 - RNA, 17 nt, Human
ugaauuuguaaugucuu

SEQ ID NO: 3410393 - RNA, 14 nt, Human
ugaauuuuaaagua

SEQ ID NO: 3410394 - RNA, 16 nt, Human
ugaauuuuaaaguaug

SEQ ID NO: 3410395 - RNA, 18 nt, Human
ugaauuuucaagcaucuc

SEQ ID NO: 3410396 - RNA, 17 nt, Human
ugaauuuucacaugaac

SEQ ID NO: 3410397 - RNA, 18 nt, Human
ugaauuuucacaugaaca

SEQ ID NO: 3410398 - RNA, 13 nt, Human
ugaauuuucauuu

SEQ ID NO: 3410399 - RNA, 15 nt, Human
ugaauuuucccacug

SEQ ID NO: 3410400 - RNA, 17 nt, Human
ugaauuuucccacugca

SEQ ID NO: 3410401 - RNA, 11 nt, Human
ugaauuuucua

SEQ ID NO: 3410402 - RNA, 17 nt, Human
ugaauuuuguguuagag

SEQ ID NO: 3410403 - RNA, 19 nt, Human
ugaauuuuguucucuggga

SEQ ID NO: 3410404 - RNA, 22 nt, Human
ugaauuuuuaaaacccauuuaa

SEQ ID NO: 3410405 - RNA, 15 nt, Human
ugaauuuuuaugugu

SEQ ID NO: 3410406 - RNA, 17 nt, Human
ugaauuuuugcaauaau

SEQ ID NO: 3410407 - RNA, 22 nt, Human
ugaauuuuugcaauaaugcagu

SEQ ID NO: 3410408 - RNA, 23 nt, Human
ugaauuuuugcaauaaugcagua

SEQ ID NO: 3410409 - RNA, 15 nt, Human
ugaauuuuuuuguaa

SEQ ID NO: 3410410 - RNA, 17 nt, Human
ugaauuuuuuuuaacau

SEQ ID NO: 3410411 - RNA, 18 nt, Human
ugaauuuuuuuuaacauu

SEQ ID NO: 3410412 - RNA, 16 nt, Human
ugaauuuuuuuuuccu

SEQ ID NO: 3410413 - RNA, 19 nt, Human
ugacaaaaaguuuccauau

SEQ ID NO: 3410414 - RNA, 14 nt, Human
ugacaaaaauucaa

SEQ ID NO: 3410415 - RNA, 22 nt, Human
ugacaaaauacuugucuguuuu

SEQ ID NO: 3410416 - RNA, 12 nt, Human
ugacaaaauguu

SEQ ID NO: 3410417 - RNA, 20 nt, Human
ugacaaaauguuauuucccu

SEQ ID NO: 3410418 - RNA, 10 nt, Human
ugacaaaauu

SEQ ID NO: 3410419 - RNA, 22 nt, Human
ugacaaacuguguacauagcgg

SEQ ID NO: 3410420 - RNA, 19 nt, Human
ugacaaagauggcucagag

SEQ ID NO: 3410421 - RNA, 22 nt, Human
ugacaaagcagauucagaaaug

SEQ ID NO: 3410422 - RNA, 14 nt, Human
ugacaaagcuuccc

SEQ ID NO: 3410423 - RNA, 14 nt, Human
ugacaaaguuacug

SEQ ID NO: 3410424 - RNA, 20 nt, Human
ugacaaauaaauuaggacca

SEQ ID NO: 3410425 - RNA, 14 nt, Human
ugacaaaucaaguu

SEQ ID NO: 3410426 - RNA, 15 nt, Human
ugacaaaucugugua

SEQ ID NO: 3410427 - RNA, 14 nt, Human
ugacaaauguuucu

SEQ ID NO: 3410428 - RNA, 12 nt, Human
ugacaacacagc

SEQ ID NO: 3410429 - RNA, 13 nt, Human
ugacaacagaagc

SEQ ID NO: 3410430 - RNA, 22 nt, Human
ugacaacagaagcuucagaagu

SEQ ID NO: 3410431 - RNA, 18 nt, Human
ugacaacagacuucugaa

SEQ ID NO: 3410432 - RNA, 15 nt, Human
ugacaacuacagaaa

SEQ ID NO: 3410433 - RNA, 13 nt, Human
ugacaacuggcag

SEQ ID NO: 3410434 - RNA, 22 nt, Human
ugacaacugucuaacuuuagaa

SEQ ID NO: 3410435 - RNA, 13 nt, Human
ugacaacugugac

SEQ ID NO: 3410436 - RNA, 22 nt, Human
ugacaacuucccagugaauucu

SEQ ID NO: 3410437 - RNA, 11 nt, Human
ugacaagagcc

SEQ ID NO: 3410438 - RNA, 14 nt, Human
ugacaagagccuga

SEQ ID NO: 3410439 - RNA, 23 nt, Human
ugacaagagccugaucucuuccu

SEQ ID NO: 3410440 - RNA, 21 nt, Human
ugacaagaguuggggacagaa

SEQ ID NO: 3410441 - RNA, 13 nt, Human
ugacaagcagaua

SEQ ID NO: 3410442 - RNA, 20 nt, Human
ugacaagcagauacugcugu

SEQ ID NO: 3410443 - RNA, 15 nt, Human
ugacaagcucacaga

SEQ ID NO: 3410444 - RNA, 21 nt, Human
ugacaaggcacuucauguaaa

SEQ ID NO: 3410445 - RNA, 14 nt, Human
ugacaaggccccag

SEQ ID NO: 3410446 - RNA, 16 nt, Human
ugacaaggccccagag

SEQ ID NO: 3410447 - RNA, 18 nt, Human
ugacaaggccccagagac

SEQ ID NO: 3410448 - RNA, 21 nt, Human
ugacaagggcugaccugccuc

SEQ ID NO: 3410449 - RNA, 22 nt, Human
ugacaagggcugaccugccucu

SEQ ID NO: 3410450 - RNA, 14 nt, Human
ugacaagucauuuu

SEQ ID NO: 3410451 - RNA, 17 nt, Human
ugacaaguuuaaaggcu

SEQ ID NO: 3410452 - RNA, 17 nt, Human
ugacaauaauuucaggu

SEQ ID NO: 3410453 - RNA, 16 nt, Human
ugacaaucaugugugu

SEQ ID NO: 3410454 - RNA, 17 nt, Human
ugacaaucauguguguu

SEQ ID NO: 3410455 - RNA, 18 nt, Human
ugacaaucauguguguua

SEQ ID NO: 3410456 - RNA, 18 nt, Human
ugacaauuuuguacaaau

SEQ ID NO: 3410457 - RNA, 13 nt, Human
ugacacaaacaca

SEQ ID NO: 3410458 - RNA, 17 nt, Human
ugacacaaacacacaca

SEQ ID NO: 3410459 - RNA, 16 nt, Human
ugacacaaaccugccu

SEQ ID NO: 3410460 - RNA, 22 nt, Human
ugacacaacugugugauuaaaa

SEQ ID NO: 3410461 - RNA, 16 nt, Human
ugacacacagcucugu

SEQ ID NO: 3410462 - RNA, 20 nt, Human
ugacacacagcucuguccug

SEQ ID NO: 3410463 - RNA, 21 nt, Human
ugacacacagcucuguccugg

SEQ ID NO: 3410464 - RNA, 12 nt, Human
ugacacacuaac

SEQ ID NO: 3410465 - RNA, 13 nt, Human
ugacacacuacac

SEQ ID NO: 3410466 - RNA, 15 nt, Human
ugacacacuacacca

SEQ ID NO: 3410467 - RNA, 17 nt, Human
ugacacacuacaccaca

SEQ ID NO: 3410468 - RNA, 21 nt, Human
ugacacacuacaccacacaca

SEQ ID NO: 3410469 - RNA, 23 nt, Human
ugacacagaaaauguugagaauc

SEQ ID NO: 3410470 - RNA, 13 nt, Human
ugacacagacuca

SEQ ID NO: 3410471 - RNA, 22 nt, Human
ugacacagacucauccugaaca

SEQ ID NO: 3410472 - RNA, 16 nt, Human
ugacacagcagcuuca

SEQ ID NO: 3410473 - RNA, 16 nt, Human
ugacacaggaugaagg

SEQ ID NO: 3410474 - RNA, 16 nt, Human
ugacacaggucuuucc

SEQ ID NO: 3410475 - RNA, 17 nt, Human
ugacacaggucuuuccu

SEQ ID NO: 3410476 - RNA, 22 nt, Human
ugacacagucuuggcucacugc

SEQ ID NO: 3410477 - RNA, 21 nt, Human
ugacacauaugcaccuugugu

SEQ ID NO: 3410478 - RNA, 20 nt, Human
ugacacaugcaaggucauuu

SEQ ID NO: 3410479 - RNA, 16 nt, Human
ugacacauggccccuc

SEQ ID NO: 3410480 - RNA, 22 nt, Human
ugacaccagccuuucucccagg

SEQ ID NO: 3410481 - RNA, 13 nt, Human
ugacacccauguu

SEQ ID NO: 3410482 - RNA, 14 nt, Human
ugacacccuucucc

SEQ ID NO: 3410483 - RNA, 16 nt, Human
ugacacccuucuccca

SEQ ID NO: 3410484 - RNA, 20 nt, Human
ugacacccuucucccacucu

SEQ ID NO: 3410485 - RNA, 23 nt, Human
ugacacccuucucccacucuccu

SEQ ID NO: 3410486 - RNA, 18 nt, Human
ugacaccuaacucuucuu

SEQ ID NO: 3410487 - RNA, 20 nt, Human
ugacaccuuucauaaucuuu

SEQ ID NO: 3410488 - RNA, 23 nt, Human
ugacaccuuucauaaucuuugcu

SEQ ID NO: 3410489 - RNA, 16 nt, Human
ugacacgaauauugcu

SEQ ID NO: 3410490 - RNA, 16 nt, Human
ugacacggccaugacc

SEQ ID NO: 3410491 - RNA, 17 nt, Human
ugacacguccaccccag

SEQ ID NO: 3410492 - RNA, 21 nt, Human
ugacacuagcccaaugaaaug

SEQ ID NO: 3410493 - RNA, 23 nt, Human
ugacacuagcccaaugaaaugaa

SEQ ID NO: 3410494 - RNA, 20 nt, Human
ugacacuauaguuuaaaaca

SEQ ID NO: 3410495 - RNA, 22 nt, Human
ugacacucccuugggcucccug

SEQ ID NO: 3410496 - RNA, 18 nt, Human
ugacacucuccuugcagu

SEQ ID NO: 3410497 - RNA, 20 nt, Human
ugacacugaaaguuuuguaa

SEQ ID NO: 3410498 - RNA, 17 nt, Human
ugacacugaaaugccuu

SEQ ID NO: 3410499 - RNA, 23 nt, Human
ugacacugaccuuggagagacac

SEQ ID NO: 3410500 - RNA, 14 nt, Human
ugaccuucugggaa

SEQ ID NO: 3410501 - RNA, 20 nt, Human
ugaccuugaacuccugggcu

SEQ ID NO: 3410502 - RNA, 18 nt, Human
ugaccuugaugagcugug

SEQ ID NO: 3410503 - RNA, 19 nt, Human
ugaccuugaugagcugugc

SEQ ID NO: 3410504 - RNA, 22 nt, Human
ugaccuugaugagcugugcaca

SEQ ID NO: 3410505 - RNA, 19 nt, Human
ugaccuuggagagacacag

SEQ ID NO: 3410506 - RNA, 12 nt, Human
ugaccuuguaau

SEQ ID NO: 3410507 - RNA, 14 nt, Human
ugaccuuguaaugu

SEQ ID NO: 3410508 - RNA, 21 nt, Human
ugaccuuguaauguaacugcu

SEQ ID NO: 3410509 - RNA, 21 nt, Human
ugaccuuguaccucucuuuga

SEQ ID NO: 3410510 - RNA, 15 nt, Human
ugaccuuuaagagaa

SEQ ID NO: 3410511 - RNA, 12 nt, Human
ugaccuuucaau

SEQ ID NO: 3410512 - RNA, 14 nt, Human
ugaccuuucaauag

SEQ ID NO: 3410513 - RNA, 15 nt, Human
ugaccuuucaauagg

SEQ ID NO: 3410514 - RNA, 18 nt, Human
ugaccuuucaauaggaaa

SEQ ID NO: 3410515 - RNA, 22 nt, Human
ugaccuuucaauaggaaaaacu

SEQ ID NO: 3410516 - RNA, 20 nt, Human
ugaccuuuugacuuaaagca

SEQ ID NO: 3410517 - RNA, 19 nt, Human
ugacgaaacuggccccgga

SEQ ID NO: 3410518 - RNA, 19 nt, Human
ugacgaacuuccauggccc

SEQ ID NO: 3410519 - RNA, 14 nt, Human
ugacgaggcugggc

SEQ ID NO: 3410520 - RNA, 13 nt, Human
ugacgccauccca

SEQ ID NO: 3410521 - RNA, 17 nt, Human
ugacgccaucccagccc

SEQ ID NO: 3410522 - RNA, 17 nt, Human
ugacgcugaauaaaugu

SEQ ID NO: 3410523 - RNA, 22 nt, Human
ugacgcugaauaaaugucuuuu

SEQ ID NO: 3410524 - RNA, 21 nt, Human
ugacggaaggaccuauguuug

SEQ ID NO: 3410525 - RNA, 19 nt, Human
ugacggaugauuggauuau

SEQ ID NO: 3410526 - RNA, 13 nt, Human
ugacggcccugca

SEQ ID NO: 3410527 - RNA, 15 nt, Human
ugacggcccugcaau

SEQ ID NO: 3410528 - RNA, 19 nt, Human
ugacggcgcccccagugug

SEQ ID NO: 3410529 - RNA, 23 nt, Human
ugacguacaaguaguucuguauu

SEQ ID NO: 3410530 - RNA, 19 nt, Human
ugacgucaagucuccuucc

SEQ ID NO: 3410531 - RNA, 19 nt, Human
ugacgucuagcuaugcugu

SEQ ID NO: 3410532 - RNA, 14 nt, Human
ugacgucugggugg

SEQ ID NO: 3410533 - RNA, 19 nt, Human
ugacgugccuuuugcaccc

SEQ ID NO: 3410534 - RNA, 22 nt, Human
ugacgugccuuuugcaccccuc

SEQ ID NO: 3410535 - RNA, 23 nt, Human
ugacguggagcgggguaugaaga

SEQ ID NO: 3410536 - RNA, 14 nt, Human
ugacguuccgggca

SEQ ID NO: 3410537 - RNA, 18 nt, Human
ugacuaaacuuuuuuucu

SEQ ID NO: 3410538 - RNA, 17 nt, Human
ugacuaaagagagaaug

SEQ ID NO: 3410539 - RNA, 15 nt, Human
ugacuaaauucguga

SEQ ID NO: 3410540 - RNA, 18 nt, Human
ugacuaaauucgugauuu

SEQ ID NO: 3410541 - RNA, 13 nt, Human
ugacuaaauuugg

SEQ ID NO: 3410542 - RNA, 23 nt, Human
ugacuaacuagacaccaaaguuc

SEQ ID NO: 3410543 - RNA, 20 nt, Human
ugacuaacucaaauacacau

SEQ ID NO: 3410544 - RNA, 23 nt, Human
ugacuaacucaaauacacauuug

SEQ ID NO: 3410545 - RNA, 15 nt, Human
ugacuaagaaauucu

SEQ ID NO: 3410546 - RNA, 15 nt, Human
ugacuaauggcauga

SEQ ID NO: 3410547 - RNA, 14 nt, Human
ugacuaauuagggu

SEQ ID NO: 3410548 - RNA, 22 nt, Human
ugacuaauucuugcauauuuug

SEQ ID NO: 3410549 - RNA, 23 nt, Human
ugacuaauuguauaacagguuau

SEQ ID NO: 3410550 - RNA, 18 nt, Human
ugacuaauuuuacauguu

SEQ ID NO: 3410551 - RNA, 13 nt, Human
ugacuacagggcc

SEQ ID NO: 3410552 - RNA, 14 nt, Human
ugacuacauuuuuu

SEQ ID NO: 3410553 - RNA, 17 nt, Human
ugacuagggagccaugu

SEQ ID NO: 3410554 - RNA, 18 nt, Human
ugacuagggagccauguu

SEQ ID NO: 3410555 - RNA, 21 nt, Human
ugacuagggagccauguuuca

SEQ ID NO: 3410556 - RNA, 13 nt, Human
ugacuaguacaaa

SEQ ID NO: 3410557 - RNA, 19 nt, Human
ugacuagugaggaaagauu

SEQ ID NO: 3410558 - RNA, 18 nt, Human
ugacuagugcugaagcuu

SEQ ID NO: 3410559 - RNA, 18 nt, Human
ugacuauauagagauguu

SEQ ID NO: 3410560 - RNA, 13 nt, Human
ugacuauguaaac

SEQ ID NO: 3410561 - RNA, 17 nt, Human
ugacuauuauguuguua

SEQ ID NO: 3410562 - RNA, 22 nt, Human
ugacuauuauguuguuagagaa

SEQ ID NO: 3410563 - RNA, 19 nt, Human
ugacuauucugagaugacu

SEQ ID NO: 3410564 - RNA, 20 nt, Human
ugacuauucuugauguaaaa

SEQ ID NO: 3410565 - RNA, 21 nt, Human
ugacuauucuugauguaaaau

SEQ ID NO: 3410566 - RNA, 22 nt, Human
ugacuauucuugauguaaaauc

SEQ ID NO: 3410567 - RNA, 22 nt, Human
ugacuauuuuuguuuuuauuaa

SEQ ID NO: 3410568 - RNA, 15 nt, Human
ugacucaacauguua

SEQ ID NO: 3410569 - RNA, 23 nt, Human
ugacucaacauguuacugaccag

SEQ ID NO: 3410570 - RNA, 15 nt, Human
ugacucaagauuccc

SEQ ID NO: 3410571 - RNA, 21 nt, Human
ugacucaagauucccaggagu

SEQ ID NO: 3410572 - RNA, 19 nt, Human
ugacucacaagaagaccag

SEQ ID NO: 3410573 - RNA, 20 nt, Human
ugacucacaagaagaccaga

SEQ ID NO: 3410574 - RNA, 14 nt, Human
ugacucacaccuga

SEQ ID NO: 3410575 - RNA, 15 nt, Human
ugacucacccaagca

SEQ ID NO: 3410576 - RNA, 18 nt, Human
ugacucacuuaucccaag

SEQ ID NO: 3410577 - RNA, 21 nt, Human
ugacucagcauaccugcuggu

SEQ ID NO: 3410578 - RNA, 14 nt, Human
ugacucagggcucc

SEQ ID NO: 3410579 - RNA, 17 nt, Human
ugacucagggcuccugg

SEQ ID NO: 3410580 - RNA, 13 nt, Human
ugacucauccucu

SEQ ID NO: 3410581 - RNA, 20 nt, Human
ugacucauucugaaggagcc

SEQ ID NO: 3410582 - RNA, 21 nt, Human
ugacuccacgauccugccacc

SEQ ID NO: 3410583 - RNA, 17 nt, Human
ugacuccagaauuuccc

SEQ ID NO: 3410584 - RNA, 11 nt, Human
ugacuccagga

SEQ ID NO: 3410585 - RNA, 21 nt, Human
ugacuccauagaccuuuucau

SEQ ID NO: 3410586 - RNA, 17 nt, Human
ugacucccaaagagcug

SEQ ID NO: 3410587 - RNA, 18 nt, Human
ugacucccaaagagcugc

SEQ ID NO: 3410588 - RNA, 20 nt, Human
ugacucccaaagagcugccu

SEQ ID NO: 3410589 - RNA, 22 nt, Human
ugacucccaaagagcugccuaa

SEQ ID NO: 3410590 - RNA, 21 nt, Human
ugacuccgcuggagguggggc

SEQ ID NO: 3410591 - RNA, 20 nt, Human
ugacuccuaccugcccugga

SEQ ID NO: 3410592 - RNA, 22 nt, Human
ugacuccuaccugcccuggaac

SEQ ID NO: 3410593 - RNA, 20 nt, Human
ugacuccuaugaucucaggu

SEQ ID NO: 3410594 - RNA, 17 nt, Human
ugacuccucuaagccac

SEQ ID NO: 3410595 - RNA, 21 nt, Human
ugacucgggcuccugugcccu

SEQ ID NO: 3410596 - RNA, 16 nt, Human
ugacucgggggugggg

SEQ ID NO: 3410597 - RNA, 18 nt, Human
ugacucggggguggggaa

SEQ ID NO: 3410598 - RNA, 15 nt, Human
ugacucgguuucucc

SEQ ID NO: 3410599 - RNA, 15 nt, Human
ugacucgugcugcau

SEQ ID NO: 3410600 - RNA, 12 nt, Human
ugacucuaaauu

SEQ ID NO: 3410601 - RNA, 23 nt, Human
ugacucuaguacugugaauccag

SEQ ID NO: 3410602 - RNA, 15 nt, Human
ugacucuauaagcaa

SEQ ID NO: 3410603 - RNA, 13 nt, Human
ugacucucuguga

SEQ ID NO: 3410604 - RNA, 14 nt, Human
ugacucugaaaucu

SEQ ID NO: 3410605 - RNA, 15 nt, Human
ugacucugaaaucug

SEQ ID NO: 3410606 - RNA, 22 nt, Human
ugacucugaaaucugaagaccu

SEQ ID NO: 3410607 - RNA, 18 nt, Human
ugacucugcccccugcug

SEQ ID NO: 3410608 - RNA, 13 nt, Human
ugacucugggucc

SEQ ID NO: 3410609 - RNA, 18 nt, Human
ugacucuggguccuuccu

SEQ ID NO: 3410610 - RNA, 20 nt, Human
ugacucuggguccuuccuga

SEQ ID NO: 3410611 - RNA, 16 nt, Human
ugacucuuaagaagac

SEQ ID NO: 3410612 - RNA, 14 nt, Human
ugacucuuggcaca

SEQ ID NO: 3410613 - RNA, 14 nt, Human
ugacugaacuguaa

SEQ ID NO: 3410614 - RNA, 14 nt, Human
ugacugaauuucuu

SEQ ID NO: 3410615 - RNA, 19 nt, Human
ugacugagcaagacccugu

SEQ ID NO: 3410616 - RNA, 13 nt, Human
ugacugauucuuc

SEQ ID NO: 3410617 - RNA, 14 nt, Human
ugacugauucuuca

SEQ ID NO: 3410618 - RNA, 18 nt, Human
ugacugcacguggcuucu

SEQ ID NO: 3410619 - RNA, 21 nt, Human
ugacugcauuuuacuguacag

SEQ ID NO: 3410620 - RNA, 22 nt, Human
ugacugcccggcacagaugcuc

SEQ ID NO: 3410621 - RNA, 16 nt, Human
ugacugcgaucuucag

SEQ ID NO: 3410622 - RNA, 17 nt, Human
ugacugcgaucuucaga

SEQ ID NO: 3410623 - RNA, 22 nt, Human
ugacugcucagaacuugcugcu

SEQ ID NO: 3410624 - RNA, 23 nt, Human
ugacugcuccccagcccuggcuc

SEQ ID NO: 3410625 - RNA, 19 nt, Human
ugacuggaauuuuuauuau

SEQ ID NO: 3410626 - RNA, 15 nt, Human
ugacuggcacagucu

SEQ ID NO: 3410627 - RNA, 14 nt, Human
ugacuggcauuuua

SEQ ID NO: 3410628 - RNA, 18 nt, Human
ugacuggcauuuuauaga

SEQ ID NO: 3410629 - RNA, 16 nt, Human
ugacugggaccaggca

SEQ ID NO: 3410630 - RNA, 23 nt, Human
ugacugguguuaucaccgugggc

SEQ ID NO: 3410631 - RNA, 16 nt, Human
ugacugguuaucacac

SEQ ID NO: 3410632 - RNA, 17 nt, Human
ugacuguagcuuuggaa

SEQ ID NO: 3410633 - RNA, 15 nt, Human
ugacuguaucugugu

SEQ ID NO: 3410634 - RNA, 16 nt, Human
ugacugucacuguucc

SEQ ID NO: 3410635 - RNA, 12 nt, Human
ugacugucuggg

SEQ ID NO: 3410636 - RNA, 17 nt, Human
ugacuguggccaugguc

SEQ ID NO: 3410637 - RNA, 21 nt, Human
ugacugugguagccagcaucg

SEQ ID NO: 3410638 - RNA, 15 nt, Human
ugacuguugauguac

SEQ ID NO: 3410639 - RNA, 15 nt, Human
ugacuguuuuuaccc

SEQ ID NO: 3410640 - RNA, 22 nt, Human
ugacuguuuuuuaaacuaggaa

SEQ ID NO: 3410641 - RNA, 20 nt, Human
ugacuuaacauagccaaaau

SEQ ID NO: 3410642 - RNA, 19 nt, Human
ugacuuaagcaaaagaaaa

SEQ ID NO: 3410643 - RNA, 15 nt, Human
ugacuuacuguacau

SEQ ID NO: 3410644 - RNA, 22 nt, Human
ugagcagugauauucuuuguua

SEQ ID NO: 3410645 - RNA, 13 nt, Human
ugagcaguggcug

SEQ ID NO: 3410646 - RNA, 18 nt, Human
ugagcaguggcuggucca

SEQ ID NO: 3410647 - RNA, 22 nt, Human
ugagcaguggcugguccagggc

SEQ ID NO: 3410648 - RNA, 17 nt, Human
ugagcagugugucuccu

SEQ ID NO: 3410649 - RNA, 23 nt, Human
ugagcauaggugauccauguaac

SEQ ID NO: 3410650 - RNA, 18 nt, Human
ugagcaucacagaaugug

SEQ ID NO: 3410651 - RNA, 15 nt, Human
ugagcaucacaguuu

SEQ ID NO: 3410652 - RNA, 17 nt, Human
ugagcauccugagcccc

SEQ ID NO: 3410653 - RNA, 23 nt, Human
ugagcauccugagccccgcccuc

SEQ ID NO: 3410654 - RNA, 21 nt, Human
ugagcaugacagccugcagca

SEQ ID NO: 3410655 - RNA, 18 nt, Human
ugagcauggagcuggccg

SEQ ID NO: 3410656 - RNA, 18 nt, Human
ugagcauguaaaagcgga

SEQ ID NO: 3410657 - RNA, 23 nt, Human
ugagcauuguggcugucagcagg

SEQ ID NO: 3410658 - RNA, 20 nt, Human
ugagccacagcagcauuuuu

SEQ ID NO: 3410659 - RNA, 12 nt, Human
ugagccaccacg

SEQ ID NO: 3410660 - RNA, 13 nt, Human
ugagccaccugcc

SEQ ID NO: 3410661 - RNA, 14 nt, Human
ugagccacugcacc

SEQ ID NO: 3410662 - RNA, 18 nt, Human
ugagccacugcaccgggc

SEQ ID NO: 3410663 - RNA, 21 nt, Human
ugagccacugcaccgggccac

SEQ ID NO: 3410664 - RNA, 15 nt, Human
ugagccacugcgccc

SEQ ID NO: 3410665 - RNA, 16 nt, Human
ugagccagauuucacu

SEQ ID NO: 3410666 - RNA, 21 nt, Human
ugagccagauuucacucuccu

SEQ ID NO: 3410667 - RNA, 13 nt, Human
ugagccagcagac

SEQ ID NO: 3410668 - RNA, 16 nt, Human
ugagccagcagacauu

SEQ ID NO: 3410669 - RNA, 21 nt, Human
ugagccagguaaugagggacu

SEQ ID NO: 3410670 - RNA, 16 nt, Human
ugagccagucccaggg

SEQ ID NO: 3410671 - RNA, 22 nt, Human
ugagccaguucaguaccuggag

SEQ ID NO: 3410672 - RNA, 15 nt, Human
ugagcccacaaagcc

SEQ ID NO: 3410673 - RNA, 16 nt, Human
ugagcccacaaagccu

SEQ ID NO: 3410674 - RNA, 19 nt, Human
ugagcccacugcccacccc

SEQ ID NO: 3410675 - RNA, 22 nt, Human
ugagcccacugcccacccccuc

SEQ ID NO: 3410676 - RNA, 11 nt, Human
ugagcccaggg

SEQ ID NO: 3410677 - RNA, 13 nt, Human
ugagcccagggag

SEQ ID NO: 3410678 - RNA, 22 nt, Human
ugagcccauguggagucagccu

SEQ ID NO: 3410679 - RNA, 13 nt, Human
ugagccccaaaag

SEQ ID NO: 3410680 - RNA, 14 nt, Human
ugagccccaagucc

SEQ ID NO: 3410681 - RNA, 19 nt, Human
ugagccccagggugcccag

SEQ ID NO: 3410682 - RNA, 21 nt, Human
ugagccccaucuucacccagg

SEQ ID NO: 3410683 - RNA, 16 nt, Human
ugagcccccagcuucc

SEQ ID NO: 3410684 - RNA, 17 nt, Human
ugagcccccagcuucca

SEQ ID NO: 3410685 - RNA, 22 nt, Human
ugagcccccagcuuccagcagg

SEQ ID NO: 3410686 - RNA, 22 nt, Human
ugagccccgcagaccuccccag

SEQ ID NO: 3410687 - RNA, 14 nt, Human
ugagccccgcccuc

SEQ ID NO: 3410688 - RNA, 19 nt, Human
ugagccccgcccucuuccu

SEQ ID NO: 3410689 - RNA, 22 nt, Human
ugagccccuaccccacaccagg

SEQ ID NO: 3410690 - RNA, 15 nt, Human
ugagccccuggaggc

SEQ ID NO: 3410691 - RNA, 14 nt, Human
ugagccccugggac

SEQ ID NO: 3410692 - RNA, 22 nt, Human
ugagccccugucuagagaggga

SEQ ID NO: 3410693 - RNA, 13 nt, Human
ugagccccuuccu

SEQ ID NO: 3410694 - RNA, 13 nt, Human
ugagcccgggcug

SEQ ID NO: 3410695 - RNA, 16 nt, Human
ugagcccgggcugccu

SEQ ID NO: 3410696 - RNA, 18 nt, Human
ugagcccgggcugccugg

SEQ ID NO: 3410697 - RNA, 22 nt, Human
ugagcccucagaacccuuggcu

SEQ ID NO: 3410698 - RNA, 16 nt, Human
ugagcccugaggaggc

SEQ ID NO: 3410699 - RNA, 18 nt, Human
ugagcccuguccugccua

SEQ ID NO: 3410700 - RNA, 15 nt, Human
ugagcccuuguuuca

SEQ ID NO: 3410701 - RNA, 22 nt, Human
ugagccgagaucacgccacugc

SEQ ID NO: 3410702 - RNA, 21 nt, Human
ugagccgcugugagccccugg

SEQ ID NO: 3410703 - RNA, 15 nt, Human
ugagccgggccccug

SEQ ID NO: 3410704 - RNA, 16 nt, Human
ugagccgggccccugg

SEQ ID NO: 3410705 - RNA, 16 nt, Human
ugagccuaaaaauaaa

SEQ ID NO: 3410706 - RNA, 18 nt, Human
ugagccuaaaaauaaagc

SEQ ID NO: 3410707 - RNA, 18 nt, Human
ugagccucugcuccccag

SEQ ID NO: 3410708 - RNA, 14 nt, Human
ugagccugagcaga

SEQ ID NO: 3410709 - RNA, 13 nt, Human
ugagccugcaggg

SEQ ID NO: 3410710 - RNA, 13 nt, Human
ugagccugccgag

SEQ ID NO: 3410711 - RNA, 13 nt, Human
ugagccugcugga

SEQ ID NO: 3410712 - RNA, 17 nt, Human
ugagccugcuggaagcc

SEQ ID NO: 3410713 - RNA, 16 nt, Human
ugagccuggcaagaau

SEQ ID NO: 3410714 - RNA, 22 nt, Human
ugagccuggcccauagaaacau

SEQ ID NO: 3410715 - RNA, 18 nt, Human
ugagccuggcucuugugc

SEQ ID NO: 3410716 - RNA, 13 nt, Human
ugagccuggcugg

SEQ ID NO: 3410717 - RNA, 14 nt, Human
ugagccugggaggu

SEQ ID NO: 3410718 - RNA, 22 nt, Human
ugagccugggaggucaaggcug

SEQ ID NO: 3410719 - RNA, 19 nt, Human
ugagccuugaacuuugacc

SEQ ID NO: 3410720 - RNA, 13 nt, Human
ugagccuuguaau

SEQ ID NO: 3410721 - RNA, 16 nt, Human
ugagcgacaaagauga

SEQ ID NO: 3410722 - RNA, 13 nt, Human
ugagcgacaguga

SEQ ID NO: 3410723 - RNA, 14 nt, Human
ugagcgacagugag

SEQ ID NO: 3410724 - RNA, 16 nt, Human
ugagcgacagugagac

SEQ ID NO: 3410725 - RNA, 22 nt, Human
ugagcgacaucucugacuuucu

SEQ ID NO: 3410726 - RNA, 23 nt, Human
ugagcgaggagaugcuccuuggg

SEQ ID NO: 3410727 - RNA, 20 nt, Human
ugagcgccuccauccaaggc

SEQ ID NO: 3410728 - RNA, 15 nt, Human
ugagcgggaggcaga

SEQ ID NO: 3410729 - RNA, 16 nt, Human
ugagcuacaaaugcau

SEQ ID NO: 3410730 - RNA, 21 nt, Human
ugagcuacugccgucagugcu

SEQ ID NO: 3410731 - RNA, 18 nt, Human
ugagcuagaacccucugu

SEQ ID NO: 3410732 - RNA, 14 nt, Human
ugagcuaggaauug

SEQ ID NO: 3410733 - RNA, 14 nt, Human
ugagcuaugacuua

SEQ ID NO: 3410734 - RNA, 15 nt, Human
ugagcuaugacuuaa

SEQ ID NO: 3410735 - RNA, 21 nt, Human
ugagcuauuuccauuccagaa

SEQ ID NO: 3410736 - RNA, 18 nt, Human
ugagcucacaaggcagca

SEQ ID NO: 3410737 - RNA, 22 nt, Human
ugagcucacaaggcagcaaggc

SEQ ID NO: 3410738 - RNA, 16 nt, Human
ugagcucagaccccca

SEQ ID NO: 3410739 - RNA, 19 nt, Human
ugagcucagacccccacuc

SEQ ID NO: 3410740 - RNA, 11 nt, Human
ugagcucagcc

SEQ ID NO: 3410741 - RNA, 12 nt, Human
ugagcucagccc

SEQ ID NO: 3410742 - RNA, 13 nt, Human
ugagcuccagacc

SEQ ID NO: 3410743 - RNA, 15 nt, Human
ugagcuccagacccc

SEQ ID NO: 3410744 - RNA, 18 nt, Human
ugagcucccacaagccug

SEQ ID NO: 3410745 - RNA, 19 nt, Human
ugagcucccacuucugcca

SEQ ID NO: 3410746 - RNA, 20 nt, Human
ugagcucccacuucugccag

SEQ ID NO: 3410747 - RNA, 15 nt, Human
ugagcuccccaaaaa

SEQ ID NO: 3410748 - RNA, 15 nt, Human
ugagcuccucugggc

SEQ ID NO: 3410749 - RNA, 12 nt, Human
ugagcuccuggg

SEQ ID NO: 3410750 - RNA, 18 nt, Human
ugagcucuacccagggcc

SEQ ID NO: 3410751 - RNA, 20 nt, Human
ugagcucuauuaugaaugug

SEQ ID NO: 3410752 - RNA, 16 nt, Human
ugagcucucggaacug

SEQ ID NO: 3410753 - RNA, 15 nt, Human
ugagcucugaaaucu

SEQ ID NO: 3410754 - RNA, 16 nt, Human
ugagcucugaaaucuu

SEQ ID NO: 3410755 - RNA, 20 nt, Human
ugagcucugagaggcccugg

SEQ ID NO: 3410756 - RNA, 21 nt, Human
ugagcucugagaggcccugga

SEQ ID NO: 3410757 - RNA, 18 nt, Human
ugagcucuucauguuuca

SEQ ID NO: 3410758 - RNA, 14 nt, Human
ugagcugagcaggc

SEQ ID NO: 3410759 - RNA, 14 nt, Human
ugagcugcagaaac

SEQ ID NO: 3410760 - RNA, 17 nt, Human
ugagcugcagaaacgaa

SEQ ID NO: 3410761 - RNA, 12 nt, Human
ugagcugccagu

SEQ ID NO: 3410762 - RNA, 15 nt, Human
ugagcugccauccag

SEQ ID NO: 3410763 - RNA, 16 nt, Human
ugagcugccucugaga

SEQ ID NO: 3410764 - RNA, 16 nt, Human
ugagcugccuucccua

SEQ ID NO: 3410765 - RNA, 19 nt, Human
ugagcugccuucccuagcu

SEQ ID NO: 3410766 - RNA, 17 nt, Human
ugagcugcuuuuuuuga

SEQ ID NO: 3410767 - RNA, 18 nt, Human
ugagcugggccggagggu

SEQ ID NO: 3410768 - RNA, 12 nt, Human
ugagcugucacu

SEQ ID NO: 3410769 - RNA, 15 nt, Human
ugagcuguguucuug

SEQ ID NO: 3410770 - RNA, 14 nt, Human
ugagcuguugccuc

SEQ ID NO: 3410771 - RNA, 19 nt, Human
ugagcuuaaaauacaagac

SEQ ID NO: 3410772 - RNA, 17 nt, Human
ugagcuuacguaguucu

SEQ ID NO: 3410773 - RNA, 18 nt, Human
ugagcuuacguaguucua

SEQ ID NO: 3410774 - RNA, 19 nt, Human
ugagcuuggcagcugaacu

SEQ ID NO: 3410775 - RNA, 13 nt, Human
ugagcuuggccag

SEQ ID NO: 3410776 - RNA, 14 nt, Human
ugagcuuggccaga

SEQ ID NO: 3410777 - RNA, 21 nt, Human
ugagcuuggccagaagggggc

SEQ ID NO: 3410778 - RNA, 18 nt, Human
ugagcuuuccauguugcu

SEQ ID NO: 3410779 - RNA, 19 nt, Human
ugagcuuuccauguugcug

SEQ ID NO: 3410780 - RNA, 20 nt, Human
ugagcuuuccauguugcugc

SEQ ID NO: 3410781 - RNA, 21 nt, Human
ugagcuuuccauguugcugcc

SEQ ID NO: 3410782 - RNA, 22 nt, Human
ugagcuuuccauguugcugcca

SEQ ID NO: 3410783 - RNA, 13 nt, Human
ugagcuuucugaa

SEQ ID NO: 3410784 - RNA, 14 nt, Human
ugagcuuucugaac

SEQ ID NO: 3410785 - RNA, 19 nt, Human
ugagcuuucugaacagcug

SEQ ID NO: 3410786 - RNA, 16 nt, Human
ugaggaaaaauaugug

SEQ ID NO: 3410787 - RNA, 16 nt, Human
ugaggaaaauaaugua

SEQ ID NO: 3410788 - RNA, 14 nt, Human
ugaggaaagcacac

SEQ ID NO: 3410789 - RNA, 15 nt, Human
ugcaggucuuuaaau

SEQ ID NO: 3410790 - RNA, 13 nt, Human
ugcaggugcacca

SEQ ID NO: 3410791 - RNA, 19 nt, Human
ugcagguggccaaguuccu

SEQ ID NO: 3410792 - RNA, 23 nt, Human
ugcagguugggccauacuggccu

SEQ ID NO: 3410793 - RNA, 15 nt, Human
ugcagguuuguuaca

SEQ ID NO: 3410794 - RNA, 11 nt, Human
ugcaguaacug

SEQ ID NO: 3410795 - RNA, 18 nt, Human
ugcaguacaggacauaua

SEQ ID NO: 3410796 - RNA, 17 nt, Human
ugcaguacuuugugcau

SEQ ID NO: 3410797 - RNA, 16 nt, Human
ugcaguagauuuucuu

SEQ ID NO: 3410798 - RNA, 16 nt, Human
ugcaguaggggaggag

SEQ ID NO: 3410799 - RNA, 18 nt, Human
ugcaguagucucugugcu

SEQ ID NO: 3410800 - RNA, 13 nt, Human
ugcaguauagaau

SEQ ID NO: 3410801 - RNA, 14 nt, Human
ugcaguauauuucu

SEQ ID NO: 3410802 - RNA, 16 nt, Human
ugcaguaucaugcccu

SEQ ID NO: 3410803 - RNA, 21 nt, Human
ugcaguaucaugcccugugca

SEQ ID NO: 3410804 - RNA, 21 nt, Human
ugcagucacguggaggagcag

SEQ ID NO: 3410805 - RNA, 13 nt, Human
ugcagucacugca

SEQ ID NO: 3410806 - RNA, 21 nt, Human
ugcagucagucaugauggcac

SEQ ID NO: 3410807 - RNA, 15 nt, Human
ugcagucaucagaag

SEQ ID NO: 3410808 - RNA, 13 nt, Human
ugcagucccaagc

SEQ ID NO: 3410809 - RNA, 14 nt, Human
ugcagucccaagcg

SEQ ID NO: 3410810 - RNA, 22 nt, Human
ugcagucccaagcggugucucu

SEQ ID NO: 3410811 - RNA, 19 nt, Human
ugcaguccugaucagagcc

SEQ ID NO: 3410812 - RNA, 21 nt, Human
ugcagucuccucuuuaaaaca

SEQ ID NO: 3410813 - RNA, 16 nt, Human
ugcagucucuauacca

SEQ ID NO: 3410814 - RNA, 18 nt, Human
ugcagucucuauaccaau

SEQ ID NO: 3410815 - RNA, 23 nt, Human
ugcagucucuauaccaauaaagu

SEQ ID NO: 3410816 - RNA, 19 nt, Human
ugcagucugcuucugcacc

SEQ ID NO: 3410817 - RNA, 22 nt, Human
ugcagucuuagaucauaguuuu

SEQ ID NO: 3410818 - RNA, 14 nt, Human
ugcagugaacuucc

SEQ ID NO: 3410819 - RNA, 19 nt, Human
ugcagugagccgagauugu

SEQ ID NO: 3410820 - RNA, 13 nt, Human
ugcagugagcuga

SEQ ID NO: 3410821 - RNA, 16 nt, Human
ugcagugcuuccaagg

SEQ ID NO: 3410822 - RNA, 18 nt, Human
ugcaguggcgcauucuag

SEQ ID NO: 3410823 - RNA, 21 nt, Human
ugcaguggcgcauucuaggcu

SEQ ID NO: 3410824 - RNA, 22 nt, Human
ugcaguggcgcgaucucagcuc

SEQ ID NO: 3410825 - RNA, 22 nt, Human
ugcaguggcgugaucucagcuc

SEQ ID NO: 3410826 - RNA, 17 nt, Human
ugcaguggcucacgccu

SEQ ID NO: 3410827 - RNA, 22 nt, Human
ugcagugguaugaucacggcuc

SEQ ID NO: 3410828 - RNA, 20 nt, Human
ugcaguggugcgaucugggu

SEQ ID NO: 3410829 - RNA, 13 nt, Human
ugcaguuacaaau

SEQ ID NO: 3410830 - RNA, 19 nt, Human
ugcaguuacaaauuauaau

SEQ ID NO: 3410831 - RNA, 14 nt, Human
ugcaguucugaaga

SEQ ID NO: 3410832 - RNA, 16 nt, Human
ugcaguucugaagaag

SEQ ID NO: 3410833 - RNA, 19 nt, Human
ugcaguucugaagaagaug

SEQ ID NO: 3410834 - RNA, 14 nt, Human
ugcaguucugagca

SEQ ID NO: 3410835 - RNA, 21 nt, Human
ugcaguucuuuggcugaaagg

SEQ ID NO: 3410836 - RNA, 13 nt, Human
ugcaguugccagu

SEQ ID NO: 3410837 - RNA, 18 nt, Human
ugcaguuuaagagcagaa

SEQ ID NO: 3410838 - RNA, 16 nt, Human
ugcaguuuaucauuca

SEQ ID NO: 3410839 - RNA, 12 nt, Human
ugcaguuuccaa

SEQ ID NO: 3410840 - RNA, 12 nt, Human
ugcaguuugaaa

SEQ ID NO: 3410841 - RNA, 19 nt, Human
ugcaguuugaaauucugaa

SEQ ID NO: 3410842 - RNA, 21 nt, Human
ugcaguuugaaauucugaauu

SEQ ID NO: 3410843 - RNA, 22 nt, Human
ugcaguuugaaauucugaauuu

SEQ ID NO: 3410844 - RNA, 14 nt, Human
ugcaguuuuucaga

SEQ ID NO: 3410845 - RNA, 12 nt, Human
ugcauaaauaug

SEQ ID NO: 3410846 - RNA, 18 nt, Human
ugcauaacaaauucugaa

SEQ ID NO: 3410847 - RNA, 18 nt, Human
ugcauaacaauuccucua

SEQ ID NO: 3410848 - RNA, 22 nt, Human
ugcauaacguauaaaagccugu

SEQ ID NO: 3410849 - RNA, 15 nt, Human
ugcauaacugacaaa

SEQ ID NO: 3410850 - RNA, 22 nt, Human
ugcauaacugacaaaucaaguu

SEQ ID NO: 3410851 - RNA, 23 nt, Human
ugcauaacugacaaaucaaguuu

SEQ ID NO: 3410852 - RNA, 14 nt, Human
ugcauaaguuaacu

SEQ ID NO: 3410853 - RNA, 11 nt, Human
ugcauaauaaa

SEQ ID NO: 3410854 - RNA, 24 nt, Human
ugcauaauaagcuaaagaggcuga

SEQ ID NO: 3410855 - RNA, 17 nt, Human
ugcauaauagcuacagu

SEQ ID NO: 3410856 - RNA, 15 nt, Human
ugcauaauggucaga

SEQ ID NO: 3410857 - RNA, 22 nt, Human
ugcauacaaacaagcauauaaa

SEQ ID NO: 3410858 - RNA, 23 nt, Human
ugcauacaaacaagcauauaaaa

SEQ ID NO: 3410859 - RNA, 14 nt, Human
ugcauacacacaca

SEQ ID NO: 3410860 - RNA, 15 nt, Human
ugcauacacacacac

SEQ ID NO: 3410861 - RNA, 16 nt, Human
ugcauacacacacaca

SEQ ID NO: 3410862 - RNA, 21 nt, Human
ugcauacacacacacacacag

SEQ ID NO: 3410863 - RNA, 22 nt, Human
ugcauacacuuuuucucuuucc

SEQ ID NO: 3410864 - RNA, 20 nt, Human
ugcauacauucuucaagauc

SEQ ID NO: 3410865 - RNA, 14 nt, Human
ugcauaccaaccug

SEQ ID NO: 3410866 - RNA, 14 nt, Human
ugcauaccacuuuu

SEQ ID NO: 3410867 - RNA, 18 nt, Human
ugcauaccacuuuuguuc

SEQ ID NO: 3410868 - RNA, 22 nt, Human
ugcauaccacuuuuguucuugg

SEQ ID NO: 3410869 - RNA, 19 nt, Human
ugcauacccgggcagggcu

SEQ ID NO: 3410870 - RNA, 15 nt, Human
ugcauacuauuaaac

SEQ ID NO: 3410871 - RNA, 16 nt, Human
ugcauacuauuaaaca

SEQ ID NO: 3410872 - RNA, 20 nt, Human
ugcauacuauuaaacaugcu

SEQ ID NO: 3410873 - RNA, 13 nt, Human
ugcauacucauua

SEQ ID NO: 3410874 - RNA, 14 nt, Human
ugcauacuucaaaa

SEQ ID NO: 3410875 - RNA, 16 nt, Human
ugcauacuucaaaagu

SEQ ID NO: 3410876 - RNA, 19 nt, Human
ugcauacuucaaaaguauu

SEQ ID NO: 3410877 - RNA, 18 nt, Human
ugcauacuuuuuaaaugu

SEQ ID NO: 3410878 - RNA, 22 nt, Human
ugcauacuuuuuaaauguaaag

SEQ ID NO: 3410879 - RNA, 23 nt, Human
ugcauacuuuuuaaauguaaaga

SEQ ID NO: 3410880 - RNA, 17 nt, Human
ugcauagaauaaaauuu

SEQ ID NO: 3410881 - RNA, 17 nt, Human
ugcauagagccacguau

SEQ ID NO: 3410882 - RNA, 19 nt, Human
ugcauagagguaccagcaa

SEQ ID NO: 3410883 - RNA, 22 nt, Human
ugcauagcagaugguuuccaca

SEQ ID NO: 3410884 - RNA, 20 nt, Human
ugcauaggaguuuggaggaa

SEQ ID NO: 3410885 - RNA, 22 nt, Human
ugcauaguaaauguaguucaua

SEQ ID NO: 3410886 - RNA, 22 nt, Human
ugcauaguaccaaucauuuuaa

SEQ ID NO: 3410887 - RNA, 20 nt, Human
ugcauagucccagcuaccca

SEQ ID NO: 3410888 - RNA, 13 nt, Human
ugcauagugcugg

SEQ ID NO: 3410889 - RNA, 19 nt, Human
ugcauaguucccauguuaa

SEQ ID NO: 3410890 - RNA, 14 nt, Human
ugcauaguuucuuu

SEQ ID NO: 3410891 - RNA, 15 nt, Human
ugcauaguuucuuua

SEQ ID NO: 3410892 - RNA, 14 nt, Human
ugcauauaacuuau

SEQ ID NO: 3410893 - RNA, 22 nt, Human
ugcauauaagggaaguaguuau

SEQ ID NO: 3410894 - RNA, 23 nt, Human
ugcauauaagggaaguaguuauc

SEQ ID NO: 3410895 - RNA, 17 nt, Human
ugcauauaaugaauaaa

SEQ ID NO: 3410896 - RNA, 20 nt, Human
ugcauauaaugaauaaauca

SEQ ID NO: 3410897 - RNA, 16 nt, Human
ugcauauccugagcca

SEQ ID NO: 3410898 - RNA, 18 nt, Human
ugcauauccugagccauc

SEQ ID NO: 3410899 - RNA, 13 nt, Human
ugcauauguugaa

SEQ ID NO: 3410900 - RNA, 13 nt, Human
ugcauauuacugu

SEQ ID NO: 3410901 - RNA, 22 nt, Human
ugcauauuacuguacaugggac

SEQ ID NO: 3410902 - RNA, 13 nt, Human
ugcauauuauaaa

SEQ ID NO: 3410903 - RNA, 16 nt, Human
ugcauauuccuuucua

SEQ ID NO: 3410904 - RNA, 22 nt, Human
ugcauauucuaguaauaaagac

SEQ ID NO: 3410905 - RNA, 14 nt, Human
ugcauauuguacac

SEQ ID NO: 3410906 - RNA, 20 nt, Human
ugcauauuguauuacuagaa

SEQ ID NO: 3410907 - RNA, 19 nt, Human
ugcauauuugcaaagugua

SEQ ID NO: 3410908 - RNA, 24 nt, Human
ugcauauuuuguaacuuccaugug

SEQ ID NO: 3410909 - RNA, 15 nt, Human
ugcaucaauccugug

SEQ ID NO: 3410910 - RNA, 21 nt, Human
ugcaucacuguaucauuuucu

SEQ ID NO: 3410911 - RNA, 20 nt, Human
ugcaucagaaagggagggcu

SEQ ID NO: 3410912 - RNA, 23 nt, Human
ugcaucagaaagggagggcucug

SEQ ID NO: 3410913 - RNA, 13 nt, Human
ugcaucagcugcu

SEQ ID NO: 3410914 - RNA, 22 nt, Human
ugcaucagcugcugaaacaaca

SEQ ID NO: 3410915 - RNA, 14 nt, Human
ugcaucaguauuaa

SEQ ID NO: 3410916 - RNA, 12 nt, Human
ugcaucaguucu

SEQ ID NO: 3410917 - RNA, 17 nt, Human
ugcaucaucuguagaua

SEQ ID NO: 3410918 - RNA, 19 nt, Human
ugcaucaucuugaacauua

SEQ ID NO: 3410919 - RNA, 18 nt, Human
ugcauccaaaggugcuca

SEQ ID NO: 3410920 - RNA, 21 nt, Human
ugcauccagcaguacaauaaa

SEQ ID NO: 3410921 - RNA, 16 nt, Human
ugcauccauuccucag

SEQ ID NO: 3410922 - RNA, 17 nt, Human
ugcauccauuccucagg

SEQ ID NO: 3410923 - RNA, 18 nt, Human
ugcauccauuccucaggg

SEQ ID NO: 3410924 - RNA, 23 nt, Human
ugcaucccaaaccacgccucuug

SEQ ID NO: 3410925 - RNA, 14 nt, Human
ugcaucccagcacc

SEQ ID NO: 3410926 - RNA, 17 nt, Human
ugcaucccccccaccuc

SEQ ID NO: 3410927 - RNA, 13 nt, Human
ugcaucccugaga

SEQ ID NO: 3410928 - RNA, 19 nt, Human
ugcauccgggggcagcucu

SEQ ID NO: 3410929 - RNA, 19 nt, Human
ugcauccguaguucccuga

SEQ ID NO: 3410930 - RNA, 18 nt, Human
ugcauccuaacuccaugu

SEQ ID NO: 3410931 - RNA, 15 nt, Human
ugcauccuccaagaa

SEQ ID NO: 3410932 - RNA, 22 nt, Human
ugcauccucuggagccagccga

SEQ ID NO: 3410933 - RNA, 20 nt, Human
ugccacugagagaucugcug

SEQ ID NO: 3410934 - RNA, 19 nt, Human
ugccacugauauucagaau

SEQ ID NO: 3410935 - RNA, 23 nt, Human
ugccacugccucuuccucccuca

SEQ ID NO: 3410936 - RNA, 19 nt, Human
ugccacuggggaaaacucc

SEQ ID NO: 3410937 - RNA, 17 nt, Human
ugccacuuaauguaugu

SEQ ID NO: 3410938 - RNA, 20 nt, Human
ugccacuuaauguauguuac

SEQ ID NO: 3410939 - RNA, 15 nt, Human
ugccacuuccuuuua

SEQ ID NO: 3410940 - RNA, 16 nt, Human
ugccacuucuaagaaa

SEQ ID NO: 3410941 - RNA, 21 nt, Human
ugccacuugaacaaaaucugu

SEQ ID NO: 3410942 - RNA, 21 nt, Human
ugccacuuuacccaccuagaa

SEQ ID NO: 3410943 - RNA, 22 nt, Human
ugccacuuuacccaccuagaac

SEQ ID NO: 3410944 - RNA, 20 nt, Human
ugccacuuugcacauuuuga

SEQ ID NO: 3410945 - RNA, 20 nt, Human
ugccagaaagcauaaaauuc

SEQ ID NO: 3410946 - RNA, 20 nt, Human
ugccagaacaguuuguacag

SEQ ID NO: 3410947 - RNA, 23 nt, Human
ugccagacgcucauucagcaucu

SEQ ID NO: 3410948 - RNA, 21 nt, Human
ugccagagaacccagcccacc

SEQ ID NO: 3410949 - RNA, 22 nt, Human
ugccagagacggaagccuuuuu

SEQ ID NO: 3410950 - RNA, 15 nt, Human
ugccagagauaaacu

SEQ ID NO: 3410951 - RNA, 20 nt, Human
ugccagagcaaagggccagg

SEQ ID NO: 3410952 - RNA, 17 nt, Human
ugccagagccuggggcu

SEQ ID NO: 3410953 - RNA, 21 nt, Human
ugccagaggaauccuggcagc

SEQ ID NO: 3410954 - RNA, 22 nt, Human
ugccagaggaauccuggcagcc

SEQ ID NO: 3410955 - RNA, 14 nt, Human
ugccagaggggaag

SEQ ID NO: 3410956 - RNA, 18 nt, Human
ugccagaggugggcaggu

SEQ ID NO: 3410957 - RNA, 19 nt, Human
ugccagaggugggcaggug

SEQ ID NO: 3410958 - RNA, 14 nt, Human
ugccagaugcugau

SEQ ID NO: 3410959 - RNA, 22 nt, Human
ugccagaugcugauguucagug

SEQ ID NO: 3410960 - RNA, 15 nt, Human
ugccagcaaagcccc

SEQ ID NO: 3410961 - RNA, 16 nt, Human
ugccagcaacugaaua

SEQ ID NO: 3410962 - RNA, 23 nt, Human
ugccagcaaugacaucucagggg

SEQ ID NO: 3410963 - RNA, 17 nt, Human
ugccagcacccccacgc

SEQ ID NO: 3410964 - RNA, 10 nt, Human
ugccagcagc

SEQ ID NO: 3410965 - RNA, 14 nt, Human
ugccagcagcagca

SEQ ID NO: 3410966 - RNA, 15 nt, Human
ugccagcagcagcag

SEQ ID NO: 3410967 - RNA, 15 nt, Human
ugccagccagcagcc

SEQ ID NO: 3410968 - RNA, 22 nt, Human
ugccagcccccuaaaagcacuc

SEQ ID NO: 3410969 - RNA, 11 nt, Human
ugccagccccu

SEQ ID NO: 3410970 - RNA, 23 nt, Human
ugccagccgagauagccaaggcc

SEQ ID NO: 3410971 - RNA, 21 nt, Human
ugccagccgugaugcucaggc

SEQ ID NO: 3410972 - RNA, 12 nt, Human
ugccagccuucc

SEQ ID NO: 3410973 - RNA, 17 nt, Human
ugccagccuuccucugc

SEQ ID NO: 3410974 - RNA, 18 nt, Human
ugccagccuuccucugca

SEQ ID NO: 3410975 - RNA, 21 nt, Human
ugccagccuuccucugcagcu

SEQ ID NO: 3410976 - RNA, 23 nt, Human
ugccagccuuccucugcagcuga

SEQ ID NO: 3410977 - RNA, 17 nt, Human
ugccagccuugagcccu

SEQ ID NO: 3410978 - RNA, 21 nt, Human
ugccagccuugagcccuggcu

SEQ ID NO: 3410979 - RNA, 17 nt, Human
ugccagcucagucccau

SEQ ID NO: 3410980 - RNA, 22 nt, Human
ugccagcucuguaucaggaccc

SEQ ID NO: 3410981 - RNA, 23 nt, Human
ugccagcucuguaucaggaccca

SEQ ID NO: 3410982 - RNA, 15 nt, Human
ugccagcucuuccua

SEQ ID NO: 3410983 - RNA, 18 nt, Human
ugccagcucuuccuagcu

SEQ ID NO: 3410984 - RNA, 20 nt, Human
ugccagcucuuccuagcugg

SEQ ID NO: 3410985 - RNA, 15 nt, Human
ugccagcugcugagc

SEQ ID NO: 3410986 - RNA, 19 nt, Human
ugccagcuuuuccucccuu

SEQ ID NO: 3410987 - RNA, 20 nt, Human
ugccaggaaacucuugcuau

SEQ ID NO: 3410988 - RNA, 19 nt, Human
ugccaggaacccuuaaaca

SEQ ID NO: 3410989 - RNA, 21 nt, Human
ugccaggaaccuguccuaagg

SEQ ID NO: 3410990 - RNA, 12 nt, Human
ugccaggaagcc

SEQ ID NO: 3410991 - RNA, 16 nt, Human
ugccaggaagccagca

SEQ ID NO: 3410992 - RNA, 23 nt, Human
ugccaggaaggggugagcacaga

SEQ ID NO: 3410993 - RNA, 13 nt, Human
ugccaggacacgc

SEQ ID NO: 3410994 - RNA, 23 nt, Human
ugccaggacaugcaauaaaauuu

SEQ ID NO: 3410995 - RNA, 22 nt, Human
ugccaggacuccccaggccagg

SEQ ID NO: 3410996 - RNA, 23 nt, Human
ugccaggacuccccaggccaggc

SEQ ID NO: 3410997 - RNA, 13 nt, Human
ugccaggaggacc

SEQ ID NO: 3410998 - RNA, 21 nt, Human
ugccaggagggacaaaggagc

SEQ ID NO: 3410999 - RNA, 18 nt, Human
ugccaggauggaaugaug

SEQ ID NO: 3411000 - RNA, 18 nt, Human
ugccaggcacaggcaggg

SEQ ID NO: 3411001 - RNA, 17 nt, Human
ugccaggcagggguggg

SEQ ID NO: 3411002 - RNA, 18 nt, Human
ugccaggccagccuccga

SEQ ID NO: 3411003 - RNA, 22 nt, Human
ugccaggcccccaccacacauc

SEQ ID NO: 3411004 - RNA, 11 nt, Human
ugccaggcccg

SEQ ID NO: 3411005 - RNA, 14 nt, Human
ugccaggcccgggg

SEQ ID NO: 3411006 - RNA, 16 nt, Human
ugccaggcuaauuuuu

SEQ ID NO: 3411007 - RNA, 17 nt, Human
ugccaggcuggagugca

SEQ ID NO: 3411008 - RNA, 11 nt, Human
ugccagggaca

SEQ ID NO: 3411009 - RNA, 15 nt, Human
ugccagggagacaga

SEQ ID NO: 3411010 - RNA, 23 nt, Human
ugccagggccaugucagacacag

SEQ ID NO: 3411011 - RNA, 12 nt, Human
ugccagggcccg

SEQ ID NO: 3411012 - RNA, 11 nt, Human
ugccaggggag

SEQ ID NO: 3411013 - RNA, 20 nt, Human
ugccaggguuucgagaagcu

SEQ ID NO: 3411014 - RNA, 18 nt, Human
ugccaggucccuuucauu

SEQ ID NO: 3411015 - RNA, 22 nt, Human
ugccaggugaaggaggcuccag

SEQ ID NO: 3411016 - RNA, 19 nt, Human
ugccagguuuucugggugu

SEQ ID NO: 3411017 - RNA, 22 nt, Human
ugccaguaaaaaaaaaaaaugg

SEQ ID NO: 3411018 - RNA, 17 nt, Human
ugccaguaacaggcuca

SEQ ID NO: 3411019 - RNA, 18 nt, Human
ugccaguaacgcgucuuc

SEQ ID NO: 3411020 - RNA, 13 nt, Human
ugccaguauuuuu

SEQ ID NO: 3411021 - RNA, 18 nt, Human
ugccaguauuuuuaaagg

SEQ ID NO: 3411022 - RNA, 16 nt, Human
ugccagucaccccggc

SEQ ID NO: 3411023 - RNA, 18 nt, Human
ugccagucaccccggcca

SEQ ID NO: 3411024 - RNA, 20 nt, Human
ugccagucaccccggccacc

SEQ ID NO: 3411025 - RNA, 22 nt, Human
ugccagucaccccggccaccug

SEQ ID NO: 3411026 - RNA, 17 nt, Human
ugccaguccuagcugca

SEQ ID NO: 3411027 - RNA, 15 nt, Human
ugccaguccuguccu

SEQ ID NO: 3411028 - RNA, 16 nt, Human
ugccagugacagacag

SEQ ID NO: 3411029 - RNA, 17 nt, Human
ugccagugacagacagg

SEQ ID NO: 3411030 - RNA, 22 nt, Human
ugccagugccuuaccuccugcc

SEQ ID NO: 3411031 - RNA, 23 nt, Human
ugccagugccuuaccuccugccc

SEQ ID NO: 3411032 - RNA, 12 nt, Human
ugccagugucuu

SEQ ID NO: 3411033 - RNA, 13 nt, Human
ugccagugugcug

SEQ ID NO: 3411034 - RNA, 21 nt, Human
ugccauaaaacauuaagaaaa

SEQ ID NO: 3411035 - RNA, 22 nt, Human
ugccauaaaacauuaagaaaau

SEQ ID NO: 3411036 - RNA, 23 nt, Human
ugccauaaaacauuaagaaaauc

SEQ ID NO: 3411037 - RNA, 16 nt, Human
ugccauaauacaaaag

SEQ ID NO: 3411038 - RNA, 15 nt, Human
ugccauagaguacac

SEQ ID NO: 3411039 - RNA, 18 nt, Human
ugccauagaguuuaacac

SEQ ID NO: 3411040 - RNA, 21 nt, Human
ugccauagaguuuaacacaag

SEQ ID NO: 3411041 - RNA, 18 nt, Human
ugccauagucacauggcc

SEQ ID NO: 3411042 - RNA, 19 nt, Human
ugccauagucacauggccu

SEQ ID NO: 3411043 - RNA, 20 nt, Human
ugccauagucuuaacugguc

SEQ ID NO: 3411044 - RNA, 21 nt, Human
ugccauauauaacagauacau

SEQ ID NO: 3411045 - RNA, 18 nt, Human
ugccauaugauuuacauu

SEQ ID NO: 3411046 - RNA, 23 nt, Human
ugccauauuaaauuuuuuguuga

SEQ ID NO: 3411047 - RNA, 20 nt, Human
ugccauauucuguuggccag

SEQ ID NO: 3411048 - RNA, 15 nt, Human
ugccauauugcacau

SEQ ID NO: 3411049 - RNA, 21 nt, Human
ugccaucaacuacuauucaaa

SEQ ID NO: 3411050 - RNA, 13 nt, Human
ugccaucaucucc

SEQ ID NO: 3411051 - RNA, 16 nt, Human
ugccaucauguuuaca

SEQ ID NO: 3411052 - RNA, 14 nt, Human
ugccaucauugcug

SEQ ID NO: 3411053 - RNA, 12 nt, Human
ugccauccaagu

SEQ ID NO: 3411054 - RNA, 12 nt, Human
ugccauccaggu

SEQ ID NO: 3411055 - RNA, 11 nt, Human
ugccaucccuc

SEQ ID NO: 3411056 - RNA, 12 nt, Human
ugccaucccucc

SEQ ID NO: 3411057 - RNA, 19 nt, Human
ugccauccucaaacacugc

SEQ ID NO: 3411058 - RNA, 15 nt, Human
ugccauccucuuucu

SEQ ID NO: 3411059 - RNA, 17 nt, Human
ugccauccucuuucucu

SEQ ID NO: 3411060 - RNA, 15 nt, Human
ugccauccuggccca

SEQ ID NO: 3411061 - RNA, 18 nt, Human
ugccaucuagccagcccc

SEQ ID NO: 3411062 - RNA, 16 nt, Human
ugccaucuaucuaguu

SEQ ID NO: 3411063 - RNA, 13 nt, Human
ugccaucucugcu

SEQ ID NO: 3411064 - RNA, 15 nt, Human
ugccaucucugcucc

SEQ ID NO: 3411065 - RNA, 12 nt, Human
ugccaucuguag

SEQ ID NO: 3411066 - RNA, 16 nt, Human
ugccaucuguguccug

SEQ ID NO: 3411067 - RNA, 19 nt, Human
ugccaugaacuggaggcca

SEQ ID NO: 3411068 - RNA, 20 nt, Human
ugccaugaagggacccuuug

SEQ ID NO: 3411069 - RNA, 18 nt, Human
ugccaugagccgcccaag

SEQ ID NO: 3411070 - RNA, 23 nt, Human
ugccaugagccgcccaaggccuu

SEQ ID NO: 3411071 - RNA, 20 nt, Human
ugccaugaggaacaaggcaa

SEQ ID NO: 3411072 - RNA, 23 nt, Human
ugccaugaggaacaaggcaaggc

SEQ ID NO: 3411073 - RNA, 17 nt, Human
ugccaugaugccucugu

SEQ ID NO: 3411074 - RNA, 20 nt, Human
ugccaugaugccucugucuu

SEQ ID NO: 3411075 - RNA, 20 nt, Human
ugccauggacagaagaaggc

SEQ ID NO: 3411076 - RNA, 12 nt, Human
ugcccugcuuuc

SEQ ID NO: 3411077 - RNA, 17 nt, Human
ugcccugcuuucagaua

SEQ ID NO: 3411078 - RNA, 18 nt, Human
ugcccuggauccaucagg

SEQ ID NO: 3411079 - RNA, 16 nt, Human
ugcccuggaugcccag

SEQ ID NO: 3411080 - RNA, 22 nt, Human
ugcccuggcagggucauccugu

SEQ ID NO: 3411081 - RNA, 23 nt, Human
ugcccuggcagggucauccugug

SEQ ID NO: 3411082 - RNA, 14 nt, Human
ugcccuggcccuga

SEQ ID NO: 3411083 - RNA, 22 nt, Human
ugcccuggcccugagguguggg

SEQ ID NO: 3411084 - RNA, 20 nt, Human
ugcccuggcugcugccccca

SEQ ID NO: 3411085 - RNA, 15 nt, Human
ugcccugggaggcag

SEQ ID NO: 3411086 - RNA, 17 nt, Human
ugcccugggaggcagug

SEQ ID NO: 3411087 - RNA, 18 nt, Human
ugcccugggaggcaguga

SEQ ID NO: 3411088 - RNA, 13 nt, Human
ugcccugggccac

SEQ ID NO: 3411089 - RNA, 20 nt, Human
ugcccuggugcugccacacu

SEQ ID NO: 3411090 - RNA, 21 nt, Human
ugcccuggugcugccacacuu

SEQ ID NO: 3411091 - RNA, 16 nt, Human
ugcccugguggcccuc

SEQ ID NO: 3411092 - RNA, 21 nt, Human
ugcccugguggcccucucccc

SEQ ID NO: 3411093 - RNA, 22 nt, Human
ugcccugguggcccucuccccu

SEQ ID NO: 3411094 - RNA, 19 nt, Human
ugcccugugggaccccagg

SEQ ID NO: 3411095 - RNA, 13 nt, Human
ugcccuguguacu

SEQ ID NO: 3411096 - RNA, 20 nt, Human
ugcccuguguacuucccggg

SEQ ID NO: 3411097 - RNA, 20 nt, Human
ugcccuguuaaaagaugaaa

SEQ ID NO: 3411098 - RNA, 20 nt, Human
ugcccuguuguguauagaug

SEQ ID NO: 3411099 - RNA, 19 nt, Human
ugcccuuaccugccaggaa

SEQ ID NO: 3411100 - RNA, 22 nt, Human
ugcccuuaccugccaggaagcc

SEQ ID NO: 3411101 - RNA, 13 nt, Human
ugcccuuaggcca

SEQ ID NO: 3411102 - RNA, 15 nt, Human
ugcccuucacuguca

SEQ ID NO: 3411103 - RNA, 15 nt, Human
ugcccuucccugucc

SEQ ID NO: 3411104 - RNA, 18 nt, Human
ugcccuuccucaguuuaa

SEQ ID NO: 3411105 - RNA, 13 nt, Human
ugcccuugcccug

SEQ ID NO: 3411106 - RNA, 15 nt, Human
ugcccuugcccugac

SEQ ID NO: 3411107 - RNA, 19 nt, Human
ugcccuuggaggccagcca

SEQ ID NO: 3411108 - RNA, 18 nt, Human
ugcccuuggcacccaaga

SEQ ID NO: 3411109 - RNA, 13 nt, Human
ugcccuugggcca

SEQ ID NO: 3411110 - RNA, 20 nt, Human
ugcccuuguuuggggcagga

SEQ ID NO: 3411111 - RNA, 23 nt, Human
ugcccuuguuuggggcaggagua

SEQ ID NO: 3411112 - RNA, 15 nt, Human
ugcccuuucugggca

SEQ ID NO: 3411113 - RNA, 17 nt, Human
ugcccuuuguccuccug

SEQ ID NO: 3411114 - RNA, 18 nt, Human
ugccgaaacuggaaguua

SEQ ID NO: 3411115 - RNA, 22 nt, Human
ugccgaccgaggcuggagcugg

SEQ ID NO: 3411116 - RNA, 15 nt, Human
ugccgagcaaccgug

SEQ ID NO: 3411117 - RNA, 17 nt, Human
ugccgagcaaccguggc

SEQ ID NO: 3411118 - RNA, 14 nt, Human
ugccgaggagccag

SEQ ID NO: 3411119 - RNA, 17 nt, Human
ugccgaggagccaggca

SEQ ID NO: 3411120 - RNA, 21 nt, Human
ugccgauauacucuagaugaa

SEQ ID NO: 3411121 - RNA, 13 nt, Human
ugccgauuucugu

SEQ ID NO: 3411122 - RNA, 20 nt, Human
ugccgauuucuguaaacucu

SEQ ID NO: 3411123 - RNA, 15 nt, Human
ugccgcaaauuguac

SEQ ID NO: 3411124 - RNA, 12 nt, Human
ugccgcacccca

SEQ ID NO: 3411125 - RNA, 18 nt, Human
ugccgcaccccagagugu

SEQ ID NO: 3411126 - RNA, 14 nt, Human
ugccgccccaccca

SEQ ID NO: 3411127 - RNA, 15 nt, Human
ugccgccccacccag

SEQ ID NO: 3411128 - RNA, 15 nt, Human
ugccgccgccucgcc

SEQ ID NO: 3411129 - RNA, 18 nt, Human
ugccgccgccucgcccac

SEQ ID NO: 3411130 - RNA, 21 nt, Human
ugccgccgccucgcccaccgc

SEQ ID NO: 3411131 - RNA, 21 nt, Human
ugccgcgucgcccucccaggc

SEQ ID NO: 3411132 - RNA, 13 nt, Human
ugccgcuaccucc

SEQ ID NO: 3411133 - RNA, 14 nt, Human
ugccggaugugcuu

SEQ ID NO: 3411134 - RNA, 14 nt, Human
ugccggcccugggg

SEQ ID NO: 3411135 - RNA, 15 nt, Human
ugccggcccuggggc

SEQ ID NO: 3411136 - RNA, 16 nt, Human
ugccggccggggcuga

SEQ ID NO: 3411137 - RNA, 16 nt, Human
ugccggcucuggcucu

SEQ ID NO: 3411138 - RNA, 14 nt, Human
ugccgggccugauu

SEQ ID NO: 3411139 - RNA, 14 nt, Human
ugccgucaccacca

SEQ ID NO: 3411140 - RNA, 17 nt, Human
ugccgucaccaccaccc

SEQ ID NO: 3411141 - RNA, 15 nt, Human
ugccgucuaccugag

SEQ ID NO: 3411142 - RNA, 16 nt, Human
ugccgucuaccugagg

SEQ ID NO: 3411143 - RNA, 19 nt, Human
ugccgucuaccugaggggc

SEQ ID NO: 3411144 - RNA, 22 nt, Human
ugccguggauugcacguggccu

SEQ ID NO: 3411145 - RNA, 13 nt, Human
ugccguggcacca

SEQ ID NO: 3411146 - RNA, 21 nt, Human
ugccguguccccugacagggc

SEQ ID NO: 3411147 - RNA, 22 nt, Human
ugccguuacucuccaaccugga

SEQ ID NO: 3411148 - RNA, 23 nt, Human
ugccuaaauccauuuggaaaucu

SEQ ID NO: 3411149 - RNA, 16 nt, Human
ugccuaacaaaauauu

SEQ ID NO: 3411150 - RNA, 19 nt, Human
ugccuaagaauaaacauuu

SEQ ID NO: 3411151 - RNA, 18 nt, Human
ugccuaagcauugccugg

SEQ ID NO: 3411152 - RNA, 12 nt, Human
ugccuaaggacu

SEQ ID NO: 3411153 - RNA, 17 nt, Human
ugccuaaguauuaaaac

SEQ ID NO: 3411154 - RNA, 21 nt, Human
ugccuaaguauuaaaacauug

SEQ ID NO: 3411155 - RNA, 22 nt, Human
ugccuaaguauuaaaacauugg

SEQ ID NO: 3411156 - RNA, 23 nt, Human
ugccuaaguauuaaaacauugga

SEQ ID NO: 3411157 - RNA, 14 nt, Human
ugccuaaguggcug

SEQ ID NO: 3411158 - RNA, 17 nt, Human
ugccuaaguggcugcug

SEQ ID NO: 3411159 - RNA, 22 nt, Human
ugccuaauaugaugacuguuuu

SEQ ID NO: 3411160 - RNA, 15 nt, Human
ugccuacauuaucua

SEQ ID NO: 3411161 - RNA, 23 nt, Human
ugccuaccaauauuuaaucuuuu

SEQ ID NO: 3411162 - RNA, 12 nt, Human
ugccuacugcau

SEQ ID NO: 3411163 - RNA, 13 nt, Human
ugccuagaaacaa

SEQ ID NO: 3411164 - RNA, 19 nt, Human
ugccuagaaacaacacugu

SEQ ID NO: 3411165 - RNA, 22 nt, Human
ugccuagaaacaacacuguagu

SEQ ID NO: 3411166 - RNA, 23 nt, Human
ugccuagaaacaacacuguagua

SEQ ID NO: 3411167 - RNA, 17 nt, Human
ugccuagauucagggaa

SEQ ID NO: 3411168 - RNA, 19 nt, Human
ugccuagcaagcuggccuc

SEQ ID NO: 3411169 - RNA, 18 nt, Human
ugccuaggauugugccug

SEQ ID NO: 3411170 - RNA, 17 nt, Human
ugccuagggccuggucc

SEQ ID NO: 3411171 - RNA, 16 nt, Human
ugccuaguuuuuagua

SEQ ID NO: 3411172 - RNA, 17 nt, Human
ugccuauaagccaaaau

SEQ ID NO: 3411173 - RNA, 14 nt, Human
ugccuauaguccca

SEQ ID NO: 3411174 - RNA, 21 nt, Human
ugccuauaugagaagaauagc

SEQ ID NO: 3411175 - RNA, 23 nt, Human
ugccuauccugcuguucuagcac

SEQ ID NO: 3411176 - RNA, 17 nt, Human
ugccuauugcuagagcu

SEQ ID NO: 3411177 - RNA, 15 nt, Human
ugccuauuguaauau

SEQ ID NO: 3411178 - RNA, 14 nt, Human
ugccuauuugugug

SEQ ID NO: 3411179 - RNA, 12 nt, Human
ugccucaaauaa

SEQ ID NO: 3411180 - RNA, 22 nt, Human
ugccucaaauaaaaagugcuuu

SEQ ID NO: 3411181 - RNA, 14 nt, Human
ugccucaaccuccc

SEQ ID NO: 3411182 - RNA, 14 nt, Human
ugccucaagagaag

SEQ ID NO: 3411183 - RNA, 15 nt, Human
ugccucaagagaagg

SEQ ID NO: 3411184 - RNA, 18 nt, Human
ugccucaagaggaaugaa

SEQ ID NO: 3411185 - RNA, 13 nt, Human
ugccucaaugcca

SEQ ID NO: 3411186 - RNA, 16 nt, Human
ugccucaaugccagua

SEQ ID NO: 3411187 - RNA, 20 nt, Human
ugccucacccacccuuuuuu

SEQ ID NO: 3411188 - RNA, 15 nt, Human
ugccucaccgcuucc

SEQ ID NO: 3411189 - RNA, 16 nt, Human
ugccucaccgcuuccc

SEQ ID NO: 3411190 - RNA, 15 nt, Human
ugccucacuaauuuu

SEQ ID NO: 3411191 - RNA, 18 nt, Human
ugccucacuaauuuuugu

SEQ ID NO: 3411192 - RNA, 12 nt, Human
ugccucagaacg

SEQ ID NO: 3411193 - RNA, 18 nt, Human
ugccucagagaccagggc

SEQ ID NO: 3411194 - RNA, 19 nt, Human
ugccucagcccugacccug

SEQ ID NO: 3411195 - RNA, 12 nt, Human
ugccucagccuc

SEQ ID NO: 3411196 - RNA, 14 nt, Human
ugccucagccuccc

SEQ ID NO: 3411197 - RNA, 14 nt, Human
ugccucagccuccg

SEQ ID NO: 3411198 - RNA, 17 nt, Human
ugccucagccuccugag

SEQ ID NO: 3411199 - RNA, 16 nt, Human
ugccucaggccucugu

SEQ ID NO: 3411200 - RNA, 12 nt, Human
ugccucagguuc

SEQ ID NO: 3411201 - RNA, 21 nt, Human
ugccucaguauauuuaaacuc

SEQ ID NO: 3411202 - RNA, 19 nt, Human
ugccucaguguauuuguau

SEQ ID NO: 3411203 - RNA, 20 nt, Human
ugccucaucuauaacaugca

SEQ ID NO: 3411204 - RNA, 21 nt, Human
ugccucauuuuagaaccacca

SEQ ID NO: 3411205 - RNA, 16 nt, Human
ugccucauuuuuuucc

SEQ ID NO: 3411206 - RNA, 17 nt, Human
ugccuccaccaccacug

SEQ ID NO: 3411207 - RNA, 12 nt, Human
ugccuccacccu

SEQ ID NO: 3411208 - RNA, 13 nt, Human
ugccuccacccuc

SEQ ID NO: 3411209 - RNA, 15 nt, Human
ugccuccacccucug

SEQ ID NO: 3411210 - RNA, 16 nt, Human
ugccuccacccucuga

SEQ ID NO: 3411211 - RNA, 17 nt, Human
ugccuccacccucugag

SEQ ID NO: 3411212 - RNA, 13 nt, Human
ugccuccaccgcu

SEQ ID NO: 3411213 - RNA, 16 nt, Human
ugccuccaccgcugcc

SEQ ID NO: 3411214 - RNA, 19 nt, Human
ugccuccacucccacuucc

SEQ ID NO: 3411215 - RNA, 20 nt, Human
ugccuccacucccacuuccc

SEQ ID NO: 3411216 - RNA, 19 nt, Human
ugccuccaggaaccacacc

SEQ ID NO: 3411217 - RNA, 17 nt, Human
ugccuccagggcuggac

SEQ ID NO: 3411218 - RNA, 20 nt, Human
ugccuccagggcuggacuga

SEQ ID NO: 3411219 - RNA, 21 nt, Human
ugccuccagggcuggacugag

SEQ ID NO: 3411220 - RNA, 13 nt, Human
ugccuccaggugu

SEQ ID NO: 3411221 - RNA, 15 nt, Human
uggaauauuguccau

SEQ ID NO: 3411222 - RNA, 20 nt, Human
uggaauauuguccauugucc

SEQ ID NO: 3411223 - RNA, 16 nt, Human
uggaaucagcucagga

SEQ ID NO: 3411224 - RNA, 12 nt, Human
uggaaucuggag

SEQ ID NO: 3411225 - RNA, 13 nt, Human
uggaaucuggaga

SEQ ID NO: 3411226 - RNA, 17 nt, Human
uggaaucuggagaccag

SEQ ID NO: 3411227 - RNA, 15 nt, Human
uggaaucuggagagc

SEQ ID NO: 3411228 - RNA, 18 nt, Human
uggaaugaauuaaauaaa

SEQ ID NO: 3411229 - RNA, 20 nt, Human
uggaaugaugggucaguugu

SEQ ID NO: 3411230 - RNA, 17 nt, Human
uggaaugcuuccuagaa

SEQ ID NO: 3411231 - RNA, 15 nt, Human
uggaauggacauccu

SEQ ID NO: 3411232 - RNA, 22 nt, Human
uggaaugguacaugucuuccau

SEQ ID NO: 3411233 - RNA, 18 nt, Human
uggaaugguuauaaaagu

SEQ ID NO: 3411234 - RNA, 16 nt, Human
uggaaugguuugggaa

SEQ ID NO: 3411235 - RNA, 14 nt, Human
uggaauguaaucaa

SEQ ID NO: 3411236 - RNA, 21 nt, Human
uggaauguggccccugaacaa

SEQ ID NO: 3411237 - RNA, 21 nt, Human
uggaauuaaaaggauaguauu

SEQ ID NO: 3411238 - RNA, 16 nt, Human
uggaauuaaccuggug

SEQ ID NO: 3411239 - RNA, 19 nt, Human
uggaauuaaccuggugcug

SEQ ID NO: 3411240 - RNA, 20 nt, Human
uggaauuagcuuggggccag

SEQ ID NO: 3411241 - RNA, 17 nt, Human
uggaauuauuuuaaaag

SEQ ID NO: 3411242 - RNA, 19 nt, Human
uggaauuccauuugaggau

SEQ ID NO: 3411243 - RNA, 12 nt, Human
uggaauugauuu

SEQ ID NO: 3411244 - RNA, 15 nt, Human
uggaauugauuugca

SEQ ID NO: 3411245 - RNA, 18 nt, Human
uggaauugauuugcauug

SEQ ID NO: 3411246 - RNA, 22 nt, Human
uggaauugauuugcauugaaca

SEQ ID NO: 3411247 - RNA, 15 nt, Human
uggaauugccagcug

SEQ ID NO: 3411248 - RNA, 18 nt, Human
uggaauuggagcucgugg

SEQ ID NO: 3411249 - RNA, 22 nt, Human
uggaauuggguggggggcuuca

SEQ ID NO: 3411250 - RNA, 19 nt, Human
uggaauuuaccaguuaauu

SEQ ID NO: 3411251 - RNA, 22 nt, Human
uggaauuucuuguuucuccaga

SEQ ID NO: 3411252 - RNA, 17 nt, Human
uggaauuugccugcugg

SEQ ID NO: 3411253 - RNA, 16 nt, Human
uggaauuuguaaguuu

SEQ ID NO: 3411254 - RNA, 12 nt, Human
uggaauuuuuca

SEQ ID NO: 3411255 - RNA, 18 nt, Human
uggacaaacuggagucug

SEQ ID NO: 3411256 - RNA, 15 nt, Human
uggacaaaucacaua

SEQ ID NO: 3411257 - RNA, 21 nt, Human
uggacaaaucacauauuuuaa

SEQ ID NO: 3411258 - RNA, 13 nt, Human
uggacaaauguga

SEQ ID NO: 3411259 - RNA, 18 nt, Human
uggacaaaugugaagaug

SEQ ID NO: 3411260 - RNA, 21 nt, Human
uggacaaaugugaagaugcau

SEQ ID NO: 3411261 - RNA, 22 nt, Human
uggacaagcagagguggccaga

SEQ ID NO: 3411262 - RNA, 16 nt, Human
uggacaagcuucugag

SEQ ID NO: 3411263 - RNA, 19 nt, Human
uggacaagcuucugagacg

SEQ ID NO: 3411264 - RNA, 13 nt, Human
uggacaaggaggu

SEQ ID NO: 3411265 - RNA, 20 nt, Human
uggacacacacagacuauuu

SEQ ID NO: 3411266 - RNA, 21 nt, Human
uggacacagcucuucuccagg

SEQ ID NO: 3411267 - RNA, 22 nt, Human
uggacaccccuuauccaggacu

SEQ ID NO: 3411268 - RNA, 10 nt, Human
uggacaccug

SEQ ID NO: 3411269 - RNA, 11 nt, Human
uggacaccugc

SEQ ID NO: 3411270 - RNA, 15 nt, Human
uggacaccugcccug

SEQ ID NO: 3411271 - RNA, 17 nt, Human
uggacacuacacccagc

SEQ ID NO: 3411272 - RNA, 20 nt, Human
uggacacuacacccagcaau

SEQ ID NO: 3411273 - RNA, 16 nt, Human
uggacacucagaccug

SEQ ID NO: 3411274 - RNA, 23 nt, Human
uggacacuccagggacacacagc

SEQ ID NO: 3411275 - RNA, 23 nt, Human
uggacacuuuucaccuccuucaa

SEQ ID NO: 3411276 - RNA, 15 nt, Human
uggacagaagcagcu

SEQ ID NO: 3411277 - RNA, 17 nt, Human
uggacagaagcagcucu

SEQ ID NO: 3411278 - RNA, 18 nt, Human
uggacagaagcagcucuu

SEQ ID NO: 3411279 - RNA, 18 nt, Human
uggacagaggggacucug

SEQ ID NO: 3411280 - RNA, 21 nt, Human
uggacagauugccuguuucug

SEQ ID NO: 3411281 - RNA, 21 nt, Human
uggacagcaaaaccauugcuu

SEQ ID NO: 3411282 - RNA, 14 nt, Human
uggacagcugugcc

SEQ ID NO: 3411283 - RNA, 23 nt, Human
uggacaggacuaacacucagaag

SEQ ID NO: 3411284 - RNA, 13 nt, Human
uggacaggaugug

SEQ ID NO: 3411285 - RNA, 17 nt, Human
uggacaggcauguucuc

SEQ ID NO: 3411286 - RNA, 18 nt, Human
uggacaggcauguucucu

SEQ ID NO: 3411287 - RNA, 22 nt, Human
uggacaggcauguucucugagg

SEQ ID NO: 3411288 - RNA, 16 nt, Human
uggacaggucugggag

SEQ ID NO: 3411289 - RNA, 21 nt, Human
uggacaguaucacugucuuuc

SEQ ID NO: 3411290 - RNA, 20 nt, Human
uggacagucacugccacuuu

SEQ ID NO: 3411291 - RNA, 20 nt, Human
uggacaguucacacccugca

SEQ ID NO: 3411292 - RNA, 23 nt, Human
uggacaguuuaccaguugccuuu

SEQ ID NO: 3411293 - RNA, 20 nt, Human
uggacauaacugacuuaguu

SEQ ID NO: 3411294 - RNA, 14 nt, Human
uggacauagagagg

SEQ ID NO: 3411295 - RNA, 22 nt, Human
uggacauagauauuuucacaau

SEQ ID NO: 3411296 - RNA, 23 nt, Human
uggacauccuccucccacccggc

SEQ ID NO: 3411297 - RNA, 18 nt, Human
uggacauccucuucugcu

SEQ ID NO: 3411298 - RNA, 16 nt, Human
uggacaugagauaaug

SEQ ID NO: 3411299 - RNA, 19 nt, Human
uggacaugcacagcuaaca

SEQ ID NO: 3411300 - RNA, 12 nt, Human
uggacauggccc

SEQ ID NO: 3411301 - RNA, 23 nt, Human
uggacauuaagcaucacaaauga

SEQ ID NO: 3411302 - RNA, 18 nt, Human
uggacauuucuaauuccu

SEQ ID NO: 3411303 - RNA, 17 nt, Human
uggacauuugccuugcu

SEQ ID NO: 3411304 - RNA, 15 nt, Human
uggaccaaaaaccag

SEQ ID NO: 3411305 - RNA, 20 nt, Human
uggaccacugcaugagcuuu

SEQ ID NO: 3411306 - RNA, 19 nt, Human
uggaccacugggcaaugau

SEQ ID NO: 3411307 - RNA, 20 nt, Human
uggaccacuguuucuugcuu

SEQ ID NO: 3411308 - RNA, 22 nt, Human
uggaccagccucuccacucaug

SEQ ID NO: 3411309 - RNA, 17 nt, Human
uggaccaguggugccuu

SEQ ID NO: 3411310 - RNA, 23 nt, Human
uggaccaugcugucuggcacagc

SEQ ID NO: 3411311 - RNA, 15 nt, Human
uggaccauuuuccug

SEQ ID NO: 3411312 - RNA, 20 nt, Human
uggacccagggaugacaugu

SEQ ID NO: 3411313 - RNA, 13 nt, Human
uggaccccagcug

SEQ ID NO: 3411314 - RNA, 20 nt, Human
uggaccccagcugggaggca

SEQ ID NO: 3411315 - RNA, 18 nt, Human
uggaccccaucugugaau

SEQ ID NO: 3411316 - RNA, 20 nt, Human
uggaccccccuuucacaggc

SEQ ID NO: 3411317 - RNA, 19 nt, Human
uggacccgcucuggaccaa

SEQ ID NO: 3411318 - RNA, 20 nt, Human
uggacccguucaugggggag

SEQ ID NO: 3411319 - RNA, 21 nt, Human
uggacccguucaugggggagg

SEQ ID NO: 3411320 - RNA, 15 nt, Human
uggacccugaaaugu

SEQ ID NO: 3411321 - RNA, 13 nt, Human
uggacccugacca

SEQ ID NO: 3411322 - RNA, 15 nt, Human
uggacccugaccagc

SEQ ID NO: 3411323 - RNA, 13 nt, Human
uggacccugaggc

SEQ ID NO: 3411324 - RNA, 14 nt, Human
uggacccugaggcc

SEQ ID NO: 3411325 - RNA, 15 nt, Human
uggacccugaggccc

SEQ ID NO: 3411326 - RNA, 16 nt, Human
uggacccugaggccca

SEQ ID NO: 3411327 - RNA, 18 nt, Human
uggacccugaggcccaga

SEQ ID NO: 3411328 - RNA, 14 nt, Human
uggacccuguugcu

SEQ ID NO: 3411329 - RNA, 19 nt, Human
uggaccgcccuuuuccccu

SEQ ID NO: 3411330 - RNA, 17 nt, Human
uggaccuaaauggccuc

SEQ ID NO: 3411331 - RNA, 17 nt, Human
uggaccuaacauucgau

SEQ ID NO: 3411332 - RNA, 14 nt, Human
uggaccuaauccaa

SEQ ID NO: 3411333 - RNA, 19 nt, Human
uggaccuauguccuaagga

SEQ ID NO: 3411334 - RNA, 22 nt, Human
uggaccuauguccuaaggacac

SEQ ID NO: 3411335 - RNA, 15 nt, Human
uggaccucaccaagc

SEQ ID NO: 3411336 - RNA, 13 nt, Human
uggaccucugaca

SEQ ID NO: 3411337 - RNA, 14 nt, Human
uggaccucugacag

SEQ ID NO: 3411338 - RNA, 15 nt, Human
uggaccucugacagc

SEQ ID NO: 3411339 - RNA, 16 nt, Human
uggaccucugcucuga

SEQ ID NO: 3411340 - RNA, 17 nt, Human
uggaccugccuccugcc

SEQ ID NO: 3411341 - RNA, 18 nt, Human
uggaccugccuccugccu

SEQ ID NO: 3411342 - RNA, 19 nt, Human
uggaccugccuccugccug

SEQ ID NO: 3411343 - RNA, 14 nt, Human
uggaccugccugca

SEQ ID NO: 3411344 - RNA, 22 nt, Human
uggaccuuacgaucaggcacag

SEQ ID NO: 3411345 - RNA, 15 nt, Human
uggaccuuaggccuu

SEQ ID NO: 3411346 - RNA, 21 nt, Human
uggaccuuaggccuuccucuc

SEQ ID NO: 3411347 - RNA, 13 nt, Human
uggaccuuccugc

SEQ ID NO: 3411348 - RNA, 14 nt, Human
uggaccuuccugcc

SEQ ID NO: 3411349 - RNA, 15 nt, Human
uggaccuuuuaaagu

SEQ ID NO: 3411350 - RNA, 21 nt, Human
uggaccuuuuaaaguguuuca

SEQ ID NO: 3411351 - RNA, 15 nt, Human
uggacggcaggcuca

SEQ ID NO: 3411352 - RNA, 15 nt, Human
uggacggcugggcac

SEQ ID NO: 3411353 - RNA, 13 nt, Human
uggacuaaaagau

SEQ ID NO: 3411354 - RNA, 22 nt, Human
uggacuaaaagauauaagugcu

SEQ ID NO: 3411355 - RNA, 16 nt, Human
uggacuaaaugccuag

SEQ ID NO: 3411356 - RNA, 22 nt, Human
uggacuaaccccaacgcacagg

SEQ ID NO: 3411357 - RNA, 20 nt, Human
uggacuaacuugucuuugga

SEQ ID NO: 3411358 - RNA, 14 nt, Human
uggacuaucugucu

SEQ ID NO: 3411359 - RNA, 17 nt, Human
uggacuaucugucuggu

SEQ ID NO: 3411360 - RNA, 20 nt, Human
uggacuaucugucugguggc

SEQ ID NO: 3411361 - RNA, 22 nt, Human
uggacuaucugucugguggccc

SEQ ID NO: 3411362 - RNA, 18 nt, Human
uggacuauuauaauuuaa

SEQ ID NO: 3411363 - RNA, 17 nt, Human
uggacucaaucccuagg

SEQ ID NO: 3411364 - RNA, 16 nt, Human
uggacucaggaugccc

SEQ ID NO: 3411365 - RNA, 22 nt, Human
uggagcccagggcaucuugcug

SEQ ID NO: 3411366 - RNA, 15 nt, Human
uggagccccacacug

SEQ ID NO: 3411367 - RNA, 12 nt, Human
uggagccccagc

SEQ ID NO: 3411368 - RNA, 16 nt, Human
uggagccccagccccc

SEQ ID NO: 3411369 - RNA, 22 nt, Human
uggagccccagcccccuuuggg

SEQ ID NO: 3411370 - RNA, 13 nt, Human
uggagccccaggg

SEQ ID NO: 3411371 - RNA, 15 nt, Human
uggagccccugggug

SEQ ID NO: 3411372 - RNA, 17 nt, Human
uggagcccgaggcacca

SEQ ID NO: 3411373 - RNA, 19 nt, Human
uggagcccgaggcaccagu

SEQ ID NO: 3411374 - RNA, 17 nt, Human
uggagcccgcaccccca

SEQ ID NO: 3411375 - RNA, 17 nt, Human
uggagcccuccgccuuc

SEQ ID NO: 3411376 - RNA, 19 nt, Human
uggagcccuccgccuucac

SEQ ID NO: 3411377 - RNA, 16 nt, Human
uggagcccuggagacc

SEQ ID NO: 3411378 - RNA, 22 nt, Human
uggagccuagagugagggccug

SEQ ID NO: 3411379 - RNA, 20 nt, Human
uggagccuccacugccucug

SEQ ID NO: 3411380 - RNA, 22 nt, Human
uggagccugagucagggcccag

SEQ ID NO: 3411381 - RNA, 14 nt, Human
uggagccuggcaca

SEQ ID NO: 3411382 - RNA, 14 nt, Human
uggagccuggugcc

SEQ ID NO: 3411383 - RNA, 17 nt, Human
uggagccuguguaacag

SEQ ID NO: 3411384 - RNA, 23 nt, Human
uggagcgagcaucccccaaaguu

SEQ ID NO: 3411385 - RNA, 22 nt, Human
uggagcgcaccugcccccuggu

SEQ ID NO: 3411386 - RNA, 16 nt, Human
uggagcguggacuggu

SEQ ID NO: 3411387 - RNA, 13 nt, Human
uggagcuccuggg

SEQ ID NO: 3411388 - RNA, 17 nt, Human
uggagcuccugggaagg

SEQ ID NO: 3411389 - RNA, 17 nt, Human
uggagcugagccucuca

SEQ ID NO: 3411390 - RNA, 13 nt, Human
uggagcugccuga

SEQ ID NO: 3411391 - RNA, 15 nt, Human
uggagcugccugaua

SEQ ID NO: 3411392 - RNA, 17 nt, Human
uggagcuuaagccacug

SEQ ID NO: 3411393 - RNA, 18 nt, Human
uggagcuuaagccacugc

SEQ ID NO: 3411394 - RNA, 21 nt, Human
uggagcuucauggcagaaggc

SEQ ID NO: 3411395 - RNA, 14 nt, Human
uggagcuuuuuucc

SEQ ID NO: 3411396 - RNA, 14 nt, Human
uggaggaaagcaac

SEQ ID NO: 3411397 - RNA, 19 nt, Human
uggaggaacaacucuccag

SEQ ID NO: 3411398 - RNA, 20 nt, Human
uggaggaacaaucggcugca

SEQ ID NO: 3411399 - RNA, 15 nt, Human
uggaggaagaacuga

SEQ ID NO: 3411400 - RNA, 12 nt, Human
uggaggaaggaa

SEQ ID NO: 3411401 - RNA, 18 nt, Human
uggaggaaggaaacccag

SEQ ID NO: 3411402 - RNA, 15 nt, Human
uggaggaccugagcc

SEQ ID NO: 3411403 - RNA, 16 nt, Human
uggaggagagccuggu

SEQ ID NO: 3411404 - RNA, 14 nt, Human
uggaggagcaaagg

SEQ ID NO: 3411405 - RNA, 18 nt, Human
uggaggagcaaaggcuga

SEQ ID NO: 3411406 - RNA, 20 nt, Human
uggaggagcaaaggcugaga

SEQ ID NO: 3411407 - RNA, 22 nt, Human
uggaggagcagugcaggcacag

SEQ ID NO: 3411408 - RNA, 19 nt, Human
uggaggagcccaggccagg

SEQ ID NO: 3411409 - RNA, 22 nt, Human
uggaggagcccaggccaggacu

SEQ ID NO: 3411410 - RNA, 21 nt, Human
uggaggaggaaggcaagaggg

SEQ ID NO: 3411411 - RNA, 13 nt, Human
uggaggaggaggc

SEQ ID NO: 3411412 - RNA, 15 nt, Human
uggaggaggccuggg

SEQ ID NO: 3411413 - RNA, 15 nt, Human
uggaggauggagaga

SEQ ID NO: 3411414 - RNA, 19 nt, Human
uggaggcacacagcugcag

SEQ ID NO: 3411415 - RNA, 14 nt, Human
uggaggcacuuuag

SEQ ID NO: 3411416 - RNA, 19 nt, Human
uggaggcaggggcuuccug

SEQ ID NO: 3411417 - RNA, 20 nt, Human
uggaggcaggggcuuccugg

SEQ ID NO: 3411418 - RNA, 21 nt, Human
uggaggccacuguuuggaaau

SEQ ID NO: 3411419 - RNA, 15 nt, Human
uggaggccagccagu

SEQ ID NO: 3411420 - RNA, 14 nt, Human
uggaggccaggaau

SEQ ID NO: 3411421 - RNA, 22 nt, Human
uggaggccauugugugagccua

SEQ ID NO: 3411422 - RNA, 12 nt, Human
uggaggcccagg

SEQ ID NO: 3411423 - RNA, 14 nt, Human
uggaggcccaggcu

SEQ ID NO: 3411424 - RNA, 18 nt, Human
uggaggcccaggcuggga

SEQ ID NO: 3411425 - RNA, 18 nt, Human
uggaggccccaacccugu

SEQ ID NO: 3411426 - RNA, 17 nt, Human
uggaggccccuggagcc

SEQ ID NO: 3411427 - RNA, 16 nt, Human
uggaggcccuccugug

SEQ ID NO: 3411428 - RNA, 14 nt, Human
uggaggccucaggu

SEQ ID NO: 3411429 - RNA, 17 nt, Human
uggaggccuuccagcug

SEQ ID NO: 3411430 - RNA, 18 nt, Human
uggaggcggugcggcagg

SEQ ID NO: 3411431 - RNA, 14 nt, Human
uggaggcucaaauu

SEQ ID NO: 3411432 - RNA, 13 nt, Human
uggaggcuuccug

SEQ ID NO: 3411433 - RNA, 20 nt, Human
uggagggaaacaccaaacuc

SEQ ID NO: 3411434 - RNA, 12 nt, Human
uggagggaaagc

SEQ ID NO: 3411435 - RNA, 11 nt, Human
uggagggaagc

SEQ ID NO: 3411436 - RNA, 12 nt, Human
uggagggaagcc

SEQ ID NO: 3411437 - RNA, 19 nt, Human
uggagggaaugaaccugga

SEQ ID NO: 3411438 - RNA, 20 nt, Human
uggagggaaugaaccuggag

SEQ ID NO: 3411439 - RNA, 11 nt, Human
uggagggaggc

SEQ ID NO: 3411440 - RNA, 13 nt, Human
uggagggaggccc

SEQ ID NO: 3411441 - RNA, 12 nt, Human
uggagggccugg

SEQ ID NO: 3411442 - RNA, 20 nt, Human
uggagggcuagaaccuggag

SEQ ID NO: 3411443 - RNA, 22 nt, Human
uggagggcuagaaccuggagag

SEQ ID NO: 3411444 - RNA, 23 nt, Human
uggagggcuagaaccuggagagc

SEQ ID NO: 3411445 - RNA, 21 nt, Human
uggagggcuagaaccuggagg

SEQ ID NO: 3411446 - RNA, 20 nt, Human
uggagggcuagaacuggaga

SEQ ID NO: 3411447 - RNA, 23 nt, Human
uggagggcuagaaucuggagagc

SEQ ID NO: 3411448 - RNA, 22 nt, Human
uggagggcuggaaucuggagag

SEQ ID NO: 3411449 - RNA, 13 nt, Human
uggaggggcagag

SEQ ID NO: 3411450 - RNA, 18 nt, Human
uggaggggcagagccagg

SEQ ID NO: 3411451 - RNA, 21 nt, Human
uggaggggcagagccaggaag

SEQ ID NO: 3411452 - RNA, 19 nt, Human
uggagggggaauggcagca

SEQ ID NO: 3411453 - RNA, 17 nt, Human
uggagggguguggcagu

SEQ ID NO: 3411454 - RNA, 19 nt, Human
uggagggguguggcagugg

SEQ ID NO: 3411455 - RNA, 23 nt, Human
uggagggguguggcuccuuccca

SEQ ID NO: 3411456 - RNA, 17 nt, Human
uggagggucccaagcug

SEQ ID NO: 3411457 - RNA, 22 nt, Human
uggagggucccaagcugggccc

SEQ ID NO: 3411458 - RNA, 20 nt, Human
uggaggugccagcaaagccc

SEQ ID NO: 3411459 - RNA, 17 nt, Human
uggaggugggguuggga

SEQ ID NO: 3411460 - RNA, 18 nt, Human
uggaggugucaggcugcu

SEQ ID NO: 3411461 - RNA, 21 nt, Human
uggagguuaaggcugaggaaa

SEQ ID NO: 3411462 - RNA, 13 nt, Human
uggagguucuaag

SEQ ID NO: 3411463 - RNA, 17 nt, Human
uggagguugaagccaag

SEQ ID NO: 3411464 - RNA, 21 nt, Human
uggagguugcagugagccaag

SEQ ID NO: 3411465 - RNA, 15 nt, Human
uggagguuucauacu

SEQ ID NO: 3411466 - RNA, 13 nt, Human
uggaguagaaugu

SEQ ID NO: 3411467 - RNA, 14 nt, Human
uggaguaugucuga

SEQ ID NO: 3411468 - RNA, 22 nt, Human
uggagucaugguccgguguccu

SEQ ID NO: 3411469 - RNA, 15 nt, Human
uggagucauucucau

SEQ ID NO: 3411470 - RNA, 16 nt, Human
uggagucauuucugau

SEQ ID NO: 3411471 - RNA, 17 nt, Human
uggagucauuucugauu

SEQ ID NO: 3411472 - RNA, 15 nt, Human
uggaguccccucacc

SEQ ID NO: 3411473 - RNA, 18 nt, Human
uggaguccgaugauucuc

SEQ ID NO: 3411474 - RNA, 16 nt, Human
uggagucuggaguggg

SEQ ID NO: 3411475 - RNA, 12 nt, Human
uggagugaccaa

SEQ ID NO: 3411476 - RNA, 13 nt, Human
uggaguggcagcc

SEQ ID NO: 3411477 - RNA, 20 nt, Human
uggaguggcagcccagccag

SEQ ID NO: 3411478 - RNA, 13 nt, Human
uggaguggccacu

SEQ ID NO: 3411479 - RNA, 24 nt, Human
uggaguguuucuaauaaacuugga

SEQ ID NO: 3411480 - RNA, 20 nt, Human
uggaguuaacgggugaauaa

SEQ ID NO: 3411481 - RNA, 17 nt, Human
uggaguuacauuaaugu

SEQ ID NO: 3411482 - RNA, 20 nt, Human
uggaguuauugaagcagagu

SEQ ID NO: 3411483 - RNA, 16 nt, Human
uggaguucaucuugaa

SEQ ID NO: 3411484 - RNA, 19 nt, Human
uggaguucucaaagaccug

SEQ ID NO: 3411485 - RNA, 15 nt, Human
uggaguucuugugcc

SEQ ID NO: 3411486 - RNA, 16 nt, Human
uggaguucuugugcca

SEQ ID NO: 3411487 - RNA, 15 nt, Human
uggaguugaucugga

SEQ ID NO: 3411488 - RNA, 22 nt, Human
uggaguugaucuggaacccaga

SEQ ID NO: 3411489 - RNA, 17 nt, Human
uggaguugguggugcug

SEQ ID NO: 3411490 - RNA, 13 nt, Human
uggaguuucuaag

SEQ ID NO: 3411491 - RNA, 17 nt, Human
uggaguuuuaacuguaa

SEQ ID NO: 3411492 - RNA, 20 nt, Human
uggaguuuuguuuccucugu

SEQ ID NO: 3411493 - RNA, 15 nt, Human
uggauaaagccacug

SEQ ID NO: 3411494 - RNA, 15 nt, Human
uggauaacuuccaca

SEQ ID NO: 3411495 - RNA, 21 nt, Human
uggauaacuuccacagggucc

SEQ ID NO: 3411496 - RNA, 14 nt, Human
uggauaauuuugca

SEQ ID NO: 3411497 - RNA, 19 nt, Human
uggauacagcaguagacau

SEQ ID NO: 3411498 - RNA, 14 nt, Human
uggauacauaaaga

SEQ ID NO: 3411499 - RNA, 13 nt, Human
uggauaccauuau

SEQ ID NO: 3411500 - RNA, 17 nt, Human
uggauacugcccggggc

SEQ ID NO: 3411501 - RNA, 23 nt, Human
uggauagaacaugggauacuuua

SEQ ID NO: 3411502 - RNA, 13 nt, Human
uggauagcuaaua

SEQ ID NO: 3411503 - RNA, 21 nt, Human
uggauauagcuaggugacaua

SEQ ID NO: 3411504 - RNA, 16 nt, Human
uggauauaguuuuacu

SEQ ID NO: 3411505 - RNA, 17 nt, Human
uggauauguaaaacauu

SEQ ID NO: 3411506 - RNA, 13 nt, Human
uggauauuuguau

SEQ ID NO: 3411507 - RNA, 22 nt, Human
uggaucaaaaucuguagagcag

SEQ ID NO: 3411508 - RNA, 15 nt, Human
uggaucacaaagugg

SEQ ID NO: 3411509 - RNA, 15 nt, Human
uggaucacagcugcu

SEQ ID NO: 3411510 - RNA, 22 nt, Human
uggccacagcccauccauagua

SEQ ID NO: 3411511 - RNA, 23 nt, Human
uggccacagcccauccauaguaa

SEQ ID NO: 3411512 - RNA, 13 nt, Human
uggccacagcgcc

SEQ ID NO: 3411513 - RNA, 18 nt, Human
uggccacagcgccagccu

SEQ ID NO: 3411514 - RNA, 17 nt, Human
uggccacaguagucuug

SEQ ID NO: 3411515 - RNA, 18 nt, Human
uggccaccaccccccacu

SEQ ID NO: 3411516 - RNA, 17 nt, Human
uggccaccaggcuggcg

SEQ ID NO: 3411517 - RNA, 22 nt, Human
uggccaccaggcuggcgcagcc

SEQ ID NO: 3411518 - RNA, 11 nt, Human
uggccaccagu

SEQ ID NO: 3411519 - RNA, 22 nt, Human
uggccacccguucugcuggccu

SEQ ID NO: 3411520 - RNA, 23 nt, Human
uggccaccugaggugggcccagg

SEQ ID NO: 3411521 - RNA, 19 nt, Human
uggccacgcagccaggaca

SEQ ID NO: 3411522 - RNA, 20 nt, Human
uggccacgcagccaggacac

SEQ ID NO: 3411523 - RNA, 13 nt, Human
uggccacucagcu

SEQ ID NO: 3411524 - RNA, 17 nt, Human
uggccacuccagacccc

SEQ ID NO: 3411525 - RNA, 21 nt, Human
uggccacuccagaccccuggc

SEQ ID NO: 3411526 - RNA, 14 nt, Human
uggccacuccgaga

SEQ ID NO: 3411527 - RNA, 18 nt, Human
uggccacuccgagaggug

SEQ ID NO: 3411528 - RNA, 14 nt, Human
uggccacugcuccc

SEQ ID NO: 3411529 - RNA, 21 nt, Human
uggccacuugggucuucccug

SEQ ID NO: 3411530 - RNA, 16 nt, Human
uggccagaagucaagc

SEQ ID NO: 3411531 - RNA, 17 nt, Human
uggccagaccagagcuc

SEQ ID NO: 3411532 - RNA, 23 nt, Human
uggccagaccagagcucuggagc

SEQ ID NO: 3411533 - RNA, 24 nt, Human
uggccagagcugggaggcauggcc

SEQ ID NO: 3411534 - RNA, 17 nt, Human
uggccagauggcccgga

SEQ ID NO: 3411535 - RNA, 13 nt, Human
uggccagcagcac

SEQ ID NO: 3411536 - RNA, 18 nt, Human
uggccagcagcaccugcc

SEQ ID NO: 3411537 - RNA, 21 nt, Human
uggccagcagcaccugcccua

SEQ ID NO: 3411538 - RNA, 12 nt, Human
uggccagcagcu

SEQ ID NO: 3411539 - RNA, 13 nt, Human
uggccagcagcuu

SEQ ID NO: 3411540 - RNA, 20 nt, Human
uggccagccccacagcccac

SEQ ID NO: 3411541 - RNA, 16 nt, Human
uggccagccccuuaga

SEQ ID NO: 3411542 - RNA, 14 nt, Human
uggccagcccggcu

SEQ ID NO: 3411543 - RNA, 19 nt, Human
uggccagcccggcugguuu

SEQ ID NO: 3411544 - RNA, 20 nt, Human
uggccagcccggcugguuuu

SEQ ID NO: 3411545 - RNA, 24 nt, Human
uggccagccgcucuccugccacau

SEQ ID NO: 3411546 - RNA, 14 nt, Human
uggccagccuggau

SEQ ID NO: 3411547 - RNA, 18 nt, Human
uggccagccuggggccug

SEQ ID NO: 3411548 - RNA, 21 nt, Human
uggccagccuggggccuggca

SEQ ID NO: 3411549 - RNA, 22 nt, Human
uggccagccuggggccuggcag

SEQ ID NO: 3411550 - RNA, 13 nt, Human
uggccaggaagcu

SEQ ID NO: 3411551 - RNA, 11 nt, Human
uggccaggagc

SEQ ID NO: 3411552 - RNA, 19 nt, Human
uggccaggcagaucugugc

SEQ ID NO: 3411553 - RNA, 13 nt, Human
uggccaggccggg

SEQ ID NO: 3411554 - RNA, 17 nt, Human
uggccaggcugcucuca

SEQ ID NO: 3411555 - RNA, 19 nt, Human
uggccaggcugcucucaaa

SEQ ID NO: 3411556 - RNA, 20 nt, Human
uggccaggcuggucuugaac

SEQ ID NO: 3411557 - RNA, 20 nt, Human
uggccaggcuugucucgaac

SEQ ID NO: 3411558 - RNA, 22 nt, Human
uggccagggccacgcuccagcu

SEQ ID NO: 3411559 - RNA, 23 nt, Human
uggccagggccuggaagacagag

SEQ ID NO: 3411560 - RNA, 13 nt, Human
uggccagggugag

SEQ ID NO: 3411561 - RNA, 18 nt, Human
uggccagggugagagcug

SEQ ID NO: 3411562 - RNA, 19 nt, Human
uggccagggugagagcugc

SEQ ID NO: 3411563 - RNA, 19 nt, Human
uggccagguggccacucca

SEQ ID NO: 3411564 - RNA, 22 nt, Human
uggccaguccacccugccugcc

SEQ ID NO: 3411565 - RNA, 17 nt, Human
uggccaguccaggcugc

SEQ ID NO: 3411566 - RNA, 14 nt, Human
uggccagugcccug

SEQ ID NO: 3411567 - RNA, 21 nt, Human
uggccagugcccugaucccag

SEQ ID NO: 3411568 - RNA, 14 nt, Human
uggccaguggcugg

SEQ ID NO: 3411569 - RNA, 16 nt, Human
uggccaguuaucccuu

SEQ ID NO: 3411570 - RNA, 16 nt, Human
uggccaguuggaacca

SEQ ID NO: 3411571 - RNA, 16 nt, Human
uggccauacugugucc

SEQ ID NO: 3411572 - RNA, 21 nt, Human
uggccauauuuaccucagccu

SEQ ID NO: 3411573 - RNA, 17 nt, Human
uggccaucccugugagg

SEQ ID NO: 3411574 - RNA, 11 nt, Human
uggccaucucu

SEQ ID NO: 3411575 - RNA, 14 nt, Human
uggccaucugcucc

SEQ ID NO: 3411576 - RNA, 14 nt, Human
uggccaugacccug

SEQ ID NO: 3411577 - RNA, 21 nt, Human
uggccaugacccugccucucc

SEQ ID NO: 3411578 - RNA, 14 nt, Human
uggccaugccucag

SEQ ID NO: 3411579 - RNA, 17 nt, Human
uggccaugccucagccc

SEQ ID NO: 3411580 - RNA, 16 nt, Human
uggccauggagaaagc

SEQ ID NO: 3411581 - RNA, 14 nt, Human
uggccauggccugc

SEQ ID NO: 3411582 - RNA, 22 nt, Human
uggccaugggaggccuuucccu

SEQ ID NO: 3411583 - RNA, 14 nt, Human
uggccauguaugaa

SEQ ID NO: 3411584 - RNA, 17 nt, Human
uggccauucuauugugg

SEQ ID NO: 3411585 - RNA, 23 nt, Human
uggccauucuuuuuuucuuggcc

SEQ ID NO: 3411586 - RNA, 16 nt, Human
uggccauuuagccacc

SEQ ID NO: 3411587 - RNA, 19 nt, Human
uggcccaaaacgucuuauu

SEQ ID NO: 3411588 - RNA, 17 nt, Human
uggcccaaggcuggcag

SEQ ID NO: 3411589 - RNA, 19 nt, Human
uggcccaccaggccccccu

SEQ ID NO: 3411590 - RNA, 19 nt, Human
uggcccaccccacccacuu

SEQ ID NO: 3411591 - RNA, 20 nt, Human
uggcccacgccuguaauccc

SEQ ID NO: 3411592 - RNA, 14 nt, Human
uggcccagcccugc

SEQ ID NO: 3411593 - RNA, 15 nt, Human
uggcccagcccugcu

SEQ ID NO: 3411594 - RNA, 15 nt, Human
uggcccagccggccu

SEQ ID NO: 3411595 - RNA, 22 nt, Human
uggcccagccggccucucuggc

SEQ ID NO: 3411596 - RNA, 12 nt, Human
uggcccagccuu

SEQ ID NO: 3411597 - RNA, 13 nt, Human
uggcccagccuuu

SEQ ID NO: 3411598 - RNA, 14 nt, Human
uggcccagcggccc

SEQ ID NO: 3411599 - RNA, 16 nt, Human
uggcccagcggccccu

SEQ ID NO: 3411600 - RNA, 12 nt, Human
uggcccagcucc

SEQ ID NO: 3411601 - RNA, 15 nt, Human
uggcccagcucccca

SEQ ID NO: 3411602 - RNA, 11 nt, Human
uggcccaggag

SEQ ID NO: 3411603 - RNA, 13 nt, Human
uggcccaggaguu

SEQ ID NO: 3411604 - RNA, 20 nt, Human
uggcccaggaguuuggccag

SEQ ID NO: 3411605 - RNA, 14 nt, Human
uggcccagggcauc

SEQ ID NO: 3411606 - RNA, 15 nt, Human
uggcccagggcccag

SEQ ID NO: 3411607 - RNA, 17 nt, Human
uggcccaggguggccac

SEQ ID NO: 3411608 - RNA, 15 nt, Human
uggcccaguccucuc

SEQ ID NO: 3411609 - RNA, 22 nt, Human
uggcccauagaaacaugacacu

SEQ ID NO: 3411610 - RNA, 22 nt, Human
uggcccaucaggguaggcugga

SEQ ID NO: 3411611 - RNA, 22 nt, Human
uggcccaucaguguacccccgc

SEQ ID NO: 3411612 - RNA, 22 nt, Human
uggcccauccccccucaccagg

SEQ ID NO: 3411613 - RNA, 21 nt, Human
uggcccauguauggccaggaa

SEQ ID NO: 3411614 - RNA, 16 nt, Human
uggcccauucuacuug

SEQ ID NO: 3411615 - RNA, 22 nt, Human
uggcccauucuacuugcucugg

SEQ ID NO: 3411616 - RNA, 13 nt, Human
uggccccacccug

SEQ ID NO: 3411617 - RNA, 12 nt, Human
uggccccaccug

SEQ ID NO: 3411618 - RNA, 19 nt, Human
uggccccaccuggcccucu

SEQ ID NO: 3411619 - RNA, 18 nt, Human
uggccccagcacagcuug

SEQ ID NO: 3411620 - RNA, 19 nt, Human
uggccccagcacagcuuga

SEQ ID NO: 3411621 - RNA, 13 nt, Human
uggccccagcccu

SEQ ID NO: 3411622 - RNA, 19 nt, Human
uggccccagcccugcuggg

SEQ ID NO: 3411623 - RNA, 12 nt, Human
uggccccagccu

SEQ ID NO: 3411624 - RNA, 17 nt, Human
uggccccagccuggccc

SEQ ID NO: 3411625 - RNA, 19 nt, Human
uggccccagccuggcccag

SEQ ID NO: 3411626 - RNA, 20 nt, Human
uggccccagccuggcccagc

SEQ ID NO: 3411627 - RNA, 21 nt, Human
uggccccagccuggcccagcu

SEQ ID NO: 3411628 - RNA, 12 nt, Human
uggccccaggac

SEQ ID NO: 3411629 - RNA, 23 nt, Human
uggccccaugucucucagaauuc

SEQ ID NO: 3411630 - RNA, 15 nt, Human
uggcccccacuggcu

SEQ ID NO: 3411631 - RNA, 21 nt, Human
uggcccccacuggcugugggc

SEQ ID NO: 3411632 - RNA, 15 nt, Human
uggcccccgagcugg

SEQ ID NO: 3411633 - RNA, 13 nt, Human
uggcccccugucc

SEQ ID NO: 3411634 - RNA, 16 nt, Human
uggcccccuuucccgg

SEQ ID NO: 3411635 - RNA, 12 nt, Human
uggccccucaac

SEQ ID NO: 3411636 - RNA, 16 nt, Human
uggccccucaccuggg

SEQ ID NO: 3411637 - RNA, 21 nt, Human
uggccccucaccugggcaccu

SEQ ID NO: 3411638 - RNA, 20 nt, Human
uggccccucagggucccugg

SEQ ID NO: 3411639 - RNA, 22 nt, Human
uggccccucagggucccuggug

SEQ ID NO: 3411640 - RNA, 19 nt, Human
uggccccucccccugccag

SEQ ID NO: 3411641 - RNA, 17 nt, Human
uggccccucgccugugg

SEQ ID NO: 3411642 - RNA, 13 nt, Human
uggccccucugac

SEQ ID NO: 3411643 - RNA, 20 nt, Human
uggccccugaacaagaauug

SEQ ID NO: 3411644 - RNA, 14 nt, Human
uggccccugcccgg

SEQ ID NO: 3411645 - RNA, 14 nt, Human
uggccccugccuug

SEQ ID NO: 3411646 - RNA, 12 nt, Human
uggccccugggu

SEQ ID NO: 3411647 - RNA, 11 nt, Human
uggccccuuca

SEQ ID NO: 3411648 - RNA, 19 nt, Human
uggccccuuugggcccugc

SEQ ID NO: 3411649 - RNA, 21 nt, Human
uggccccuuugggcccugcau

SEQ ID NO: 3411650 - RNA, 16 nt, Human
uggcccgacagccugg

SEQ ID NO: 3411651 - RNA, 17 nt, Human
uggcccgacagccuggc

SEQ ID NO: 3411652 - RNA, 17 nt, Human
uggcccggaugcugcuu

SEQ ID NO: 3411653 - RNA, 22 nt, Human
uggcccgucaagugcugccccu

SEQ ID NO: 3411654 - RNA, 23 nt, Human
uggcccgugacagacuccugagg

SEQ ID NO: 3411655 - RNA, 19 nt, Human
uggucuucaaauugucuuu

SEQ ID NO: 3411656 - RNA, 14 nt, Human
uggucuucccaggc

SEQ ID NO: 3411657 - RNA, 20 nt, Human
uggucuuggaauuccauuug

SEQ ID NO: 3411658 - RNA, 14 nt, Human
uggucuuuccucug

SEQ ID NO: 3411659 - RNA, 20 nt, Human
uggucuuuuccucgcuucuu

SEQ ID NO: 3411660 - RNA, 15 nt, Human
uggugaaaauguacu

SEQ ID NO: 3411661 - RNA, 14 nt, Human
uggugaaaccuccu

SEQ ID NO: 3411662 - RNA, 19 nt, Human
uggugaacagaacaaaagg

SEQ ID NO: 3411663 - RNA, 15 nt, Human
uggugaacauugcaa

SEQ ID NO: 3411664 - RNA, 13 nt, Human
uggugaagaguag

SEQ ID NO: 3411665 - RNA, 17 nt, Human
uggugaauggccuuccu

SEQ ID NO: 3411666 - RNA, 19 nt, Human
uggugaauggccuuccuuc

SEQ ID NO: 3411667 - RNA, 16 nt, Human
uggugaauuucacaag

SEQ ID NO: 3411668 - RNA, 13 nt, Human
uggugaauuugaa

SEQ ID NO: 3411669 - RNA, 22 nt, Human
uggugacaucagguuuuucccg

SEQ ID NO: 3411670 - RNA, 14 nt, Human
uggugaccucugcc

SEQ ID NO: 3411671 - RNA, 17 nt, Human
uggugaccucugccuga

SEQ ID NO: 3411672 - RNA, 22 nt, Human
uggugaccuuccaagagccuga

SEQ ID NO: 3411673 - RNA, 19 nt, Human
uggugacugauucuucagc

SEQ ID NO: 3411674 - RNA, 19 nt, Human
uggugacuuuccucuuugg

SEQ ID NO: 3411675 - RNA, 16 nt, Human
uggugacuuugcuuca

SEQ ID NO: 3411676 - RNA, 15 nt, Human
uggugacuuuggaua

SEQ ID NO: 3411677 - RNA, 19 nt, Human
uggugacuuuggauaauaa

SEQ ID NO: 3411678 - RNA, 23 nt, Human
uggugagaacuacucagggaaug

SEQ ID NO: 3411679 - RNA, 17 nt, Human
uggugagaugcagcugg

SEQ ID NO: 3411680 - RNA, 18 nt, Human
uggugagccggucaggca

SEQ ID NO: 3411681 - RNA, 17 nt, Human
uggugaggccuugcucc

SEQ ID NO: 3411682 - RNA, 19 nt, Human
uggugaggcuuaacaaugu

SEQ ID NO: 3411683 - RNA, 16 nt, Human
uggugauuuagcagga

SEQ ID NO: 3411684 - RNA, 17 nt, Human
uggugauuuagcaggaa

SEQ ID NO: 3411685 - RNA, 19 nt, Human
uggugauuugaaaaauaua

SEQ ID NO: 3411686 - RNA, 12 nt, Human
uggugauuuuaa

SEQ ID NO: 3411687 - RNA, 15 nt, Human
uggugauuuuaaaug

SEQ ID NO: 3411688 - RNA, 19 nt, Human
uggugauuuuaaaugugug

SEQ ID NO: 3411689 - RNA, 19 nt, Human
uggugcaaguugaggacuu

SEQ ID NO: 3411690 - RNA, 23 nt, Human
uggugcacgcuggggaagaauuu

SEQ ID NO: 3411691 - RNA, 19 nt, Human
uggugcacuuuguaaauuc

SEQ ID NO: 3411692 - RNA, 13 nt, Human
uggugcagacaga

SEQ ID NO: 3411693 - RNA, 15 nt, Human
uggugcagacagaag

SEQ ID NO: 3411694 - RNA, 22 nt, Human
uggugcagacagaagucuccuc

SEQ ID NO: 3411695 - RNA, 17 nt, Human
uggugcagggccuccau

SEQ ID NO: 3411696 - RNA, 15 nt, Human
uggugcauagaacug

SEQ ID NO: 3411697 - RNA, 18 nt, Human
uggugcauagaacugggu

SEQ ID NO: 3411698 - RNA, 17 nt, Human
uggugcauagcagaugg

SEQ ID NO: 3411699 - RNA, 16 nt, Human
uggugcauuacagaga

SEQ ID NO: 3411700 - RNA, 20 nt, Human
uggugccaauggaaccuccu

SEQ ID NO: 3411701 - RNA, 17 nt, Human
uggugccacaaauaaaa

SEQ ID NO: 3411702 - RNA, 18 nt, Human
uggugccacaaauaaaau

SEQ ID NO: 3411703 - RNA, 10 nt, Human
uggugccacc

SEQ ID NO: 3411704 - RNA, 22 nt, Human
uggugccaucauugcugucugc

SEQ ID NO: 3411705 - RNA, 14 nt, Human
uggugccaucccca

SEQ ID NO: 3411706 - RNA, 18 nt, Human
uggugccccaggaccagc

SEQ ID NO: 3411707 - RNA, 19 nt, Human
uggugccccaggaccagcu

SEQ ID NO: 3411708 - RNA, 21 nt, Human
uggugccccaggaccagcuca

SEQ ID NO: 3411709 - RNA, 23 nt, Human
uggugccccaggaccagcucagg

SEQ ID NO: 3411710 - RNA, 23 nt, Human
uggugccccccaccccuggaaga

SEQ ID NO: 3411711 - RNA, 20 nt, Human
uggugcccugcuuucagaua

SEQ ID NO: 3411712 - RNA, 20 nt, Human
uggugcccuguucucuacca

SEQ ID NO: 3411713 - RNA, 24 nt, Human
uggugccuaguauugacaaaaugu

SEQ ID NO: 3411714 - RNA, 21 nt, Human
uggugccucuggaggccucug

SEQ ID NO: 3411715 - RNA, 15 nt, Human
uggugccugagaggc

SEQ ID NO: 3411716 - RNA, 17 nt, Human
uggugccugagaggcag

SEQ ID NO: 3411717 - RNA, 19 nt, Human
uggugccugagaggcaggc

SEQ ID NO: 3411718 - RNA, 21 nt, Human
uggugccugauucggcugucu

SEQ ID NO: 3411719 - RNA, 18 nt, Human
uggugccuggccuggcac

SEQ ID NO: 3411720 - RNA, 19 nt, Human
uggugccuggccuggcaca

SEQ ID NO: 3411721 - RNA, 24 nt, Human
uggugccuggccuggcacacauca

SEQ ID NO: 3411722 - RNA, 12 nt, Human
uggugccuucau

SEQ ID NO: 3411723 - RNA, 17 nt, Human
uggugcgaucuggguuc

SEQ ID NO: 3411724 - RNA, 22 nt, Human
uggugcggcuggccauggagaa

SEQ ID NO: 3411725 - RNA, 19 nt, Human
uggugcgggcacaauaaau

SEQ ID NO: 3411726 - RNA, 21 nt, Human
uggugcucaccaugcuuccag

SEQ ID NO: 3411727 - RNA, 15 nt, Human
uggugcucaguugua

SEQ ID NO: 3411728 - RNA, 21 nt, Human
uggugcucaguuguagaaugu

SEQ ID NO: 3411729 - RNA, 15 nt, Human
uggugcucucugcca

SEQ ID NO: 3411730 - RNA, 15 nt, Human
uggugcugaccucug

SEQ ID NO: 3411731 - RNA, 13 nt, Human
uggugcugccaca

SEQ ID NO: 3411732 - RNA, 18 nt, Human
uggugcugccacacuuca

SEQ ID NO: 3411733 - RNA, 12 nt, Human
uggugcuggaua

SEQ ID NO: 3411734 - RNA, 17 nt, Human
uggugcuggauauuuuc

SEQ ID NO: 3411735 - RNA, 11 nt, Human
uggugcuggga

SEQ ID NO: 3411736 - RNA, 17 nt, Human
uggugcuuaaguuccag

SEQ ID NO: 3411737 - RNA, 22 nt, Human
uggugcuuacacaucucagacc

SEQ ID NO: 3411738 - RNA, 19 nt, Human
uggugcuuccaaauauugu

SEQ ID NO: 3411739 - RNA, 23 nt, Human
uggugcuucucagauuucugagg

SEQ ID NO: 3411740 - RNA, 18 nt, Human
uggugcuuuccuguuucu

SEQ ID NO: 3411741 - RNA, 17 nt, Human
uggugcuuuuuauaaaa

SEQ ID NO: 3411742 - RNA, 18 nt, Human
ugguggaagaggggacag

SEQ ID NO: 3411743 - RNA, 18 nt, Human
ugguggacaguccuggga

SEQ ID NO: 3411744 - RNA, 16 nt, Human
ugguggcacugagccc

SEQ ID NO: 3411745 - RNA, 12 nt, Human
ugguggcagcuc

SEQ ID NO: 3411746 - RNA, 16 nt, Human
ugguggcagcucaccu

SEQ ID NO: 3411747 - RNA, 15 nt, Human
ugguggccaugcucc

SEQ ID NO: 3411748 - RNA, 21 nt, Human
ugguggccaugcuccucuucc

SEQ ID NO: 3411749 - RNA, 19 nt, Human
ugguggcccgacagccugg

SEQ ID NO: 3411750 - RNA, 21 nt, Human
ugguggcccgacagccuggca

SEQ ID NO: 3411751 - RNA, 14 nt, Human
ugguggcccucucc

SEQ ID NO: 3411752 - RNA, 12 nt, Human
ugguggccucag

SEQ ID NO: 3411753 - RNA, 16 nt, Human
ugguggccuggucccu

SEQ ID NO: 3411754 - RNA, 14 nt, Human
ugguggcuucagcu

SEQ ID NO: 3411755 - RNA, 13 nt, Human
ugguggcuuuccu

SEQ ID NO: 3411756 - RNA, 22 nt, Human
uggugggaggggcgcccaccuc

SEQ ID NO: 3411757 - RNA, 19 nt, Human
uggugggaugugguuuucu

SEQ ID NO: 3411758 - RNA, 20 nt, Human
uggugggccaacaaagaaca

SEQ ID NO: 3411759 - RNA, 14 nt, Human
uggugggcuucagg

SEQ ID NO: 3411760 - RNA, 13 nt, Human
ugguggggagggg

SEQ ID NO: 3411761 - RNA, 14 nt, Human
ugguggggcagcuc

SEQ ID NO: 3411762 - RNA, 20 nt, Human
ugguggggcugccaggggag

SEQ ID NO: 3411763 - RNA, 18 nt, Human
ugguggggguagagcuga

SEQ ID NO: 3411764 - RNA, 23 nt, Human
ugguggggucuccucaggaccag

SEQ ID NO: 3411765 - RNA, 23 nt, Human
uggugggguguguuccaacugcc

SEQ ID NO: 3411766 - RNA, 15 nt, Human
uggugggugaaagaa

SEQ ID NO: 3411767 - RNA, 19 nt, Human
ugguggguucaggggacuc

SEQ ID NO: 3411768 - RNA, 17 nt, Human
uggugguuucacggugc

SEQ ID NO: 3411769 - RNA, 18 nt, Human
ugguguaagguacuuuca

SEQ ID NO: 3411770 - RNA, 17 nt, Human
ugguguaauaagacaua

SEQ ID NO: 3411771 - RNA, 17 nt, Human
ugguguaauuugaagau

SEQ ID NO: 3411772 - RNA, 14 nt, Human
ugguguacaaaaug

SEQ ID NO: 3411773 - RNA, 21 nt, Human
ugguguagaacacuaauucau

SEQ ID NO: 3411774 - RNA, 21 nt, Human
ugguguagcccucccacuuug

SEQ ID NO: 3411775 - RNA, 17 nt, Human
ugguguagcuacagaga

SEQ ID NO: 3411776 - RNA, 20 nt, Human
ugguguagcuacagagaaac

SEQ ID NO: 3411777 - RNA, 19 nt, Human
ugguguaguugaacugaua

SEQ ID NO: 3411778 - RNA, 23 nt, Human
ugguguauagaaguuuguccauu

SEQ ID NO: 3411779 - RNA, 14 nt, Human
uggugucaccccag

SEQ ID NO: 3411780 - RNA, 16 nt, Human
uggugucaccccagag

SEQ ID NO: 3411781 - RNA, 17 nt, Human
uggugucaccccagagc

SEQ ID NO: 3411782 - RNA, 18 nt, Human
uggugucaccccagagcc

SEQ ID NO: 3411783 - RNA, 19 nt, Human
uggugucacugucccuccu

SEQ ID NO: 3411784 - RNA, 17 nt, Human
uggugucacuuacuguu

SEQ ID NO: 3411785 - RNA, 18 nt, Human
uggugucaguauccaggc

SEQ ID NO: 3411786 - RNA, 20 nt, Human
uggugucauagaauagcaug

SEQ ID NO: 3411787 - RNA, 14 nt, Human
ugguguccaccugg

SEQ ID NO: 3411788 - RNA, 18 nt, Human
ugguguccaccuggcccc

SEQ ID NO: 3411789 - RNA, 18 nt, Human
ugguguccagacagagcc

SEQ ID NO: 3411790 - RNA, 17 nt, Human
ugguguccagcugaguu

SEQ ID NO: 3411791 - RNA, 17 nt, Human
ugguguccugaccaccc

SEQ ID NO: 3411792 - RNA, 15 nt, Human
uggugucgggcccuu

SEQ ID NO: 3411793 - RNA, 20 nt, Human
uggugucuccaaccccccag

SEQ ID NO: 3411794 - RNA, 15 nt, Human
uggugugaaagucag

SEQ ID NO: 3411795 - RNA, 14 nt, Human
uggugugaacuaaa

SEQ ID NO: 3411796 - RNA, 16 nt, Human
uggugugaccugaggg

SEQ ID NO: 3411797 - RNA, 22 nt, Human
ugguguggguguccugccuguc

SEQ ID NO: 3411798 - RNA, 14 nt, Human
ugguguguuggaca

SEQ ID NO: 3411799 - RNA, 20 nt, Human
uguaacuugcuuaaauuucu

SEQ ID NO: 3411800 - RNA, 17 nt, Human
uguaacuuucucuauga

SEQ ID NO: 3411801 - RNA, 18 nt, Human
uguaagaaaauaucacuu

SEQ ID NO: 3411802 - RNA, 12 nt, Human
uguaagaaauac

SEQ ID NO: 3411803 - RNA, 18 nt, Human
uguaagaacuacaaacaa

SEQ ID NO: 3411804 - RNA, 17 nt, Human
uguaagaagagacuggg

SEQ ID NO: 3411805 - RNA, 14 nt, Human
uguaagaaggcaau

SEQ ID NO: 3411806 - RNA, 16 nt, Human
uguaagaauucagaag

SEQ ID NO: 3411807 - RNA, 19 nt, Human
uguaagacaauccauguaa

SEQ ID NO: 3411808 - RNA, 17 nt, Human
uguaagagaauguugaa

SEQ ID NO: 3411809 - RNA, 19 nt, Human
uguaagagcaccuuccuca

SEQ ID NO: 3411810 - RNA, 22 nt, Human
uguaagagcaccuuccucacuu

SEQ ID NO: 3411811 - RNA, 15 nt, Human
uguaagaguguagaa

SEQ ID NO: 3411812 - RNA, 14 nt, Human
uguaagaugcuggg

SEQ ID NO: 3411813 - RNA, 15 nt, Human
uguaagaugcugggu

SEQ ID NO: 3411814 - RNA, 17 nt, Human
uguaagaugcuggguug

SEQ ID NO: 3411815 - RNA, 14 nt, Human
uguaagaugucugu

SEQ ID NO: 3411816 - RNA, 18 nt, Human
uguaagauuauagauucu

SEQ ID NO: 3411817 - RNA, 22 nt, Human
uguaagauuauagauucuaaag

SEQ ID NO: 3411818 - RNA, 17 nt, Human
uguaagauuuugaaaac

SEQ ID NO: 3411819 - RNA, 18 nt, Human
uguaagcacucuggauga

SEQ ID NO: 3411820 - RNA, 13 nt, Human
uguaagccaaaga

SEQ ID NO: 3411821 - RNA, 15 nt, Human
uguaagccaaagaaa

SEQ ID NO: 3411822 - RNA, 22 nt, Human
uguaagcucuacugaggugcua

SEQ ID NO: 3411823 - RNA, 16 nt, Human
uguaagcuguguccua

SEQ ID NO: 3411824 - RNA, 15 nt, Human
uguaagcuguuuauu

SEQ ID NO: 3411825 - RNA, 22 nt, Human
uguaagcuguuuauuuuauauu

SEQ ID NO: 3411826 - RNA, 18 nt, Human
uguaaggaaugauuaauu

SEQ ID NO: 3411827 - RNA, 15 nt, Human
uguaaggcaugaagg

SEQ ID NO: 3411828 - RNA, 14 nt, Human
uguaaggcucuaga

SEQ ID NO: 3411829 - RNA, 15 nt, Human
uguaaggcucuagau

SEQ ID NO: 3411830 - RNA, 14 nt, Human
uguaaggcugugua

SEQ ID NO: 3411831 - RNA, 21 nt, Human
uguaaggcuguguaagauuug

SEQ ID NO: 3411832 - RNA, 13 nt, Human
uguaagggaaacu

SEQ ID NO: 3411833 - RNA, 21 nt, Human
uguaagggccagaaauaucuu

SEQ ID NO: 3411834 - RNA, 18 nt, Human
uguaaguaaacugcccug

SEQ ID NO: 3411835 - RNA, 16 nt, Human
uguaaguaaaugucug

SEQ ID NO: 3411836 - RNA, 17 nt, Human
uguaaguaaaugucugu

SEQ ID NO: 3411837 - RNA, 14 nt, Human
uguaaguaauuauc

SEQ ID NO: 3411838 - RNA, 17 nt, Human
uguaagucaguguugag

SEQ ID NO: 3411839 - RNA, 17 nt, Human
uguaagugaaaaacaug

SEQ ID NO: 3411840 - RNA, 22 nt, Human
uguaagugcuacauaaauuggc

SEQ ID NO: 3411841 - RNA, 14 nt, Human
uguaagugggccca

SEQ ID NO: 3411842 - RNA, 12 nt, Human
uguaagugugag

SEQ ID NO: 3411843 - RNA, 21 nt, Human
uguaagugugaguaagagcug

SEQ ID NO: 3411844 - RNA, 15 nt, Human
uguaauaaacuuuaa

SEQ ID NO: 3411845 - RNA, 12 nt, Human
uguaauaaauau

SEQ ID NO: 3411846 - RNA, 14 nt, Human
uguaauaaauauga

SEQ ID NO: 3411847 - RNA, 14 nt, Human
uguaauaaauaugu

SEQ ID NO: 3411848 - RNA, 21 nt, Human
uguaauaaauauguuucacac

SEQ ID NO: 3411849 - RNA, 22 nt, Human
uguaauaaauauguuucacaca

SEQ ID NO: 3411850 - RNA, 14 nt, Human
uguaauaacuguga

SEQ ID NO: 3411851 - RNA, 22 nt, Human
uguaauaacugugaaguuuaca

SEQ ID NO: 3411852 - RNA, 13 nt, Human
uguaauaagacau

SEQ ID NO: 3411853 - RNA, 19 nt, Human
uguaauaauaaagaauagc

SEQ ID NO: 3411854 - RNA, 13 nt, Human
uguaauaauaccu

SEQ ID NO: 3411855 - RNA, 20 nt, Human
uguaauaauaccucaauguu

SEQ ID NO: 3411856 - RNA, 23 nt, Human
uguaauaauaccucaauguuuga

SEQ ID NO: 3411857 - RNA, 13 nt, Human
uguaauaauguga

SEQ ID NO: 3411858 - RNA, 20 nt, Human
uguaauagggaaaauucuaa

SEQ ID NO: 3411859 - RNA, 19 nt, Human
uguaauauaccagcuugua

SEQ ID NO: 3411860 - RNA, 14 nt, Human
uguaauauuuacaa

SEQ ID NO: 3411861 - RNA, 21 nt, Human
uguaauauuuacaauguauua

SEQ ID NO: 3411862 - RNA, 17 nt, Human
uguaauauuucuucaaa

SEQ ID NO: 3411863 - RNA, 17 nt, Human
uguaauauuuuguauua

SEQ ID NO: 3411864 - RNA, 18 nt, Human
uguaaucaauaaacgauu

SEQ ID NO: 3411865 - RNA, 14 nt, Human
uguaaucaauguuu

SEQ ID NO: 3411866 - RNA, 14 nt, Human
uguaaucaguuuua

SEQ ID NO: 3411867 - RNA, 14 nt, Human
uguaaucauuuguu

SEQ ID NO: 3411868 - RNA, 19 nt, Human
uguaaucauuuguuuacau

SEQ ID NO: 3411869 - RNA, 12 nt, Human
uguaauccagca

SEQ ID NO: 3411870 - RNA, 13 nt, Human
uguaaucccagca

SEQ ID NO: 3411871 - RNA, 22 nt, Human
uguaaucccagcacuuugggag

SEQ ID NO: 3411872 - RNA, 23 nt, Human
uguaaucccagcacuuugggagg

SEQ ID NO: 3411873 - RNA, 22 nt, Human
uguaaucucucugcagcugccg

SEQ ID NO: 3411874 - RNA, 21 nt, Human
uguaaucuugaauuguaacug

SEQ ID NO: 3411875 - RNA, 14 nt, Human
uguaaucuuguuga

SEQ ID NO: 3411876 - RNA, 17 nt, Human
uguaaugcgauuuuauu

SEQ ID NO: 3411877 - RNA, 12 nt, Human
uguaaugcugca

SEQ ID NO: 3411878 - RNA, 22 nt, Human
uguaauggagcaucaagccacu

SEQ ID NO: 3411879 - RNA, 17 nt, Human
uguaauggcaguuauau

SEQ ID NO: 3411880 - RNA, 23 nt, Human
uguaauggcaguuauauuuugca

SEQ ID NO: 3411881 - RNA, 21 nt, Human
uguaaugguacugacuuugcu

SEQ ID NO: 3411882 - RNA, 20 nt, Human
uguaaugguaucuuaaagug

SEQ ID NO: 3411883 - RNA, 12 nt, Human
uguaauguaacu

SEQ ID NO: 3411884 - RNA, 13 nt, Human
uguaauguaacug

SEQ ID NO: 3411885 - RNA, 19 nt, Human
uguaaugucaccaccuucc

SEQ ID NO: 3411886 - RNA, 21 nt, Human
uguaaugugugguggccucag

SEQ ID NO: 3411887 - RNA, 17 nt, Human
uguaauguuaauauuga

SEQ ID NO: 3411888 - RNA, 18 nt, Human
uguaauguuaauauugau

SEQ ID NO: 3411889 - RNA, 16 nt, Human
uguaauguuacugauc

SEQ ID NO: 3411890 - RNA, 19 nt, Human
uguaauguuacugaucaug

SEQ ID NO: 3411891 - RNA, 18 nt, Human
uguaauuaaauuauggua

SEQ ID NO: 3411892 - RNA, 15 nt, Human
uguaauuaaauucug

SEQ ID NO: 3411893 - RNA, 23 nt, Human
uguaauuaaguacuauguaucaa

SEQ ID NO: 3411894 - RNA, 17 nt, Human
uguaauuacuuauugua

SEQ ID NO: 3411895 - RNA, 23 nt, Human
uguaauuagugccacuuaaugua

SEQ ID NO: 3411896 - RNA, 21 nt, Human
uguaauuauaucuaaaauauu

SEQ ID NO: 3411897 - RNA, 14 nt, Human
uguaauuauaucug

SEQ ID NO: 3411898 - RNA, 23 nt, Human
uguaauuaugguuaguagaggua

SEQ ID NO: 3411899 - RNA, 11 nt, Human
uguaauuauug

SEQ ID NO: 3411900 - RNA, 12 nt, Human
uguaauuauugu

SEQ ID NO: 3411901 - RNA, 20 nt, Human
uguaauuauuuauguauggu

SEQ ID NO: 3411902 - RNA, 14 nt, Human
uguaauuauuugaa

SEQ ID NO: 3411903 - RNA, 15 nt, Human
uguaauuauuugaau

SEQ ID NO: 3411904 - RNA, 21 nt, Human
uguaauuccuaccucccugca

SEQ ID NO: 3411905 - RNA, 16 nt, Human
uguaauucuaaaugaa

SEQ ID NO: 3411906 - RNA, 15 nt, Human
uguaauugaauaaag

SEQ ID NO: 3411907 - RNA, 17 nt, Human
uguaauugaauauuauu

SEQ ID NO: 3411908 - RNA, 19 nt, Human
uguaauugaauauuauucc

SEQ ID NO: 3411909 - RNA, 16 nt, Human
uguaauugcuuacauu

SEQ ID NO: 3411910 - RNA, 16 nt, Human
uguaauuguguggauu

SEQ ID NO: 3411911 - RNA, 15 nt, Human
uguaauuguuccuuu

SEQ ID NO: 3411912 - RNA, 19 nt, Human
uguaauuguuugucuuuaa

SEQ ID NO: 3411913 - RNA, 20 nt, Human
uguaauuuaaaauugugaug

SEQ ID NO: 3411914 - RNA, 21 nt, Human
uguaauuuaaaauugugaugu

SEQ ID NO: 3411915 - RNA, 14 nt, Human
uguaauuuaaacag

SEQ ID NO: 3411916 - RNA, 23 nt, Human
uguaauuuaaacaggcccagcau

SEQ ID NO: 3411917 - RNA, 15 nt, Human
uguaauuuaaaugaa

SEQ ID NO: 3411918 - RNA, 17 nt, Human
uguaauuuaaaugaaag

SEQ ID NO: 3411919 - RNA, 16 nt, Human
uguaauuuaugugaaa

SEQ ID NO: 3411920 - RNA, 19 nt, Human
uguaauuucaggaggaaua

SEQ ID NO: 3411921 - RNA, 23 nt, Human
uguaauuucaggaggaauacuga

SEQ ID NO: 3411922 - RNA, 14 nt, Human
uguaauuugugaua

SEQ ID NO: 3411923 - RNA, 17 nt, Human
uguaauuuguguaauaa

SEQ ID NO: 3411924 - RNA, 21 nt, Human
uguaauuuuaaauaaaaguga

SEQ ID NO: 3411925 - RNA, 23 nt, Human
uguaauuuuauuuuaaaauuuca

SEQ ID NO: 3411926 - RNA, 12 nt, Human
uguaauuuucuu

SEQ ID NO: 3411927 - RNA, 17 nt, Human
uguaauuuucuugauga

SEQ ID NO: 3411928 - RNA, 19 nt, Human
uguaauuuuucuguauaga

SEQ ID NO: 3411929 - RNA, 20 nt, Human
uguaauuuuucuguauagac

SEQ ID NO: 3411930 - RNA, 13 nt, Human
uguacaaaauaaa

SEQ ID NO: 3411931 - RNA, 21 nt, Human
uguacaaaaucgauuggcuuu

SEQ ID NO: 3411932 - RNA, 16 nt, Human
uguacaaaauuaagca

SEQ ID NO: 3411933 - RNA, 21 nt, Human
uguacaaauauaagaauaaaa

SEQ ID NO: 3411934 - RNA, 16 nt, Human
uguacaauaaaaacau

SEQ ID NO: 3411935 - RNA, 14 nt, Human
uguacaauauuuaa

SEQ ID NO: 3411936 - RNA, 15 nt, Human
uguacaauauuuuaa

SEQ ID NO: 3411937 - RNA, 20 nt, Human
uguacaauauuuuaagcauu

SEQ ID NO: 3411938 - RNA, 21 nt, Human
uguacaauauuuuaagcauua

SEQ ID NO: 3411939 - RNA, 17 nt, Human
uguacaauuaaaaaccu

SEQ ID NO: 3411940 - RNA, 13 nt, Human
uguacacacuuua

SEQ ID NO: 3411941 - RNA, 19 nt, Human
uguacacacuuuauuuacu

SEQ ID NO: 3411942 - RNA, 12 nt, Human
uguacacaguca

SEQ ID NO: 3411943 - RNA, 17 nt, Human
uguacacguguccugua

SEQ ID NO: 3411944 - RNA, 22 nt, Human
uguauagacaguuuguaaaugu

SEQ ID NO: 3411945 - RNA, 18 nt, Human
uguauagaugcaagauau

SEQ ID NO: 3411946 - RNA, 23 nt, Human
uguauagauuagagaguguugaa

SEQ ID NO: 3411947 - RNA, 22 nt, Human
uguauagauuagauuauauuga

SEQ ID NO: 3411948 - RNA, 23 nt, Human
uguauagccaaaugacugaaagc

SEQ ID NO: 3411949 - RNA, 15 nt, Human
uguauaguaaaucac

SEQ ID NO: 3411950 - RNA, 21 nt, Human
uguauaguacuggcaugguac

SEQ ID NO: 3411951 - RNA, 16 nt, Human
uguauaguauuugaaa

SEQ ID NO: 3411952 - RNA, 20 nt, Human
uguauaguauuugaaaacag

SEQ ID NO: 3411953 - RNA, 15 nt, Human
uguauaguuauguaa

SEQ ID NO: 3411954 - RNA, 17 nt, Human
uguauaguuauguaaau

SEQ ID NO: 3411955 - RNA, 18 nt, Human
uguauaguuauguaaaua

SEQ ID NO: 3411956 - RNA, 14 nt, Human
uguauaguucacgu

SEQ ID NO: 3411957 - RNA, 17 nt, Human
uguauaguuuucccuau

SEQ ID NO: 3411958 - RNA, 19 nt, Human
uguauauaaaauauuuuca

SEQ ID NO: 3411959 - RNA, 18 nt, Human
uguauauaaaugggaaca

SEQ ID NO: 3411960 - RNA, 19 nt, Human
uguauauaaaugggaacau

SEQ ID NO: 3411961 - RNA, 16 nt, Human
uguauauacaauaaca

SEQ ID NO: 3411962 - RNA, 13 nt, Human
uguauauacacau

SEQ ID NO: 3411963 - RNA, 17 nt, Human
uguauauacacauauac

SEQ ID NO: 3411964 - RNA, 19 nt, Human
uguauauacacauauaccu

SEQ ID NO: 3411965 - RNA, 15 nt, Human
uguauauacauauau

SEQ ID NO: 3411966 - RNA, 21 nt, Human
uguauauacgcaucuauaaau

SEQ ID NO: 3411967 - RNA, 14 nt, Human
uguauauaguuuuu

SEQ ID NO: 3411968 - RNA, 14 nt, Human
uguauauauacaua

SEQ ID NO: 3411969 - RNA, 15 nt, Human
uguauauauauauau

SEQ ID NO: 3411970 - RNA, 14 nt, Human
uguauauauaugug

SEQ ID NO: 3411971 - RNA, 21 nt, Human
uguauauauaugugaggaugu

SEQ ID NO: 3411972 - RNA, 13 nt, Human
uguauauaugugu

SEQ ID NO: 3411973 - RNA, 16 nt, Human
uguauauauguguaua

SEQ ID NO: 3411974 - RNA, 18 nt, Human
uguauauauguguauaua

SEQ ID NO: 3411975 - RNA, 14 nt, Human
uguauauaugugug

SEQ ID NO: 3411976 - RNA, 19 nt, Human
uguauauauguguguuuaa

SEQ ID NO: 3411977 - RNA, 22 nt, Human
uguauauauuuccuauauuguu

SEQ ID NO: 3411978 - RNA, 13 nt, Human
uguauaucagaaa

SEQ ID NO: 3411979 - RNA, 13 nt, Human
uguauaucguuau

SEQ ID NO: 3411980 - RNA, 19 nt, Human
uguauaugguauauauaca

SEQ ID NO: 3411981 - RNA, 20 nt, Human
uguauaugguauauauacau

SEQ ID NO: 3411982 - RNA, 21 nt, Human
uguauaugguauauauacaua

SEQ ID NO: 3411983 - RNA, 16 nt, Human
uguauauguagaugua

SEQ ID NO: 3411984 - RNA, 21 nt, Human
uguauauguagauguaugcac

SEQ ID NO: 3411985 - RNA, 16 nt, Human
uguauauuaaggugug

SEQ ID NO: 3411986 - RNA, 19 nt, Human
uguauauuaagguguggcu

SEQ ID NO: 3411987 - RNA, 18 nt, Human
uguauauuacacauuugu

SEQ ID NO: 3411988 - RNA, 23 nt, Human
uguauauuacacauuuguacaga

SEQ ID NO: 3411989 - RNA, 21 nt, Human
uguauauuauggaagauuuua

SEQ ID NO: 3411990 - RNA, 23 nt, Human
uguauauuauggaagauuuuaaa

SEQ ID NO: 3411991 - RNA, 12 nt, Human
uguauauuauuu

SEQ ID NO: 3411992 - RNA, 16 nt, Human
uguauauuauuucuag

SEQ ID NO: 3411993 - RNA, 21 nt, Human
uguauauuauuucuaggaaga

SEQ ID NO: 3411994 - RNA, 15 nt, Human
uguauauuauuuggc

SEQ ID NO: 3411995 - RNA, 14 nt, Human
uguauauuccuuug

SEQ ID NO: 3411996 - RNA, 14 nt, Human
uguauauuugauuu

SEQ ID NO: 3411997 - RNA, 16 nt, Human
uguauauuugauuuau

SEQ ID NO: 3411998 - RNA, 16 nt, Human
uguauauuuguaaagc

SEQ ID NO: 3411999 - RNA, 14 nt, Human
uguauauuuguaca

SEQ ID NO: 3412000 - RNA, 16 nt, Human
uguauauuuguacaaa

SEQ ID NO: 3412001 - RNA, 15 nt, Human
uguauauuuguauau

SEQ ID NO: 3412002 - RNA, 19 nt, Human
uguauauuuguaugauauu

SEQ ID NO: 3412003 - RNA, 22 nt, Human
uguauauuugugauagcacuuu

SEQ ID NO: 3412004 - RNA, 12 nt, Human
uguauauuuuau

SEQ ID NO: 3412005 - RNA, 22 nt, Human
uguauauuuuuaucuauauaaa

SEQ ID NO: 3412006 - RNA, 14 nt, Human
uguaucaaaaugcu

SEQ ID NO: 3412007 - RNA, 15 nt, Human
uguaucaaaaugcuc

SEQ ID NO: 3412008 - RNA, 20 nt, Human
uguaucaaacuguauaacuu

SEQ ID NO: 3412009 - RNA, 14 nt, Human
uguaucaaauacau

SEQ ID NO: 3412010 - RNA, 23 nt, Human
uguaucaaauacauuuaaaacau

SEQ ID NO: 3412011 - RNA, 17 nt, Human
uguaucaaugaguaaca

SEQ ID NO: 3412012 - RNA, 18 nt, Human
uguaucacaaaucuuaac

SEQ ID NO: 3412013 - RNA, 19 nt, Human
uguaucagaagagagggga

SEQ ID NO: 3412014 - RNA, 18 nt, Human
uguaucagaggccuauaa

SEQ ID NO: 3412015 - RNA, 21 nt, Human
uguaucaggugcccaucccug

SEQ ID NO: 3412016 - RNA, 15 nt, Human
uguaucaguguuuau

SEQ ID NO: 3412017 - RNA, 16 nt, Human
uguaucauaauuacca

SEQ ID NO: 3412018 - RNA, 15 nt, Human
uguaucauagaaaug

SEQ ID NO: 3412019 - RNA, 22 nt, Human
uguauccaacaagccagaauca

SEQ ID NO: 3412020 - RNA, 22 nt, Human
uguauccauccauggggcugau

SEQ ID NO: 3412021 - RNA, 18 nt, Human
uguauccauuaucaugug

SEQ ID NO: 3412022 - RNA, 22 nt, Human
uguauccccccccuguauaguu

SEQ ID NO: 3412023 - RNA, 18 nt, Human
uguauccuggaacaauau

SEQ ID NO: 3412024 - RNA, 21 nt, Human
uguauccuuccaauuuggaau

SEQ ID NO: 3412025 - RNA, 19 nt, Human
uguauccuuucacacauuu

SEQ ID NO: 3412026 - RNA, 19 nt, Human
uguaucguauagcuguauu

SEQ ID NO: 3412027 - RNA, 21 nt, Human
uguaucguauagcuguauuga

SEQ ID NO: 3412028 - RNA, 16 nt, Human
uguaucucuuucacau

SEQ ID NO: 3412029 - RNA, 12 nt, Human
uguaucugaguu

SEQ ID NO: 3412030 - RNA, 16 nt, Human
uguaucugaguugcca

SEQ ID NO: 3412031 - RNA, 20 nt, Human
uguaucugcaggcagacacg

SEQ ID NO: 3412032 - RNA, 15 nt, Human
uguaucugucuuucc

SEQ ID NO: 3412033 - RNA, 22 nt, Human
uguaucugucuuuccacucugg

SEQ ID NO: 3412034 - RNA, 13 nt, Human
uguaucugugaag

SEQ ID NO: 3412035 - RNA, 12 nt, Human
uguaucugugua

SEQ ID NO: 3412036 - RNA, 16 nt, Human
uguaucuguguagacu

SEQ ID NO: 3412037 - RNA, 16 nt, Human
uguaucuuccauauuu

SEQ ID NO: 3412038 - RNA, 22 nt, Human
uguaucuugggggacagggcug

SEQ ID NO: 3412039 - RNA, 14 nt, Human
uguaucuuucuaug

SEQ ID NO: 3412040 - RNA, 18 nt, Human
uguaugaaaaauugggga

SEQ ID NO: 3412041 - RNA, 20 nt, Human
uguaugaaaaauuggggagg

SEQ ID NO: 3412042 - RNA, 19 nt, Human
uguaugaaaacauggaaca

SEQ ID NO: 3412043 - RNA, 20 nt, Human
uguaugacuaaagagagaau

SEQ ID NO: 3412044 - RNA, 17 nt, Human
uguaugacugcacauga

SEQ ID NO: 3412045 - RNA, 16 nt, Human
uguaugaguagccagg

SEQ ID NO: 3412046 - RNA, 21 nt, Human
uguaugauauuccauaguaua

SEQ ID NO: 3412047 - RNA, 23 nt, Human
uguaugaucaaauguuuaaucau

SEQ ID NO: 3412048 - RNA, 15 nt, Human
uguaugcacacacau

SEQ ID NO: 3412049 - RNA, 18 nt, Human
uguaugcacgugugcaca

SEQ ID NO: 3412050 - RNA, 12 nt, Human
uguaugcagcua

SEQ ID NO: 3412051 - RNA, 17 nt, Human
uguaugcauaauaaucc

SEQ ID NO: 3412052 - RNA, 16 nt, Human
uguaugccaagugaga

SEQ ID NO: 3412053 - RNA, 20 nt, Human
uguaugccaagugagaagau

SEQ ID NO: 3412054 - RNA, 19 nt, Human
uguaugcuucauacaggga

SEQ ID NO: 3412055 - RNA, 18 nt, Human
uguauggaaauaaaugua

SEQ ID NO: 3412056 - RNA, 13 nt, Human
uguauggggaggc

SEQ ID NO: 3412057 - RNA, 20 nt, Human
uguauggguaggguaaauca

SEQ ID NO: 3412058 - RNA, 22 nt, Human
uguaugguccauagcacuguau

SEQ ID NO: 3412059 - RNA, 23 nt, Human
uguaugguuuuugagauauuaau

SEQ ID NO: 3412060 - RNA, 12 nt, Human
uguauguaaaaa

SEQ ID NO: 3412061 - RNA, 13 nt, Human
uguauguacauau

SEQ ID NO: 3412062 - RNA, 15 nt, Human
uguaugucaaagcuu

SEQ ID NO: 3412063 - RNA, 15 nt, Human
uguaugucuuaaaac

SEQ ID NO: 3412064 - RNA, 17 nt, Human
uguaugucuuaaaaccu

SEQ ID NO: 3412065 - RNA, 16 nt, Human
uguaugugcacuguca

SEQ ID NO: 3412066 - RNA, 19 nt, Human
uguaugugcacugucacuu

SEQ ID NO: 3412067 - RNA, 16 nt, Human
uguauguguaauaaau

SEQ ID NO: 3412068 - RNA, 16 nt, Human
uguauguguuuagaau

SEQ ID NO: 3412069 - RNA, 22 nt, Human
uguauguugugaagauguuugc

SEQ ID NO: 3412070 - RNA, 14 nt, Human
uguauguuuacacu

SEQ ID NO: 3412071 - RNA, 18 nt, Human
uguauguuuacacuguca

SEQ ID NO: 3412072 - RNA, 11 nt, Human
uguauguuuug

SEQ ID NO: 3412073 - RNA, 17 nt, Human
uguauuaaauuacauuu

SEQ ID NO: 3412074 - RNA, 18 nt, Human
uguauuaaauuacauuug

SEQ ID NO: 3412075 - RNA, 19 nt, Human
uguauuaaauuacauuugu

SEQ ID NO: 3412076 - RNA, 12 nt, Human
uguauuaacaaa

SEQ ID NO: 3412077 - RNA, 19 nt, Human
uguauuaacaaaaguuccc

SEQ ID NO: 3412078 - RNA, 21 nt, Human
uguauuaacacuacucaaagc

SEQ ID NO: 3412079 - RNA, 16 nt, Human
uguauuaagaaaggaa

SEQ ID NO: 3412080 - RNA, 16 nt, Human
uguauuaagaaugaaa

SEQ ID NO: 3412081 - RNA, 22 nt, Human
uguauuaagcccacaguauauu

SEQ ID NO: 3412082 - RNA, 18 nt, Human
uguauuaagggauuuagu

SEQ ID NO: 3412083 - RNA, 21 nt, Human
uguauuaaguuguuaauaaaa

SEQ ID NO: 3412084 - RNA, 21 nt, Human
uguauuaauauucauuguaua

SEQ ID NO: 3412085 - RNA, 22 nt, Human
uguauuacaaauccaaugaaau

SEQ ID NO: 3412086 - RNA, 18 nt, Human
uguauuacauaaauaaau

SEQ ID NO: 3412087 - RNA, 13 nt, Human
uguauuagauguu

SEQ ID NO: 3412088 - RNA, 12 nt, Human
uguguuguuuga

SEQ ID NO: 3412089 - RNA, 14 nt, Human
uguguuguuugaaa

SEQ ID NO: 3412090 - RNA, 18 nt, Human
uguguuuaaauaaaguau

SEQ ID NO: 3412091 - RNA, 22 nt, Human
uguguuuaaauaaaguaucaug

SEQ ID NO: 3412092 - RNA, 21 nt, Human
uguguuuacauuuuauggugc

SEQ ID NO: 3412093 - RNA, 17 nt, Human
uguguuuaugugagcug

SEQ ID NO: 3412094 - RNA, 22 nt, Human
uguguuuauucuugaugaaaag

SEQ ID NO: 3412095 - RNA, 15 nt, Human
uguguuuauuucacu

SEQ ID NO: 3412096 - RNA, 23 nt, Human
uguguuucacaguuugaaauaag

SEQ ID NO: 3412097 - RNA, 15 nt, Human
uguguuucuguauaa

SEQ ID NO: 3412098 - RNA, 21 nt, Human
uguguuucuguccuguaacug

SEQ ID NO: 3412099 - RNA, 16 nt, Human
uguguuugaaaucauc

SEQ ID NO: 3412100 - RNA, 16 nt, Human
uguguuuggcuuucag

SEQ ID NO: 3412101 - RNA, 16 nt, Human
uguguuugguuuacau

SEQ ID NO: 3412102 - RNA, 17 nt, Human
uguguuugucauuagcc

SEQ ID NO: 3412103 - RNA, 19 nt, Human
uguguuugucauuagccug

SEQ ID NO: 3412104 - RNA, 10 nt, Human
uguguuuguu

SEQ ID NO: 3412105 - RNA, 17 nt, Human
uguguuuucauaauaaa

SEQ ID NO: 3412106 - RNA, 19 nt, Human
uguguuuuguuuugauuua

SEQ ID NO: 3412107 - RNA, 15 nt, Human
uguguuuuuaacaug

SEQ ID NO: 3412108 - RNA, 15 nt, Human
uguguuuuuaauaaa

SEQ ID NO: 3412109 - RNA, 14 nt, Human
uguguuuuuauugu

SEQ ID NO: 3412110 - RNA, 19 nt, Human
uguguuuuuauuguuaacu

SEQ ID NO: 3412111 - RNA, 13 nt, Human
uguguuuuucuca

SEQ ID NO: 3412112 - RNA, 21 nt, Human
uguguuuuugcuaucacacag

SEQ ID NO: 3412113 - RNA, 20 nt, Human
uguguuuuugggaugucuua

SEQ ID NO: 3412114 - RNA, 13 nt, Human
uguuaaaaauaaa

SEQ ID NO: 3412115 - RNA, 21 nt, Human
uguuaaaagaugaaaauauuu

SEQ ID NO: 3412116 - RNA, 15 nt, Human
uguuaaaagauuuuu

SEQ ID NO: 3412117 - RNA, 19 nt, Human
uguuaaaaucucucucugu

SEQ ID NO: 3412118 - RNA, 15 nt, Human
uguuaaaauguauuc

SEQ ID NO: 3412119 - RNA, 17 nt, Human
uguuaaaauuaugaauc

SEQ ID NO: 3412120 - RNA, 20 nt, Human
uguuaaaccaugggauaaau

SEQ ID NO: 3412121 - RNA, 21 nt, Human
uguuaaaccaugggauaaaug

SEQ ID NO: 3412122 - RNA, 23 nt, Human
uguuaaaccaugggauaaaugcc

SEQ ID NO: 3412123 - RNA, 18 nt, Human
uguuaaacuagcauaucu

SEQ ID NO: 3412124 - RNA, 23 nt, Human
uguuaaacuagcauaucugccuu

SEQ ID NO: 3412125 - RNA, 20 nt, Human
uguuaaacuguuagcacugu

SEQ ID NO: 3412126 - RNA, 12 nt, Human
uguuaaagagaa

SEQ ID NO: 3412127 - RNA, 16 nt, Human
uguuaaagagaaugag

SEQ ID NO: 3412128 - RNA, 19 nt, Human
uguuaaagauguagcaaac

SEQ ID NO: 3412129 - RNA, 13 nt, Human
uguuaaauaaauu

SEQ ID NO: 3412130 - RNA, 18 nt, Human
uguuaaauaaauuguaua

SEQ ID NO: 3412131 - RNA, 16 nt, Human
uguuaaauacaggaaa

SEQ ID NO: 3412132 - RNA, 16 nt, Human
uguuaaauauuuacau

SEQ ID NO: 3412133 - RNA, 14 nt, Human
uguuaaaugaaacc

SEQ ID NO: 3412134 - RNA, 14 nt, Human
uguuaaauuuguaa

SEQ ID NO: 3412135 - RNA, 21 nt, Human
uguuaaauuuguaaguuucag

SEQ ID NO: 3412136 - RNA, 16 nt, Human
uguuaaauuuuucuga

SEQ ID NO: 3412137 - RNA, 14 nt, Human
uguuaacaaugccu

SEQ ID NO: 3412138 - RNA, 13 nt, Human
uguuaacacauuu

SEQ ID NO: 3412139 - RNA, 20 nt, Human
uguuaacacauuuuguauaa

SEQ ID NO: 3412140 - RNA, 21 nt, Human
uguuaacacauuuuguauaau

SEQ ID NO: 3412141 - RNA, 22 nt, Human
uguuaacacauuuuguauaauu

SEQ ID NO: 3412142 - RNA, 20 nt, Human
uguuaacauuccaagacucu

SEQ ID NO: 3412143 - RNA, 17 nt, Human
uguuaacauuuuuggua

SEQ ID NO: 3412144 - RNA, 19 nt, Human
uguuaaccucugcuuuuau

SEQ ID NO: 3412145 - RNA, 17 nt, Human
uguuaacucuugucuau

SEQ ID NO: 3412146 - RNA, 14 nt, Human
uguuaacugaauac

SEQ ID NO: 3412147 - RNA, 22 nt, Human
uguuaacugagugccuuuuggu

SEQ ID NO: 3412148 - RNA, 22 nt, Human
uguuaacuuaauaguauuuaug

SEQ ID NO: 3412149 - RNA, 17 nt, Human
uguuaacuuauucaaag

SEQ ID NO: 3412150 - RNA, 18 nt, Human
uguuaacuuauucaaaga

SEQ ID NO: 3412151 - RNA, 23 nt, Human
uguuaacuuauucaaagagaaaa

SEQ ID NO: 3412152 - RNA, 17 nt, Human
uguuaagaaaucuguuu

SEQ ID NO: 3412153 - RNA, 13 nt, Human
uguuaagcaucua

SEQ ID NO: 3412154 - RNA, 20 nt, Human
uguuaagcgugucuguauuu

SEQ ID NO: 3412155 - RNA, 15 nt, Human
uguuaagugguuuca

SEQ ID NO: 3412156 - RNA, 19 nt, Human
uguuaauaaaaguacaugu

SEQ ID NO: 3412157 - RNA, 19 nt, Human
uguuaauaucacucauuaa

SEQ ID NO: 3412158 - RNA, 14 nt, Human
uguuaauauucuuu

SEQ ID NO: 3412159 - RNA, 17 nt, Human
uguuaauauucuuucaa

SEQ ID NO: 3412160 - RNA, 13 nt, Human
uguuaauauugau

SEQ ID NO: 3412161 - RNA, 13 nt, Human
uguuaauauuuua

SEQ ID NO: 3412162 - RNA, 20 nt, Human
uguuaauccuagcugugugc

SEQ ID NO: 3412163 - RNA, 17 nt, Human
uguuaaugaaaauguca

SEQ ID NO: 3412164 - RNA, 19 nt, Human
uguuaaugauagcuacugu

SEQ ID NO: 3412165 - RNA, 17 nt, Human
uguuaaugguuugaaua

SEQ ID NO: 3412166 - RNA, 12 nt, Human
uguuaauuauac

SEQ ID NO: 3412167 - RNA, 18 nt, Human
uguuaauuauaggagccu

SEQ ID NO: 3412168 - RNA, 13 nt, Human
uguuaauuuaugc

SEQ ID NO: 3412169 - RNA, 13 nt, Human
uguuaauuucagu

SEQ ID NO: 3412170 - RNA, 15 nt, Human
uguuaauuuuugaua

SEQ ID NO: 3412171 - RNA, 16 nt, Human
uguuacaaaauguaac

SEQ ID NO: 3412172 - RNA, 23 nt, Human
uguuacaaaauguaacuguuacc

SEQ ID NO: 3412173 - RNA, 18 nt, Human
uguuacaaaguuguaugu

SEQ ID NO: 3412174 - RNA, 17 nt, Human
uguuacaaauuguagaa

SEQ ID NO: 3412175 - RNA, 19 nt, Human
uguuacaaguuuauauaua

SEQ ID NO: 3412176 - RNA, 21 nt, Human
uguuacaggcaccgagaaugu

SEQ ID NO: 3412177 - RNA, 21 nt, Human
uguuacaguaaugucauaaag

SEQ ID NO: 3412178 - RNA, 13 nt, Human
uguuacauagugu

SEQ ID NO: 3412179 - RNA, 15 nt, Human
uguuacauguaucaa

SEQ ID NO: 3412180 - RNA, 15 nt, Human
uguuacauuauuauc

SEQ ID NO: 3412181 - RNA, 22 nt, Human
uguuacauuuuuaagugcugca

SEQ ID NO: 3412182 - RNA, 18 nt, Human
uguuacccuccuguaaau

SEQ ID NO: 3412183 - RNA, 18 nt, Human
uguuaccuaaaguauuuu

SEQ ID NO: 3412184 - RNA, 20 nt, Human
uguuaccuaauuagagcaga

SEQ ID NO: 3412185 - RNA, 16 nt, Human
uguuaccugaaaacac

SEQ ID NO: 3412186 - RNA, 22 nt, Human
uguuaccugaaaacacugugca

SEQ ID NO: 3412187 - RNA, 15 nt, Human
uguuaccugugugcu

SEQ ID NO: 3412188 - RNA, 13 nt, Human
uguuaccuuaaaa

SEQ ID NO: 3412189 - RNA, 14 nt, Human
uguuaccuuaaaac

SEQ ID NO: 3412190 - RNA, 17 nt, Human
uguuaccuuaaaacuag

SEQ ID NO: 3412191 - RNA, 16 nt, Human
uguuacguagccuaag

SEQ ID NO: 3412192 - RNA, 15 nt, Human
uguuacuauuuucua

SEQ ID NO: 3412193 - RNA, 20 nt, Human
uguuacuauuuucuacaauu

SEQ ID NO: 3412194 - RNA, 18 nt, Human
uguuacucuugggacauc

SEQ ID NO: 3412195 - RNA, 20 nt, Human
uguuacugaucaugcauugu

SEQ ID NO: 3412196 - RNA, 14 nt, Human
uguuacugcaguug

SEQ ID NO: 3412197 - RNA, 19 nt, Human
uguuacugccuuaauaaaa

SEQ ID NO: 3412198 - RNA, 20 nt, Human
uguuacuggauaaauuguuu

SEQ ID NO: 3412199 - RNA, 10 nt, Human
uguuacuguu

SEQ ID NO: 3412200 - RNA, 17 nt, Human
uguuagaaaacaaaauu

SEQ ID NO: 3412201 - RNA, 19 nt, Human
uguuagaaaauggacacug

SEQ ID NO: 3412202 - RNA, 13 nt, Human
uguuagaacacua

SEQ ID NO: 3412203 - RNA, 15 nt, Human
uguuagaacacuauu

SEQ ID NO: 3412204 - RNA, 17 nt, Human
uguuagaacacuauuuu

SEQ ID NO: 3412205 - RNA, 18 nt, Human
uguuagaacacuauuuuc

SEQ ID NO: 3412206 - RNA, 15 nt, Human
uguuagacucauggu

SEQ ID NO: 3412207 - RNA, 18 nt, Human
uguuagacucuuacuuuu

SEQ ID NO: 3412208 - RNA, 18 nt, Human
uguuagagacuuuuuucu

SEQ ID NO: 3412209 - RNA, 22 nt, Human
uguuagaggaucccucucugga

SEQ ID NO: 3412210 - RNA, 19 nt, Human
uguuagagggaacagggcg

SEQ ID NO: 3412211 - RNA, 20 nt, Human
uguuagagguuuuaaaguga

SEQ ID NO: 3412212 - RNA, 22 nt, Human
uguuagagguuuuaaagugauu

SEQ ID NO: 3412213 - RNA, 18 nt, Human
uguuagaguccaacgugg

SEQ ID NO: 3412214 - RNA, 19 nt, Human
uguuagauagcugcaugug

SEQ ID NO: 3412215 - RNA, 13 nt, Human
uguuagcacuguu

SEQ ID NO: 3412216 - RNA, 14 nt, Human
uguuagcagacagg

SEQ ID NO: 3412217 - RNA, 17 nt, Human
uguuagccccauaauuu

SEQ ID NO: 3412218 - RNA, 19 nt, Human
uguuagccucaauuucuga

SEQ ID NO: 3412219 - RNA, 21 nt, Human
uguuagccuuuuuuccccaga

SEQ ID NO: 3412220 - RNA, 17 nt, Human
uguuagcuccucacugu

SEQ ID NO: 3412221 - RNA, 14 nt, Human
uguuagcuguuauu

SEQ ID NO: 3412222 - RNA, 14 nt, Human
uguuagcuuccuua

SEQ ID NO: 3412223 - RNA, 15 nt, Human
uguuagcuuccuuaa

SEQ ID NO: 3412224 - RNA, 21 nt, Human
uguuaggauuuucacauucuu

SEQ ID NO: 3412225 - RNA, 19 nt, Human
uguuaggccaaagacaaau

SEQ ID NO: 3412226 - RNA, 20 nt, Human
uguuaggccuggcacagugu

SEQ ID NO: 3412227 - RNA, 14 nt, Human
uguuaguaauaccu

SEQ ID NO: 3412228 - RNA, 14 nt, Human
uguuaguagaaauu

SEQ ID NO: 3412229 - RNA, 14 nt, Human
uguuagugcaaauu

SEQ ID NO: 3412230 - RNA, 21 nt, Human
uguuaguguuuuaagaaaugu

SEQ ID NO: 3412231 - RNA, 20 nt, Human
uguuaguuaccuuauaguua

SEQ ID NO: 3412232 - RNA, 13 nt, Human
uguuaguucccaa

SEQ ID NO: 3412233 - RNA, 19 nt, Human
uguuggacaaaugugaaga

SEQ ID NO: 3412234 - RNA, 23 nt, Human
uguuggacaaaugugaagaugca

SEQ ID NO: 3412235 - RNA, 21 nt, Human
uguuggacaagcuucugagac

SEQ ID NO: 3412236 - RNA, 21 nt, Human
uguuggagaagaacugaaauc

SEQ ID NO: 3412237 - RNA, 16 nt, Human
uguuggaguguuucua

SEQ ID NO: 3412238 - RNA, 20 nt, Human
uguuggauaaaucagugguu

SEQ ID NO: 3412239 - RNA, 17 nt, Human
uguuggauuuauaaaug

SEQ ID NO: 3412240 - RNA, 19 nt, Human
uguuggauuuauaaaugcu

SEQ ID NO: 3412241 - RNA, 23 nt, Human
uguuggauuuauaaaugcuauuu

SEQ ID NO: 3412242 - RNA, 15 nt, Human
uguuggcacucacag

SEQ ID NO: 3412243 - RNA, 23 nt, Human
uguuggcacucacagaccuggag

SEQ ID NO: 3412244 - RNA, 14 nt, Human
uguuggcagcauaa

SEQ ID NO: 3412245 - RNA, 12 nt, Human
uguuggcaggcu

SEQ ID NO: 3412246 - RNA, 21 nt, Human
uguuggcaggcuggccagucc

SEQ ID NO: 3412247 - RNA, 17 nt, Human
uguuggcauagcucugg

SEQ ID NO: 3412248 - RNA, 20 nt, Human
uguuggccuccggccucccc

SEQ ID NO: 3412249 - RNA, 18 nt, Human
uguuggcguaggcuacag

SEQ ID NO: 3412250 - RNA, 20 nt, Human
uguuggcguaggcuacagag

SEQ ID NO: 3412251 - RNA, 24 nt, Human
uguuggcguaggcuacagagaagc

SEQ ID NO: 3412252 - RNA, 14 nt, Human
uguuggcuuuguuu

SEQ ID NO: 3412253 - RNA, 19 nt, Human
uguugggagagggcgcagg

SEQ ID NO: 3412254 - RNA, 18 nt, Human
uguugggauuccugaccc

SEQ ID NO: 3412255 - RNA, 16 nt, Human
uguugggccuuuuucc

SEQ ID NO: 3412256 - RNA, 16 nt, Human
uguuggggcucuuccu

SEQ ID NO: 3412257 - RNA, 22 nt, Human
uguugggguggguauaaaagau

SEQ ID NO: 3412258 - RNA, 20 nt, Human
uguuggucaggcuggucuca

SEQ ID NO: 3412259 - RNA, 14 nt, Human
uguuggucuguacu

SEQ ID NO: 3412260 - RNA, 16 nt, Human
uguuggucuguacuga

SEQ ID NO: 3412261 - RNA, 22 nt, Human
uguugguuacccuccuagcuuu

SEQ ID NO: 3412262 - RNA, 16 nt, Human
uguugguuccaagccc

SEQ ID NO: 3412263 - RNA, 20 nt, Human
uguugguugguuuucuucuu

SEQ ID NO: 3412264 - RNA, 14 nt, Human
uguuguaaaaagaa

SEQ ID NO: 3412265 - RNA, 13 nt, Human
uguuguaaaaugu

SEQ ID NO: 3412266 - RNA, 14 nt, Human
uguuguaaccugcu

SEQ ID NO: 3412267 - RNA, 13 nt, Human
uguuguaacuuau

SEQ ID NO: 3412268 - RNA, 13 nt, Human
uguuguaaugcug

SEQ ID NO: 3412269 - RNA, 15 nt, Human
uguuguaaugcugca

SEQ ID NO: 3412270 - RNA, 13 nt, Human
uguuguaauucuu

SEQ ID NO: 3412271 - RNA, 20 nt, Human
uguuguacauuuaugauuua

SEQ ID NO: 3412272 - RNA, 14 nt, Human
uguuguagagaaaa

SEQ ID NO: 3412273 - RNA, 20 nt, Human
uguuguagauacaaucagcu

SEQ ID NO: 3412274 - RNA, 22 nt, Human
uguuguagauugauuguauugu

SEQ ID NO: 3412275 - RNA, 11 nt, Human
uguuguauaaa

SEQ ID NO: 3412276 - RNA, 13 nt, Human
uguuguauaaauu

SEQ ID NO: 3412277 - RNA, 15 nt, Human
uguuguaugccuuua

SEQ ID NO: 3412278 - RNA, 14 nt, Human
uguuguauuaacaa

SEQ ID NO: 3412279 - RNA, 15 nt, Human
uguuguauuaacaaa

SEQ ID NO: 3412280 - RNA, 17 nt, Human
uguugucagcaucuucu

SEQ ID NO: 3412281 - RNA, 15 nt, Human
uguugucauugcuuu

SEQ ID NO: 3412282 - RNA, 17 nt, Human
uguugucauugcuuuac

SEQ ID NO: 3412283 - RNA, 13 nt, Human
uguugucauugua

SEQ ID NO: 3412284 - RNA, 12 nt, Human
uguugucccuuc

SEQ ID NO: 3412285 - RNA, 17 nt, Human
uguuguccuuuucauag

SEQ ID NO: 3412286 - RNA, 22 nt, Human
uguuguccuuuucauaggucug

SEQ ID NO: 3412287 - RNA, 14 nt, Human
uguugucuaagaaa

SEQ ID NO: 3412288 - RNA, 17 nt, Human
uguugucuaagaaauug

SEQ ID NO: 3412289 - RNA, 22 nt, Human
uguugucuaagaaauugaauac

SEQ ID NO: 3412290 - RNA, 13 nt, Human
uguugucucuucu

SEQ ID NO: 3412291 - RNA, 18 nt, Human
uguugugaagauguuugc

SEQ ID NO: 3412292 - RNA, 15 nt, Human
uguugugaauaauua

SEQ ID NO: 3412293 - RNA, 17 nt, Human
uguugugaauaauuaca

SEQ ID NO: 3412294 - RNA, 13 nt, Human
uguugugaauguc

SEQ ID NO: 3412295 - RNA, 20 nt, Human
uguugugauguauucuagcu

SEQ ID NO: 3412296 - RNA, 14 nt, Human
uguugugaugucuu

SEQ ID NO: 3412297 - RNA, 16 nt, Human
uguugugccucccugg

SEQ ID NO: 3412298 - RNA, 16 nt, Human
uguugugguuuguugc

SEQ ID NO: 3412299 - RNA, 21 nt, Human
uguuguguacguggagaggga

SEQ ID NO: 3412300 - RNA, 12 nt, Human
uguugugugugc

SEQ ID NO: 3412301 - RNA, 16 nt, Human
uguugugugugggagu

SEQ ID NO: 3412302 - RNA, 14 nt, Human
uguuguguuucugu

SEQ ID NO: 3412303 - RNA, 18 nt, Human
uguuguuaaugaaaaugu

SEQ ID NO: 3412304 - RNA, 15 nt, Human
uguuguuaugaugug

SEQ ID NO: 3412305 - RNA, 23 nt, Human
uguuguuccaaauacuaaugaaa

SEQ ID NO: 3412306 - RNA, 15 nt, Human
uguuguuccuuuuga

SEQ ID NO: 3412307 - RNA, 13 nt, Human
uguuguucuguua

SEQ ID NO: 3412308 - RNA, 18 nt, Human
uguuguucuuucagaaag

SEQ ID NO: 3412309 - RNA, 13 nt, Human
uguuguuuaagug

SEQ ID NO: 3412310 - RNA, 15 nt, Human
uguuguuucuuaaau

SEQ ID NO: 3412311 - RNA, 12 nt, Human
uguuguuucuuu

SEQ ID NO: 3412312 - RNA, 12 nt, Human
uguuguuugcca

SEQ ID NO: 3412313 - RNA, 13 nt, Human
uguuguuuguaaa

SEQ ID NO: 3412314 - RNA, 19 nt, Human
uguuguuuguuuuuuugcc

SEQ ID NO: 3412315 - RNA, 13 nt, Human
uguuguuuuacua

SEQ ID NO: 3412316 - RNA, 20 nt, Human
uguuguuuuguuuuaaauac

SEQ ID NO: 3412317 - RNA, 21 nt, Human
uguuuaaaaaccgaauaaaug

SEQ ID NO: 3412318 - RNA, 20 nt, Human
uguuuaaaacaccuucuaua

SEQ ID NO: 3412319 - RNA, 14 nt, Human
uguuuaaaaggauu

SEQ ID NO: 3412320 - RNA, 18 nt, Human
uguuuaaaauaaaaugaa

SEQ ID NO: 3412321 - RNA, 19 nt, Human
uguuuaaaauaaaaugaaa

SEQ ID NO: 3412322 - RNA, 12 nt, Human
uguuuaaagaga

SEQ ID NO: 3412323 - RNA, 17 nt, Human
uguuuaaagagagguua

SEQ ID NO: 3412324 - RNA, 21 nt, Human
uguuuaaagagagguuauaga

SEQ ID NO: 3412325 - RNA, 13 nt, Human
uguuuaaaguuca

SEQ ID NO: 3412326 - RNA, 14 nt, Human
uguuuaaauaaagu

SEQ ID NO: 3412327 - RNA, 20 nt, Human
uguuuaacuuaaucaauuaa

SEQ ID NO: 3412328 - RNA, 19 nt, Human
uguuuaagacacuuccguc

SEQ ID NO: 3412329 - RNA, 13 nt, Human
uguuuaagauuua

SEQ ID NO: 3412330 - RNA, 23 nt, Human
uguuuaagauuuaauuugccaaa

SEQ ID NO: 3412331 - RNA, 13 nt, Human
uguuuaagcagaa

SEQ ID NO: 3412332 - RNA, 16 nt, Human
uguuuaauauugagaa

SEQ ID NO: 3412333 - RNA, 15 nt, Human
uguuuaauauuuaaa

SEQ ID NO: 3412334 - RNA, 20 nt, Human
uguuuaaucuguuauguacu

SEQ ID NO: 3412335 - RNA, 18 nt, Human
uguuuaaugugaacuugu

SEQ ID NO: 3412336 - RNA, 23 nt, Human
uguuuaaugugaacuuguagcug

SEQ ID NO: 3412337 - RNA, 19 nt, Human
uguuuaauguucugugaua

SEQ ID NO: 3412338 - RNA, 17 nt, Human
uguuuaauuucuucaaa

SEQ ID NO: 3412339 - RNA, 20 nt, Human
uguuuaauuucuucaaaaug

SEQ ID NO: 3412340 - RNA, 21 nt, Human
uguuuaauuucuucaaaaugu

SEQ ID NO: 3412341 - RNA, 18 nt, Human
uguuuaauuuuuauuucu

SEQ ID NO: 3412342 - RNA, 21 nt, Human
uguuuaauuuuuauuucuucc

SEQ ID NO: 3412343 - RNA, 21 nt, Human
uguuuacaaaaauuucuguaa

SEQ ID NO: 3412344 - RNA, 16 nt, Human
uguuuacacacgugca

SEQ ID NO: 3412345 - RNA, 19 nt, Human
uguuuacacucuuuguaag

SEQ ID NO: 3412346 - RNA, 14 nt, Human
uguuuacacuguca

SEQ ID NO: 3412347 - RNA, 15 nt, Human
uguuuacacugucaa

SEQ ID NO: 3412348 - RNA, 16 nt, Human
uguuuacacugucaaa

SEQ ID NO: 3412349 - RNA, 21 nt, Human
uguuuacagaggacaguauuu

SEQ ID NO: 3412350 - RNA, 16 nt, Human
uguuuacagauaauua

SEQ ID NO: 3412351 - RNA, 20 nt, Human
uguuuacagcacuacucugu

SEQ ID NO: 3412352 - RNA, 21 nt, Human
uguuuacagcacuacucugug

SEQ ID NO: 3412353 - RNA, 17 nt, Human
uguuuacagggagccuc

SEQ ID NO: 3412354 - RNA, 21 nt, Human
uguuuacaugcuuauuccaug

SEQ ID NO: 3412355 - RNA, 15 nt, Human
uguuuacauguguag

SEQ ID NO: 3412356 - RNA, 17 nt, Human
uguuuacauuugaugca

SEQ ID NO: 3412357 - RNA, 13 nt, Human
uguuuacuaggga

SEQ ID NO: 3412358 - RNA, 12 nt, Human
uguuuacugaaa

SEQ ID NO: 3412359 - RNA, 15 nt, Human
uguuuacuuaaagau

SEQ ID NO: 3412360 - RNA, 19 nt, Human
uguuuacuuaaagauuuau

SEQ ID NO: 3412361 - RNA, 23 nt, Human
uguuuacuuaaagauuuaucaaa

SEQ ID NO: 3412362 - RNA, 15 nt, Human
uguuuacuugaauag

SEQ ID NO: 3412363 - RNA, 22 nt, Human
uguuuacuugaauaguauugug

SEQ ID NO: 3412364 - RNA, 16 nt, Human
uguuuagaagaagugu

SEQ ID NO: 3412365 - RNA, 19 nt, Human
uguuuagaagaaguguguc

SEQ ID NO: 3412366 - RNA, 18 nt, Human
uguuuagacuuuaacaua

SEQ ID NO: 3412367 - RNA, 23 nt, Human
uguuuagacuuuaacauaagcua

SEQ ID NO: 3412368 - RNA, 17 nt, Human
uguuuagaguugcaauc

SEQ ID NO: 3412369 - RNA, 20 nt, Human
uguuuagauaauacaccacu

SEQ ID NO: 3412370 - RNA, 16 nt, Human
uguuuagauagggcug

SEQ ID NO: 3412371 - RNA, 15 nt, Human
uguuuagaugaaugu

SEQ ID NO: 3412372 - RNA, 17 nt, Human
uguuuagauuugccaua

SEQ ID NO: 3412373 - RNA, 22 nt, Human
uguuuagcagcagccuuuaaug

SEQ ID NO: 3412374 - RNA, 22 nt, Human
uguuuagcuacguuuacucaca

SEQ ID NO: 3412375 - RNA, 13 nt, Human
uguuuaguaauca

SEQ ID NO: 3412376 - RNA, 17 nt, Human
uguuuaguaaucauauu

SEQ ID NO: 3412377 - RNA, 14 nt, Human
uguuuaguugcaga

SEQ ID NO: 3412378 - RNA, 23 nt, Human
uuagauuuuacaugaaguauuuu

SEQ ID NO: 3412379 - RNA, 19 nt, Human
uuagcaaagaguuaauaua

SEQ ID NO: 3412380 - RNA, 12 nt, Human
uuagcaaggauu

SEQ ID NO: 3412381 - RNA, 18 nt, Human
uuagcaaggucauuucuu

SEQ ID NO: 3412382 - RNA, 13 nt, Human
uuagcacagauuu

SEQ ID NO: 3412383 - RNA, 22 nt, Human
uuagcacagauuuuaauuguca

SEQ ID NO: 3412384 - RNA, 12 nt, Human
uuagcaccaggg

SEQ ID NO: 3412385 - RNA, 22 nt, Human
uuagcacguuuaaaguucugug

SEQ ID NO: 3412386 - RNA, 21 nt, Human
uuagcacuucagggcagauuu

SEQ ID NO: 3412387 - RNA, 21 nt, Human
uuagcacuugggugacggcag

SEQ ID NO: 3412388 - RNA, 23 nt, Human
uuagcaggagaggagagccagag

SEQ ID NO: 3412389 - RNA, 23 nt, Human
uuagcaggccaaggucugagcca

SEQ ID NO: 3412390 - RNA, 12 nt, Human
uuagcaguucug

SEQ ID NO: 3412391 - RNA, 16 nt, Human
uuagcaguuugcuuug

SEQ ID NO: 3412392 - RNA, 18 nt, Human
uuagcauagcuuauuauu

SEQ ID NO: 3412393 - RNA, 17 nt, Human
uuagcauccuaagaaau

SEQ ID NO: 3412394 - RNA, 17 nt, Human
uuagcaucuaauuucaa

SEQ ID NO: 3412395 - RNA, 19 nt, Human
uuagcauguuguugaaagg

SEQ ID NO: 3412396 - RNA, 18 nt, Human
uuagccaagugugguaga

SEQ ID NO: 3412397 - RNA, 17 nt, Human
uuagccaggaucauggu

SEQ ID NO: 3412398 - RNA, 23 nt, Human
uuagccaggaucaugguguaaua

SEQ ID NO: 3412399 - RNA, 17 nt, Human
uuagcccccacccacuu

SEQ ID NO: 3412400 - RNA, 21 nt, Human
uuagccguggugauuuagcag

SEQ ID NO: 3412401 - RNA, 20 nt, Human
uuagccucaauuucugaaca

SEQ ID NO: 3412402 - RNA, 14 nt, Human
uuagccuguccugu

SEQ ID NO: 3412403 - RNA, 14 nt, Human
uuagccuucucugu

SEQ ID NO: 3412404 - RNA, 21 nt, Human
uuagccuucucuguucauuuc

SEQ ID NO: 3412405 - RNA, 17 nt, Human
uuagccuuuuuucccca

SEQ ID NO: 3412406 - RNA, 18 nt, Human
uuagccuuuuuuccccag

SEQ ID NO: 3412407 - RNA, 21 nt, Human
uuagccuuuuuuccccagacu

SEQ ID NO: 3412408 - RNA, 16 nt, Human
uuagcgacaacagauu

SEQ ID NO: 3412409 - RNA, 21 nt, Human
uuagcguagcuaagugaaaag

SEQ ID NO: 3412410 - RNA, 22 nt, Human
uuagcuaauaaaaagcuuuugu

SEQ ID NO: 3412411 - RNA, 14 nt, Human
uuagcuccccucca

SEQ ID NO: 3412412 - RNA, 13 nt, Human
uuagcuccugugg

SEQ ID NO: 3412413 - RNA, 12 nt, Human
uuagcucugaga

SEQ ID NO: 3412414 - RNA, 22 nt, Human
uuagcucuuaauuguucauuuu

SEQ ID NO: 3412415 - RNA, 23 nt, Human
uuagcucuuaauuguucauuuug

SEQ ID NO: 3412416 - RNA, 23 nt, Human
uuagcugaugaacuuauucugua

SEQ ID NO: 3412417 - RNA, 22 nt, Human
uuagcugccaagccccauccug

SEQ ID NO: 3412418 - RNA, 13 nt, Human
uuagcuggaaaag

SEQ ID NO: 3412419 - RNA, 13 nt, Human
uuagcuguaacag

SEQ ID NO: 3412420 - RNA, 17 nt, Human
uuagcuguaacaguucu

SEQ ID NO: 3412421 - RNA, 16 nt, Human
uuagcuguuauuucua

SEQ ID NO: 3412422 - RNA, 16 nt, Human
uuagcuuagaccucag

SEQ ID NO: 3412423 - RNA, 21 nt, Human
uuagcuuagaccucagccugu

SEQ ID NO: 3412424 - RNA, 19 nt, Human
uuagcuuaucaauuuguca

SEQ ID NO: 3412425 - RNA, 20 nt, Human
uuagcuuggggccagggaag

SEQ ID NO: 3412426 - RNA, 16 nt, Human
uuagcuuugucacugu

SEQ ID NO: 3412427 - RNA, 16 nt, Human
uuagcuuuuuaauugu

SEQ ID NO: 3412428 - RNA, 17 nt, Human
uuagcuuuuuaauuguu

SEQ ID NO: 3412429 - RNA, 17 nt, Human
uuagcuuuuucaucccc

SEQ ID NO: 3412430 - RNA, 18 nt, Human
uuaggaaaggaugaucaa

SEQ ID NO: 3412431 - RNA, 21 nt, Human
uuaggaaauaaaaccuuucaa

SEQ ID NO: 3412432 - RNA, 17 nt, Human
uuaggaacuucagagau

SEQ ID NO: 3412433 - RNA, 15 nt, Human
uuaggaagagaaacc

SEQ ID NO: 3412434 - RNA, 13 nt, Human
uuaggaaguguaa

SEQ ID NO: 3412435 - RNA, 19 nt, Human
uuaggaaguguaacagcug

SEQ ID NO: 3412436 - RNA, 21 nt, Human
uuaggaaguguaacagcugag

SEQ ID NO: 3412437 - RNA, 17 nt, Human
uuaggaaguuuucugua

SEQ ID NO: 3412438 - RNA, 14 nt, Human
uuaggaaugagaag

SEQ ID NO: 3412439 - RNA, 15 nt, Human
uuaggacuugcccuc

SEQ ID NO: 3412440 - RNA, 15 nt, Human
uuaggagcuaaggcu

SEQ ID NO: 3412441 - RNA, 20 nt, Human
uuaggcaaggcuaugugauu

SEQ ID NO: 3412442 - RNA, 19 nt, Human
uuaggcagauugaaaagga

SEQ ID NO: 3412443 - RNA, 18 nt, Human
uuaggcaguauaaagaau

SEQ ID NO: 3412444 - RNA, 18 nt, Human
uuaggcauaugcuucuuu

SEQ ID NO: 3412445 - RNA, 19 nt, Human
uuaggccaaagacaaauag

SEQ ID NO: 3412446 - RNA, 17 nt, Human
uuaggccagcaacgcuu

SEQ ID NO: 3412447 - RNA, 19 nt, Human
uuaggcccccaucauccuc

SEQ ID NO: 3412448 - RNA, 14 nt, Human
uuaggccuaccuga

SEQ ID NO: 3412449 - RNA, 12 nt, Human
uuaggccuggca

SEQ ID NO: 3412450 - RNA, 16 nt, Human
uuaggccuuccucucu

SEQ ID NO: 3412451 - RNA, 16 nt, Human
uuaggcuauuuguaaa

SEQ ID NO: 3412452 - RNA, 19 nt, Human
uuaggcuauuuguaaaucu

SEQ ID NO: 3412453 - RNA, 20 nt, Human
uuaggcuauuuguaaaucug

SEQ ID NO: 3412454 - RNA, 12 nt, Human
uuaggcugggcc

SEQ ID NO: 3412455 - RNA, 14 nt, Human
uuaggcugggccca

SEQ ID NO: 3412456 - RNA, 16 nt, Human
uuagggaagagaaaca

SEQ ID NO: 3412457 - RNA, 22 nt, Human
uuagggacaggaccccagcucu

SEQ ID NO: 3412458 - RNA, 23 nt, Human
uuagggacucaauuucuccccag

SEQ ID NO: 3412459 - RNA, 21 nt, Human
uuagggauaguacuaagcauu

SEQ ID NO: 3412460 - RNA, 17 nt, Human
uuagggcaccagggguu

SEQ ID NO: 3412461 - RNA, 19 nt, Human
uuaggggaaggagaaguaa

SEQ ID NO: 3412462 - RNA, 14 nt, Human
uuaggguuaugauu

SEQ ID NO: 3412463 - RNA, 17 nt, Human
uuagguaauuuuuuuca

SEQ ID NO: 3412464 - RNA, 14 nt, Human
uuaggucucuuccc

SEQ ID NO: 3412465 - RNA, 16 nt, Human
uuaggugaggaagcaa

SEQ ID NO: 3412466 - RNA, 18 nt, Human
uuagguggcaagcuguga

SEQ ID NO: 3412467 - RNA, 16 nt, Human
uuaggugugacugaau

SEQ ID NO: 3412468 - RNA, 19 nt, Human
uuagguguugauuuucugu

SEQ ID NO: 3412469 - RNA, 14 nt, Human
uuagguucuaaagu

SEQ ID NO: 3412470 - RNA, 16 nt, Human
uuagguucuaaaguuc

SEQ ID NO: 3412471 - RNA, 19 nt, Human
uuagguucuaaaguucuaa

SEQ ID NO: 3412472 - RNA, 12 nt, Human
uuaguaaaccaa

SEQ ID NO: 3412473 - RNA, 19 nt, Human
uuaguaaaugucuuuguaa

SEQ ID NO: 3412474 - RNA, 21 nt, Human
uuaguaaaugucuuuguaagu

SEQ ID NO: 3412475 - RNA, 16 nt, Human
uuaguaacaucauuuu

SEQ ID NO: 3412476 - RNA, 23 nt, Human
uuaguaacauguguuaaguauuu

SEQ ID NO: 3412477 - RNA, 16 nt, Human
uuaguaauaccucuaa

SEQ ID NO: 3412478 - RNA, 13 nt, Human
uuaguaaucauau

SEQ ID NO: 3412479 - RNA, 16 nt, Human
uuaguaaucuguacau

SEQ ID NO: 3412480 - RNA, 17 nt, Human
uuaguaaucuguacauu

SEQ ID NO: 3412481 - RNA, 17 nt, Human
uuaguaaucuguauaau

SEQ ID NO: 3412482 - RNA, 15 nt, Human
uuaguacuauaucug

SEQ ID NO: 3412483 - RNA, 18 nt, Human
uuaguacuauaucuguuu

SEQ ID NO: 3412484 - RNA, 20 nt, Human
uuaguacuauaucuguuuua

SEQ ID NO: 3412485 - RNA, 19 nt, Human
uuaguacuccccuccuuga

SEQ ID NO: 3412486 - RNA, 12 nt, Human
uuaguacuuuau

SEQ ID NO: 3412487 - RNA, 16 nt, Human
uuaguacuuuauagaa

SEQ ID NO: 3412488 - RNA, 21 nt, Human
uuaguacuuuauagaagaaug

SEQ ID NO: 3412489 - RNA, 16 nt, Human
uuaguaggauaugccu

SEQ ID NO: 3412490 - RNA, 22 nt, Human
uuaguaggauaugccugcucuu

SEQ ID NO: 3412491 - RNA, 15 nt, Human
uuaguaucuaacaug

SEQ ID NO: 3412492 - RNA, 19 nt, Human
uuaguaugacgcugauaca

SEQ ID NO: 3412493 - RNA, 22 nt, Human
uuaguaugacgcugauacauaa

SEQ ID NO: 3412494 - RNA, 22 nt, Human
uuaguauuuauuuaauguuaug

SEQ ID NO: 3412495 - RNA, 15 nt, Human
uuagucauuuugcuu

SEQ ID NO: 3412496 - RNA, 24 nt, Human
uuagucgugagcucuugugaggaa

SEQ ID NO: 3412497 - RNA, 20 nt, Human
uuagucuacucuuaagccau

SEQ ID NO: 3412498 - RNA, 21 nt, Human
uuagucuacucuuaagccauc

SEQ ID NO: 3412499 - RNA, 22 nt, Human
uuagucucaguuugugugucuu

SEQ ID NO: 3412500 - RNA, 23 nt, Human
uuagucucaguuugugugucuua

SEQ ID NO: 3412501 - RNA, 17 nt, Human
uuagucucuuuauuccu

SEQ ID NO: 3412502 - RNA, 17 nt, Human
uuagucugcaaaaugag

SEQ ID NO: 3412503 - RNA, 18 nt, Human
uuagucuucucauagcau

SEQ ID NO: 3412504 - RNA, 15 nt, Human
uuagugacaaaauag

SEQ ID NO: 3412505 - RNA, 20 nt, Human
uuagugcaucuuugccucuc

SEQ ID NO: 3412506 - RNA, 18 nt, Human
uuagugccacuuaaugua

SEQ ID NO: 3412507 - RNA, 15 nt, Human
uuagugcuaagugug

SEQ ID NO: 3412508 - RNA, 16 nt, Human
uuagugcuaaguguga

SEQ ID NO: 3412509 - RNA, 16 nt, Human
uuaguggacccugaaa

SEQ ID NO: 3412510 - RNA, 21 nt, Human
uuaguggacccugaaaugugu

SEQ ID NO: 3412511 - RNA, 19 nt, Human
uuagugguuuaucagcaaa

SEQ ID NO: 3412512 - RNA, 18 nt, Human
uuaguguaugauuacugg

SEQ ID NO: 3412513 - RNA, 23 nt, Human
uuagugucacuuaccuagauuua

SEQ ID NO: 3412514 - RNA, 12 nt, Human
uuagugugauug

SEQ ID NO: 3412515 - RNA, 21 nt, Human
uuaguguuuggguauauucau

SEQ ID NO: 3412516 - RNA, 14 nt, Human
uuaguuaaguuuua

SEQ ID NO: 3412517 - RNA, 13 nt, Human
uuaguuaauggau

SEQ ID NO: 3412518 - RNA, 14 nt, Human
uuaguuaauggauu

SEQ ID NO: 3412519 - RNA, 13 nt, Human
uuaguuaccuuau

SEQ ID NO: 3412520 - RNA, 22 nt, Human
uuaguuaccuuauaguuacugu

SEQ ID NO: 3412521 - RNA, 15 nt, Human
uuaguuacuuuagau

SEQ ID NO: 3412522 - RNA, 14 nt, Human
uuauagugcaauau

SEQ ID NO: 3412523 - RNA, 15 nt, Human
uuauagugcaauaua

SEQ ID NO: 3412524 - RNA, 13 nt, Human
uuauaguuaaucu

SEQ ID NO: 3412525 - RNA, 14 nt, Human
uuauaguuaaucua

SEQ ID NO: 3412526 - RNA, 14 nt, Human
uuauaguuuauaca

SEQ ID NO: 3412527 - RNA, 17 nt, Human
uuauaguuuauacaguu

SEQ ID NO: 3412528 - RNA, 14 nt, Human
uuauaguuucaagc

SEQ ID NO: 3412529 - RNA, 22 nt, Human
uuauauaaagagaaaauugaau

SEQ ID NO: 3412530 - RNA, 13 nt, Human
uuauauaaaugcu

SEQ ID NO: 3412531 - RNA, 18 nt, Human
uuauauaaauguaaaaau

SEQ ID NO: 3412532 - RNA, 16 nt, Human
uuauauaacuguauuu

SEQ ID NO: 3412533 - RNA, 18 nt, Human
uuauauaagcuuguauuc

SEQ ID NO: 3412534 - RNA, 13 nt, Human
uuauauaaguauu

SEQ ID NO: 3412535 - RNA, 20 nt, Human
uuauauaauaucuaaaguua

SEQ ID NO: 3412536 - RNA, 16 nt, Human
uuauauaauuauguua

SEQ ID NO: 3412537 - RNA, 22 nt, Human
uuauauaauucacucaagcacu

SEQ ID NO: 3412538 - RNA, 22 nt, Human
uuauauaauugccaaaaaguga

SEQ ID NO: 3412539 - RNA, 14 nt, Human
uuauauacaauaau

SEQ ID NO: 3412540 - RNA, 22 nt, Human
uuauauacaauaauggaaaaaa

SEQ ID NO: 3412541 - RNA, 21 nt, Human
uuauauagggaucaaccagcu

SEQ ID NO: 3412542 - RNA, 18 nt, Human
uuauauagguugugcaaa

SEQ ID NO: 3412543 - RNA, 18 nt, Human
uuauauauaaauauauua

SEQ ID NO: 3412544 - RNA, 14 nt, Human
uuauauauauauau

SEQ ID NO: 3412545 - RNA, 19 nt, Human
uuauauauauauauauuuc

SEQ ID NO: 3412546 - RNA, 13 nt, Human
uuauauaucccug

SEQ ID NO: 3412547 - RNA, 21 nt, Human
uuauauauggggaugguaguu

SEQ ID NO: 3412548 - RNA, 14 nt, Human
uuauauauguauuu

SEQ ID NO: 3412549 - RNA, 17 nt, Human
uuauauauguauuuaua

SEQ ID NO: 3412550 - RNA, 22 nt, Human
uuauauauugguaacauccuuu

SEQ ID NO: 3412551 - RNA, 14 nt, Human
uuauauauuuauaa

SEQ ID NO: 3412552 - RNA, 22 nt, Human
uuauaucagacugcuuugagaa

SEQ ID NO: 3412553 - RNA, 16 nt, Human
uuauaucaugcaaaau

SEQ ID NO: 3412554 - RNA, 20 nt, Human
uuauaucaugcaaaauaugu

SEQ ID NO: 3412555 - RNA, 18 nt, Human
uuauauccaguaacacau

SEQ ID NO: 3412556 - RNA, 14 nt, Human
uuauauccccugcu

SEQ ID NO: 3412557 - RNA, 17 nt, Human
uuauauccugacaagau

SEQ ID NO: 3412558 - RNA, 22 nt, Human
uuauaucugaggaauucuguau

SEQ ID NO: 3412559 - RNA, 11 nt, Human
uuauaucugua

SEQ ID NO: 3412560 - RNA, 14 nt, Human
uuauaucuguaugu

SEQ ID NO: 3412561 - RNA, 22 nt, Human
uuauaucuguggucuucaaauu

SEQ ID NO: 3412562 - RNA, 13 nt, Human
uuauaugaacaua

SEQ ID NO: 3412563 - RNA, 17 nt, Human
uuauaugaacauacaaa

SEQ ID NO: 3412564 - RNA, 16 nt, Human
uuauaugcuauuucua

SEQ ID NO: 3412565 - RNA, 10 nt, Human
uuauauggaa

SEQ ID NO: 3412566 - RNA, 20 nt, Human
uuauauggaaauauauauua

SEQ ID NO: 3412567 - RNA, 22 nt, Human
uuauauggaaauauauauuaua

SEQ ID NO: 3412568 - RNA, 12 nt, Human
uuauauguaugu

SEQ ID NO: 3412569 - RNA, 13 nt, Human
uuauauguguuga

SEQ ID NO: 3412570 - RNA, 19 nt, Human
uuauauuaauguacuuguu

SEQ ID NO: 3412571 - RNA, 20 nt, Human
uuauauuaguugcuuuguua

SEQ ID NO: 3412572 - RNA, 14 nt, Human
uuauauucaaccau

SEQ ID NO: 3412573 - RNA, 15 nt, Human
uuauauucaaccaug

SEQ ID NO: 3412574 - RNA, 19 nt, Human
uuauauucucagcagagug

SEQ ID NO: 3412575 - RNA, 21 nt, Human
uuauauucucagcagagugcu

SEQ ID NO: 3412576 - RNA, 16 nt, Human
uuauauugaagacaau

SEQ ID NO: 3412577 - RNA, 17 nt, Human
uuauauugauaagaucu

SEQ ID NO: 3412578 - RNA, 13 nt, Human
uuauauugcaaug

SEQ ID NO: 3412579 - RNA, 14 nt, Human
uuauauuguaagaa

SEQ ID NO: 3412580 - RNA, 15 nt, Human
uuauauuguucacuu

SEQ ID NO: 3412581 - RNA, 17 nt, Human
uuauauuguucacuucu

SEQ ID NO: 3412582 - RNA, 13 nt, Human
uuauauuuaacuc

SEQ ID NO: 3412583 - RNA, 16 nt, Human
uuauauuuaauuauua

SEQ ID NO: 3412584 - RNA, 19 nt, Human
uuauauuuauauuucaggu

SEQ ID NO: 3412585 - RNA, 11 nt, Human
uuauauuucaa

SEQ ID NO: 3412586 - RNA, 15 nt, Human
uuauauuucagaugu

SEQ ID NO: 3412587 - RNA, 11 nt, Human
uuauauuucau

SEQ ID NO: 3412588 - RNA, 22 nt, Human
uuauauuuccuuuaugugaauu

SEQ ID NO: 3412589 - RNA, 22 nt, Human
uuauauuucuauuuuauuauga

SEQ ID NO: 3412590 - RNA, 20 nt, Human
uuauauuuggaugcagaguu

SEQ ID NO: 3412591 - RNA, 15 nt, Human
uuauauuuucguaug

SEQ ID NO: 3412592 - RNA, 20 nt, Human
uuauauuuucguaugaaaau

SEQ ID NO: 3412593 - RNA, 14 nt, Human
uuauauuuuucuua

SEQ ID NO: 3412594 - RNA, 16 nt, Human
uuaucaaaaauuucau

SEQ ID NO: 3412595 - RNA, 22 nt, Human
uuaucaaagggugaaaauuauu

SEQ ID NO: 3412596 - RNA, 20 nt, Human
uuaucaaaucagucagugca

SEQ ID NO: 3412597 - RNA, 15 nt, Human
uuaucaacaauagug

SEQ ID NO: 3412598 - RNA, 14 nt, Human
uuaucaacauuugu

SEQ ID NO: 3412599 - RNA, 16 nt, Human
uuaucaacucaagaau

SEQ ID NO: 3412600 - RNA, 21 nt, Human
uuaucaacuuccuaaauauua

SEQ ID NO: 3412601 - RNA, 23 nt, Human
uuaucaagaguugugacaacuuc

SEQ ID NO: 3412602 - RNA, 15 nt, Human
uuaucaagugucuuc

SEQ ID NO: 3412603 - RNA, 17 nt, Human
uuaucaagugucuucca

SEQ ID NO: 3412604 - RNA, 22 nt, Human
uuaucaaguuugggucugugcu

SEQ ID NO: 3412605 - RNA, 16 nt, Human
uuaucaauagcccagg

SEQ ID NO: 3412606 - RNA, 15 nt, Human
uuaucaauaucuaau

SEQ ID NO: 3412607 - RNA, 23 nt, Human
uuaucaaugugucuuucuaagaa

SEQ ID NO: 3412608 - RNA, 20 nt, Human
uuaucaauuugucauuuuga

SEQ ID NO: 3412609 - RNA, 15 nt, Human
uuaucacauguaugu

SEQ ID NO: 3412610 - RNA, 16 nt, Human
uuaucacauguauguu

SEQ ID NO: 3412611 - RNA, 17 nt, Human
uuaucaccagcugccuc

SEQ ID NO: 3412612 - RNA, 18 nt, Human
uuaucacccagaagaaaa

SEQ ID NO: 3412613 - RNA, 18 nt, Human
uuaucaccgugggcuccc

SEQ ID NO: 3412614 - RNA, 21 nt, Human
uuaucaccgugggcucccuga

SEQ ID NO: 3412615 - RNA, 21 nt, Human
uuaucacugacacaaaaagua

SEQ ID NO: 3412616 - RNA, 16 nt, Human
uuaucacuuuuugaac

SEQ ID NO: 3412617 - RNA, 22 nt, Human
uuaucacuuuuugaacuaagaa

SEQ ID NO: 3412618 - RNA, 22 nt, Human
uuaucagacucggaaucuauuu

SEQ ID NO: 3412619 - RNA, 20 nt, Human
uuaucagauacaucacugcu

SEQ ID NO: 3412620 - RNA, 16 nt, Human
uuaucaguaaauaacu

SEQ ID NO: 3412621 - RNA, 23 nt, Human
uuaucagucauaacuaaauaaag

SEQ ID NO: 3412622 - RNA, 16 nt, Human
uuaucagugacagagu

SEQ ID NO: 3412623 - RNA, 21 nt, Human
uuaucaguuuccagucucaaa

SEQ ID NO: 3412624 - RNA, 16 nt, Human
uuaucauccacauugu

SEQ ID NO: 3412625 - RNA, 18 nt, Human
uuaucauccacauuguuu

SEQ ID NO: 3412626 - RNA, 12 nt, Human
uuaucaugaagc

SEQ ID NO: 3412627 - RNA, 18 nt, Human
uuaucaugaauuuuaaag

SEQ ID NO: 3412628 - RNA, 19 nt, Human
uuaucaugacauguuauau

SEQ ID NO: 3412629 - RNA, 17 nt, Human
uuaucaugugaaaucau

SEQ ID NO: 3412630 - RNA, 18 nt, Human
uuaucauguguaaucaau

SEQ ID NO: 3412631 - RNA, 11 nt, Human
uuaucauguua

SEQ ID NO: 3412632 - RNA, 22 nt, Human
uuaucauguuaguaauaccucu

SEQ ID NO: 3412633 - RNA, 23 nt, Human
uuaucauguuaguaauaccucua

SEQ ID NO: 3412634 - RNA, 18 nt, Human
uuaucauucaaguguaaa

SEQ ID NO: 3412635 - RNA, 16 nt, Human
uuaucauuuucaaaau

SEQ ID NO: 3412636 - RNA, 21 nt, Human
uuauccaaaauguguauuucu

SEQ ID NO: 3412637 - RNA, 22 nt, Human
uuauccaagguguaacucuaau

SEQ ID NO: 3412638 - RNA, 18 nt, Human
uuauccagaaaacuguga

SEQ ID NO: 3412639 - RNA, 18 nt, Human
uuauccauggggaaggga

SEQ ID NO: 3412640 - RNA, 15 nt, Human
uuaucccagcugccu

SEQ ID NO: 3412641 - RNA, 16 nt, Human
uuaucccagcugccua

SEQ ID NO: 3412642 - RNA, 20 nt, Human
uuaucccucaccuguagcag

SEQ ID NO: 3412643 - RNA, 19 nt, Human
uuauccuaaaacaaauagu

SEQ ID NO: 3412644 - RNA, 20 nt, Human
uuauccuagauuauaucaaa

SEQ ID NO: 3412645 - RNA, 22 nt, Human
uuauccuagauuauaucaaagu

SEQ ID NO: 3412646 - RNA, 18 nt, Human
uuauccuagcacaugcuu

SEQ ID NO: 3412647 - RNA, 11 nt, Human
uuauccucccu

SEQ ID NO: 3412648 - RNA, 13 nt, Human
uuauccucccugu

SEQ ID NO: 3412649 - RNA, 16 nt, Human
uuauccucugaucucc

SEQ ID NO: 3412650 - RNA, 19 nt, Human
uuauccucugaucuccaug

SEQ ID NO: 3412651 - RNA, 20 nt, Human
uuauccucugaucuccaugg

SEQ ID NO: 3412652 - RNA, 14 nt, Human
uuauccucuuuaga

SEQ ID NO: 3412653 - RNA, 18 nt, Human
uuauccucuuuagaguua

SEQ ID NO: 3412654 - RNA, 17 nt, Human
uuauccugaaauuucag

SEQ ID NO: 3412655 - RNA, 13 nt, Human
uuauccugcauug

SEQ ID NO: 3412656 - RNA, 14 nt, Human
uuaucgaaauaaca

SEQ ID NO: 3412657 - RNA, 22 nt, Human
uuaucgaaauaacaauguuaag

SEQ ID NO: 3412658 - RNA, 15 nt, Human
uuaucggaagcagug

SEQ ID NO: 3412659 - RNA, 17 nt, Human
uuaucgggaacaguguu

SEQ ID NO: 3412660 - RNA, 18 nt, Human
uuaucguccagugacuuu

SEQ ID NO: 3412661 - RNA, 18 nt, Human
uuaucguuuucuuaaagu

SEQ ID NO: 3412662 - RNA, 22 nt, Human
uuaucguuuuuguauuuucaug

SEQ ID NO: 3412663 - RNA, 21 nt, Human
uuaucuaaguuaauuuaaagu

SEQ ID NO: 3412664 - RNA, 11 nt, Human
uuaucuaauuu

SEQ ID NO: 3412665 - RNA, 17 nt, Human
uuaucuaccaacuuuca

SEQ ID NO: 3412666 - RNA, 19 nt, Human
uuaucuagauguaaauuuu

SEQ ID NO: 3412667 - RNA, 22 nt, Human
uuauguuuuuuaaaauauuuau

SEQ ID NO: 3412668 - RNA, 23 nt, Human
uuauuaaaaaucucaaauuucua

SEQ ID NO: 3412669 - RNA, 14 nt, Human
uuauuaaaaugauu

SEQ ID NO: 3412670 - RNA, 14 nt, Human
uuauuaaaauucug

SEQ ID NO: 3412671 - RNA, 15 nt, Human
uuauuaaaauucuga

SEQ ID NO: 3412672 - RNA, 12 nt, Human
uuauuaaagaaa

SEQ ID NO: 3412673 - RNA, 14 nt, Human
uuauuaaagaaaaa

SEQ ID NO: 3412674 - RNA, 23 nt, Human
uuauuaaagaaaaaaauguauuu

SEQ ID NO: 3412675 - RNA, 17 nt, Human
uuauuaaaguucuguaa

SEQ ID NO: 3412676 - RNA, 16 nt, Human
uuauuaaauaaaauca

SEQ ID NO: 3412677 - RNA, 19 nt, Human
uuauuaaauaaaaucaauu

SEQ ID NO: 3412678 - RNA, 20 nt, Human
uuauuaaauaaaaucaauuu

SEQ ID NO: 3412679 - RNA, 21 nt, Human
uuauuaaauaaaaucaauuuu

SEQ ID NO: 3412680 - RNA, 21 nt, Human
uuauuaaaugcccagccccuu

SEQ ID NO: 3412681 - RNA, 15 nt, Human
uuauuaaaugcuuca

SEQ ID NO: 3412682 - RNA, 16 nt, Human
uuauuaaauggaaacu

SEQ ID NO: 3412683 - RNA, 15 nt, Human
uuauuaaauguagcu

SEQ ID NO: 3412684 - RNA, 17 nt, Human
uuauuaaauuguaaaac

SEQ ID NO: 3412685 - RNA, 18 nt, Human
uuauuaacauaggugaaa

SEQ ID NO: 3412686 - RNA, 15 nt, Human
uuauuaacuuuaaug

SEQ ID NO: 3412687 - RNA, 18 nt, Human
uuauuaagagguaagacu

SEQ ID NO: 3412688 - RNA, 19 nt, Human
uuauuaagagguaagacuu

SEQ ID NO: 3412689 - RNA, 21 nt, Human
uuauuaagauggauucucaga

SEQ ID NO: 3412690 - RNA, 15 nt, Human
uuauuaagcuuuuug

SEQ ID NO: 3412691 - RNA, 15 nt, Human
uuauuaauaaacauu

SEQ ID NO: 3412692 - RNA, 19 nt, Human
uuauuaauauauauuaucu

SEQ ID NO: 3412693 - RNA, 12 nt, Human
uuauuaaucacu

SEQ ID NO: 3412694 - RNA, 13 nt, Human
uuauuaaucacug

SEQ ID NO: 3412695 - RNA, 18 nt, Human
uuauuaaucacuguguau

SEQ ID NO: 3412696 - RNA, 13 nt, Human
uuauuaaugcacu

SEQ ID NO: 3412697 - RNA, 18 nt, Human
uuauuaaugcacuuucua

SEQ ID NO: 3412698 - RNA, 15 nt, Human
uuauuaaugcuaagg

SEQ ID NO: 3412699 - RNA, 13 nt, Human
uuauuaauguuuu

SEQ ID NO: 3412700 - RNA, 16 nt, Human
uuauuaauguuuucaa

SEQ ID NO: 3412701 - RNA, 14 nt, Human
uuauuaauugcuuu

SEQ ID NO: 3412702 - RNA, 15 nt, Human
uuauuaauugcuuug

SEQ ID NO: 3412703 - RNA, 16 nt, Human
uuauuacaguauaauu

SEQ ID NO: 3412704 - RNA, 18 nt, Human
uuauuacauccuuguggc

SEQ ID NO: 3412705 - RNA, 20 nt, Human
uuauuacauccuuguggcac

SEQ ID NO: 3412706 - RNA, 13 nt, Human
uuauuacauguaa

SEQ ID NO: 3412707 - RNA, 18 nt, Human
uuauuacauguaauuuga

SEQ ID NO: 3412708 - RNA, 21 nt, Human
uuauuaccagugaaucuuugu

SEQ ID NO: 3412709 - RNA, 18 nt, Human
uuauuacccagaguuuuu

SEQ ID NO: 3412710 - RNA, 15 nt, Human
uuauuaccucugaua

SEQ ID NO: 3412711 - RNA, 21 nt, Human
uuauuacguaugucugguucu

SEQ ID NO: 3412712 - RNA, 14 nt, Human
uuauuacugcuaag

SEQ ID NO: 3412713 - RNA, 16 nt, Human
uuauuacuuccaugaa

SEQ ID NO: 3412714 - RNA, 18 nt, Human
uuauuacuuccaugaauu

SEQ ID NO: 3412715 - RNA, 16 nt, Human
uuauuacuuguaaaua

SEQ ID NO: 3412716 - RNA, 14 nt, Human
uuauuacuuuugcu

SEQ ID NO: 3412717 - RNA, 18 nt, Human
uuauuagaaucaaacauu

SEQ ID NO: 3412718 - RNA, 16 nt, Human
uuauuagggagaaaau

SEQ ID NO: 3412719 - RNA, 18 nt, Human
uuauuagggagaaaauuc

SEQ ID NO: 3412720 - RNA, 24 nt, Human
uuauuaguaccauaguaccauuua

SEQ ID NO: 3412721 - RNA, 22 nt, Human
uuauuaguuccccaaauacaaa

SEQ ID NO: 3412722 - RNA, 15 nt, Human
uuauuaguuuacauc

SEQ ID NO: 3412723 - RNA, 21 nt, Human
uuauuauaaucuuauaauugu

SEQ ID NO: 3412724 - RNA, 12 nt, Human
uuauuauaauug

SEQ ID NO: 3412725 - RNA, 18 nt, Human
uuauuauaauuguaucag

SEQ ID NO: 3412726 - RNA, 20 nt, Human
uuauuauaauuguaucagag

SEQ ID NO: 3412727 - RNA, 15 nt, Human
uuauuauauauauaa

SEQ ID NO: 3412728 - RNA, 15 nt, Human
uuauuauauuuacaa

SEQ ID NO: 3412729 - RNA, 17 nt, Human
uuauuaugaaacuugug

SEQ ID NO: 3412730 - RNA, 19 nt, Human
uuauuaugcauaacugaca

SEQ ID NO: 3412731 - RNA, 20 nt, Human
uuauuaugcauaacugacaa

SEQ ID NO: 3412732 - RNA, 23 nt, Human
uuauuauggcacaucagcacgau

SEQ ID NO: 3412733 - RNA, 15 nt, Human
uuauuauugaaauug

SEQ ID NO: 3412734 - RNA, 20 nt, Human
uuauuauuugcagucaugga

SEQ ID NO: 3412735 - RNA, 22 nt, Human
uuauuauuuguguuuuaauuua

SEQ ID NO: 3412736 - RNA, 16 nt, Human
uuauuauuuucaccug

SEQ ID NO: 3412737 - RNA, 15 nt, Human
uuauucaaagagaaa

SEQ ID NO: 3412738 - RNA, 20 nt, Human
uuauucaaagagaaaacauc

SEQ ID NO: 3412739 - RNA, 22 nt, Human
uuauucaacagcaagugugaau

SEQ ID NO: 3412740 - RNA, 23 nt, Human
uuauucaagaaugccaguagaaa

SEQ ID NO: 3412741 - RNA, 15 nt, Human
uuauucaagguaaaa

SEQ ID NO: 3412742 - RNA, 21 nt, Human
uuauucaauaaaguauuuaau

SEQ ID NO: 3412743 - RNA, 20 nt, Human
uuauucaauuuauuugaaug

SEQ ID NO: 3412744 - RNA, 19 nt, Human
uuauucaccauguaaaaca

SEQ ID NO: 3412745 - RNA, 21 nt, Human
uuauucacugaaguucuccug

SEQ ID NO: 3412746 - RNA, 20 nt, Human
uuauucacuuuuauuuagca

SEQ ID NO: 3412747 - RNA, 23 nt, Human
uuauucaggaaaagccucugugu

SEQ ID NO: 3412748 - RNA, 13 nt, Human
uuauucaguguca

SEQ ID NO: 3412749 - RNA, 14 nt, Human
uuauucagugucac

SEQ ID NO: 3412750 - RNA, 17 nt, Human
uuauucaguuaagaaaa

SEQ ID NO: 3412751 - RNA, 11 nt, Human
uuauucauugg

SEQ ID NO: 3412752 - RNA, 16 nt, Human
uuauucauuuaaaaug

SEQ ID NO: 3412753 - RNA, 13 nt, Human
uuauuccacaucu

SEQ ID NO: 3412754 - RNA, 19 nt, Human
uuauuccacaucuacguuu

SEQ ID NO: 3412755 - RNA, 17 nt, Human
uuauuccagaaugcugu

SEQ ID NO: 3412756 - RNA, 17 nt, Human
uuauuccauauuagaaa

SEQ ID NO: 3412757 - RNA, 19 nt, Human
uuauuccauauucauguaa

SEQ ID NO: 3412758 - RNA, 20 nt, Human
uuauuccauauucauguaaa

SEQ ID NO: 3412759 - RNA, 13 nt, Human
uuauuccaugacu

SEQ ID NO: 3412760 - RNA, 16 nt, Human
uuauuccaugacugcu

SEQ ID NO: 3412761 - RNA, 23 nt, Human
uuauuccaugacugcuugcccua

SEQ ID NO: 3412762 - RNA, 14 nt, Human
uuauuccuaguugg

SEQ ID NO: 3412763 - RNA, 17 nt, Human
uuauuccugauaauaau

SEQ ID NO: 3412764 - RNA, 20 nt, Human
uuauuccugcccugcuguuu

SEQ ID NO: 3412765 - RNA, 17 nt, Human
uuauuccuguauguugu

SEQ ID NO: 3412766 - RNA, 19 nt, Human
uuauuccuguauguugucc

SEQ ID NO: 3412767 - RNA, 14 nt, Human
uuauucucaaagca

SEQ ID NO: 3412768 - RNA, 16 nt, Human
uuauucucaaagcagg

SEQ ID NO: 3412769 - RNA, 20 nt, Human
uuauucugggaauguauagu

SEQ ID NO: 3412770 - RNA, 23 nt, Human
uuauucugggcaccacaaaauau

SEQ ID NO: 3412771 - RNA, 20 nt, Human
uuauucuguagauucugugg

SEQ ID NO: 3412772 - RNA, 15 nt, Human
uuauucuugaugaaa

SEQ ID NO: 3412773 - RNA, 12 nt, Human
uuauucuugguu

SEQ ID NO: 3412774 - RNA, 14 nt, Human
uuauucuuugcacu

SEQ ID NO: 3412775 - RNA, 15 nt, Human
uuauucuuugcacuu

SEQ ID NO: 3412776 - RNA, 13 nt, Human
uuauucuuuuuaa

SEQ ID NO: 3412777 - RNA, 13 nt, Human
uuauugaagaaac

SEQ ID NO: 3412778 - RNA, 22 nt, Human
uuauugaagaaacagauaccau

SEQ ID NO: 3412779 - RNA, 15 nt, Human
uuauugaagcagagu

SEQ ID NO: 3412780 - RNA, 16 nt, Human
uuauugaagcagagug

SEQ ID NO: 3412781 - RNA, 23 nt, Human
uuauugaaggaagccaaauuuau

SEQ ID NO: 3412782 - RNA, 16 nt, Human
uuauugaauauaugau

SEQ ID NO: 3412783 - RNA, 20 nt, Human
uuauugaaucuauuuaagua

SEQ ID NO: 3412784 - RNA, 14 nt, Human
uuauugacaauaau

SEQ ID NO: 3412785 - RNA, 18 nt, Human
uuauugacaauaauuuca

SEQ ID NO: 3412786 - RNA, 12 nt, Human
uuauugacacug

SEQ ID NO: 3412787 - RNA, 17 nt, Human
uuauugacucuugaguu

SEQ ID NO: 3412788 - RNA, 20 nt, Human
uuauugacucuugaguuguu

SEQ ID NO: 3412789 - RNA, 14 nt, Human
uuauugagaaagag

SEQ ID NO: 3412790 - RNA, 18 nt, Human
uuauugagagagaugugu

SEQ ID NO: 3412791 - RNA, 19 nt, Human
uuauugagagagaugugua

SEQ ID NO: 3412792 - RNA, 23 nt, Human
uuauugagauuguccucauuucu

SEQ ID NO: 3412793 - RNA, 14 nt, Human
uuauugaguuugua

SEQ ID NO: 3412794 - RNA, 19 nt, Human
uuauugauaaguucauaca

SEQ ID NO: 3412795 - RNA, 14 nt, Human
uuauugauauauau

SEQ ID NO: 3412796 - RNA, 13 nt, Human
uuauugaugaaaa

SEQ ID NO: 3412797 - RNA, 15 nt, Human
uuauugauguuuuca

SEQ ID NO: 3412798 - RNA, 12 nt, Human
uuauugcacaaa

SEQ ID NO: 3412799 - RNA, 19 nt, Human
uuauugcagcgauuaauaa

SEQ ID NO: 3412800 - RNA, 18 nt, Human
uuauugcaguuuaucauu

SEQ ID NO: 3412801 - RNA, 22 nt, Human
uuauugcaguuuaucauucaag

SEQ ID NO: 3412802 - RNA, 12 nt, Human
uuauugcauuug

SEQ ID NO: 3412803 - RNA, 21 nt, Human
uuauugcccaugauauaacuu

SEQ ID NO: 3412804 - RNA, 15 nt, Human
uuauugcgcugcuac

SEQ ID NO: 3412805 - RNA, 16 nt, Human
uuauugcuaguauuug

SEQ ID NO: 3412806 - RNA, 19 nt, Human
uuauugcuaguauuugaau

SEQ ID NO: 3412807 - RNA, 17 nt, Human
uuauugcugauuuuaau

SEQ ID NO: 3412808 - RNA, 12 nt, Human
uuauugcuguug

SEQ ID NO: 3412809 - RNA, 13 nt, Human
uuauugcuuuuau

SEQ ID NO: 3412810 - RNA, 22 nt, Human
uuauuggcugagauaugaacau

SEQ ID NO: 3412811 - RNA, 16 nt, Human
uuauuggcuuuucuga

SEQ ID NO: 3412812 - RNA, 13 nt, Human
uucacacugucug

SEQ ID NO: 3412813 - RNA, 12 nt, Human
uucacacuucca

SEQ ID NO: 3412814 - RNA, 15 nt, Human
uucacacuuccacca

SEQ ID NO: 3412815 - RNA, 20 nt, Human
uucacacuuccaccagccug

SEQ ID NO: 3412816 - RNA, 12 nt, Human
uucacacuugaa

SEQ ID NO: 3412817 - RNA, 10 nt, Human
uucacagagc

SEQ ID NO: 3412818 - RNA, 12 nt, Human
uucacagcuccu

SEQ ID NO: 3412819 - RNA, 13 nt, Human
uucacagcuccuc

SEQ ID NO: 3412820 - RNA, 12 nt, Human
uucacaggcagc

SEQ ID NO: 3412821 - RNA, 14 nt, Human
uucacaggcagcca

SEQ ID NO: 3412822 - RNA, 16 nt, Human
uucacaggcagccagu

SEQ ID NO: 3412823 - RNA, 10 nt, Human
uucacaggcg

SEQ ID NO: 3412824 - RNA, 15 nt, Human
uucacaguagagcca

SEQ ID NO: 3412825 - RNA, 19 nt, Human
uucacaguagagccagcuu

SEQ ID NO: 3412826 - RNA, 20 nt, Human
uucacaguagagccagcuug

SEQ ID NO: 3412827 - RNA, 21 nt, Human
uucacagugaucgaugauuca

SEQ ID NO: 3412828 - RNA, 22 nt, Human
uucacagugaucgaugauucag

SEQ ID NO: 3412829 - RNA, 13 nt, Human
uucacaguucucu

SEQ ID NO: 3412830 - RNA, 15 nt, Human
uucacaguucucucc

SEQ ID NO: 3412831 - RNA, 20 nt, Human
uucacaguucucuccuucuu

SEQ ID NO: 3412832 - RNA, 22 nt, Human
uucacaguuugaaauaagcuau

SEQ ID NO: 3412833 - RNA, 17 nt, Human
uucacauaaaauagauu

SEQ ID NO: 3412834 - RNA, 20 nt, Human
uucacauaaaugcagcccau

SEQ ID NO: 3412835 - RNA, 18 nt, Human
uucacauaagcucagaau

SEQ ID NO: 3412836 - RNA, 17 nt, Human
uucacauacccuccccc

SEQ ID NO: 3412837 - RNA, 19 nt, Human
uucacauagagaucauccu

SEQ ID NO: 3412838 - RNA, 15 nt, Human
uucacauagcugucu

SEQ ID NO: 3412839 - RNA, 17 nt, Human
uucacauauugauuucc

SEQ ID NO: 3412840 - RNA, 21 nt, Human
uucacauccuguguuucuagg

SEQ ID NO: 3412841 - RNA, 19 nt, Human
uucacaucuaaccucaucu

SEQ ID NO: 3412842 - RNA, 13 nt, Human
uucacaucucauu

SEQ ID NO: 3412843 - RNA, 20 nt, Human
uucacauguuuucaaaugga

SEQ ID NO: 3412844 - RNA, 18 nt, Human
uucacauuaaaaaaugaa

SEQ ID NO: 3412845 - RNA, 23 nt, Human
uucacauuaaaaaaugaaauauu

SEQ ID NO: 3412846 - RNA, 14 nt, Human
uucacauuauucug

SEQ ID NO: 3412847 - RNA, 19 nt, Human
uucacauucuuauaaauau

SEQ ID NO: 3412848 - RNA, 15 nt, Human
uucacauucuuggcu

SEQ ID NO: 3412849 - RNA, 13 nt, Human
uucacauuggaaa

SEQ ID NO: 3412850 - RNA, 17 nt, Human
uucacauuguuaagaaa

SEQ ID NO: 3412851 - RNA, 16 nt, Human
uucaccaaaauuaucc

SEQ ID NO: 3412852 - RNA, 15 nt, Human
uucaccacagacuuu

SEQ ID NO: 3412853 - RNA, 22 nt, Human
uucaccacaugugcacaugcac

SEQ ID NO: 3412854 - RNA, 16 nt, Human
uucaccacuucacuga

SEQ ID NO: 3412855 - RNA, 12 nt, Human
uucaccagagca

SEQ ID NO: 3412856 - RNA, 22 nt, Human
uucaccaguacauucucaguuu

SEQ ID NO: 3412857 - RNA, 17 nt, Human
uucaccaucaauccuga

SEQ ID NO: 3412858 - RNA, 16 nt, Human
uucaccauguaaaaca

SEQ ID NO: 3412859 - RNA, 22 nt, Human
uucaccauguaaaacaaaaaac

SEQ ID NO: 3412860 - RNA, 22 nt, Human
uucaccauguuggccaggcugc

SEQ ID NO: 3412861 - RNA, 18 nt, Human
uucaccauuauaaugaau

SEQ ID NO: 3412862 - RNA, 16 nt, Human
uucacccacagaaaga

SEQ ID NO: 3412863 - RNA, 13 nt, Human
uucaccccacccu

SEQ ID NO: 3412864 - RNA, 20 nt, Human
uucaccccagggccugagcc

SEQ ID NO: 3412865 - RNA, 20 nt, Human
uucaccccaucccuccuuaa

SEQ ID NO: 3412866 - RNA, 17 nt, Human
uucaccccccacucacc

SEQ ID NO: 3412867 - RNA, 22 nt, Human
uucaccccccacucaccagugu

SEQ ID NO: 3412868 - RNA, 21 nt, Human
uucacccccugagauccccug

SEQ ID NO: 3412869 - RNA, 18 nt, Human
uucaccccggcaggcccu

SEQ ID NO: 3412870 - RNA, 20 nt, Human
uucaccccggcaggcccugc

SEQ ID NO: 3412871 - RNA, 12 nt, Human
uucaccccuccc

SEQ ID NO: 3412872 - RNA, 13 nt, Human
uucacccucugua

SEQ ID NO: 3412873 - RNA, 22 nt, Human
uucacccuuauagucuaagacu

SEQ ID NO: 3412874 - RNA, 13 nt, Human
uucacccuuuucu

SEQ ID NO: 3412875 - RNA, 14 nt, Human
uucaccgaggacau

SEQ ID NO: 3412876 - RNA, 13 nt, Human
uucaccuccucgc

SEQ ID NO: 3412877 - RNA, 21 nt, Human
uucaccugauucaacuaaaaa

SEQ ID NO: 3412878 - RNA, 21 nt, Human
uucaccuggaagcauuuguuu

SEQ ID NO: 3412879 - RNA, 11 nt, Human
uucaccuguaa

SEQ ID NO: 3412880 - RNA, 22 nt, Human
uucaccuguuuuuaagcuguuu

SEQ ID NO: 3412881 - RNA, 15 nt, Human
uucacgauucauuuu

SEQ ID NO: 3412882 - RNA, 22 nt, Human
uucacgcaacuugaaauuauau

SEQ ID NO: 3412883 - RNA, 14 nt, Human
uucacgcccuuggc

SEQ ID NO: 3412884 - RNA, 19 nt, Human
uucacgccugaggcaauua

SEQ ID NO: 3412885 - RNA, 21 nt, Human
uucacgccuguaaucccagca

SEQ ID NO: 3412886 - RNA, 23 nt, Human
uucacgccuguaaucccagcacu

SEQ ID NO: 3412887 - RNA, 15 nt, Human
uucacgugguccuaa

SEQ ID NO: 3412888 - RNA, 18 nt, Human
uucacuauaaaugguguu

SEQ ID NO: 3412889 - RNA, 16 nt, Human
uucacuauaaugugaa

SEQ ID NO: 3412890 - RNA, 14 nt, Human
uucacuauuuccuu

SEQ ID NO: 3412891 - RNA, 14 nt, Human
uucacucacuguca

SEQ ID NO: 3412892 - RNA, 13 nt, Human
uucacuccagccu

SEQ ID NO: 3412893 - RNA, 23 nt, Human
uucacuccggugugccugcagcc

SEQ ID NO: 3412894 - RNA, 17 nt, Human
uucacucuaagauguua

SEQ ID NO: 3412895 - RNA, 18 nt, Human
uucacucuaagauguuau

SEQ ID NO: 3412896 - RNA, 22 nt, Human
uucacucuaagauguuauauuu

SEQ ID NO: 3412897 - RNA, 21 nt, Human
uucacucuccauuuaauaauu

SEQ ID NO: 3412898 - RNA, 19 nt, Human
uucacucuccuaugccuuu

SEQ ID NO: 3412899 - RNA, 13 nt, Human
uucacucuccuug

SEQ ID NO: 3412900 - RNA, 21 nt, Human
uucacucugggcacacucugc

SEQ ID NO: 3412901 - RNA, 23 nt, Human
uucacucuuaggcacuuuggggg

SEQ ID NO: 3412902 - RNA, 13 nt, Human
uucacugaagacg

SEQ ID NO: 3412903 - RNA, 13 nt, Human
uucacugccccca

SEQ ID NO: 3412904 - RNA, 16 nt, Human
uucacugccuuugcuc

SEQ ID NO: 3412905 - RNA, 17 nt, Human
uucacugcuggcugccu

SEQ ID NO: 3412906 - RNA, 19 nt, Human
uucacugcuggcugccuua

SEQ ID NO: 3412907 - RNA, 22 nt, Human
uucacuggccccuacuuugugg

SEQ ID NO: 3412908 - RNA, 20 nt, Human
uucacuguaagacucauucc

SEQ ID NO: 3412909 - RNA, 19 nt, Human
uucacuguauaaauaggag

SEQ ID NO: 3412910 - RNA, 20 nt, Human
uucacugucaccacccugcu

SEQ ID NO: 3412911 - RNA, 22 nt, Human
uucacugucaggaagaaaucac

SEQ ID NO: 3412912 - RNA, 16 nt, Human
uucacugucugucugg

SEQ ID NO: 3412913 - RNA, 12 nt, Human
uucacugugcug

SEQ ID NO: 3412914 - RNA, 18 nt, Human
uucacugugcuguuguua

SEQ ID NO: 3412915 - RNA, 22 nt, Human
uucacuguuagcuuuuuaaaac

SEQ ID NO: 3412916 - RNA, 21 nt, Human
uucacuguugaaaauuauuuu

SEQ ID NO: 3412917 - RNA, 22 nt, Human
uucacuuaaguuaguuccacug

SEQ ID NO: 3412918 - RNA, 13 nt, Human
uucacuucacgcu

SEQ ID NO: 3412919 - RNA, 14 nt, Human
uucacuucucccaa

SEQ ID NO: 3412920 - RNA, 18 nt, Human
uucacuucucccaagacu

SEQ ID NO: 3412921 - RNA, 13 nt, Human
uucacuucuuucc

SEQ ID NO: 3412922 - RNA, 16 nt, Human
uucacuucuuucccuu

SEQ ID NO: 3412923 - RNA, 22 nt, Human
uucacuucuuucccuuccucca

SEQ ID NO: 3412924 - RNA, 19 nt, Human
uucacuuguguuuuaaaau

SEQ ID NO: 3412925 - RNA, 20 nt, Human
uucacuuguucuuaaacuuu

SEQ ID NO: 3412926 - RNA, 17 nt, Human
uucacuuuagaugcuga

SEQ ID NO: 3412927 - RNA, 17 nt, Human
uucacuuucaaaaacau

SEQ ID NO: 3412928 - RNA, 15 nt, Human
uucacuuucauuuuu

SEQ ID NO: 3412929 - RNA, 22 nt, Human
uucacuuuugcaagguuccaca

SEQ ID NO: 3412930 - RNA, 18 nt, Human
uucagaaaacgggaagcg

SEQ ID NO: 3412931 - RNA, 13 nt, Human
uucagaaaauauu

SEQ ID NO: 3412932 - RNA, 15 nt, Human
uucagaaaauguucu

SEQ ID NO: 3412933 - RNA, 18 nt, Human
uucagaaagugugcuuua

SEQ ID NO: 3412934 - RNA, 21 nt, Human
uucagaaauauaacacauuuu

SEQ ID NO: 3412935 - RNA, 13 nt, Human
uucagaaauaugu

SEQ ID NO: 3412936 - RNA, 18 nt, Human
uucagaaaugcugccugc

SEQ ID NO: 3412937 - RNA, 20 nt, Human
uucagaaaugcugccugccu

SEQ ID NO: 3412938 - RNA, 21 nt, Human
uucagaaaugcugccugccug

SEQ ID NO: 3412939 - RNA, 11 nt, Human
uucagaaaugu

SEQ ID NO: 3412940 - RNA, 13 nt, Human
uucagaaaugugu

SEQ ID NO: 3412941 - RNA, 23 nt, Human
uucagaaccccaacuacuguguu

SEQ ID NO: 3412942 - RNA, 12 nt, Human
uucagaaccucu

SEQ ID NO: 3412943 - RNA, 17 nt, Human
uucagaaccucuucccc

SEQ ID NO: 3412944 - RNA, 13 nt, Human
uucagaagaaauu

SEQ ID NO: 3412945 - RNA, 16 nt, Human
uucagaagacacugca

SEQ ID NO: 3412946 - RNA, 16 nt, Human
uucagaaggggagggg

SEQ ID NO: 3412947 - RNA, 22 nt, Human
uucagaagucacacauuacaaa

SEQ ID NO: 3412948 - RNA, 22 nt, Human
uucagaagugagcuuugcugcu

SEQ ID NO: 3412949 - RNA, 20 nt, Human
uucagaagugcccuuccugc

SEQ ID NO: 3412950 - RNA, 14 nt, Human
uucagaaguuuaaa

SEQ ID NO: 3412951 - RNA, 20 nt, Human
uucagaaguuuggcaauagu

SEQ ID NO: 3412952 - RNA, 19 nt, Human
uucagaaucacuucugaga

SEQ ID NO: 3412953 - RNA, 13 nt, Human
uucagaaucugaa

SEQ ID NO: 3412954 - RNA, 17 nt, Human
uucagaaucugaaugua

SEQ ID NO: 3412955 - RNA, 21 nt, Human
uucagaaucugaauguaauuu

SEQ ID NO: 3412956 - RNA, 17 nt, Human
uucagaaucuuuguuaa

SEQ ID NO: 3412957 - RNA, 21 nt, Human
uucugaaauuuccugggagcu

SEQ ID NO: 3412958 - RNA, 18 nt, Human
uucugaacagcuggugua

SEQ ID NO: 3412959 - RNA, 23 nt, Human
uucugaacagcugguguagcuac

SEQ ID NO: 3412960 - RNA, 19 nt, Human
uucugaacuuggcgcugcc

SEQ ID NO: 3412961 - RNA, 22 nt, Human
uucugaacuuggcgcugccccu

SEQ ID NO: 3412962 - RNA, 12 nt, Human
uucugaagaaga

SEQ ID NO: 3412963 - RNA, 15 nt, Human
uucugaaguuauauu

SEQ ID NO: 3412964 - RNA, 16 nt, Human
uucugaauaaagcaau

SEQ ID NO: 3412965 - RNA, 11 nt, Human
uucugaauaug

SEQ ID NO: 3412966 - RNA, 22 nt, Human
uucugaauauuuuaucuuuccu

SEQ ID NO: 3412967 - RNA, 14 nt, Human
uucugaaugcugcu

SEQ ID NO: 3412968 - RNA, 23 nt, Human
uucugaaugcuucuaaguaaaua

SEQ ID NO: 3412969 - RNA, 15 nt, Human
uucugacaaacugug

SEQ ID NO: 3412970 - RNA, 22 nt, Human
uucugacacgacuucuguuuca

SEQ ID NO: 3412971 - RNA, 20 nt, Human
uucugaccacagcaucauuu

SEQ ID NO: 3412972 - RNA, 14 nt, Human
uucugaccauuuca

SEQ ID NO: 3412973 - RNA, 22 nt, Human
uucugacccaugcugcccugug

SEQ ID NO: 3412974 - RNA, 13 nt, Human
uucugaccucagc

SEQ ID NO: 3412975 - RNA, 15 nt, Human
uucugaccucagcau

SEQ ID NO: 3412976 - RNA, 15 nt, Human
uucugacuccagugg

SEQ ID NO: 3412977 - RNA, 15 nt, Human
uucugacucugagcu

SEQ ID NO: 3412978 - RNA, 14 nt, Human
uucugacucuuccc

SEQ ID NO: 3412979 - RNA, 13 nt, Human
uucugagaaaaca

SEQ ID NO: 3412980 - RNA, 21 nt, Human
uucugagaaaacaagcaaguu

SEQ ID NO: 3412981 - RNA, 16 nt, Human
uucugagaaagacuau

SEQ ID NO: 3412982 - RNA, 19 nt, Human
uucugagacgucaugagga

SEQ ID NO: 3412983 - RNA, 19 nt, Human
uucugagauggcucccagg

SEQ ID NO: 3412984 - RNA, 21 nt, Human
uucugagcccgggcugccugg

SEQ ID NO: 3412985 - RNA, 21 nt, Human
uucugaggacauuccaagaca

SEQ ID NO: 3412986 - RNA, 15 nt, Human
uucugagugccuucu

SEQ ID NO: 3412987 - RNA, 18 nt, Human
uucugagugccuucugug

SEQ ID NO: 3412988 - RNA, 22 nt, Human
uucugagugccuucugugggga

SEQ ID NO: 3412989 - RNA, 14 nt, Human
uucugaguguuuuu

SEQ ID NO: 3412990 - RNA, 20 nt, Human
uucugaguguuuuuacuaca

SEQ ID NO: 3412991 - RNA, 12 nt, Human
uucugaguuccu

SEQ ID NO: 3412992 - RNA, 23 nt, Human
uucugaguuucauucuccugccu

SEQ ID NO: 3412993 - RNA, 21 nt, Human
uucugaguuuuguguuuguug

SEQ ID NO: 3412994 - RNA, 19 nt, Human
uucugauaaaagauggcca

SEQ ID NO: 3412995 - RNA, 16 nt, Human
uucugauaaugaaaau

SEQ ID NO: 3412996 - RNA, 15 nt, Human
uucugaucaaggccu

SEQ ID NO: 3412997 - RNA, 15 nt, Human
uucugaucacugaaa

SEQ ID NO: 3412998 - RNA, 21 nt, Human
uucugaugucucuaaagcacu

SEQ ID NO: 3412999 - RNA, 15 nt, Human
uucugauuagcuuug

SEQ ID NO: 3413000 - RNA, 20 nt, Human
uucugauuagcuuuguguuu

SEQ ID NO: 3413001 - RNA, 12 nt, Human
uucugauuccac

SEQ ID NO: 3413002 - RNA, 11 nt, Human
uucugauugua

SEQ ID NO: 3413003 - RNA, 20 nt, Human
uucugauuucuuuucaccau

SEQ ID NO: 3413004 - RNA, 23 nt, Human
uucugauuuuaggagcuaaggcu

SEQ ID NO: 3413005 - RNA, 19 nt, Human
uucugcaaaaauauuuaua

SEQ ID NO: 3413006 - RNA, 13 nt, Human
uucugcaagccug

SEQ ID NO: 3413007 - RNA, 12 nt, Human
uucugcacccuc

SEQ ID NO: 3413008 - RNA, 16 nt, Human
uucugcacccuccacc

SEQ ID NO: 3413009 - RNA, 19 nt, Human
uucugcacccuccacccug

SEQ ID NO: 3413010 - RNA, 15 nt, Human
uucugcaccuuaucu

SEQ ID NO: 3413011 - RNA, 16 nt, Human
uucugcacuauaugca

SEQ ID NO: 3413012 - RNA, 17 nt, Human
uucugcacugagcagag

SEQ ID NO: 3413013 - RNA, 23 nt, Human
uucugcagaguuuccaaaaccag

SEQ ID NO: 3413014 - RNA, 17 nt, Human
uucugcauauguugaau

SEQ ID NO: 3413015 - RNA, 21 nt, Human
uucugcauucauuuuuauagc

SEQ ID NO: 3413016 - RNA, 22 nt, Human
uucugcauugcuagauaaaagc

SEQ ID NO: 3413017 - RNA, 14 nt, Human
uucugccacauaaa

SEQ ID NO: 3413018 - RNA, 22 nt, Human
uucugccagauguccuaauggu

SEQ ID NO: 3413019 - RNA, 16 nt, Human
uucugccauuucaugu

SEQ ID NO: 3413020 - RNA, 19 nt, Human
uucugcccaaaaauauggu

SEQ ID NO: 3413021 - RNA, 20 nt, Human
uucugcccauccugucuguu

SEQ ID NO: 3413022 - RNA, 23 nt, Human
uucugcccugugggaccccaggc

SEQ ID NO: 3413023 - RNA, 13 nt, Human
uucugccgcagcc

SEQ ID NO: 3413024 - RNA, 14 nt, Human
uucugccgcagccc

SEQ ID NO: 3413025 - RNA, 15 nt, Human
uucugccgcagcccu

SEQ ID NO: 3413026 - RNA, 21 nt, Human
uucugccgcccccuccugaac

SEQ ID NO: 3413027 - RNA, 16 nt, Human
uucugccucugaugua

SEQ ID NO: 3413028 - RNA, 12 nt, Human
uucugccugcca

SEQ ID NO: 3413029 - RNA, 17 nt, Human
uucugccugccagcugc

SEQ ID NO: 3413030 - RNA, 19 nt, Human
uucugccugccagcugcac

SEQ ID NO: 3413031 - RNA, 17 nt, Human
uucugccugcccaggcc

SEQ ID NO: 3413032 - RNA, 14 nt, Human
uucugccuguuaua

SEQ ID NO: 3413033 - RNA, 15 nt, Human
uucugccuguuauaa

SEQ ID NO: 3413034 - RNA, 24 nt, Human
uucugccuguuauaacucugcacu

SEQ ID NO: 3413035 - RNA, 11 nt, Human
uucugccuucc

SEQ ID NO: 3413036 - RNA, 16 nt, Human
uucugccuucucauga

SEQ ID NO: 3413037 - RNA, 23 nt, Human
uucugccuuugauguuacagauu

SEQ ID NO: 3413038 - RNA, 20 nt, Human
uucugccuuugcagaaacag

SEQ ID NO: 3413039 - RNA, 13 nt, Human
uucugccuuugcc

SEQ ID NO: 3413040 - RNA, 15 nt, Human
uucugccuuugccag

SEQ ID NO: 3413041 - RNA, 22 nt, Human
uucugccuuuggggacuuuucu

SEQ ID NO: 3413042 - RNA, 12 nt, Human
uucugccuuuuc

SEQ ID NO: 3413043 - RNA, 16 nt, Human
uucugcuaaauuucaa

SEQ ID NO: 3413044 - RNA, 19 nt, Human
uucugcuacuggcaaaagg

SEQ ID NO: 3413045 - RNA, 19 nt, Human
uucugcucauucuaaugau

SEQ ID NO: 3413046 - RNA, 11 nt, Human
uucugcuccac

SEQ ID NO: 3413047 - RNA, 18 nt, Human
uucugcuccacccuuggc

SEQ ID NO: 3413048 - RNA, 15 nt, Human
uucugcuccagacag

SEQ ID NO: 3413049 - RNA, 16 nt, Human
uucugcuccagacagg

SEQ ID NO: 3413050 - RNA, 15 nt, Human
uucugcuccucucca

SEQ ID NO: 3413051 - RNA, 16 nt, Human
uucugcuccucuccag

SEQ ID NO: 3413052 - RNA, 18 nt, Human
uucugcuccucuccaggc

SEQ ID NO: 3413053 - RNA, 17 nt, Human
uucugcucugguuguuu

SEQ ID NO: 3413054 - RNA, 21 nt, Human
uucugcucugguuguuucugu

SEQ ID NO: 3413055 - RNA, 18 nt, Human
uucugcugaauuuucaca

SEQ ID NO: 3413056 - RNA, 20 nt, Human
uucugcugaauuuucacaug

SEQ ID NO: 3413057 - RNA, 21 nt, Human
uucugcuggauaaaaugaggu

SEQ ID NO: 3413058 - RNA, 15 nt, Human
uucugcuggccucug

SEQ ID NO: 3413059 - RNA, 18 nt, Human
uucugcuggccucugcga

SEQ ID NO: 3413060 - RNA, 19 nt, Human
uucugcuggccuggaucuc

SEQ ID NO: 3413061 - RNA, 13 nt, Human
uucugcugggcug

SEQ ID NO: 3413062 - RNA, 14 nt, Human
uucugcuuaggaga

SEQ ID NO: 3413063 - RNA, 16 nt, Human
uucugcuucaauaaau

SEQ ID NO: 3413064 - RNA, 19 nt, Human
uucugcuucaauaaaucuu

SEQ ID NO: 3413065 - RNA, 15 nt, Human
uucugcuucagccuc

SEQ ID NO: 3413066 - RNA, 13 nt, Human
uucugcuugagaa

SEQ ID NO: 3413067 - RNA, 17 nt, Human
uucugcuugagaauauu

SEQ ID NO: 3413068 - RNA, 22 nt, Human
uucugcuugcuugcuuuuuaau

SEQ ID NO: 3413069 - RNA, 14 nt, Human
uucugcuuucuccc

SEQ ID NO: 3413070 - RNA, 19 nt, Human
uucugcuuucuuugauucu

SEQ ID NO: 3413071 - RNA, 19 nt, Human
uucugcuuuguugugugcc

SEQ ID NO: 3413072 - RNA, 20 nt, Human
uucugcuuuguugugugccu

SEQ ID NO: 3413073 - RNA, 22 nt, Human
uucugcuuuguugugugccucu

SEQ ID NO: 3413074 - RNA, 13 nt, Human
uucugcuuuucug

SEQ ID NO: 3413075 - RNA, 19 nt, Human
uucugcuuuucugcccugg

SEQ ID NO: 3413076 - RNA, 19 nt, Human
uucugcuuuugaaaucugu

SEQ ID NO: 3413077 - RNA, 19 nt, Human
uucuggaauacaugaaaua

SEQ ID NO: 3413078 - RNA, 22 nt, Human
uucuggaaucauuguccagagc

SEQ ID NO: 3413079 - RNA, 20 nt, Human
uucuggaauguaaucaaugu

SEQ ID NO: 3413080 - RNA, 19 nt, Human
uucuggaauuuguucaagu

SEQ ID NO: 3413081 - RNA, 20 nt, Human
uucuggaauuuguucaaguu

SEQ ID NO: 3413082 - RNA, 22 nt, Human
uucuggaauuuguucaaguuuu

SEQ ID NO: 3413083 - RNA, 15 nt, Human
uucuggaccucuggg

SEQ ID NO: 3413084 - RNA, 21 nt, Human
uucuggaccuuguuguuguua

SEQ ID NO: 3413085 - RNA, 15 nt, Human
uucuggagucuccag

SEQ ID NO: 3413086 - RNA, 18 nt, Human
uucuggauaaagccacug

SEQ ID NO: 3413087 - RNA, 23 nt, Human
uucuggauggauuuuauaggaaa

SEQ ID NO: 3413088 - RNA, 20 nt, Human
uucuggauggugugccuucc

SEQ ID NO: 3413089 - RNA, 20 nt, Human
uucuggauuuugucaagcag

SEQ ID NO: 3413090 - RNA, 11 nt, Human
uucuggcaccg

SEQ ID NO: 3413091 - RNA, 17 nt, Human
uucuggccaguguuuaa

SEQ ID NO: 3413092 - RNA, 20 nt, Human
uucuggccugccuucguuaa

SEQ ID NO: 3413093 - RNA, 21 nt, Human
uucuggccuuuccucucuccu

SEQ ID NO: 3413094 - RNA, 16 nt, Human
uucuggcucucccauu

SEQ ID NO: 3413095 - RNA, 22 nt, Human
uucuggcucucccauuuccuga

SEQ ID NO: 3413096 - RNA, 15 nt, Human
uucuggcucuuccag

SEQ ID NO: 3413097 - RNA, 16 nt, Human
uucuggcucuuccagg

SEQ ID NO: 3413098 - RNA, 18 nt, Human
uucuggcugaaaaaggcc

SEQ ID NO: 3413099 - RNA, 20 nt, Human
uucuggcugccccaaccugc

SEQ ID NO: 3413100 - RNA, 14 nt, Human
uucugggagggcag

SEQ ID NO: 3413101 - RNA, 16 nt, Human
uucuuugcaaaguauu

SEQ ID NO: 3413102 - RNA, 14 nt, Human
uucuuugccuguuc

SEQ ID NO: 3413103 - RNA, 21 nt, Human
uucuuugcuugaacacaguau

SEQ ID NO: 3413104 - RNA, 21 nt, Human
uucuuuggauucuaaauacau

SEQ ID NO: 3413105 - RNA, 15 nt, Human
uucuuuggugccuuu

SEQ ID NO: 3413106 - RNA, 22 nt, Human
uucuuuggugccuuuccuguuc

SEQ ID NO: 3413107 - RNA, 22 nt, Human
uucuuugguggagauaaagauu

SEQ ID NO: 3413108 - RNA, 15 nt, Human
uucuuuguaaugaaa

SEQ ID NO: 3413109 - RNA, 16 nt, Human
uucuuuguaaugaaaa

SEQ ID NO: 3413110 - RNA, 22 nt, Human
uucuuuguacacccaugaaaga

SEQ ID NO: 3413111 - RNA, 10 nt, Human
uucuuugugu

SEQ ID NO: 3413112 - RNA, 11 nt, Human
uucuuugugua

SEQ ID NO: 3413113 - RNA, 19 nt, Human
uucuuugugucaacaugaa

SEQ ID NO: 3413114 - RNA, 14 nt, Human
uucuuuuaaagacc

SEQ ID NO: 3413115 - RNA, 18 nt, Human
uucuuuuaaauuagaaaa

SEQ ID NO: 3413116 - RNA, 20 nt, Human
uucuuuuaacuucuuucuau

SEQ ID NO: 3413117 - RNA, 21 nt, Human
uucuuuuaacuucuuucuauu

SEQ ID NO: 3413118 - RNA, 19 nt, Human
uucuuuuacucaugaucuu

SEQ ID NO: 3413119 - RNA, 12 nt, Human
uucuuuucacau

SEQ ID NO: 3413120 - RNA, 20 nt, Human
uucuuuucacauucuuauaa

SEQ ID NO: 3413121 - RNA, 23 nt, Human
uucuuuucgccguggcugcggca

SEQ ID NO: 3413122 - RNA, 15 nt, Human
uucuuuucuggccaa

SEQ ID NO: 3413123 - RNA, 15 nt, Human
uucuuuugaauuguu

SEQ ID NO: 3413124 - RNA, 23 nt, Human
uucuuuugagcaacuuucuuaca

SEQ ID NO: 3413125 - RNA, 22 nt, Human
uucuuuugcccuucacaguguu

SEQ ID NO: 3413126 - RNA, 14 nt, Human
uucuuuuggcuucc

SEQ ID NO: 3413127 - RNA, 13 nt, Human
uucuuuugguaaa

SEQ ID NO: 3413128 - RNA, 13 nt, Human
uucuuuuguaauu

SEQ ID NO: 3413129 - RNA, 18 nt, Human
uucuuuuguauguaaaug

SEQ ID NO: 3413130 - RNA, 13 nt, Human
uucuuuuguuacu

SEQ ID NO: 3413131 - RNA, 17 nt, Human
uucuuuuguuacuguuc

SEQ ID NO: 3413132 - RNA, 18 nt, Human
uucuuuuguuacuguucu

SEQ ID NO: 3413133 - RNA, 19 nt, Human
uucuuuuguuacuguucuu

SEQ ID NO: 3413134 - RNA, 13 nt, Human
uucuuuuguuugg

SEQ ID NO: 3413135 - RNA, 21 nt, Human
uucuuuuuaaguaauguggaa

SEQ ID NO: 3413136 - RNA, 23 nt, Human
uucuuuuuacauaacugccuuga

SEQ ID NO: 3413137 - RNA, 22 nt, Human
uucuuuuuacccauuuguucau

SEQ ID NO: 3413138 - RNA, 12 nt, Human
uucuuuuucuga

SEQ ID NO: 3413139 - RNA, 14 nt, Human
uucuuuuugaaaug

SEQ ID NO: 3413140 - RNA, 18 nt, Human
uucuuuuugaaguauuua

SEQ ID NO: 3413141 - RNA, 18 nt, Human
uucuuuuugaaucuuuaa

SEQ ID NO: 3413142 - RNA, 18 nt, Human
uucuuuuugggagagacu

SEQ ID NO: 3413143 - RNA, 23 nt, Human
uucuuuuuguagcuggggcuuug

SEQ ID NO: 3413144 - RNA, 19 nt, Human
uucuuuuuuaaauuuucuu

SEQ ID NO: 3413145 - RNA, 22 nt, Human
uucuuuuuugauauagaaguau

SEQ ID NO: 3413146 - RNA, 23 nt, Human
uucuuuuuuggccaucugcuccu

SEQ ID NO: 3413147 - RNA, 16 nt, Human
uucuuuuuuucuuggc

SEQ ID NO: 3413148 - RNA, 14 nt, Human
uucuuuuuuuguga

SEQ ID NO: 3413149 - RNA, 20 nt, Human
uugaaaaaauagagccugag

SEQ ID NO: 3413150 - RNA, 19 nt, Human
uugaaaaaauuuaaaagua

SEQ ID NO: 3413151 - RNA, 21 nt, Human
uugaaaaacucuuuauuuucc

SEQ ID NO: 3413152 - RNA, 20 nt, Human
uugaaaaauauaaaauuaug

SEQ ID NO: 3413153 - RNA, 15 nt, Human
uugaaaaaugcaugu

SEQ ID NO: 3413154 - RNA, 15 nt, Human
uugaaaaauuccuau

SEQ ID NO: 3413155 - RNA, 20 nt, Human
uugaaaaauuccuauuguga

SEQ ID NO: 3413156 - RNA, 21 nt, Human
uugaaaacacuguucucugcc

SEQ ID NO: 3413157 - RNA, 19 nt, Human
uugaaaaccaaaaugacau

SEQ ID NO: 3413158 - RNA, 16 nt, Human
uugaaaaccugacaaa

SEQ ID NO: 3413159 - RNA, 14 nt, Human
uugaaaacuacauu

SEQ ID NO: 3413160 - RNA, 22 nt, Human
uugaaaacuacauuuuaacaug

SEQ ID NO: 3413161 - RNA, 18 nt, Human
uugaaaacuucagaagca

SEQ ID NO: 3413162 - RNA, 14 nt, Human
uugaaaacuuuucu

SEQ ID NO: 3413163 - RNA, 17 nt, Human
uugaaaacuuuucucag

SEQ ID NO: 3413164 - RNA, 16 nt, Human
uugaaaagacuccaaa

SEQ ID NO: 3413165 - RNA, 22 nt, Human
uugaaaagacuccaaagaaaug

SEQ ID NO: 3413166 - RNA, 23 nt, Human
uugaaaagacuccaaagaaaugu

SEQ ID NO: 3413167 - RNA, 13 nt, Human
uugaaaagagaca

SEQ ID NO: 3413168 - RNA, 14 nt, Human
uugaaaagaggugu

SEQ ID NO: 3413169 - RNA, 23 nt, Human
uugaaaagauguaccugguggau

SEQ ID NO: 3413170 - RNA, 13 nt, Human
uugaaaagccaug

SEQ ID NO: 3413171 - RNA, 19 nt, Human
uugaaaagccauguuuaag

SEQ ID NO: 3413172 - RNA, 21 nt, Human
uugaaaagccauguuuaagau

SEQ ID NO: 3413173 - RNA, 12 nt, Human
uugaaaagcuau

SEQ ID NO: 3413174 - RNA, 13 nt, Human
uugaaaagcuauu

SEQ ID NO: 3413175 - RNA, 14 nt, Human
uugaaaagcuauua

SEQ ID NO: 3413176 - RNA, 22 nt, Human
uugaaaauaaccuaauuaauau

SEQ ID NO: 3413177 - RNA, 21 nt, Human
uugaaaauaagaauagaaaua

SEQ ID NO: 3413178 - RNA, 14 nt, Human
uugaaaauauuauc

SEQ ID NO: 3413179 - RNA, 15 nt, Human
uugaaaauuauuuua

SEQ ID NO: 3413180 - RNA, 18 nt, Human
uugaaaauucaaaaagug

SEQ ID NO: 3413181 - RNA, 20 nt, Human
uugaaaauucaaaaaguguu

SEQ ID NO: 3413182 - RNA, 16 nt, Human
uugaaacaaagaaggu

SEQ ID NO: 3413183 - RNA, 11 nt, Human
uugaaacauug

SEQ ID NO: 3413184 - RNA, 21 nt, Human
uugaaacggaugauuucuaug

SEQ ID NO: 3413185 - RNA, 18 nt, Human
uugaaacuacuacaauga

SEQ ID NO: 3413186 - RNA, 16 nt, Human
uugaaacugcauuugu

SEQ ID NO: 3413187 - RNA, 14 nt, Human
uugaaacuuuaaga

SEQ ID NO: 3413188 - RNA, 20 nt, Human
uugaaacuuugagaucuaaa

SEQ ID NO: 3413189 - RNA, 16 nt, Human
uugaaagaauguaaag

SEQ ID NO: 3413190 - RNA, 14 nt, Human
uugaaagcaaaaau

SEQ ID NO: 3413191 - RNA, 17 nt, Human
uugaaagcaaaaaugcu

SEQ ID NO: 3413192 - RNA, 18 nt, Human
uugaaagcaaaaaugcua

SEQ ID NO: 3413193 - RNA, 21 nt, Human
uugaaagcaaaaaugcuaaua

SEQ ID NO: 3413194 - RNA, 19 nt, Human
uugaaaggcauucucugaa

SEQ ID NO: 3413195 - RNA, 17 nt, Human
uugaaagggcaauauga

SEQ ID NO: 3413196 - RNA, 18 nt, Human
uugaaagugaauaaacuu

SEQ ID NO: 3413197 - RNA, 15 nt, Human
uugaaagugccuuug

SEQ ID NO: 3413198 - RNA, 17 nt, Human
uugaaagugccuuugca

SEQ ID NO: 3413199 - RNA, 12 nt, Human
uugaaauaagcu

SEQ ID NO: 3413200 - RNA, 15 nt, Human
uugaaauaauaaauc

SEQ ID NO: 3413201 - RNA, 20 nt, Human
uugaaauaccucauguuuau

SEQ ID NO: 3413202 - RNA, 16 nt, Human
uugaaauauaaugcaa

SEQ ID NO: 3413203 - RNA, 20 nt, Human
uugaaauauauggucuaaug

SEQ ID NO: 3413204 - RNA, 23 nt, Human
uugaaauauauggucuaauguuu

SEQ ID NO: 3413205 - RNA, 18 nt, Human
uugaaauauccugcuuga

SEQ ID NO: 3413206 - RNA, 19 nt, Human
uugaaauauugacuuuuua

SEQ ID NO: 3413207 - RNA, 21 nt, Human
uugaaaucaguaaacacugug

SEQ ID NO: 3413208 - RNA, 23 nt, Human
uugaaaucaguaaacacugugua

SEQ ID NO: 3413209 - RNA, 21 nt, Human
uugaaaugaaaguauaacuga

SEQ ID NO: 3413210 - RNA, 14 nt, Human
uugaaaugaaauuu

SEQ ID NO: 3413211 - RNA, 20 nt, Human
uugaaaugaggucuguuuaa

SEQ ID NO: 3413212 - RNA, 14 nt, Human
uugaaaugauuuca

SEQ ID NO: 3413213 - RNA, 20 nt, Human
uugaaaugcauugcucugga

SEQ ID NO: 3413214 - RNA, 11 nt, Human
uugaaaugcug

SEQ ID NO: 3413215 - RNA, 20 nt, Human
uugaaauguaaggcugugua

SEQ ID NO: 3413216 - RNA, 18 nt, Human
uugaaaugugguuuuccu

SEQ ID NO: 3413217 - RNA, 19 nt, Human
uugaaaugugguuuuccug

SEQ ID NO: 3413218 - RNA, 11 nt, Human
uugaaauuaua

SEQ ID NO: 3413219 - RNA, 17 nt, Human
uugaaauuauaucugug

SEQ ID NO: 3413220 - RNA, 18 nt, Human
uugaaauuauguauguuu

SEQ ID NO: 3413221 - RNA, 19 nt, Human
uugaaauuauguauguuua

SEQ ID NO: 3413222 - RNA, 21 nt, Human
uugaaauuauguauguuuaca

SEQ ID NO: 3413223 - RNA, 23 nt, Human
uugaaauuauguauguuuacaua

SEQ ID NO: 3413224 - RNA, 17 nt, Human
uugaaauucugaauuug

SEQ ID NO: 3413225 - RNA, 22 nt, Human
uugaaauucugaauuugcaaag

SEQ ID NO: 3413226 - RNA, 15 nt, Human
uugaaauuguacaua

SEQ ID NO: 3413227 - RNA, 17 nt, Human
uugaaauuguauuacaa

SEQ ID NO: 3413228 - RNA, 13 nt, Human
uugaaauuuccua

SEQ ID NO: 3413229 - RNA, 13 nt, Human
uugaaauuugaau

SEQ ID NO: 3413230 - RNA, 12 nt, Human
uugaaauuuuaa

SEQ ID NO: 3413231 - RNA, 19 nt, Human
uugaaauuuugcaaauaua

SEQ ID NO: 3413232 - RNA, 16 nt, Human
uugaacaaaauaaauu

SEQ ID NO: 3413233 - RNA, 12 nt, Human
uugaacaaauga

SEQ ID NO: 3413234 - RNA, 23 nt, Human
uugaacaaugaaguugaaaauca

SEQ ID NO: 3413235 - RNA, 18 nt, Human
uugaacacaaacuguaaa

SEQ ID NO: 3413236 - RNA, 21 nt, Human
uugaacacaaacuguaaauaa

SEQ ID NO: 3413237 - RNA, 13 nt, Human
uugaacacaguau

SEQ ID NO: 3413238 - RNA, 18 nt, Human
uugaacacucaugcugaa

SEQ ID NO: 3413239 - RNA, 13 nt, Human
uugaacacugggg

SEQ ID NO: 3413240 - RNA, 22 nt, Human
uugaacauuaauccacauguuu

SEQ ID NO: 3413241 - RNA, 15 nt, Human
uugaaccaaaacauu

SEQ ID NO: 3413242 - RNA, 13 nt, Human
uugaacccaggag

SEQ ID NO: 3413243 - RNA, 17 nt, Human
uugaacccaggaguuca

SEQ ID NO: 3413244 - RNA, 20 nt, Human
uugaaccugaugaaaauaaa

SEQ ID NO: 3413245 - RNA, 14 nt, Human
uugacaacugugac

SEQ ID NO: 3413246 - RNA, 21 nt, Human
uugacaaguugcgacggagag

SEQ ID NO: 3413247 - RNA, 12 nt, Human
uugacaauaaaa

SEQ ID NO: 3413248 - RNA, 18 nt, Human
uugacaauaauuucaggu

SEQ ID NO: 3413249 - RNA, 16 nt, Human
uugacaauugggagcu

SEQ ID NO: 3413250 - RNA, 18 nt, Human
uugacacaaguggaccuu

SEQ ID NO: 3413251 - RNA, 15 nt, Human
uugacacaauuggaa

SEQ ID NO: 3413252 - RNA, 13 nt, Human
uugacacaggucu

SEQ ID NO: 3413253 - RNA, 19 nt, Human
uugacacaggucuuuccua

SEQ ID NO: 3413254 - RNA, 22 nt, Human
uugacacaggucuuuccuaagg

SEQ ID NO: 3413255 - RNA, 14 nt, Human
uugacacuauaucu

SEQ ID NO: 3413256 - RNA, 22 nt, Human
uugacacuauaucuguauauaa

SEQ ID NO: 3413257 - RNA, 14 nt, Human
uugacacucugcag

SEQ ID NO: 3413258 - RNA, 14 nt, Human
uugacacugcucua

SEQ ID NO: 3413259 - RNA, 22 nt, Human
uugacacugcucuaacagcccu

SEQ ID NO: 3413260 - RNA, 22 nt, Human
uugacacuuauagauugaaauu

SEQ ID NO: 3413261 - RNA, 14 nt, Human
uugacagaacacug

SEQ ID NO: 3413262 - RNA, 23 nt, Human
uugacagagccugccccagcgcu

SEQ ID NO: 3413263 - RNA, 19 nt, Human
uugacagcuuugcugcuga

SEQ ID NO: 3413264 - RNA, 10 nt, Human
uugacagggc

SEQ ID NO: 3413265 - RNA, 14 nt, Human
uugacaguguuuuu

SEQ ID NO: 3413266 - RNA, 15 nt, Human
uugacaguucugaag

SEQ ID NO: 3413267 - RNA, 15 nt, Human
uugacauaaaguuga

SEQ ID NO: 3413268 - RNA, 17 nt, Human
uugacauagucuggcug

SEQ ID NO: 3413269 - RNA, 13 nt, Human
uugacauauuuaa

SEQ ID NO: 3413270 - RNA, 16 nt, Human
uugacaucaacugcau

SEQ ID NO: 3413271 - RNA, 18 nt, Human
uugacaucagccagcugc

SEQ ID NO: 3413272 - RNA, 18 nt, Human
uugacaucaguuccuuug

SEQ ID NO: 3413273 - RNA, 23 nt, Human
uugacaugagauuuauaagguuu

SEQ ID NO: 3413274 - RNA, 13 nt, Human
uugacauggaaau

SEQ ID NO: 3413275 - RNA, 16 nt, Human
uugacauggaaaugaa

SEQ ID NO: 3413276 - RNA, 14 nt, Human
uugacauguacaga

SEQ ID NO: 3413277 - RNA, 22 nt, Human
uugacauguggaaagugaauuu

SEQ ID NO: 3413278 - RNA, 14 nt, Human
uugacauucugaau

SEQ ID NO: 3413279 - RNA, 16 nt, Human
uugacauucugaaugc

SEQ ID NO: 3413280 - RNA, 18 nt, Human
uugacauucugaaugcuu

SEQ ID NO: 3413281 - RNA, 21 nt, Human
uugacauuguauguaucuauu

SEQ ID NO: 3413282 - RNA, 22 nt, Human
uugacauuguauguaucuauuu

SEQ ID NO: 3413283 - RNA, 14 nt, Human
uugaccaagaacug

SEQ ID NO: 3413284 - RNA, 15 nt, Human
uugaccaagaacugc

SEQ ID NO: 3413285 - RNA, 21 nt, Human
uugaccaagaacugcauggac

SEQ ID NO: 3413286 - RNA, 18 nt, Human
uugaccaagcaggaagcu

SEQ ID NO: 3413287 - RNA, 17 nt, Human
uugaccaggcaccuccc

SEQ ID NO: 3413288 - RNA, 18 nt, Human
uugaccauucuccaccug

SEQ ID NO: 3413289 - RNA, 17 nt, Human
uugacccugcacccucc

SEQ ID NO: 3413290 - RNA, 17 nt, Human
uugaccgugaggccaga

SEQ ID NO: 3413291 - RNA, 23 nt, Human
uugacgaagucucuuuucuuuag

SEQ ID NO: 3413292 - RNA, 23 nt, Human
uugacgagugugaagcuuccuug

SEQ ID NO: 3413293 - RNA, 15 nt, Human
uugacgauuccuucu

SEQ ID NO: 3413294 - RNA, 14 nt, Human
uugacgccauccca

SEQ ID NO: 3413295 - RNA, 17 nt, Human
uugacgccaucccagcc

SEQ ID NO: 3413296 - RNA, 18 nt, Human
uugacgccaucccagccc

SEQ ID NO: 3413297 - RNA, 19 nt, Human
uugacgccaucccagcccc

SEQ ID NO: 3413298 - RNA, 20 nt, Human
uugacgccaucccagcccca

SEQ ID NO: 3413299 - RNA, 22 nt, Human
uugacgccaucccagccccaau

SEQ ID NO: 3413300 - RNA, 15 nt, Human
uugacggaugauugg

SEQ ID NO: 3413301 - RNA, 19 nt, Human
uugacguauuauuguccuu

SEQ ID NO: 3413302 - RNA, 23 nt, Human
uugacuagaugauggaugccaau

SEQ ID NO: 3413303 - RNA, 21 nt, Human
uugacuagggauucaggcugc

SEQ ID NO: 3413304 - RNA, 14 nt, Human
uugacucaccuguu

SEQ ID NO: 3413305 - RNA, 14 nt, Human
uugacucaggagcc

SEQ ID NO: 3413306 - RNA, 20 nt, Human
uugacucaggagccugugac

SEQ ID NO: 3413307 - RNA, 16 nt, Human
uugacucccaaguuuc

SEQ ID NO: 3413308 - RNA, 21 nt, Human
uugacucuaguacugugaauc

SEQ ID NO: 3413309 - RNA, 21 nt, Human
uugacugaugcugagauucuu

SEQ ID NO: 3413310 - RNA, 23 nt, Human
uugacuguuuuuacccauauccc

SEQ ID NO: 3413311 - RNA, 21 nt, Human
uugacuuaaugugauuacugc

SEQ ID NO: 3413312 - RNA, 15 nt, Human
uugacuuauuuucuc

SEQ ID NO: 3413313 - RNA, 19 nt, Human
uugacuugacagaacacug

SEQ ID NO: 3413314 - RNA, 20 nt, Human
uugacuugacagaacacugu

SEQ ID NO: 3413315 - RNA, 14 nt, Human
uugacuuuaauuua

SEQ ID NO: 3413316 - RNA, 22 nt, Human
uugacuuuacgcccaucucagg

SEQ ID NO: 3413317 - RNA, 12 nt, Human
uugacuuucagg

SEQ ID NO: 3413318 - RNA, 22 nt, Human
uugacuuuccccaccagaugcu

SEQ ID NO: 3413319 - RNA, 12 nt, Human
uugacuuugucu

SEQ ID NO: 3413320 - RNA, 18 nt, Human
uugacuuuucuguaauuc

SEQ ID NO: 3413321 - RNA, 19 nt, Human
uugacuuuucuguaauuca

SEQ ID NO: 3413322 - RNA, 22 nt, Human
uugagaaaccuuauuguaccuc

SEQ ID NO: 3413323 - RNA, 17 nt, Human
uugagaaagucagauuc

SEQ ID NO: 3413324 - RNA, 16 nt, Human
uugagaaaugaauaau

SEQ ID NO: 3413325 - RNA, 19 nt, Human
uugagaacugcauauguuu

SEQ ID NO: 3413326 - RNA, 21 nt, Human
uugagaacugcauauguuucg

SEQ ID NO: 3413327 - RNA, 15 nt, Human
uugagaagaaaacau

SEQ ID NO: 3413328 - RNA, 18 nt, Human
uugagaagaaaacaucua

SEQ ID NO: 3413329 - RNA, 22 nt, Human
uugagaagaccucaccuagaaa

SEQ ID NO: 3413330 - RNA, 16 nt, Human
uugagaagaggacauu

SEQ ID NO: 3413331 - RNA, 23 nt, Human
uugagaagccuucagcuccaggg

SEQ ID NO: 3413332 - RNA, 17 nt, Human
uugagaagcguauguuu

SEQ ID NO: 3413333 - RNA, 15 nt, Human
uugagaagcugcuca

SEQ ID NO: 3413334 - RNA, 16 nt, Human
uugagaagcugcucaa

SEQ ID NO: 3413335 - RNA, 19 nt, Human
uugagaaggaaaauuuuag

SEQ ID NO: 3413336 - RNA, 20 nt, Human
uugagaaggaaaauuuuagc

SEQ ID NO: 3413337 - RNA, 14 nt, Human
uugagaaggagaga

SEQ ID NO: 3413338 - RNA, 16 nt, Human
uugagaaggagagaaa

SEQ ID NO: 3413339 - RNA, 16 nt, Human
uugagaaguucauugu

SEQ ID NO: 3413340 - RNA, 13 nt, Human
uugagaauuuuaa

SEQ ID NO: 3413341 - RNA, 13 nt, Human
uugagacaaaaau

SEQ ID NO: 3413342 - RNA, 15 nt, Human
uugagacaaaaauua

SEQ ID NO: 3413343 - RNA, 22 nt, Human
uugagacaguuucuuagcuuuu

SEQ ID NO: 3413344 - RNA, 13 nt, Human
uugagacauucca

SEQ ID NO: 3413345 - RNA, 14 nt, Human
uugagaccucagcc

SEQ ID NO: 3413346 - RNA, 23 nt, Human
uugagagaaauaugaagaacuga

SEQ ID NO: 3413347 - RNA, 17 nt, Human
uugagagaagagacaaa

SEQ ID NO: 3413348 - RNA, 16 nt, Human
uugagagaccaggcaa

SEQ ID NO: 3413349 - RNA, 14 nt, Human
uugagaguucuaaa

SEQ ID NO: 3413350 - RNA, 20 nt, Human
uugagauacuuuuucuuuug

SEQ ID NO: 3413351 - RNA, 17 nt, Human
uugagauaguuuucauc

SEQ ID NO: 3413352 - RNA, 21 nt, Human
uugagauauuaaugcccagac

SEQ ID NO: 3413353 - RNA, 15 nt, Human
uugagaucagccugg

SEQ ID NO: 3413354 - RNA, 16 nt, Human
uugagaucagccuggg

SEQ ID NO: 3413355 - RNA, 17 nt, Human
uugagauugccccaggu

SEQ ID NO: 3413356 - RNA, 19 nt, Human
uugagauugccccaggucu

SEQ ID NO: 3413357 - RNA, 13 nt, Human
uugagcaaacauu

SEQ ID NO: 3413358 - RNA, 23 nt, Human
uugagcagcagguagccugcugg

SEQ ID NO: 3413359 - RNA, 15 nt, Human
uugagcaucacagaa

SEQ ID NO: 3413360 - RNA, 15 nt, Human
uugagcaucuguccc

SEQ ID NO: 3413361 - RNA, 19 nt, Human
uugagcaugacagccugca

SEQ ID NO: 3413362 - RNA, 14 nt, Human
uugagccagcagac

SEQ ID NO: 3413363 - RNA, 20 nt, Human
uugagccagcagacauuguc

SEQ ID NO: 3413364 - RNA, 13 nt, Human
uugagccaggccu

SEQ ID NO: 3413365 - RNA, 14 nt, Human
uugagcccucccca

SEQ ID NO: 3413366 - RNA, 15 nt, Human
uugagcccuccccag

SEQ ID NO: 3413367 - RNA, 16 nt, Human
uugagccuugaacuuu

SEQ ID NO: 3413368 - RNA, 13 nt, Human
uugagcucagccc

SEQ ID NO: 3413369 - RNA, 12 nt, Human
uugagcucccac

SEQ ID NO: 3413370 - RNA, 22 nt, Human
uugagcucccacuucugccaga

SEQ ID NO: 3413371 - RNA, 13 nt, Human
uugagcuccuggg

SEQ ID NO: 3413372 - RNA, 22 nt, Human
uugagcugaaaugcugcauuuu

SEQ ID NO: 3413373 - RNA, 12 nt, Human
uugagcugccuu

SEQ ID NO: 3413374 - RNA, 14 nt, Human
uugagcugccuucc

SEQ ID NO: 3413375 - RNA, 15 nt, Human
uugagcugccuuccc

SEQ ID NO: 3413376 - RNA, 19 nt, Human
uugagcugccuucccuagc

SEQ ID NO: 3413377 - RNA, 11 nt, Human
uugagcuggcc

SEQ ID NO: 3413378 - RNA, 14 nt, Human
uugagcugguaaca

SEQ ID NO: 3413379 - RNA, 21 nt, Human
uugagcuguugccucaguccc

SEQ ID NO: 3413380 - RNA, 18 nt, Human
uugagcuguuuucccuga

SEQ ID NO: 3413381 - RNA, 23 nt, Human
uugaggaaaacaagcauucacaa

SEQ ID NO: 3413382 - RNA, 14 nt, Human
uugaggaacuguac

SEQ ID NO: 3413383 - RNA, 19 nt, Human
uugaggaacuguacagaaa

SEQ ID NO: 3413384 - RNA, 15 nt, Human
uugaggacacugaua

SEQ ID NO: 3413385 - RNA, 16 nt, Human
uugaggagcauguuuu

SEQ ID NO: 3413386 - RNA, 16 nt, Human
uugaggagccccagcu

SEQ ID NO: 3413387 - RNA, 19 nt, Human
uugaggaggggcagguaaa

SEQ ID NO: 3413388 - RNA, 16 nt, Human
uugaggagugguuuuu

SEQ ID NO: 3413389 - RNA, 18 nt, Human
uugaggauauauuuucac

SEQ ID NO: 3413390 - RNA, 20 nt, Human
uugucuaugggacucaaugc

SEQ ID NO: 3413391 - RNA, 13 nt, Human
uugucuauuuuaa

SEQ ID NO: 3413392 - RNA, 16 nt, Human
uugucucaaugcucau

SEQ ID NO: 3413393 - RNA, 15 nt, Human
uugucucaugccagu

SEQ ID NO: 3413394 - RNA, 18 nt, Human
uugucucauuuuaaugua

SEQ ID NO: 3413395 - RNA, 18 nt, Human
uugucuccccuguucccc

SEQ ID NO: 3413396 - RNA, 21 nt, Human
uugucucccgccccccacacu

SEQ ID NO: 3413397 - RNA, 16 nt, Human
uugucucccuggcccu

SEQ ID NO: 3413398 - RNA, 17 nt, Human
uugucucccuggcccuc

SEQ ID NO: 3413399 - RNA, 17 nt, Human
uugucucguuugugauu

SEQ ID NO: 3413400 - RNA, 12 nt, Human
uugucucuccuu

SEQ ID NO: 3413401 - RNA, 14 nt, Human
uugucucuccuuuu

SEQ ID NO: 3413402 - RNA, 14 nt, Human
uugucucucuucag

SEQ ID NO: 3413403 - RNA, 15 nt, Human
uugucucugaugcag

SEQ ID NO: 3413404 - RNA, 17 nt, Human
uugucucugaugcagcu

SEQ ID NO: 3413405 - RNA, 12 nt, Human
uugucucugggc

SEQ ID NO: 3413406 - RNA, 22 nt, Human
uugucugaaaagugaagacaga

SEQ ID NO: 3413407 - RNA, 15 nt, Human
uugucugaaacauuu

SEQ ID NO: 3413408 - RNA, 17 nt, Human
uugucugccccaaguuu

SEQ ID NO: 3413409 - RNA, 16 nt, Human
uugucuguuuguuuca

SEQ ID NO: 3413410 - RNA, 15 nt, Human
uugucuuaaaaagug

SEQ ID NO: 3413411 - RNA, 13 nt, Human
uugucuuaaugga

SEQ ID NO: 3413412 - RNA, 14 nt, Human
uugucuuauucccu

SEQ ID NO: 3413413 - RNA, 15 nt, Human
uugucuuauugacag

SEQ ID NO: 3413414 - RNA, 16 nt, Human
uugucuucuccccagg

SEQ ID NO: 3413415 - RNA, 22 nt, Human
uugucuugaaugucuuuugaau

SEQ ID NO: 3413416 - RNA, 18 nt, Human
uugucuugccuuauuaaa

SEQ ID NO: 3413417 - RNA, 14 nt, Human
uugucuuuaacugu

SEQ ID NO: 3413418 - RNA, 19 nt, Human
uugucuuuggugaacauug

SEQ ID NO: 3413419 - RNA, 13 nt, Human
uugucuuuuuaga

SEQ ID NO: 3413420 - RNA, 17 nt, Human
uugugaaaugaaaacau

SEQ ID NO: 3413421 - RNA, 20 nt, Human
uugugaaaugaaaacaugua

SEQ ID NO: 3413422 - RNA, 23 nt, Human
uugugaaaugaaaacauguaaua

SEQ ID NO: 3413423 - RNA, 23 nt, Human
uugugaaauggccaggauccucu

SEQ ID NO: 3413424 - RNA, 14 nt, Human
uugugaaauuuuuc

SEQ ID NO: 3413425 - RNA, 23 nt, Human
uugugaaauuuuucauauuuuaa

SEQ ID NO: 3413426 - RNA, 23 nt, Human
uugugaacucagccaagcacagu

SEQ ID NO: 3413427 - RNA, 19 nt, Human
uugugaagaacuauuuuau

SEQ ID NO: 3413428 - RNA, 17 nt, Human
uugugaagauguuugca

SEQ ID NO: 3413429 - RNA, 22 nt, Human
uugugaagccaugaguuccaga

SEQ ID NO: 3413430 - RNA, 18 nt, Human
uugugaaggauuauggaa

SEQ ID NO: 3413431 - RNA, 14 nt, Human
uugugaaggccaug

SEQ ID NO: 3413432 - RNA, 22 nt, Human
uugugaaggccaugauauuuug

SEQ ID NO: 3413433 - RNA, 22 nt, Human
uugugaaggccucgcaggaaga

SEQ ID NO: 3413434 - RNA, 17 nt, Human
uugugaagguggaaaua

SEQ ID NO: 3413435 - RNA, 14 nt, Human
uugugaaguacaua

SEQ ID NO: 3413436 - RNA, 22 nt, Human
uugugaaguacccguucacauu

SEQ ID NO: 3413437 - RNA, 21 nt, Human
uugugaaguuagguucuuaaa

SEQ ID NO: 3413438 - RNA, 14 nt, Human
uugugaauaaagag

SEQ ID NO: 3413439 - RNA, 14 nt, Human
uugugaauaauuac

SEQ ID NO: 3413440 - RNA, 15 nt, Human
uugugaauaauuaca

SEQ ID NO: 3413441 - RNA, 21 nt, Human
uugugaauggauuggauuauu

SEQ ID NO: 3413442 - RNA, 19 nt, Human
uugugaauuaggcuguaac

SEQ ID NO: 3413443 - RNA, 13 nt, Human
uugugacaaaaaa

SEQ ID NO: 3413444 - RNA, 14 nt, Human
uugugacaaaaaau

SEQ ID NO: 3413445 - RNA, 16 nt, Human
uugugacaaaaaauua

SEQ ID NO: 3413446 - RNA, 19 nt, Human
uugugacagauuauacaga

SEQ ID NO: 3413447 - RNA, 23 nt, Human
uugugacagcucuuuuugugaag

SEQ ID NO: 3413448 - RNA, 17 nt, Human
uugugacccaauuaagu

SEQ ID NO: 3413449 - RNA, 14 nt, Human
uugugacuaauugu

SEQ ID NO: 3413450 - RNA, 16 nt, Human
uugugacuaauuguau

SEQ ID NO: 3413451 - RNA, 15 nt, Human
uugugacuauauaga

SEQ ID NO: 3413452 - RNA, 19 nt, Human
uugugacuauauagagaug

SEQ ID NO: 3413453 - RNA, 22 nt, Human
uugugacuauauagagauguuu

SEQ ID NO: 3413454 - RNA, 16 nt, Human
uugugacuguauauaa

SEQ ID NO: 3413455 - RNA, 16 nt, Human
uugugaggaaagucau

SEQ ID NO: 3413456 - RNA, 17 nt, Human
uugugaggaaagucauu

SEQ ID NO: 3413457 - RNA, 22 nt, Human
uugugaggaaagucauuggcuu

SEQ ID NO: 3413458 - RNA, 13 nt, Human
uugugaggaagcc

SEQ ID NO: 3413459 - RNA, 22 nt, Human
uugugaguuuguuucuuugaau

SEQ ID NO: 3413460 - RNA, 18 nt, Human
uugugauacaaugcugug

SEQ ID NO: 3413461 - RNA, 19 nt, Human
uugugauacaaugcugugc

SEQ ID NO: 3413462 - RNA, 16 nt, Human
uugugauauauguauu

SEQ ID NO: 3413463 - RNA, 13 nt, Human
uugugauaugcac

SEQ ID NO: 3413464 - RNA, 16 nt, Human
uugugauauggagccc

SEQ ID NO: 3413465 - RNA, 18 nt, Human
uugugaugucauacagag

SEQ ID NO: 3413466 - RNA, 21 nt, Human
uugugaugucauacagagaag

SEQ ID NO: 3413467 - RNA, 17 nt, Human
uugugaugugcacguaa

SEQ ID NO: 3413468 - RNA, 12 nt, Human
uugugauguguc

SEQ ID NO: 3413469 - RNA, 23 nt, Human
uugugauuauuucacuuuagaug

SEQ ID NO: 3413470 - RNA, 14 nt, Human
uugugauucugccu

SEQ ID NO: 3413471 - RNA, 23 nt, Human
uugugauuucccguggccccagc

SEQ ID NO: 3413472 - RNA, 11 nt, Human
uugugauuuga

SEQ ID NO: 3413473 - RNA, 15 nt, Human
uugugauuugacugu

SEQ ID NO: 3413474 - RNA, 15 nt, Human
uugugauuuugugau

SEQ ID NO: 3413475 - RNA, 12 nt, Human
uugugauuuuug

SEQ ID NO: 3413476 - RNA, 16 nt, Human
uugugauuuuuguaau

SEQ ID NO: 3413477 - RNA, 21 nt, Human
uugugcaaaagcuucaaauua

SEQ ID NO: 3413478 - RNA, 22 nt, Human
uugugcaaaagcuucaaauuaa

SEQ ID NO: 3413479 - RNA, 17 nt, Human
uugugcaauguaaauau

SEQ ID NO: 3413480 - RNA, 22 nt, Human
uugugcaauguaaauauuuuaa

SEQ ID NO: 3413481 - RNA, 19 nt, Human
uugugcacccucuauccca

SEQ ID NO: 3413482 - RNA, 21 nt, Human
uugugcacccucuaucccaau

SEQ ID NO: 3413483 - RNA, 12 nt, Human
uugugcacuguu

SEQ ID NO: 3413484 - RNA, 16 nt, Human
uugugcagaaaacauu

SEQ ID NO: 3413485 - RNA, 13 nt, Human
uugugcagcuuuu

SEQ ID NO: 3413486 - RNA, 23 nt, Human
uugugcauuaucuagauacugua

SEQ ID NO: 3413487 - RNA, 22 nt, Human
uugugccaaccuauuuugaagu

SEQ ID NO: 3413488 - RNA, 16 nt, Human
uugugccaauauguau

SEQ ID NO: 3413489 - RNA, 21 nt, Human
uugugccaugucaaacaaaua

SEQ ID NO: 3413490 - RNA, 22 nt, Human
uugugcccccaaccauuuccuc

SEQ ID NO: 3413491 - RNA, 12 nt, Human
uugugccccugc

SEQ ID NO: 3413492 - RNA, 17 nt, Human
uugugccucccugguga

SEQ ID NO: 3413493 - RNA, 13 nt, Human
uugugccuggggu

SEQ ID NO: 3413494 - RNA, 23 nt, Human
uugugcgcuaaacuuuucugaua

SEQ ID NO: 3413495 - RNA, 23 nt, Human
uugugcuacaugacgacaaagcu

SEQ ID NO: 3413496 - RNA, 14 nt, Human
uugugcuagaauac

SEQ ID NO: 3413497 - RNA, 19 nt, Human
uugugcuauaguauuugau

SEQ ID NO: 3413498 - RNA, 12 nt, Human
uugugcugccau

SEQ ID NO: 3413499 - RNA, 14 nt, Human
uugugcuucucccc

SEQ ID NO: 3413500 - RNA, 17 nt, Human
uugugcuucuccccaga

SEQ ID NO: 3413501 - RNA, 22 nt, Human
uuguggaauggagauucaguuu

SEQ ID NO: 3413502 - RNA, 21 nt, Human
uuguggaauugggagcuuggg

SEQ ID NO: 3413503 - RNA, 17 nt, Human
uuguggaccaauuauug

SEQ ID NO: 3413504 - RNA, 18 nt, Human
uuguggaccaauuauuga

SEQ ID NO: 3413505 - RNA, 13 nt, Human
uuguggacuaaaa

SEQ ID NO: 3413506 - RNA, 22 nt, Human
uuguggacuaaaagauauaagu

SEQ ID NO: 3413507 - RNA, 14 nt, Human
uuguggagccccac

SEQ ID NO: 3413508 - RNA, 22 nt, Human
uuguggaggagcucaggacacu

SEQ ID NO: 3413509 - RNA, 15 nt, Human
uuguggauaacaaag

SEQ ID NO: 3413510 - RNA, 14 nt, Human
uuguggaugucuuc

SEQ ID NO: 3413511 - RNA, 23 nt, Human
uuguggauguuuuaauuccauga

SEQ ID NO: 3413512 - RNA, 20 nt, Human
uuguggauuuaacagaaaug

SEQ ID NO: 3413513 - RNA, 21 nt, Human
uuguggauuuaacagaaaugu

SEQ ID NO: 3413514 - RNA, 22 nt, Human
uuguggauuuaacagaaaugua

SEQ ID NO: 3413515 - RNA, 14 nt, Human
uuguggcacauucu

SEQ ID NO: 3413516 - RNA, 20 nt, Human
uuguggccaaggagcugcua

SEQ ID NO: 3413517 - RNA, 12 nt, Human
uuguggccucag

SEQ ID NO: 3413518 - RNA, 21 nt, Human
uuguggccugggccuccucac

SEQ ID NO: 3413519 - RNA, 18 nt, Human
uuguggccuuugcgcucc

SEQ ID NO: 3413520 - RNA, 18 nt, Human
uuguggcuccacacacac

SEQ ID NO: 3413521 - RNA, 14 nt, Human
uuguggcugggggc

SEQ ID NO: 3413522 - RNA, 20 nt, Human
uugugggacuuauuacaauu

SEQ ID NO: 3413523 - RNA, 16 nt, Human
uugugggcauaaacug

SEQ ID NO: 3413524 - RNA, 18 nt, Human
uugugggggacuguaagu

SEQ ID NO: 3413525 - RNA, 13 nt, Human
uugugggugggag

SEQ ID NO: 3413526 - RNA, 22 nt, Human
uugugguaggccuuuuaacauu

SEQ ID NO: 3413527 - RNA, 20 nt, Human
uugugguuuauauauuuaaa

SEQ ID NO: 3413528 - RNA, 14 nt, Human
uugugguuuggaau

SEQ ID NO: 3413529 - RNA, 22 nt, Human
uuguguaacaauuuuaaugcua

SEQ ID NO: 3413530 - RNA, 14 nt, Human
uuguguaagaaaua

SEQ ID NO: 3413531 - RNA, 20 nt, Human
uuguguaagagaauguugaa

SEQ ID NO: 3413532 - RNA, 22 nt, Human
uuguguaagagaauguugaaua

SEQ ID NO: 3413533 - RNA, 14 nt, Human
uuguguaauaaagu

SEQ ID NO: 3413534 - RNA, 22 nt, Human
uuuaaacacucuucagagaaau

SEQ ID NO: 3413535 - RNA, 14 nt, Human
uuuaaacagauguc

SEQ ID NO: 3413536 - RNA, 13 nt, Human
uuuaaacagcagu

SEQ ID NO: 3413537 - RNA, 17 nt, Human
uuuaaacaguauuucau

SEQ ID NO: 3413538 - RNA, 14 nt, Human
uuuaaacauuaaaa

SEQ ID NO: 3413539 - RNA, 23 nt, Human
uuuaaacauuaaaaauggaacug

SEQ ID NO: 3413540 - RNA, 21 nt, Human
uuuaaacccauuuuagucacu

SEQ ID NO: 3413541 - RNA, 23 nt, Human
uuuaaaccgcuaaaagaaacuuu

SEQ ID NO: 3413542 - RNA, 18 nt, Human
uuuaaaccuauacucacu

SEQ ID NO: 3413543 - RNA, 16 nt, Human
uuuaaacuagaugacc

SEQ ID NO: 3413544 - RNA, 15 nt, Human
uuuaaacugauucau

SEQ ID NO: 3413545 - RNA, 18 nt, Human
uuuaaacuguacaguguc

SEQ ID NO: 3413546 - RNA, 14 nt, Human
uuuaaacuguguac

SEQ ID NO: 3413547 - RNA, 21 nt, Human
uuuaaagaaaaaaauugaaau

SEQ ID NO: 3413548 - RNA, 22 nt, Human
uuuaaagaaaaaaauugaaaug

SEQ ID NO: 3413549 - RNA, 17 nt, Human
uuuaaagaaaaguuuug

SEQ ID NO: 3413550 - RNA, 21 nt, Human
uuuaaagaaaaguuuuguaaa

SEQ ID NO: 3413551 - RNA, 13 nt, Human
uuuaaagaaagug

SEQ ID NO: 3413552 - RNA, 13 nt, Human
uuuaaagaaugcu

SEQ ID NO: 3413553 - RNA, 12 nt, Human
uuuaaagaauug

SEQ ID NO: 3413554 - RNA, 15 nt, Human
uuuaaagagucuaga

SEQ ID NO: 3413555 - RNA, 19 nt, Human
uuuaaagcagguucuuguu

SEQ ID NO: 3413556 - RNA, 17 nt, Human
uuuaaagcguuugcaca

SEQ ID NO: 3413557 - RNA, 24 nt, Human
uuuaaagcuuauuaaaacucauuu

SEQ ID NO: 3413558 - RNA, 12 nt, Human
uuuaaaggaaaa

SEQ ID NO: 3413559 - RNA, 15 nt, Human
uuuaaaggaaaaaau

SEQ ID NO: 3413560 - RNA, 19 nt, Human
uuuaaaggcccagccccua

SEQ ID NO: 3413561 - RNA, 23 nt, Human
uuuaaaggcccagccccuagaaa

SEQ ID NO: 3413562 - RNA, 18 nt, Human
uuuaaagucucaguuucu

SEQ ID NO: 3413563 - RNA, 17 nt, Human
uuuaaagugauuaaacg

SEQ ID NO: 3413564 - RNA, 18 nt, Human
uuuaaaguggcaaucuca

SEQ ID NO: 3413565 - RNA, 14 nt, Human
uuuaaaguguuuca

SEQ ID NO: 3413566 - RNA, 22 nt, Human
uuuaaaguuaguaucuuuugau

SEQ ID NO: 3413567 - RNA, 12 nt, Human
uuuaaaguucug

SEQ ID NO: 3413568 - RNA, 21 nt, Human
uuuaaaguucuguguauuuaa

SEQ ID NO: 3413569 - RNA, 23 nt, Human
uuuaaauaaaaauuacuguguua

SEQ ID NO: 3413570 - RNA, 16 nt, Human
uuuaaauaaaacccuu

SEQ ID NO: 3413571 - RNA, 19 nt, Human
uuuaaauaaaagugaucaa

SEQ ID NO: 3413572 - RNA, 12 nt, Human
uuuaaauaaacu

SEQ ID NO: 3413573 - RNA, 13 nt, Human
uuuaaauaaacuu

SEQ ID NO: 3413574 - RNA, 20 nt, Human
uuuaaauaaacuuuuuuuca

SEQ ID NO: 3413575 - RNA, 23 nt, Human
uuuaaauaaacuuuuuuucaaug

SEQ ID NO: 3413576 - RNA, 15 nt, Human
uuuaaauauaauucu

SEQ ID NO: 3413577 - RNA, 14 nt, Human
uuuaaauauagaau

SEQ ID NO: 3413578 - RNA, 16 nt, Human
uuuaaauauagaauuu

SEQ ID NO: 3413579 - RNA, 15 nt, Human
uuuaaauauuaagca

SEQ ID NO: 3413580 - RNA, 15 nt, Human
uuuaaauauuuucua

SEQ ID NO: 3413581 - RNA, 17 nt, Human
uuuaaauauuuucuauu

SEQ ID NO: 3413582 - RNA, 12 nt, Human
uuuaaauccugu

SEQ ID NO: 3413583 - RNA, 17 nt, Human
uuuaaauccuguugaaa

SEQ ID NO: 3413584 - RNA, 19 nt, Human
uuuaaaucuaaaucuauuu

SEQ ID NO: 3413585 - RNA, 14 nt, Human
uuuaaaucugugau

SEQ ID NO: 3413586 - RNA, 20 nt, Human
uuuaaaucuguuuuucuaac

SEQ ID NO: 3413587 - RNA, 21 nt, Human
uuuaaaugaaagugagacuuu

SEQ ID NO: 3413588 - RNA, 18 nt, Human
uuuaaaugcauaaaugca

SEQ ID NO: 3413589 - RNA, 12 nt, Human
uuuaaaugccau

SEQ ID NO: 3413590 - RNA, 15 nt, Human
uuuaaauguaaagau

SEQ ID NO: 3413591 - RNA, 20 nt, Human
uuuaaauguacagacauauu

SEQ ID NO: 3413592 - RNA, 12 nt, Human
uuuaaauguaua

SEQ ID NO: 3413593 - RNA, 15 nt, Human
uuuaaauguauacua

SEQ ID NO: 3413594 - RNA, 14 nt, Human
uuuaaauguuuuuu

SEQ ID NO: 3413595 - RNA, 14 nt, Human
uuuaaauuagaaaa

SEQ ID NO: 3413596 - RNA, 22 nt, Human
uuuaaauuauaacuuaaaauau

SEQ ID NO: 3413597 - RNA, 17 nt, Human
uuuaaauuauaaggacu

SEQ ID NO: 3413598 - RNA, 18 nt, Human
uuuaaauuauaaggacug

SEQ ID NO: 3413599 - RNA, 20 nt, Human
uuuaaauuauaaggacugca

SEQ ID NO: 3413600 - RNA, 19 nt, Human
uuuaaauuauguuuuacug

SEQ ID NO: 3413601 - RNA, 22 nt, Human
uuuaaauuauguuuuuauuaag

SEQ ID NO: 3413602 - RNA, 19 nt, Human
uuuaaauucacaauagaaa

SEQ ID NO: 3413603 - RNA, 12 nt, Human
uuuaaauugugu

SEQ ID NO: 3413604 - RNA, 18 nt, Human
uuuaaauuuuacccuuua

SEQ ID NO: 3413605 - RNA, 17 nt, Human
uuuaaauuuucuucagu

SEQ ID NO: 3413606 - RNA, 15 nt, Human
uuuaaauuuuguaau

SEQ ID NO: 3413607 - RNA, 18 nt, Human
uuuaacaaaaagugcuuc

SEQ ID NO: 3413608 - RNA, 16 nt, Human
uuuaacaaaagcaaga

SEQ ID NO: 3413609 - RNA, 23 nt, Human
uuuaacaacuaugauuuggaaaa

SEQ ID NO: 3413610 - RNA, 13 nt, Human
uuuaacaagaaga

SEQ ID NO: 3413611 - RNA, 15 nt, Human
uuuaacaagaagaug

SEQ ID NO: 3413612 - RNA, 20 nt, Human
uuuaacaauaacuacugugu

SEQ ID NO: 3413613 - RNA, 22 nt, Human
uuuaacaauaacuacuguguuc

SEQ ID NO: 3413614 - RNA, 19 nt, Human
uuuaacacaaguccuguga

SEQ ID NO: 3413615 - RNA, 18 nt, Human
uuuaacacacauaaagga

SEQ ID NO: 3413616 - RNA, 18 nt, Human
uuuaacaccugaugugua

SEQ ID NO: 3413617 - RNA, 14 nt, Human
uuuaacagaaaugu

SEQ ID NO: 3413618 - RNA, 13 nt, Human
uuuaacagaaauu

SEQ ID NO: 3413619 - RNA, 14 nt, Human
uuuaacagaaauug

SEQ ID NO: 3413620 - RNA, 16 nt, Human
uuuaacagaaauugua

SEQ ID NO: 3413621 - RNA, 23 nt, Human
uuuaacagggucucuagugcugu

SEQ ID NO: 3413622 - RNA, 16 nt, Human
uuuaacauaagcuauu

SEQ ID NO: 3413623 - RNA, 21 nt, Human
uuuaacauauaauuucuuuaa

SEQ ID NO: 3413624 - RNA, 23 nt, Human
uuuaacaugaacacccuuagaaa

SEQ ID NO: 3413625 - RNA, 12 nt, Human
uuuaacauuauu

SEQ ID NO: 3413626 - RNA, 19 nt, Human
uuuaaccaaacaauuauuu

SEQ ID NO: 3413627 - RNA, 21 nt, Human
uuuaaccaaaggugaaggaau

SEQ ID NO: 3413628 - RNA, 17 nt, Human
uuuaaccauuaaaacug

SEQ ID NO: 3413629 - RNA, 18 nt, Human
uuuaaccccccuguacac

SEQ ID NO: 3413630 - RNA, 19 nt, Human
uuuaaccccccuguacaca

SEQ ID NO: 3413631 - RNA, 16 nt, Human
uuuaaccuaugauauu

SEQ ID NO: 3413632 - RNA, 16 nt, Human
uuuaaccuuguauaaa

SEQ ID NO: 3413633 - RNA, 21 nt, Human
uuuaacgugggauucagagaa

SEQ ID NO: 3413634 - RNA, 18 nt, Human
uuuaacuacccuuaauua

SEQ ID NO: 3413635 - RNA, 17 nt, Human
uuuaacuagaauuuauu

SEQ ID NO: 3413636 - RNA, 20 nt, Human
uuuaacuaugaacugaaggc

SEQ ID NO: 3413637 - RNA, 21 nt, Human
uuuaacucagaucacuacugc

SEQ ID NO: 3413638 - RNA, 23 nt, Human
uuuaacucgagaccuuuucaacu

SEQ ID NO: 3413639 - RNA, 21 nt, Human
uuuaacucuacuguguaauau

SEQ ID NO: 3413640 - RNA, 13 nt, Human
uuuaacuggugca

SEQ ID NO: 3413641 - RNA, 12 nt, Human
uuuaacugugga

SEQ ID NO: 3413642 - RNA, 13 nt, Human
uuuaacuuaaaua

SEQ ID NO: 3413643 - RNA, 21 nt, Human
uuuaacuuaaucaauuaauuu

SEQ ID NO: 3413644 - RNA, 20 nt, Human
uuuaacuuaguuuugcauag

SEQ ID NO: 3413645 - RNA, 19 nt, Human
uuuaacuugaggguaauaa

SEQ ID NO: 3413646 - RNA, 15 nt, Human
uuuaacuuguaauaa

SEQ ID NO: 3413647 - RNA, 14 nt, Human
uuuaacuuuaaguu

SEQ ID NO: 3413648 - RNA, 12 nt, Human
uuuaacuuuguu

SEQ ID NO: 3413649 - RNA, 17 nt, Human
uuuaacuuuguuuuauu

SEQ ID NO: 3413650 - RNA, 22 nt, Human
uuuaagaaaaaauaacacacau

SEQ ID NO: 3413651 - RNA, 15 nt, Human
uuuaagaaaaguauu

SEQ ID NO: 3413652 - RNA, 19 nt, Human
uuuaagaaaaguauuuuga

SEQ ID NO: 3413653 - RNA, 12 nt, Human
uuuaagaaaaua

SEQ ID NO: 3413654 - RNA, 16 nt, Human
uuuaagaaaauacaau

SEQ ID NO: 3413655 - RNA, 20 nt, Human
uuuaagaauugaguaauggu

SEQ ID NO: 3413656 - RNA, 15 nt, Human
uuuaagacacuuuuu

SEQ ID NO: 3413657 - RNA, 16 nt, Human
uuuaagacccucucaa

SEQ ID NO: 3413658 - RNA, 19 nt, Human
uuuaagacguguuuguguu

SEQ ID NO: 3413659 - RNA, 14 nt, Human
uuuaagacuguaau

SEQ ID NO: 3413660 - RNA, 14 nt, Human
uuuaagagacagcc

SEQ ID NO: 3413661 - RNA, 21 nt, Human
uuuaagagagaaaucugaaaa

SEQ ID NO: 3413662 - RNA, 23 nt, Human
uuuaagauaauaauauauguuua

SEQ ID NO: 3413663 - RNA, 14 nt, Human
uuuaagaugugaaa

SEQ ID NO: 3413664 - RNA, 22 nt, Human
uuuaagauuuaauuugccaaaa

SEQ ID NO: 3413665 - RNA, 12 nt, Human
uuuaagauuuuu

SEQ ID NO: 3413666 - RNA, 18 nt, Human
uuuaagauuuuucucaaa

SEQ ID NO: 3413667 - RNA, 15 nt, Human
uuuaagcaacaucuu

SEQ ID NO: 3413668 - RNA, 17 nt, Human
uuuaagcaaguuaagug

SEQ ID NO: 3413669 - RNA, 23 nt, Human
uuuaagcacuacauaaacugacu

SEQ ID NO: 3413670 - RNA, 20 nt, Human
uuuaagcauuacucuuguaa

SEQ ID NO: 3413671 - RNA, 21 nt, Human
uuuaagcauuacucuuguaag

SEQ ID NO: 3413672 - RNA, 13 nt, Human
uuuaagcauuguu

SEQ ID NO: 3413673 - RNA, 14 nt, Human
uuuaagcauuguuu

SEQ ID NO: 3413674 - RNA, 21 nt, Human
uuuaagcauuguuugcuuauu

SEQ ID NO: 3413675 - RNA, 20 nt, Human
uuuaagccaaaacaauguuu

SEQ ID NO: 3413676 - RNA, 16 nt, Human
uuuaagccuaaagauu

SEQ ID NO: 3413677 - RNA, 12 nt, Human
uuuaagccuuug

SEQ ID NO: 3413678 - RNA, 21 nt, Human
uuuaagccuuuguugaacugu

SEQ ID NO: 3413679 - RNA, 16 nt, Human
uuuaggaacuucagag

SEQ ID NO: 3413680 - RNA, 13 nt, Human
uuuaggaaguguu

SEQ ID NO: 3413681 - RNA, 15 nt, Human
uuuaggacaugaaaa

SEQ ID NO: 3413682 - RNA, 23 nt, Human
uuuaggauguguauuucauuuau

SEQ ID NO: 3413683 - RNA, 20 nt, Human
uuuaggcauaugcuucuuua

SEQ ID NO: 3413684 - RNA, 18 nt, Human
uuuaggcuauuuguaaau

SEQ ID NO: 3413685 - RNA, 16 nt, Human
uuuaggguaaaaauug

SEQ ID NO: 3413686 - RNA, 17 nt, Human
uuuaggguucugccucu

SEQ ID NO: 3413687 - RNA, 22 nt, Human
uuuaggugaauuaauuaaacau

SEQ ID NO: 3413688 - RNA, 13 nt, Human
uuuagguucuaaa

SEQ ID NO: 3413689 - RNA, 16 nt, Human
uuuagguucuaaaguu

SEQ ID NO: 3413690 - RNA, 23 nt, Human
uuuagguucuaaaguucuaagau

SEQ ID NO: 3413691 - RNA, 23 nt, Human
uuuagguucuuugcugcauucug

SEQ ID NO: 3413692 - RNA, 22 nt, Human
uuuaguaaaccaauccuaugca

SEQ ID NO: 3413693 - RNA, 17 nt, Human
uuuaguaacaucauuuu

SEQ ID NO: 3413694 - RNA, 19 nt, Human
uuuaguaaucuguacauuu

SEQ ID NO: 3413695 - RNA, 22 nt, Human
uuuaguaucaguguuuuaaauu

SEQ ID NO: 3413696 - RNA, 16 nt, Human
uuuaguaucuuuuuau

SEQ ID NO: 3413697 - RNA, 21 nt, Human
uuuaguauugaauacuuacau

SEQ ID NO: 3413698 - RNA, 14 nt, Human
uuuagucucuuuau

SEQ ID NO: 3413699 - RNA, 16 nt, Human
uuuagucugcaaaaug

SEQ ID NO: 3413700 - RNA, 18 nt, Human
uuuagucugcaaaaugag

SEQ ID NO: 3413701 - RNA, 15 nt, Human
uuuagucuugucuca

SEQ ID NO: 3413702 - RNA, 13 nt, Human
uuuagucuuuaua

SEQ ID NO: 3413703 - RNA, 16 nt, Human
uuuagugaacuugaaa

SEQ ID NO: 3413704 - RNA, 12 nt, Human
uuuagugacuaa

SEQ ID NO: 3413705 - RNA, 19 nt, Human
uuuaguggacccugaaaug

SEQ ID NO: 3413706 - RNA, 22 nt, Human
uuuaguggacccugaaaugugu

SEQ ID NO: 3413707 - RNA, 24 nt, Human
uuuagugguagcauauagauuguc

SEQ ID NO: 3413708 - RNA, 15 nt, Human
uuuaguguaaaaaug

SEQ ID NO: 3413709 - RNA, 13 nt, Human
uuuagugugguuu

SEQ ID NO: 3413710 - RNA, 20 nt, Human
uuuaguguuuuuuuauuucu

SEQ ID NO: 3413711 - RNA, 23 nt, Human
uuuaguucaauauuuguuacugu

SEQ ID NO: 3413712 - RNA, 12 nt, Human
uuuaguuccugu

SEQ ID NO: 3413713 - RNA, 11 nt, Human
uuuaguucuuu

SEQ ID NO: 3413714 - RNA, 17 nt, Human
uuuaguucuuuggaaau

SEQ ID NO: 3413715 - RNA, 19 nt, Human
uuuaguugcagacucaguu

SEQ ID NO: 3413716 - RNA, 17 nt, Human
uuuaguuguaucucuuu

SEQ ID NO: 3413717 - RNA, 15 nt, Human
uuuaguuuucucuua

SEQ ID NO: 3413718 - RNA, 14 nt, Human
uuuaguuuugcuuu

SEQ ID NO: 3413719 - RNA, 13 nt, Human
uuuaguuuuucau

SEQ ID NO: 3413720 - RNA, 16 nt, Human
uuuaguuuuucauuaa

SEQ ID NO: 3413721 - RNA, 19 nt, Human
uuuauaaaaaaaaugaaau

SEQ ID NO: 3413722 - RNA, 20 nt, Human
uuuauaaaaaaaaugaaaug

SEQ ID NO: 3413723 - RNA, 21 nt, Human
uuuauaaaauagaguguaguu

SEQ ID NO: 3413724 - RNA, 18 nt, Human
uuuauaaaauuaaagaaa

SEQ ID NO: 3413725 - RNA, 19 nt, Human
uuuauaaaauuaaagaaaa

SEQ ID NO: 3413726 - RNA, 12 nt, Human
uuuauaaacaga

SEQ ID NO: 3413727 - RNA, 23 nt, Human
uuuauaaacagacaauaugugag

SEQ ID NO: 3413728 - RNA, 16 nt, Human
uuuauaaaccucuaau

SEQ ID NO: 3413729 - RNA, 12 nt, Human
uuuauaaagcau

SEQ ID NO: 3413730 - RNA, 15 nt, Human
uuuauaaaucgcuuu

SEQ ID NO: 3413731 - RNA, 12 nt, Human
uuuauaaaugag

SEQ ID NO: 3413732 - RNA, 14 nt, Human
uuuauaaaugcuau

SEQ ID NO: 3413733 - RNA, 15 nt, Human
uuuauaaauuaaaua

SEQ ID NO: 3413734 - RNA, 17 nt, Human
uuuauaaauuaaauaua

SEQ ID NO: 3413735 - RNA, 20 nt, Human
uuuauaacaucuuuauugaa

SEQ ID NO: 3413736 - RNA, 19 nt, Human
uuuauaacuaguccuuuac

SEQ ID NO: 3413737 - RNA, 16 nt, Human
uuuauaacuauucagu

SEQ ID NO: 3413738 - RNA, 19 nt, Human
uuuauaacucaucauaaaa

SEQ ID NO: 3413739 - RNA, 21 nt, Human
uuuauaacucaucauaaaaua

SEQ ID NO: 3413740 - RNA, 16 nt, Human
uuuauaagaaagccug

SEQ ID NO: 3413741 - RNA, 23 nt, Human
uuuauaagaaagccugaguacuc

SEQ ID NO: 3413742 - RNA, 23 nt, Human
uuuauaagcaaauuucaaaagac

SEQ ID NO: 3413743 - RNA, 20 nt, Human
uuuauaagcagauuuaacaa

SEQ ID NO: 3413744 - RNA, 14 nt, Human
uuuauaagcaucau

SEQ ID NO: 3413745 - RNA, 18 nt, Human
uuuauaagcaucauuauu

SEQ ID NO: 3413746 - RNA, 22 nt, Human
uuuauaagccaguguugccuaa

SEQ ID NO: 3413747 - RNA, 13 nt, Human
uuuauaaggucug

SEQ ID NO: 3413748 - RNA, 16 nt, Human
uuuauaauaaaaauau

SEQ ID NO: 3413749 - RNA, 21 nt, Human
uuuauaauacagaaucuuguu

SEQ ID NO: 3413750 - RNA, 18 nt, Human
uuuauaauucaguauguu

SEQ ID NO: 3413751 - RNA, 18 nt, Human
uuuauaauuuuaagauuc

SEQ ID NO: 3413752 - RNA, 22 nt, Human
uuuauaauuuugugaagcaaaa

SEQ ID NO: 3413753 - RNA, 19 nt, Human
uuuauacaacagugcuaaa

SEQ ID NO: 3413754 - RNA, 19 nt, Human
uuuauacaccaauugauuu

SEQ ID NO: 3413755 - RNA, 15 nt, Human
uuuauacaggucaua

SEQ ID NO: 3413756 - RNA, 12 nt, Human
uuuauacauaaa

SEQ ID NO: 3413757 - RNA, 17 nt, Human
uuuauacauuaguaaau

SEQ ID NO: 3413758 - RNA, 16 nt, Human
uuuauaccauucagau

SEQ ID NO: 3413759 - RNA, 21 nt, Human
uuuauaccucaaacuaucugg

SEQ ID NO: 3413760 - RNA, 17 nt, Human
uuuauacguguagcuau

SEQ ID NO: 3413761 - RNA, 16 nt, Human
uuuauacucuuucugu

SEQ ID NO: 3413762 - RNA, 17 nt, Human
uuuauacuggcaugcua

SEQ ID NO: 3413763 - RNA, 16 nt, Human
uuuauacuguuuacug

SEQ ID NO: 3413764 - RNA, 16 nt, Human
uuuauaggugagaaaa

SEQ ID NO: 3413765 - RNA, 19 nt, Human
uuuauagugcacaaaauga

SEQ ID NO: 3413766 - RNA, 17 nt, Human
uuuauaguguguugugc

SEQ ID NO: 3413767 - RNA, 18 nt, Human
uuuauaguuuauacaguu

SEQ ID NO: 3413768 - RNA, 13 nt, Human
uuuauauaagcuu

SEQ ID NO: 3413769 - RNA, 17 nt, Human
uuuauauaauaucuaaa

SEQ ID NO: 3413770 - RNA, 22 nt, Human
uuuauauaauaucuaaaguuau

SEQ ID NO: 3413771 - RNA, 13 nt, Human
uuuauauauacag

SEQ ID NO: 3413772 - RNA, 21 nt, Human
uuuauauauacaguaacuuua

SEQ ID NO: 3413773 - RNA, 15 nt, Human
uuuauauauauaucu

SEQ ID NO: 3413774 - RNA, 14 nt, Human
uuuauauauaugca

SEQ ID NO: 3413775 - RNA, 13 nt, Human
uuuauauauguau

SEQ ID NO: 3413776 - RNA, 15 nt, Human
uuuauauauuauaug

SEQ ID NO: 3413777 - RNA, 12 nt, Human
uuuauauauuua

SEQ ID NO: 3413778 - RNA, 13 nt, Human
uuuauauauuuau

SEQ ID NO: 3413779 - RNA, 15 nt, Human
uuuauaucaugcaaa

SEQ ID NO: 3413780 - RNA, 17 nt, Human
uuuauaucaugcaaaau

SEQ ID NO: 3413781 - RNA, 16 nt, Human
uuuauaucuggaauga

SEQ ID NO: 3413782 - RNA, 14 nt, Human
uuuauaugaacaua

SEQ ID NO: 3413783 - RNA, 12 nt, Human
uuuauaugcuuu

SEQ ID NO: 3413784 - RNA, 14 nt, Human
uuuauauguacaug

SEQ ID NO: 3413785 - RNA, 12 nt, Human
uuuauauguacu

SEQ ID NO: 3413786 - RNA, 17 nt, Human
uuuauauguauccagua

SEQ ID NO: 3413787 - RNA, 15 nt, Human
uuuauauguaugugu

SEQ ID NO: 3413788 - RNA, 14 nt, Human
uuuauaugucaaag

SEQ ID NO: 3413789 - RNA, 16 nt, Human
uuuauauuagaagugu

SEQ ID NO: 3413790 - RNA, 16 nt, Human
uuuauauuaguugcuu

SEQ ID NO: 3413791 - RNA, 19 nt, Human
uuuauauuaguugcuuugu

SEQ ID NO: 3413792 - RNA, 12 nt, Human
uuuauauugaaa

SEQ ID NO: 3413793 - RNA, 14 nt, Human
uuuauauugaaaaa

SEQ ID NO: 3413794 - RNA, 22 nt, Human
uuuauauugauaagaucuuuua

SEQ ID NO: 3413795 - RNA, 17 nt, Human
uuuauauuuaauuauua

SEQ ID NO: 3413796 - RNA, 16 nt, Human
uuuauauuuacuaaaa

SEQ ID NO: 3413797 - RNA, 14 nt, Human
uuuauauuuaucca

SEQ ID NO: 3413798 - RNA, 14 nt, Human
uuuauauuucaagu

SEQ ID NO: 3413799 - RNA, 21 nt, Human
uuuauauuucaaguacacuga

SEQ ID NO: 3413800 - RNA, 13 nt, Human
uuuauauuuccuu

SEQ ID NO: 3413801 - RNA, 15 nt, Human
uuuauauuuccuuua

SEQ ID NO: 3413802 - RNA, 14 nt, Human
uuuauauuuggaug

SEQ ID NO: 3413803 - RNA, 13 nt, Human
uuuauauuuucaa

SEQ ID NO: 3413804 - RNA, 19 nt, Human
uuuauauuuucaauucaaa

SEQ ID NO: 3413805 - RNA, 22 nt, Human
uuuaucaaacagaauuuuaaag

SEQ ID NO: 3413806 - RNA, 22 nt, Human
uuuaucaaacccuagccuugcu

SEQ ID NO: 3413807 - RNA, 13 nt, Human
uuuaucaagaagu

SEQ ID NO: 3413808 - RNA, 21 nt, Human
uuuaucaaucaguauaauucu

SEQ ID NO: 3413809 - RNA, 16 nt, Human
uuuaucaaugugucuu

SEQ ID NO: 3413810 - RNA, 17 nt, Human
uuuaucacacuucugug

SEQ ID NO: 3413811 - RNA, 18 nt, Human
uuuaucacauguauguuu

SEQ ID NO: 3413812 - RNA, 13 nt, Human
uuuaucacuuaaa

SEQ ID NO: 3413813 - RNA, 16 nt, Human
uuuaucagaacuaugu

SEQ ID NO: 3413814 - RNA, 23 nt, Human
uuuaucagacucggaaucuauuu

SEQ ID NO: 3413815 - RNA, 22 nt, Human
uuuaucagauugcuuuugugca

SEQ ID NO: 3413816 - RNA, 20 nt, Human
uuuaucagggaaacuaagau

SEQ ID NO: 3413817 - RNA, 13 nt, Human
uuuaucagugaca

SEQ ID NO: 3413818 - RNA, 21 nt, Human
uuuaucagugacagaguucac

SEQ ID NO: 3413819 - RNA, 19 nt, Human
uuuaucaugaaugcuuuua

SEQ ID NO: 3413820 - RNA, 23 nt, Human
uuuaucaugacauguuauauauu

SEQ ID NO: 3413821 - RNA, 18 nt, Human
uuuaucaugugaaaucau

SEQ ID NO: 3413822 - RNA, 12 nt, Human
uuuaucauuuuc

SEQ ID NO: 3413823 - RNA, 14 nt, Human
uuuauccacaggaa

SEQ ID NO: 3413824 - RNA, 18 nt, Human
uuuaucccaaaguuguug

SEQ ID NO: 3413825 - RNA, 14 nt, Human
uuuguucuuacaca

SEQ ID NO: 3413826 - RNA, 13 nt, Human
uuuguucuucaga

SEQ ID NO: 3413827 - RNA, 19 nt, Human
uuuguugacaaaauuuucu

SEQ ID NO: 3413828 - RNA, 13 nt, Human
uuuguugacauua

SEQ ID NO: 3413829 - RNA, 14 nt, Human
uuuguugacauuag

SEQ ID NO: 3413830 - RNA, 18 nt, Human
uuuguugacauucugaau

SEQ ID NO: 3413831 - RNA, 18 nt, Human
uuuguugcaagaugugaa

SEQ ID NO: 3413832 - RNA, 10 nt, Human
uuuguugcac

SEQ ID NO: 3413833 - RNA, 17 nt, Human
uuuguugcacugaaguu

SEQ ID NO: 3413834 - RNA, 18 nt, Human
uuuguugcacugaaguuu

SEQ ID NO: 3413835 - RNA, 14 nt, Human
uuuguugccccaga

SEQ ID NO: 3413836 - RNA, 19 nt, Human
uuuguuggaguguuucuaa

SEQ ID NO: 3413837 - RNA, 15 nt, Human
uuuguuguaaaacaa

SEQ ID NO: 3413838 - RNA, 17 nt, Human
uuuguuguaaagaguug

SEQ ID NO: 3413839 - RNA, 15 nt, Human
uuuguugucagcuga

SEQ ID NO: 3413840 - RNA, 21 nt, Human
uuuguugugugccucuagcug

SEQ ID NO: 3413841 - RNA, 10 nt, Human
uuuguuguua

SEQ ID NO: 3413842 - RNA, 19 nt, Human
uuuguuguucuuucagaaa

SEQ ID NO: 3413843 - RNA, 22 nt, Human
uuuguuguuucuuaauuuggaa

SEQ ID NO: 3413844 - RNA, 14 nt, Human
uuuguuguuuguuu

SEQ ID NO: 3413845 - RNA, 14 nt, Human
uuuguuuaaaaagu

SEQ ID NO: 3413846 - RNA, 14 nt, Human
uuuguuuaaaagga

SEQ ID NO: 3413847 - RNA, 17 nt, Human
uuuguuuaaugugaacu

SEQ ID NO: 3413848 - RNA, 21 nt, Human
uuuguuuaauuuuuauuucuu

SEQ ID NO: 3413849 - RNA, 17 nt, Human
uuuguuucaaugaggug

SEQ ID NO: 3413850 - RNA, 14 nt, Human
uuuguuuccuuugu

SEQ ID NO: 3413851 - RNA, 13 nt, Human
uuuguuucuguac

SEQ ID NO: 3413852 - RNA, 18 nt, Human
uuuguuucuguacuuuuu

SEQ ID NO: 3413853 - RNA, 10 nt, Human
uuuguuucuu

SEQ ID NO: 3413854 - RNA, 12 nt, Human
uuuguuugaacu

SEQ ID NO: 3413855 - RNA, 13 nt, Human
uuuguuugcuauc

SEQ ID NO: 3413856 - RNA, 15 nt, Human
uuuguuugcuaucuu

SEQ ID NO: 3413857 - RNA, 18 nt, Human
uuuguuugguauuguauu

SEQ ID NO: 3413858 - RNA, 12 nt, Human
uuuguuugucuc

SEQ ID NO: 3413859 - RNA, 15 nt, Human
uuuguuugugcuucu

SEQ ID NO: 3413860 - RNA, 16 nt, Human
uuuguuugugcuucua

SEQ ID NO: 3413861 - RNA, 15 nt, Human
uuuguuuuaaaauua

SEQ ID NO: 3413862 - RNA, 14 nt, Human
uuuguuuucauggu

SEQ ID NO: 3413863 - RNA, 21 nt, Human
uuuguuuuuaaacuguacagu

SEQ ID NO: 3413864 - RNA, 13 nt, Human
uuuguuuuuaauu

SEQ ID NO: 3413865 - RNA, 12 nt, Human
uuuguuuuucau

SEQ ID NO: 3413866 - RNA, 14 nt, Human
uuuguuuuucucac

SEQ ID NO: 3413867 - RNA, 15 nt, Human
uuuguuuuucugcuu

SEQ ID NO: 3413868 - RNA, 17 nt, Human
uuuguuuuuugaagugu

SEQ ID NO: 3413869 - RNA, 16 nt, Human
uuuguuuuuugagucu

SEQ ID NO: 3413870 - RNA, 19 nt, Human
uuuguuuuuugagucuuuu

SEQ ID NO: 3413871 - RNA, 13 nt, Human
uuuuaaaaaaaga

SEQ ID NO: 3413872 - RNA, 22 nt, Human
uuuuaaaaaaauaaaacauuuu

SEQ ID NO: 3413873 - RNA, 13 nt, Human
uuuuaaaaaagaa

SEQ ID NO: 3413874 - RNA, 23 nt, Human
uuuuaaaaaagcaacagaaaccu

SEQ ID NO: 3413875 - RNA, 20 nt, Human
uuuuaaaaaagcuuaaaacu

SEQ ID NO: 3413876 - RNA, 21 nt, Human
uuuuaaaaaagcuuaaaacuu

SEQ ID NO: 3413877 - RNA, 23 nt, Human
uuuuaaaaaagcuuaaaacuuug

SEQ ID NO: 3413878 - RNA, 17 nt, Human
uuuuaaaaaauggucac

SEQ ID NO: 3413879 - RNA, 20 nt, Human
uuuuaaaaacauaacauaaa

SEQ ID NO: 3413880 - RNA, 19 nt, Human
uuuuaaaaacauagaaaaa

SEQ ID NO: 3413881 - RNA, 13 nt, Human
uuuuaaaaaccua

SEQ ID NO: 3413882 - RNA, 18 nt, Human
uuuuaaaaaguauugcca

SEQ ID NO: 3413883 - RNA, 20 nt, Human
uuuuaaaaaguauugccaaa

SEQ ID NO: 3413884 - RNA, 16 nt, Human
uuuuaaaaauacauau

SEQ ID NO: 3413885 - RNA, 22 nt, Human
uuuuaaaaaucauaaacugugu

SEQ ID NO: 3413886 - RNA, 16 nt, Human
uuuuaaaaaugaaauu

SEQ ID NO: 3413887 - RNA, 14 nt, Human
uuuuaaaaaugaau

SEQ ID NO: 3413888 - RNA, 22 nt, Human
uuuuaaaaauuaaaucaaccuu

SEQ ID NO: 3413889 - RNA, 20 nt, Human
uuuuaaaaauuguuaauuuu

SEQ ID NO: 3413890 - RNA, 22 nt, Human
uuuuaaaacaagaaaguuuccc

SEQ ID NO: 3413891 - RNA, 22 nt, Human
uuuuaaaacacuuccauaaucu

SEQ ID NO: 3413892 - RNA, 15 nt, Human
uuuuaaaacuggacc

SEQ ID NO: 3413893 - RNA, 22 nt, Human
uuuuaaaagagacaaacuguaa

SEQ ID NO: 3413894 - RNA, 23 nt, Human
uuuuaaaagccuuggccucagag

SEQ ID NO: 3413895 - RNA, 12 nt, Human
uuuuaaaaguuu

SEQ ID NO: 3413896 - RNA, 13 nt, Human
uuuuaaaaguuuc

SEQ ID NO: 3413897 - RNA, 21 nt, Human
uuuuaaaaguuucaaugugau

SEQ ID NO: 3413898 - RNA, 17 nt, Human
uuuuaaaauaaggauuu

SEQ ID NO: 3413899 - RNA, 15 nt, Human
uuuuaaaauaagucu

SEQ ID NO: 3413900 - RNA, 22 nt, Human
uuuuaaaauaagucugauuuaa

SEQ ID NO: 3413901 - RNA, 19 nt, Human
uuuuaaaauacuguagaua

SEQ ID NO: 3413902 - RNA, 22 nt, Human
uuuuaaaaucagcuauuuugug

SEQ ID NO: 3413903 - RNA, 20 nt, Human
uuuuaaaaucugagggaaau

SEQ ID NO: 3413904 - RNA, 21 nt, Human
uuuuaaaaucugagggaaaug

SEQ ID NO: 3413905 - RNA, 12 nt, Human
uuuuaaaaugua

SEQ ID NO: 3413906 - RNA, 15 nt, Human
uuuuaaaauguacau

SEQ ID NO: 3413907 - RNA, 21 nt, Human
uuuuaaaauguacauguauua

SEQ ID NO: 3413908 - RNA, 13 nt, Human
uuuuaaacaaaca

SEQ ID NO: 3413909 - RNA, 13 nt, Human
uuuuaaacaguga

SEQ ID NO: 3413910 - RNA, 20 nt, Human
uuuuaaacccuauugguaaa

SEQ ID NO: 3413911 - RNA, 19 nt, Human
uuuuaaacuacagguaguu

SEQ ID NO: 3413912 - RNA, 13 nt, Human
uuuuaaacuagau

SEQ ID NO: 3413913 - RNA, 12 nt, Human
uuuuaaacucau

SEQ ID NO: 3413914 - RNA, 14 nt, Human
uuuuaaacuguaca

SEQ ID NO: 3413915 - RNA, 11 nt, Human
uuuuaaagaaa

SEQ ID NO: 3413916 - RNA, 23 nt, Human
uuuuaaagaaaaaaauugaaaug

SEQ ID NO: 3413917 - RNA, 19 nt, Human
uuuuaaagaaaagaugaaa

SEQ ID NO: 3413918 - RNA, 17 nt, Human
uuuuaaagaaugcucuu

SEQ ID NO: 3413919 - RNA, 13 nt, Human
uuuuaaagaauug

SEQ ID NO: 3413920 - RNA, 21 nt, Human
uuuuaaagaccugacaccuuu

SEQ ID NO: 3413921 - RNA, 18 nt, Human
uuuuaaagacuuuuauga

SEQ ID NO: 3413922 - RNA, 20 nt, Human
uuuuaaagagugaaaaauga

SEQ ID NO: 3413923 - RNA, 13 nt, Human
uuuuaaaggcauu

SEQ ID NO: 3413924 - RNA, 19 nt, Human
uuuuaaaggcauuagaguc

SEQ ID NO: 3413925 - RNA, 13 nt, Human
uuuuaaaguguuu

SEQ ID NO: 3413926 - RNA, 12 nt, Human
uuuuaaaguuca

SEQ ID NO: 3413927 - RNA, 17 nt, Human
uuuuaaauaaaagcagc

SEQ ID NO: 3413928 - RNA, 13 nt, Human
uuuuaaauaaacu

SEQ ID NO: 3413929 - RNA, 14 nt, Human
uuuuaaauaaacuu

SEQ ID NO: 3413930 - RNA, 16 nt, Human
uuuuaaauaaacuuuu

SEQ ID NO: 3413931 - RNA, 23 nt, Human
uuuuaaauaaacuuuuuuucaau

SEQ ID NO: 3413932 - RNA, 18 nt, Human
uuuuaaauauuuuuucuu

SEQ ID NO: 3413933 - RNA, 18 nt, Human
uuuuaaauccuguugaaa

SEQ ID NO: 3413934 - RNA, 19 nt, Human
uuuuaaauccuguugaaaa

SEQ ID NO: 3413935 - RNA, 18 nt, Human
uuuuaaaucuaaaucuau

SEQ ID NO: 3413936 - RNA, 12 nt, Human
uuuuaaaugcac

SEQ ID NO: 3413937 - RNA, 15 nt, Human
uuuuaaauguacaga

SEQ ID NO: 3413938 - RNA, 20 nt, Human
uuuuaaaugugugagugcau

SEQ ID NO: 3413939 - RNA, 18 nt, Human
uuuuaaauuagaaaauau

SEQ ID NO: 3413940 - RNA, 13 nt, Human
uuuuaaauucuga

SEQ ID NO: 3413941 - RNA, 14 nt, Human
uuuuaacaagaaga

SEQ ID NO: 3413942 - RNA, 19 nt, Human
uuuuaacaagaagaugaau

SEQ ID NO: 3413943 - RNA, 20 nt, Human
uuuuaacaccugauguguac

SEQ ID NO: 3413944 - RNA, 13 nt, Human
uuuuaacauggaa

SEQ ID NO: 3413945 - RNA, 15 nt, Human
uuuuaaccaaaggug

SEQ ID NO: 3413946 - RNA, 20 nt, Human
uuuuaacuaaauuuuaaagc

SEQ ID NO: 3413947 - RNA, 17 nt, Human
uuuuaacuuagagcuuu

SEQ ID NO: 3413948 - RNA, 12 nt, Human
uuuuaacuuugu

SEQ ID NO: 3413949 - RNA, 11 nt, Human
uuuuaagaaau

SEQ ID NO: 3413950 - RNA, 16 nt, Human
uuuuaagaauaucugu

SEQ ID NO: 3413951 - RNA, 17 nt, Human
uuuuaagacuuugguua

SEQ ID NO: 3413952 - RNA, 16 nt, Human
uuuuaagaggcagggu

SEQ ID NO: 3413953 - RNA, 22 nt, Human
uuuuaagauuccuuuucuuguu

SEQ ID NO: 3413954 - RNA, 18 nt, Human
uuuuaagauuuuucucaa

SEQ ID NO: 3413955 - RNA, 19 nt, Human
uuuuaagauuuuucucaaa

SEQ ID NO: 3413956 - RNA, 21 nt, Human
uuuuaagauuuuucucaaagu

SEQ ID NO: 3413957 - RNA, 21 nt, Human
uuuuaagcacucuuaaagcaa

SEQ ID NO: 3413958 - RNA, 19 nt, Human
uuuuaagcauuacucuugu

SEQ ID NO: 3413959 - RNA, 21 nt, Human
uuuuaagcguaauuuugccaa

SEQ ID NO: 3413960 - RNA, 21 nt, Human
uuuuaagcuaggaaaagaaau

SEQ ID NO: 3413961 - RNA, 15 nt, Human
uuuuaagcucugagc

SEQ ID NO: 3413962 - RNA, 12 nt, Human
uuuuaagcuguu

SEQ ID NO: 3413963 - RNA, 17 nt, Human
uuuuaaggaagaaaaau

SEQ ID NO: 3413964 - RNA, 16 nt, Human
uuuuaaggacugacug

SEQ ID NO: 3413965 - RNA, 22 nt, Human
uuuuaaggacugacugaggcag

SEQ ID NO: 3413966 - RNA, 21 nt, Human
uuuuaaggucuuucaguacuu

SEQ ID NO: 3413967 - RNA, 15 nt, Human
uuuuaaguaaugugg

SEQ ID NO: 3413968 - RNA, 17 nt, Human
uuuuaaguaauguggaa

SEQ ID NO: 3413969 - RNA, 18 nt, Human
uuuuaaguauuuauauau

SEQ ID NO: 3413970 - RNA, 19 nt, Human
uuuuaaguauuuauauauu

SEQ ID NO: 3413971 - RNA, 17 nt, Human
uuuuaucacauguaugu

SEQ ID NO: 3413972 - RNA, 14 nt, Human
uuuuaucaggauuu

SEQ ID NO: 3413973 - RNA, 12 nt, Human
uuuuaucaguag

SEQ ID NO: 3413974 - RNA, 19 nt, Human
uuuuaucauuuucaaaaug

SEQ ID NO: 3413975 - RNA, 17 nt, Human
uuuuaucccucaccugu

SEQ ID NO: 3413976 - RNA, 18 nt, Human
uuuuaucgucacugcuua

SEQ ID NO: 3413977 - RNA, 23 nt, Human
uuuuaucguuuuuguauuuucau

SEQ ID NO: 3413978 - RNA, 21 nt, Human
uuuuaucugaaaucaauuaaa

SEQ ID NO: 3413979 - RNA, 20 nt, Human
uuuuaucugaguuacagaaa

SEQ ID NO: 3413980 - RNA, 14 nt, Human
uuuuaucuguuuaa

SEQ ID NO: 3413981 - RNA, 15 nt, Human
uuuuaucuguuuccu

SEQ ID NO: 3413982 - RNA, 16 nt, Human
uuuuaucuuuucuaca

SEQ ID NO: 3413983 - RNA, 14 nt, Human
uuuuaugaagaaaa

SEQ ID NO: 3413984 - RNA, 19 nt, Human
uuuuaugagaaagccuucu

SEQ ID NO: 3413985 - RNA, 21 nt, Human
uuuuaugagauggaucacaua

SEQ ID NO: 3413986 - RNA, 18 nt, Human
uuuuaugagcuuccaagg

SEQ ID NO: 3413987 - RNA, 13 nt, Human
uuuuaugaucagu

SEQ ID NO: 3413988 - RNA, 23 nt, Human
uuuuaugcaaauauuuuuuugua

SEQ ID NO: 3413989 - RNA, 24 nt, Human
uuuuaugcucuuuuuuacucauug

SEQ ID NO: 3413990 - RNA, 23 nt, Human
uuuuauggaggcuuugcauagau

SEQ ID NO: 3413991 - RNA, 18 nt, Human
uuuuauggcuuuugugca

SEQ ID NO: 3413992 - RNA, 21 nt, Human
uuuuauggcuuuugugcauua

SEQ ID NO: 3413993 - RNA, 19 nt, Human
uuuuauguaguaauugaca

SEQ ID NO: 3413994 - RNA, 18 nt, Human
uuuuaugugagagaaagu

SEQ ID NO: 3413995 - RNA, 12 nt, Human
uuuuauuaaauu

SEQ ID NO: 3413996 - RNA, 15 nt, Human
uuuuauuaaucacug

SEQ ID NO: 3413997 - RNA, 21 nt, Human
uuuuauuaaucacuguguaua

SEQ ID NO: 3413998 - RNA, 19 nt, Human
uuuuauuaaugcacuuucu

SEQ ID NO: 3413999 - RNA, 13 nt, Human
uuuuauuauguaa

SEQ ID NO: 3414000 - RNA, 15 nt, Human
uuuuauuauuaacaa

SEQ ID NO: 3414001 - RNA, 12 nt, Human
uuuuauuauugu

SEQ ID NO: 3414002 - RNA, 13 nt, Human
uuuuauuccacau

SEQ ID NO: 3414003 - RNA, 14 nt, Human
uuuuauugccuucu

SEQ ID NO: 3414004 - RNA, 24 nt, Human
uuuuauugccuucucaccagcugc

SEQ ID NO: 3414005 - RNA, 19 nt, Human
uuuuauugcuaguauuuga

SEQ ID NO: 3414006 - RNA, 21 nt, Human
uuuuauugcuaguauuugaau

SEQ ID NO: 3414007 - RNA, 20 nt, Human
uuuuauuguaacagacauug

SEQ ID NO: 3414008 - RNA, 17 nt, Human
uuuuauuguuuaaagca

SEQ ID NO: 3414009 - RNA, 17 nt, Human
uuuuauuuagggaacau

SEQ ID NO: 3414010 - RNA, 16 nt, Human
uuuuauuuauauguau

SEQ ID NO: 3414011 - RNA, 15 nt, Human
uuuuauuuaugaagu

SEQ ID NO: 3414012 - RNA, 15 nt, Human
uuuuauuuauuuuau

SEQ ID NO: 3414013 - RNA, 16 nt, Human
uuuuauuuccuaugau

SEQ ID NO: 3414014 - RNA, 11 nt, Human
uuuuauuuuac

SEQ ID NO: 3414015 - RNA, 16 nt, Human
uuuuauuuuauguuua

SEQ ID NO: 3414016 - RNA, 17 nt, Human
uuuuauuuucaaaacca

SEQ ID NO: 3414017 - RNA, 16 nt, Human
uuuuauuuucuaaagu

SEQ ID NO: 3414018 - RNA, 12 nt, Human
uuuuauuuugaa

SEQ ID NO: 3414019 - RNA, 15 nt, Human
uuuuauuuuguaauu

SEQ ID NO: 3414020 - RNA, 14 nt, Human
uuuuauuuuguuuu

SEQ ID NO: 3414021 - RNA, 18 nt, Human
uuuuauuuuucuaaaaaa

SEQ ID NO: 3414022 - RNA, 14 nt, Human
uuuuauuuuuuagu

SEQ ID NO: 3414023 - RNA, 17 nt, Human
uuuucaaaauaaaaaug

SEQ ID NO: 3414024 - RNA, 14 nt, Human
uuuucaaaauggag

SEQ ID NO: 3414025 - RNA, 20 nt, Human
uuuucaaacaaagaugccac

SEQ ID NO: 3414026 - RNA, 13 nt, Human
uuuucaaagcaau

SEQ ID NO: 3414027 - RNA, 22 nt, Human
uuuucaacagugaagacagaag

SEQ ID NO: 3414028 - RNA, 23 nt, Human
uuuucaaccagauaacauaccuu

SEQ ID NO: 3414029 - RNA, 12 nt, Human
uuuucaacccca

SEQ ID NO: 3414030 - RNA, 17 nt, Human
uuuucaacgcagcccug

SEQ ID NO: 3414031 - RNA, 22 nt, Human
uuuucaacgcagcccugcuuug

SEQ ID NO: 3414032 - RNA, 16 nt, Human
uuuucaacuuugaaua

SEQ ID NO: 3414033 - RNA, 21 nt, Human
uuuucaacuuugaauaaagaa

SEQ ID NO: 3414034 - RNA, 16 nt, Human
uuuucaagaauaauca

SEQ ID NO: 3414035 - RNA, 19 nt, Human
uuuucaauaacuggaacac

SEQ ID NO: 3414036 - RNA, 23 nt, Human
uuuucaauaacuggaacacucua

SEQ ID NO: 3414037 - RNA, 14 nt, Human
uuuucaauagccac

SEQ ID NO: 3414038 - RNA, 23 nt, Human
uuuucaauauauugaacuuuugu

SEQ ID NO: 3414039 - RNA, 20 nt, Human
uuuucaaucucguauagaag

SEQ ID NO: 3414040 - RNA, 10 nt, Human
uuuucaauua

SEQ ID NO: 3414041 - RNA, 13 nt, Human
uuuucaauuaaac

SEQ ID NO: 3414042 - RNA, 15 nt, Human
uuuucaauuaaacgg

SEQ ID NO: 3414043 - RNA, 22 nt, Human
uuuucaauucaaaaauguacaa

SEQ ID NO: 3414044 - RNA, 13 nt, Human
uuuucacaaauaa

SEQ ID NO: 3414045 - RNA, 17 nt, Human
uuuucacaaugucagua

SEQ ID NO: 3414046 - RNA, 23 nt, Human
uuuucacacaauacaauaaguua

SEQ ID NO: 3414047 - RNA, 13 nt, Human
uuuucacauaucu

SEQ ID NO: 3414048 - RNA, 18 nt, Human
uuuucacauccuugacuu

SEQ ID NO: 3414049 - RNA, 13 nt, Human
uuuucacaugaac

SEQ ID NO: 3414050 - RNA, 14 nt, Human
uuuucacaugaaca

SEQ ID NO: 3414051 - RNA, 18 nt, Human
uuuucacauuagaagaca

SEQ ID NO: 3414052 - RNA, 17 nt, Human
uuuucacauucuuggcu

SEQ ID NO: 3414053 - RNA, 23 nt, Human
uuuucaccauucguacauaauac

SEQ ID NO: 3414054 - RNA, 17 nt, Human
uuuucacggaaguuuuc

SEQ ID NO: 3414055 - RNA, 19 nt, Human
uuuucacucuaagucaugu

SEQ ID NO: 3414056 - RNA, 21 nt, Human
uuuucacucuaagucauguau

SEQ ID NO: 3414057 - RNA, 16 nt, Human
uuuucagaaaauauua

SEQ ID NO: 3414058 - RNA, 23 nt, Human
uuuucagaaaauauuauguguuu

SEQ ID NO: 3414059 - RNA, 17 nt, Human
uuuucagaaccucuucc

SEQ ID NO: 3414060 - RNA, 11 nt, Human
uuuucagaauc

SEQ ID NO: 3414061 - RNA, 16 nt, Human
uuuucagaaucugaau

SEQ ID NO: 3414062 - RNA, 16 nt, Human
uuuucagacuugucaa

SEQ ID NO: 3414063 - RNA, 15 nt, Human
uuuucagauauaaaa

SEQ ID NO: 3414064 - RNA, 17 nt, Human
uuuucagaugugaacca

SEQ ID NO: 3414065 - RNA, 14 nt, Human
uuuucagauuugca

SEQ ID NO: 3414066 - RNA, 15 nt, Human
uuuucagauuugcac

SEQ ID NO: 3414067 - RNA, 18 nt, Human
uuuucagcaaacucuuuu

SEQ ID NO: 3414068 - RNA, 19 nt, Human
uuuucagcuaggaacaaau

SEQ ID NO: 3414069 - RNA, 17 nt, Human
uuuucagcuucugcugg

SEQ ID NO: 3414070 - RNA, 19 nt, Human
uuuucaguauuauauguac

SEQ ID NO: 3414071 - RNA, 14 nt, Human
uuuucaguguacau

SEQ ID NO: 3414072 - RNA, 16 nt, Human
uuuucaguuccaagaa

SEQ ID NO: 3414073 - RNA, 12 nt, Human
uuuucaguuguu

SEQ ID NO: 3414074 - RNA, 22 nt, Human
uuuucaguuguuuguuuuugcu

SEQ ID NO: 3414075 - RNA, 15 nt, Human
uuuucauaacuuauu

SEQ ID NO: 3414076 - RNA, 16 nt, Human
uuuucauacauuuucu

SEQ ID NO: 3414077 - RNA, 18 nt, Human
uuuucauacauuuucuaa

SEQ ID NO: 3414078 - RNA, 16 nt, Human
uuuucauauuugcacu

SEQ ID NO: 3414079 - RNA, 18 nt, Human
uuuucauccauaacugaa

SEQ ID NO: 3414080 - RNA, 13 nt, Human
uuuucauccccuu

SEQ ID NO: 3414081 - RNA, 15 nt, Human
uuuucaucugggaaa

SEQ ID NO: 3414082 - RNA, 16 nt, Human
uuuucaucuucaguug

SEQ ID NO: 3414083 - RNA, 21 nt, Human
uuuucaugauuuugaaaccau

SEQ ID NO: 3414084 - RNA, 17 nt, Human
uuuucaugcuuuaucaa

SEQ ID NO: 3414085 - RNA, 22 nt, Human
uuuucauggacacuuugaaaug

SEQ ID NO: 3414086 - RNA, 16 nt, Human
uuuucauguuuuaaca

SEQ ID NO: 3414087 - RNA, 18 nt, Human
uuuucauuaaauaaauuu

SEQ ID NO: 3414088 - RNA, 20 nt, Human
uuuucauuaaauaaauuuga

SEQ ID NO: 3414089 - RNA, 22 nt, Human
uuuucauuaaauaaauuugacu

SEQ ID NO: 3414090 - RNA, 19 nt, Human
uuuucauuacaauggaaac

SEQ ID NO: 3414091 - RNA, 22 nt, Human
uuuucauuagcaaaaaaaguug

SEQ ID NO: 3414092 - RNA, 20 nt, Human
uuuucauuccaugugcccag

SEQ ID NO: 3414093 - RNA, 21 nt, Human
uuuucauuccaugugcccagu

SEQ ID NO: 3414094 - RNA, 22 nt, Human
uuuucauucuccuaucaccugu

SEQ ID NO: 3414095 - RNA, 18 nt, Human
uuuucauugaacagcaaa

SEQ ID NO: 3414096 - RNA, 14 nt, Human
uuuucauugcugug

SEQ ID NO: 3414097 - RNA, 13 nt, Human
uuuucauuuuaca

SEQ ID NO: 3414098 - RNA, 14 nt, Human
uuuucauuuuccaa

SEQ ID NO: 3414099 - RNA, 17 nt, Human
uuuucauuuuccaauac

SEQ ID NO: 3414100 - RNA, 18 nt, Human
uuuucauuuucugcaagc

SEQ ID NO: 3414101 - RNA, 20 nt, Human
uuuuccaaaaguggccucuu

SEQ ID NO: 3414102 - RNA, 23 nt, Human
uuuuccaaaaguggccucuuugu

SEQ ID NO: 3414103 - RNA, 14 nt, Human
uuuuccaaugucug

SEQ ID NO: 3414104 - RNA, 15 nt, Human
uuuuccacuacugcu

SEQ ID NO: 3414105 - RNA, 19 nt, Human
uuuuccagagcauuccagu

SEQ ID NO: 3414106 - RNA, 20 nt, Human
uuuuccagagcauuccaguc

SEQ ID NO: 3414107 - RNA, 12 nt, Human
uuuuccagcaag

SEQ ID NO: 3414108 - RNA, 13 nt, Human
uuuuccagcaagu

SEQ ID NO: 3414109 - RNA, 19 nt, Human
uuuuccagguuuaagcugu

SEQ ID NO: 3414110 - RNA, 14 nt, Human
uuuuccaguauuuu

SEQ ID NO: 3414111 - RNA, 18 nt, Human
uuuuccagucucuuguac

SEQ ID NO: 3414112 - RNA, 18 nt, Human
uuuuccauauuuuuacaa

SEQ ID NO: 3414113 - RNA, 16 nt, Human
uuuuccaucuaaaaau

SEQ ID NO: 3414114 - RNA, 16 nt, Human
uuuuccaugaaaacgu

SEQ ID NO: 3414115 - RNA, 18 nt, Human
uuuuccaugaguccccug

SEQ ID NO: 3414116 - RNA, 14 nt, Human
uuuugaaucuuuaa

SEQ ID NO: 3414117 - RNA, 16 nt, Human
uuuugaaucuuuaauu

SEQ ID NO: 3414118 - RNA, 18 nt, Human
uuuugaaugcuuccugac

SEQ ID NO: 3414119 - RNA, 22 nt, Human
uuuugaaugcuuccugacaauc

SEQ ID NO: 3414120 - RNA, 18 nt, Human
uuuugaaugguguuguau

SEQ ID NO: 3414121 - RNA, 14 nt, Human
uuuugaauuuagug

SEQ ID NO: 3414122 - RNA, 16 nt, Human
uuuugacacuauaucu

SEQ ID NO: 3414123 - RNA, 18 nt, Human
uuuugacacuauaucugu

SEQ ID NO: 3414124 - RNA, 16 nt, Human
uuuugacacugaaaua

SEQ ID NO: 3414125 - RNA, 23 nt, Human
uuuugacagaauauguuucaaac

SEQ ID NO: 3414126 - RNA, 23 nt, Human
uuuugacaguguugaaaauguuc

SEQ ID NO: 3414127 - RNA, 15 nt, Human
uuuugaccuuugaua

SEQ ID NO: 3414128 - RNA, 21 nt, Human
uuuugacucuggcaaagcuuu

SEQ ID NO: 3414129 - RNA, 14 nt, Human
uuuugacuuaaugu

SEQ ID NO: 3414130 - RNA, 20 nt, Human
uuuugacuuucauuggaaau

SEQ ID NO: 3414131 - RNA, 17 nt, Human
uuuugagaacguaaaga

SEQ ID NO: 3414132 - RNA, 19 nt, Human
uuuugagaacguaaagaac

SEQ ID NO: 3414133 - RNA, 17 nt, Human
uuuugagcaacuuucuu

SEQ ID NO: 3414134 - RNA, 19 nt, Human
uuuugagcgacaucucuga

SEQ ID NO: 3414135 - RNA, 22 nt, Human
uuuugagcugaaaugcugcauu

SEQ ID NO: 3414136 - RNA, 18 nt, Human
uuuugaguagauauuacu

SEQ ID NO: 3414137 - RNA, 17 nt, Human
uuuugagugccuuacac

SEQ ID NO: 3414138 - RNA, 18 nt, Human
uuuugauaaaguaguaaa

SEQ ID NO: 3414139 - RNA, 20 nt, Human
uuuugauaaaguuucucaga

SEQ ID NO: 3414140 - RNA, 14 nt, Human
uuuugauaacuguu

SEQ ID NO: 3414141 - RNA, 18 nt, Human
uuuugauaauaaauugaa

SEQ ID NO: 3414142 - RNA, 18 nt, Human
uuuugauacuaagcauug

SEQ ID NO: 3414143 - RNA, 19 nt, Human
uuuugauagcauuguaagc

SEQ ID NO: 3414144 - RNA, 20 nt, Human
uuuugauagcugucccaucu

SEQ ID NO: 3414145 - RNA, 15 nt, Human
uuuugauauaugaaa

SEQ ID NO: 3414146 - RNA, 16 nt, Human
uuuugauauuucuagc

SEQ ID NO: 3414147 - RNA, 17 nt, Human
uuuugauccaagcuggu

SEQ ID NO: 3414148 - RNA, 18 nt, Human
uuuugaucuucaacaaau

SEQ ID NO: 3414149 - RNA, 15 nt, Human
uuuugaugcagcauu

SEQ ID NO: 3414150 - RNA, 16 nt, Human
uuuugauguaaagaug

SEQ ID NO: 3414151 - RNA, 18 nt, Human
uuuugauguaaagauguu

SEQ ID NO: 3414152 - RNA, 18 nt, Human
uuuugauuauuguauuua

SEQ ID NO: 3414153 - RNA, 19 nt, Human
uuuugcaaagauuuaaucu

SEQ ID NO: 3414154 - RNA, 18 nt, Human
uuuugcaaauaaguguau

SEQ ID NO: 3414155 - RNA, 18 nt, Human
uuuugcaaauauaaacau

SEQ ID NO: 3414156 - RNA, 21 nt, Human
uuuugcaaccucgcuggacuc

SEQ ID NO: 3414157 - RNA, 21 nt, Human
uuuugcaagguaaaauuuuag

SEQ ID NO: 3414158 - RNA, 21 nt, Human
uuuugcaagguuccacagagu

SEQ ID NO: 3414159 - RNA, 23 nt, Human
uuuugcaagugaagguuuacaau

SEQ ID NO: 3414160 - RNA, 18 nt, Human
uuuugcaaucccuuaaua

SEQ ID NO: 3414161 - RNA, 17 nt, Human
uuuugcaauggcuauau

SEQ ID NO: 3414162 - RNA, 17 nt, Human
uuuugcacagccaaauu

SEQ ID NO: 3414163 - RNA, 13 nt, Human
uuuugcaccccuc

SEQ ID NO: 3414164 - RNA, 21 nt, Human
uuuugcagcccagacaaaugu

SEQ ID NO: 3414165 - RNA, 13 nt, Human
uuuugcaggagca

SEQ ID NO: 3414166 - RNA, 14 nt, Human
uuuugcaguaacug

SEQ ID NO: 3414167 - RNA, 22 nt, Human
uuuugcaguagagucaucucca

SEQ ID NO: 3414168 - RNA, 15 nt, Human
uuuugcauauugcau

SEQ ID NO: 3414169 - RNA, 18 nt, Human
uuuugcauauugcauacu

SEQ ID NO: 3414170 - RNA, 19 nt, Human
uuuugcauggcacuugcau

SEQ ID NO: 3414171 - RNA, 22 nt, Human
uuuugcauggcacuugcaucug

SEQ ID NO: 3414172 - RNA, 14 nt, Human
uuuugccacagcuu

SEQ ID NO: 3414173 - RNA, 20 nt, Human
uuuugccacagcuuuugcaa

SEQ ID NO: 3414174 - RNA, 13 nt, Human
uuuugccagccca

SEQ ID NO: 3414175 - RNA, 20 nt, Human
uuuugccauacaucaguuau

SEQ ID NO: 3414176 - RNA, 13 nt, Human
uuuugcccuuuga

SEQ ID NO: 3414177 - RNA, 15 nt, Human
uuuugccucuuuucu

SEQ ID NO: 3414178 - RNA, 13 nt, Human
uuuugccuucauu

SEQ ID NO: 3414179 - RNA, 17 nt, Human
uuuugcuauuguaaaua

SEQ ID NO: 3414180 - RNA, 23 nt, Human
uuuugcuggaauuccuaacuuuu

SEQ ID NO: 3414181 - RNA, 13 nt, Human
uuuugcuguagaa

SEQ ID NO: 3414182 - RNA, 12 nt, Human
uuuugcuguaua

SEQ ID NO: 3414183 - RNA, 21 nt, Human
uuuugcuguuguuucuaaaca

SEQ ID NO: 3414184 - RNA, 21 nt, Human
uuuugcuuuuggcaaaacucu

SEQ ID NO: 3414185 - RNA, 14 nt, Human
uuuuggaaaagaau

SEQ ID NO: 3414186 - RNA, 13 nt, Human
uuuuggaauuugc

SEQ ID NO: 3414187 - RNA, 15 nt, Human
uuuuggaauuuuccu

SEQ ID NO: 3414188 - RNA, 17 nt, Human
uuuuggacuucaaagca

SEQ ID NO: 3414189 - RNA, 15 nt, Human
uuuuggacuucuggg

SEQ ID NO: 3414190 - RNA, 20 nt, Human
uuuuggaguguuauguauuu

SEQ ID NO: 3414191 - RNA, 17 nt, Human
uuuuggaucuugaaugu

SEQ ID NO: 3414192 - RNA, 18 nt, Human
uuuuggaugguguuacau

SEQ ID NO: 3414193 - RNA, 19 nt, Human
uuuuggcaaacgcuaaaga

SEQ ID NO: 3414194 - RNA, 23 nt, Human
uuuuggcaaugacucaaagucug

SEQ ID NO: 3414195 - RNA, 19 nt, Human
uuuuggcaucucuguccca

SEQ ID NO: 3414196 - RNA, 17 nt, Human
uuuuggccaaaguguua

SEQ ID NO: 3414197 - RNA, 16 nt, Human
uuuuggccaugaaagc

SEQ ID NO: 3414198 - RNA, 19 nt, Human
uuuuggcgcuauuacaaau

SEQ ID NO: 3414199 - RNA, 22 nt, Human
uuuuggcugaaauucuccugga

SEQ ID NO: 3414200 - RNA, 14 nt, Human
uuuuggcugcugaa

SEQ ID NO: 3414201 - RNA, 14 nt, Human
uuuugggaugucuu

SEQ ID NO: 3414202 - RNA, 21 nt, Human
uuuuggggauaugcuuaguaa

SEQ ID NO: 3414203 - RNA, 22 nt, Human
uuuuggggauuuucaaaagaua

SEQ ID NO: 3414204 - RNA, 18 nt, Human
uuuugggggucaggcagc

SEQ ID NO: 3414205 - RNA, 18 nt, Human
uuuugggguacccacugc

SEQ ID NO: 3414206 - RNA, 19 nt, Human
uuuugggguuguguuguca

SEQ ID NO: 3414207 - RNA, 17 nt, Human
uuuugguagauuaaaua

SEQ ID NO: 3414208 - RNA, 23 nt, Human
uuuugguauuacacuguauuugu

SEQ ID NO: 3414209 - RNA, 14 nt, Human
uuuugguauuugaa

SEQ ID NO: 3414210 - RNA, 14 nt, Human
uuuuggucauugua

SEQ ID NO: 3414211 - RNA, 15 nt, Human
uuuuggucuguguga

SEQ ID NO: 3414212 - RNA, 18 nt, Human
uuuugguggauguaaaua

SEQ ID NO: 3414213 - RNA, 20 nt, Human
uuuuggugguuuuagugauu

SEQ ID NO: 3414214 - RNA, 13 nt, Human
uuuugguguguug

SEQ ID NO: 3414215 - RNA, 22 nt, Human
uuuugguuaaguuggcuucugu

SEQ ID NO: 3414216 - RNA, 20 nt, Human
uuuugguugaauaaacuaga

SEQ ID NO: 3414217 - RNA, 16 nt, Human
uuuugguugcuuuaau

SEQ ID NO: 3414218 - RNA, 20 nt, Human
uuuugguuguauucuuugau

SEQ ID NO: 3414219 - RNA, 22 nt, Human
uuuugguuugcagaugacaaaa

SEQ ID NO: 3414220 - RNA, 13 nt, Human
uuuuguaaacauu

SEQ ID NO: 3414221 - RNA, 19 nt, Human
uuuuguaaacgacaagaau

SEQ ID NO: 3414222 - RNA, 15 nt, Human
uuuuguaaacuuuga

SEQ ID NO: 3414223 - RNA, 21 nt, Human
uuuuguaaagaugccggguuu

SEQ ID NO: 3414224 - RNA, 13 nt, Human
uuuuguaaagugu

SEQ ID NO: 3414225 - RNA, 11 nt, Human
uuuuguaagaa

SEQ ID NO: 3414226 - RNA, 20 nt, Human
uuuuguaagaugcuggguug

SEQ ID NO: 3414227 - RNA, 22 nt, Human
uuuuguaauaagcaaucaaggu

SEQ ID NO: 3414228 - RNA, 17 nt, Human
uuuuguaauaauaaaga

SEQ ID NO: 3414229 - RNA, 14 nt, Human
uuuuguaauugcuu

SEQ ID NO: 3414230 - RNA, 14 nt, Human
uuuuguaauuuaaa

SEQ ID NO: 3414231 - RNA, 17 nt, Human
uuuuguaauuuucuuga

SEQ ID NO: 3414232 - RNA, 21 nt, Human
uuuuguacaucuggcuuauuu

SEQ ID NO: 3414233 - RNA, 11 nt, Human
uuuuguacaug

SEQ ID NO: 3414234 - RNA, 15 nt, Human
uuuuguacugaauuu

SEQ ID NO: 3414235 - RNA, 19 nt, Human
uuuuguagagccagggucu

SEQ ID NO: 3414236 - RNA, 14 nt, Human
uuuuguagguacuu

SEQ ID NO: 3414237 - RNA, 16 nt, Human
uuuuguauaaaauaga

SEQ ID NO: 3414238 - RNA, 16 nt, Human
uuuuguauaauuggau

SEQ ID NO: 3414239 - RNA, 23 nt, Human
uuuuguauaauuggauuuccuaa

SEQ ID NO: 3414240 - RNA, 11 nt, Human
uuuuguauaca

SEQ ID NO: 3414241 - RNA, 16 nt, Human
uuuuguauaguaaagu

SEQ ID NO: 3414242 - RNA, 23 nt, Human
uuuuguaugcaagcaguuucaau

SEQ ID NO: 3414243 - RNA, 15 nt, Human
uuuugucaacauugu

SEQ ID NO: 3414244 - RNA, 16 nt, Human
uuuugucaacauugug

SEQ ID NO: 3414245 - RNA, 13 nt, Human
uuuugucuuauau

SEQ ID NO: 3414246 - RNA, 13 nt, Human
uuuugucuugaau

SEQ ID NO: 3414247 - RNA, 24 nt, Human
uuuugugaaaugaaaacauguaau

SEQ ID NO: 3414248 - RNA, 13 nt, Human
uuuugugaaauuu

SEQ ID NO: 3414249 - RNA, 14 nt, Human
uuuugugaacuuuu

SEQ ID NO: 3414250 - RNA, 19 nt, Human
uuuugugaagugaaggauu

SEQ ID NO: 3414251 - RNA, 19 nt, Human
uuuugugaauggauuggau

SEQ ID NO: 3414252 - RNA, 21 nt, Human
uuuugugaugucccaacuugu

SEQ ID NO: 3414253 - RNA, 19 nt, Human
uuuugugauuuagaacugu

SEQ ID NO: 3414254 - RNA, 22 nt, Human
uuuugugcaaaagcuucaaauu

SEQ ID NO: 3414255 - RNA, 14 nt, Human
uuuugugcauugga

SEQ ID NO: 3414256 - RNA, 13 nt, Human
uuuugugcauuug

SEQ ID NO: 3414257 - RNA, 16 nt, Human
uuuuguggaggcagug

SEQ ID NO: 3414258 - RNA, 21 nt, Human
uuuugugggggacuguaaguu

SEQ ID NO: 3414259 - RNA, 21 nt, Human
uuuuguggucauuaagcauug

SEQ ID NO: 3414260 - RNA, 20 nt, Human
aaaacacaguguuuuuguaa

SEQ ID NO: 3414261 - RNA, 12 nt, Human
aaaacacauugc

SEQ ID NO: 3414262 - RNA, 12 nt, Human
aaaacacauuuu

SEQ ID NO: 3414263 - RNA, 13 nt, Human
aaaacacauuuuu

SEQ ID NO: 3414264 - RNA, 21 nt, Human
aaaacaccgcuucugccuuuu

SEQ ID NO: 3414265 - RNA, 15 nt, Human
aaaacaccuagcuuu

SEQ ID NO: 3414266 - RNA, 13 nt, Human
aaaacacugugca

SEQ ID NO: 3414267 - RNA, 16 nt, Human
aaaacagaaauuggua

SEQ ID NO: 3414268 - RNA, 13 nt, Human
aaaacagaagccu

SEQ ID NO: 3414269 - RNA, 23 nt, Human
aaaacagcugucucuaacuuauu

SEQ ID NO: 3414270 - RNA, 19 nt, Human
aaaacaggaaaaaaacuuu

SEQ ID NO: 3414271 - RNA, 15 nt, Human
aaaacaggcaaauuc

SEQ ID NO: 3414272 - RNA, 17 nt, Human
aaaacaggcacugcccu

SEQ ID NO: 3414273 - RNA, 18 nt, Human
aaaacaggcacugcccug

SEQ ID NO: 3414274 - RNA, 23 nt, Human
aaaacaggcacugcccugguggc

SEQ ID NO: 3414275 - RNA, 12 nt, Human
aaaacagguaga

SEQ ID NO: 3414276 - RNA, 22 nt, Human
aaaacagguagaauuaucuaau

SEQ ID NO: 3414277 - RNA, 20 nt, Human
aaaacaguccuucaaacuuc

SEQ ID NO: 3414278 - RNA, 17 nt, Human
aaaacaguguguaaaca

SEQ ID NO: 3414279 - RNA, 20 nt, Human
aaaacaguuggcaugcaucc

SEQ ID NO: 3414280 - RNA, 17 nt, Human
aaaacauaaaaaguuaa

SEQ ID NO: 3414281 - RNA, 17 nt, Human
aaaacauaacauaaauu

SEQ ID NO: 3414282 - RNA, 24 nt, Human
aaaacauaaucuucugccuucuca

SEQ ID NO: 3414283 - RNA, 19 nt, Human
aaaacaucauuccuuuuua

SEQ ID NO: 3414284 - RNA, 14 nt, Human
aaaacaucuuugaa

SEQ ID NO: 3414285 - RNA, 23 nt, Human
aaaacaugcagaacaaaugaaga

SEQ ID NO: 3414286 - RNA, 14 nt, Human
aaaacaugguagaa

SEQ ID NO: 3414287 - RNA, 16 nt, Human
aaaacaugguagaauu

SEQ ID NO: 3414288 - RNA, 14 nt, Human
aaaacauuaagaaa

SEQ ID NO: 3414289 - RNA, 16 nt, Human
aaaacauucuaucuac

SEQ ID NO: 3414290 - RNA, 22 nt, Human
aaaacauugaagagagagcuga

SEQ ID NO: 3414291 - RNA, 22 nt, Human
aaaacauuguccccaaugaaua

SEQ ID NO: 3414292 - RNA, 16 nt, Human
aaaacauuuuaaaugg

SEQ ID NO: 3414293 - RNA, 17 nt, Human
aaaacauuuuaaaugga

SEQ ID NO: 3414294 - RNA, 19 nt, Human
aaaacauuuucacacaaua

SEQ ID NO: 3414295 - RNA, 14 nt, Human
aaaaccaaaaugac

SEQ ID NO: 3414296 - RNA, 13 nt, Human
aaaaccaaagagg

SEQ ID NO: 3414297 - RNA, 21 nt, Human
aaaaccacaaaggccaaacug

SEQ ID NO: 3414298 - RNA, 14 nt, Human
aaaaccacagcagu

SEQ ID NO: 3414299 - RNA, 14 nt, Human
aaaaccaggcuuuc

SEQ ID NO: 3414300 - RNA, 18 nt, Human
aaaaccaucuggccuggc

SEQ ID NO: 3414301 - RNA, 20 nt, Human
aaaacccuugggccagaagu

SEQ ID NO: 3414302 - RNA, 15 nt, Human
aaaaccuacauauuc

SEQ ID NO: 3414303 - RNA, 22 nt, Human
aaaaccucacccgaggcugccc

SEQ ID NO: 3414304 - RNA, 18 nt, Human
aaaaccugagauuuauua

SEQ ID NO: 3414305 - RNA, 22 nt, Human
aaaaccugagauuuauuaaaga

SEQ ID NO: 3414306 - RNA, 18 nt, Human
aaaaccugggauuauaua

SEQ ID NO: 3414307 - RNA, 23 nt, Human
aaaaccuuagcucccucccgcac

SEQ ID NO: 3414308 - RNA, 23 nt, Human
aaaaccuuuuacugguugcaugg

SEQ ID NO: 3414309 - RNA, 15 nt, Human
aaaacgauuuaauuu

SEQ ID NO: 3414310 - RNA, 13 nt, Human
aaaacgcauggag

SEQ ID NO: 3414311 - RNA, 14 nt, Human
aaaacgcgcagaug

SEQ ID NO: 3414312 - RNA, 16 nt, Human
aaaacggcccucuuga

SEQ ID NO: 3414313 - RNA, 16 nt, Human
aaaacgguuaaaacug

SEQ ID NO: 3414314 - RNA, 14 nt, Human
aaaacguggcugcu

SEQ ID NO: 3414315 - RNA, 18 nt, Human
aaaacguggcugcuucaa

SEQ ID NO: 3414316 - RNA, 15 nt, Human
aaaacguuuuauugu

SEQ ID NO: 3414317 - RNA, 18 nt, Human
aaaacuaaauagcaugua

SEQ ID NO: 3414318 - RNA, 19 nt, Human
aaaacuaaauagcauguau

SEQ ID NO: 3414319 - RNA, 14 nt, Human
aaaacuaaauuuca

SEQ ID NO: 3414320 - RNA, 13 nt, Human
aaaacuaaguucu

SEQ ID NO: 3414321 - RNA, 21 nt, Human
aaaacuacaaaucaaguauuu

SEQ ID NO: 3414322 - RNA, 22 nt, Human
aaaacuacaaccaauggaaugu

SEQ ID NO: 3414323 - RNA, 12 nt, Human
aaaacuacauuu

SEQ ID NO: 3414324 - RNA, 16 nt, Human
aaaacuacauuuuaac

SEQ ID NO: 3414325 - RNA, 17 nt, Human
aaaacuacauuuuaaca

SEQ ID NO: 3414326 - RNA, 22 nt, Human
aaaacuagaggugagaaauuua

SEQ ID NO: 3414327 - RNA, 15 nt, Human
aaaacuaguaguucu

SEQ ID NO: 3414328 - RNA, 12 nt, Human
aaaacuauacaa

SEQ ID NO: 3414329 - RNA, 15 nt, Human
aaaacuauuaaggau

SEQ ID NO: 3414330 - RNA, 19 nt, Human
aaaacucaaccaaauggua

SEQ ID NO: 3414331 - RNA, 18 nt, Human
aaaacucaggcaaagaaa

SEQ ID NO: 3414332 - RNA, 16 nt, Human
aaaacuccaccuuccc

SEQ ID NO: 3414333 - RNA, 17 nt, Human
aaaacuccaccuuccca

SEQ ID NO: 3414334 - RNA, 16 nt, Human
aaaacuccgcccccag

SEQ ID NO: 3414335 - RNA, 18 nt, Human
aaaacucuacuuaaucca

SEQ ID NO: 3414336 - RNA, 21 nt, Human
aaaacucuacuuaauccaaug

SEQ ID NO: 3414337 - RNA, 13 nt, Human
aaaacucuuuaac

SEQ ID NO: 3414338 - RNA, 12 nt, Human
aaaacucuuuga

SEQ ID NO: 3414339 - RNA, 12 nt, Human
aaaacucuuuua

SEQ ID NO: 3414340 - RNA, 23 nt, Human
aaaacugaaagugaaaguccaga

SEQ ID NO: 3414341 - RNA, 19 nt, Human
aaaacugaagucugaaauu

SEQ ID NO: 3414342 - RNA, 17 nt, Human
aaaacugaauuauaaga

SEQ ID NO: 3414343 - RNA, 13 nt, Human
aaaacugagcaua

SEQ ID NO: 3414344 - RNA, 23 nt, Human
aaaacugcugacuguuuucucuu

SEQ ID NO: 3414345 - RNA, 12 nt, Human
aaaacuguguug

SEQ ID NO: 3414346 - RNA, 17 nt, Human
aaaacuuaacauauuua

SEQ ID NO: 3414347 - RNA, 19 nt, Human
aaaacuuaacauauuuacu

SEQ ID NO: 3414348 - RNA, 21 nt, Human
aaaacuuaaccgcaucagaag

SEQ ID NO: 3414349 - RNA, 17 nt, Human
aaaacuuaguuugugaa

SEQ ID NO: 3414350 - RNA, 15 nt, Human
aaaacuuauuugagu

SEQ ID NO: 3414351 - RNA, 17 nt, Human
aaaacuucauguaauuu

SEQ ID NO: 3414352 - RNA, 10 nt, Human
aaaacuucuu

SEQ ID NO: 3414353 - RNA, 23 nt, Human
aaaacuucuuaaauaucuuuuau

SEQ ID NO: 3414354 - RNA, 21 nt, Human
aaaacuugacuccauuucauc

SEQ ID NO: 3414355 - RNA, 22 nt, Human
aaaacuugugugaaauuuucuu

SEQ ID NO: 3414356 - RNA, 13 nt, Human
aaaacuuuaaagc

SEQ ID NO: 3414357 - RNA, 19 nt, Human
aaaacuuuacuaagaugac

SEQ ID NO: 3414358 - RNA, 15 nt, Human
aaaacuuuauuuuau

SEQ ID NO: 3414359 - RNA, 17 nt, Human
aaaacuuuauuuuauau

SEQ ID NO: 3414360 - RNA, 18 nt, Human
aaaacuuuauuuuauaua

SEQ ID NO: 3414361 - RNA, 19 nt, Human
aaaacuuuauuuuauauaa

SEQ ID NO: 3414362 - RNA, 16 nt, Human
aaaacuuuccucgccu

SEQ ID NO: 3414363 - RNA, 16 nt, Human
aaaacuuuggaaccag

SEQ ID NO: 3414364 - RNA, 17 nt, Human
aaaacuuuggaaccaga

SEQ ID NO: 3414365 - RNA, 17 nt, Human
aaaacuuuguuaggcca

SEQ ID NO: 3414366 - RNA, 19 nt, Human
aaaacuuuguuaggccaaa

SEQ ID NO: 3414367 - RNA, 17 nt, Human
aaaacuuuuauaaauua

SEQ ID NO: 3414368 - RNA, 18 nt, Human
aaaacuuuuauaaauuaa

SEQ ID NO: 3414369 - RNA, 15 nt, Human
aaaacuuuucugcug

SEQ ID NO: 3414370 - RNA, 17 nt, Human
aaaacuuuuuauauuuu

SEQ ID NO: 3414371 - RNA, 20 nt, Human
aaaacuuuuuauauuuuaua

SEQ ID NO: 3414372 - RNA, 12 nt, Human
aaaagaaaaaaa

SEQ ID NO: 3414373 - RNA, 11 nt, Human
aaaagaaaaac

SEQ ID NO: 3414374 - RNA, 14 nt, Human
aaaagaaaaaccac

SEQ ID NO: 3414375 - RNA, 12 nt, Human
aaaagaaaacaa

SEQ ID NO: 3414376 - RNA, 10 nt, Human
aaaagaaaau

SEQ ID NO: 3414377 - RNA, 11 nt, Human
aaaagaaaaug

SEQ ID NO: 3414378 - RNA, 15 nt, Human
aaaagaaaauuuuug

SEQ ID NO: 3414379 - RNA, 11 nt, Human
aaaagaaaggc

SEQ ID NO: 3414380 - RNA, 13 nt, Human
aaaagaaauaaua

SEQ ID NO: 3414381 - RNA, 12 nt, Human
aaaagaaaucua

SEQ ID NO: 3414382 - RNA, 12 nt, Human
aaaagaaaugaa

SEQ ID NO: 3414383 - RNA, 20 nt, Human
aaaagaaauucccuggacca

SEQ ID NO: 3414384 - RNA, 17 nt, Human
aaaagaacacuagaguc

SEQ ID NO: 3414385 - RNA, 16 nt, Human
aaaagaacaguaaaca

SEQ ID NO: 3414386 - RNA, 16 nt, Human
aaaagaacaugcaguu

SEQ ID NO: 3414387 - RNA, 13 nt, Human
aaaagaaggaaaa

SEQ ID NO: 3414388 - RNA, 14 nt, Human
aaaagaauauucag

SEQ ID NO: 3414389 - RNA, 13 nt, Human
aaaagaauauuuu

SEQ ID NO: 3414390 - RNA, 20 nt, Human
aaaagacacacuuguccaca

SEQ ID NO: 3414391 - RNA, 18 nt, Human
aaaagacauguuguaaau

SEQ ID NO: 3414392 - RNA, 19 nt, Human
aaaagacgcaccagcccag

SEQ ID NO: 3414393 - RNA, 16 nt, Human
aaaagacucaguguuc

SEQ ID NO: 3414394 - RNA, 11 nt, Human
aaaagacucau

SEQ ID NO: 3414395 - RNA, 13 nt, Human
aaaagagaaugau

SEQ ID NO: 3414396 - RNA, 22 nt, Human
aaaagagagcagagaauauaac

SEQ ID NO: 3414397 - RNA, 21 nt, Human
aaaagagcagugguaagaaua

SEQ ID NO: 3414398 - RNA, 15 nt, Human
aaaagaggagcacuu

SEQ ID NO: 3414399 - RNA, 15 nt, Human
aaaagagucuuccaa

SEQ ID NO: 3414400 - RNA, 19 nt, Human
aaaagaguguaaaauauuu

SEQ ID NO: 3414401 - RNA, 22 nt, Human
aaaagauaaagaccagaaauuc

SEQ ID NO: 3414402 - RNA, 18 nt, Human
aaaagauaaagaugaucu

SEQ ID NO: 3414403 - RNA, 18 nt, Human
aaaagauacauuuguaug

SEQ ID NO: 3414404 - RNA, 22 nt, Human
aaaagauaccuuaaaauuugaa

SEQ ID NO: 3414405 - RNA, 13 nt, Human
aaaagauauaagu

SEQ ID NO: 3414406 - RNA, 12 nt, Human
aaaauaagaaaa

SEQ ID NO: 3414407 - RNA, 15 nt, Human
aaaauaagaaaagau

SEQ ID NO: 3414408 - RNA, 16 nt, Human
aaaauaagaauagaaa

SEQ ID NO: 3414409 - RNA, 16 nt, Human
aaaauaagucaacagu

SEQ ID NO: 3414410 - RNA, 18 nt, Human
aaaauaagucaacaguaa

SEQ ID NO: 3414411 - RNA, 11 nt, Human
aaaauaauaaa

SEQ ID NO: 3414412 - RNA, 13 nt, Human
aaaauaauaaauu

SEQ ID NO: 3414413 - RNA, 16 nt, Human
aaaauaauaaauugca

SEQ ID NO: 3414414 - RNA, 13 nt, Human
aaaauaaugucuu

SEQ ID NO: 3414415 - RNA, 23 nt, Human
aaaauaaugucuuguuaauauuc

SEQ ID NO: 3414416 - RNA, 19 nt, Human
aaaauaauuagguauuuuc

SEQ ID NO: 3414417 - RNA, 13 nt, Human
aaaauaauucuaa

SEQ ID NO: 3414418 - RNA, 16 nt, Human
aaaauaauugauuuca

SEQ ID NO: 3414419 - RNA, 11 nt, Human
aaaauaauuuu

SEQ ID NO: 3414420 - RNA, 14 nt, Human
aaaauaauuuuaug

SEQ ID NO: 3414421 - RNA, 23 nt, Human
aaaauaauuuuuauauuugaaau

SEQ ID NO: 3414422 - RNA, 14 nt, Human
aaaauacacacuca

SEQ ID NO: 3414423 - RNA, 15 nt, Human
aaaauacaguauucu

SEQ ID NO: 3414424 - RNA, 21 nt, Human
aaaauacaguuugucacauga

SEQ ID NO: 3414425 - RNA, 17 nt, Human
aaaauacauaagaccau

SEQ ID NO: 3414426 - RNA, 15 nt, Human
aaaauacaugaagcu

SEQ ID NO: 3414427 - RNA, 12 nt, Human
aaaauacauugu

SEQ ID NO: 3414428 - RNA, 12 nt, Human
aaaauacauuua

SEQ ID NO: 3414429 - RNA, 13 nt, Human
aaaauacauuuua

SEQ ID NO: 3414430 - RNA, 13 nt, Human
aaaauaccaagga

SEQ ID NO: 3414431 - RNA, 15 nt, Human
aaaauaccagccagu

SEQ ID NO: 3414432 - RNA, 18 nt, Human
aaaauaccucaggaaaga

SEQ ID NO: 3414433 - RNA, 16 nt, Human
aaaauacuauuuaaga

SEQ ID NO: 3414434 - RNA, 18 nt, Human
aaaauacucuaauucuaa

SEQ ID NO: 3414435 - RNA, 14 nt, Human
aaaauacucuuuuu

SEQ ID NO: 3414436 - RNA, 14 nt, Human
aaaauacugccaga

SEQ ID NO: 3414437 - RNA, 15 nt, Human
aaaauacuuaaaugu

SEQ ID NO: 3414438 - RNA, 20 nt, Human
aaaauacuugucuguuuuaa

SEQ ID NO: 3414439 - RNA, 15 nt, Human
aaaauacuuugaguu

SEQ ID NO: 3414440 - RNA, 19 nt, Human
aaaauacuuuuucuaauga

SEQ ID NO: 3414441 - RNA, 11 nt, Human
aaaauagaaac

SEQ ID NO: 3414442 - RNA, 13 nt, Human
aaaauagaaacau

SEQ ID NO: 3414443 - RNA, 14 nt, Human
aaaauagaagaaua

SEQ ID NO: 3414444 - RNA, 17 nt, Human
aaaauagaauugacauu

SEQ ID NO: 3414445 - RNA, 15 nt, Human
aaaauagacaaauag

SEQ ID NO: 3414446 - RNA, 19 nt, Human
aaaauagacaaauagaaaa

SEQ ID NO: 3414447 - RNA, 21 nt, Human
aaaauagagaugagcuuucuu

SEQ ID NO: 3414448 - RNA, 14 nt, Human
aaaauagaugucuu

SEQ ID NO: 3414449 - RNA, 17 nt, Human
aaaauagcaaaagaaga

SEQ ID NO: 3414450 - RNA, 17 nt, Human
aaaauagcaauccuaaa

SEQ ID NO: 3414451 - RNA, 16 nt, Human
aaaauaggcuuuuuaa

SEQ ID NO: 3414452 - RNA, 18 nt, Human
aaaauaguugagccagca

SEQ ID NO: 3414453 - RNA, 20 nt, Human
aaaauaguugagccagcaga

SEQ ID NO: 3414454 - RNA, 21 nt, Human
aaaauaguugagccagcagac

SEQ ID NO: 3414455 - RNA, 14 nt, Human
aaaauauaaaacug

SEQ ID NO: 3414456 - RNA, 22 nt, Human
aaaauauaaaacugcguuaaag

SEQ ID NO: 3414457 - RNA, 16 nt, Human
aaaauauaaacaaaga

SEQ ID NO: 3414458 - RNA, 10 nt, Human
aaaauauaac

SEQ ID NO: 3414459 - RNA, 12 nt, Human
aaaauauaagua

SEQ ID NO: 3414460 - RNA, 18 nt, Human
aaaauauaaguaaaguga

SEQ ID NO: 3414461 - RNA, 12 nt, Human
aaaauauaauug

SEQ ID NO: 3414462 - RNA, 15 nt, Human
aaaauauaauuguuu

SEQ ID NO: 3414463 - RNA, 19 nt, Human
aaaauauaauuguuuuuua

SEQ ID NO: 3414464 - RNA, 13 nt, Human
aaaauauacaaaa

SEQ ID NO: 3414465 - RNA, 14 nt, Human
aaaauauacuguaa

SEQ ID NO: 3414466 - RNA, 20 nt, Human
aaaauauacuguaaagaaag

SEQ ID NO: 3414467 - RNA, 22 nt, Human
aaaauauacuguaaagaaagag

SEQ ID NO: 3414468 - RNA, 10 nt, Human
aaaauauaua

SEQ ID NO: 3414469 - RNA, 13 nt, Human
aaaauauauacua

SEQ ID NO: 3414470 - RNA, 17 nt, Human
aaaauauauacuaaaca

SEQ ID NO: 3414471 - RNA, 20 nt, Human
aaaauauauauagugcuaua

SEQ ID NO: 3414472 - RNA, 14 nt, Human
aaaauauauaucua

SEQ ID NO: 3414473 - RNA, 21 nt, Human
aaaauauauauguugauuucu

SEQ ID NO: 3414474 - RNA, 14 nt, Human
aaaauauauguauu

SEQ ID NO: 3414475 - RNA, 15 nt, Human
aaaauauauguauuu

SEQ ID NO: 3414476 - RNA, 16 nt, Human
aaaauauauguauuuu

SEQ ID NO: 3414477 - RNA, 15 nt, Human
aaaauauauugaaua

SEQ ID NO: 3414478 - RNA, 16 nt, Human
aaaauauauuuaauga

SEQ ID NO: 3414479 - RNA, 21 nt, Human
aaaauaucaccaaaaaccuau

SEQ ID NO: 3414480 - RNA, 16 nt, Human
aaaauaucauucagca

SEQ ID NO: 3414481 - RNA, 13 nt, Human
aaaauaucuacau

SEQ ID NO: 3414482 - RNA, 18 nt, Human
aaaauaucugaaauguga

SEQ ID NO: 3414483 - RNA, 13 nt, Human
aaaauaugauauu

SEQ ID NO: 3414484 - RNA, 12 nt, Human
aaaauaugcacu

SEQ ID NO: 3414485 - RNA, 20 nt, Human
aaaauaugucccagaaaugu

SEQ ID NO: 3414486 - RNA, 23 nt, Human
aaaauaugucucgcuagugaugu

SEQ ID NO: 3414487 - RNA, 12 nt, Human
aaaauaugugaa

SEQ ID NO: 3414488 - RNA, 13 nt, Human
aaaauaugugaag

SEQ ID NO: 3414489 - RNA, 11 nt, Human
aaaauauuauc

SEQ ID NO: 3414490 - RNA, 21 nt, Human
aaaauauuauguguuuccaua

SEQ ID NO: 3414491 - RNA, 19 nt, Human
aaaauauuuaaaaaugucu

SEQ ID NO: 3414492 - RNA, 21 nt, Human
aaaauauuugacuauucugua

SEQ ID NO: 3414493 - RNA, 18 nt, Human
aaaauauuuuauaauuuu

SEQ ID NO: 3414494 - RNA, 15 nt, Human
aaaauauuuuaugau

SEQ ID NO: 3414495 - RNA, 13 nt, Human
aaaauauuuucuc

SEQ ID NO: 3414496 - RNA, 20 nt, Human
aaaauauuuucuguguguuc

SEQ ID NO: 3414497 - RNA, 22 nt, Human
aaaauauuuucuguguguuccu

SEQ ID NO: 3414498 - RNA, 23 nt, Human
aaaauauuuucuguguguuccug

SEQ ID NO: 3414499 - RNA, 13 nt, Human
aaaauauuuugaa

SEQ ID NO: 3414500 - RNA, 19 nt, Human
aaaauauuuugaucuucaa

SEQ ID NO: 3414501 - RNA, 16 nt, Human
aaaauauuuugucuaa

SEQ ID NO: 3414502 - RNA, 17 nt, Human
aaaauauuuuuuuuucu

SEQ ID NO: 3414503 - RNA, 16 nt, Human
aaaaucaaaacaagug

SEQ ID NO: 3414504 - RNA, 14 nt, Human
aaaaucaaauaaua

SEQ ID NO: 3414505 - RNA, 13 nt, Human
aaaaucaaauggu

SEQ ID NO: 3414506 - RNA, 16 nt, Human
aaaaucaaguauuaua

SEQ ID NO: 3414507 - RNA, 15 nt, Human
aaaaucaauuaacca

SEQ ID NO: 3414508 - RNA, 13 nt, Human
aaaaucacaaaaa

SEQ ID NO: 3414509 - RNA, 14 nt, Human
aaaaucacaaaaau

SEQ ID NO: 3414510 - RNA, 14 nt, Human
aaaaucacguuaaa

SEQ ID NO: 3414511 - RNA, 11 nt, Human
aaaaucacuaa

SEQ ID NO: 3414512 - RNA, 17 nt, Human
aaaaucacuuucauaau

SEQ ID NO: 3414513 - RNA, 20 nt, Human
aaaaucagccaauuauguua

SEQ ID NO: 3414514 - RNA, 15 nt, Human
aaaaucagccagaca

SEQ ID NO: 3414515 - RNA, 18 nt, Human
aaaaucagcuauuuugug

SEQ ID NO: 3414516 - RNA, 13 nt, Human
aaaaucauaaacu

SEQ ID NO: 3414517 - RNA, 13 nt, Human
aaaaucauauugc

SEQ ID NO: 3414518 - RNA, 15 nt, Human
aaaaucauguuugcu

SEQ ID NO: 3414519 - RNA, 22 nt, Human
aaaaucauuuuauaugucaaag

SEQ ID NO: 3414520 - RNA, 16 nt, Human
aaaauccaaauauugu

SEQ ID NO: 3414521 - RNA, 12 nt, Human
aaaauccagaaa

SEQ ID NO: 3414522 - RNA, 17 nt, Human
aaaaucccccagcacuu

SEQ ID NO: 3414523 - RNA, 22 nt, Human
aaaaucccuuaccucggugccu

SEQ ID NO: 3414524 - RNA, 16 nt, Human
aaaauccuaagacaca

SEQ ID NO: 3414525 - RNA, 21 nt, Human
aaaauccuaagacacaaaugc

SEQ ID NO: 3414526 - RNA, 12 nt, Human
aaaauccuacca

SEQ ID NO: 3414527 - RNA, 18 nt, Human
aaaauccuaccaaccucu

SEQ ID NO: 3414528 - RNA, 13 nt, Human
aaaauccuugcuu

SEQ ID NO: 3414529 - RNA, 22 nt, Human
aaaacugcuccuccuccuguau

SEQ ID NO: 3414530 - RNA, 20 nt, Human
aaaacugcugacuguuuucu

SEQ ID NO: 3414531 - RNA, 23 nt, Human
aaaacugcuuuuuuuuuuccagc

SEQ ID NO: 3414532 - RNA, 17 nt, Human
aaaacuggaauaagaag

SEQ ID NO: 3414533 - RNA, 21 nt, Human
aaaacuggaauaagaagcaaa

SEQ ID NO: 3414534 - RNA, 21 nt, Human
aaaacuggcaacauuccaaga

SEQ ID NO: 3414535 - RNA, 13 nt, Human
aaaacuggccuga

SEQ ID NO: 3414536 - RNA, 19 nt, Human
aaaacugggccuguagcuc

SEQ ID NO: 3414537 - RNA, 19 nt, Human
aaaacuguacuuugauuca

SEQ ID NO: 3414538 - RNA, 22 nt, Human
aaaacuguacuuugauucacau

SEQ ID NO: 3414539 - RNA, 11 nt, Human
aaaacuuauuu

SEQ ID NO: 3414540 - RNA, 15 nt, Human
aaaacuucagacaua

SEQ ID NO: 3414541 - RNA, 20 nt, Human
aaaacuucuugucagacaua

SEQ ID NO: 3414542 - RNA, 24 nt, Human
aaaacuucuugucagacauaaagc

SEQ ID NO: 3414543 - RNA, 20 nt, Human
aaaacuugaaaauauaugau

SEQ ID NO: 3414544 - RNA, 22 nt, Human
aaaacuugauguguuaucucuu

SEQ ID NO: 3414545 - RNA, 19 nt, Human
aaaacuugguuuuaugguu

SEQ ID NO: 3414546 - RNA, 19 nt, Human
aaaacuugugugaaauuuu

SEQ ID NO: 3414547 - RNA, 12 nt, Human
aaaacuuuauuu

SEQ ID NO: 3414548 - RNA, 20 nt, Human
aaaacuuuauuuuauauaau

SEQ ID NO: 3414549 - RNA, 11 nt, Human
aaaacuuugga

SEQ ID NO: 3414550 - RNA, 19 nt, Human
aaaacuuuggaaccagacu

SEQ ID NO: 3414551 - RNA, 11 nt, Human
aaaacuuuguu

SEQ ID NO: 3414552 - RNA, 13 nt, Human
aaaacuuuuaaac

SEQ ID NO: 3414553 - RNA, 23 nt, Human
aaaaugugcaguaauagcacugc

SEQ ID NO: 3414554 - RNA, 20 nt, Human
aaaaugugcuauacugcaua

SEQ ID NO: 3414555 - RNA, 22 nt, Human
aaaaugugggauuaugggucac

SEQ ID NO: 3414556 - RNA, 11 nt, Human
aaaauguguaa

SEQ ID NO: 3414557 - RNA, 16 nt, Human
aaaauguguugaaacu

SEQ ID NO: 3414558 - RNA, 18 nt, Human
aaaauguuaucuucucaa

SEQ ID NO: 3414559 - RNA, 15 nt, Human
aaaauguuauuuccc

SEQ ID NO: 3414560 - RNA, 12 nt, Human
aaaauguucuuu

SEQ ID NO: 3414561 - RNA, 15 nt, Human
aaaauguucuuugga

SEQ ID NO: 3414562 - RNA, 14 nt, Human
aaaauguugagaau

SEQ ID NO: 3414563 - RNA, 22 nt, Human
aaaauguuggauuuauaaaugc

SEQ ID NO: 3414564 - RNA, 21 nt, Human
aaaauguuggucauuuuaugu

SEQ ID NO: 3414565 - RNA, 18 nt, Human
aaaauguuuuagcaauuu

SEQ ID NO: 3414566 - RNA, 12 nt, Human
aaaauguuuuca

SEQ ID NO: 3414567 - RNA, 20 nt, Human
aaaauguuuuguaagaaacc

SEQ ID NO: 3414568 - RNA, 22 nt, Human
aaaauguuuuuggucuuuuaua

SEQ ID NO: 3414569 - RNA, 15 nt, Human
aaaauguuuuuucau

SEQ ID NO: 3414570 - RNA, 15 nt, Human
aaaauuaaagaaaau

SEQ ID NO: 3414571 - RNA, 13 nt, Human
aaaauuaagaaag

SEQ ID NO: 3414572 - RNA, 22 nt, Human
aaaauuacuuaguauugcaaag

SEQ ID NO: 3414573 - RNA, 23 nt, Human
aaaauuagacugugauucagaaa

SEQ ID NO: 3414574 - RNA, 18 nt, Human
aaaauuagaugcauguug

SEQ ID NO: 3414575 - RNA, 15 nt, Human
aaaauuagccaagug

SEQ ID NO: 3414576 - RNA, 17 nt, Human
aaaauuagccaguaauc

SEQ ID NO: 3414577 - RNA, 19 nt, Human
aaaauuagccaguaauccu

SEQ ID NO: 3414578 - RNA, 17 nt, Human
aaaauuagccuaagaua

SEQ ID NO: 3414579 - RNA, 15 nt, Human
aaaauuauacugugu

SEQ ID NO: 3414580 - RNA, 18 nt, Human
aaaauuauagaugggaau

SEQ ID NO: 3414581 - RNA, 23 nt, Human
aaaauuauaggaauaucaauaua

SEQ ID NO: 3414582 - RNA, 17 nt, Human
aaaauuauggaaacaga

SEQ ID NO: 3414583 - RNA, 18 nt, Human
aaaauuauggaaacagau

SEQ ID NO: 3414584 - RNA, 21 nt, Human
aaaauuauuugaaaacauaua

SEQ ID NO: 3414585 - RNA, 14 nt, Human
aaaauuauuugcag

SEQ ID NO: 3414586 - RNA, 14 nt, Human
aaaauuauuugcau

SEQ ID NO: 3414587 - RNA, 17 nt, Human
aaaauuauuuuaaacaa

SEQ ID NO: 3414588 - RNA, 18 nt, Human
aaaauuauuuuaaacaaa

SEQ ID NO: 3414589 - RNA, 18 nt, Human
aaaauuauuuuguucaua

SEQ ID NO: 3414590 - RNA, 22 nt, Human
aaaauucaaagcauggacauuu

SEQ ID NO: 3414591 - RNA, 14 nt, Human
aaaauucaauugua

SEQ ID NO: 3414592 - RNA, 18 nt, Human
aaaauucagcaaaccauu

SEQ ID NO: 3414593 - RNA, 14 nt, Human
aaaauucagcaaag

SEQ ID NO: 3414594 - RNA, 19 nt, Human
aaaauucauaguaagauug

SEQ ID NO: 3414595 - RNA, 13 nt, Human
aaaauucauuucu

SEQ ID NO: 3414596 - RNA, 13 nt, Human
aaaauucauuuuu

SEQ ID NO: 3414597 - RNA, 21 nt, Human
aaaauuccaucccaucaucuu

SEQ ID NO: 3414598 - RNA, 15 nt, Human
aaaauucccuaaagc

SEQ ID NO: 3414599 - RNA, 16 nt, Human
aaaauucccuaaagcc

SEQ ID NO: 3414600 - RNA, 17 nt, Human
aaaauuccuauugugau

SEQ ID NO: 3414601 - RNA, 13 nt, Human
aaaauucuccuga

SEQ ID NO: 3414602 - RNA, 13 nt, Human
aaaauucugaauu

SEQ ID NO: 3414603 - RNA, 23 nt, Human
aaaauucugugccuuguuuuuug

SEQ ID NO: 3414604 - RNA, 13 nt, Human
aaaauucuuggaa

SEQ ID NO: 3414605 - RNA, 22 nt, Human
aaaauugaagagagauauaucu

SEQ ID NO: 3414606 - RNA, 15 nt, Human
aaaauugaauuuaac

SEQ ID NO: 3414607 - RNA, 21 nt, Human
aaaauugauguguuuauuuau

SEQ ID NO: 3414608 - RNA, 12 nt, Human
aaaauugccaua

SEQ ID NO: 3414609 - RNA, 13 nt, Human
aaaauugccauau

SEQ ID NO: 3414610 - RNA, 14 nt, Human
aaaauugccauauu

SEQ ID NO: 3414611 - RNA, 16 nt, Human
aaaauugccauauugc

SEQ ID NO: 3414612 - RNA, 18 nt, Human
aaaauugccauauugcac

SEQ ID NO: 3414613 - RNA, 22 nt, Human
aaaauugcuauguuacuauuuu

SEQ ID NO: 3414614 - RNA, 22 nt, Human
aaaauuggacauuaagcaucac

SEQ ID NO: 3414615 - RNA, 19 nt, Human
aaaauuggcauuaaaacuu

SEQ ID NO: 3414616 - RNA, 17 nt, Human
aaaauuggggauucuua

SEQ ID NO: 3414617 - RNA, 13 nt, Human
aaaauuguuauuu

SEQ ID NO: 3414618 - RNA, 16 nt, Human
aaaauuuaagcauugu

SEQ ID NO: 3414619 - RNA, 15 nt, Human
aaaauuuaagugcgu

SEQ ID NO: 3414620 - RNA, 19 nt, Human
aaaauuuacuacaauaugu

SEQ ID NO: 3414621 - RNA, 21 nt, Human
aaaauuuacuacaauauguac

SEQ ID NO: 3414622 - RNA, 19 nt, Human
aaaauuuagaaauauaauu

SEQ ID NO: 3414623 - RNA, 16 nt, Human
aaaauuuaguuuuugu

SEQ ID NO: 3414624 - RNA, 10 nt, Human
aaaauuuaua

SEQ ID NO: 3414625 - RNA, 13 nt, Human
aaaauuuauaugu

SEQ ID NO: 3414626 - RNA, 17 nt, Human
aaaauuuccaguaccuu

SEQ ID NO: 3414627 - RNA, 23 nt, Human
aaaauuuccaguaccuuugucac

SEQ ID NO: 3414628 - RNA, 15 nt, Human
aaaauuugaaacauu

SEQ ID NO: 3414629 - RNA, 20 nt, Human
aaaauuugaaacauugcuuu

SEQ ID NO: 3414630 - RNA, 18 nt, Human
aaaauuugaaauuuagcu

SEQ ID NO: 3414631 - RNA, 14 nt, Human
aaaauuugaaccaa

SEQ ID NO: 3414632 - RNA, 16 nt, Human
aaaauuugaaccaaaa

SEQ ID NO: 3414633 - RNA, 22 nt, Human
aaaauuugaaccaaaacauucc

SEQ ID NO: 3414634 - RNA, 13 nt, Human
aaaauuuggaauu

SEQ ID NO: 3414635 - RNA, 18 nt, Human
aaaauuuguuauuuugca

SEQ ID NO: 3414636 - RNA, 19 nt, Human
aaaauuuguucuuguauuu

SEQ ID NO: 3414637 - RNA, 14 nt, Human
aaaauuuguugcau

SEQ ID NO: 3414638 - RNA, 13 nt, Human
aaaauuuguuuaa

SEQ ID NO: 3414639 - RNA, 13 nt, Human
aaaauuuuaagcu

SEQ ID NO: 3414640 - RNA, 19 nt, Human
aaaauuuuaccagcagaag

SEQ ID NO: 3414641 - RNA, 22 nt, Human
aaaauuuuaccagcagaaggau

SEQ ID NO: 3414642 - RNA, 19 nt, Human
aaaauuuuaggcaaguuuu

SEQ ID NO: 3414643 - RNA, 21 nt, Human
aaaauuuuaggcacucuuaaa

SEQ ID NO: 3414644 - RNA, 21 nt, Human
aaaauuuuauaaaauuaagca

SEQ ID NO: 3414645 - RNA, 13 nt, Human
aaaauuuuauaag

SEQ ID NO: 3414646 - RNA, 15 nt, Human
aaaauuuucucauuu

SEQ ID NO: 3414647 - RNA, 16 nt, Human
aaaauuuugccuaaua

SEQ ID NO: 3414648 - RNA, 15 nt, Human
aaaauuuuguaauuu

SEQ ID NO: 3414649 - RNA, 18 nt, Human
aaaauuuuguaauuuucu

SEQ ID NO: 3414650 - RNA, 21 nt, Human
aaaauuuuguauguuaaagag

SEQ ID NO: 3414651 - RNA, 15 nt, Human
aaaauuuuuaaucuu

SEQ ID NO: 3414652 - RNA, 16 nt, Human
aaaauuuuuaaucuuu

SEQ ID NO: 3414653 - RNA, 16 nt, Human
aaaauuuuuuuagaaa

SEQ ID NO: 3414654 - RNA, 15 nt, Human
aaaauuuuuuuucau

SEQ ID NO: 3414655 - RNA, 16 nt, Human
aaaauuuuuuuucaug

SEQ ID NO: 3414656 - RNA, 14 nt, Human
aaacaaaaaacaau

SEQ ID NO: 3414657 - RNA, 16 nt, Human
aaacaaaaagaacaaa

SEQ ID NO: 3414658 - RNA, 20 nt, Human
aaacaaaaauucacaagcug

SEQ ID NO: 3414659 - RNA, 9 nt, Human
aaacaaaac

SEQ ID NO: 3414660 - RNA, 15 nt, Human
aaacaaaacaaaacu

SEQ ID NO: 3414661 - RNA, 16 nt, Human
aaacaaaacaaaacua

SEQ ID NO: 3414662 - RNA, 12 nt, Human
aaacaaaaccaa

SEQ ID NO: 3414663 - RNA, 21 nt, Human
aaacaaaaccccuaagagacu

SEQ ID NO: 3414664 - RNA, 12 nt, Human
aaacaaaacuau

SEQ ID NO: 3414665 - RNA, 18 nt, Human
aaacaaaacuauacuuga

SEQ ID NO: 3414666 - RNA, 12 nt, Human
aaacaaaauaga

SEQ ID NO: 3414667 - RNA, 15 nt, Human
aaacaaaauuucuau

SEQ ID NO: 3414668 - RNA, 12 nt, Human
aaacaaaauuug

SEQ ID NO: 3414669 - RNA, 15 nt, Human
aaacaaacauugugu

SEQ ID NO: 3414670 - RNA, 23 nt, Human
aaacaaacuuuucaaggcuuaua

SEQ ID NO: 3414671 - RNA, 13 nt, Human
aaacaaagaaauu

SEQ ID NO: 3414672 - RNA, 15 nt, Human
aaacaaagcuuagca

SEQ ID NO: 3414673 - RNA, 23 nt, Human
aaacaaagcuuagcaggagagga

SEQ ID NO: 3414674 - RNA, 20 nt, Human
aaacaaaggccuaauucuau

SEQ ID NO: 3414675 - RNA, 17 nt, Human
aaacaaagguugagaug

SEQ ID NO: 3414676 - RNA, 11 nt, Human
aaacaaagugg

SEQ ID NO: 3414677 - RNA, 19 nt, Human
aaacaaaguuucagaguau

SEQ ID NO: 3414678 - RNA, 16 nt, Human
aaacaaauaaucacau

SEQ ID NO: 3414679 - RNA, 17 nt, Human
aaacaaaucuuuccaua

SEQ ID NO: 3414680 - RNA, 16 nt, Human
aaacaacaauuucuac

SEQ ID NO: 3414681 - RNA, 22 nt, Human
aaacaacaauuucuacuuugaa

SEQ ID NO: 3414682 - RNA, 20 nt, Human
aaacaacagcucgauccaaa

SEQ ID NO: 3414683 - RNA, 22 nt, Human
aaacaacauuuugagaacaaag

SEQ ID NO: 3414684 - RNA, 19 nt, Human
aaacaacuucaauauccaa

SEQ ID NO: 3414685 - RNA, 23 nt, Human
aaaaucuaagcagcuuauuguuu

SEQ ID NO: 3414686 - RNA, 15 nt, Human
aaaaucuaauauuaa

SEQ ID NO: 3414687 - RNA, 17 nt, Human
aaaaucuaccuucugua

SEQ ID NO: 3414688 - RNA, 20 nt, Human
aaaaucuaccuucuguaguu

SEQ ID NO: 3414689 - RNA, 21 nt, Human
aaaaucuaccuucuguaguuu

SEQ ID NO: 3414690 - RNA, 18 nt, Human
aaaaucuagaagagucua

SEQ ID NO: 3414691 - RNA, 15 nt, Human
aaaaucuauauuuug

SEQ ID NO: 3414692 - RNA, 19 nt, Human
aaaaucucuccacuuucag

SEQ ID NO: 3414693 - RNA, 21 nt, Human
aaaaucucuccacuuucagcu

SEQ ID NO: 3414694 - RNA, 13 nt, Human
aaaaucugaagau

SEQ ID NO: 3414695 - RNA, 15 nt, Human
aaaaucugaagauug

SEQ ID NO: 3414696 - RNA, 21 nt, Human
aaaaucuguugauaaauccau

SEQ ID NO: 3414697 - RNA, 20 nt, Human
aaaaucuuaauacuguuauu

SEQ ID NO: 3414698 - RNA, 12 nt, Human
aaacaaguauuu

SEQ ID NO: 3414699 - RNA, 19 nt, Human
aaacaagucagucauucag

SEQ ID NO: 3414700 - RNA, 15 nt, Human
aaacaagugcuggca

SEQ ID NO: 3414701 - RNA, 22 nt, Human
aaacaauaguaauucucaggcc

SEQ ID NO: 3414702 - RNA, 12 nt, Human
aaacaauaucau

SEQ ID NO: 3414703 - RNA, 16 nt, Human
aaacaauauuguuucu

SEQ ID NO: 3414704 - RNA, 17 nt, Human
aaacaauauuguuucua

SEQ ID NO: 3414705 - RNA, 18 nt, Human
aaacaaucuggaagaaaa

SEQ ID NO: 3414706 - RNA, 13 nt, Human
aaacaauucaaag

SEQ ID NO: 3414707 - RNA, 15 nt, Human
aaacaauuuaaaaau

SEQ ID NO: 3414708 - RNA, 16 nt, Human
aaacaauuuauuuuau

SEQ ID NO: 3414709 - RNA, 21 nt, Human
aaacacacgcgcgcacacaca

SEQ ID NO: 3414710 - RNA, 16 nt, Human
aaacacacugaggcag

SEQ ID NO: 3414711 - RNA, 20 nt, Human
aaacacacuguuguuuaguu

SEQ ID NO: 3414712 - RNA, 21 nt, Human
aaacacagacauucugccagg

SEQ ID NO: 3414713 - RNA, 11 nt, Human
aaacacagcug

SEQ ID NO: 3414714 - RNA, 23 nt, Human
aaacacagcuuacaaucgcaaau

SEQ ID NO: 3414715 - RNA, 19 nt, Human
aaacacaguguuuuuguaa

SEQ ID NO: 3414716 - RNA, 14 nt, Human
aaacacauagauuc

SEQ ID NO: 3414717 - RNA, 18 nt, Human
aaacacauagauucaccu

SEQ ID NO: 3414718 - RNA, 19 nt, Human
aaacacauagauucaccug

SEQ ID NO: 3414719 - RNA, 11 nt, Human
aaacacauuaa

SEQ ID NO: 3414720 - RNA, 17 nt, Human
aaacacauuaggaaaag

SEQ ID NO: 3414721 - RNA, 12 nt, Human
aaacacauuuuu

SEQ ID NO: 3414722 - RNA, 15 nt, Human
aaacaccaacauaaa

SEQ ID NO: 3414723 - RNA, 19 nt, Human
aaacaccaacauguuggga

SEQ ID NO: 3414724 - RNA, 15 nt, Human
aaacaccucacaccu

SEQ ID NO: 3414725 - RNA, 18 nt, Human
aaacaccuccucauguac

SEQ ID NO: 3414726 - RNA, 13 nt, Human
aaacaccuucucu

SEQ ID NO: 3414727 - RNA, 14 nt, Human
aaacaccuucucug

SEQ ID NO: 3414728 - RNA, 15 nt, Human
aaacaccuucucugg

SEQ ID NO: 3414729 - RNA, 14 nt, Human
aaacacgaaacuug

SEQ ID NO: 3414730 - RNA, 15 nt, Human
aaacacgaaacuugu

SEQ ID NO: 3414731 - RNA, 18 nt, Human
aaacacgaaacuuguuau

SEQ ID NO: 3414732 - RNA, 21 nt, Human
aaacacgcacuuagucucuaa

SEQ ID NO: 3414733 - RNA, 22 nt, Human
aaacacucaaguugauuagaaa

SEQ ID NO: 3414734 - RNA, 20 nt, Human
aaacacuccacccuccaccu

SEQ ID NO: 3414735 - RNA, 14 nt, Human
aaacacuccuugca

SEQ ID NO: 3414736 - RNA, 14 nt, Human
aaacacucuugaaa

SEQ ID NO: 3414737 - RNA, 15 nt, Human
aaacacugcaggcau

SEQ ID NO: 3414738 - RNA, 13 nt, Human
aaacacugccauc

SEQ ID NO: 3414739 - RNA, 22 nt, Human
aaacacugggagaaaugaaaaa

SEQ ID NO: 3414740 - RNA, 19 nt, Human
aaacacugguuuuaaauau

SEQ ID NO: 3414741 - RNA, 13 nt, Human
aaacacugugcac

SEQ ID NO: 3414742 - RNA, 22 nt, Human
aaacacuguggaacuaauaaau

SEQ ID NO: 3414743 - RNA, 18 nt, Human
aaacacuguucucugccc

SEQ ID NO: 3414744 - RNA, 23 nt, Human
aaacacuguuuguuccagaaucu

SEQ ID NO: 3414745 - RNA, 15 nt, Human
aaacacuucuguccu

SEQ ID NO: 3414746 - RNA, 14 nt, Human
aaacacuuucaaaa

SEQ ID NO: 3414747 - RNA, 13 nt, Human
aaacacuuucucu

SEQ ID NO: 3414748 - RNA, 15 nt, Human
aaacagaaaaaaaac

SEQ ID NO: 3414749 - RNA, 12 nt, Human
aaacagaacacu

SEQ ID NO: 3414750 - RNA, 13 nt, Human
aaacagaacauca

SEQ ID NO: 3414751 - RNA, 21 nt, Human
aaacagaacaucauuagaaca

SEQ ID NO: 3414752 - RNA, 13 nt, Human
aaacagaaugucu

SEQ ID NO: 3414753 - RNA, 22 nt, Human
aaacagacaauaugugagugcc

SEQ ID NO: 3414754 - RNA, 12 nt, Human
aaacagacacug

SEQ ID NO: 3414755 - RNA, 22 nt, Human
aaacagacuuguauauucuauu

SEQ ID NO: 3414756 - RNA, 16 nt, Human
aaacagagaugugaua

SEQ ID NO: 3414757 - RNA, 20 nt, Human
aaacagaggccauggcagaa

SEQ ID NO: 3414758 - RNA, 20 nt, Human
aaacagaucuccuggcaaag

SEQ ID NO: 3414759 - RNA, 20 nt, Human
aaacagauuuggugaauuug

SEQ ID NO: 3414760 - RNA, 15 nt, Human
aaacagauuuuuaca

SEQ ID NO: 3414761 - RNA, 19 nt, Human
aaacagauuuuuacaaaug

SEQ ID NO: 3414762 - RNA, 15 nt, Human
aaacagcaaaccaag

SEQ ID NO: 3414763 - RNA, 20 nt, Human
aaacagcaaaccaagagauu

SEQ ID NO: 3414764 - RNA, 20 nt, Human
aaacagcagaacuucugaaa

SEQ ID NO: 3414765 - RNA, 21 nt, Human
aaacagcauugcuuucugaaa

SEQ ID NO: 3414766 - RNA, 23 nt, Human
aaacagccgucagccaaauguaa

SEQ ID NO: 3414767 - RNA, 15 nt, Human
aaacagccugugucu

SEQ ID NO: 3414768 - RNA, 12 nt, Human
aaacagcugccu

SEQ ID NO: 3414769 - RNA, 14 nt, Human
aaacagcugccucu

SEQ ID NO: 3414770 - RNA, 21 nt, Human
aaacagcugccuuagcuucag

SEQ ID NO: 3414771 - RNA, 18 nt, Human
aaacagcuucaugccuuu

SEQ ID NO: 3414772 - RNA, 21 nt, Human
aaacagcuucaugccuuugua

SEQ ID NO: 3414773 - RNA, 12 nt, Human
aaacagcuuuca

SEQ ID NO: 3414774 - RNA, 11 nt, Human
aaacaggacca

SEQ ID NO: 3414775 - RNA, 21 nt, Human
aaacaggacuuaaaaugacau

SEQ ID NO: 3414776 - RNA, 18 nt, Human
aaacaggagacaggaagg

SEQ ID NO: 3414777 - RNA, 17 nt, Human
aaacaggcacugcccug

SEQ ID NO: 3414778 - RNA, 21 nt, Human
aaacaggcaguuggccagaga

SEQ ID NO: 3414779 - RNA, 11 nt, Human
aaacagggccu

SEQ ID NO: 3414780 - RNA, 18 nt, Human
aaacagguauauacuuug

SEQ ID NO: 3414781 - RNA, 17 nt, Human
aaacaggucaauacagu

SEQ ID NO: 3414782 - RNA, 20 nt, Human
aaacaguauuuauuuuguaa

SEQ ID NO: 3414783 - RNA, 15 nt, Human
aaacaguauuucauu

SEQ ID NO: 3414784 - RNA, 18 nt, Human
aaacaguauuucauugcc

SEQ ID NO: 3414785 - RNA, 13 nt, Human
aaacagugacugu

SEQ ID NO: 3414786 - RNA, 14 nt, Human
aaacagugagccug

SEQ ID NO: 3414787 - RNA, 23 nt, Human
aaacaguggaucacaaaguggaa

SEQ ID NO: 3414788 - RNA, 15 nt, Human
aaacaguguguaaac

SEQ ID NO: 3414789 - RNA, 14 nt, Human
aaacaguuaacuuu

SEQ ID NO: 3414790 - RNA, 23 nt, Human
aaacaguuaacuuucagaagaga

SEQ ID NO: 3414791 - RNA, 15 nt, Human
aaacaguugcacagc

SEQ ID NO: 3414792 - RNA, 16 nt, Human
aaacaguugcacagca

SEQ ID NO: 3414793 - RNA, 18 nt, Human
aaacaguugcauguagua

SEQ ID NO: 3414794 - RNA, 24 nt, Human
aaacaguugcauguaguaacacua

SEQ ID NO: 3414795 - RNA, 17 nt, Human
aaacauaagaucacugc

SEQ ID NO: 3414796 - RNA, 15 nt, Human
aaacauaaugaaaau

SEQ ID NO: 3414797 - RNA, 13 nt, Human
aaacauaauucuu

SEQ ID NO: 3414798 - RNA, 13 nt, Human
aaacauauauaac

SEQ ID NO: 3414799 - RNA, 16 nt, Human
aaacauauauaacaau

SEQ ID NO: 3414800 - RNA, 14 nt, Human
aaacauaucucuua

SEQ ID NO: 3414801 - RNA, 13 nt, Human
aaacauaugauuu

SEQ ID NO: 3414802 - RNA, 17 nt, Human
aaacauaugauuucacu

SEQ ID NO: 3414803 - RNA, 14 nt, Human
aaacauaugcacau

SEQ ID NO: 3414804 - RNA, 16 nt, Human
aaacaucaguuacucu

SEQ ID NO: 3414805 - RNA, 20 nt, Human
aaacaucaguuacucugaag

SEQ ID NO: 3414806 - RNA, 19 nt, Human
aaacaucauucauuuuugu

SEQ ID NO: 3414807 - RNA, 16 nt, Human
aaacaucauuccuuuu

SEQ ID NO: 3414808 - RNA, 22 nt, Human
aaacaucauuccuuuuuauuua

SEQ ID NO: 3414809 - RNA, 15 nt, Human
aaacaucucaucaug

SEQ ID NO: 3414810 - RNA, 22 nt, Human
aaacaucuuugaaauuauguaa

SEQ ID NO: 3414811 - RNA, 15 nt, Human
aaacaugacacugac

SEQ ID NO: 3414812 - RNA, 17 nt, Human
aaacaugacacugaccu

SEQ ID NO: 3414813 - RNA, 15 nt, Human
aaacaugagaugugu

SEQ ID NO: 3414814 - RNA, 20 nt, Human
aaacaugcagaacaaaugaa

SEQ ID NO: 3414815 - RNA, 16 nt, Human
aaacaugcuacacacu

SEQ ID NO: 3414816 - RNA, 17 nt, Human
aaacauggccuuugcuu

SEQ ID NO: 3414817 - RNA, 22 nt, Human
aaacaugggguuggcugggccc

SEQ ID NO: 3414818 - RNA, 17 nt, Human
aaacaugguuugacucu

SEQ ID NO: 3414819 - RNA, 18 nt, Human
aaacauguacaaaaucga

SEQ ID NO: 3414820 - RNA, 13 nt, Human
aaacauguauuua

SEQ ID NO: 3414821 - RNA, 15 nt, Human
aaacauguauuuaug

SEQ ID NO: 3414822 - RNA, 14 nt, Human
aaacauguguuuua

SEQ ID NO: 3414823 - RNA, 21 nt, Human
aaacauguuaaugacaauauu

SEQ ID NO: 3414824 - RNA, 20 nt, Human
aaacauguuuauuuuucuug

SEQ ID NO: 3414825 - RNA, 21 nt, Human
aaacauguuuauuuuucuugu

SEQ ID NO: 3414826 - RNA, 12 nt, Human
aaacauguuucc

SEQ ID NO: 3414827 - RNA, 22 nt, Human
aaacauguuucuuuguaaugaa

SEQ ID NO: 3414828 - RNA, 16 nt, Human
aaacauuaagaaaauc

SEQ ID NO: 3414829 - RNA, 19 nt, Human
aaacauuaagaaaaucaua

SEQ ID NO: 3414830 - RNA, 20 nt, Human
aaacauuaagaaaaucauau

SEQ ID NO: 3414831 - RNA, 15 nt, Human
aaacauuaagauuga

SEQ ID NO: 3414832 - RNA, 16 nt, Human
aaacauuaauguugau

SEQ ID NO: 3414833 - RNA, 14 nt, Human
aaacauuaguacuu

SEQ ID NO: 3414834 - RNA, 15 nt, Human
aaacauuaugaugug

SEQ ID NO: 3414835 - RNA, 20 nt, Human
aaacauugguucuuguauua

SEQ ID NO: 3414836 - RNA, 20 nt, Human
aaacauuuaccaaucauauu

SEQ ID NO: 3414837 - RNA, 12 nt, Human
aaacauuuauuu

SEQ ID NO: 3414838 - RNA, 23 nt, Human
aaacauuuauuuuuuuuaaagaa

SEQ ID NO: 3414839 - RNA, 23 nt, Human
aaacauuucauaauuuguuucca

SEQ ID NO: 3414840 - RNA, 20 nt, Human
aaacauuuuaaauggacaga

SEQ ID NO: 3414841 - RNA, 19 nt, Human
aaaagguuuuauuuuguaa

SEQ ID NO: 3414842 - RNA, 13 nt, Human
aaaaguaaaaugu

SEQ ID NO: 3414843 - RNA, 15 nt, Human
aaaaguaauauuuau

SEQ ID NO: 3414844 - RNA, 14 nt, Human
aaagagaaugaguc

SEQ ID NO: 3414845 - RNA, 21 nt, Human
aaagagaauugggggcuuagg

SEQ ID NO: 3414846 - RNA, 22 nt, Human
aaagagacaaacuguaaaaaau

SEQ ID NO: 3414847 - RNA, 15 nt, Human
aaagagacaaagcuu

SEQ ID NO: 3414848 - RNA, 21 nt, Human
aaagagacagugauauuggaa

SEQ ID NO: 3414849 - RNA, 12 nt, Human
aaagagagaaaa

SEQ ID NO: 3414850 - RNA, 13 nt, Human
aaagagagaaaac

SEQ ID NO: 3414851 - RNA, 13 nt, Human
aaagagagaaaau

SEQ ID NO: 3414852 - RNA, 15 nt, Human
aaagagagaaaauaa

SEQ ID NO: 3414853 - RNA, 19 nt, Human
aaagagagaaaauaaaaag

SEQ ID NO: 3414854 - RNA, 11 nt, Human
aaagagagaga

SEQ ID NO: 3414855 - RNA, 13 nt, Human
aaagagagauuuu

SEQ ID NO: 3414856 - RNA, 15 nt, Human
aaagagagcagagaa

SEQ ID NO: 3414857 - RNA, 14 nt, Human
aaagagauacagag

SEQ ID NO: 3414858 - RNA, 16 nt, Human
aaagagauauuuuaaa

SEQ ID NO: 3414859 - RNA, 21 nt, Human
aaagagaugagacaaacaugc

SEQ ID NO: 3414860 - RNA, 18 nt, Human
aaagagcacaaacauuuu

SEQ ID NO: 3414861 - RNA, 18 nt, Human
aaagagcacuuaagagaa

SEQ ID NO: 3414862 - RNA, 20 nt, Human
aaagagcacuuaagagaaua

SEQ ID NO: 3414863 - RNA, 11 nt, Human
aaagagcugcc

SEQ ID NO: 3414864 - RNA, 13 nt, Human
aaagagcugccua

SEQ ID NO: 3414865 - RNA, 11 nt, Human
aaagaggaaaa

SEQ ID NO: 3414866 - RNA, 20 nt, Human
aaagaggacucgcuuguaaa

SEQ ID NO: 3414867 - RNA, 20 nt, Human
aaagaggcagcuugaaacug

SEQ ID NO: 3414868 - RNA, 13 nt, Human
aaagaggcuaugu

SEQ ID NO: 3414869 - RNA, 18 nt, Human
aaagaggcuaugugagca

SEQ ID NO: 3414870 - RNA, 16 nt, Human
aaagaggcugaaagag

SEQ ID NO: 3414871 - RNA, 19 nt, Human
aaagaggcugaggccugga

SEQ ID NO: 3414872 - RNA, 19 nt, Human
aaagaggcugaggcuggca

SEQ ID NO: 3414873 - RNA, 20 nt, Human
aaagaggcugccccucucac

SEQ ID NO: 3414874 - RNA, 15 nt, Human
aaagagggcuuccuc

SEQ ID NO: 3414875 - RNA, 19 nt, Human
aaagagggcuuccucuaga

SEQ ID NO: 3414876 - RNA, 18 nt, Human
aaagaggucgcuugggaa

SEQ ID NO: 3414877 - RNA, 18 nt, Human
aaagaggugaccccaggg

SEQ ID NO: 3414878 - RNA, 21 nt, Human
aaagaggugaccccagggcac

SEQ ID NO: 3414879 - RNA, 11 nt, Human
aaagagguuuu

SEQ ID NO: 3414880 - RNA, 16 nt, Human
aaagagguuuuucuua

SEQ ID NO: 3414881 - RNA, 20 nt, Human
aaagaguccauuguuuaaaa

SEQ ID NO: 3414882 - RNA, 20 nt, Human
aaagaguucaagaaauaagu

SEQ ID NO: 3414883 - RNA, 23 nt, Human
aaagaguucuggaaaagaacugu

SEQ ID NO: 3414884 - RNA, 21 nt, Human
aaagaguugggugucuccuua

SEQ ID NO: 3414885 - RNA, 18 nt, Human
aaagauaaacacaagauu

SEQ ID NO: 3414886 - RNA, 15 nt, Human
aaagauaaagaccag

SEQ ID NO: 3414887 - RNA, 13 nt, Human
aaagauaaagaug

SEQ ID NO: 3414888 - RNA, 15 nt, Human
aaagauaaagaugau

SEQ ID NO: 3414889 - RNA, 13 nt, Human
aaagauaaauauu

SEQ ID NO: 3414890 - RNA, 15 nt, Human
aaagauaaauauuau

SEQ ID NO: 3414891 - RNA, 20 nt, Human
aaagauaacaagaucuuuca

SEQ ID NO: 3414892 - RNA, 22 nt, Human
aaagauaacaagaucuuucagg

SEQ ID NO: 3414893 - RNA, 21 nt, Human
aaagauacagaacucuuucaa

SEQ ID NO: 3414894 - RNA, 17 nt, Human
aaacaagaaaguuuccc

SEQ ID NO: 3414895 - RNA, 12 nt, Human
aaacaagaauga

SEQ ID NO: 3414896 - RNA, 22 nt, Human
aaacaagaguuuucuuccuugu

SEQ ID NO: 3414897 - RNA, 15 nt, Human
aaacaagauuuuaaa

SEQ ID NO: 3414898 - RNA, 15 nt, Human
aaacaagcauauaaa

SEQ ID NO: 3414899 - RNA, 20 nt, Human
aaacaaggggcuguuacaua

SEQ ID NO: 3414900 - RNA, 12 nt, Human
aaacaauaccug

SEQ ID NO: 3414901 - RNA, 21 nt, Human
aaacaauacucauaaugugaa

SEQ ID NO: 3414902 - RNA, 15 nt, Human
aaacaauauuguuuc

SEQ ID NO: 3414903 - RNA, 15 nt, Human
aaacaaucacacuca

SEQ ID NO: 3414904 - RNA, 16 nt, Human
aaacaaugaaugucuu

SEQ ID NO: 3414905 - RNA, 12 nt, Human
aaacaauuuauu

SEQ ID NO: 3414906 - RNA, 13 nt, Human
aaacacaaaugca

SEQ ID NO: 3414907 - RNA, 14 nt, Human
aaacacaaaugcag

SEQ ID NO: 3414908 - RNA, 15 nt, Human
aaacacaagauuggu

SEQ ID NO: 3414909 - RNA, 21 nt, Human
aaacacaagauugguguuuuu

SEQ ID NO: 3414910 - RNA, 14 nt, Human
aaacacaauauuuu

SEQ ID NO: 3414911 - RNA, 21 nt, Human
aaacacacagauacacacaca

SEQ ID NO: 3414912 - RNA, 16 nt, Human
aaacacaccaggcugu

SEQ ID NO: 3414913 - RNA, 17 nt, Human
aaacacacugaaagcuc

SEQ ID NO: 3414914 - RNA, 17 nt, Human
aaacacacugaggcagg

SEQ ID NO: 3414915 - RNA, 19 nt, Human
aaacacacugaggcaggga

SEQ ID NO: 3414916 - RNA, 10 nt, Human
aaacacagag

SEQ ID NO: 3414917 - RNA, 11 nt, Human
aaacacagagg

SEQ ID NO: 3414918 - RNA, 14 nt, Human
aaacacagcaaggg

SEQ ID NO: 3414919 - RNA, 12 nt, Human
aaacacagcugu

SEQ ID NO: 3414920 - RNA, 13 nt, Human
aaacacagcuguu

SEQ ID NO: 3414921 - RNA, 18 nt, Human
aaacacaguuacacuugu

SEQ ID NO: 3414922 - RNA, 14 nt, Human
aaacacauaauuaa

SEQ ID NO: 3414923 - RNA, 18 nt, Human
aaacacauaauuaacacu

SEQ ID NO: 3414924 - RNA, 22 nt, Human
aaacacauagauucaccuguaa

SEQ ID NO: 3414925 - RNA, 14 nt, Human
aaacacaucuuccc

SEQ ID NO: 3414926 - RNA, 13 nt, Human
aaacacauugccu

SEQ ID NO: 3414927 - RNA, 23 nt, Human
aaacacauugccuaacuacuagu

SEQ ID NO: 3414928 - RNA, 16 nt, Human
aaacacauuguuauuu

SEQ ID NO: 3414929 - RNA, 20 nt, Human
aaacacauuguuauuuucag

SEQ ID NO: 3414930 - RNA, 20 nt, Human
aaacacccgacgucauguau

SEQ ID NO: 3414931 - RNA, 15 nt, Human
aaacaccuagcuuua

SEQ ID NO: 3414932 - RNA, 12 nt, Human
aaacaccugcug

SEQ ID NO: 3414933 - RNA, 23 nt, Human
aaacaccuucuuauuauauauau

SEQ ID NO: 3414934 - RNA, 13 nt, Human
aaacacgaaacuu

SEQ ID NO: 3414935 - RNA, 23 nt, Human
aaacacgaaacuuguuauuguga

SEQ ID NO: 3414936 - RNA, 17 nt, Human
aaacacguuuuaaggac

SEQ ID NO: 3414937 - RNA, 18 nt, Human
aaacacguuuuaaggacu

SEQ ID NO: 3414938 - RNA, 14 nt, Human
aaacacuaaauguu

SEQ ID NO: 3414939 - RNA, 15 nt, Human
aaacacuaaauguua

SEQ ID NO: 3414940 - RNA, 17 nt, Human
aaacacuaaauguuaaa

SEQ ID NO: 3414941 - RNA, 19 nt, Human
aaacacuaaauguuaaaga

SEQ ID NO: 3414942 - RNA, 22 nt, Human
aaacacuaaauguuaaagaugu

SEQ ID NO: 3414943 - RNA, 23 nt, Human
aaacacuaguaccuucagauccu

SEQ ID NO: 3414944 - RNA, 16 nt, Human
aaacacucagcuguuc

SEQ ID NO: 3414945 - RNA, 24 nt, Human
aaacacucaguuguucaauaauaa

SEQ ID NO: 3414946 - RNA, 13 nt, Human
aaacacuccuugc

SEQ ID NO: 3414947 - RNA, 17 nt, Human
aaacacucggcauuuca

SEQ ID NO: 3414948 - RNA, 21 nt, Human
aaacacucggcauuucaaaug

SEQ ID NO: 3414949 - RNA, 16 nt, Human
aaacacugaaaagaag

SEQ ID NO: 3414950 - RNA, 13 nt, Human
aaacacugccuuu

SEQ ID NO: 3414951 - RNA, 22 nt, Human
aaacacugccuuuuuauuuaua

SEQ ID NO: 3414952 - RNA, 15 nt, Human
aaacacuguguaagc

SEQ ID NO: 3414953 - RNA, 19 nt, Human
aaacacuguucucugcccu

SEQ ID NO: 3414954 - RNA, 20 nt, Human
aaacacuugugacuuuugcu

SEQ ID NO: 3414955 - RNA, 21 nt, Human
aaacacuuucucuucuuguuu

SEQ ID NO: 3414956 - RNA, 14 nt, Human
aaacacuuuuuugg

SEQ ID NO: 3414957 - RNA, 12 nt, Human
aaacagaaaaaa

SEQ ID NO: 3414958 - RNA, 13 nt, Human
aaacagaaaaaaa

SEQ ID NO: 3414959 - RNA, 13 nt, Human
aaacagaaacaaa

SEQ ID NO: 3414960 - RNA, 21 nt, Human
aaacagaaacaaaaacacuaa

SEQ ID NO: 3414961 - RNA, 13 nt, Human
aaacagaacacuu

SEQ ID NO: 3414962 - RNA, 16 nt, Human
aaacagagacaggccc

SEQ ID NO: 3414963 - RNA, 13 nt, Human
aaacagaggacca

SEQ ID NO: 3414964 - RNA, 17 nt, Human
aaacagaguaaucuugu

SEQ ID NO: 3414965 - RNA, 19 nt, Human
aaacagauaccauacucau

SEQ ID NO: 3414966 - RNA, 12 nt, Human
aaacagauauaa

SEQ ID NO: 3414967 - RNA, 15 nt, Human
aaacagauauaaaug

SEQ ID NO: 3414968 - RNA, 14 nt, Human
aaacagaugaaaag

SEQ ID NO: 3414969 - RNA, 21 nt, Human
aaacagaugaugagaauuucu

SEQ ID NO: 3414970 - RNA, 22 nt, Human
aaacagaugaugagaauuucua

SEQ ID NO: 3414971 - RNA, 14 nt, Human
aaacagaugcucug

SEQ ID NO: 3414972 - RNA, 14 nt, Human
aaacagauguccau

SEQ ID NO: 3414973 - RNA, 22 nt, Human
aaacagauguccaucagaugac

SEQ ID NO: 3414974 - RNA, 17 nt, Human
aaacagauuuggaaaga

SEQ ID NO: 3414975 - RNA, 17 nt, Human
aaacagcaaaccaagag

SEQ ID NO: 3414976 - RNA, 18 nt, Human
aaacagcaaaccaagaga

SEQ ID NO: 3414977 - RNA, 14 nt, Human
aaacagcaguguuc

SEQ ID NO: 3414978 - RNA, 14 nt, Human
aaacagcauugcuu

SEQ ID NO: 3414979 - RNA, 16 nt, Human
aaacagcauugcuuuc

SEQ ID NO: 3414980 - RNA, 18 nt, Human
aaacagcauugcuuucug

SEQ ID NO: 3414981 - RNA, 14 nt, Human
aaacagccagcaag

SEQ ID NO: 3414982 - RNA, 18 nt, Human
aaacagcugcauuagaaa

SEQ ID NO: 3414983 - RNA, 13 nt, Human
aaacagcugccuu

SEQ ID NO: 3414984 - RNA, 17 nt, Human
aaacagcugccuuagcu

SEQ ID NO: 3414985 - RNA, 18 nt, Human
aaacagcugccuuagcuu

SEQ ID NO: 3414986 - RNA, 20 nt, Human
aaacagcuucaugccuuugu

SEQ ID NO: 3414987 - RNA, 14 nt, Human
aaacagcuuucaag

SEQ ID NO: 3414988 - RNA, 18 nt, Human
aaacagcuuucaagugcc

SEQ ID NO: 3414989 - RNA, 20 nt, Human
aaacagcuuuggggugucuu

SEQ ID NO: 3414990 - RNA, 22 nt, Human
aaagcagaacaguuaagcagcc

SEQ ID NO: 3414991 - RNA, 19 nt, Human
aaagcagaauaguauuuuu

SEQ ID NO: 3414992 - RNA, 14 nt, Human
aaagcagaggccaa

SEQ ID NO: 3414993 - RNA, 21 nt, Human
aaagcagaggcuggccucaga

SEQ ID NO: 3414994 - RNA, 22 nt, Human
aaagcagauaccucacccugcu

SEQ ID NO: 3414995 - RNA, 13 nt, Human
aaagcagcaucug

SEQ ID NO: 3414996 - RNA, 17 nt, Human
aaagcagccuggccaac

SEQ ID NO: 3414997 - RNA, 16 nt, Human
aaagcagcguuucuau

SEQ ID NO: 3414998 - RNA, 17 nt, Human
aaagcaggcagaacuca

SEQ ID NO: 3414999 - RNA, 18 nt, Human
aaagcagggaauuucuau

SEQ ID NO: 3415000 - RNA, 17 nt, Human
aaagcagggacuugaac

SEQ ID NO: 3415001 - RNA, 18 nt, Human
aaagcaggggcuacaaga

SEQ ID NO: 3415002 - RNA, 22 nt, Human
aaagcaggggcuacaagaggga

SEQ ID NO: 3415003 - RNA, 17 nt, Human
aaagcagguggcaucuc

SEQ ID NO: 3415004 - RNA, 19 nt, Human
aaagcagguucuuguuggu

SEQ ID NO: 3415005 - RNA, 17 nt, Human
aaagcagguuucaagga

SEQ ID NO: 3415006 - RNA, 22 nt, Human
aaagcaguagaaauaauaugca

SEQ ID NO: 3415007 - RNA, 23 nt, Human
aaagcaguuaacuuuaagacuga

SEQ ID NO: 3415008 - RNA, 20 nt, Human
aaagcauagauguuuuggua

SEQ ID NO: 3415009 - RNA, 21 nt, Human
aaagcauauggguuagauguu

SEQ ID NO: 3415010 - RNA, 17 nt, Human
aaagcaucaccucaggc

SEQ ID NO: 3415011 - RNA, 18 nt, Human
aaagcaucaccucaggcc

SEQ ID NO: 3415012 - RNA, 17 nt, Human
aaagcaucccucaccca

SEQ ID NO: 3415013 - RNA, 15 nt, Human
aaagcauggacauuu

SEQ ID NO: 3415014 - RNA, 16 nt, Human
aaagcauguacagugu

SEQ ID NO: 3415015 - RNA, 22 nt, Human
aaagcauguucacccuuauagu

SEQ ID NO: 3415016 - RNA, 17 nt, Human
aaagcauguuuugcaug

SEQ ID NO: 3415017 - RNA, 22 nt, Human
aaagcauucaauuuauucaaga

SEQ ID NO: 3415018 - RNA, 17 nt, Human
aaagcauuguaaaugug

SEQ ID NO: 3415019 - RNA, 15 nt, Human
aaagcauuuauaaau

SEQ ID NO: 3415020 - RNA, 14 nt, Human
aaagcauuuaucau

SEQ ID NO: 3415021 - RNA, 14 nt, Human
aaagcauuugaaug

SEQ ID NO: 3415022 - RNA, 19 nt, Human
aaagcauuugaaugcauuu

SEQ ID NO: 3415023 - RNA, 22 nt, Human
aaagcauuugaaugcauuuugu

SEQ ID NO: 3415024 - RNA, 13 nt, Human
aaagcauuuugua

SEQ ID NO: 3415025 - RNA, 14 nt, Human
aaagcauuuuguaa

SEQ ID NO: 3415026 - RNA, 15 nt, Human
aaagcauuuuguaau

SEQ ID NO: 3415027 - RNA, 15 nt, Human
aaagccaaugugaac

SEQ ID NO: 3415028 - RNA, 17 nt, Human
aaagccacauuauuucu

SEQ ID NO: 3415029 - RNA, 12 nt, Human
aaagccaccucu

SEQ ID NO: 3415030 - RNA, 18 nt, Human
aaagccaccucugucauu

SEQ ID NO: 3415031 - RNA, 20 nt, Human
aaagccagaaccagaugagu

SEQ ID NO: 3415032 - RNA, 14 nt, Human
aaagccagaagcug

SEQ ID NO: 3415033 - RNA, 21 nt, Human
aaagccagcguccuccucugu

SEQ ID NO: 3415034 - RNA, 13 nt, Human
aaagccagggucu

SEQ ID NO: 3415035 - RNA, 14 nt, Human
aaagccagucuuaa

SEQ ID NO: 3415036 - RNA, 19 nt, Human
aaagccagugacuccagga

SEQ ID NO: 3415037 - RNA, 16 nt, Human
aaagccauguuuaaga

SEQ ID NO: 3415038 - RNA, 17 nt, Human
aaagccauguuuaagau

SEQ ID NO: 3415039 - RNA, 14 nt, Human
aaagccauguuuau

SEQ ID NO: 3415040 - RNA, 12 nt, Human
aaagcccaggag

SEQ ID NO: 3415041 - RNA, 14 nt, Human
aaagcccaggagcc

SEQ ID NO: 3415042 - RNA, 22 nt, Human
aaagcccauaugcuaccaccag

SEQ ID NO: 3415043 - RNA, 16 nt, Human
aaagccccauuaacug

SEQ ID NO: 3415044 - RNA, 14 nt, Human
aaagcccccagagc

SEQ ID NO: 3415045 - RNA, 13 nt, Human
aaagcccugugcu

SEQ ID NO: 3415046 - RNA, 19 nt, Human
aaagcccuuaggaagaauu

SEQ ID NO: 3415047 - RNA, 16 nt, Human
aaagccuaaucacagu

SEQ ID NO: 3415048 - RNA, 17 nt, Human
aaagccugggugacauu

SEQ ID NO: 3415049 - RNA, 18 nt, Human
aaagccugggugacauuu

SEQ ID NO: 3415050 - RNA, 17 nt, Human
aaagccuguaagccugc

SEQ ID NO: 3415051 - RNA, 17 nt, Human
aaagccuguucauggca

SEQ ID NO: 3415052 - RNA, 18 nt, Human
aaagccuguucauggcag

SEQ ID NO: 3415053 - RNA, 20 nt, Human
aaagccuguuccccucacug

SEQ ID NO: 3415054 - RNA, 10 nt, Human
aaagccuucc

SEQ ID NO: 3415055 - RNA, 18 nt, Human
aaagccuucuuuuggggg

SEQ ID NO: 3415056 - RNA, 16 nt, Human
aaagcacaagaagcgu

SEQ ID NO: 3415057 - RNA, 19 nt, Human
aaagcacaggagacacugu

SEQ ID NO: 3415058 - RNA, 15 nt, Human
aaagcacaguuugaa

SEQ ID NO: 3415059 - RNA, 17 nt, Human
aaagcacaguuugaaca

SEQ ID NO: 3415060 - RNA, 19 nt, Human
aaagcaccaaaauaagaaa

SEQ ID NO: 3415061 - RNA, 22 nt, Human
aaagcaccaaaauaagaaaaga

SEQ ID NO: 3415062 - RNA, 14 nt, Human
aaagcacuauacag

SEQ ID NO: 3415063 - RNA, 22 nt, Human
aaagcacuuggacucuugcucu

SEQ ID NO: 3415064 - RNA, 16 nt, Human
aaagcagagauuuuca

SEQ ID NO: 3415065 - RNA, 15 nt, Human
aaagcagccacgagg

SEQ ID NO: 3415066 - RNA, 15 nt, Human
aaagcagcguuucua

SEQ ID NO: 3415067 - RNA, 18 nt, Human
aaagcagcguuucuauga

SEQ ID NO: 3415068 - RNA, 19 nt, Human
aaagcagcucaaaggcaca

SEQ ID NO: 3415069 - RNA, 19 nt, Human
aaagcaggcagaacucauc

SEQ ID NO: 3415070 - RNA, 24 nt, Human
aaagcaggcuugcccaguacauuu

SEQ ID NO: 3415071 - RNA, 14 nt, Human
aaagcagguucuug

SEQ ID NO: 3415072 - RNA, 17 nt, Human
aaagcagguucuuguug

SEQ ID NO: 3415073 - RNA, 22 nt, Human
aaagcagguucuuguuggugca

SEQ ID NO: 3415074 - RNA, 15 nt, Human
aaagcaguauuuuuc

SEQ ID NO: 3415075 - RNA, 13 nt, Human
aaagcagugcaug

SEQ ID NO: 3415076 - RNA, 22 nt, Human
aaagcagugcaugcugucccuu

SEQ ID NO: 3415077 - RNA, 14 nt, Human
aaagcauaaaaaca

SEQ ID NO: 3415078 - RNA, 13 nt, Human
aaagcauaaagcu

SEQ ID NO: 3415079 - RNA, 17 nt, Human
aaagcauauugacuuuu

SEQ ID NO: 3415080 - RNA, 24 nt, Human
aaagcaucccucacccauccuaga

SEQ ID NO: 3415081 - RNA, 22 nt, Human
aaagcaucuugcauuaugcaau

SEQ ID NO: 3415082 - RNA, 17 nt, Human
aaagcaugaaaugugaa

SEQ ID NO: 3415083 - RNA, 18 nt, Human
aaagcauggacauuuaga

SEQ ID NO: 3415084 - RNA, 12 nt, Human
aaagcauggacu

SEQ ID NO: 3415085 - RNA, 11 nt, Human
aaagcauguac

SEQ ID NO: 3415086 - RNA, 13 nt, Human
aaagcauguacag

SEQ ID NO: 3415087 - RNA, 14 nt, Human
aaagcauguacagu

SEQ ID NO: 3415088 - RNA, 15 nt, Human
aaagcauguacagug

SEQ ID NO: 3415089 - RNA, 21 nt, Human
aaagcauguacaguguucugu

SEQ ID NO: 3415090 - RNA, 13 nt, Human
aaagcaugucuca

SEQ ID NO: 3415091 - RNA, 20 nt, Human
aaagcauuguaaaugugcuu

SEQ ID NO: 3415092 - RNA, 17 nt, Human
aaagcauuuacuuugaa

SEQ ID NO: 3415093 - RNA, 16 nt, Human
aaagcauuuuucaaua

SEQ ID NO: 3415094 - RNA, 15 nt, Human
aaagccaagaggcug

SEQ ID NO: 3415095 - RNA, 17 nt, Human
aaagccaaggugucauu

SEQ ID NO: 3415096 - RNA, 19 nt, Human
aaagccaauaacacacagc

SEQ ID NO: 3415097 - RNA, 17 nt, Human
aaagccaaugugaacag

SEQ ID NO: 3415098 - RNA, 20 nt, Human
aaagccacauuauuucuagu

SEQ ID NO: 3415099 - RNA, 19 nt, Human
aaagccaccucugucauuu

SEQ ID NO: 3415100 - RNA, 20 nt, Human
aaagccaccucugucauuug

SEQ ID NO: 3415101 - RNA, 17 nt, Human
aaagccacuagacucuu

SEQ ID NO: 3415102 - RNA, 13 nt, Human
aaagccaugcugg

SEQ ID NO: 3415103 - RNA, 13 nt, Human
aaagccauguuua

SEQ ID NO: 3415104 - RNA, 19 nt, Human
aaagccauguuuaagauuu

SEQ ID NO: 3415105 - RNA, 18 nt, Human
aaagccauguuuauuaca

SEQ ID NO: 3415106 - RNA, 16 nt, Human
aaagcccaaccuccug

SEQ ID NO: 3415107 - RNA, 18 nt, Human
aaagcccaagggaucugg

SEQ ID NO: 3415108 - RNA, 23 nt, Human
aaagcccaagggaucugguccua

SEQ ID NO: 3415109 - RNA, 15 nt, Human
aaagcccagagacag

SEQ ID NO: 3415110 - RNA, 16 nt, Human
aaagcccauucauucc

SEQ ID NO: 3415111 - RNA, 14 nt, Human
aaagccccagaaau

SEQ ID NO: 3415112 - RNA, 14 nt, Human
aaagcccugagauc

SEQ ID NO: 3415113 - RNA, 14 nt, Human
aaagcccugugcuc

SEQ ID NO: 3415114 - RNA, 20 nt, Human
aaagccucaagguuuuaggu

SEQ ID NO: 3415115 - RNA, 16 nt, Human
aaagccucugcugcca

SEQ ID NO: 3415116 - RNA, 13 nt, Human
aaagccucugugu

SEQ ID NO: 3415117 - RNA, 24 nt, Human
aaagccucugugucacuggcugcc

SEQ ID NO: 3415118 - RNA, 17 nt, Human
aaagccucuguuuugau

SEQ ID NO: 3415119 - RNA, 13 nt, Human
aaagccugcucaa

SEQ ID NO: 3415120 - RNA, 20 nt, Human
aaagccuggguuugguguau

SEQ ID NO: 3415121 - RNA, 22 nt, Human
aaagccuguaagccugcaagcc

SEQ ID NO: 3415122 - RNA, 17 nt, Human
aaagccuguauucucaa

SEQ ID NO: 3415123 - RNA, 16 nt, Human
aaagccuguuuaagag

SEQ ID NO: 3415124 - RNA, 15 nt, Human
aaagccuuagggaag

SEQ ID NO: 3415125 - RNA, 17 nt, Human
aaagccuuaucaagugu

SEQ ID NO: 3415126 - RNA, 19 nt, Human
aaagccuuguguauauuug

SEQ ID NO: 3415127 - RNA, 23 nt, Human
aaagccuugugucuacagagaac

SEQ ID NO: 3415128 - RNA, 17 nt, Human
aaagccuuuaguaucag

SEQ ID NO: 3415129 - RNA, 16 nt, Human
aaagccuuuauuuguu

SEQ ID NO: 3415130 - RNA, 12 nt, Human
aaagcgaaaaaa

SEQ ID NO: 3415131 - RNA, 14 nt, Human
aaagcggggggagg

SEQ ID NO: 3415132 - RNA, 16 nt, Human
aaagcuaaaauaaaga

SEQ ID NO: 3415133 - RNA, 16 nt, Human
aaagcuaggccuggcc

SEQ ID NO: 3415134 - RNA, 17 nt, Human
aaagcuaggccuggcca

SEQ ID NO: 3415135 - RNA, 15 nt, Human
aaagguuuacagaau

SEQ ID NO: 3415136 - RNA, 22 nt, Human
aaagguuuaugaaaaagaagaa

SEQ ID NO: 3415137 - RNA, 16 nt, Human
aaagguuuauuuuucu

SEQ ID NO: 3415138 - RNA, 16 nt, Human
aaagguuuuauuuugu

SEQ ID NO: 3415139 - RNA, 17 nt, Human
aaagguuuuauuuugua

SEQ ID NO: 3415140 - RNA, 13 nt, Human
aaagguuuugagc

SEQ ID NO: 3415141 - RNA, 12 nt, Human
aaagguuuuuuu

SEQ ID NO: 3415142 - RNA, 12 nt, Human
aaaguaaaagag

SEQ ID NO: 3415143 - RNA, 15 nt, Human
aaaguaaaagcagca

SEQ ID NO: 3415144 - RNA, 19 nt, Human
aaaguaaaagcagcauaaa

SEQ ID NO: 3415145 - RNA, 14 nt, Human
aaaguaaaccacaa

SEQ ID NO: 3415146 - RNA, 20 nt, Human
aaaguaacucauuuguuaaa

SEQ ID NO: 3415147 - RNA, 16 nt, Human
aaaguaacugugagaa

SEQ ID NO: 3415148 - RNA, 21 nt, Human
aaaguaaggugcuuggaguuu

SEQ ID NO: 3415149 - RNA, 17 nt, Human
aaaguaaugaucucaaa

SEQ ID NO: 3415150 - RNA, 15 nt, Human
aaaguacacucugcu

SEQ ID NO: 3415151 - RNA, 14 nt, Human
aaaguacagaauuu

SEQ ID NO: 3415152 - RNA, 16 nt, Human
aaaguacagguacuuu

SEQ ID NO: 3415153 - RNA, 16 nt, Human
aaaguacauguuaaac

SEQ ID NO: 3415154 - RNA, 22 nt, Human
aaaguacauucuggggaaacaa

SEQ ID NO: 3415155 - RNA, 18 nt, Human
aaaguacugagcagugau

SEQ ID NO: 3415156 - RNA, 23 nt, Human
aaaguagaacuuuguauaguuau

SEQ ID NO: 3415157 - RNA, 14 nt, Human
aaaguagauuaaga

SEQ ID NO: 3415158 - RNA, 21 nt, Human
aaaguaguacuucuucuguaa

SEQ ID NO: 3415159 - RNA, 16 nt, Human
aaaguaguccugugaa

SEQ ID NO: 3415160 - RNA, 13 nt, Human
aaaguauagagag

SEQ ID NO: 3415161 - RNA, 15 nt, Human
aaaguauauauuuau

SEQ ID NO: 3415162 - RNA, 12 nt, Human
aaaguaucaugc

SEQ ID NO: 3415163 - RNA, 14 nt, Human
aaaguaucaugcau

SEQ ID NO: 3415164 - RNA, 15 nt, Human
aaaguaucaugcauu

SEQ ID NO: 3415165 - RNA, 16 nt, Human
aaaguaucaugcauuc

SEQ ID NO: 3415166 - RNA, 19 nt, Human
aaaguaucauggaaauauu

SEQ ID NO: 3415167 - RNA, 18 nt, Human
aaaguaucccuacuguaa

SEQ ID NO: 3415168 - RNA, 21 nt, Human
aaaguaucccuacuguaauuu

SEQ ID NO: 3415169 - RNA, 12 nt, Human
aaaguaugaauc

SEQ ID NO: 3415170 - RNA, 19 nt, Human
aaaguauguaaaguaugua

SEQ ID NO: 3415171 - RNA, 18 nt, Human
aaaguauguuagugcaaa

SEQ ID NO: 3415172 - RNA, 12 nt, Human
aaaguauguucu

SEQ ID NO: 3415173 - RNA, 20 nt, Human
aaaguauuaagcauauauuu

SEQ ID NO: 3415174 - RNA, 14 nt, Human
aaaguauuccaccu

SEQ ID NO: 3415175 - RNA, 18 nt, Human
aaaguauuccaccuuaaa

SEQ ID NO: 3415176 - RNA, 14 nt, Human
aaaguauucucuuu

SEQ ID NO: 3415177 - RNA, 16 nt, Human
aaaguauucucuuuuc

SEQ ID NO: 3415178 - RNA, 15 nt, Human
aaaguauucuuuuuc

SEQ ID NO: 3415179 - RNA, 21 nt, Human
aaaguauuguaaauuauauuu

SEQ ID NO: 3415180 - RNA, 12 nt, Human
aaaguauuuucc

SEQ ID NO: 3415181 - RNA, 17 nt, Human
aaaguauuuuccuguaa

SEQ ID NO: 3415182 - RNA, 12 nt, Human
aaaguauuuuga

SEQ ID NO: 3415183 - RNA, 13 nt, Human
aaaguauuuugaa

SEQ ID NO: 3415184 - RNA, 16 nt, Human
aaaguauuuugaaguu

SEQ ID NO: 3415185 - RNA, 20 nt, Human
aaagucaaaaggugccugug

SEQ ID NO: 3415186 - RNA, 21 nt, Human
aaagucaaucuuaucauauuu

SEQ ID NO: 3415187 - RNA, 17 nt, Human
aaagucaauguuuucag

SEQ ID NO: 3415188 - RNA, 13 nt, Human
aaagucacaguua

SEQ ID NO: 3415189 - RNA, 16 nt, Human
aaagucagaacaaauu

SEQ ID NO: 3415190 - RNA, 14 nt, Human
aaagucagauguuu

SEQ ID NO: 3415191 - RNA, 15 nt, Human
aaagucauaauugca

SEQ ID NO: 3415192 - RNA, 17 nt, Human
aaagucauuaaagacag

SEQ ID NO: 3415193 - RNA, 15 nt, Human
aaagucauuggcuuu

SEQ ID NO: 3415194 - RNA, 21 nt, Human
aaagucauuggcuuuauccuc

SEQ ID NO: 3415195 - RNA, 23 nt, Human
aaagucauuggcuuuauccucuu

SEQ ID NO: 3415196 - RNA, 20 nt, Human
aaaguccaauuuuaauuuag

SEQ ID NO: 3415197 - RNA, 13 nt, Human
aaaguccuuuucu

SEQ ID NO: 3415198 - RNA, 15 nt, Human
aaagucgaauuaaua

SEQ ID NO: 3415199 - RNA, 16 nt, Human
aaagucuaucuaauga

SEQ ID NO: 3415200 - RNA, 18 nt, Human
aaagucucaaugaaauag

SEQ ID NO: 3415201 - RNA, 14 nt, Human
aaagucuccagccc

SEQ ID NO: 3415202 - RNA, 15 nt, Human
aaagucuccagccca

SEQ ID NO: 3415203 - RNA, 13 nt, Human
aaagucucuauuu

SEQ ID NO: 3415204 - RNA, 20 nt, Human
aaagucucuauuuaaauucu

SEQ ID NO: 3415205 - RNA, 23 nt, Human
aaagucucuauuuaaauucuuuu

SEQ ID NO: 3415206 - RNA, 22 nt, Human
aaagucucucauucuaggccuc

SEQ ID NO: 3415207 - RNA, 19 nt, Human
aaagucucuggaauuugaa

SEQ ID NO: 3415208 - RNA, 23 nt, Human
aaagucugcucucauauaagaca

SEQ ID NO: 3415209 - RNA, 19 nt, Human
aaagucuguccuugaagga

SEQ ID NO: 3415210 - RNA, 16 nt, Human
aaagucugucuuuccu

SEQ ID NO: 3415211 - RNA, 17 nt, Human
aaagucuucaagggcug

SEQ ID NO: 3415212 - RNA, 18 nt, Human
aaagucuugaauguugaa

SEQ ID NO: 3415213 - RNA, 23 nt, Human
aaagucuuuggggucuacacugc

SEQ ID NO: 3415214 - RNA, 15 nt, Human
aaagugaaauaaugu

SEQ ID NO: 3415215 - RNA, 17 nt, Human
aaagugaaauaaugugu

SEQ ID NO: 3415216 - RNA, 11 nt, Human
aaagccuugug

SEQ ID NO: 3415217 - RNA, 21 nt, Human
aaagccuugugucuacagaga

SEQ ID NO: 3415218 - RNA, 14 nt, Human
aaagcgaauuuuaa

SEQ ID NO: 3415219 - RNA, 14 nt, Human
aaagcguuugcaca

SEQ ID NO: 3415220 - RNA, 18 nt, Human
aaagcuaaaguaucugua

SEQ ID NO: 3415221 - RNA, 13 nt, Human
aaagcuagaaaug

SEQ ID NO: 3415222 - RNA, 14 nt, Human
aaagcuagaaauga

SEQ ID NO: 3415223 - RNA, 19 nt, Human
aaagcuagaacacugccaa

SEQ ID NO: 3415224 - RNA, 13 nt, Human
aaagcuagaauug

SEQ ID NO: 3415225 - RNA, 14 nt, Human
aaagcuaggccugg

SEQ ID NO: 3415226 - RNA, 19 nt, Human
aaagcuagucaacaguacc

SEQ ID NO: 3415227 - RNA, 17 nt, Human
aaagcuauauaagacaa

SEQ ID NO: 3415228 - RNA, 18 nt, Human
aaagcuaucuucauguaa

SEQ ID NO: 3415229 - RNA, 14 nt, Human
aaagcucaaaugaa

SEQ ID NO: 3415230 - RNA, 18 nt, Human
aaagcucaaaugaaaugu

SEQ ID NO: 3415231 - RNA, 15 nt, Human
aaagcucacuuuacu

SEQ ID NO: 3415232 - RNA, 19 nt, Human
aaagcuccaugugccucuu

SEQ ID NO: 3415233 - RNA, 22 nt, Human
aaagcuccaugugccucuuugu

SEQ ID NO: 3415234 - RNA, 20 nt, Human
aaagcuccucgagggcaggg

SEQ ID NO: 3415235 - RNA, 13 nt, Human
aaagcuccugucc

SEQ ID NO: 3415236 - RNA, 16 nt, Human
aaagcuccuguccucc

SEQ ID NO: 3415237 - RNA, 19 nt, Human
aaagcugacgaggcugggc

SEQ ID NO: 3415238 - RNA, 18 nt, Human
aaagcugacuuggcuggu

SEQ ID NO: 3415239 - RNA, 17 nt, Human
aaagcugagaacuccug

SEQ ID NO: 3415240 - RNA, 20 nt, Human
aaagcugaucugguuugacu

SEQ ID NO: 3415241 - RNA, 22 nt, Human
aaagcugauuacugucaauaaa

SEQ ID NO: 3415242 - RNA, 22 nt, Human
aaagcugccagccgagauagcc

SEQ ID NO: 3415243 - RNA, 10 nt, Human
aaagcugccu

SEQ ID NO: 3415244 - RNA, 16 nt, Human
aaagcugccuguaguu

SEQ ID NO: 3415245 - RNA, 21 nt, Human
aaagcugccuguaguuaggaa

SEQ ID NO: 3415246 - RNA, 22 nt, Human
aaagcugcuaaaucuccuauuu

SEQ ID NO: 3415247 - RNA, 21 nt, Human
aaagcugcucagggaaaagca

SEQ ID NO: 3415248 - RNA, 20 nt, Human
aaagcugguggcagaguccu

SEQ ID NO: 3415249 - RNA, 22 nt, Human
aaagcuggugggugaaagaaau

SEQ ID NO: 3415250 - RNA, 15 nt, Human
aaagcugguuuaaug

SEQ ID NO: 3415251 - RNA, 16 nt, Human
aaagcugguuuaaugu

SEQ ID NO: 3415252 - RNA, 18 nt, Human
aaagcuguguguuuggaa

SEQ ID NO: 3415253 - RNA, 21 nt, Human
aaagcuguguuguugcuucuu

SEQ ID NO: 3415254 - RNA, 14 nt, Human
aaagcuguguuuau

SEQ ID NO: 3415255 - RNA, 17 nt, Human
aaagcuguucugucuuc

SEQ ID NO: 3415256 - RNA, 13 nt, Human
aaagcuguucuuc

SEQ ID NO: 3415257 - RNA, 19 nt, Human
aaagcuuaaaacuuugaag

SEQ ID NO: 3415258 - RNA, 16 nt, Human
aaagcuucacaguacc

SEQ ID NO: 3415259 - RNA, 14 nt, Human
aaagcuucagggaa

SEQ ID NO: 3415260 - RNA, 18 nt, Human
aaagcuuccaugauucua

SEQ ID NO: 3415261 - RNA, 12 nt, Human
aaagcuucuuaa

SEQ ID NO: 3415262 - RNA, 19 nt, Human
aaagcuugaguaaaauaaa

SEQ ID NO: 3415263 - RNA, 12 nt, Human
aaagcuuuauga

SEQ ID NO: 3415264 - RNA, 14 nt, Human
aaagcuuuguuugu

SEQ ID NO: 3415265 - RNA, 13 nt, Human
aaagcuuuugcau

SEQ ID NO: 3415266 - RNA, 17 nt, Human
aaagcuuuugcauauug

SEQ ID NO: 3415267 - RNA, 11 nt, Human
aaaggaaaaaa

SEQ ID NO: 3415268 - RNA, 14 nt, Human
aaaggaaaaaaaga

SEQ ID NO: 3415269 - RNA, 15 nt, Human
aaaggaaaaacaaac

SEQ ID NO: 3415270 - RNA, 15 nt, Human
aaaggaaaaaguauc

SEQ ID NO: 3415271 - RNA, 12 nt, Human
aaaggaaaagac

SEQ ID NO: 3415272 - RNA, 18 nt, Human
aaaggaaaauaguaaugu

SEQ ID NO: 3415273 - RNA, 12 nt, Human
aaaggaaaccuu

SEQ ID NO: 3415274 - RNA, 15 nt, Human
aaaggaaagaaaaca

SEQ ID NO: 3415275 - RNA, 15 nt, Human
aaaggaaaucaaaug

SEQ ID NO: 3415276 - RNA, 15 nt, Human
aaaggaaaugauuga

SEQ ID NO: 3415277 - RNA, 13 nt, Human
aaaggaagaaaaa

SEQ ID NO: 3415278 - RNA, 20 nt, Human
aaaggaagcauuguaaaaua

SEQ ID NO: 3415279 - RNA, 15 nt, Human
aaaggaagccaaaga

SEQ ID NO: 3415280 - RNA, 23 nt, Human
aaaggaagguaguucaagaaaug

SEQ ID NO: 3415281 - RNA, 18 nt, Human
aaaggaagugcccccucc

SEQ ID NO: 3415282 - RNA, 22 nt, Human
aaagauauaagugcuguauaaa

SEQ ID NO: 3415283 - RNA, 17 nt, Human
aaagauauauacacagg

SEQ ID NO: 3415284 - RNA, 12 nt, Human
aaagauauauua

SEQ ID NO: 3415285 - RNA, 20 nt, Human
aaagauauauuaaaaauaua

SEQ ID NO: 3415286 - RNA, 15 nt, Human
aaagauauggagaau

SEQ ID NO: 3415287 - RNA, 17 nt, Human
aaagauauuuugcuuug

SEQ ID NO: 3415288 - RNA, 16 nt, Human
aaagauauuuuuaucu

SEQ ID NO: 3415289 - RNA, 15 nt, Human
aaagaucauguaaaa

SEQ ID NO: 3415290 - RNA, 18 nt, Human
aaagaucuguccucagcc

SEQ ID NO: 3415291 - RNA, 21 nt, Human
aaagaucuguuuugaaggcaa

SEQ ID NO: 3415292 - RNA, 13 nt, Human
aaagaugaaaaua

SEQ ID NO: 3415293 - RNA, 16 nt, Human
aaagaugaaaauauuu

SEQ ID NO: 3415294 - RNA, 17 nt, Human
aaagaugaaagagcagu

SEQ ID NO: 3415295 - RNA, 21 nt, Human
aaagaugauuuaaaagggaag

SEQ ID NO: 3415296 - RNA, 13 nt, Human
aaagaugcacaga

SEQ ID NO: 3415297 - RNA, 19 nt, Human
aaagaugcacuuugcuuua

SEQ ID NO: 3415298 - RNA, 23 nt, Human
aaagaugcacuuugcuuuaauau

SEQ ID NO: 3415299 - RNA, 21 nt, Human
aaagaugcagccgccuuccuu

SEQ ID NO: 3415300 - RNA, 22 nt, Human
aaagaugcaucuaccgcucuug

SEQ ID NO: 3415301 - RNA, 22 nt, Human
aaagaugccggguuuuauauuu

SEQ ID NO: 3415302 - RNA, 19 nt, Human
aaagaugcuucucacugcc

SEQ ID NO: 3415303 - RNA, 17 nt, Human
aaagauggaguuucuaa

SEQ ID NO: 3415304 - RNA, 16 nt, Human
aaagauggaugugcuu

SEQ ID NO: 3415305 - RNA, 17 nt, Human
aaagauggggucuguaa

SEQ ID NO: 3415306 - RNA, 18 nt, Human
aaagauggggucuguaaa

SEQ ID NO: 3415307 - RNA, 23 nt, Human
aaagauggggucuguaaaaucuu

SEQ ID NO: 3415308 - RNA, 19 nt, Human
aaagaugguuaaacauuuu

SEQ ID NO: 3415309 - RNA, 12 nt, Human
aaagauguagca

SEQ ID NO: 3415310 - RNA, 20 nt, Human
aaagauguuugucagauaug

SEQ ID NO: 3415311 - RNA, 11 nt, Human
aaagauuaaac

SEQ ID NO: 3415312 - RNA, 14 nt, Human
aaagauuaaacugc

SEQ ID NO: 3415313 - RNA, 20 nt, Human
aaagauucuauaguucuaga

SEQ ID NO: 3415314 - RNA, 12 nt, Human
aaagauucuuuu

SEQ ID NO: 3415315 - RNA, 23 nt, Human
aaagauugaaguauuuugcugga

SEQ ID NO: 3415316 - RNA, 18 nt, Human
aaagauugacaccagguu

SEQ ID NO: 3415317 - RNA, 19 nt, Human
aaagauugcugaaauuuua

SEQ ID NO: 3415318 - RNA, 16 nt, Human
aaagauuguguggugu

SEQ ID NO: 3415319 - RNA, 12 nt, Human
aaagauuuauca

SEQ ID NO: 3415320 - RNA, 22 nt, Human
aaagauuuguacuacaguucuu

SEQ ID NO: 3415321 - RNA, 15 nt, Human
aaagauuuuaaucaa

SEQ ID NO: 3415322 - RNA, 18 nt, Human
aaagauuuuaaucaaguu

SEQ ID NO: 3415323 - RNA, 16 nt, Human
aaagauuuugaucuca

SEQ ID NO: 3415324 - RNA, 22 nt, Human
aaagauuuugaucucacauuuu

SEQ ID NO: 3415325 - RNA, 19 nt, Human
aaagauuuuuuaauaauuu

SEQ ID NO: 3415326 - RNA, 22 nt, Human
aaagauuuuuuaauaauuuaga

SEQ ID NO: 3415327 - RNA, 23 nt, Human
aaagauuuuuuuuuuuucucuca

SEQ ID NO: 3415328 - RNA, 15 nt, Human
aaagcaaaaaagaaa

SEQ ID NO: 3415329 - RNA, 21 nt, Human
aaagcaaaaaagaaaaccuuu

SEQ ID NO: 3415330 - RNA, 14 nt, Human
aaagcaaaaaugcu

SEQ ID NO: 3415331 - RNA, 18 nt, Human
aaagcaaaaaugcuaaua

SEQ ID NO: 3415332 - RNA, 13 nt, Human
aaagcaaaugaga

SEQ ID NO: 3415333 - RNA, 18 nt, Human
aaagcaacaucagcuuga

SEQ ID NO: 3415334 - RNA, 14 nt, Human
aaagcaagaaucag

SEQ ID NO: 3415335 - RNA, 20 nt, Human
aaagcaagcugauuaaauga

SEQ ID NO: 3415336 - RNA, 20 nt, Human
aaagcaaggaaacuauguaa

SEQ ID NO: 3415337 - RNA, 14 nt, Human
aaagcaaggaucuu

SEQ ID NO: 3415338 - RNA, 17 nt, Human
aaagcaaggaucuuuca

SEQ ID NO: 3415339 - RNA, 21 nt, Human
aaagcaauaaaauuuuuuugg

SEQ ID NO: 3415340 - RNA, 13 nt, Human
aaagcaauagaaa

SEQ ID NO: 3415341 - RNA, 12 nt, Human
aaagcaaugcau

SEQ ID NO: 3415342 - RNA, 23 nt, Human
aaagcaaugcugaugaaucacug

SEQ ID NO: 3415343 - RNA, 12 nt, Human
aaagcaauuuuc

SEQ ID NO: 3415344 - RNA, 13 nt, Human
aaagcaauuuucc

SEQ ID NO: 3415345 - RNA, 17 nt, Human
aaagcaauuuuccuuga

SEQ ID NO: 3415346 - RNA, 20 nt, Human
aaagcacacucauccccuca

SEQ ID NO: 3415347 - RNA, 15 nt, Human
aaagcacaggagaca

SEQ ID NO: 3415348 - RNA, 22 nt, Human
aaagcacaggugggcuucccag

SEQ ID NO: 3415349 - RNA, 21 nt, Human
aaagcacaguguuaaaugaaa

SEQ ID NO: 3415350 - RNA, 16 nt, Human
aaagcacaguuugaac

SEQ ID NO: 3415351 - RNA, 16 nt, Human
aaagcacauugaaaga

SEQ ID NO: 3415352 - RNA, 16 nt, Human
aaagcaccaaaauaag

SEQ ID NO: 3415353 - RNA, 23 nt, Human
aaagcaccaaaauaagaaaagau

SEQ ID NO: 3415354 - RNA, 14 nt, Human
aaagcacggacucu

SEQ ID NO: 3415355 - RNA, 15 nt, Human
aaagcacuagagaau

SEQ ID NO: 3415356 - RNA, 14 nt, Human
aaagcacugaccug

SEQ ID NO: 3415357 - RNA, 16 nt, Human
aaagcacuuggacucu

SEQ ID NO: 3415358 - RNA, 21 nt, Human
aaagcacuuggacucuugcuc

SEQ ID NO: 3415359 - RNA, 13 nt, Human
aaagcagaaaaua

SEQ ID NO: 3415360 - RNA, 14 nt, Human
aaagcagagauuuu

SEQ ID NO: 3415361 - RNA, 18 nt, Human
aaagcagcucuccccuca

SEQ ID NO: 3415362 - RNA, 22 nt, Human
aaagcaggcuugcccaguacau

SEQ ID NO: 3415363 - RNA, 18 nt, Human
aaagcagucacuuuuccu

SEQ ID NO: 3415364 - RNA, 21 nt, Human
aaagcagugcaugcugucccu

SEQ ID NO: 3415365 - RNA, 18 nt, Human
aaagcauaaaaacauuuu

SEQ ID NO: 3415366 - RNA, 21 nt, Human
aaagcauaaagcucaaaugaa

SEQ ID NO: 3415367 - RNA, 15 nt, Human
aaagcauaaaugcaa

SEQ ID NO: 3415368 - RNA, 18 nt, Human
aaagcauaaguauacagu

SEQ ID NO: 3415369 - RNA, 17 nt, Human
aaagcauagauguuuug

SEQ ID NO: 3415370 - RNA, 16 nt, Human
aaagcaucaccucagg

SEQ ID NO: 3415371 - RNA, 16 nt, Human
aaagcaucacuuggga

SEQ ID NO: 3415372 - RNA, 20 nt, Human
aaagcaucauggcuaucugu

SEQ ID NO: 3415373 - RNA, 13 nt, Human
aaagcauccaugu

SEQ ID NO: 3415374 - RNA, 12 nt, Human
aaagcaucccuc

SEQ ID NO: 3415375 - RNA, 15 nt, Human
aaagcaucuugcauu

SEQ ID NO: 3415376 - RNA, 16 nt, Human
aaagcaugaaauguga

SEQ ID NO: 3415377 - RNA, 18 nt, Human
aaagcaugaaaugugaau

SEQ ID NO: 3415378 - RNA, 18 nt, Human
aaagcauugcuguuaugu

SEQ ID NO: 3415379 - RNA, 22 nt, Human
aaagcauugcuuuuauuuugaa

SEQ ID NO: 3415380 - RNA, 15 nt, Human
aaagcauuguaaaug

SEQ ID NO: 3415381 - RNA, 19 nt, Human
aaagcauuguaaaugugcu

SEQ ID NO: 3415382 - RNA, 16 nt, Human
aaagcauuuacuuuga

SEQ ID NO: 3415383 - RNA, 12 nt, Human
aaagcauuuaua

SEQ ID NO: 3415384 - RNA, 13 nt, Human
aaagcauuugaau

SEQ ID NO: 3415385 - RNA, 17 nt, Human
aaagcauuugaaugcau

SEQ ID NO: 3415386 - RNA, 20 nt, Human
aaagcauuugaaugcauuuu

SEQ ID NO: 3415387 - RNA, 11 nt, Human
aaagcauuuuu

SEQ ID NO: 3415388 - RNA, 17 nt, Human
aaagccaaacucugcca

SEQ ID NO: 3415389 - RNA, 23 nt, Human
aaagccaacagucaaaacagaga

SEQ ID NO: 3415390 - RNA, 22 nt, Human
aaagccaaggagucacugagac

SEQ ID NO: 3415391 - RNA, 14 nt, Human
aaagccaagggcaa

SEQ ID NO: 3415392 - RNA, 23 nt, Human
aaagccaaguuuauauacaauua

SEQ ID NO: 3415393 - RNA, 19 nt, Human
aaagccacaaccacauaca

SEQ ID NO: 3415394 - RNA, 18 nt, Human
aaagccacauuauuucua

SEQ ID NO: 3415395 - RNA, 21 nt, Human
aaagccacauuauuucuaguc

SEQ ID NO: 3415396 - RNA, 17 nt, Human
aaagccaccucucccuc

SEQ ID NO: 3415397 - RNA, 16 nt, Human
aaagccacuagacucu

SEQ ID NO: 3415398 - RNA, 16 nt, Human
aaagccagggcuggag

SEQ ID NO: 3415399 - RNA, 14 nt, Human
aaagccagggucuc

SEQ ID NO: 3415400 - RNA, 15 nt, Human
aaagccaggucccuc

SEQ ID NO: 3415401 - RNA, 19 nt, Human
aaagccaggucccucucau

SEQ ID NO: 3415402 - RNA, 17 nt, Human
aaagccaucauguaaau

SEQ ID NO: 3415403 - RNA, 20 nt, Human
aaagccaucauguaaauuac

SEQ ID NO: 3415404 - RNA, 16 nt, Human
aaagccauguuuauua

SEQ ID NO: 3415405 - RNA, 23 nt, Human
aaagccauguuuauuacaguaua

SEQ ID NO: 3415406 - RNA, 16 nt, Human
aaagccauuuuaggcu

SEQ ID NO: 3415407 - RNA, 15 nt, Human
aaagcccaaaguggu

SEQ ID NO: 3415408 - RNA, 15 nt, Human
aaagcccaggagccc

SEQ ID NO: 3415409 - RNA, 17 nt, Human
aaagcccauucauucca

SEQ ID NO: 3415410 - RNA, 17 nt, Human
aaagccccaugcuggag

SEQ ID NO: 3415411 - RNA, 19 nt, Human
aaagccccaugcuggagcc

SEQ ID NO: 3415412 - RNA, 21 nt, Human
aaagccccaugcuggagccug

SEQ ID NO: 3415413 - RNA, 16 nt, Human
aaauaucugaacauuu

SEQ ID NO: 3415414 - RNA, 13 nt, Human
aaauaucuuuuau

SEQ ID NO: 3415415 - RNA, 14 nt, Human
aaauaucuuuuaug

SEQ ID NO: 3415416 - RNA, 20 nt, Human
aaauaucuuuuauguuugaa

SEQ ID NO: 3415417 - RNA, 23 nt, Human
aaauaucuuuuauguuugaauau

SEQ ID NO: 3415418 - RNA, 17 nt, Human
aaauaucuuuugaccug

SEQ ID NO: 3415419 - RNA, 23 nt, Human
aaauaugaaacauuuaaaauaua

SEQ ID NO: 3415420 - RNA, 18 nt, Human
aaauaugaacccuuuguu

SEQ ID NO: 3415421 - RNA, 19 nt, Human
aaauaugaacccuuuguuu

SEQ ID NO: 3415422 - RNA, 21 nt, Human
aaauaugauguuaaaaaaaua

SEQ ID NO: 3415423 - RNA, 19 nt, Human
aaauaugauuuuauuugac

SEQ ID NO: 3415424 - RNA, 10 nt, Human
aaauaugcaa

SEQ ID NO: 3415425 - RNA, 13 nt, Human
aaauaugcaaagc

SEQ ID NO: 3415426 - RNA, 12 nt, Human
aaauaugcaucu

SEQ ID NO: 3415427 - RNA, 12 nt, Human
aaaucaacuuuu

SEQ ID NO: 3415428 - RNA, 23 nt, Human
aaaucaacuuuuuauugccuucu

SEQ ID NO: 3415429 - RNA, 23 nt, Human
aaaucaaguauuugggaagugaa

SEQ ID NO: 3415430 - RNA, 17 nt, Human
aaaucaauacacuaguu

SEQ ID NO: 3415431 - RNA, 19 nt, Human
aaaucaaugcuauaacuau

SEQ ID NO: 3415432 - RNA, 13 nt, Human
aaaucaaugucac

SEQ ID NO: 3415433 - RNA, 16 nt, Human
aaaucacaauuuuuaa

SEQ ID NO: 3415434 - RNA, 19 nt, Human
aaaucacauauuuuaaaau

SEQ ID NO: 3415435 - RNA, 12 nt, Human
aaaucacauccu

SEQ ID NO: 3415436 - RNA, 20 nt, Human
aaaucaccacaaacuguaau

SEQ ID NO: 3415437 - RNA, 22 nt, Human
aaaucaccacaccaaaccucuc

SEQ ID NO: 3415438 - RNA, 22 nt, Human
aaaucagagacaaaauauuucc

SEQ ID NO: 3415439 - RNA, 21 nt, Human
aaaucagccaauuauguuaaa

SEQ ID NO: 3415440 - RNA, 23 nt, Human
aaaucagccaauuauguuaaacu

SEQ ID NO: 3415441 - RNA, 19 nt, Human
aaaucagccugcuccagcu

SEQ ID NO: 3415442 - RNA, 14 nt, Human
aaaucauaaaguca

SEQ ID NO: 3415443 - RNA, 22 nt, Human
aaaucauaggaaaguauuuuuu

SEQ ID NO: 3415444 - RNA, 23 nt, Human
aaaucauaggcaccuuuuacugu

SEQ ID NO: 3415445 - RNA, 19 nt, Human
aaaucauauuuggaauaaa

SEQ ID NO: 3415446 - RNA, 12 nt, Human
aaaucaucaaga

SEQ ID NO: 3415447 - RNA, 13 nt, Human
aaaucaucuauuu

SEQ ID NO: 3415448 - RNA, 14 nt, Human
aaaucaucuauuuu

SEQ ID NO: 3415449 - RNA, 17 nt, Human
aaaucauguacauuucu

SEQ ID NO: 3415450 - RNA, 13 nt, Human
aaaucauguuaug

SEQ ID NO: 3415451 - RNA, 18 nt, Human
aaaucauguuaugauaaa

SEQ ID NO: 3415452 - RNA, 19 nt, Human
aaaucauuaauacucuucu

SEQ ID NO: 3415453 - RNA, 21 nt, Human
aaaucauucuuacuaaaaagu

SEQ ID NO: 3415454 - RNA, 11 nt, Human
aaaucauuucu

SEQ ID NO: 3415455 - RNA, 19 nt, Human
aaaucauuucugcaucagc

SEQ ID NO: 3415456 - RNA, 12 nt, Human
aaaucauuuggg

SEQ ID NO: 3415457 - RNA, 17 nt, Human
aaaucauuuuaugucaa

SEQ ID NO: 3415458 - RNA, 18 nt, Human
aaauccaaauauuguuaa

SEQ ID NO: 3415459 - RNA, 22 nt, Human
aaauccagaaacuuguucuucc

SEQ ID NO: 3415460 - RNA, 11 nt, Human
aaauccaggac

SEQ ID NO: 3415461 - RNA, 14 nt, Human
aaauccauuuggaa

SEQ ID NO: 3415462 - RNA, 15 nt, Human
aaauccauuuggaaa

SEQ ID NO: 3415463 - RNA, 16 nt, Human
aaaucccauuauucaa

SEQ ID NO: 3415464 - RNA, 19 nt, Human
aaaucccauuauucaaagu

SEQ ID NO: 3415465 - RNA, 14 nt, Human
aaaucccuggauca

SEQ ID NO: 3415466 - RNA, 21 nt, Human
aaauccgaaccuccucuguga

SEQ ID NO: 3415467 - RNA, 18 nt, Human
aaauccgcucucuuccug

SEQ ID NO: 3415468 - RNA, 16 nt, Human
aaauccggagaagcug

SEQ ID NO: 3415469 - RNA, 19 nt, Human
aaauccuaccaaccucuga

SEQ ID NO: 3415470 - RNA, 16 nt, Human
aaauccuaugugauuu

SEQ ID NO: 3415471 - RNA, 17 nt, Human
aaauccuguugaaaagc

SEQ ID NO: 3415472 - RNA, 21 nt, Human
aaauccuguugaaaagccaug

SEQ ID NO: 3415473 - RNA, 16 nt, Human
aaauccuuccaugaaa

SEQ ID NO: 3415474 - RNA, 15 nt, Human
aaauccuucccaagu

SEQ ID NO: 3415475 - RNA, 14 nt, Human
aaauccuucuaauc

SEQ ID NO: 3415476 - RNA, 14 nt, Human
aaauccuugaagau

SEQ ID NO: 3415477 - RNA, 16 nt, Human
aaauccuuuacuguua

SEQ ID NO: 3415478 - RNA, 20 nt, Human
aaaucgaaugaaauuaacug

SEQ ID NO: 3415479 - RNA, 13 nt, Human
aaaucgcuuuuga

SEQ ID NO: 3415480 - RNA, 14 nt, Human
aaaucgcuuuugau

SEQ ID NO: 3415481 - RNA, 21 nt, Human
aaaucuaagcagcuuauuguu

SEQ ID NO: 3415482 - RNA, 19 nt, Human
aaaucuaauauuaaaaaua

SEQ ID NO: 3415483 - RNA, 15 nt, Human
aaaucuaccuucugu

SEQ ID NO: 3415484 - RNA, 17 nt, Human
aaaucuaccuucuguag

SEQ ID NO: 3415485 - RNA, 18 nt, Human
aaaucuaccuucuguagu

SEQ ID NO: 3415486 - RNA, 16 nt, Human
aaaucuaggaaaauau

SEQ ID NO: 3415487 - RNA, 22 nt, Human
aaaucuaggaaaauuauucuau

SEQ ID NO: 3415488 - RNA, 22 nt, Human
aaaucuaguauuucaugcuggg

SEQ ID NO: 3415489 - RNA, 14 nt, Human
aaaucuauagaaag

SEQ ID NO: 3415490 - RNA, 22 nt, Human
aaaucuauagaaaguguucugu

SEQ ID NO: 3415491 - RNA, 16 nt, Human
aaaucuaugauuccag

SEQ ID NO: 3415492 - RNA, 13 nt, Human
aaaucuaugccac

SEQ ID NO: 3415493 - RNA, 13 nt, Human
aaaucuauucaga

SEQ ID NO: 3415494 - RNA, 19 nt, Human
aaaucuauucagacaagca

SEQ ID NO: 3415495 - RNA, 19 nt, Human
aaaucucaaauuucuaaau

SEQ ID NO: 3415496 - RNA, 23 nt, Human
aaaucucaaauuuggauugcuaa

SEQ ID NO: 3415497 - RNA, 16 nt, Human
aaaucucaauucuucc

SEQ ID NO: 3415498 - RNA, 15 nt, Human
aaaucucagcaauga

SEQ ID NO: 3415499 - RNA, 11 nt, Human
aaaucucauac

SEQ ID NO: 3415500 - RNA, 23 nt, Human
aaaucucauacucccccacaguu

SEQ ID NO: 3415501 - RNA, 19 nt, Human
aaaucuccaaaauaaaacu

SEQ ID NO: 3415502 - RNA, 22 nt, Human
aaaucuccaaaauaaaacuuuu

SEQ ID NO: 3415503 - RNA, 18 nt, Human
aaaucucccauuuuggaa

SEQ ID NO: 3415504 - RNA, 21 nt, Human
aaaucucccauuuuggaauuu

SEQ ID NO: 3415505 - RNA, 14 nt, Human
aaaucuccuauuuu

SEQ ID NO: 3415506 - RNA, 13 nt, Human
aaaucucuccacu

SEQ ID NO: 3415507 - RNA, 19 nt, Human
aaaucucuccacuuucagc

SEQ ID NO: 3415508 - RNA, 21 nt, Human
aaaucucucucuguuguguuc

SEQ ID NO: 3415509 - RNA, 13 nt, Human
aaaucucuucugu

SEQ ID NO: 3415510 - RNA, 11 nt, Human
aaaucugaaga

SEQ ID NO: 3415511 - RNA, 13 nt, Human
aaaucugaagacc

SEQ ID NO: 3415512 - RNA, 15 nt, Human
aaaucugaagauugc

SEQ ID NO: 3415513 - RNA, 17 nt, Human
aaaucugaagauuguuu

SEQ ID NO: 3415514 - RNA, 20 nt, Human
aaaucugaagauuguuuauc

SEQ ID NO: 3415515 - RNA, 17 nt, Human
aaaucugaccaaaacaa

SEQ ID NO: 3415516 - RNA, 18 nt, Human
aaaucugacccagugccc

SEQ ID NO: 3415517 - RNA, 20 nt, Human
aaaucugagggaaauguuuu

SEQ ID NO: 3415518 - RNA, 13 nt, Human
aaaucugcagagg

SEQ ID NO: 3415519 - RNA, 11 nt, Human
aaaucugccac

SEQ ID NO: 3415520 - RNA, 13 nt, Human
aaaucugccuggg

SEQ ID NO: 3415521 - RNA, 20 nt, Human
aaaucugcuggaguuucaug

SEQ ID NO: 3415522 - RNA, 18 nt, Human
aaaucugcuuuuuaaaga

SEQ ID NO: 3415523 - RNA, 12 nt, Human
aaaucuggaagc

SEQ ID NO: 3415524 - RNA, 19 nt, Human
aaaucuguaacagguauuu

SEQ ID NO: 3415525 - RNA, 22 nt, Human
aaaucuguaacagguauuuugu

SEQ ID NO: 3415526 - RNA, 23 nt, Human
aaaucuguaacagguauuuuguu

SEQ ID NO: 3415527 - RNA, 17 nt, Human
aaaucuguaagcucuuu

SEQ ID NO: 3415528 - RNA, 19 nt, Human
aaaucuguaagcucuuuga

SEQ ID NO: 3415529 - RNA, 20 nt, Human
aaaucugucaagaguaguua

SEQ ID NO: 3415530 - RNA, 14 nt, Human
aaaucugucugcug

SEQ ID NO: 3415531 - RNA, 20 nt, Human
aaaucugugaacuugaaauu

SEQ ID NO: 3415532 - RNA, 20 nt, Human
aaaucuguguauauuauuug

SEQ ID NO: 3415533 - RNA, 15 nt, Human
aaaucuguucuaaca

SEQ ID NO: 3415534 - RNA, 12 nt, Human
aaaucuuaagaa

SEQ ID NO: 3415535 - RNA, 14 nt, Human
aaaucuuaagaaau

SEQ ID NO: 3415536 - RNA, 16 nt, Human
aaaucuuaagaaauaa

SEQ ID NO: 3415537 - RNA, 19 nt, Human
aaaucuuaauacuguuauu

SEQ ID NO: 3415538 - RNA, 13 nt, Human
aaaucuuacaaca

SEQ ID NO: 3415539 - RNA, 17 nt, Human
aaaucuuauaguucuag

SEQ ID NO: 3415540 - RNA, 20 nt, Human
aaaucuuauaguucuaggca

SEQ ID NO: 3415541 - RNA, 12 nt, Human
aaaucuuauuaa

SEQ ID NO: 3415542 - RNA, 21 nt, Human
aaaucuuauuaaaguuucaaa

SEQ ID NO: 3415543 - RNA, 16 nt, Human
aaaucuucauggaauu

SEQ ID NO: 3415544 - RNA, 20 nt, Human
aaaucuucauggaauucaca

SEQ ID NO: 3415545 - RNA, 14 nt, Human
aaaucuuccaauuu

SEQ ID NO: 3415546 - RNA, 23 nt, Human
aaaucuuccuggucgaaaguuag

SEQ ID NO: 3415547 - RNA, 15 nt, Human
aaaucuucuccagau

SEQ ID NO: 3415548 - RNA, 13 nt, Human
aaaucuugaaauu

SEQ ID NO: 3415549 - RNA, 13 nt, Human
aaaucuuggaagu

SEQ ID NO: 3415550 - RNA, 22 nt, Human
aaaucuugguugaugccaaaaa

SEQ ID NO: 3415551 - RNA, 11 nt, Human
aaaucuuuuac

SEQ ID NO: 3415552 - RNA, 14 nt, Human
aaaucuuuucuauu

SEQ ID NO: 3415553 - RNA, 14 nt, Human
aaaucuuuuugcuu

SEQ ID NO: 3415554 - RNA, 13 nt, Human
aaaucuuuuuugu

SEQ ID NO: 3415555 - RNA, 14 nt, Human
aaaugaaaaaauau

SEQ ID NO: 3415556 - RNA, 21 nt, Human
aaaugaaaacaguguguaaac

SEQ ID NO: 3415557 - RNA, 11 nt, Human
aaaugaaaaua

SEQ ID NO: 3415558 - RNA, 15 nt, Human
aaaugaaaaugucuu

SEQ ID NO: 3415559 - RNA, 16 nt, Human
aaaugaaaaugucuug

SEQ ID NO: 3415560 - RNA, 14 nt, Human
aaaugaaagaaaau

SEQ ID NO: 3415561 - RNA, 15 nt, Human
aaaugaaagaaaauu

SEQ ID NO: 3415562 - RNA, 21 nt, Human
aaaugaaagcagggacuugaa

SEQ ID NO: 3415563 - RNA, 22 nt, Human
aaaugaaagcagggacuugaac

SEQ ID NO: 3415564 - RNA, 18 nt, Human
aaaugaaagcaugucuca

SEQ ID NO: 3415565 - RNA, 14 nt, Human
aaaugaaagcuacu

SEQ ID NO: 3415566 - RNA, 12 nt, Human
aaaugaaauguu

SEQ ID NO: 3415567 - RNA, 22 nt, Human
aaaugaaauuacuacaaaauuu

SEQ ID NO: 3415568 - RNA, 15 nt, Human
aaaugaaauuguaaa

SEQ ID NO: 3415569 - RNA, 22 nt, Human
aaagcccccagagcccaggcuc

SEQ ID NO: 3415570 - RNA, 22 nt, Human
aaagcccuuccaugucgccucu

SEQ ID NO: 3415571 - RNA, 23 nt, Human
aaagccguuguuuacuuaaagau

SEQ ID NO: 3415572 - RNA, 16 nt, Human
aaaggguguuuuucug

SEQ ID NO: 3415573 - RNA, 16 nt, Human
aaagguauaauuuuau

SEQ ID NO: 3415574 - RNA, 19 nt, Human
aaaucuauagaaaguguuc

SEQ ID NO: 3415575 - RNA, 20 nt, Human
aaaucuaugccacucagaau

SEQ ID NO: 3415576 - RNA, 15 nt, Human
aaaucuauucugugu

SEQ ID NO: 3415577 - RNA, 22 nt, Human
aaaucuauuuauuaauauuuaa

SEQ ID NO: 3415578 - RNA, 15 nt, Human
aaaucucaaauuucu

SEQ ID NO: 3415579 - RNA, 16 nt, Human
aaaucucaaauuucua

SEQ ID NO: 3415580 - RNA, 18 nt, Human
aaaucucaauauuucaga

SEQ ID NO: 3415581 - RNA, 16 nt, Human
aaaucucccauuuugg

SEQ ID NO: 3415582 - RNA, 20 nt, Human
aaaucucccauuuuggaauu

SEQ ID NO: 3415583 - RNA, 13 nt, Human
aaaucuccuauuu

SEQ ID NO: 3415584 - RNA, 15 nt, Human
aaaucuccuauuuuu

SEQ ID NO: 3415585 - RNA, 12 nt, Human
aaaucucuaaua

SEQ ID NO: 3415586 - RNA, 13 nt, Human
aaaucucuaauau

SEQ ID NO: 3415587 - RNA, 22 nt, Human
aaaucucuacaaauuuuucugu

SEQ ID NO: 3415588 - RNA, 20 nt, Human
aaaucucuccacuuucagcu

SEQ ID NO: 3415589 - RNA, 21 nt, Human
aaaucucuccacuuucagcug

SEQ ID NO: 3415590 - RNA, 13 nt, Human
aaaucugaacauu

SEQ ID NO: 3415591 - RNA, 18 nt, Human
aaaucugaagauuguuua

SEQ ID NO: 3415592 - RNA, 23 nt, Human
aaaucugaagauuguuuaucuag

SEQ ID NO: 3415593 - RNA, 20 nt, Human
aaaucugacccagugccccc

SEQ ID NO: 3415594 - RNA, 23 nt, Human
aaaucugcagaaggaaaaaugug

SEQ ID NO: 3415595 - RNA, 15 nt, Human
aaaucugcuguuaac

SEQ ID NO: 3415596 - RNA, 18 nt, Human
aaaucuggcuucuggcca

SEQ ID NO: 3415597 - RNA, 20 nt, Human
aaaucuggucuuguuagaaa

SEQ ID NO: 3415598 - RNA, 15 nt, Human
aaaucugugaacuug

SEQ ID NO: 3415599 - RNA, 21 nt, Human
aaaucugugaacuugaaauuu

SEQ ID NO: 3415600 - RNA, 12 nt, Human
aaaucuguguau

SEQ ID NO: 3415601 - RNA, 22 nt, Human
aaaucuguguauauuauuuggc

SEQ ID NO: 3415602 - RNA, 20 nt, Human
aaaucuguucugggcucuuu

SEQ ID NO: 3415603 - RNA, 18 nt, Human
aaaucuguuugaucccug

SEQ ID NO: 3415604 - RNA, 14 nt, Human
aaaucuuaaaaagu

SEQ ID NO: 3415605 - RNA, 14 nt, Human
aaaucuuaacuuga

SEQ ID NO: 3415606 - RNA, 13 nt, Human
aaaucuuaagaaa

SEQ ID NO: 3415607 - RNA, 13 nt, Human
aaaucuuaauguu

SEQ ID NO: 3415608 - RNA, 23 nt, Human
aaaucuuaauguuccucaaagcu

SEQ ID NO: 3415609 - RNA, 16 nt, Human
aaaucuuauaguucua

SEQ ID NO: 3415610 - RNA, 18 nt, Human
aaaucuuauaguucuagg

SEQ ID NO: 3415611 - RNA, 19 nt, Human
aaaucuuauaguucuaggc

SEQ ID NO: 3415612 - RNA, 19 nt, Human
aaaucuuauauuccauaua

SEQ ID NO: 3415613 - RNA, 21 nt, Human
aaaucuuauauuccauauauu

SEQ ID NO: 3415614 - RNA, 19 nt, Human
aaaucuuauuaaaguuuca

SEQ ID NO: 3415615 - RNA, 22 nt, Human
aaaucuuauuaaaguuucaaaa

SEQ ID NO: 3415616 - RNA, 22 nt, Human
aaaucuucauggaauucacaaa

SEQ ID NO: 3415617 - RNA, 13 nt, Human
aaaucuucccaug

SEQ ID NO: 3415618 - RNA, 23 nt, Human
aaaucuuggaaguacaugaauac

SEQ ID NO: 3415619 - RNA, 20 nt, Human
aaaucuugguugaugccaaa

SEQ ID NO: 3415620 - RNA, 18 nt, Human
aaaucuugucauguguau

SEQ ID NO: 3415621 - RNA, 19 nt, Human
aaaucuugucauguguaua

SEQ ID NO: 3415622 - RNA, 21 nt, Human
aaaucuugucauguguauaaa

SEQ ID NO: 3415623 - RNA, 20 nt, Human
aaaucuugugcuagaauacu

SEQ ID NO: 3415624 - RNA, 23 nt, Human
aaaucuuucuuucuuagaaauuu

SEQ ID NO: 3415625 - RNA, 22 nt, Human
aaaucuuuuaaaaauucaaaug

SEQ ID NO: 3415626 - RNA, 17 nt, Human
aaaucuuuugaagcaua

SEQ ID NO: 3415627 - RNA, 20 nt, Human
aaaugaaaaacaaccaagcg

SEQ ID NO: 3415628 - RNA, 17 nt, Human
aaaugaaaaugucuugu

SEQ ID NO: 3415629 - RNA, 11 nt, Human
aaaugaaaauu

SEQ ID NO: 3415630 - RNA, 12 nt, Human
aaaugaaaauug

SEQ ID NO: 3415631 - RNA, 14 nt, Human
aaaugaaaauugua

SEQ ID NO: 3415632 - RNA, 14 nt, Human
aaaugaaagaugau

SEQ ID NO: 3415633 - RNA, 15 nt, Human
aaaugaaagaugauu

SEQ ID NO: 3415634 - RNA, 13 nt, Human
aaaugaaagcuac

SEQ ID NO: 3415635 - RNA, 21 nt, Human
aaaugaaauauauuuaaaaua

SEQ ID NO: 3415636 - RNA, 13 nt, Human
aaaugaaauauuu

SEQ ID NO: 3415637 - RNA, 12 nt, Human
aaaugaaaugca

SEQ ID NO: 3415638 - RNA, 15 nt, Human
aaaugaaauguaugc

SEQ ID NO: 3415639 - RNA, 14 nt, Human
aaaugaaauguuuu

SEQ ID NO: 3415640 - RNA, 21 nt, Human
aaaugaaauguuuuaaggcuu

SEQ ID NO: 3415641 - RNA, 11 nt, Human
aaaugaaauuu

SEQ ID NO: 3415642 - RNA, 15 nt, Human
aaaugaaauuuaaac

SEQ ID NO: 3415643 - RNA, 16 nt, Human
aaaugaaauuuaaaca

SEQ ID NO: 3415644 - RNA, 14 nt, Human
aaaugaaauuuuac

SEQ ID NO: 3415645 - RNA, 21 nt, Human
aaaugaacaagagaagcauuc

SEQ ID NO: 3415646 - RNA, 15 nt, Human
aaaugaacacaaauu

SEQ ID NO: 3415647 - RNA, 18 nt, Human
aaaugaacaucagaauuu

SEQ ID NO: 3415648 - RNA, 23 nt, Human
aaaugaacgauauguagcagaaa

SEQ ID NO: 3415649 - RNA, 18 nt, Human
aaaugaagaauuuaaaga

SEQ ID NO: 3415650 - RNA, 19 nt, Human
aaaugaagguuaggauuua

SEQ ID NO: 3415651 - RNA, 20 nt, Human
aaaugaagugcaaauuugau

SEQ ID NO: 3415652 - RNA, 16 nt, Human
aaaugaauggcucacu

SEQ ID NO: 3415653 - RNA, 20 nt, Human
aaaugacacucauauaauua

SEQ ID NO: 3415654 - RNA, 15 nt, Human
aaaugacaucuuuuu

SEQ ID NO: 3415655 - RNA, 21 nt, Human
aaaugaccaguaauugugaaa

SEQ ID NO: 3415656 - RNA, 17 nt, Human
aaaugacuacuuagcau

SEQ ID NO: 3415657 - RNA, 13 nt, Human
aaaugagaaaucu

SEQ ID NO: 3415658 - RNA, 14 nt, Human
aaaugagaacaugu

SEQ ID NO: 3415659 - RNA, 15 nt, Human
aaaugagaucaggcu

SEQ ID NO: 3415660 - RNA, 23 nt, Human
aaaugagcucgcauuugucaaug

SEQ ID NO: 3415661 - RNA, 18 nt, Human
aaaugaggauuauugaua

SEQ ID NO: 3415662 - RNA, 23 nt, Human
aaaugagguacucuccuggaaau

SEQ ID NO: 3415663 - RNA, 19 nt, Human
aaaugaggucagagccugc

SEQ ID NO: 3415664 - RNA, 16 nt, Human
aaaugaggucuguuua

SEQ ID NO: 3415665 - RNA, 12 nt, Human
aaaugaguaaca

SEQ ID NO: 3415666 - RNA, 18 nt, Human
aaaugaguguguuuguca

SEQ ID NO: 3415667 - RNA, 19 nt, Human
aaaugauauuaaaaauugg

SEQ ID NO: 3415668 - RNA, 20 nt, Human
aaaugauauuaaaaauuggc

SEQ ID NO: 3415669 - RNA, 16 nt, Human
aaaugaucaguuuuuu

SEQ ID NO: 3415670 - RNA, 22 nt, Human
aaaugauccccaagugugaaca

SEQ ID NO: 3415671 - RNA, 22 nt, Human
aaaugaugauguggaagaacuu

SEQ ID NO: 3415672 - RNA, 23 nt, Human
aaaugauguucauuuagauugaa

SEQ ID NO: 3415673 - RNA, 21 nt, Human
aaaugauuuguaguggaaaca

SEQ ID NO: 3415674 - RNA, 23 nt, Human
aaaugauuuuuacaaguuuuaaa

SEQ ID NO: 3415675 - RNA, 20 nt, Human
aaaugcaaaaaaucuuaaua

SEQ ID NO: 3415676 - RNA, 16 nt, Human
aaaugcaaaaaucucu

SEQ ID NO: 3415677 - RNA, 17 nt, Human
aaaugcaaacacacaaa

SEQ ID NO: 3415678 - RNA, 21 nt, Human
aaaugcaaacacacaaaggua

SEQ ID NO: 3415679 - RNA, 22 nt, Human
aaaugcaaacugggcuggaaga

SEQ ID NO: 3415680 - RNA, 15 nt, Human
aaaugcaaaguucug

SEQ ID NO: 3415681 - RNA, 19 nt, Human
aaaugcaaaguucuguguu

SEQ ID NO: 3415682 - RNA, 21 nt, Human
aaaugcaaauccuaugugauu

SEQ ID NO: 3415683 - RNA, 14 nt, Human
aaaugcaagauuuu

SEQ ID NO: 3415684 - RNA, 13 nt, Human
aaaugcaauaugu

SEQ ID NO: 3415685 - RNA, 16 nt, Human
aaaugcaauauguauu

SEQ ID NO: 3415686 - RNA, 12 nt, Human
aaaugcacaaug

SEQ ID NO: 3415687 - RNA, 19 nt, Human
aaaugcacauagcuaucaa

SEQ ID NO: 3415688 - RNA, 20 nt, Human
aaaugcacccaacuagcucu

SEQ ID NO: 3415689 - RNA, 14 nt, Human
aaaugcaccuggaa

SEQ ID NO: 3415690 - RNA, 12 nt, Human
aaaugcagccca

SEQ ID NO: 3415691 - RNA, 14 nt, Human
aaaugcaguauauu

SEQ ID NO: 3415692 - RNA, 17 nt, Human
aaaugcaguuacaaauu

SEQ ID NO: 3415693 - RNA, 19 nt, Human
aaaugcauauccugagcca

SEQ ID NO: 3415694 - RNA, 21 nt, Human
aaaugcaucaauccugugugg

SEQ ID NO: 3415695 - RNA, 16 nt, Human
aaaugcauccauuccu

SEQ ID NO: 3415696 - RNA, 23 nt, Human
aaaugcauccauuccucagggac

SEQ ID NO: 3415697 - RNA, 15 nt, Human
aaaugcaucuuugau

SEQ ID NO: 3415698 - RNA, 14 nt, Human
aaaugcaugauuuu

SEQ ID NO: 3415699 - RNA, 18 nt, Human
aaaugcaugauuuuguaa

SEQ ID NO: 3415700 - RNA, 13 nt, Human
aaaugcauuguau

SEQ ID NO: 3415701 - RNA, 20 nt, Human
aaaugccauaauacaaaagg

SEQ ID NO: 3415702 - RNA, 23 nt, Human
aaaugccauaauacaaaaggcuc

SEQ ID NO: 3415703 - RNA, 22 nt, Human
aaaugccaugaugccucugucu

SEQ ID NO: 3415704 - RNA, 22 nt, Human
aaaugccauuuauuuauugauu

SEQ ID NO: 3415705 - RNA, 13 nt, Human
aaaugcccagccc

SEQ ID NO: 3415706 - RNA, 14 nt, Human
aaaugcccagcccc

SEQ ID NO: 3415707 - RNA, 22 nt, Human
aaaugcccuuacacuuacuguu

SEQ ID NO: 3415708 - RNA, 15 nt, Human
aaaugccuaagaaga

SEQ ID NO: 3415709 - RNA, 16 nt, Human
aaaugccuaagaagau

SEQ ID NO: 3415710 - RNA, 15 nt, Human
aaaugccuuacuuug

SEQ ID NO: 3415711 - RNA, 16 nt, Human
aaaugccuuacuuugu

SEQ ID NO: 3415712 - RNA, 23 nt, Human
aaaugccuuagaaauguaaacug

SEQ ID NO: 3415713 - RNA, 15 nt, Human
aaaugccuuuguacu

SEQ ID NO: 3415714 - RNA, 16 nt, Human
aaaugccuuuucccaa

SEQ ID NO: 3415715 - RNA, 18 nt, Human
aaaugcuaauauuaaaag

SEQ ID NO: 3415716 - RNA, 15 nt, Human
aaauguugaauaaaa

SEQ ID NO: 3415717 - RNA, 23 nt, Human
aaauguugaauaaaaauauguac

SEQ ID NO: 3415718 - RNA, 20 nt, Human
aaauguugacauaccuuuua

SEQ ID NO: 3415719 - RNA, 23 nt, Human
aaauguugacaugggacauuugc

SEQ ID NO: 3415720 - RNA, 19 nt, Human
aaauguugagaaucccaaa

SEQ ID NO: 3415721 - RNA, 11 nt, Human
aaauguugcug

SEQ ID NO: 3415722 - RNA, 20 nt, Human
aaauguuggauuuauaaaug

SEQ ID NO: 3415723 - RNA, 15 nt, Human
aaauguuuauuuaaa

SEQ ID NO: 3415724 - RNA, 15 nt, Human
aaauguuucugcagu

SEQ ID NO: 3415725 - RNA, 19 nt, Human
aaauguuucuuuuguuugg

SEQ ID NO: 3415726 - RNA, 23 nt, Human
aaauguuuuaaggcuucaauuua

SEQ ID NO: 3415727 - RNA, 14 nt, Human
aaauguuuuauaag

SEQ ID NO: 3415728 - RNA, 22 nt, Human
aaauguuuucauauuuuucaaa

SEQ ID NO: 3415729 - RNA, 11 nt, Human
aaauguuuugc

SEQ ID NO: 3415730 - RNA, 19 nt, Human
aaauguuuuguaagaaacc

SEQ ID NO: 3415731 - RNA, 17 nt, Human
aaauguuuuucuaugua

SEQ ID NO: 3415732 - RNA, 20 nt, Human
aaagguauuuuaaucaccaa

SEQ ID NO: 3415733 - RNA, 18 nt, Human
aaagguauuuugaauacc

SEQ ID NO: 3415734 - RNA, 24 nt, Human
aaaggucaccucacucagcaccac

SEQ ID NO: 3415735 - RNA, 21 nt, Human
aaagguccacaggucuagacu

SEQ ID NO: 3415736 - RNA, 14 nt, Human
aaaggugaaggaau

SEQ ID NO: 3415737 - RNA, 22 nt, Human
aaaggugaccuugcaacuucau

SEQ ID NO: 3415738 - RNA, 19 nt, Human
aaagguggacuggaagggg

SEQ ID NO: 3415739 - RNA, 21 nt, Human
aaagguggccacaaauucuuu

SEQ ID NO: 3415740 - RNA, 17 nt, Human
aaaggugguaugugugu

SEQ ID NO: 3415741 - RNA, 19 nt, Human
aaaggugguaugugugugu

SEQ ID NO: 3415742 - RNA, 15 nt, Human
aaagguguauuuaaa

SEQ ID NO: 3415743 - RNA, 17 nt, Human
aaaggugugagacuggg

SEQ ID NO: 3415744 - RNA, 19 nt, Human
aaagguuagagaauaaauu

SEQ ID NO: 3415745 - RNA, 18 nt, Human
aaagguuauuuucuccug

SEQ ID NO: 3415746 - RNA, 18 nt, Human
aaagguucaugcaaacuu

SEQ ID NO: 3415747 - RNA, 15 nt, Human
aaagguucuucaucc

SEQ ID NO: 3415748 - RNA, 21 nt, Human
aaagguucuucaucccuuucc

SEQ ID NO: 3415749 - RNA, 22 nt, Human
aaagguucuucaucccuuucca

SEQ ID NO: 3415750 - RNA, 16 nt, Human
aaagguuuaaaugaac

SEQ ID NO: 3415751 - RNA, 20 nt, Human
aaagguuuaaaugaacaaga

SEQ ID NO: 3415752 - RNA, 22 nt, Human
aaagguuuaaaugaacaagaga

SEQ ID NO: 3415753 - RNA, 20 nt, Human
aaagguuuaagaaauagaau

SEQ ID NO: 3415754 - RNA, 21 nt, Human
aaagguuuauuuuucuguuac

SEQ ID NO: 3415755 - RNA, 18 nt, Human
aaagguuuuuuuucaguu

SEQ ID NO: 3415756 - RNA, 21 nt, Human
aaaguaaaaacaaagaaauua

SEQ ID NO: 3415757 - RNA, 14 nt, Human
aaaguaaaaugucu

SEQ ID NO: 3415758 - RNA, 12 nt, Human
aaaguaaagcua

SEQ ID NO: 3415759 - RNA, 14 nt, Human
aaaguaacucauuu

SEQ ID NO: 3415760 - RNA, 19 nt, Human
aaaguaaguaccacucagg

SEQ ID NO: 3415761 - RNA, 22 nt, Human
aaaguaauuucuucucaaaggg

SEQ ID NO: 3415762 - RNA, 14 nt, Human
aaaguaauuuggaa

SEQ ID NO: 3415763 - RNA, 16 nt, Human
aaaguacaauguguuu

SEQ ID NO: 3415764 - RNA, 18 nt, Human
aaaguacacuguuucaaa

SEQ ID NO: 3415765 - RNA, 20 nt, Human
aaaguacacuguuucaaacu

SEQ ID NO: 3415766 - RNA, 18 nt, Human
aaaguacagguacuuugu

SEQ ID NO: 3415767 - RNA, 17 nt, Human
aaaguacauauuuauuu

SEQ ID NO: 3415768 - RNA, 13 nt, Human
aaaguacauuuaa

SEQ ID NO: 3415769 - RNA, 15 nt, Human
aaaguacauuuaaua

SEQ ID NO: 3415770 - RNA, 21 nt, Human
aaaguacugagcagugauauu

SEQ ID NO: 3415771 - RNA, 20 nt, Human
aaaguacuucuccacccugc

SEQ ID NO: 3415772 - RNA, 18 nt, Human
aaaguacuugaguguaau

SEQ ID NO: 3415773 - RNA, 16 nt, Human
aaaguagaacuuugua

SEQ ID NO: 3415774 - RNA, 17 nt, Human
aaaguagaacuuuguau

SEQ ID NO: 3415775 - RNA, 20 nt, Human
aaaguagaagaggguuuuag

SEQ ID NO: 3415776 - RNA, 22 nt, Human
aaaguagaucaugcauagagug

SEQ ID NO: 3415777 - RNA, 14 nt, Human
aaaguaguaaaaau

SEQ ID NO: 3415778 - RNA, 21 nt, Human
aaaguaguaaaaauuaaaaaa

SEQ ID NO: 3415779 - RNA, 20 nt, Human
aaaguaguacuucuucugua

SEQ ID NO: 3415780 - RNA, 13 nt, Human
aaaguauaauguu

SEQ ID NO: 3415781 - RNA, 16 nt, Human
aaaguauaauguuuau

SEQ ID NO: 3415782 - RNA, 23 nt, Human
aaaguauaauguuuauuaaaugc

SEQ ID NO: 3415783 - RNA, 13 nt, Human
aaaguauauauag

SEQ ID NO: 3415784 - RNA, 14 nt, Human
aaaguauauguuag

SEQ ID NO: 3415785 - RNA, 22 nt, Human
aaaguaucauggaaauauuaug

SEQ ID NO: 3415786 - RNA, 19 nt, Human
aaaguaugcauuauuaaau

SEQ ID NO: 3415787 - RNA, 20 nt, Human
aaaguaugcauuauuaaauu

SEQ ID NO: 3415788 - RNA, 17 nt, Human
aaaguauguauuauuua

SEQ ID NO: 3415789 - RNA, 16 nt, Human
aaaguauguuuuacuu

SEQ ID NO: 3415790 - RNA, 15 nt, Human
aaaguauuaaaaugc

SEQ ID NO: 3415791 - RNA, 19 nt, Human
aaaguauuaagcauauauu

SEQ ID NO: 3415792 - RNA, 15 nt, Human
aaaguauuauuuucc

SEQ ID NO: 3415793 - RNA, 16 nt, Human
aaaguauuauuuucca

SEQ ID NO: 3415794 - RNA, 20 nt, Human
aaaguauuccaccuuaaauu

SEQ ID NO: 3415795 - RNA, 21 nt, Human
aaaguauuccaccuuaaauua

SEQ ID NO: 3415796 - RNA, 19 nt, Human
aaaguauucuguacucuua

SEQ ID NO: 3415797 - RNA, 12 nt, Human
aaaguauucuuc

SEQ ID NO: 3415798 - RNA, 18 nt, Human
aaaguauucuuuuucuuu

SEQ ID NO: 3415799 - RNA, 13 nt, Human
aaaguauugccaa

SEQ ID NO: 3415800 - RNA, 13 nt, Human
aaaguauuguaaa

SEQ ID NO: 3415801 - RNA, 20 nt, Human
aaaguauuguaaauuauauu

SEQ ID NO: 3415802 - RNA, 23 nt, Human
aaaguauuguaaauuauauuugu

SEQ ID NO: 3415803 - RNA, 17 nt, Human
aaaguauuuaauuagug

SEQ ID NO: 3415804 - RNA, 20 nt, Human
aaaguauuuaauuagugcua

SEQ ID NO: 3415805 - RNA, 21 nt, Human
aaaguauuuaauuagugcuaa

SEQ ID NO: 3415806 - RNA, 13 nt, Human
aaaguauuuuccu

SEQ ID NO: 3415807 - RNA, 18 nt, Human
aaaguauuuugaaguuua

SEQ ID NO: 3415808 - RNA, 14 nt, Human
aaagucacaauguu

SEQ ID NO: 3415809 - RNA, 22 nt, Human
aaagucacuuacuauuguugcu

SEQ ID NO: 3415810 - RNA, 15 nt, Human
aaagucagaaguuuu

SEQ ID NO: 3415811 - RNA, 14 nt, Human
aaagucagaaucag

SEQ ID NO: 3415812 - RNA, 15 nt, Human
aaagucagagacaga

SEQ ID NO: 3415813 - RNA, 15 nt, Human
aaagucaggaaucau

SEQ ID NO: 3415814 - RNA, 23 nt, Human
aaagucaguugcucaaaaagaaa

SEQ ID NO: 3415815 - RNA, 17 nt, Human
aaagucauaauugcauu

SEQ ID NO: 3415816 - RNA, 21 nt, Human
aaagucaugauguuuuuaaaa

SEQ ID NO: 3415817 - RNA, 22 nt, Human
aaagucaugauguuuuuaaaau

SEQ ID NO: 3415818 - RNA, 19 nt, Human
aaagucaugcaaaggcugg

SEQ ID NO: 3415819 - RNA, 13 nt, Human
aaagucauuggcu

SEQ ID NO: 3415820 - RNA, 17 nt, Human
aaagucauuggcuuuau

SEQ ID NO: 3415821 - RNA, 21 nt, Human
aaaguccauaccuuauauaug

SEQ ID NO: 3415822 - RNA, 12 nt, Human
aaaguccccaga

SEQ ID NO: 3415823 - RNA, 18 nt, Human
aaaguccuuuucuugcuu

SEQ ID NO: 3415824 - RNA, 16 nt, Human
aaaguccuuuuuuucc

SEQ ID NO: 3415825 - RNA, 15 nt, Human
aaagucguuuuccaa

SEQ ID NO: 3415826 - RNA, 16 nt, Human
aaagucguuuuccaaa

SEQ ID NO: 3415827 - RNA, 18 nt, Human
aaagucguuuuccaaacu

SEQ ID NO: 3415828 - RNA, 17 nt, Human
aaagucucuauuuaaau

SEQ ID NO: 3415829 - RNA, 21 nt, Human
aaagucucuauuuaaauucuu

SEQ ID NO: 3415830 - RNA, 14 nt, Human
aaagucuguccuug

SEQ ID NO: 3415831 - RNA, 18 nt, Human
aaagucugucuuuccuga

SEQ ID NO: 3415832 - RNA, 23 nt, Human
aaagucugugugaugaacuuucu

SEQ ID NO: 3415833 - RNA, 19 nt, Human
aaagucuguugauuaaaga

SEQ ID NO: 3415834 - RNA, 20 nt, Human
aaagucuguugauuaaagau

SEQ ID NO: 3415835 - RNA, 20 nt, Human
aaagucuugcuguggucucu

SEQ ID NO: 3415836 - RNA, 15 nt, Human
aaagucuugugacua

SEQ ID NO: 3415837 - RNA, 18 nt, Human
aaagucuugugacuagug

SEQ ID NO: 3415838 - RNA, 21 nt, Human
aaagucuugugacuagugcug

SEQ ID NO: 3415839 - RNA, 13 nt, Human
aaagucuuuuaaa

SEQ ID NO: 3415840 - RNA, 14 nt, Human
aaagucuuuuaaaa

SEQ ID NO: 3415841 - RNA, 15 nt, Human
aaagucuuuuaaaaa

SEQ ID NO: 3415842 - RNA, 16 nt, Human
aaagucuuuuaaaaag

SEQ ID NO: 3415843 - RNA, 20 nt, Human
aaagucuuuuaaaaaguauu

SEQ ID NO: 3415844 - RNA, 18 nt, Human
aaagucuuuuuuuuccug

SEQ ID NO: 3415845 - RNA, 15 nt, Human
aaagugaauaaaaau

SEQ ID NO: 3415846 - RNA, 16 nt, Human
aaagugaauaaacuuc

SEQ ID NO: 3415847 - RNA, 19 nt, Human
aaagugaauaaacuucagc

SEQ ID NO: 3415848 - RNA, 15 nt, Human
aaagugaaugaaaga

SEQ ID NO: 3415849 - RNA, 21 nt, Human
aaagugauaauuucuggaauu

SEQ ID NO: 3415850 - RNA, 17 nt, Human
aaagugaugacauauuu

SEQ ID NO: 3415851 - RNA, 23 nt, Human
aaagugcagcuccguuuggcagu

SEQ ID NO: 3415852 - RNA, 14 nt, Human
aaagugcauuuuug

SEQ ID NO: 3415853 - RNA, 15 nt, Human
aaagugccaaagaaa

SEQ ID NO: 3415854 - RNA, 16 nt, Human
aaagugccagaaagug

SEQ ID NO: 3415855 - RNA, 19 nt, Human
aaagugccauuaacaaaug

SEQ ID NO: 3415856 - RNA, 12 nt, Human
aaagugcccagc

SEQ ID NO: 3415857 - RNA, 17 nt, Human
aaagugccucaagagga

SEQ ID NO: 3415858 - RNA, 16 nt, Human
aaagugccuuucagga

SEQ ID NO: 3415859 - RNA, 23 nt, Human
aaagugccuuucaggaucuauuu

SEQ ID NO: 3415860 - RNA, 14 nt, Human
aacaccacagacac

SEQ ID NO: 3415861 - RNA, 19 nt, Human
aacaccacagacacacaca

SEQ ID NO: 3415862 - RNA, 17 nt, Human
aacaccagccccugccc

SEQ ID NO: 3415863 - RNA, 21 nt, Human
aacaccagguuuauggaaaau

SEQ ID NO: 3415864 - RNA, 19 nt, Human
aacaccaugauuccuuuaa

SEQ ID NO: 3415865 - RNA, 20 nt, Human
aacaccaugauuccuuuaac

SEQ ID NO: 3415866 - RNA, 17 nt, Human
aacaccauugaaggcuu

SEQ ID NO: 3415867 - RNA, 15 nt, Human
aacacccacaggcau

SEQ ID NO: 3415868 - RNA, 20 nt, Human
aacacccagucuguucccca

SEQ ID NO: 3415869 - RNA, 16 nt, Human
aacacccauuuuuccu

SEQ ID NO: 3415870 - RNA, 21 nt, Human
aacaccccucaguugugcagc

SEQ ID NO: 3415871 - RNA, 16 nt, Human
aacacccuauauuuug

SEQ ID NO: 3415872 - RNA, 18 nt, Human
aacacccucgaagcgcgc

SEQ ID NO: 3415873 - RNA, 14 nt, Human
aacacccuuagaaa

SEQ ID NO: 3415874 - RNA, 12 nt, Human
aacacccuuccu

SEQ ID NO: 3415875 - RNA, 20 nt, Human
aacaccgcuucugccuuuuc

SEQ ID NO: 3415876 - RNA, 16 nt, Human
aacaccuagaucagaa

SEQ ID NO: 3415877 - RNA, 18 nt, Human
aacaccugacagccccuc

SEQ ID NO: 3415878 - RNA, 15 nt, Human
aacaccugaugugua

SEQ ID NO: 3415879 - RNA, 19 nt, Human
aacaccuucuauagcauca

SEQ ID NO: 3415880 - RNA, 13 nt, Human
aacaccuucucug

SEQ ID NO: 3415881 - RNA, 20 nt, Human
aacaccuucuuauuauauau

SEQ ID NO: 3415882 - RNA, 12 nt, Human
aacacgaaacuu

SEQ ID NO: 3415883 - RNA, 14 nt, Human
aacacgaaacuugu

SEQ ID NO: 3415884 - RNA, 20 nt, Human
aacacgaaacuuguuauugu

SEQ ID NO: 3415885 - RNA, 14 nt, Human
aacacgcaccugcc

SEQ ID NO: 3415886 - RNA, 19 nt, Human
aacacgcaccugccucagg

SEQ ID NO: 3415887 - RNA, 21 nt, Human
aacacggccacaucaaagagg

SEQ ID NO: 3415888 - RNA, 15 nt, Human
aacacgugaugugau

SEQ ID NO: 3415889 - RNA, 20 nt, Human
aacacuaaagauccaagaag

SEQ ID NO: 3415890 - RNA, 13 nt, Human
aacacuaaauguu

SEQ ID NO: 3415891 - RNA, 16 nt, Human
aacacuaaauguuaaa

SEQ ID NO: 3415892 - RNA, 18 nt, Human
aacacuaacauauaaugu

SEQ ID NO: 3415893 - RNA, 17 nt, Human
aacacuaacaugauuug

SEQ ID NO: 3415894 - RNA, 11 nt, Human
aacacuaaccu

SEQ ID NO: 3415895 - RNA, 18 nt, Human
aacacuaacuaugcaugg

SEQ ID NO: 3415896 - RNA, 13 nt, Human
aacacuaauauau

SEQ ID NO: 3415897 - RNA, 23 nt, Human
aacacuaauauauuuaaaaauaa

SEQ ID NO: 3415898 - RNA, 23 nt, Human
aacacuagggccuuggaaauucc

SEQ ID NO: 3415899 - RNA, 16 nt, Human
aacacuauuuucagaa

SEQ ID NO: 3415900 - RNA, 18 nt, Human
aacacuauuuucagaauc

SEQ ID NO: 3415901 - RNA, 17 nt, Human
aacacucaagaagcagg

SEQ ID NO: 3415902 - RNA, 18 nt, Human
aacacucagaagccuggg

SEQ ID NO: 3415903 - RNA, 19 nt, Human
aacacucagaagccugggg

SEQ ID NO: 3415904 - RNA, 14 nt, Human
aacacucagcuguu

SEQ ID NO: 3415905 - RNA, 14 nt, Human
aacacucaugcuga

SEQ ID NO: 3415906 - RNA, 17 nt, Human
aacacuccaauuaagga

SEQ ID NO: 3415907 - RNA, 13 nt, Human
aacacuccucugc

SEQ ID NO: 3415908 - RNA, 16 nt, Human
aacacucuuuugcuuu

SEQ ID NO: 3415909 - RNA, 15 nt, Human
aacacugaaaaauua

SEQ ID NO: 3415910 - RNA, 14 nt, Human
aacacugauuuccc

SEQ ID NO: 3415911 - RNA, 12 nt, Human
aacacugccagc

SEQ ID NO: 3415912 - RNA, 23 nt, Human
aacacugccuuuuuauuuauaug

SEQ ID NO: 3415913 - RNA, 17 nt, Human
aacacugcuuguguuuu

SEQ ID NO: 3415914 - RNA, 19 nt, Human
aacacuggcaacaacaaag

SEQ ID NO: 3415915 - RNA, 15 nt, Human
aacacuggcagacug

SEQ ID NO: 3415916 - RNA, 23 nt, Human
aacacuggucugcuguuccagug

SEQ ID NO: 3415917 - RNA, 19 nt, Human
aacacuguaguaaauaaug

SEQ ID NO: 3415918 - RNA, 20 nt, Human
aacacugugcacaucugugu

SEQ ID NO: 3415919 - RNA, 16 nt, Human
aacacugugcccuggu

SEQ ID NO: 3415920 - RNA, 12 nt, Human
aacacuguuauc

SEQ ID NO: 3415921 - RNA, 15 nt, Human
aacacuguucucugc

SEQ ID NO: 3415922 - RNA, 15 nt, Human
aacacuuauugcuuu

SEQ ID NO: 3415923 - RNA, 11 nt, Human
aacacuuccau

SEQ ID NO: 3415924 - RNA, 19 nt, Human
aacacuucuguccugugag

SEQ ID NO: 3415925 - RNA, 21 nt, Human
aacacuucuguccugugaggu

SEQ ID NO: 3415926 - RNA, 16 nt, Human
aacacuugugacuuuu

SEQ ID NO: 3415927 - RNA, 22 nt, Human
aacacuugugacuuuugcuuua

SEQ ID NO: 3415928 - RNA, 23 nt, Human
aacacuugugacuuuugcuuuaa

SEQ ID NO: 3415929 - RNA, 16 nt, Human
aacagaaaaaaaacac

SEQ ID NO: 3415930 - RNA, 11 nt, Human
aacagaaaaca

SEQ ID NO: 3415931 - RNA, 19 nt, Human
aacagaaaacauucugauu

SEQ ID NO: 3415932 - RNA, 16 nt, Human
aacagaaacaaaaaca

SEQ ID NO: 3415933 - RNA, 19 nt, Human
aacagaaagucauuccuuc

SEQ ID NO: 3415934 - RNA, 14 nt, Human
aaauauaagccuuu

SEQ ID NO: 3415935 - RNA, 16 nt, Human
aaauauaauucuguaa

SEQ ID NO: 3415936 - RNA, 17 nt, Human
aaauauaauucuguaaa

SEQ ID NO: 3415937 - RNA, 18 nt, Human
aaauauaauucuguaaau

SEQ ID NO: 3415938 - RNA, 19 nt, Human
aaauauaauuguuuuuuau

SEQ ID NO: 3415939 - RNA, 18 nt, Human
aaauauacauguuuaugu

SEQ ID NO: 3415940 - RNA, 12 nt, Human
aaauauacugua

SEQ ID NO: 3415941 - RNA, 13 nt, Human
aaauauacuguaa

SEQ ID NO: 3415942 - RNA, 17 nt, Human
aaauauacuguaaagaa

SEQ ID NO: 3415943 - RNA, 12 nt, Human
aaauauagauua

SEQ ID NO: 3415944 - RNA, 18 nt, Human
aaauauagauuagaaaaa

SEQ ID NO: 3415945 - RNA, 21 nt, Human
aaauauagcuguacaaauaua

SEQ ID NO: 3415946 - RNA, 21 nt, Human
aaauauauaaaaagaaaagau

SEQ ID NO: 3415947 - RNA, 14 nt, Human
aaauauauacucaa

SEQ ID NO: 3415948 - RNA, 10 nt, Human
aaauauauau

SEQ ID NO: 3415949 - RNA, 14 nt, Human
aaauauauauaaac

SEQ ID NO: 3415950 - RNA, 14 nt, Human
aaauauauauaaau

SEQ ID NO: 3415951 - RNA, 19 nt, Human
aaauauauauaaauauaua

SEQ ID NO: 3415952 - RNA, 16 nt, Human
aaauauauauacauau

SEQ ID NO: 3415953 - RNA, 19 nt, Human
aaauauauauacauaugua

SEQ ID NO: 3415954 - RNA, 12 nt, Human
aaauauauauau

SEQ ID NO: 3415955 - RNA, 19 nt, Human
aaauauauauauauauaaa

SEQ ID NO: 3415956 - RNA, 12 nt, Human
aaauauauauua

SEQ ID NO: 3415957 - RNA, 17 nt, Human
aaauauauauuauacuu

SEQ ID NO: 3415958 - RNA, 22 nt, Human
aaauauauauuauacuuguaau

SEQ ID NO: 3415959 - RNA, 20 nt, Human
aaauauauggucuaauguuu

SEQ ID NO: 3415960 - RNA, 12 nt, Human
aaauauauguau

SEQ ID NO: 3415961 - RNA, 14 nt, Human
aaauauauguaugu

SEQ ID NO: 3415962 - RNA, 22 nt, Human
aaauauauguauuuuuauauaa

SEQ ID NO: 3415963 - RNA, 20 nt, Human
aaauauauuuaagauaauua

SEQ ID NO: 3415964 - RNA, 22 nt, Human
aaauauauuuaagauaauuaua

SEQ ID NO: 3415965 - RNA, 21 nt, Human
aaauaucaaagucauuaaaga

SEQ ID NO: 3415966 - RNA, 22 nt, Human
aaauaucaaagucauuaaagac

SEQ ID NO: 3415967 - RNA, 12 nt, Human
aaauaucaaauu

SEQ ID NO: 3415968 - RNA, 15 nt, Human
aaauaucagacuagu

SEQ ID NO: 3415969 - RNA, 14 nt, Human
aaauaucauucagc

SEQ ID NO: 3415970 - RNA, 13 nt, Human
aaauaucauugua

SEQ ID NO: 3415971 - RNA, 20 nt, Human
aaauaucuaguaauauauuu

SEQ ID NO: 3415972 - RNA, 10 nt, Human
aaauaucuga

SEQ ID NO: 3415973 - RNA, 14 nt, Human
aaauaucugaaaau

SEQ ID NO: 3415974 - RNA, 22 nt, Human
aaauaucugaaaauguaugugu

SEQ ID NO: 3415975 - RNA, 23 nt, Human
aaauaucugaaaauguaugugua

SEQ ID NO: 3415976 - RNA, 17 nt, Human
aaauaucugaacauuua

SEQ ID NO: 3415977 - RNA, 23 nt, Human
aaauaucugagcucuuugcacua

SEQ ID NO: 3415978 - RNA, 23 nt, Human
aaauaucuguaagaguguuuaua

SEQ ID NO: 3415979 - RNA, 13 nt, Human
aaauaucuguauu

SEQ ID NO: 3415980 - RNA, 15 nt, Human
aaauaucugugaaau

SEQ ID NO: 3415981 - RNA, 15 nt, Human
aaauaucuugaaagg

SEQ ID NO: 3415982 - RNA, 14 nt, Human
aaauaucuuggccu

SEQ ID NO: 3415983 - RNA, 21 nt, Human
aaauaucuuguguuguccuuu

SEQ ID NO: 3415984 - RNA, 22 nt, Human
aaauaucuuuuauguuugaaua

SEQ ID NO: 3415985 - RNA, 17 nt, Human
aaauaugaagaacugag

SEQ ID NO: 3415986 - RNA, 20 nt, Human
aaauaugaagacauaaaccc

SEQ ID NO: 3415987 - RNA, 12 nt, Human
aaauaugaaugc

SEQ ID NO: 3415988 - RNA, 19 nt, Human
aaauaugauauugcauaug

SEQ ID NO: 3415989 - RNA, 20 nt, Human
aaauaugauuuuauuugaca

SEQ ID NO: 3415990 - RNA, 16 nt, Human
aaauaugcaaagcacu

SEQ ID NO: 3415991 - RNA, 19 nt, Human
aaauaugcacuaagucucu

SEQ ID NO: 3415992 - RNA, 21 nt, Human
aaauaugcacuaagucucuuu

SEQ ID NO: 3415993 - RNA, 14 nt, Human
aaauaugcagugau

SEQ ID NO: 3415994 - RNA, 23 nt, Human
aaauaugcagugauauggcagaa

SEQ ID NO: 3415995 - RNA, 14 nt, Human
aaauaugccucucc

SEQ ID NO: 3415996 - RNA, 21 nt, Human
aaauaugccucuccuuuguau

SEQ ID NO: 3415997 - RNA, 22 nt, Human
aaauaugccucuccuuuguaua

SEQ ID NO: 3415998 - RNA, 15 nt, Human
aaauaugcuaauuug

SEQ ID NO: 3415999 - RNA, 16 nt, Human
aaauauggaacuuaca

SEQ ID NO: 3416000 - RNA, 21 nt, Human
aaauauggaacuuacauuguu

SEQ ID NO: 3416001 - RNA, 16 nt, Human
aaauauggaacuucua

SEQ ID NO: 3416002 - RNA, 16 nt, Human
aaauauggacacuuaa

SEQ ID NO: 3416003 - RNA, 20 nt, Human
aaauauggacacuuaauacu

SEQ ID NO: 3416004 - RNA, 18 nt, Human
aaauauggacugcucagg

SEQ ID NO: 3416005 - RNA, 19 nt, Human
aaauauggcuauaaauaua

SEQ ID NO: 3416006 - RNA, 12 nt, Human
aaauauguauua

SEQ ID NO: 3416007 - RNA, 21 nt, Human
aaauauguccauaucuaacca

SEQ ID NO: 3416008 - RNA, 18 nt, Human
aaauaugucucgcuagug

SEQ ID NO: 3416009 - RNA, 24 nt, Human
aaauaugugagauuuuuuauugcu

SEQ ID NO: 3416010 - RNA, 22 nt, Human
aaauauguuucacacaaacaag

SEQ ID NO: 3416011 - RNA, 12 nt, Human
aaauauuaaaaa

SEQ ID NO: 3416012 - RNA, 22 nt, Human
aaauauuaaaaagucuuuuaaa

SEQ ID NO: 3416013 - RNA, 19 nt, Human
aaauauuaagaaagacuau

SEQ ID NO: 3416014 - RNA, 15 nt, Human
aaauauuaagcaugu

SEQ ID NO: 3416015 - RNA, 14 nt, Human
aaauauuagaaaca

SEQ ID NO: 3416016 - RNA, 15 nt, Human
aaauauuagauguga

SEQ ID NO: 3416017 - RNA, 20 nt, Human
aaauauuagaugugauuuaa

SEQ ID NO: 3416018 - RNA, 19 nt, Human
aaauauuaggcuuaaaaac

SEQ ID NO: 3416019 - RNA, 15 nt, Human
aaauauuaucuuugu

SEQ ID NO: 3416020 - RNA, 22 nt, Human
aaauauuaucuuuguaauuauu

SEQ ID NO: 3416021 - RNA, 16 nt, Human
aaauauuaugagaugc

SEQ ID NO: 3416022 - RNA, 16 nt, Human
aaauauuauucuuaau

SEQ ID NO: 3416023 - RNA, 13 nt, Human
aaauauuauuugu

SEQ ID NO: 3416024 - RNA, 20 nt, Human
aaauauuauuuuaugaaagg

SEQ ID NO: 3416025 - RNA, 20 nt, Human
aaauauuccugcauuuguga

SEQ ID NO: 3416026 - RNA, 19 nt, Human
aaauauuccuuugcauauu

SEQ ID NO: 3416027 - RNA, 14 nt, Human
aaauauucuauaug

SEQ ID NO: 3416028 - RNA, 15 nt, Human
aaauauucucuauuu

SEQ ID NO: 3416029 - RNA, 23 nt, Human
aaauauucuucuauaaaugaauc

SEQ ID NO: 3416030 - RNA, 21 nt, Human
aaauauugaaaggcaaacauu

SEQ ID NO: 3416031 - RNA, 19 nt, Human
aaauauugacuuuuuaugg

SEQ ID NO: 3416032 - RNA, 18 nt, Human
aaauauugaggcuuugug

SEQ ID NO: 3416033 - RNA, 20 nt, Human
aaauauugaggcuuuguguu

SEQ ID NO: 3416034 - RNA, 12 nt, Human
aaauauugucuu

SEQ ID NO: 3416035 - RNA, 17 nt, Human
aaauauugucuuuuugu

SEQ ID NO: 3416036 - RNA, 20 nt, Human
aaauauugucuuuuuguaug

SEQ ID NO: 3416037 - RNA, 14 nt, Human
aaauauuuaaaaau

SEQ ID NO: 3416038 - RNA, 17 nt, Human
aaauauuuaauguugaa

SEQ ID NO: 3416039 - RNA, 16 nt, Human
aaauauuuagcaaaua

SEQ ID NO: 3416040 - RNA, 22 nt, Human
aaauauuuauuaaauaaaauca

SEQ ID NO: 3416041 - RNA, 23 nt, Human
aaauauuuauuaaauaaaaucaa

SEQ ID NO: 3416042 - RNA, 15 nt, Human
aaauauuuauuuuaa

SEQ ID NO: 3416043 - RNA, 21 nt, Human
aaauauuuauuuuaauaaugu

SEQ ID NO: 3416044 - RNA, 12 nt, Human
aaauauuucaag

SEQ ID NO: 3416045 - RNA, 13 nt, Human
aaauauuucaaga

SEQ ID NO: 3416046 - RNA, 17 nt, Human
aaauauuugacuauucu

SEQ ID NO: 3416047 - RNA, 15 nt, Human
aaauauuuguacaua

SEQ ID NO: 3416048 - RNA, 20 nt, Human
aaauauuuuaauuuuuaaau

SEQ ID NO: 3416049 - RNA, 14 nt, Human
aaauauuuucuauu

SEQ ID NO: 3416050 - RNA, 19 nt, Human
aaauauuuucuauuuuaag

SEQ ID NO: 3416051 - RNA, 12 nt, Human
aaauauuuucuc

SEQ ID NO: 3416052 - RNA, 13 nt, Human
aaauauuuucugu

SEQ ID NO: 3416053 - RNA, 14 nt, Human
aaauauuuucugug

SEQ ID NO: 3416054 - RNA, 15 nt, Human
aaauauuuucugugu

SEQ ID NO: 3416055 - RNA, 16 nt, Human
aaauauuuucugugug

SEQ ID NO: 3416056 - RNA, 18 nt, Human
aaauauuuucuguguguu

SEQ ID NO: 3416057 - RNA, 21 nt, Human
aaauauuuucuguguguuccu

SEQ ID NO: 3416058 - RNA, 17 nt, Human
aaauauuuugaucuuca

SEQ ID NO: 3416059 - RNA, 15 nt, Human
aaauauuuugucuaa

SEQ ID NO: 3416060 - RNA, 22 nt, Human
aaauauuuugucuaaaaugccu

SEQ ID NO: 3416061 - RNA, 14 nt, Human
aaauauuuuuagua

SEQ ID NO: 3416062 - RNA, 23 nt, Human
aaauauuuuuauagauuugaccu

SEQ ID NO: 3416063 - RNA, 20 nt, Human
aaauauuuuuuuguagauga

SEQ ID NO: 3416064 - RNA, 21 nt, Human
aaauauuuuuuuguagaugaa

SEQ ID NO: 3416065 - RNA, 13 nt, Human
aaaucaaagugcu

SEQ ID NO: 3416066 - RNA, 14 nt, Human
aaaucaaagugcua

SEQ ID NO: 3416067 - RNA, 15 nt, Human
aaaucaaagugcuau

SEQ ID NO: 3416068 - RNA, 12 nt, Human
aaaucaaauaug

SEQ ID NO: 3416069 - RNA, 14 nt, Human
aaaucaaauaugca

SEQ ID NO: 3416070 - RNA, 16 nt, Human
aaaucaaauaugcaaa

SEQ ID NO: 3416071 - RNA, 16 nt, Human
aaaucaacagaagcau

SEQ ID NO: 3416072 - RNA, 22 nt, Human
aaaucaacagaagcauuuguau

SEQ ID NO: 3416073 - RNA, 16 nt, Human
aaaucaacuuaacaug

SEQ ID NO: 3416074 - RNA, 11 nt, Human
aaaucaacuuu

SEQ ID NO: 3416075 - RNA, 21 nt, Human
aaaucaacuuuuuauugccuu

SEQ ID NO: 3416076 - RNA, 21 nt, Human
aaaucaagcagguuagagaaa

SEQ ID NO: 3416077 - RNA, 12 nt, Human
aaaucaaguauu

SEQ ID NO: 3416078 - RNA, 17 nt, Human
aaaucaaguauuauaaa

SEQ ID NO: 3416079 - RNA, 17 nt, Human
aaaucaauaaaugaaua

SEQ ID NO: 3416080 - RNA, 15 nt, Human
aaaucaauacacuag

SEQ ID NO: 3416081 - RNA, 15 nt, Human
aaaucaauaguugaa

SEQ ID NO: 3416082 - RNA, 14 nt, Human
aaaucaauuuuuag

SEQ ID NO: 3416083 - RNA, 19 nt, Human
aaaucaccacaaacuguaa

SEQ ID NO: 3416084 - RNA, 13 nt, Human
aacagggucucua

SEQ ID NO: 3416085 - RNA, 20 nt, Human
aacagggucucuagugcugu

SEQ ID NO: 3416086 - RNA, 15 nt, Human
aacagguaauauaaa

SEQ ID NO: 3416087 - RNA, 14 nt, Human
aacagguauuuugu

SEQ ID NO: 3416088 - RNA, 22 nt, Human
aacagguauuuuguuucuuuua

SEQ ID NO: 3416089 - RNA, 17 nt, Human
aacaggucuccucuuaa

SEQ ID NO: 3416090 - RNA, 19 nt, Human
aacaggucuccucuuaaaa

SEQ ID NO: 3416091 - RNA, 20 nt, Human
aacaggucuccucuuaaaaa

SEQ ID NO: 3416092 - RNA, 14 nt, Human
aacagguggagaaa

SEQ ID NO: 3416093 - RNA, 19 nt, Human
aacagguggcaggaccagg

SEQ ID NO: 3416094 - RNA, 21 nt, Human
aacagguggcaggaccaggac

SEQ ID NO: 3416095 - RNA, 23 nt, Human
aacagguggcaggaccaggacua

SEQ ID NO: 3416096 - RNA, 20 nt, Human
aacagguuauuuuaguuucu

SEQ ID NO: 3416097 - RNA, 16 nt, Human
aacagguuuuauaauu

SEQ ID NO: 3416098 - RNA, 13 nt, Human
aacaguaaaccac

SEQ ID NO: 3416099 - RNA, 15 nt, Human
aacaguaaaccacug

SEQ ID NO: 3416100 - RNA, 16 nt, Human
aacaguaaaccacuga

SEQ ID NO: 3416101 - RNA, 14 nt, Human
aacaguaaucaguu

SEQ ID NO: 3416102 - RNA, 21 nt, Human
aacaguacccugguugugugu

SEQ ID NO: 3416103 - RNA, 12 nt, Human
aacaguagcaua

SEQ ID NO: 3416104 - RNA, 18 nt, Human
aacaguaucucaaacaau

SEQ ID NO: 3416105 - RNA, 20 nt, Human
aacaguauuuauuuuguaau

SEQ ID NO: 3416106 - RNA, 12 nt, Human
aacagucauguu

SEQ ID NO: 3416107 - RNA, 14 nt, Human
aacagucauguuuu

SEQ ID NO: 3416108 - RNA, 13 nt, Human
aacagucucagga

SEQ ID NO: 3416109 - RNA, 17 nt, Human
aacagucucaggaaauc

SEQ ID NO: 3416110 - RNA, 17 nt, Human
aacagucuucaggcaaa

SEQ ID NO: 3416111 - RNA, 20 nt, Human
aacagugaaguuuuacuguc

SEQ ID NO: 3416112 - RNA, 23 nt, Human
aacagugagagacuccauaguuu

SEQ ID NO: 3416113 - RNA, 20 nt, Human
aacagugauuuuuuuuuaga

SEQ ID NO: 3416114 - RNA, 17 nt, Human
aacagugcaacacuggu

SEQ ID NO: 3416115 - RNA, 19 nt, Human
aacagugccauugucuuua

SEQ ID NO: 3416116 - RNA, 23 nt, Human
aacagugcuaaaaaugggacuuc

SEQ ID NO: 3416117 - RNA, 15 nt, Human
aacagugcuguuucc

SEQ ID NO: 3416118 - RNA, 15 nt, Human
aacaguggaauauaa

SEQ ID NO: 3416119 - RNA, 14 nt, Human
aacaguggaucaca

SEQ ID NO: 3416120 - RNA, 16 nt, Human
aacaguggggaagagu

SEQ ID NO: 3416121 - RNA, 13 nt, Human
aacagugugaagu

SEQ ID NO: 3416122 - RNA, 20 nt, Human
aacagugugaaguuagaauu

SEQ ID NO: 3416123 - RNA, 18 nt, Human
aacagugugcaaggcagc

SEQ ID NO: 3416124 - RNA, 13 nt, Human
aacaguguuuaaa

SEQ ID NO: 3416125 - RNA, 18 nt, Human
aacaguguuucccauaau

SEQ ID NO: 3416126 - RNA, 13 nt, Human
aacaguguuuuca

SEQ ID NO: 3416127 - RNA, 13 nt, Human
aacaguuaacuuu

SEQ ID NO: 3416128 - RNA, 20 nt, Human
aacaguuaacuuucagaaga

SEQ ID NO: 3416129 - RNA, 14 nt, Human
aacaguuccuucag

SEQ ID NO: 3416130 - RNA, 17 nt, Human
aacaguuccuuucaaag

SEQ ID NO: 3416131 - RNA, 14 nt, Human
aacaguugguaacu

SEQ ID NO: 3416132 - RNA, 21 nt, Human
aacaguugguaacuuuuguga

SEQ ID NO: 3416133 - RNA, 22 nt, Human
aacaguugguaacuuuugugaa

SEQ ID NO: 3416134 - RNA, 13 nt, Human
aacaguuuaauga

SEQ ID NO: 3416135 - RNA, 22 nt, Human
aacaguuuaugcagugcugcuu

SEQ ID NO: 3416136 - RNA, 14 nt, Human
aacaguuuguacag

SEQ ID NO: 3416137 - RNA, 17 nt, Human
aacaguuuuccaugaaa

SEQ ID NO: 3416138 - RNA, 19 nt, Human
aacaguuuuccaugaaaac

SEQ ID NO: 3416139 - RNA, 20 nt, Human
aacaguuuuccuaugcuuug

SEQ ID NO: 3416140 - RNA, 21 nt, Human
aacaguuuuccuaugcuuuga

SEQ ID NO: 3416141 - RNA, 12 nt, Human
aacaguuuugug

SEQ ID NO: 3416142 - RNA, 21 nt, Human
aacaguuuuuuaugcuaauca

SEQ ID NO: 3416143 - RNA, 16 nt, Human
aacauaaaaaaacuuc

SEQ ID NO: 3416144 - RNA, 19 nt, Human
aacauaaaaaggacaucag

SEQ ID NO: 3416145 - RNA, 13 nt, Human
aacauaaaaaguu

SEQ ID NO: 3416146 - RNA, 14 nt, Human
aacauaaaaaugau

SEQ ID NO: 3416147 - RNA, 14 nt, Human
aacauaaagcaaau

SEQ ID NO: 3416148 - RNA, 19 nt, Human
aacauaaagguaaaacaaa

SEQ ID NO: 3416149 - RNA, 12 nt, Human
aacauaaagguu

SEQ ID NO: 3416150 - RNA, 14 nt, Human
aacauaaauaaaau

SEQ ID NO: 3416151 - RNA, 17 nt, Human
aaauccuuuuaccuuuu

SEQ ID NO: 3416152 - RNA, 17 nt, Human
aaauccuuuuucuuuau

SEQ ID NO: 3416153 - RNA, 18 nt, Human
aaauccuuuuucuuuaua

SEQ ID NO: 3416154 - RNA, 13 nt, Human
aaaucgaaugaaa

SEQ ID NO: 3416155 - RNA, 14 nt, Human
aaaucgauuggcuu

SEQ ID NO: 3416156 - RNA, 15 nt, Human
aaaucgauuggcuuu

SEQ ID NO: 3416157 - RNA, 15 nt, Human
aaaucgcuuuugaua

SEQ ID NO: 3416158 - RNA, 22 nt, Human
aaaucggaucuggggcucuggg

SEQ ID NO: 3416159 - RNA, 17 nt, Human
aaaucuaaaucuauuua

SEQ ID NO: 3416160 - RNA, 20 nt, Human
aaaucuaaaucuauuuauua

SEQ ID NO: 3416161 - RNA, 15 nt, Human
aaaucuaacauuauu

SEQ ID NO: 3416162 - RNA, 15 nt, Human
aaaucuaagcugugu

SEQ ID NO: 3416163 - RNA, 19 nt, Human
aaaucuaaugacauucaau

SEQ ID NO: 3416164 - RNA, 18 nt, Human
aaaucuagaagagucuau

SEQ ID NO: 3416165 - RNA, 22 nt, Human
aaaucuagacucaagguuccca

SEQ ID NO: 3416166 - RNA, 19 nt, Human
aaaucuauuuaauuaggaa

SEQ ID NO: 3416167 - RNA, 16 nt, Human
aaaucuauuuauuaau

SEQ ID NO: 3416168 - RNA, 17 nt, Human
aaaucuauuuauuaaua

SEQ ID NO: 3416169 - RNA, 19 nt, Human
aaaucuauuuauuaauauu

SEQ ID NO: 3416170 - RNA, 17 nt, Human
aaaucucaaauuucuaa

SEQ ID NO: 3416171 - RNA, 15 nt, Human
aaaucucaauauuuc

SEQ ID NO: 3416172 - RNA, 22 nt, Human
aaaucucagaauuccuuuucua

SEQ ID NO: 3416173 - RNA, 15 nt, Human
aaaucucuaauaugg

SEQ ID NO: 3416174 - RNA, 23 nt, Human
aaaucucuccacuuucagcuguc

SEQ ID NO: 3416175 - RNA, 19 nt, Human
aaaucucucucuguugugu

SEQ ID NO: 3416176 - RNA, 16 nt, Human
aaaucugaacauucuc

SEQ ID NO: 3416177 - RNA, 16 nt, Human
aaaucugaagauuguu

SEQ ID NO: 3416178 - RNA, 19 nt, Human
aaaucugaagauuguuuau

SEQ ID NO: 3416179 - RNA, 21 nt, Human
aaaucugaagauuguuuaucu

SEQ ID NO: 3416180 - RNA, 23 nt, Human
aaaucugcaaagcauguuuugca

SEQ ID NO: 3416181 - RNA, 19 nt, Human
aaaucugccacaaaaacag

SEQ ID NO: 3416182 - RNA, 11 nt, Human
aaaucugccug

SEQ ID NO: 3416183 - RNA, 22 nt, Human
aaaucugcuggaguuucaugua

SEQ ID NO: 3416184 - RNA, 15 nt, Human
aaaucuggucuuguu

SEQ ID NO: 3416185 - RNA, 18 nt, Human
aaaucuguaacagguauu

SEQ ID NO: 3416186 - RNA, 23 nt, Human
aaaucuguaagcucuuugaaaca

SEQ ID NO: 3416187 - RNA, 16 nt, Human
aaaucugucaagagua

SEQ ID NO: 3416188 - RNA, 16 nt, Human
aaaucugugaacuuga

SEQ ID NO: 3416189 - RNA, 18 nt, Human
aaaucugugaacuugaaa

SEQ ID NO: 3416190 - RNA, 19 nt, Human
aaaucugugaugauccuca

SEQ ID NO: 3416191 - RNA, 19 nt, Human
aaaucugugccugagaaca

SEQ ID NO: 3416192 - RNA, 18 nt, Human
aaaucuguguauauuauu

SEQ ID NO: 3416193 - RNA, 12 nt, Human
aaaucuuaaaaa

SEQ ID NO: 3416194 - RNA, 17 nt, Human
aaaucuuaaaaaguugu

SEQ ID NO: 3416195 - RNA, 17 nt, Human
aaaucuuauaauuuaaa

SEQ ID NO: 3416196 - RNA, 14 nt, Human
aaaucuuauuaaag

SEQ ID NO: 3416197 - RNA, 20 nt, Human
aaaucuuauuaaaguuucaa

SEQ ID NO: 3416198 - RNA, 19 nt, Human
aaaucuuggaaguacauga

SEQ ID NO: 3416199 - RNA, 20 nt, Human
aaaucuuggaaguacaugaa

SEQ ID NO: 3416200 - RNA, 17 nt, Human
aaaucuugucaugugua

SEQ ID NO: 3416201 - RNA, 16 nt, Human
aaaucuuucuuucuua

SEQ ID NO: 3416202 - RNA, 18 nt, Human
aaaucuuuuauaggauuu

SEQ ID NO: 3416203 - RNA, 13 nt, Human
aaaucuuuuugcu

SEQ ID NO: 3416204 - RNA, 17 nt, Human
aaaugaaaaucgugaca

SEQ ID NO: 3416205 - RNA, 13 nt, Human
aaaugaaaauugu

SEQ ID NO: 3416206 - RNA, 21 nt, Human
aaaugaaacaaauaaucacau

SEQ ID NO: 3416207 - RNA, 12 nt, Human
aaaugaaagaaa

SEQ ID NO: 3416208 - RNA, 20 nt, Human
aaaugaaagaaaauugaguu

SEQ ID NO: 3416209 - RNA, 20 nt, Human
aaaugaaaguauaacugagu

SEQ ID NO: 3416210 - RNA, 16 nt, Human
aaaugaaauuuuacca

SEQ ID NO: 3416211 - RNA, 13 nt, Human
aaaugaacaagag

SEQ ID NO: 3416212 - RNA, 16 nt, Human
aaaugaacacaaauua

SEQ ID NO: 3416213 - RNA, 19 nt, Human
aaaugaacgauauguagca

SEQ ID NO: 3416214 - RNA, 21 nt, Human
aaaugaacugaaguuucacau

SEQ ID NO: 3416215 - RNA, 11 nt, Human
aaaugaagaaa

SEQ ID NO: 3416216 - RNA, 18 nt, Human
aaaugaagcagcuuuaaa

SEQ ID NO: 3416217 - RNA, 21 nt, Human
aaaugaauaaugccuuuguaa

SEQ ID NO: 3416218 - RNA, 17 nt, Human
aaaugaauaucuauuaa

SEQ ID NO: 3416219 - RNA, 14 nt, Human
aaaugaauauuuug

SEQ ID NO: 3416220 - RNA, 23 nt, Human
aaaugaauggaggaacuuuccaa

SEQ ID NO: 3416221 - RNA, 11 nt, Human
aaaugaaugug

SEQ ID NO: 3416222 - RNA, 14 nt, Human
aaaugaaugugugu

SEQ ID NO: 3416223 - RNA, 21 nt, Human
aaaugacaaucauguguguua

SEQ ID NO: 3416224 - RNA, 14 nt, Human
aaaugacagauguu

SEQ ID NO: 3416225 - RNA, 16 nt, Human
aaaugacaucuuuuua

SEQ ID NO: 3416226 - RNA, 14 nt, Human
aaaugacaugcacu

SEQ ID NO: 3416227 - RNA, 15 nt, Human
aaaugaccaauauua

SEQ ID NO: 3416228 - RNA, 19 nt, Human
aaaugaccaguaauuguga

SEQ ID NO: 3416229 - RNA, 14 nt, Human
aaaugacccaaaga

SEQ ID NO: 3416230 - RNA, 17 nt, Human
aaaugacccaaagacca

SEQ ID NO: 3416231 - RNA, 22 nt, Human
aaaugacuacuuagcauccuaa

SEQ ID NO: 3416232 - RNA, 20 nt, Human
aaaugacuuuauuauuuauu

SEQ ID NO: 3416233 - RNA, 11 nt, Human
aaaugagaaau

SEQ ID NO: 3416234 - RNA, 22 nt, Human
aaaugagaacauguugguauuu

SEQ ID NO: 3416235 - RNA, 13 nt, Human
aaaugagaaggaa

SEQ ID NO: 3416236 - RNA, 17 nt, Human
aaaugagaucaggcucu

SEQ ID NO: 3416237 - RNA, 19 nt, Human
aaaugagccuggcaagaau

SEQ ID NO: 3416238 - RNA, 19 nt, Human
aaaugagcucugaaaucuu

SEQ ID NO: 3416239 - RNA, 18 nt, Human
aaaugagcuugauuaaau

SEQ ID NO: 3416240 - RNA, 14 nt, Human
aaaugaggaaugua

SEQ ID NO: 3416241 - RNA, 18 nt, Human
aaaugaggaauguauaug

SEQ ID NO: 3416242 - RNA, 19 nt, Human
aaaugaggaauguauaugu

SEQ ID NO: 3416243 - RNA, 15 nt, Human
aaaugaggaggaugc

SEQ ID NO: 3416244 - RNA, 22 nt, Human
aaaugaggaggaugcuaaaaau

SEQ ID NO: 3416245 - RNA, 19 nt, Human
aaaugaggccauggacucu

SEQ ID NO: 3416246 - RNA, 22 nt, Human
aacauguggcuugaauuaagaa

SEQ ID NO: 3416247 - RNA, 13 nt, Human
aacauguguacuu

SEQ ID NO: 3416248 - RNA, 22 nt, Human
aacauguuaaugacaauauucc

SEQ ID NO: 3416249 - RNA, 20 nt, Human
aacauguuauuuguaauaga

SEQ ID NO: 3416250 - RNA, 16 nt, Human
aacauguugguauuua

SEQ ID NO: 3416251 - RNA, 21 nt, Human
aacauguugguauuuaucuau

SEQ ID NO: 3416252 - RNA, 11 nt, Human
aacauguuucc

SEQ ID NO: 3416253 - RNA, 17 nt, Human
aacauguuuccagcauu

SEQ ID NO: 3416254 - RNA, 15 nt, Human
aacauuaaaaaugga

SEQ ID NO: 3416255 - RNA, 21 nt, Human
aacauuaaaaauggaacugug

SEQ ID NO: 3416256 - RNA, 18 nt, Human
aacauuaaaugucuuaua

SEQ ID NO: 3416257 - RNA, 14 nt, Human
aacauuaagaaaau

SEQ ID NO: 3416258 - RNA, 18 nt, Human
aacauuaagaaaaucaua

SEQ ID NO: 3416259 - RNA, 19 nt, Human
aacauuaauagcagccuuu

SEQ ID NO: 3416260 - RNA, 12 nt, Human
aacauuaauguu

SEQ ID NO: 3416261 - RNA, 17 nt, Human
aacauuaauguugauuu

SEQ ID NO: 3416262 - RNA, 15 nt, Human
aacauuaguacuuua

SEQ ID NO: 3416263 - RNA, 20 nt, Human
aacauuauuacuuuuccucu

SEQ ID NO: 3416264 - RNA, 16 nt, Human
aacauuauuuauucag

SEQ ID NO: 3416265 - RNA, 14 nt, Human
aacauucaggagcu

SEQ ID NO: 3416266 - RNA, 18 nt, Human
aacauucaugcucauugc

SEQ ID NO: 3416267 - RNA, 12 nt, Human
aacauuccaaga

SEQ ID NO: 3416268 - RNA, 13 nt, Human
aacauuccauccu

SEQ ID NO: 3416269 - RNA, 14 nt, Human
aacauuccauccuu

SEQ ID NO: 3416270 - RNA, 22 nt, Human
aacauuccguuuacauuuuaga

SEQ ID NO: 3416271 - RNA, 18 nt, Human
aacauuccuaaaaugcuu

SEQ ID NO: 3416272 - RNA, 20 nt, Human
aacauuccucaugaauguaa

SEQ ID NO: 3416273 - RNA, 21 nt, Human
aacauuccucaugaauguaaa

SEQ ID NO: 3416274 - RNA, 16 nt, Human
aacauucugauuugga

SEQ ID NO: 3416275 - RNA, 18 nt, Human
aacauucugauuuggaaa

SEQ ID NO: 3416276 - RNA, 20 nt, Human
aacauugaccaagaacugca

SEQ ID NO: 3416277 - RNA, 23 nt, Human
aacauugaccaagaacugcaugg

SEQ ID NO: 3416278 - RNA, 16 nt, Human
aacauugcaauagaaa

SEQ ID NO: 3416279 - RNA, 20 nt, Human
aacauugcauauaacuuaua

SEQ ID NO: 3416280 - RNA, 14 nt, Human
aacauugccuauuu

SEQ ID NO: 3416281 - RNA, 14 nt, Human
aacauugcuuuuaa

SEQ ID NO: 3416282 - RNA, 17 nt, Human
aacauugcuuuuaaaac

SEQ ID NO: 3416283 - RNA, 12 nt, Human
aacauuggaagc

SEQ ID NO: 3416284 - RNA, 16 nt, Human
aacauuggaagcaggu

SEQ ID NO: 3416285 - RNA, 21 nt, Human
aacauuggaauguucucagau

SEQ ID NO: 3416286 - RNA, 18 nt, Human
aacauugggaaaucuuau

SEQ ID NO: 3416287 - RNA, 16 nt, Human
aacauugguucuugua

SEQ ID NO: 3416288 - RNA, 16 nt, Human
aacauuguagccucaa

SEQ ID NO: 3416289 - RNA, 13 nt, Human
aacauuguguucc

SEQ ID NO: 3416290 - RNA, 15 nt, Human
aacauuguuccagau

SEQ ID NO: 3416291 - RNA, 17 nt, Human
aacauuguuccagauuc

SEQ ID NO: 3416292 - RNA, 20 nt, Human
aacauuguugcucccuguga

SEQ ID NO: 3416293 - RNA, 15 nt, Human
aacauuuacaguccu

SEQ ID NO: 3416294 - RNA, 14 nt, Human
aacauuuacaugua

SEQ ID NO: 3416295 - RNA, 13 nt, Human
aacauuuacuaca

SEQ ID NO: 3416296 - RNA, 15 nt, Human
aaccuuuagggcagc

SEQ ID NO: 3416297 - RNA, 16 nt, Human
aaccuuuagggcagcu

SEQ ID NO: 3416298 - RNA, 13 nt, Human
aaccuuuccccca

SEQ ID NO: 3416299 - RNA, 20 nt, Human
aaccuuucccucacccccuc

SEQ ID NO: 3416300 - RNA, 16 nt, Human
aaccuuugugcccuau

SEQ ID NO: 3416301 - RNA, 20 nt, Human
aaccuuuuacugguugcaug

SEQ ID NO: 3416302 - RNA, 18 nt, Human
aaccuuuuuuaagauuuu

SEQ ID NO: 3416303 - RNA, 14 nt, Human
aacgaaaaucauug

SEQ ID NO: 3416304 - RNA, 21 nt, Human
aacgaaagcugggcaacaugc

SEQ ID NO: 3416305 - RNA, 21 nt, Human
aacgaaccuuggccugggccg

SEQ ID NO: 3416306 - RNA, 13 nt, Human
aacgaagaaaaaa

SEQ ID NO: 3416307 - RNA, 14 nt, Human
aacgaagaaaaaaa

SEQ ID NO: 3416308 - RNA, 12 nt, Human
aacgaaguuggg

SEQ ID NO: 3416309 - RNA, 18 nt, Human
aacgacaaaucugucugc

SEQ ID NO: 3416310 - RNA, 14 nt, Human
aacgacaauagcuu

SEQ ID NO: 3416311 - RNA, 17 nt, Human
aacgaucacaaaugacu

SEQ ID NO: 3416312 - RNA, 22 nt, Human
aacgaugaugcuuguaacaaga

SEQ ID NO: 3416313 - RNA, 13 nt, Human
aacgaugugucug

SEQ ID NO: 3416314 - RNA, 14 nt, Human
aacgauuuuuaaaa

SEQ ID NO: 3416315 - RNA, 18 nt, Human
aacgauuuuuaaaaugua

SEQ ID NO: 3416316 - RNA, 19 nt, Human
aacgauuuuuaaaauguac

SEQ ID NO: 3416317 - RNA, 20 nt, Human
aacgcaaagggcugaaagcc

SEQ ID NO: 3416318 - RNA, 13 nt, Human
aacgcagcccuag

SEQ ID NO: 3416319 - RNA, 21 nt, Human
aacgcagcccuagagccugcc

SEQ ID NO: 3416320 - RNA, 22 nt, Human
aacgcagcccuagagccugccu

SEQ ID NO: 3416321 - RNA, 16 nt, Human
aacgcagcccugcuuu

SEQ ID NO: 3416322 - RNA, 23 nt, Human
aacgcaucuaguuccccuguuua

SEQ ID NO: 3416323 - RNA, 18 nt, Human
aacgcauggaguguguau

SEQ ID NO: 3416324 - RNA, 22 nt, Human
aacgcauggaguguguauuguu

SEQ ID NO: 3416325 - RNA, 22 nt, Human
aacgccccagauaccagccccu

SEQ ID NO: 3416326 - RNA, 17 nt, Human
aacgccuccccugcccc

SEQ ID NO: 3416327 - RNA, 12 nt, Human
aacgccugagcc

SEQ ID NO: 3416328 - RNA, 17 nt, Human
aacgccugagcccaggg

SEQ ID NO: 3416329 - RNA, 14 nt, Human
aacgcgaaaccaau

SEQ ID NO: 3416330 - RNA, 16 nt, Human
aacgcguguguacacg

SEQ ID NO: 3416331 - RNA, 16 nt, Human
aacgcuaucugggaag

SEQ ID NO: 3416332 - RNA, 20 nt, Human
aacgcucuagguacgaugac

SEQ ID NO: 3416333 - RNA, 14 nt, Human
aacgcugccugccc

SEQ ID NO: 3416334 - RNA, 16 nt, Human
aacgcugucaaaaguu

SEQ ID NO: 3416335 - RNA, 17 nt, Human
aacggaacguuggacuu

SEQ ID NO: 3416336 - RNA, 23 nt, Human
aacggaggccugcgacccugggg

SEQ ID NO: 3416337 - RNA, 14 nt, Human
aacggaugauuucu

SEQ ID NO: 3416338 - RNA, 17 nt, Human
aacggaugauuucuaug

SEQ ID NO: 3416339 - RNA, 18 nt, Human
aacggauuauuuuuucag

SEQ ID NO: 3416340 - RNA, 21 nt, Human
aacggauuauuuuuucagacc

SEQ ID NO: 3416341 - RNA, 17 nt, Human
aacggccccagcuucuc

SEQ ID NO: 3416342 - RNA, 19 nt, Human
aacggcccugcagccagcu

SEQ ID NO: 3416343 - RNA, 14 nt, Human
aacggcuccaggau

SEQ ID NO: 3416344 - RNA, 12 nt, Human
aacggggagaaa

SEQ ID NO: 3416345 - RNA, 15 nt, Human
aacgggguccuucaa

SEQ ID NO: 3416346 - RNA, 17 nt, Human
aacgggucguaaugacu

SEQ ID NO: 3416347 - RNA, 22 nt, Human
aacgguacacagacuauugaca

SEQ ID NO: 3416348 - RNA, 13 nt, Human
aacgguuaaaacu

SEQ ID NO: 3416349 - RNA, 19 nt, Human
aacguaagcacuguuuuuc

SEQ ID NO: 3416350 - RNA, 21 nt, Human
aacguagucggcacagccugg

SEQ ID NO: 3416351 - RNA, 18 nt, Human
aacguaugcaugugaaga

SEQ ID NO: 3416352 - RNA, 12 nt, Human
aacgugaaaaug

SEQ ID NO: 3416353 - RNA, 15 nt, Human
aacgugaugaucagc

SEQ ID NO: 3416354 - RNA, 21 nt, Human
aacgugaugugcucaucagaa

SEQ ID NO: 3416355 - RNA, 23 nt, Human
aacgugaugugcucaucagaaac

SEQ ID NO: 3416356 - RNA, 20 nt, Human
aacgugcaacugacacuccc

SEQ ID NO: 3416357 - RNA, 11 nt, Human
aacgugcauug

SEQ ID NO: 3416358 - RNA, 14 nt, Human
aacgugcauugugc

SEQ ID NO: 3416359 - RNA, 20 nt, Human
aacgugcucuuuguuuugug

SEQ ID NO: 3416360 - RNA, 15 nt, Human
aacguggcugcuuca

SEQ ID NO: 3416361 - RNA, 16 nt, Human
aacguggcugcuucaa

SEQ ID NO: 3416362 - RNA, 19 nt, Human
aacguggcugcuucaagga

SEQ ID NO: 3416363 - RNA, 22 nt, Human
aacguggcugcuucaaggaucc

SEQ ID NO: 3416364 - RNA, 18 nt, Human
aacgugggaguucagcug

SEQ ID NO: 3416365 - RNA, 18 nt, Human
aacgugggauucagagaa

SEQ ID NO: 3416366 - RNA, 18 nt, Human
aacguggggcagcacaga

SEQ ID NO: 3416367 - RNA, 14 nt, Human
aacguguauguuuu

SEQ ID NO: 3416368 - RNA, 16 nt, Human
aacgugugcuguguuu

SEQ ID NO: 3416369 - RNA, 16 nt, Human
aacguguucaauauuu

SEQ ID NO: 3416370 - RNA, 20 nt, Human
aacguuacucagggcuccuc

SEQ ID NO: 3416371 - RNA, 16 nt, Human
aacguugcugugggaa

SEQ ID NO: 3416372 - RNA, 20 nt, Human
aacguuugguucaaaugugu

SEQ ID NO: 3416373 - RNA, 13 nt, Human
aacguuuuauugu

SEQ ID NO: 3416374 - RNA, 15 nt, Human
aacguuuuauugugu

SEQ ID NO: 3416375 - RNA, 13 nt, Human
aacguuuucuaau

SEQ ID NO: 3416376 - RNA, 15 nt, Human
aacguuuugaacuaa

SEQ ID NO: 3416377 - RNA, 20 nt, Human
aacuaaaacaaagccacuuu

SEQ ID NO: 3416378 - RNA, 16 nt, Human
aacuaaacuaguuuuu

SEQ ID NO: 3416379 - RNA, 18 nt, Human
aacuaaacucuuaccaua

SEQ ID NO: 3416380 - RNA, 13 nt, Human
aacuaaagcaaua

SEQ ID NO: 3416381 - RNA, 16 nt, Human
aacuaaaguuguacuu

SEQ ID NO: 3416382 - RNA, 15 nt, Human
aacuaaauagcaugu

SEQ ID NO: 3416383 - RNA, 13 nt, Human
aacuaaauguucu

SEQ ID NO: 3416384 - RNA, 18 nt, Human
aacuaaauguucuauggu

SEQ ID NO: 3416385 - RNA, 20 nt, Human
aacuaaauuugauacuuaua

SEQ ID NO: 3416386 - RNA, 14 nt, Human
aacuaaauuuuaaa

SEQ ID NO: 3416387 - RNA, 16 nt, Human
aacuaaauuuuaaagc

SEQ ID NO: 3416388 - RNA, 18 nt, Human
aacuaaauuuuaaagcca

SEQ ID NO: 3416389 - RNA, 16 nt, Human
aacuaacacuauuuua

SEQ ID NO: 3416390 - RNA, 19 nt, Human
aacuaagaaacuuaaauuu

SEQ ID NO: 3416391 - RNA, 16 nt, Human
aacuaagauucuuuua

SEQ ID NO: 3416392 - RNA, 17 nt, Human
aacuaagauucuuuuaa

SEQ ID NO: 3416393 - RNA, 18 nt, Human
aacuaagcagucccugag

SEQ ID NO: 3416394 - RNA, 17 nt, Human
aacuaagcccccgcugu

SEQ ID NO: 3416395 - RNA, 19 nt, Human
aacuaagcccccgcuguaa

SEQ ID NO: 3416396 - RNA, 22 nt, Human
aacuaaggugcuaaaucugcga

SEQ ID NO: 3416397 - RNA, 16 nt, Human
aacuaauaaaauauuu

SEQ ID NO: 3416398 - RNA, 22 nt, Human
aacuaauaaaauauuuucugug

SEQ ID NO: 3416399 - RNA, 19 nt, Human
aacuaaucuauuggguuca

SEQ ID NO: 3416400 - RNA, 12 nt, Human
aacuaaugaguu

SEQ ID NO: 3416401 - RNA, 15 nt, Human
aacuaaugccuuacu

SEQ ID NO: 3416402 - RNA, 15 nt, Human
aacuacaaacaaaau

SEQ ID NO: 3416403 - RNA, 16 nt, Human
aacuacaaagguuuaa

SEQ ID NO: 3416404 - RNA, 17 nt, Human
aacuacaaagguuuaaa

SEQ ID NO: 3416405 - RNA, 15 nt, Human
aacuacauuuaugag

SEQ ID NO: 3416406 - RNA, 14 nt, Human
aacuacauuuuaac

SEQ ID NO: 3416407 - RNA, 15 nt, Human
aacuaccuguauuua

SEQ ID NO: 3416408 - RNA, 20 nt, Human
aacuacuaccuguaaugaca

SEQ ID NO: 3416409 - RNA, 18 nt, Human
aacuacuaucucagagau

SEQ ID NO: 3416410 - RNA, 17 nt, Human
aacuacucagggaauga

SEQ ID NO: 3416411 - RNA, 17 nt, Human
aacuacuguguuaugca

SEQ ID NO: 3416412 - RNA, 16 nt, Human
aacuacuguguuccug

SEQ ID NO: 3416413 - RNA, 22 nt, Human
aacuacuucucuuguuagguaa

SEQ ID NO: 3416414 - RNA, 14 nt, Human
aacuacuugauuuu

SEQ ID NO: 3416415 - RNA, 15 nt, Human
aacuacuuuauaacu

SEQ ID NO: 3416416 - RNA, 16 nt, Human
aacuagaaccuggagg

SEQ ID NO: 3416417 - RNA, 17 nt, Human
aacuagaauuuauucaa

SEQ ID NO: 3416418 - RNA, 17 nt, Human
aacuagaauuucauuua

SEQ ID NO: 3416419 - RNA, 17 nt, Human
aacuagacaccaaaguu

SEQ ID NO: 3416420 - RNA, 20 nt, Human
aacuagagaugacugagucc

SEQ ID NO: 3416421 - RNA, 21 nt, Human
aacuagagaugugcaauugau

SEQ ID NO: 3416422 - RNA, 21 nt, Human
aacuagaguuuagcuggaaaa

SEQ ID NO: 3416423 - RNA, 15 nt, Human
aacuagaugaccuca

SEQ ID NO: 3416424 - RNA, 17 nt, Human
aacuagauggugcugag

SEQ ID NO: 3416425 - RNA, 20 nt, Human
aacuagauggugcugagaag

SEQ ID NO: 3416426 - RNA, 17 nt, Human
aacuagcauaucugccu

SEQ ID NO: 3416427 - RNA, 18 nt, Human
aacuagcauaucugccuu

SEQ ID NO: 3416428 - RNA, 15 nt, Human
aacuagcauuguaaa

SEQ ID NO: 3416429 - RNA, 13 nt, Human
aacuagccccugg

SEQ ID NO: 3416430 - RNA, 18 nt, Human
aacuaggaaggcacuucu

SEQ ID NO: 3416431 - RNA, 14 nt, Human
aacuaggaucagaa

SEQ ID NO: 3416432 - RNA, 15 nt, Human
aacuaggcugagcaa

SEQ ID NO: 3416433 - RNA, 15 nt, Human
aacuaguccuuuacu

SEQ ID NO: 3416434 - RNA, 20 nt, Human
aacuagugguggcucugaga

SEQ ID NO: 3416435 - RNA, 14 nt, Human
aacuaguguacauu

SEQ ID NO: 3416436 - RNA, 23 nt, Human
aacuaguuuuuccuaucauguua

SEQ ID NO: 3416437 - RNA, 20 nt, Human
aacuaucucauuuccaagca

SEQ ID NO: 3416438 - RNA, 23 nt, Human
aacuaucucauuuccaagcaagu

SEQ ID NO: 3416439 - RNA, 19 nt, Human
aacuaucuggccauauuua

SEQ ID NO: 3416440 - RNA, 11 nt, Human
aacuaucuugg

SEQ ID NO: 3416441 - RNA, 15 nt, Human
aaauuuauuuccaau

SEQ ID NO: 3416442 - RNA, 20 nt, Human
aaauuuauuuccuaguucug

SEQ ID NO: 3416443 - RNA, 23 nt, Human
aaauuuauuuuauaagaaaaacu

SEQ ID NO: 3416444 - RNA, 21 nt, Human
aaauuucaaaagacauguugu

SEQ ID NO: 3416445 - RNA, 22 nt, Human
aaauuuccaguaccuuugucac

SEQ ID NO: 3416446 - RNA, 23 nt, Human
aacuauuuaucuguguuuuugaa

SEQ ID NO: 3416447 - RNA, 17 nt, Human
aacuauuucuuauauau

SEQ ID NO: 3416448 - RNA, 18 nt, Human
aacuauuugucuuucagg

SEQ ID NO: 3416449 - RNA, 15 nt, Human
aacucaaaauauuug

SEQ ID NO: 3416450 - RNA, 17 nt, Human
aacucaaacucuuaaaa

SEQ ID NO: 3416451 - RNA, 22 nt, Human
aacucaaacugaggaauuucac

SEQ ID NO: 3416452 - RNA, 11 nt, Human
aacucaaaugc

SEQ ID NO: 3416453 - RNA, 22 nt, Human
aacucaaaugcuuggcuucuca

SEQ ID NO: 3416454 - RNA, 21 nt, Human
aacucaaauggggccagaucc

SEQ ID NO: 3416455 - RNA, 22 nt, Human
aacucaaauggggccagaucca

SEQ ID NO: 3416456 - RNA, 12 nt, Human
aacucaacaugg

SEQ ID NO: 3416457 - RNA, 17 nt, Human
aacucaaccaaauggua

SEQ ID NO: 3416458 - RNA, 23 nt, Human
aacucaaggauaccuucuuauuu

SEQ ID NO: 3416459 - RNA, 14 nt, Human
aacucacaaaugau

SEQ ID NO: 3416460 - RNA, 12 nt, Human
aacucaccccag

SEQ ID NO: 3416461 - RNA, 17 nt, Human
aacucaccuaauguuua

SEQ ID NO: 3416462 - RNA, 17 nt, Human
aacucaccucucaaggu

SEQ ID NO: 3416463 - RNA, 15 nt, Human
aacucaccugccccu

SEQ ID NO: 3416464 - RNA, 12 nt, Human
aacucaccugcu

SEQ ID NO: 3416465 - RNA, 22 nt, Human
aacucaccugcuggccccucac

SEQ ID NO: 3416466 - RNA, 15 nt, Human
aacucaccuggggcu

SEQ ID NO: 3416467 - RNA, 20 nt, Human
aacucaccuggggcugcugg

SEQ ID NO: 3416468 - RNA, 20 nt, Human
aacucacuccuuuuaaagaa

SEQ ID NO: 3416469 - RNA, 13 nt, Human
aacucacucuggg

SEQ ID NO: 3416470 - RNA, 12 nt, Human
aacucagaaggg

SEQ ID NO: 3416471 - RNA, 17 nt, Human
aacucagccaagcacag

SEQ ID NO: 3416472 - RNA, 21 nt, Human
aacucagccaagcacaguggu

SEQ ID NO: 3416473 - RNA, 17 nt, Human
aacucagccugggacag

SEQ ID NO: 3416474 - RNA, 15 nt, Human
aacucaggacuccag

SEQ ID NO: 3416475 - RNA, 18 nt, Human
aacucaggacuccagccc

SEQ ID NO: 3416476 - RNA, 18 nt, Human
aacucaguuuuaacuaga

SEQ ID NO: 3416477 - RNA, 21 nt, Human
aacucauaaucuauaaacaau

SEQ ID NO: 3416478 - RNA, 23 nt, Human
aacucauacacucguaugauacu

SEQ ID NO: 3416479 - RNA, 18 nt, Human
aacucauaccuuuaaagg

SEQ ID NO: 3416480 - RNA, 16 nt, Human
aacucauacugugcug

SEQ ID NO: 3416481 - RNA, 22 nt, Human
aacucauacugugcuggagcca

SEQ ID NO: 3416482 - RNA, 16 nt, Human
aacucauauuuucaug

SEQ ID NO: 3416483 - RNA, 18 nt, Human
aacucaucacuguggcug

SEQ ID NO: 3416484 - RNA, 14 nt, Human
aacucaucauaaaa

SEQ ID NO: 3416485 - RNA, 17 nt, Human
aacucaucauaaaauaa

SEQ ID NO: 3416486 - RNA, 14 nt, Human
aacucaucugaaau

SEQ ID NO: 3416487 - RNA, 23 nt, Human
aacucauuagacuggaacuugaa

SEQ ID NO: 3416488 - RNA, 14 nt, Human
aacucauuccagau

SEQ ID NO: 3416489 - RNA, 15 nt, Human
aacucauuccagauc

SEQ ID NO: 3416490 - RNA, 19 nt, Human
aacucauuccugccugucu

SEQ ID NO: 3416491 - RNA, 22 nt, Human
aacucauugcucuguuaauaau

SEQ ID NO: 3416492 - RNA, 12 nt, Human
aacucauuucua

SEQ ID NO: 3416493 - RNA, 23 nt, Human
aacuccaccaacccaucagaagg

SEQ ID NO: 3416494 - RNA, 15 nt, Human
aacuccaccuuccca

SEQ ID NO: 3416495 - RNA, 14 nt, Human
aacuccagaaagug

SEQ ID NO: 3416496 - RNA, 21 nt, Human
aacuccagaaagugacaagcu

SEQ ID NO: 3416497 - RNA, 10 nt, Human
aacuccaggg

SEQ ID NO: 3416498 - RNA, 18 nt, Human
aacuccaguacuggagcu

SEQ ID NO: 3416499 - RNA, 16 nt, Human
aacucccaucaccucu

SEQ ID NO: 3416500 - RNA, 17 nt, Human
aacuccccuguuucaau

SEQ ID NO: 3416501 - RNA, 18 nt, Human
aacuccgcccccagccua

SEQ ID NO: 3416502 - RNA, 21 nt, Human
aacuccggauugcguuccucc

SEQ ID NO: 3416503 - RNA, 21 nt, Human
aacuccuagggccacugaaga

SEQ ID NO: 3416504 - RNA, 14 nt, Human
aacuccuaguucua

SEQ ID NO: 3416505 - RNA, 15 nt, Human
aacuccuaguucuag

SEQ ID NO: 3416506 - RNA, 21 nt, Human
aacuccucacacacccugagg

SEQ ID NO: 3416507 - RNA, 22 nt, Human
aacuccucacacacccugaggu

SEQ ID NO: 3416508 - RNA, 14 nt, Human
aacuccucccaggg

SEQ ID NO: 3416509 - RNA, 16 nt, Human
aacuccugacagucuu

SEQ ID NO: 3416510 - RNA, 14 nt, Human
aacuccugaccuca

SEQ ID NO: 3416511 - RNA, 12 nt, Human
aacuccugcccc

SEQ ID NO: 3416512 - RNA, 17 nt, Human
aacuccugccccuguuc

SEQ ID NO: 3416513 - RNA, 21 nt, Human
aacuccugugaccacaacaug

SEQ ID NO: 3416514 - RNA, 14 nt, Human
aacuccuuccuggc

SEQ ID NO: 3416515 - RNA, 11 nt, Human
aacuccuuggc

SEQ ID NO: 3416516 - RNA, 13 nt, Human
aacuccuuggccu

SEQ ID NO: 3416517 - RNA, 18 nt, Human
aacuccuuuagcaggugg

SEQ ID NO: 3416518 - RNA, 21 nt, Human
aacucgguguccccaccaucu

SEQ ID NO: 3416519 - RNA, 15 nt, Human
aacucguauagcaug

SEQ ID NO: 3416520 - RNA, 21 nt, Human
aacucuaauucccauuuugca

SEQ ID NO: 3416521 - RNA, 23 nt, Human
aacucuauauuguucagcaugca

SEQ ID NO: 3416522 - RNA, 21 nt, Human
aacucuaucggagaacaugaa

SEQ ID NO: 3416523 - RNA, 14 nt, Human
aacucuaucugggc

SEQ ID NO: 3416524 - RNA, 21 nt, Human
aacucuaucugggccugggcu

SEQ ID NO: 3416525 - RNA, 14 nt, Human
aacucuauuuagau

SEQ ID NO: 3416526 - RNA, 15 nt, Human
aacucuccuccagag

SEQ ID NO: 3416527 - RNA, 18 nt, Human
aacucuccuccagaguca

SEQ ID NO: 3416528 - RNA, 16 nt, Human
aacucuccucugcugc

SEQ ID NO: 3416529 - RNA, 22 nt, Human
aacucucuccacccuauaugua

SEQ ID NO: 3416530 - RNA, 12 nt, Human
aacucucugaac

SEQ ID NO: 3416531 - RNA, 18 nt, Human
aacucucuuauugccuca

SEQ ID NO: 3416532 - RNA, 12 nt, Human
aacucugaauaa

SEQ ID NO: 3416533 - RNA, 18 nt, Human
aacucugaauaagcacuu

SEQ ID NO: 3416534 - RNA, 23 nt, Human
aacucugaauuuaucuuugauaa

SEQ ID NO: 3416535 - RNA, 22 nt, Human
aacucugacaacagacuucuga

SEQ ID NO: 3416536 - RNA, 23 nt, Human
aacucugacaacagacuucugaa

SEQ ID NO: 3416537 - RNA, 21 nt, Human
aacucugacaagggcugaccu

SEQ ID NO: 3416538 - RNA, 19 nt, Human
aacucugagugcaaacuuc

SEQ ID NO: 3416539 - RNA, 21 nt, Human
aacucugauguaaaugaagua

SEQ ID NO: 3416540 - RNA, 11 nt, Human
aacucugcugu

SEQ ID NO: 3416541 - RNA, 16 nt, Human
aacucuggcuuccagg

SEQ ID NO: 3416542 - RNA, 20 nt, Human
aacucuggcuuccagguauc

SEQ ID NO: 3416543 - RNA, 15 nt, Human
aacucuggcuuuugg

SEQ ID NO: 3416544 - RNA, 20 nt, Human
aacucugucuucaccugauu

SEQ ID NO: 3416545 - RNA, 23 nt, Human
aacucugucuucaccugauucaa

SEQ ID NO: 3416546 - RNA, 16 nt, Human
aacucuguggcauuau

SEQ ID NO: 3416547 - RNA, 20 nt, Human
aacucuguguugugaauguc

SEQ ID NO: 3416548 - RNA, 16 nt, Human
aacucuguuacacuuu

SEQ ID NO: 3416549 - RNA, 19 nt, Human
aacucuguugcaagugcaa

SEQ ID NO: 3416550 - RNA, 22 nt, Human
aacucuuaaucaaauagcauaa

SEQ ID NO: 3416551 - RNA, 22 nt, Human
aacucuuauaaauuucuauuuu

SEQ ID NO: 3416552 - RNA, 18 nt, Human
aacucuucacaaaaucug

SEQ ID NO: 3416553 - RNA, 17 nt, Human
aacucuucacucuucaa

SEQ ID NO: 3416554 - RNA, 23 nt, Human
aacucuucacucuucaaaugccu

SEQ ID NO: 3416555 - RNA, 11 nt, Human
aacucuuccuc

SEQ ID NO: 3416556 - RNA, 17 nt, Human
aacucuucucauuacuu

SEQ ID NO: 3416557 - RNA, 11 nt, Human
aacucuuuaac

SEQ ID NO: 3416558 - RNA, 13 nt, Human
aacucuuuaacuu

SEQ ID NO: 3416559 - RNA, 14 nt, Human
aacucuuugagaaa

SEQ ID NO: 3416560 - RNA, 13 nt, Human
aacucuuugcugc

SEQ ID NO: 3416561 - RNA, 23 nt, Human
aacucuuugcugcugcccauguu

SEQ ID NO: 3416562 - RNA, 19 nt, Human
aacugaaaacaagccauga

SEQ ID NO: 3416563 - RNA, 19 nt, Human
aacugaaaacauaaaaagu

SEQ ID NO: 3416564 - RNA, 12 nt, Human
aacugaaaagac

SEQ ID NO: 3416565 - RNA, 13 nt, Human
aacugaaaauuau

SEQ ID NO: 3416566 - RNA, 17 nt, Human
aacugaaauuaaaacua

SEQ ID NO: 3416567 - RNA, 23 nt, Human
aacugaacaccauugaaggcuua

SEQ ID NO: 3416568 - RNA, 15 nt, Human
aacugaacauuccag

SEQ ID NO: 3416569 - RNA, 20 nt, Human
aacugaacucugacaacaga

SEQ ID NO: 3416570 - RNA, 15 nt, Human
aacugaacuuugaag

SEQ ID NO: 3416571 - RNA, 15 nt, Human
aacugaagagacagu

SEQ ID NO: 3416572 - RNA, 17 nt, Human
aacugaagauguugaga

SEQ ID NO: 3416573 - RNA, 18 nt, Human
aacugaagcagccucucc

SEQ ID NO: 3416574 - RNA, 21 nt, Human
aacugaagcagccucucccca

SEQ ID NO: 3416575 - RNA, 14 nt, Human
aacugaagucugaa

SEQ ID NO: 3416576 - RNA, 18 nt, Human
aacugaauaccacucugu

SEQ ID NO: 3416577 - RNA, 12 nt, Human
aacugaaugaga

SEQ ID NO: 3416578 - RNA, 15 nt, Human
aacugaauuuugucu

SEQ ID NO: 3416579 - RNA, 10 nt, Human
aacugacaag

SEQ ID NO: 3416580 - RNA, 16 nt, Human
aacugacaagccaucu

SEQ ID NO: 3416581 - RNA, 19 nt, Human
aacugacaagcuccauuua

SEQ ID NO: 3416582 - RNA, 12 nt, Human
aacugacacagg

SEQ ID NO: 3416583 - RNA, 20 nt, Human
aacugacaugauuagcagaa

SEQ ID NO: 3416584 - RNA, 19 nt, Human
aacugaccagccuccaugc

SEQ ID NO: 3416585 - RNA, 20 nt, Human
aacugacucuuaagaagacu

SEQ ID NO: 3416586 - RNA, 21 nt, Human
aacuuagaauaaaauuguaaa

SEQ ID NO: 3416587 - RNA, 20 nt, Human
aacuuagaucaucagucacc

SEQ ID NO: 3416588 - RNA, 16 nt, Human
aacuuagauuuuacau

SEQ ID NO: 3416589 - RNA, 19 nt, Human
aacuuagauuuuacaugaa

SEQ ID NO: 3416590 - RNA, 21 nt, Human
aacuuagccauuuuucaaagc

SEQ ID NO: 3416591 - RNA, 21 nt, Human
aacuuaggcaugcacagcugu

SEQ ID NO: 3416592 - RNA, 23 nt, Human
aacuuagugcggacaaguuuuaa

SEQ ID NO: 3416593 - RNA, 16 nt, Human
aacuuaguuugugaau

SEQ ID NO: 3416594 - RNA, 15 nt, Human
aacuuauaaaucaua

SEQ ID NO: 3416595 - RNA, 13 nt, Human
aacuuauauugaa

SEQ ID NO: 3416596 - RNA, 19 nt, Human
aacuuauauugaagacaau

SEQ ID NO: 3416597 - RNA, 20 nt, Human
aacuuauauuguaagaaaua

SEQ ID NO: 3416598 - RNA, 19 nt, Human
aacuuauccuaaaacaaau

SEQ ID NO: 3416599 - RNA, 17 nt, Human
aacuuaucuuacaaagu

SEQ ID NO: 3416600 - RNA, 19 nt, Human
aacuuaucuuacaaagugu

SEQ ID NO: 3416601 - RNA, 21 nt, Human
aacuuauguagauauuuggcu

SEQ ID NO: 3416602 - RNA, 22 nt, Human
aacuuauguagauauuuggcuu

SEQ ID NO: 3416603 - RNA, 21 nt, Human
aacuuauuaaauggaaacuga

SEQ ID NO: 3416604 - RNA, 16 nt, Human
aacuuauugcugauuu

SEQ ID NO: 3416605 - RNA, 23 nt, Human
aaauuuccaguaccuuugucaca

SEQ ID NO: 3416606 - RNA, 22 nt, Human
aaauuuccugggagcuuuugua

SEQ ID NO: 3416607 - RNA, 14 nt, Human
aaauuucuuaugug

SEQ ID NO: 3416608 - RNA, 15 nt, Human
aaauuucuuauguga

SEQ ID NO: 3416609 - RNA, 13 nt, Human
aaauuugaaacau

SEQ ID NO: 3416610 - RNA, 14 nt, Human
aaauuugaaacauu

SEQ ID NO: 3416611 - RNA, 18 nt, Human
aaauuugaaccaaaacau

SEQ ID NO: 3416612 - RNA, 15 nt, Human
aaauuugaauuuugu

SEQ ID NO: 3416613 - RNA, 17 nt, Human
aaauuugacuaauuuua

SEQ ID NO: 3416614 - RNA, 18 nt, Human
aaauuugauacuuauauu

SEQ ID NO: 3416615 - RNA, 17 nt, Human
aaauuugauugauuuga

SEQ ID NO: 3416616 - RNA, 13 nt, Human
aaauuugcuagca

SEQ ID NO: 3416617 - RNA, 18 nt, Human
aaauuuggccaaacaagu

SEQ ID NO: 3416618 - RNA, 12 nt, Human
aaauuuguaagu

SEQ ID NO: 3416619 - RNA, 17 nt, Human
aaauuuguaaguuucag

SEQ ID NO: 3416620 - RNA, 20 nt, Human
aaauuuguaaguuucaggug

SEQ ID NO: 3416621 - RNA, 11 nt, Human
aaauuuguacu

SEQ ID NO: 3416622 - RNA, 21 nt, Human
aaauuugucugaaacauuuca

SEQ ID NO: 3416623 - RNA, 23 nt, Human
aaauuugucuugccuuauuaaag

SEQ ID NO: 3416624 - RNA, 12 nt, Human
aaauuuguguaa

SEQ ID NO: 3416625 - RNA, 18 nt, Human
aaauuuguuauaaugaau

SEQ ID NO: 3416626 - RNA, 18 nt, Human
aaauuuguugaaauuaug

SEQ ID NO: 3416627 - RNA, 14 nt, Human
aaauuuguugcaua

SEQ ID NO: 3416628 - RNA, 18 nt, Human
aaauuuguuugaaaucuu

SEQ ID NO: 3416629 - RNA, 12 nt, Human
aaauuuuaaagc

SEQ ID NO: 3416630 - RNA, 22 nt, Human
aaauuuuaauauggguucuuuu

SEQ ID NO: 3416631 - RNA, 14 nt, Human
aaauuuuaauuuau

SEQ ID NO: 3416632 - RNA, 15 nt, Human
aaauuuuaguccaaa

SEQ ID NO: 3416633 - RNA, 22 nt, Human
aaauuuuauaagcaaauuucaa

SEQ ID NO: 3416634 - RNA, 17 nt, Human
aaauuuuaucucuuauu

SEQ ID NO: 3416635 - RNA, 13 nt, Human
aaauuuuauuccu

SEQ ID NO: 3416636 - RNA, 23 nt, Human
aaauuuuccuguccucuuucagc

SEQ ID NO: 3416637 - RNA, 19 nt, Human
aaauuuucuagacuuucug

SEQ ID NO: 3416638 - RNA, 14 nt, Human
aaauuuucuucagu

SEQ ID NO: 3416639 - RNA, 18 nt, Human
aaauuuucuucaguuggu

SEQ ID NO: 3416640 - RNA, 17 nt, Human
aaauuuucuugauuuga

SEQ ID NO: 3416641 - RNA, 14 nt, Human
aaauuuugaaaagu

SEQ ID NO: 3416642 - RNA, 18 nt, Human
aaauuuugauguuuuaag

SEQ ID NO: 3416643 - RNA, 13 nt, Human
aaauuuugcaaau

SEQ ID NO: 3416644 - RNA, 18 nt, Human
aaauuuuguaagggagca

SEQ ID NO: 3416645 - RNA, 14 nt, Human
aaauuuuguaauga

SEQ ID NO: 3416646 - RNA, 15 nt, Human
aaauuuuguaaugaa

SEQ ID NO: 3416647 - RNA, 18 nt, Human
aaauuuuguaauuuucuu

SEQ ID NO: 3416648 - RNA, 19 nt, Human
aaauuuuguaauuuucuug

SEQ ID NO: 3416649 - RNA, 21 nt, Human
aaauuuugugauauggagccc

SEQ ID NO: 3416650 - RNA, 20 nt, Human
aaauuuuguuuauaagaaau

SEQ ID NO: 3416651 - RNA, 23 nt, Human
aaauuuuuaaucuuuaauuuuac

SEQ ID NO: 3416652 - RNA, 21 nt, Human
aaauuuuucagaugcuucugg

SEQ ID NO: 3416653 - RNA, 12 nt, Human
aaauuuuucaua

SEQ ID NO: 3416654 - RNA, 17 nt, Human
aaauuuuucauauuuua

SEQ ID NO: 3416655 - RNA, 16 nt, Human
aaauuuuucugcuuua

SEQ ID NO: 3416656 - RNA, 23 nt, Human
aaauuuuucuuccuuaaacuccu

SEQ ID NO: 3416657 - RNA, 13 nt, Human
aaauuuuuguaaa

SEQ ID NO: 3416658 - RNA, 20 nt, Human
aaauuuuuguaguagcguuu

SEQ ID NO: 3416659 - RNA, 12 nt, Human
aaauuuuuugac

SEQ ID NO: 3416660 - RNA, 23 nt, Human
aaauuuuuugacuuuuuuuguau

SEQ ID NO: 3416661 - RNA, 14 nt, Human
aaauuuuuuguuga

SEQ ID NO: 3416662 - RNA, 13 nt, Human
aaauuuuuuuaga

SEQ ID NO: 3416663 - RNA, 15 nt, Human
aaauuuuuuuagaaa

SEQ ID NO: 3416664 - RNA, 21 nt, Human
aaauuuuuuuagaaagcauuu

SEQ ID NO: 3416665 - RNA, 14 nt, Human
aaauuuuuuugguc

SEQ ID NO: 3416666 - RNA, 12 nt, Human
aaauuuuuuugu

SEQ ID NO: 3416667 - RNA, 13 nt, Human
aaauuuuuuugua

SEQ ID NO: 3416668 - RNA, 19 nt, Human
aaauuuuuuuguaugaaaa

SEQ ID NO: 3416669 - RNA, 20 nt, Human
aaauuuuuuuguaugaaaac

SEQ ID NO: 3416670 - RNA, 18 nt, Human
aaauuuuuuuuacauuuu

SEQ ID NO: 3416671 - RNA, 15 nt, Human
aaauuuuuuuucaug

SEQ ID NO: 3416672 - RNA, 13 nt, Human
aacaaaaaaaucu

SEQ ID NO: 3416673 - RNA, 14 nt, Human
aacaaaaaagcuaa

SEQ ID NO: 3416674 - RNA, 20 nt, Human
aacaaaaaccaaauguuuau

SEQ ID NO: 3416675 - RNA, 13 nt, Human
aacaaaaagaugu

SEQ ID NO: 3416676 - RNA, 16 nt, Human
aacaaaaagcuucccc

SEQ ID NO: 3416677 - RNA, 18 nt, Human
aacaaaacaaaacaacau

SEQ ID NO: 3416678 - RNA, 16 nt, Human
aacaaaacaaaacuau

SEQ ID NO: 3416679 - RNA, 21 nt, Human
aacaaaaccaaaaguuauuaa

SEQ ID NO: 3416680 - RNA, 9 nt, Human
aacaaaacu

SEQ ID NO: 3416681 - RNA, 17 nt, Human
aacaaaacuauacuuga

SEQ ID NO: 3416682 - RNA, 13 nt, Human
aacaaaagaugaa

SEQ ID NO: 3416683 - RNA, 15 nt, Human
aacaaaauagaaagu

SEQ ID NO: 3416684 - RNA, 17 nt, Human
aacaaaauggcuucagu

SEQ ID NO: 3416685 - RNA, 15 nt, Human
aacaaaauuacagac

SEQ ID NO: 3416686 - RNA, 15 nt, Human
aacaaaauuucuauu

SEQ ID NO: 3416687 - RNA, 24 nt, Human
aacaaaauuugacuaauuuuacau

SEQ ID NO: 3416688 - RNA, 19 nt, Human
aacaaacaccuucuuauua

SEQ ID NO: 3416689 - RNA, 21 nt, Human
aacaaacauuguguugacauu

SEQ ID NO: 3416690 - RNA, 22 nt, Human
aacaaacauuguguugacauua

SEQ ID NO: 3416691 - RNA, 10 nt, Human
aacaaaccau

SEQ ID NO: 3416692 - RNA, 14 nt, Human
aacaaacuauuucu

SEQ ID NO: 3416693 - RNA, 14 nt, Human
aacaaacugcacau

SEQ ID NO: 3416694 - RNA, 22 nt, Human
aacaaacugcacaugauuucac

SEQ ID NO: 3416695 - RNA, 14 nt, Human
aacaaagaaauauu

SEQ ID NO: 3416696 - RNA, 17 nt, Human
aacaaagaagacaacau

SEQ ID NO: 3416697 - RNA, 21 nt, Human
aacaaagaccaauuuuuugug

SEQ ID NO: 3416698 - RNA, 19 nt, Human
aacaaagagaaaaaauaca

SEQ ID NO: 3416699 - RNA, 23 nt, Human
aacaaagaguucaagaaauaagu

SEQ ID NO: 3416700 - RNA, 21 nt, Human
aacaaagaugccacauucaaa

SEQ ID NO: 3416701 - RNA, 12 nt, Human
aacaaagccaga

SEQ ID NO: 3416702 - RNA, 12 nt, Human
aacaaagcuguu

SEQ ID NO: 3416703 - RNA, 22 nt, Human
aacaaagcuguuaaacuguuag

SEQ ID NO: 3416704 - RNA, 14 nt, Human
aacaaagcuuagca

SEQ ID NO: 3416705 - RNA, 22 nt, Human
aacaaaggccuaauucuaugcc

SEQ ID NO: 3416706 - RNA, 18 nt, Human
aacaaaggguuuuaaugu

SEQ ID NO: 3416707 - RNA, 16 nt, Human
aacaaagguugagaug

SEQ ID NO: 3416708 - RNA, 16 nt, Human
aacaaauaaucacauu

SEQ ID NO: 3416709 - RNA, 12 nt, Human
aacaaauaugca

SEQ ID NO: 3416710 - RNA, 18 nt, Human
aacaaauaugcuaauuug

SEQ ID NO: 3416711 - RNA, 21 nt, Human
aacaaaucuaggaaaauauuu

SEQ ID NO: 3416712 - RNA, 12 nt, Human
aacaaaugaaga

SEQ ID NO: 3416713 - RNA, 15 nt, Human
aacaaauuauuuuug

SEQ ID NO: 3416714 - RNA, 16 nt, Human
aacaaauugaacucuu

SEQ ID NO: 3416715 - RNA, 19 nt, Human
aacaacaauugguaaaacu

SEQ ID NO: 3416716 - RNA, 14 nt, Human
aacaacacuguagu

SEQ ID NO: 3416717 - RNA, 18 nt, Human
aacaaccccccaucacaa

SEQ ID NO: 3416718 - RNA, 19 nt, Human
aacaaccccccaucacaaa

SEQ ID NO: 3416719 - RNA, 14 nt, Human
aacaacgaaagaag

SEQ ID NO: 3416720 - RNA, 21 nt, Human
aacaacuuucucuuguaaacg

SEQ ID NO: 3416721 - RNA, 12 nt, Human
aacaagaaaaau

SEQ ID NO: 3416722 - RNA, 17 nt, Human
aacaagaaaaauaaaga

SEQ ID NO: 3416723 - RNA, 23 nt, Human
aacaagaauaaaggcagcuguug

SEQ ID NO: 3416724 - RNA, 13 nt, Human
aacaagaaugcau

SEQ ID NO: 3416725 - RNA, 16 nt, Human
aacaagaaugcauuga

SEQ ID NO: 3416726 - RNA, 19 nt, Human
aacaagaccacguuucuaa

SEQ ID NO: 3416727 - RNA, 22 nt, Human
aacaagaccucagugccuuccu

SEQ ID NO: 3416728 - RNA, 15 nt, Human
aacaagagaagcauu

SEQ ID NO: 3416729 - RNA, 16 nt, Human
aacaagagaagcauuc

SEQ ID NO: 3416730 - RNA, 19 nt, Human
aacaagagcacuacauuca

SEQ ID NO: 3416731 - RNA, 22 nt, Human
aacaagaugcuggaugucugcc

SEQ ID NO: 3416732 - RNA, 12 nt, Human
aacaagauuucc

SEQ ID NO: 3416733 - RNA, 20 nt, Human
aacaagauuuccuugugcaa

SEQ ID NO: 3416734 - RNA, 13 nt, Human
aacaagcaugcag

SEQ ID NO: 3416735 - RNA, 15 nt, Human
aacaaggcaaggcug

SEQ ID NO: 3416736 - RNA, 21 nt, Human
aacaaggcaaggcugucaauu

SEQ ID NO: 3416737 - RNA, 19 nt, Human
aacaaggguggcaucccag

SEQ ID NO: 3416738 - RNA, 16 nt, Human
aacaagguaguuuuua

SEQ ID NO: 3416739 - RNA, 19 nt, Human
aacaagguuauaugaauau

SEQ ID NO: 3416740 - RNA, 20 nt, Human
aacaagguuauaugaauaua

SEQ ID NO: 3416741 - RNA, 23 nt, Human
aacaaguauuuguuaauuuagaa

SEQ ID NO: 3416742 - RNA, 15 nt, Human
aacaagucagucauu

SEQ ID NO: 3416743 - RNA, 18 nt, Human
aacaagucagucauucag

SEQ ID NO: 3416744 - RNA, 23 nt, Human
aacaagugaaauaacaaaaugga

SEQ ID NO: 3416745 - RNA, 14 nt, Human
aacaagugaacaca

SEQ ID NO: 3416746 - RNA, 14 nt, Human
aacaagugcuggca

SEQ ID NO: 3416747 - RNA, 15 nt, Human
aacaagugcuggcac

SEQ ID NO: 3416748 - RNA, 14 nt, Human
aacaaguugagcua

SEQ ID NO: 3416749 - RNA, 21 nt, Human
aacaaguugagcuaugacuua

SEQ ID NO: 3416750 - RNA, 23 nt, Human
aacaauaaaauuuuuuuucaugu

SEQ ID NO: 3416751 - RNA, 15 nt, Human
aacaauaaaugugca

SEQ ID NO: 3416752 - RNA, 18 nt, Human
aacaauaacuacuguguu

SEQ ID NO: 3416753 - RNA, 13 nt, Human
aacaauacaaaug

SEQ ID NO: 3416754 - RNA, 20 nt, Human
aacaauacucauaaugugaa

SEQ ID NO: 3416755 - RNA, 16 nt, Human
aacaauagaaaccugu

SEQ ID NO: 3416756 - RNA, 14 nt, Human
aacugacacaggaa

SEQ ID NO: 3416757 - RNA, 20 nt, Human
aacugacacucccacccagu

SEQ ID NO: 3416758 - RNA, 23 nt, Human
aacugacaugcccucccuucucc

SEQ ID NO: 3416759 - RNA, 15 nt, Human
aacugacccucccuu

SEQ ID NO: 3416760 - RNA, 22 nt, Human
aacugacccucccuuccugucc

SEQ ID NO: 3416761 - RNA, 15 nt, Human
aacugacuaucauaa

SEQ ID NO: 3416762 - RNA, 18 nt, Human
aacugacuaucauaaaau

SEQ ID NO: 3416763 - RNA, 15 nt, Human
aacugacucuuaaga

SEQ ID NO: 3416764 - RNA, 18 nt, Human
aacugagauccuuccuuu

SEQ ID NO: 3416765 - RNA, 20 nt, Human
aacugagaugugaacacauc

SEQ ID NO: 3416766 - RNA, 14 nt, Human
aacugagcuccucu

SEQ ID NO: 3416767 - RNA, 22 nt, Human
aacugagcuccucugggcagga

SEQ ID NO: 3416768 - RNA, 23 nt, Human
aacugaguauuaauaucugagga

SEQ ID NO: 3416769 - RNA, 17 nt, Human
aacugaguccuuaaaca

SEQ ID NO: 3416770 - RNA, 14 nt, Human
aacugauaaagaug

SEQ ID NO: 3416771 - RNA, 15 nt, Human
aacugauaguuacug

SEQ ID NO: 3416772 - RNA, 22 nt, Human
aacugauaguuacuguugugac

SEQ ID NO: 3416773 - RNA, 20 nt, Human
aacugaucauguuuaugaga

SEQ ID NO: 3416774 - RNA, 17 nt, Human
aacugauccagcaauua

SEQ ID NO: 3416775 - RNA, 21 nt, Human
aacugauccaguauaagacua

SEQ ID NO: 3416776 - RNA, 15 nt, Human
aacugaucuguuaua

SEQ ID NO: 3416777 - RNA, 13 nt, Human
aacugaugugaaa

SEQ ID NO: 3416778 - RNA, 14 nt, Human
aacugaugugaaac

SEQ ID NO: 3416779 - RNA, 19 nt, Human
aacugauucacaucucauu

SEQ ID NO: 3416780 - RNA, 22 nt, Human
aacugauuuuuuuuuccuucag

SEQ ID NO: 3416781 - RNA, 18 nt, Human
aacugcaaccuuguuuau

SEQ ID NO: 3416782 - RNA, 18 nt, Human
aacugcaagucacaaagg

SEQ ID NO: 3416783 - RNA, 17 nt, Human
aacugcaauaacuucug

SEQ ID NO: 3416784 - RNA, 21 nt, Human
aacugcaauaacuucugaccu

SEQ ID NO: 3416785 - RNA, 22 nt, Human
aacugcaauagagacuguagau

SEQ ID NO: 3416786 - RNA, 23 nt, Human
aacugcaauagagacuguagauu

SEQ ID NO: 3416787 - RNA, 21 nt, Human
aacugcacaugaagaaauacu

SEQ ID NO: 3416788 - RNA, 17 nt, Human
aacugcacaugauuuca

SEQ ID NO: 3416789 - RNA, 13 nt, Human
aacugcaggcccu

SEQ ID NO: 3416790 - RNA, 16 nt, Human
aacugcaggcccuggc

SEQ ID NO: 3416791 - RNA, 18 nt, Human
aacugcaggcccuggccu

SEQ ID NO: 3416792 - RNA, 21 nt, Human
aacugcaggcccuggccuccc

SEQ ID NO: 3416793 - RNA, 23 nt, Human
aacugcaggcccuggccuccccu

SEQ ID NO: 3416794 - RNA, 14 nt, Human
aacugcagggaaaa

SEQ ID NO: 3416795 - RNA, 16 nt, Human
aacugcauacacuuuu

SEQ ID NO: 3416796 - RNA, 15 nt, Human
aacugcauggaccua

SEQ ID NO: 3416797 - RNA, 23 nt, Human
aacugcauuaccgcguuguaaaa

SEQ ID NO: 3416798 - RNA, 20 nt, Human
aacugcauugagaacugcau

SEQ ID NO: 3416799 - RNA, 14 nt, Human
aacugcccaaagca

SEQ ID NO: 3416800 - RNA, 16 nt, Human
aacugcccccaacuuu

SEQ ID NO: 3416801 - RNA, 18 nt, Human
aacugcccccucugcccu

SEQ ID NO: 3416802 - RNA, 13 nt, Human
aacugccuagaaa

SEQ ID NO: 3416803 - RNA, 17 nt, Human
aacugccuagaaacaac

SEQ ID NO: 3416804 - RNA, 17 nt, Human
aacugccuuaaaacuuu

SEQ ID NO: 3416805 - RNA, 18 nt, Human
aacugcucauaugaugua

SEQ ID NO: 3416806 - RNA, 17 nt, Human
aacugcucccaccuccu

SEQ ID NO: 3416807 - RNA, 13 nt, Human
aacugcuccuccu

SEQ ID NO: 3416808 - RNA, 20 nt, Human
aacugcucuugggcaauauu

SEQ ID NO: 3416809 - RNA, 12 nt, Human
aacugcugccac

SEQ ID NO: 3416810 - RNA, 13 nt, Human
aacugcugcccca

SEQ ID NO: 3416811 - RNA, 20 nt, Human
aacugcugcuuuuugaggug

SEQ ID NO: 3416812 - RNA, 20 nt, Human
aacugcuggacgucuuucuu

SEQ ID NO: 3416813 - RNA, 22 nt, Human
aacugcuucccuuacuuugcug

SEQ ID NO: 3416814 - RNA, 18 nt, Human
aacugcuuccuauaauuu

SEQ ID NO: 3416815 - RNA, 19 nt, Human
aacugcuuccuuucuugau

SEQ ID NO: 3416816 - RNA, 18 nt, Human
aacugcuuucuguuccaa

SEQ ID NO: 3416817 - RNA, 22 nt, Human
aacugcuuuuuuuuuuccagca

SEQ ID NO: 3416818 - RNA, 20 nt, Human
aacuggaaaacagaacacuu

SEQ ID NO: 3416819 - RNA, 12 nt, Human
aacuggaaagaa

SEQ ID NO: 3416820 - RNA, 13 nt, Human
aacuggaagcaca

SEQ ID NO: 3416821 - RNA, 21 nt, Human
aacuggaauaagaagcaaaua

SEQ ID NO: 3416822 - RNA, 18 nt, Human
aacuggacccuguugcua

SEQ ID NO: 3416823 - RNA, 19 nt, Human
aacuggacccuguugcuaa

SEQ ID NO: 3416824 - RNA, 22 nt, Human
aacuggacccuguugcuaagcc

SEQ ID NO: 3416825 - RNA, 15 nt, Human
aacuggacucaggau

SEQ ID NO: 3416826 - RNA, 13 nt, Human
aacuggcaaagca

SEQ ID NO: 3416827 - RNA, 22 nt, Human
aacuggcaggcaggcucccagg

SEQ ID NO: 3416828 - RNA, 20 nt, Human
aacuggcaucugacacaaaa

SEQ ID NO: 3416829 - RNA, 16 nt, Human
aacuggccaagcugag

SEQ ID NO: 3416830 - RNA, 17 nt, Human
aacuggccaagcugagg

SEQ ID NO: 3416831 - RNA, 21 nt, Human
aacuggccaagcugaggugcc

SEQ ID NO: 3416832 - RNA, 21 nt, Human
aacuggccccggaucagagca

SEQ ID NO: 3416833 - RNA, 18 nt, Human
aacuggcccuauuuagau

SEQ ID NO: 3416834 - RNA, 22 nt, Human
aacuggcccuauuuagaugaua

SEQ ID NO: 3416835 - RNA, 21 nt, Human
aacuggcccucuucuuacuug

SEQ ID NO: 3416836 - RNA, 13 nt, Human
aacugggaccuuu

SEQ ID NO: 3416837 - RNA, 16 nt, Human
aacugggggaaaagau

SEQ ID NO: 3416838 - RNA, 16 nt, Human
aacuggguacuugugg

SEQ ID NO: 3416839 - RNA, 21 nt, Human
aacuggguacuuguggacaca

SEQ ID NO: 3416840 - RNA, 14 nt, Human
aacuggguuccugc

SEQ ID NO: 3416841 - RNA, 15 nt, Human
aacuggguuccugca

SEQ ID NO: 3416842 - RNA, 21 nt, Human
aacugguauucuguucuggag

SEQ ID NO: 3416843 - RNA, 13 nt, Human
aacugguauuuua

SEQ ID NO: 3416844 - RNA, 22 nt, Human
aacugguauuuuaucuuugauu

SEQ ID NO: 3416845 - RNA, 15 nt, Human
aacuggucuuccuuu

SEQ ID NO: 3416846 - RNA, 18 nt, Human
aacuggugcacuuuguaa

SEQ ID NO: 3416847 - RNA, 21 nt, Human
aacuggugcacuuuguaaauu

SEQ ID NO: 3416848 - RNA, 14 nt, Human
aacuguaaagaugu

SEQ ID NO: 3416849 - RNA, 20 nt, Human
aacuguaauuauuugaauga

SEQ ID NO: 3416850 - RNA, 16 nt, Human
aacuguacagugucuu

SEQ ID NO: 3416851 - RNA, 17 nt, Human
aacuguacagugucuuu

SEQ ID NO: 3416852 - RNA, 14 nt, Human
aacuguacauuuaa

SEQ ID NO: 3416853 - RNA, 22 nt, Human
aacuguaccaugugcuacaggg

SEQ ID NO: 3416854 - RNA, 15 nt, Human
aacuguacuuugauu

SEQ ID NO: 3416855 - RNA, 19 nt, Human
aacuguacuuugauucaca

SEQ ID NO: 3416856 - RNA, 20 nt, Human
aacuguacuuugauucacau

SEQ ID NO: 3416857 - RNA, 14 nt, Human
aacuguagaaauga

SEQ ID NO: 3416858 - RNA, 17 nt, Human
aacuguagaaaugauga

SEQ ID NO: 3416859 - RNA, 14 nt, Human
aacuguauauuugu

SEQ ID NO: 3416860 - RNA, 21 nt, Human
aacugucaaagaaucaaucca

SEQ ID NO: 3416861 - RNA, 17 nt, Human
aacuguccucuuucaga

SEQ ID NO: 3416862 - RNA, 19 nt, Human
aacuguccucuuucagaaa

SEQ ID NO: 3416863 - RNA, 11 nt, Human
aacuguccugu

SEQ ID NO: 3416864 - RNA, 18 nt, Human
aacuguccuguccugcuc

SEQ ID NO: 3416865 - RNA, 14 nt, Human
aacuguccuuuccu

SEQ ID NO: 3416866 - RNA, 19 nt, Human
aacugucuauuucugcuga

SEQ ID NO: 3416867 - RNA, 19 nt, Human
aacugucucucaugaaccu

SEQ ID NO: 3416868 - RNA, 14 nt, Human
aacugucuuccuca

SEQ ID NO: 3416869 - RNA, 16 nt, Human
aacugucuuccucaaa

SEQ ID NO: 3416870 - RNA, 19 nt, Human
aacugucuuuaaaagagag

SEQ ID NO: 3416871 - RNA, 23 nt, Human
aacugugaugaagccgaccuuag

SEQ ID NO: 3416872 - RNA, 15 nt, Human
aacugugccacaaug

SEQ ID NO: 3416873 - RNA, 14 nt, Human
aacuguggauauug

SEQ ID NO: 3416874 - RNA, 11 nt, Human
aacuguggccg

SEQ ID NO: 3416875 - RNA, 14 nt, Human
aacaugaaaugaua

SEQ ID NO: 3416876 - RNA, 20 nt, Human
aacaugaacacccuuagaaa

SEQ ID NO: 3416877 - RNA, 19 nt, Human
aacaugacauuuaccagca

SEQ ID NO: 3416878 - RNA, 18 nt, Human
aacaugaggccacuggag

SEQ ID NO: 3416879 - RNA, 14 nt, Human
aacaugaugaaacc

SEQ ID NO: 3416880 - RNA, 17 nt, Human
aacaugcaguuugaaau

SEQ ID NO: 3416881 - RNA, 18 nt, Human
aacaugcaguuugaaauu

SEQ ID NO: 3416882 - RNA, 22 nt, Human
aacaugccugccccaaacaaau

SEQ ID NO: 3416883 - RNA, 17 nt, Human
aacaugcuaccugaucc

SEQ ID NO: 3416884 - RNA, 17 nt, Human
aacaugcuguguaagcu

SEQ ID NO: 3416885 - RNA, 23 nt, Human
aacaugcuguuauuuagguauuu

SEQ ID NO: 3416886 - RNA, 23 nt, Human
aacaugcuuaugacaaugacugu

SEQ ID NO: 3416887 - RNA, 22 nt, Human
aacauggaacucauuccugccu

SEQ ID NO: 3416888 - RNA, 15 nt, Human
aacauggaaguacua

SEQ ID NO: 3416889 - RNA, 15 nt, Human
aacauggacuuguau

SEQ ID NO: 3416890 - RNA, 18 nt, Human
aacauggacuuguauauu

SEQ ID NO: 3416891 - RNA, 23 nt, Human
aacauggccuuugcuugaaagaa

SEQ ID NO: 3416892 - RNA, 13 nt, Human
aacauggcuuuga

SEQ ID NO: 3416893 - RNA, 20 nt, Human
aacaugguuacaaucauugc

SEQ ID NO: 3416894 - RNA, 23 nt, Human
aacaugguuugacucaucuuaua

SEQ ID NO: 3416895 - RNA, 12 nt, Human
aacauguaauau

SEQ ID NO: 3416896 - RNA, 18 nt, Human
aacauguaauauaaagau

SEQ ID NO: 3416897 - RNA, 23 nt, Human
aacauguaauuaaguacuaugua

SEQ ID NO: 3416898 - RNA, 15 nt, Human
aacauguacuguucu

SEQ ID NO: 3416899 - RNA, 11 nt, Human
aacauguaugu

SEQ ID NO: 3416900 - RNA, 19 nt, Human
aacauguccugccuauuau

SEQ ID NO: 3416901 - RNA, 20 nt, Human
aacauguggcuccucccagc

SEQ ID NO: 3416902 - RNA, 13 nt, Human
aacauguguuuua

SEQ ID NO: 3416903 - RNA, 12 nt, Human
aacauguuggua

SEQ ID NO: 3416904 - RNA, 14 nt, Human
aacauguugguauu

SEQ ID NO: 3416905 - RNA, 15 nt, Human
aacauguugguauuu

SEQ ID NO: 3416906 - RNA, 16 nt, Human
aacauguuuccagcau

SEQ ID NO: 3416907 - RNA, 18 nt, Human
aacauguuuccagcauuc

SEQ ID NO: 3416908 - RNA, 21 nt, Human
aacauguuuccagcauuccca

SEQ ID NO: 3416909 - RNA, 22 nt, Human
aacauguuuccagcauucccag

SEQ ID NO: 3416910 - RNA, 22 nt, Human
aacauguuuuucuucucccuca

SEQ ID NO: 3416911 - RNA, 16 nt, Human
aacauuaaaaauggaa

SEQ ID NO: 3416912 - RNA, 16 nt, Human
aacauuaagaaaauca

SEQ ID NO: 3416913 - RNA, 19 nt, Human
aacauuaauccacauguuu

SEQ ID NO: 3416914 - RNA, 18 nt, Human
aacauuaaugccugcuuu

SEQ ID NO: 3416915 - RNA, 23 nt, Human
aacauuaaugccugcuuuuugga

SEQ ID NO: 3416916 - RNA, 15 nt, Human
aacauuaauguugau

SEQ ID NO: 3416917 - RNA, 20 nt, Human
aacauuacagggaaugccug

SEQ ID NO: 3416918 - RNA, 16 nt, Human
aacauuaccuuacugu

SEQ ID NO: 3416919 - RNA, 21 nt, Human
aacauuaggcagguugcuuaa

SEQ ID NO: 3416920 - RNA, 23 nt, Human
aacauuauuuauucagcuucauu

SEQ ID NO: 3416921 - RNA, 17 nt, Human
aacauuccaagacucua

SEQ ID NO: 3416922 - RNA, 10 nt, Human
aacauuccau

SEQ ID NO: 3416923 - RNA, 23 nt, Human
aacauuccauccuugagucaaaa

SEQ ID NO: 3416924 - RNA, 19 nt, Human
aacauuccguuuacauuuu

SEQ ID NO: 3416925 - RNA, 22 nt, Human
aacauuccucaugaauguaaau

SEQ ID NO: 3416926 - RNA, 21 nt, Human
aacauucgaucucauucagua

SEQ ID NO: 3416927 - RNA, 14 nt, Human
aacauucuauuuca

SEQ ID NO: 3416928 - RNA, 16 nt, Human
aacauugaaguaauga

SEQ ID NO: 3416929 - RNA, 19 nt, Human
aacauugaccaagaacugc

SEQ ID NO: 3416930 - RNA, 17 nt, Human
aacauugcaauagaaau

SEQ ID NO: 3416931 - RNA, 20 nt, Human
aacauugccuauuucagugg

SEQ ID NO: 3416932 - RNA, 19 nt, Human
aacauugcuuuuaaaacua

SEQ ID NO: 3416933 - RNA, 24 nt, Human
aacauuggaagcagguuaaauguu

SEQ ID NO: 3416934 - RNA, 12 nt, Human
aacauuggauua

SEQ ID NO: 3416935 - RNA, 15 nt, Human
aacauuggcuccugu

SEQ ID NO: 3416936 - RNA, 23 nt, Human
aacauugguucuuguauuaagaa

SEQ ID NO: 3416937 - RNA, 23 nt, Human
aacauuguguucccauuucagcu

SEQ ID NO: 3416938 - RNA, 18 nt, Human
aacauuguuccagauuca

SEQ ID NO: 3416939 - RNA, 19 nt, Human
aacauuguuccagauucaa

SEQ ID NO: 3416940 - RNA, 17 nt, Human
aacauuuacuacaguuu

SEQ ID NO: 3416941 - RNA, 19 nt, Human
aacauuuacuacaguuuuu

SEQ ID NO: 3416942 - RNA, 19 nt, Human
aacauuuauuuuaugagaa

SEQ ID NO: 3416943 - RNA, 20 nt, Human
aacauuuauuuuaugagaaa

SEQ ID NO: 3416944 - RNA, 16 nt, Human
aacauuucucaauaau

SEQ ID NO: 3416945 - RNA, 16 nt, Human
aacauuucuguaaaua

SEQ ID NO: 3416946 - RNA, 12 nt, Human
aacauuugccuu

SEQ ID NO: 3416947 - RNA, 22 nt, Human
aacauuugugauauauguauua

SEQ ID NO: 3416948 - RNA, 17 nt, Human
aacauuuguguguuaua

SEQ ID NO: 3416949 - RNA, 15 nt, Human
aacauuuuaaauaaa

SEQ ID NO: 3416950 - RNA, 15 nt, Human
aacauuuuaaaugga

SEQ ID NO: 3416951 - RNA, 17 nt, Human
aacauuuuaaauggaca

SEQ ID NO: 3416952 - RNA, 14 nt, Human
aacauuuuaauuca

SEQ ID NO: 3416953 - RNA, 19 nt, Human
aacauuuucucuuagaaaa

SEQ ID NO: 3416954 - RNA, 23 nt, Human
aacauuuugaaagucuguccuug

SEQ ID NO: 3416955 - RNA, 16 nt, Human
aacauuuugucauaua

SEQ ID NO: 3416956 - RNA, 22 nt, Human
aacauuuuguggucauuaagca

SEQ ID NO: 3416957 - RNA, 16 nt, Human
aagaccuuuuucugca

SEQ ID NO: 3416958 - RNA, 21 nt, Human
aagacgaggcccucgggccca

SEQ ID NO: 3416959 - RNA, 15 nt, Human
aagacgccugagcuc

SEQ ID NO: 3416960 - RNA, 17 nt, Human
aagacgccuuucuccuc

SEQ ID NO: 3416961 - RNA, 23 nt, Human
aagacgcugugcugcccugccca

SEQ ID NO: 3416962 - RNA, 19 nt, Human
aagacgguuaaauacugug

SEQ ID NO: 3416963 - RNA, 16 nt, Human
aagacgugauuuugcu

SEQ ID NO: 3416964 - RNA, 16 nt, Human
aagacguguuuguguu

SEQ ID NO: 3416965 - RNA, 15 nt, Human
aagacguuuuauaag

SEQ ID NO: 3416966 - RNA, 22 nt, Human
aagacuauauauauaaauguau

SEQ ID NO: 3416967 - RNA, 18 nt, Human
aagacuaucuaaauguug

SEQ ID NO: 3416968 - RNA, 17 nt, Human
aagacuaugaaaaugcu

SEQ ID NO: 3416969 - RNA, 13 nt, Human
aagacuauucaaa

SEQ ID NO: 3416970 - RNA, 14 nt, Human
aagacucaaauguu

SEQ ID NO: 3416971 - RNA, 19 nt, Human
aagacucaaauguucuaag

SEQ ID NO: 3416972 - RNA, 16 nt, Human
aagacuccucggccug

SEQ ID NO: 3416973 - RNA, 22 nt, Human
aagacucuaccagacuguguau

SEQ ID NO: 3416974 - RNA, 13 nt, Human
aagacucuagagu

SEQ ID NO: 3416975 - RNA, 15 nt, Human
aagacugagcaccug

SEQ ID NO: 3416976 - RNA, 17 nt, Human
aagacugaguacguugu

SEQ ID NO: 3416977 - RNA, 18 nt, Human
aagacugcuguggccagg

SEQ ID NO: 3416978 - RNA, 19 nt, Human
aagacugcuguggccagga

SEQ ID NO: 3416979 - RNA, 11 nt, Human
aagacuggcuu

SEQ ID NO: 3416980 - RNA, 23 nt, Human
aagacuggcuuuuauuaaugcac

SEQ ID NO: 3416981 - RNA, 16 nt, Human
aagacuguacaaagua

SEQ ID NO: 3416982 - RNA, 15 nt, Human
aagacuguggcugcu

SEQ ID NO: 3416983 - RNA, 16 nt, Human
aagacuuacucuaaga

SEQ ID NO: 3416984 - RNA, 17 nt, Human
aagacuuagauugugcu

SEQ ID NO: 3416985 - RNA, 16 nt, Human
aagacuuccagagccu

SEQ ID NO: 3416986 - RNA, 18 nt, Human
aagacuuccagagccuca

SEQ ID NO: 3416987 - RNA, 13 nt, Human
aagacuugacagu

SEQ ID NO: 3416988 - RNA, 14 nt, Human
aagacuugacagug

SEQ ID NO: 3416989 - RNA, 19 nt, Human
aagacuuggcaacagaagc

SEQ ID NO: 3416990 - RNA, 16 nt, Human
aagacuuguuucugau

SEQ ID NO: 3416991 - RNA, 12 nt, Human
aagacuuguuuu

SEQ ID NO: 3416992 - RNA, 19 nt, Human
aagacuuugggauaggaaa

SEQ ID NO: 3416993 - RNA, 21 nt, Human
aagacuuuuccaacccucauc

SEQ ID NO: 3416994 - RNA, 13 nt, Human
aagagaaaaaaua

SEQ ID NO: 3416995 - RNA, 11 nt, Human
aagagaaaaag

SEQ ID NO: 3416996 - RNA, 18 nt, Human
aagagaaaacaucucauc

SEQ ID NO: 3416997 - RNA, 12 nt, Human
aagagaaaagaa

SEQ ID NO: 3416998 - RNA, 18 nt, Human
aagagaaaauugaauuua

SEQ ID NO: 3416999 - RNA, 18 nt, Human
aagagaaacuuuauacau

SEQ ID NO: 3417000 - RNA, 18 nt, Human
aagagaaacuuugugcua

SEQ ID NO: 3417001 - RNA, 20 nt, Human
aagagaaacuuugugcuaca

SEQ ID NO: 3417002 - RNA, 19 nt, Human
aagagaaaggccugcacac

SEQ ID NO: 3417003 - RNA, 11 nt, Human
aagagaaaucu

SEQ ID NO: 3417004 - RNA, 20 nt, Human
aagagaacccacgaacauuc

SEQ ID NO: 3417005 - RNA, 21 nt, Human
aagagaaccgagcaaagauca

SEQ ID NO: 3417006 - RNA, 17 nt, Human
aagagaagcugcugacc

SEQ ID NO: 3417007 - RNA, 13 nt, Human
aagagaaggagca

SEQ ID NO: 3417008 - RNA, 12 nt, Human
aagagaauauuu

SEQ ID NO: 3417009 - RNA, 13 nt, Human
aagagaauauuuu

SEQ ID NO: 3417010 - RNA, 18 nt, Human
aagagaauauuuuaagua

SEQ ID NO: 3417011 - RNA, 13 nt, Human
aagagaauguuga

SEQ ID NO: 3417012 - RNA, 14 nt, Human
aagagacagaaugu

SEQ ID NO: 3417013 - RNA, 18 nt, Human
aagagacagagacaagua

SEQ ID NO: 3417014 - RNA, 22 nt, Human
aagagacagagacaaguaauuu

SEQ ID NO: 3417015 - RNA, 14 nt, Human
aagagacaggcagg

SEQ ID NO: 3417016 - RNA, 17 nt, Human
aagagaccuaccucagg

SEQ ID NO: 3417017 - RNA, 15 nt, Human
aagagacucagccug

SEQ ID NO: 3417018 - RNA, 16 nt, Human
aagagacucagccugc

SEQ ID NO: 3417019 - RNA, 17 nt, Human
aagagacucagccugca

SEQ ID NO: 3417020 - RNA, 14 nt, Human
aaccagagcacugu

SEQ ID NO: 3417021 - RNA, 18 nt, Human
aaccagagccauggacuc

SEQ ID NO: 3417022 - RNA, 14 nt, Human
aaccagaggcagcu

SEQ ID NO: 3417023 - RNA, 13 nt, Human
aaccagauaacau

SEQ ID NO: 3417024 - RNA, 14 nt, Human
aaccagaucauugu

SEQ ID NO: 3417025 - RNA, 21 nt, Human
aaccagcuaagaaaagauuuu

SEQ ID NO: 3417026 - RNA, 17 nt, Human
aaccagcuuccuucaga

SEQ ID NO: 3417027 - RNA, 20 nt, Human
aaccagcuuccuucagagag

SEQ ID NO: 3417028 - RNA, 22 nt, Human
aaccagcuuccuucagagagca

SEQ ID NO: 3417029 - RNA, 18 nt, Human
aaccaggcaccucuuccu

SEQ ID NO: 3417030 - RNA, 21 nt, Human
aaccaggcuuucuagaaagaa

SEQ ID NO: 3417031 - RNA, 15 nt, Human
aaccagggauuguuu

SEQ ID NO: 3417032 - RNA, 19 nt, Human
aaccagggauuguuucugu

SEQ ID NO: 3417033 - RNA, 22 nt, Human
aaccagggcaccaagcccacag

SEQ ID NO: 3417034 - RNA, 22 nt, Human
aaccagguccaaugagcuuucu

SEQ ID NO: 3417035 - RNA, 18 nt, Human
aaccagguccagaugugc

SEQ ID NO: 3417036 - RNA, 21 nt, Human
aaccaguauuguacaaaguau

SEQ ID NO: 3417037 - RNA, 16 nt, Human
aaccaguauuuuugcu

SEQ ID NO: 3417038 - RNA, 22 nt, Human
aaccaguauuuuugcugcuucu

SEQ ID NO: 3417039 - RNA, 22 nt, Human
aaccaguccccccacccucauu

SEQ ID NO: 3417040 - RNA, 15 nt, Human
aaccagucugaaguu

SEQ ID NO: 3417041 - RNA, 13 nt, Human
aaccagugccaag

SEQ ID NO: 3417042 - RNA, 15 nt, Human
aaccagugccaagga

SEQ ID NO: 3417043 - RNA, 16 nt, Human
aaccagugccaaggac

SEQ ID NO: 3417044 - RNA, 14 nt, Human
aaccaguguagccu

SEQ ID NO: 3417045 - RNA, 17 nt, Human
aaccaguuuagauuuca

SEQ ID NO: 3417046 - RNA, 22 nt, Human
aaccaguuuagauuucaagaaa

SEQ ID NO: 3417047 - RNA, 15 nt, Human
aaccauaaaaagcug

SEQ ID NO: 3417048 - RNA, 18 nt, Human
aaccauaaacuucauggu

SEQ ID NO: 3417049 - RNA, 22 nt, Human
aaccauagcacaggcuaauuuu

SEQ ID NO: 3417050 - RNA, 22 nt, Human
aaccauaggcugcucugccugu

SEQ ID NO: 3417051 - RNA, 18 nt, Human
aaccauaguuacuguaaa

SEQ ID NO: 3417052 - RNA, 16 nt, Human
aaccauauggauauua

SEQ ID NO: 3417053 - RNA, 14 nt, Human
aaccauauuuagca

SEQ ID NO: 3417054 - RNA, 20 nt, Human
aaccaucauugaaaucuuuu

SEQ ID NO: 3417055 - RNA, 23 nt, Human
aaccaucauugaaaucuuuuugc

SEQ ID NO: 3417056 - RNA, 20 nt, Human
aaccauccagugacaaacca

SEQ ID NO: 3417057 - RNA, 19 nt, Human
aaccauccccuccguggca

SEQ ID NO: 3417058 - RNA, 12 nt, Human
aaccaucucccu

SEQ ID NO: 3417059 - RNA, 13 nt, Human
aaccaucucccug

SEQ ID NO: 3417060 - RNA, 15 nt, Human
aaccaucuggccugg

SEQ ID NO: 3417061 - RNA, 17 nt, Human
aaccaucuggccuggcc

SEQ ID NO: 3417062 - RNA, 17 nt, Human
aaccaugaagacaggau

SEQ ID NO: 3417063 - RNA, 23 nt, Human
aaccaugaagagauuuuucauga

SEQ ID NO: 3417064 - RNA, 24 nt, Human
aaccaugaagagauuuuucaugau

SEQ ID NO: 3417065 - RNA, 16 nt, Human
aaccauggacuuuaua

SEQ ID NO: 3417066 - RNA, 16 nt, Human
aaccauggcugaagga

SEQ ID NO: 3417067 - RNA, 16 nt, Human
aaccauggugcuuguu

SEQ ID NO: 3417068 - RNA, 20 nt, Human
aaccauguguuauguuuucg

SEQ ID NO: 3417069 - RNA, 13 nt, Human
aaccauguuuugg

SEQ ID NO: 3417070 - RNA, 15 nt, Human
aaccauuaaagucag

SEQ ID NO: 3417071 - RNA, 17 nt, Human
aaccauuaaccagaucu

SEQ ID NO: 3417072 - RNA, 23 nt, Human
aaccauuccauuuccaagcacuu

SEQ ID NO: 3417073 - RNA, 15 nt, Human
aaccauugcuucacu

SEQ ID NO: 3417074 - RNA, 14 nt, Human
aaccauugucuugu

SEQ ID NO: 3417075 - RNA, 15 nt, Human
aaccauugucuuguu

SEQ ID NO: 3417076 - RNA, 24 nt, Human
aaccauugucuuguucugugauga

SEQ ID NO: 3417077 - RNA, 15 nt, Human
aaccauuuaucuuga

SEQ ID NO: 3417078 - RNA, 14 nt, Human
aaccauuuucauua

SEQ ID NO: 3417079 - RNA, 23 nt, Human
aaccauuuugcugucccuuuucc

SEQ ID NO: 3417080 - RNA, 15 nt, Human
aacccaaaccuggag

SEQ ID NO: 3417081 - RNA, 17 nt, Human
aacccaaaccuggagau

SEQ ID NO: 3417082 - RNA, 13 nt, Human
aacccaaauguuc

SEQ ID NO: 3417083 - RNA, 16 nt, Human
aacccaacucuccugg

SEQ ID NO: 3417084 - RNA, 15 nt, Human
aacccaagcuccucc

SEQ ID NO: 3417085 - RNA, 13 nt, Human
aacccaaggagca

SEQ ID NO: 3417086 - RNA, 20 nt, Human
aacccaaggagcacaggucc

SEQ ID NO: 3417087 - RNA, 19 nt, Human
aacccaagguaccauccua

SEQ ID NO: 3417088 - RNA, 13 nt, Human
aacccaauaguug

SEQ ID NO: 3417089 - RNA, 14 nt, Human
aacccaauccaaau

SEQ ID NO: 3417090 - RNA, 22 nt, Human
aacccaccuuguuggagccugc

SEQ ID NO: 3417091 - RNA, 14 nt, Human
aacccagaaacacc

SEQ ID NO: 3417092 - RNA, 21 nt, Human
aacccagacggcuccacuagg

SEQ ID NO: 3417093 - RNA, 16 nt, Human
aacccagacucagaca

SEQ ID NO: 3417094 - RNA, 14 nt, Human
aacccagauaaagg

SEQ ID NO: 3417095 - RNA, 23 nt, Human
aacccagcaacagaaaaauggag

SEQ ID NO: 3417096 - RNA, 10 nt, Human
aacccagcuc

SEQ ID NO: 3417097 - RNA, 20 nt, Human
aacccagcucccuucuuccc

SEQ ID NO: 3417098 - RNA, 15 nt, Human
aacccagcugcaccc

SEQ ID NO: 3417099 - RNA, 16 nt, Human
aacccagcugcacccc

SEQ ID NO: 3417100 - RNA, 21 nt, Human
aacccagcugcaccccuuccu

SEQ ID NO: 3417101 - RNA, 12 nt, Human
aacccaggaggu

SEQ ID NO: 3417102 - RNA, 19 nt, Human
aacccagggcucugcccca

SEQ ID NO: 3417103 - RNA, 17 nt, Human
aacccagucacugugag

SEQ ID NO: 3417104 - RNA, 23 nt, Human
aacccagucgcccuuacuucuug

SEQ ID NO: 3417105 - RNA, 21 nt, Human
aacccauauuguaaaacaggu

SEQ ID NO: 3417106 - RNA, 21 nt, Human
aacccaucuaccccuggauga

SEQ ID NO: 3417107 - RNA, 15 nt, Human
aaccccaacgcacag

SEQ ID NO: 3417108 - RNA, 18 nt, Human
aaccccaacgcacaggaa

SEQ ID NO: 3417109 - RNA, 19 nt, Human
aaccccaacgcacaggaaa

SEQ ID NO: 3417110 - RNA, 16 nt, Human
aaccccaaguuaguuc

SEQ ID NO: 3417111 - RNA, 15 nt, Human
aaccccacccuguuu

SEQ ID NO: 3417112 - RNA, 15 nt, Human
aaccccagacacugg

SEQ ID NO: 3417113 - RNA, 12 nt, Human
aaccccagcucc

SEQ ID NO: 3417114 - RNA, 19 nt, Human
aaccccaguucugcuccuc

SEQ ID NO: 3417115 - RNA, 17 nt, Human
aaccccauguccucagc

SEQ ID NO: 3417116 - RNA, 14 nt, Human
aacccccacacaca

SEQ ID NO: 3417117 - RNA, 10 nt, Human
aacccccacc

SEQ ID NO: 3417118 - RNA, 11 nt, Human
aacccccaccc

SEQ ID NO: 3417119 - RNA, 17 nt, Human
aagaggcgggccagcca

SEQ ID NO: 3417120 - RNA, 20 nt, Human
aagaggcguugcuuucacuc

SEQ ID NO: 3417121 - RNA, 16 nt, Human
aagaggcugagacagg

SEQ ID NO: 3417122 - RNA, 18 nt, Human
aagaggcugaggccugga

SEQ ID NO: 3417123 - RNA, 22 nt, Human
aagaggcugaggcuggcacagg

SEQ ID NO: 3417124 - RNA, 14 nt, Human
aagaggcugcagcc

SEQ ID NO: 3417125 - RNA, 23 nt, Human
aagaggcugccccucucaccaaa

SEQ ID NO: 3417126 - RNA, 12 nt, Human
aagaggcugguu

SEQ ID NO: 3417127 - RNA, 22 nt, Human
aagagggaauccccgaaggugc

SEQ ID NO: 3417128 - RNA, 16 nt, Human
aagagggacgccuggg

SEQ ID NO: 3417129 - RNA, 18 nt, Human
aagagggagaagcaugaa

SEQ ID NO: 3417130 - RNA, 19 nt, Human
aagagggagagguggagca

SEQ ID NO: 3417131 - RNA, 18 nt, Human
aagagggagauggagacu

SEQ ID NO: 3417132 - RNA, 23 nt, Human
aagagggagggagggcuccagac

SEQ ID NO: 3417133 - RNA, 17 nt, Human
aagagggcacacacugu

SEQ ID NO: 3417134 - RNA, 12 nt, Human
aagagggccugu

SEQ ID NO: 3417135 - RNA, 14 nt, Human
aagagggccugugg

SEQ ID NO: 3417136 - RNA, 11 nt, Human
aagaggggcag

SEQ ID NO: 3417137 - RNA, 13 nt, Human
aagaggggcagcc

SEQ ID NO: 3417138 - RNA, 15 nt, Human
aagaggggcagcccu

SEQ ID NO: 3417139 - RNA, 21 nt, Human
aagaggggugcagaggcugug

SEQ ID NO: 3417140 - RNA, 17 nt, Human
aagagggugggugggua

SEQ ID NO: 3417141 - RNA, 22 nt, Human
aagaggguuuuagguagaaaaa

SEQ ID NO: 3417142 - RNA, 17 nt, Human
aagaggugaccccaggg

SEQ ID NO: 3417143 - RNA, 18 nt, Human
aagaggugaccccagggc

SEQ ID NO: 3417144 - RNA, 19 nt, Human
aagaggugaccccagggca

SEQ ID NO: 3417145 - RNA, 20 nt, Human
aagaggugaccccagggcac

SEQ ID NO: 3417146 - RNA, 22 nt, Human
aagaggugaccccagggcacag

SEQ ID NO: 3417147 - RNA, 24 nt, Human
aagaggugaccccagggcacagga

SEQ ID NO: 3417148 - RNA, 16 nt, Human
aagaggugggagggcc

SEQ ID NO: 3417149 - RNA, 16 nt, Human
aagaggugugcaagag

SEQ ID NO: 3417150 - RNA, 18 nt, Human
aagaggugugcaagagag

SEQ ID NO: 3417151 - RNA, 15 nt, Human
aagagguguuauuug

SEQ ID NO: 3417152 - RNA, 17 nt, Human
aagagguguuauuugga

SEQ ID NO: 3417153 - RNA, 17 nt, Human
aagagguguuuuuucua

SEQ ID NO: 3417154 - RNA, 18 nt, Human
aagagguuuuaaagcuuc

SEQ ID NO: 3417155 - RNA, 16 nt, Human
aagagguuuuucuuaa

SEQ ID NO: 3417156 - RNA, 17 nt, Human
aagaguaaaggaaauga

SEQ ID NO: 3417157 - RNA, 13 nt, Human
aagaguaaucaau

SEQ ID NO: 3417158 - RNA, 15 nt, Human
aagaguagaauugca

SEQ ID NO: 3417159 - RNA, 20 nt, Human
aagaguaggaagacuuugga

SEQ ID NO: 3417160 - RNA, 19 nt, Human
aagaguaguugauguugca

SEQ ID NO: 3417161 - RNA, 14 nt, Human
aagagucuuccaau

SEQ ID NO: 3417162 - RNA, 16 nt, Human
aagagucuuucuucuu

SEQ ID NO: 3417163 - RNA, 15 nt, Human
aagagugaaaaauga

SEQ ID NO: 3417164 - RNA, 22 nt, Human
aagagugacucuccaggggucc

SEQ ID NO: 3417165 - RNA, 15 nt, Human
aagauucccaggagu

SEQ ID NO: 3417166 - RNA, 24 nt, Human
aagauuccggauccuaagcaucua

SEQ ID NO: 3417167 - RNA, 22 nt, Human
aagauuccuuuucuuguuuauc

SEQ ID NO: 3417168 - RNA, 19 nt, Human
aagauucuauaguucuaga

SEQ ID NO: 3417169 - RNA, 21 nt, Human
aagauucuauguuaauauuuu

SEQ ID NO: 3417170 - RNA, 20 nt, Human
aagauucucuauguaucaaa

SEQ ID NO: 3417171 - RNA, 15 nt, Human
aagauucuucccauu

SEQ ID NO: 3417172 - RNA, 20 nt, Human
aagauucuucccauucucca

SEQ ID NO: 3417173 - RNA, 22 nt, Human
aagauucuucccauucuccauu

SEQ ID NO: 3417174 - RNA, 14 nt, Human
aagauugagaaguu

SEQ ID NO: 3417175 - RNA, 20 nt, Human
aagauugauaucuauaaaau

SEQ ID NO: 3417176 - RNA, 17 nt, Human
aagauugauguuuccuu

SEQ ID NO: 3417177 - RNA, 18 nt, Human
aagauugccccaucuaga

SEQ ID NO: 3417178 - RNA, 12 nt, Human
aagauugcugaa

SEQ ID NO: 3417179 - RNA, 17 nt, Human
aagauugugugguguuu

SEQ ID NO: 3417180 - RNA, 19 nt, Human
aagauuguuuaucuagaug

SEQ ID NO: 3417181 - RNA, 21 nt, Human
aagauuuaagcacaaacuuua

SEQ ID NO: 3417182 - RNA, 12 nt, Human
aagauuuaauau

SEQ ID NO: 3417183 - RNA, 16 nt, Human
aagauuuaccacuugu

SEQ ID NO: 3417184 - RNA, 14 nt, Human
aagauuuaucaaau

SEQ ID NO: 3417185 - RNA, 17 nt, Human
aagauuuaucaaaucag

SEQ ID NO: 3417186 - RNA, 22 nt, Human
aagauuuccuucuuuuuuucuu

SEQ ID NO: 3417187 - RNA, 22 nt, Human
aagauuugaugcuggagagguu

SEQ ID NO: 3417188 - RNA, 23 nt, Human
aagauuugaugcuggagagguua

SEQ ID NO: 3417189 - RNA, 15 nt, Human
aagauuugcccauuu

SEQ ID NO: 3417190 - RNA, 21 nt, Human
aagauuugcccauuuacacuu

SEQ ID NO: 3417191 - RNA, 20 nt, Human
aagauuuguuuuuaaacugu

SEQ ID NO: 3417192 - RNA, 16 nt, Human
aagauuuuaaagacau

SEQ ID NO: 3417193 - RNA, 13 nt, Human
aagauuuuaaauu

SEQ ID NO: 3417194 - RNA, 12 nt, Human
aagauuuuccuu

SEQ ID NO: 3417195 - RNA, 12 nt, Human
aagauuuugaaa

SEQ ID NO: 3417196 - RNA, 14 nt, Human
aagauuuugaaaac

SEQ ID NO: 3417197 - RNA, 15 nt, Human
aagauuuugaaugcu

SEQ ID NO: 3417198 - RNA, 13 nt, Human
aagauuuugaucu

SEQ ID NO: 3417199 - RNA, 20 nt, Human
aagauuuugaucucacauuu

SEQ ID NO: 3417200 - RNA, 21 nt, Human
aagauuuuggaggagaaggac

SEQ ID NO: 3417201 - RNA, 15 nt, Human
aagauuuuucucaaa

SEQ ID NO: 3417202 - RNA, 20 nt, Human
aagauuuuucucaaaguuuu

SEQ ID NO: 3417203 - RNA, 18 nt, Human
aagauuuuuguuuguuua

SEQ ID NO: 3417204 - RNA, 19 nt, Human
aagauuuuuuaauuguuua

SEQ ID NO: 3417205 - RNA, 20 nt, Human
aagcaaaaaaugaaugucua

SEQ ID NO: 3417206 - RNA, 23 nt, Human
aagcaaaaacaaaccaugacuga

SEQ ID NO: 3417207 - RNA, 14 nt, Human
aagcaaaaagugau

SEQ ID NO: 3417208 - RNA, 13 nt, Human
aagcaaaaaugcu

SEQ ID NO: 3417209 - RNA, 18 nt, Human
aagcaaaauaaaaacuau

SEQ ID NO: 3417210 - RNA, 21 nt, Human
aagcaaacucuaaaauuauaa

SEQ ID NO: 3417211 - RNA, 21 nt, Human
aagcaaagcacccauuucaau

SEQ ID NO: 3417212 - RNA, 12 nt, Human
aagcaaaggaga

SEQ ID NO: 3417213 - RNA, 21 nt, Human
aagcaaaggggacagcugugu

SEQ ID NO: 3417214 - RNA, 17 nt, Human
aagcaaaggugaagaga

SEQ ID NO: 3417215 - RNA, 16 nt, Human
aagcaaauaaauauca

SEQ ID NO: 3417216 - RNA, 20 nt, Human
aagcaaaugugaaucauuuu

SEQ ID NO: 3417217 - RNA, 14 nt, Human
aagcaaauguuaca

SEQ ID NO: 3417218 - RNA, 13 nt, Human
aagcaaauuucaa

SEQ ID NO: 3417219 - RNA, 20 nt, Human
aagcaaauuucaaaagacau

SEQ ID NO: 3417220 - RNA, 22 nt, Human
aagcaacaauuuucagauuugc

SEQ ID NO: 3417221 - RNA, 14 nt, Human
aagcaacaucagcu

SEQ ID NO: 3417222 - RNA, 15 nt, Human
aagcaacauggcuuu

SEQ ID NO: 3417223 - RNA, 20 nt, Human
aagcaaccucaguaauuuag

SEQ ID NO: 3417224 - RNA, 19 nt, Human
aagcaacuaggccuucagu

SEQ ID NO: 3417225 - RNA, 18 nt, Human
aagcaacugucuauuucu

SEQ ID NO: 3417226 - RNA, 14 nt, Human
aagcaacuguuaug

SEQ ID NO: 3417227 - RNA, 17 nt, Human
aagcaagaaucagagaa

SEQ ID NO: 3417228 - RNA, 13 nt, Human
aagcaagacugag

SEQ ID NO: 3417229 - RNA, 17 nt, Human
aagcaagagagauguuu

SEQ ID NO: 3417230 - RNA, 23 nt, Human
aagcaagaggcaagcugaaauuu

SEQ ID NO: 3417231 - RNA, 15 nt, Human
aagcaagcauucaga

SEQ ID NO: 3417232 - RNA, 21 nt, Human
aagcaagcauucagaagaaaa

SEQ ID NO: 3417233 - RNA, 12 nt, Human
aagcaagcucuc

SEQ ID NO: 3417234 - RNA, 16 nt, Human
aagcaagcucucuugc

SEQ ID NO: 3417235 - RNA, 16 nt, Human
aagcaaggaaaacuua

SEQ ID NO: 3417236 - RNA, 19 nt, Human
aagcaaggaucuuucaccc

SEQ ID NO: 3417237 - RNA, 17 nt, Human
aagcaauaaagaagagu

SEQ ID NO: 3417238 - RNA, 20 nt, Human
aagcaauaauggucccaucc

SEQ ID NO: 3417239 - RNA, 17 nt, Human
aagcaauauuguauauu

SEQ ID NO: 3417240 - RNA, 16 nt, Human
aagcaauccuccugag

SEQ ID NO: 3417241 - RNA, 22 nt, Human
aagcaauccucucaccucagcc

SEQ ID NO: 3417242 - RNA, 13 nt, Human
aagcaaugcauuu

SEQ ID NO: 3417243 - RNA, 16 nt, Human
aagcaauuccaaccuu

SEQ ID NO: 3417244 - RNA, 17 nt, Human
aagcaauugcugcaucu

SEQ ID NO: 3417245 - RNA, 16 nt, Human
aagcaauuuuccuuga

SEQ ID NO: 3417246 - RNA, 17 nt, Human
aagcaauuuuccuugaa

SEQ ID NO: 3417247 - RNA, 18 nt, Human
aagcaauuuuccuugaag

SEQ ID NO: 3417248 - RNA, 19 nt, Human
aagcaauuuuccuugaagc

SEQ ID NO: 3417249 - RNA, 18 nt, Human
aagcacaccaaucuuacu

SEQ ID NO: 3417250 - RNA, 14 nt, Human
aagcacacuuguag

SEQ ID NO: 3417251 - RNA, 19 nt, Human
aagcacagaaggaggagga

SEQ ID NO: 3417252 - RNA, 15 nt, Human
aagcacagaauauuu

SEQ ID NO: 3417253 - RNA, 16 nt, Human
aagcacagaauauuuu

SEQ ID NO: 3417254 - RNA, 16 nt, Human
aagcacagcagccugg

SEQ ID NO: 3417255 - RNA, 11 nt, Human
aagcacagcug

SEQ ID NO: 3417256 - RNA, 14 nt, Human
aagcacaggagaca

SEQ ID NO: 3417257 - RNA, 15 nt, Human
aagcacagugccugc

SEQ ID NO: 3417258 - RNA, 23 nt, Human
aagcacagugguggcagggccua

SEQ ID NO: 3417259 - RNA, 14 nt, Human
aagcacaguuugaa

SEQ ID NO: 3417260 - RNA, 16 nt, Human
aagcacaguuugaaca

SEQ ID NO: 3417261 - RNA, 23 nt, Human
aagcacauauuagugcagccaag

SEQ ID NO: 3417262 - RNA, 16 nt, Human
aagcacauauugagca

SEQ ID NO: 3417263 - RNA, 14 nt, Human
aagcacaugccucu

SEQ ID NO: 3417264 - RNA, 15 nt, Human
aagcacaugccucuc

SEQ ID NO: 3417265 - RNA, 16 nt, Human
aagcacaugccucucu

SEQ ID NO: 3417266 - RNA, 19 nt, Human
aagcacaugccucucucag

SEQ ID NO: 3417267 - RNA, 20 nt, Human
aagcacaugccucucucagg

SEQ ID NO: 3417268 - RNA, 22 nt, Human
aagcaccaaaauaagaaaagau

SEQ ID NO: 3417269 - RNA, 15 nt, Human
aagcaccauccccuc

SEQ ID NO: 3417270 - RNA, 15 nt, Human
aagcacccauuucaa

SEQ ID NO: 3417271 - RNA, 19 nt, Human
aagcaccgccuccaaaugc

SEQ ID NO: 3417272 - RNA, 16 nt, Human
aagcaccuccugccuc

SEQ ID NO: 3417273 - RNA, 17 nt, Human
aagcaccuccugccucg

SEQ ID NO: 3417274 - RNA, 12 nt, Human
aagcaccugccg

SEQ ID NO: 3417275 - RNA, 13 nt, Human
aagcacuagagaa

SEQ ID NO: 3417276 - RNA, 20 nt, Human
aagcacuagagaaugcacag

SEQ ID NO: 3417277 - RNA, 17 nt, Human
aagcacucuuaaagcaa

SEQ ID NO: 3417278 - RNA, 16 nt, Human
aagcacugaccuguca

SEQ ID NO: 3417279 - RNA, 12 nt, Human
aacccccacccc

SEQ ID NO: 3417280 - RNA, 13 nt, Human
aacccccacccca

SEQ ID NO: 3417281 - RNA, 17 nt, Human
aacccccaccccacacu

SEQ ID NO: 3417282 - RNA, 12 nt, Human
aacccccacugg

SEQ ID NO: 3417283 - RNA, 13 nt, Human
aacccccagccug

SEQ ID NO: 3417284 - RNA, 14 nt, Human
aaccccccagauau

SEQ ID NO: 3417285 - RNA, 16 nt, Human
aaccccccagauauca

SEQ ID NO: 3417286 - RNA, 14 nt, Human
aaccccccagcacu

SEQ ID NO: 3417287 - RNA, 18 nt, Human
aacccccuuugugcugug

SEQ ID NO: 3417288 - RNA, 22 nt, Human
aaccccgucgaggggcucucag

SEQ ID NO: 3417289 - RNA, 23 nt, Human
aaccccucgcccagucccagcag

SEQ ID NO: 3417290 - RNA, 20 nt, Human
aaccccuggcuccaggccag

SEQ ID NO: 3417291 - RNA, 12 nt, Human
aaccccuguccc

SEQ ID NO: 3417292 - RNA, 20 nt, Human
aaccccuuaagcccuggccc

SEQ ID NO: 3417293 - RNA, 12 nt, Human
aaccccuuccca

SEQ ID NO: 3417294 - RNA, 18 nt, Human
aaccccuuucccacccca

SEQ ID NO: 3417295 - RNA, 17 nt, Human
aacccgacagagggaag

SEQ ID NO: 3417296 - RNA, 15 nt, Human
aacccgaggcccgca

SEQ ID NO: 3417297 - RNA, 16 nt, Human
aacccgaggcccgcau

SEQ ID NO: 3417298 - RNA, 15 nt, Human
aacccgucuggccca

SEQ ID NO: 3417299 - RNA, 17 nt, Human
aacccuacacccagacc

SEQ ID NO: 3417300 - RNA, 14 nt, Human
aacccuagcaaaag

SEQ ID NO: 3417301 - RNA, 21 nt, Human
aacccuauacuguaguauucu

SEQ ID NO: 3417302 - RNA, 15 nt, Human
aacccuaucuccuga

SEQ ID NO: 3417303 - RNA, 22 nt, Human
aacccuaucuccugacagaagg

SEQ ID NO: 3417304 - RNA, 18 nt, Human
aacccucagggcaaagcc

SEQ ID NO: 3417305 - RNA, 16 nt, Human
aacccucccucagccc

SEQ ID NO: 3417306 - RNA, 18 nt, Human
aacccucccucagccccu

SEQ ID NO: 3417307 - RNA, 21 nt, Human
aacccucccucagccccucuu

SEQ ID NO: 3417308 - RNA, 19 nt, Human
aacccuccuaucaccuccc

SEQ ID NO: 3417309 - RNA, 21 nt, Human
aacccuccuaucaccuccccu

SEQ ID NO: 3417310 - RNA, 13 nt, Human
aaggagaacaaau

SEQ ID NO: 3417311 - RNA, 15 nt, Human
aaggagaaccagcac

SEQ ID NO: 3417312 - RNA, 15 nt, Human
aaggagaaggaagga

SEQ ID NO: 3417313 - RNA, 18 nt, Human
aaggagacacagauguuc

SEQ ID NO: 3417314 - RNA, 14 nt, Human
aaggagacaggcag

SEQ ID NO: 3417315 - RNA, 16 nt, Human
aaggagacaggcagag

SEQ ID NO: 3417316 - RNA, 19 nt, Human
aaggagacaggcagagcug

SEQ ID NO: 3417317 - RNA, 16 nt, Human
aaggagacucaccucu

SEQ ID NO: 3417318 - RNA, 14 nt, Human
aaggagagaaagug

SEQ ID NO: 3417319 - RNA, 17 nt, Human
aaggagaggaaagaacu

SEQ ID NO: 3417320 - RNA, 13 nt, Human
aaggagaggaggc

SEQ ID NO: 3417321 - RNA, 14 nt, Human
aaggagaggaggca

SEQ ID NO: 3417322 - RNA, 21 nt, Human
aaggagagucuugcagugauu

SEQ ID NO: 3417323 - RNA, 18 nt, Human
aaggagaugucuuggaac

SEQ ID NO: 3417324 - RNA, 14 nt, Human
aaggagauuuacaa

SEQ ID NO: 3417325 - RNA, 12 nt, Human
aaggagcaucua

SEQ ID NO: 3417326 - RNA, 12 nt, Human
aaggagccugug

SEQ ID NO: 3417327 - RNA, 16 nt, Human
aaggagcugccuggac

SEQ ID NO: 3417328 - RNA, 20 nt, Human
aaggagcugcuauagccugg

SEQ ID NO: 3417329 - RNA, 13 nt, Human
aaggaggacccag

SEQ ID NO: 3417330 - RNA, 22 nt, Human
aaggaggacccaggacaggauc

SEQ ID NO: 3417331 - RNA, 15 nt, Human
aaggaggagccuguc

SEQ ID NO: 3417332 - RNA, 18 nt, Human
aaggaggcaugccucuga

SEQ ID NO: 3417333 - RNA, 20 nt, Human
aaggaggcaugccucugaua

SEQ ID NO: 3417334 - RNA, 16 nt, Human
aaggaggccaccuccu

SEQ ID NO: 3417335 - RNA, 19 nt, Human
aaggaggcuccaggcagca

SEQ ID NO: 3417336 - RNA, 18 nt, Human
aaggaggcuggcuggggc

SEQ ID NO: 3417337 - RNA, 20 nt, Human
aaggaggggaaaaaaauguu

SEQ ID NO: 3417338 - RNA, 22 nt, Human
aaggaggggaaaaaaauguugu

SEQ ID NO: 3417339 - RNA, 17 nt, Human
aaggaggggcuguaaaa

SEQ ID NO: 3417340 - RNA, 12 nt, Human
aaggagggugag

SEQ ID NO: 3417341 - RNA, 21 nt, Human
aaggaggguggaucaccugag

SEQ ID NO: 3417342 - RNA, 15 nt, Human
aaggaggugagggau

SEQ ID NO: 3417343 - RNA, 19 nt, Human
aaggaguaaucuguguaca

SEQ ID NO: 3417344 - RNA, 20 nt, Human
aaggaguuccaugaagacca

SEQ ID NO: 3417345 - RNA, 12 nt, Human
aaggaguuuaug

SEQ ID NO: 3417346 - RNA, 13 nt, Human
aaggaguuuaugu

SEQ ID NO: 3417347 - RNA, 23 nt, Human
aaggaguuucuuuagcugacaga

SEQ ID NO: 3417348 - RNA, 13 nt, Human
aaggauaaagaag

SEQ ID NO: 3417349 - RNA, 11 nt, Human
aaggauaaagu

SEQ ID NO: 3417350 - RNA, 15 nt, Human
aaggauaaaucauaa

SEQ ID NO: 3417351 - RNA, 19 nt, Human
aaggauaaaucauaaaguc

SEQ ID NO: 3417352 - RNA, 22 nt, Human
aaggauaaaucauaaagucagu

SEQ ID NO: 3417353 - RNA, 15 nt, Human
aaggauacaggcugg

SEQ ID NO: 3417354 - RNA, 17 nt, Human
aaggauaccuucuuauu

SEQ ID NO: 3417355 - RNA, 13 nt, Human
aaggauacuuauu

SEQ ID NO: 3417356 - RNA, 17 nt, Human
aaggauagaagcugcag

SEQ ID NO: 3417357 - RNA, 19 nt, Human
aaggauagaucaaagucaa

SEQ ID NO: 3417358 - RNA, 15 nt, Human
aaggauagaugcugg

SEQ ID NO: 3417359 - RNA, 23 nt, Human
aaggauauuuaagaaaauacaau

SEQ ID NO: 3417360 - RNA, 13 nt, Human
aaggaucaucuga

SEQ ID NO: 3417361 - RNA, 12 nt, Human
aaggauccugag

SEQ ID NO: 3417362 - RNA, 22 nt, Human
aaggaucucucaggagcacagg

SEQ ID NO: 3417363 - RNA, 15 nt, Human
aaggaucuguuuuua

SEQ ID NO: 3417364 - RNA, 24 nt, Human
aaggaugcacagaguuguuacauu

SEQ ID NO: 3417365 - RNA, 14 nt, Human
aaggaugcccaaag

SEQ ID NO: 3417366 - RNA, 16 nt, Human
aaggaugcuuguacau

SEQ ID NO: 3417367 - RNA, 19 nt, Human
aaggaugcuuguacauaau

SEQ ID NO: 3417368 - RNA, 19 nt, Human
aaggauguaaacagugccu

SEQ ID NO: 3417369 - RNA, 23 nt, Human
aaggauguaaacagugccugcug

SEQ ID NO: 3417370 - RNA, 15 nt, Human
aaggauguacauuuc

SEQ ID NO: 3417371 - RNA, 23 nt, Human
aaggauguagcuuuucaccuuua

SEQ ID NO: 3417372 - RNA, 16 nt, Human
aaggaugucacagggc

SEQ ID NO: 3417373 - RNA, 17 nt, Human
aaggaugucacagggcc

SEQ ID NO: 3417374 - RNA, 15 nt, Human
aaggaugugauugug

SEQ ID NO: 3417375 - RNA, 22 nt, Human
aaggauuaauugcugcaaggac

SEQ ID NO: 3417376 - RNA, 20 nt, Human
aaggauuauggaaaaauaaa

SEQ ID NO: 3417377 - RNA, 16 nt, Human
aaggauucauguggaa

SEQ ID NO: 3417378 - RNA, 12 nt, Human
aaggauuguaaa

SEQ ID NO: 3417379 - RNA, 16 nt, Human
aaggauuuguguuuua

SEQ ID NO: 3417380 - RNA, 16 nt, Human
aaggauuuuaugcuuu

SEQ ID NO: 3417381 - RNA, 12 nt, Human
aaggauuuuucu

SEQ ID NO: 3417382 - RNA, 14 nt, Human
aaggcaaaaaugua

SEQ ID NO: 3417383 - RNA, 14 nt, Human
aaggcaaaauugca

SEQ ID NO: 3417384 - RNA, 15 nt, Human
aaggcaaacauuuga

SEQ ID NO: 3417385 - RNA, 22 nt, Human
aaggcaaaccuuucuauaauuu

SEQ ID NO: 3417386 - RNA, 18 nt, Human
aaggcaaauguguacaug

SEQ ID NO: 3417387 - RNA, 21 nt, Human
aaggcaacugaacaaaaaaau

SEQ ID NO: 3417388 - RNA, 11 nt, Human
aaggcaagcca

SEQ ID NO: 3417389 - RNA, 15 nt, Human
aaggcaaguuaagag

SEQ ID NO: 3417390 - RNA, 20 nt, Human
aaggcaaguuucuagcuaga

SEQ ID NO: 3417391 - RNA, 15 nt, Human
aaggcacaauauggg

SEQ ID NO: 3417392 - RNA, 15 nt, Human
aaggcaccagccggg

SEQ ID NO: 3417393 - RNA, 20 nt, Human
aaggcacccacaaauaaaug

SEQ ID NO: 3417394 - RNA, 22 nt, Human
aaggcaccuauaaaacagguca

SEQ ID NO: 3417395 - RNA, 14 nt, Human
aaggcacucuagau

SEQ ID NO: 3417396 - RNA, 15 nt, Human
aaggcacucuagauu

SEQ ID NO: 3417397 - RNA, 18 nt, Human
aaggcacuucauguaaag

SEQ ID NO: 3417398 - RNA, 15 nt, Human
aaggcagagaaaucu

SEQ ID NO: 3417399 - RNA, 22 nt, Human
aaggcagagaaaucuaagcugu

SEQ ID NO: 3417400 - RNA, 14 nt, Human
aaggcagaggccug

SEQ ID NO: 3417401 - RNA, 14 nt, Human
aaggcagcaaggcc

SEQ ID NO: 3417402 - RNA, 21 nt, Human
aaggcagcauguauaguugcu

SEQ ID NO: 3417403 - RNA, 11 nt, Human
aaggcagccac

SEQ ID NO: 3417404 - RNA, 19 nt, Human
aaggcagccgugggcccca

SEQ ID NO: 3417405 - RNA, 23 nt, Human
aaggcagccgugggccccacccu

SEQ ID NO: 3417406 - RNA, 16 nt, Human
aaggcaggaaugugug

SEQ ID NO: 3417407 - RNA, 18 nt, Human
aaggcaggcagggcucuc

SEQ ID NO: 3417408 - RNA, 20 nt, Human
aaggcagggagcgagggaga

SEQ ID NO: 3417409 - RNA, 12 nt, Human
aaggcagggagg

SEQ ID NO: 3417410 - RNA, 18 nt, Human
aaggcaggggaauguaug

SEQ ID NO: 3417411 - RNA, 14 nt, Human
aaggcaggugccuc

SEQ ID NO: 3417412 - RNA, 17 nt, Human
aaggcaggugccuccag

SEQ ID NO: 3417413 - RNA, 22 nt, Human
aaggcaggugccuccaggugug

SEQ ID NO: 3417414 - RNA, 15 nt, Human
aaggcaguuugcaaa

SEQ ID NO: 3417415 - RNA, 17 nt, Human
aaggcauacgagagcag

SEQ ID NO: 3417416 - RNA, 21 nt, Human
aaggcauacgagagcagaggu

SEQ ID NO: 3417417 - RNA, 22 nt, Human
aaggcaucgucaugcacaguau

SEQ ID NO: 3417418 - RNA, 17 nt, Human
aaggcaucuaucugugc

SEQ ID NO: 3417419 - RNA, 12 nt, Human
aaggcaugaagg

SEQ ID NO: 3417420 - RNA, 19 nt, Human
aaggcaugugugaaacaua

SEQ ID NO: 3417421 - RNA, 17 nt, Human
aaggcauucucugaaga

SEQ ID NO: 3417422 - RNA, 17 nt, Human
aaggccaaaccucuguu

SEQ ID NO: 3417423 - RNA, 16 nt, Human
aaggccaaaggaagca

SEQ ID NO: 3417424 - RNA, 21 nt, Human
aaggccaauuccuauacgcag

SEQ ID NO: 3417425 - RNA, 17 nt, Human
aaggccagaccugcaga

SEQ ID NO: 3417426 - RNA, 22 nt, Human
aaggccagaguggccuggccag

SEQ ID NO: 3417427 - RNA, 23 nt, Human
aaggccagaguggccuggccagg

SEQ ID NO: 3417428 - RNA, 18 nt, Human
aaggccaguggaaauuca

SEQ ID NO: 3417429 - RNA, 24 nt, Human
aaggccauaaaacagguaauauaa

SEQ ID NO: 3417430 - RNA, 14 nt, Human
aaggccaucagagc

SEQ ID NO: 3417431 - RNA, 22 nt, Human
aaggccaucugggcuccuccag

SEQ ID NO: 3417432 - RNA, 21 nt, Human
aaggccauggagagcuggagc

SEQ ID NO: 3417433 - RNA, 21 nt, Human
aaggcccacgagcuuguucuu

SEQ ID NO: 3417434 - RNA, 18 nt, Human
aaggcccagccccuagaa

SEQ ID NO: 3417435 - RNA, 19 nt, Human
aaggcccccugccugcccu

SEQ ID NO: 3417436 - RNA, 16 nt, Human
aaggccccgcccaggc

SEQ ID NO: 3417437 - RNA, 16 nt, Human
aaggcccgagcagcug

SEQ ID NO: 3417438 - RNA, 17 nt, Human
aaggcccgagcagcuga

SEQ ID NO: 3417439 - RNA, 19 nt, Human
aaggcccgagcagcugagc

SEQ ID NO: 3417440 - RNA, 21 nt, Human
aaggcccgagcagcugagcag

SEQ ID NO: 3417441 - RNA, 18 nt, Human
aaggcccugcugagucau

SEQ ID NO: 3417442 - RNA, 22 nt, Human
aaggccgaagaaggguccuucc

SEQ ID NO: 3417443 - RNA, 17 nt, Human
aaggccgagaagcaaga

SEQ ID NO: 3417444 - RNA, 16 nt, Human
aaggccuaggauucua

SEQ ID NO: 3417445 - RNA, 19 nt, Human
aaggccucccacagugacu

SEQ ID NO: 3417446 - RNA, 19 nt, Human
aaggccucccuagccagca

SEQ ID NO: 3417447 - RNA, 15 nt, Human
aaggccuccuggcug

SEQ ID NO: 3417448 - RNA, 15 nt, Human
aaggccucgcaggaa

SEQ ID NO: 3417449 - RNA, 16 nt, Human
aaggccucuuggagac

SEQ ID NO: 3417450 - RNA, 20 nt, Human
aaggccucuuguaaagacug

SEQ ID NO: 3417451 - RNA, 21 nt, Human
aaggccucuuguaaagacugg

SEQ ID NO: 3417452 - RNA, 17 nt, Human
aaggccuggggugaccc

SEQ ID NO: 3417453 - RNA, 22 nt, Human
aaggccuggggugacccggcac

SEQ ID NO: 3417454 - RNA, 20 nt, Human
aaggccugucagcuaaagaa

SEQ ID NO: 3417455 - RNA, 13 nt, Human
aacuguacuuuga

SEQ ID NO: 3417456 - RNA, 17 nt, Human
aacuguacuuugauuca

SEQ ID NO: 3417457 - RNA, 18 nt, Human
aacuguacuuugauucac

SEQ ID NO: 3417458 - RNA, 16 nt, Human
aacuguagaaaugaug

SEQ ID NO: 3417459 - RNA, 19 nt, Human
aacuguagaaaugaugaug

SEQ ID NO: 3417460 - RNA, 13 nt, Human
aacuguaucuuga

SEQ ID NO: 3417461 - RNA, 21 nt, Human
aacugucaggcugaaaacaau

SEQ ID NO: 3417462 - RNA, 21 nt, Human
aacuguccguaagcaguauau

SEQ ID NO: 3417463 - RNA, 14 nt, Human
aacuguccuguccu

SEQ ID NO: 3417464 - RNA, 15 nt, Human
aacugucgugucaua

SEQ ID NO: 3417465 - RNA, 19 nt, Human
aacugucuagcacuuccuu

SEQ ID NO: 3417466 - RNA, 17 nt, Human
aacugucuauuucugcu

SEQ ID NO: 3417467 - RNA, 21 nt, Human
aacugucuccuaccucugcuc

SEQ ID NO: 3417468 - RNA, 19 nt, Human
aacugugaaguuuacauug

SEQ ID NO: 3417469 - RNA, 16 nt, Human
aacugugauuucagga

SEQ ID NO: 3417470 - RNA, 22 nt, Human
aacugugcagagucuagaaguu

SEQ ID NO: 3417471 - RNA, 18 nt, Human
aacuguggauauuguuac

SEQ ID NO: 3417472 - RNA, 20 nt, Human
aacuguggccguuaucugga

SEQ ID NO: 3417473 - RNA, 13 nt, Human
aacuguguaacug

SEQ ID NO: 3417474 - RNA, 23 nt, Human
aacuguguacauaacugaaaaug

SEQ ID NO: 3417475 - RNA, 13 nt, Human
aacuguguagcau

SEQ ID NO: 3417476 - RNA, 17 nt, Human
aacuguguauguacaua

SEQ ID NO: 3417477 - RNA, 18 nt, Human
aacuguguggacugugau

SEQ ID NO: 3417478 - RNA, 14 nt, Human
aacuguguguaauu

SEQ ID NO: 3417479 - RNA, 17 nt, Human
aacuguguuguauuaac

SEQ ID NO: 3417480 - RNA, 18 nt, Human
aacuguguuguauuaaca

SEQ ID NO: 3417481 - RNA, 19 nt, Human
aacuguguuucaaguucaa

SEQ ID NO: 3417482 - RNA, 19 nt, Human
aacuguuaaauugcugugu

SEQ ID NO: 3417483 - RNA, 21 nt, Human
aacuguuaagaaaucuguuuu

SEQ ID NO: 3417484 - RNA, 14 nt, Human
aacuguuacaguaa

SEQ ID NO: 3417485 - RNA, 16 nt, Human
aaggcucugagagucu

SEQ ID NO: 3417486 - RNA, 23 nt, Human
aaggcucugagcaaauguggcuc

SEQ ID NO: 3417487 - RNA, 17 nt, Human
aaggcugaccaagagag

SEQ ID NO: 3417488 - RNA, 18 nt, Human
aaggcugacuacauuuuu

SEQ ID NO: 3417489 - RNA, 19 nt, Human
aaggcugagaggagagaga

SEQ ID NO: 3417490 - RNA, 18 nt, Human
aaggcugcagauaacaga

SEQ ID NO: 3417491 - RNA, 20 nt, Human
aaggcugccaacggggagcg

SEQ ID NO: 3417492 - RNA, 14 nt, Human
aaggcugcgucugg

SEQ ID NO: 3417493 - RNA, 16 nt, Human
aaggcugcuguacuga

SEQ ID NO: 3417494 - RNA, 16 nt, Human
aaggcugggggaagaa

SEQ ID NO: 3417495 - RNA, 19 nt, Human
aaggcugggggaagaagcu

SEQ ID NO: 3417496 - RNA, 12 nt, Human
aaggcuguauuc

SEQ ID NO: 3417497 - RNA, 17 nt, Human
aaggcuguauucagcaa

SEQ ID NO: 3417498 - RNA, 20 nt, Human
aaggcugucaauuacaggaa

SEQ ID NO: 3417499 - RNA, 22 nt, Human
aaggcuguccuuacccaucugc

SEQ ID NO: 3417500 - RNA, 22 nt, Human
aaggcugugcucccugguucug

SEQ ID NO: 3417501 - RNA, 14 nt, Human
aaggcuuauaaaac

SEQ ID NO: 3417502 - RNA, 21 nt, Human
aaggcuuauauucaaccaugg

SEQ ID NO: 3417503 - RNA, 23 nt, Human
aaggcuuauauucaaccauggac

SEQ ID NO: 3417504 - RNA, 23 nt, Human
aaggcuucaauuuauugcacaaa

SEQ ID NO: 3417505 - RNA, 14 nt, Human
aaggcuucucucuc

SEQ ID NO: 3417506 - RNA, 17 nt, Human
aaggcuucucucucacc

SEQ ID NO: 3417507 - RNA, 17 nt, Human
aaggcuucucucugugg

SEQ ID NO: 3417508 - RNA, 13 nt, Human
aaggcuugaagcu

SEQ ID NO: 3417509 - RNA, 15 nt, Human
aaggcuuuaucucag

SEQ ID NO: 3417510 - RNA, 20 nt, Human
aagggaaaaaucaaguauua

SEQ ID NO: 3417511 - RNA, 17 nt, Human
aagggaaacugccagca

SEQ ID NO: 3417512 - RNA, 14 nt, Human
aagggaaauaucau

SEQ ID NO: 3417513 - RNA, 16 nt, Human
aagggaaauaucauuu

SEQ ID NO: 3417514 - RNA, 15 nt, Human
aagggaaccuguguc

SEQ ID NO: 3417515 - RNA, 13 nt, Human
aagggaagacauu

SEQ ID NO: 3417516 - RNA, 23 nt, Human
aagggaaggccccacagacaagg

SEQ ID NO: 3417517 - RNA, 20 nt, Human
aagggaaguaguuaucaugu

SEQ ID NO: 3417518 - RNA, 22 nt, Human
aagggaaguaguuaucauguua

SEQ ID NO: 3417519 - RNA, 21 nt, Human
aagggaauagaaauguuugcu

SEQ ID NO: 3417520 - RNA, 20 nt, Human
aagggaaucacaucuuuuaa

SEQ ID NO: 3417521 - RNA, 12 nt, Human
aagggaauccuc

SEQ ID NO: 3417522 - RNA, 17 nt, Human
aagggaauccuccucca

SEQ ID NO: 3417523 - RNA, 19 nt, Human
aagggacccuuuggggguu

SEQ ID NO: 3417524 - RNA, 20 nt, Human
aagggacuuggaagcuccgc

SEQ ID NO: 3417525 - RNA, 12 nt, Human
aagggagaagaa

SEQ ID NO: 3417526 - RNA, 16 nt, Human
aagggagaagaaaggu

SEQ ID NO: 3417527 - RNA, 16 nt, Human
aagggagagagagagg

SEQ ID NO: 3417528 - RNA, 17 nt, Human
aagggagagcggggcag

SEQ ID NO: 3417529 - RNA, 17 nt, Human
aagggagcagaacugaa

SEQ ID NO: 3417530 - RNA, 13 nt, Human
aagggagccaagg

SEQ ID NO: 3417531 - RNA, 18 nt, Human
aagggagcuaucaggaac

SEQ ID NO: 3417532 - RNA, 18 nt, Human
aagggaggacgggagcug

SEQ ID NO: 3417533 - RNA, 21 nt, Human
aagggaggaggagcuucuggg

SEQ ID NO: 3417534 - RNA, 21 nt, Human
aagggagggcagagcuggugc

SEQ ID NO: 3417535 - RNA, 21 nt, Human
aagggagggcucugaggcgcc

SEQ ID NO: 3417536 - RNA, 13 nt, Human
aagggagggggag

SEQ ID NO: 3417537 - RNA, 12 nt, Human
aagggagguggg

SEQ ID NO: 3417538 - RNA, 19 nt, Human
aagggaguguacucccagg

SEQ ID NO: 3417539 - RNA, 15 nt, Human
aagggaguuuuugau

SEQ ID NO: 3417540 - RNA, 12 nt, Human
aagggauauuuu

SEQ ID NO: 3417541 - RNA, 17 nt, Human
aagggaugaauuguaaa

SEQ ID NO: 3417542 - RNA, 16 nt, Human
aagggaugcaggcucc

SEQ ID NO: 3417543 - RNA, 15 nt, Human
aagggauggaaaagg

SEQ ID NO: 3417544 - RNA, 21 nt, Human
aagggauggaaaaggaagacu

SEQ ID NO: 3417545 - RNA, 17 nt, Human
aagggauggacaucuug

SEQ ID NO: 3417546 - RNA, 14 nt, Human
aagggauggcaaga

SEQ ID NO: 3417547 - RNA, 22 nt, Human
aagggauguuauuauccuuggg

SEQ ID NO: 3417548 - RNA, 15 nt, Human
aagggauuucuuagg

SEQ ID NO: 3417549 - RNA, 23 nt, Human
aagggauuuucagcccucagaau

SEQ ID NO: 3417550 - RNA, 18 nt, Human
aagggcagaaguagggga

SEQ ID NO: 3417551 - RNA, 19 nt, Human
aagggcagcuuugcucaua

SEQ ID NO: 3417552 - RNA, 20 nt, Human
aagggcagcuuugcucauau

SEQ ID NO: 3417553 - RNA, 17 nt, Human
aagggcauaaaacagcu

SEQ ID NO: 3417554 - RNA, 14 nt, Human
aagggcauccuucu

SEQ ID NO: 3417555 - RNA, 16 nt, Human
aagggcaugccuugug

SEQ ID NO: 3417556 - RNA, 17 nt, Human
aagggcaugccuugugc

SEQ ID NO: 3417557 - RNA, 19 nt, Human
aagggcaugccuugugcug

SEQ ID NO: 3417558 - RNA, 12 nt, Human
aagggccaaaga

SEQ ID NO: 3417559 - RNA, 22 nt, Human
aagggccaaagaaccaaagaag

SEQ ID NO: 3417560 - RNA, 22 nt, Human
aagggccaccuacaauacaucu

SEQ ID NO: 3417561 - RNA, 9 nt, Human
aagggccag

SEQ ID NO: 3417562 - RNA, 16 nt, Human
aagggccagagccagg

SEQ ID NO: 3417563 - RNA, 17 nt, Human
aagggccagagccaggg

SEQ ID NO: 3417564 - RNA, 14 nt, Human
aagggccagucugg

SEQ ID NO: 3417565 - RNA, 17 nt, Human
aagggccaugcugaagg

SEQ ID NO: 3417566 - RNA, 19 nt, Human
aagggccaugcugaaggga

SEQ ID NO: 3417567 - RNA, 13 nt, Human
aagggcccagaga

SEQ ID NO: 3417568 - RNA, 22 nt, Human
aagggcccuuuuucaauaacug

SEQ ID NO: 3417569 - RNA, 19 nt, Human
aagggccugccuggccccu

SEQ ID NO: 3417570 - RNA, 13 nt, Human
aagggccuggccu

SEQ ID NO: 3417571 - RNA, 14 nt, Human
aagggccuggccug

SEQ ID NO: 3417572 - RNA, 19 nt, Human
aagggccuggccugagcug

SEQ ID NO: 3417573 - RNA, 19 nt, Human
aagggcuagaaccuggagg

SEQ ID NO: 3417574 - RNA, 16 nt, Human
aagggcuauguaaaua

SEQ ID NO: 3417575 - RNA, 20 nt, Human
aagggcugcaugauguuugc

SEQ ID NO: 3417576 - RNA, 16 nt, Human
aagggcugcuucccug

SEQ ID NO: 3417577 - RNA, 17 nt, Human
aagggcuguuauaaucu

SEQ ID NO: 3417578 - RNA, 22 nt, Human
aagggcuucugcacccuccacc

SEQ ID NO: 3417579 - RNA, 20 nt, Human
aaggggacccccgcccccug

SEQ ID NO: 3417580 - RNA, 14 nt, Human
aaggggaggcagcc

SEQ ID NO: 3417581 - RNA, 20 nt, Human
aaggggauuuuuaugucugg

SEQ ID NO: 3417582 - RNA, 12 nt, Human
aaggggcaaauu

SEQ ID NO: 3417583 - RNA, 19 nt, Human
aaggggcagucuggagggg

SEQ ID NO: 3417584 - RNA, 14 nt, Human
aaggggcaguggug

SEQ ID NO: 3417585 - RNA, 17 nt, Human
aaggggcaguggugguu

SEQ ID NO: 3417586 - RNA, 14 nt, Human
aaggggcccuugga

SEQ ID NO: 3417587 - RNA, 20 nt, Human
aaggggcccuuggagcgugg

SEQ ID NO: 3417588 - RNA, 14 nt, Human
aaggggccugagca

SEQ ID NO: 3417589 - RNA, 18 nt, Human
aaggggcgucuguucccc

SEQ ID NO: 3417590 - RNA, 16 nt, Human
aaggggcugaaagaac

SEQ ID NO: 3417591 - RNA, 22 nt, Human
aaggggcuucagguccaggcug

SEQ ID NO: 3417592 - RNA, 21 nt, Human
aagggggguugcaguggagag

SEQ ID NO: 3417593 - RNA, 21 nt, Human
aagggguaggauuacuaggug

SEQ ID NO: 3417594 - RNA, 14 nt, Human
aagggguuucuaac

SEQ ID NO: 3417595 - RNA, 12 nt, Human
aaggguaaacaa

SEQ ID NO: 3417596 - RNA, 16 nt, Human
aaggguaucaggugcu

SEQ ID NO: 3417597 - RNA, 17 nt, Human
aaggguaucaggugcug

SEQ ID NO: 3417598 - RNA, 11 nt, Human
aagggucaggc

SEQ ID NO: 3417599 - RNA, 12 nt, Human
aagggucaggcc

SEQ ID NO: 3417600 - RNA, 21 nt, Human
aaggagccugugaacccagga

SEQ ID NO: 3417601 - RNA, 22 nt, Human
aaggagccugugaacccaggac

SEQ ID NO: 3417602 - RNA, 22 nt, Human
aaggagcugagaauagaaggaa

SEQ ID NO: 3417603 - RNA, 17 nt, Human
aaggagcugccuggacc

SEQ ID NO: 3417604 - RNA, 18 nt, Human
aaggagcugccuggaccc

SEQ ID NO: 3417605 - RNA, 20 nt, Human
aaggaggaagagaaaaaaua

SEQ ID NO: 3417606 - RNA, 17 nt, Human
aaggaggacccaggaca

SEQ ID NO: 3417607 - RNA, 17 nt, Human
aaggaggagagggaaaa

SEQ ID NO: 3417608 - RNA, 22 nt, Human
aaggaggagccuguccugccug

SEQ ID NO: 3417609 - RNA, 14 nt, Human
aaggaggccaccuc

SEQ ID NO: 3417610 - RNA, 19 nt, Human
aaggaggccaccuccuaaa

SEQ ID NO: 3417611 - RNA, 13 nt, Human
aaggaggcuggcu

SEQ ID NO: 3417612 - RNA, 15 nt, Human
aaggaggcuggcugg

SEQ ID NO: 3417613 - RNA, 15 nt, Human
aaggagggagaugga

SEQ ID NO: 3417614 - RNA, 18 nt, Human
aaggaggggaaaaaaaug

SEQ ID NO: 3417615 - RNA, 19 nt, Human
aaggaggggaaaaaaaugu

SEQ ID NO: 3417616 - RNA, 20 nt, Human
aaggaggggauagagagaga

SEQ ID NO: 3417617 - RNA, 18 nt, Human
aaggaggguacagcuggg

SEQ ID NO: 3417618 - RNA, 19 nt, Human
aaggaggguacagcugggc

SEQ ID NO: 3417619 - RNA, 17 nt, Human
aaggagggucaggaagg

SEQ ID NO: 3417620 - RNA, 19 nt, Human
aaggaggguuagggagggg

SEQ ID NO: 3417621 - RNA, 18 nt, Human
aaggaguaaucuguguac

SEQ ID NO: 3417622 - RNA, 19 nt, Human
aaggaguguagcaacuaca

SEQ ID NO: 3417623 - RNA, 13 nt, Human
aaggaguuaagag

SEQ ID NO: 3417624 - RNA, 16 nt, Human
aaggaguuggaaguga

SEQ ID NO: 3417625 - RNA, 14 nt, Human
aaggaguuuauguu

SEQ ID NO: 3417626 - RNA, 22 nt, Human
aaggauaaacuuuuagaaacuu

SEQ ID NO: 3417627 - RNA, 21 nt, Human
aaggauaaaguugguaaaccu

SEQ ID NO: 3417628 - RNA, 23 nt, Human
aaggauaaaguugguaaaccuuu

SEQ ID NO: 3417629 - RNA, 13 nt, Human
aaggauaaugaau

SEQ ID NO: 3417630 - RNA, 17 nt, Human
aaggauauuuaagaaaa

SEQ ID NO: 3417631 - RNA, 15 nt, Human
aaggauccugagcca

SEQ ID NO: 3417632 - RNA, 17 nt, Human
aaggauccugagccaga

SEQ ID NO: 3417633 - RNA, 12 nt, Human
aaggaucuuuca

SEQ ID NO: 3417634 - RNA, 16 nt, Human
aaggaucuuuguggcc

SEQ ID NO: 3417635 - RNA, 18 nt, Human
aaggaucuuuguggccaa

SEQ ID NO: 3417636 - RNA, 20 nt, Human
aaggaugccaagaaguuuaa
